United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 5

SEQ ID NO: 161505 - DNA, 16 bp, Homo sapiens
tttcacaaccttctgt

SEQ ID NO: 161506 - DNA, 19 bp, Homo sapiens
tttcacagtgtgtttgtga

SEQ ID NO: 161507 - DNA, 15 bp, Homo sapiens
tttcacattaatatt

SEQ ID NO: 161508 - DNA, 22 bp, Homo sapiens
tttcaccccacccttcccctcc

SEQ ID NO: 161509 - DNA, 22 bp, Homo sapiens
tttcacctgtttttaagctgtt

SEQ ID NO: 161510 - DNA, 23 bp, Homo sapiens
tttcacctgtttttaagctgttt

SEQ ID NO: 161511 - DNA, 14 bp, Homo sapiens
tttcacggaagttt

SEQ ID NO: 161512 - DNA, 17 bp, Homo sapiens
tttcactggagttacat

SEQ ID NO: 161513 - DNA, 19 bp, Homo sapiens
tttcactggagttacatta

SEQ ID NO: 161514 - DNA, 16 bp, Homo sapiens
tttcagaaatatgtgg

SEQ ID NO: 161515 - DNA, 15 bp, Homo sapiens
tttcagatatatatc

SEQ ID NO: 161516 - DNA, 16 bp, Homo sapiens
tttcagatatatatca

SEQ ID NO: 161517 - DNA, 18 bp, Homo sapiens
tttcaggttttgtaaaga

SEQ ID NO: 161518 - DNA, 19 bp, Homo sapiens
tttcaggttttgtaaagat

SEQ ID NO: 161519 - DNA, 21 bp, Homo sapiens
tttcagtggggcagtcattat

SEQ ID NO: 161520 - DNA, 18 bp, Homo sapiens
tttcataagtatttcaaa

SEQ ID NO: 161521 - DNA, 21 bp, Homo sapiens
tttcatccactagtgcaaatc

SEQ ID NO: 161522 - DNA, 13 bp, Homo sapiens
tttcatctatttc

SEQ ID NO: 161523 - DNA, 16 bp, Homo sapiens
tttcatctatttctga

SEQ ID NO: 161524 - DNA, 18 bp, Homo sapiens
tttcatctatttctgaga

SEQ ID NO: 161525 - DNA, 19 bp, Homo sapiens
tttcatgtaaactgtgcac

SEQ ID NO: 161526 - DNA, 23 bp, Homo sapiens
tttcatgttgcacacccactcag

SEQ ID NO: 161527 - DNA, 21 bp, Homo sapiens
tttcattaatacagggcattt

SEQ ID NO: 161528 - DNA, 15 bp, Homo sapiens
tttcattctcctgcc

SEQ ID NO: 161529 - DNA, 14 bp, Homo sapiens
tttcatttcaactg

SEQ ID NO: 161530 - DNA, 20 bp, Homo sapiens
tttccacaagattcccagag

SEQ ID NO: 161531 - DNA, 13 bp, Homo sapiens
tttccattccaga

SEQ ID NO: 161532 - DNA, 12 bp, Homo sapiens
tttcccaattca

SEQ ID NO: 161533 - DNA, 15 bp, Homo sapiens
tttcccaattcacat

SEQ ID NO: 161534 - DNA, 19 bp, Homo sapiens
tttccccaggggaaaatga

SEQ ID NO: 161535 - DNA, 18 bp, Homo sapiens
tttcctaacaggattaga

SEQ ID NO: 161536 - DNA, 19 bp, Homo sapiens
tttcctaagtgattgtatg

SEQ ID NO: 161537 - DNA, 23 bp, Homo sapiens
tttcctaataaagttctgtactc

SEQ ID NO: 161538 - DNA, 24 bp, Homo sapiens
tttcctaataaagttctgtactca

SEQ ID NO: 161539 - DNA, 24 bp, Homo sapiens
tttcctactctcaggatcaagaaa

SEQ ID NO: 161540 - DNA, 21 bp, Homo sapiens
tttcctcaggctgctggagga

SEQ ID NO: 161541 - DNA, 18 bp, Homo sapiens
tttccttccttccctggc

SEQ ID NO: 161542 - DNA, 15 bp, Homo sapiens
tttctaatgtgtgaa

SEQ ID NO: 161543 - DNA, 22 bp, Homo sapiens
tttctactttgaagtcatacca

SEQ ID NO: 161544 - DNA, 16 bp, Homo sapiens
tttctagactttctgt

SEQ ID NO: 161545 - DNA, 20 bp, Homo sapiens
tttctagctagaaatatgat

SEQ ID NO: 161546 - DNA, 22 bp, Homo sapiens
tttctagctagaaatatgattt

SEQ ID NO: 161547 - DNA, 19 bp, Homo sapiens
tttctagctgttgagctgt

SEQ ID NO: 161548 - DNA, 17 bp, Homo sapiens
tttctatttctcctcca

SEQ ID NO: 161549 - DNA, 16 bp, Homo sapiens
tttctgagaaggtcct

SEQ ID NO: 161550 - DNA, 16 bp, Homo sapiens
tttctgggataagtaa

SEQ ID NO: 161551 - DNA, 21 bp, Homo sapiens
tttcttcactgttgaaaatta

SEQ ID NO: 161552 - DNA, 22 bp, Homo sapiens
tttcttgactcttgttttcagt

SEQ ID NO: 161553 - DNA, 16 bp, Homo sapiens
tttcttgcagatcaaa

SEQ ID NO: 161554 - DNA, 22 bp, Homo sapiens
tttcttttgcccttcacagtgt

SEQ ID NO: 161555 - DNA, 16 bp, Homo sapiens
tttcttttgtaaatgt

SEQ ID NO: 161556 - DNA, 15 bp, Homo sapiens
tttgaactaataaaa

SEQ ID NO: 161557 - DNA, 23 bp, Homo sapiens
tttgaagtagtttgtataacttc

SEQ ID NO: 161558 - DNA, 21 bp, Homo sapiens
tttgaagtgtaggcagacaca

SEQ ID NO: 161559 - DNA, 16 bp, Homo sapiens
tttgagagttctaaat

SEQ ID NO: 161560 - DNA, 17 bp, Homo sapiens
tttgagatcagcctggg

SEQ ID NO: 161561 - DNA, 13 bp, Homo sapiens
tttgagtgctctg

SEQ ID NO: 161562 - DNA, 14 bp, Homo sapiens
tttgagtgttttaa

SEQ ID NO: 161563 - DNA, 18 bp, Homo sapiens
tttgatcaggtggggagt

SEQ ID NO: 161564 - DNA, 15 bp, Homo sapiens
tttgattctgtgtgt

SEQ ID NO: 161565 - DNA, 14 bp, Homo sapiens
tttgcaacctcgct

SEQ ID NO: 161566 - DNA, 13 bp, Homo sapiens
tttgcaagtgaag

SEQ ID NO: 161567 - DNA, 19 bp, Homo sapiens
tttgcaatggctatatggc

SEQ ID NO: 161568 - DNA, 12 bp, Homo sapiens
tttgcaggctca

SEQ ID NO: 161569 - DNA, 17 bp, Homo sapiens
tttgcataacaattcct

SEQ ID NO: 161570 - DNA, 16 bp, Homo sapiens
tttgccagtgggaact

SEQ ID NO: 161571 - DNA, 13 bp, Homo sapiens
tttgctctttctt

SEQ ID NO: 161572 - DNA, 19 bp, Homo sapiens
tttgctgagcatgtactga

SEQ ID NO: 161573 - DNA, 20 bp, Homo sapiens
tttggcagagcttcttccag

SEQ ID NO: 161574 - DNA, 14 bp, Homo sapiens
tttggctgtgtcta

SEQ ID NO: 161575 - DNA, 16 bp, Homo sapiens
tttgggagacatgtga

SEQ ID NO: 161576 - DNA, 21 bp, Homo sapiens
tttgggagacatgtgacattt

SEQ ID NO: 161577 - DNA, 22 bp, Homo sapiens
tttgtaagttaggtaactgtat

SEQ ID NO: 161578 - DNA, 23 bp, Homo sapiens
tttgtaatgtcaccaccttccca

SEQ ID NO: 161579 - DNA, 20 bp, Homo sapiens
tttgtaggggtcaaagaaat

SEQ ID NO: 161580 - DNA, 16 bp, Homo sapiens
tttgtatagtaaagtg

SEQ ID NO: 161581 - DNA, 17 bp, Homo sapiens
tttgtatagtaaagtga

SEQ ID NO: 161582 - DNA, 21 bp, Homo sapiens
tttgtatctgcaggcagacac

SEQ ID NO: 161583 - DNA, 14 bp, Homo sapiens
tttgtatgtaaatg

SEQ ID NO: 161584 - DNA, 17 bp, Homo sapiens
tttgtattttgtttaaa

SEQ ID NO: 161585 - DNA, 11 bp, Homo sapiens
tttgtggaaaa

SEQ ID NO: 161586 - DNA, 21 bp, Homo sapiens
tttgtgttgttggaaaaagtc

SEQ ID NO: 161587 - DNA, 20 bp, Homo sapiens
tttgttattttcagtatttt

SEQ ID NO: 161588 - DNA, 15 bp, Homo sapiens
tttgttcttcttaaa

SEQ ID NO: 161589 - DNA, 15 bp, Homo sapiens
tttgttgtcagctga

SEQ ID NO: 161590 - DNA, 16 bp, Homo sapiens
tttgttgtcagctgaa

SEQ ID NO: 161591 - DNA, 20 bp, Homo sapiens
ttttaaaaattgttaatttt

SEQ ID NO: 161592 - DNA, 20 bp, Homo sapiens
ttttaaacaaaatagaagct

SEQ ID NO: 161593 - DNA, 20 bp, Homo sapiens
ttttaaaccctattggtaaa

SEQ ID NO: 161594 - DNA, 16 bp, Homo sapiens
ttttaaagtatatatt

SEQ ID NO: 161595 - DNA, 21 bp, Homo sapiens
ttttaaattataacttaaaat

SEQ ID NO: 161596 - DNA, 12 bp, Homo sapiens
ttttaactagaa

SEQ ID NO: 161597 - DNA, 11 bp, Homo sapiens
ttttaagaaat

SEQ ID NO: 161598 - DNA, 15 bp, Homo sapiens
ttttaagcaaaatat

SEQ ID NO: 161599 - DNA, 23 bp, Homo sapiens
ttttaagcccatcaattatagaa

SEQ ID NO: 161600 - DNA, 21 bp, Homo sapiens
ttttaagtattgcatctgtat

SEQ ID NO: 161601 - DNA, 17 bp, Homo sapiens
ttttaagtatttatata

SEQ ID NO: 161602 - DNA, 22 bp, Homo sapiens
ttttaatcagacaaagtaattc

SEQ ID NO: 161603 - DNA, 16 bp, Homo sapiens
ttttaattattattct

SEQ ID NO: 161604 - DNA, 17 bp, Homo sapiens
ttttaattattattctt

SEQ ID NO: 161605 - DNA, 23 bp, Homo sapiens
ttttaattattatttatatatgt

SEQ ID NO: 161606 - DNA, 19 bp, Homo sapiens
ttttacaaaaaagaaaaga

SEQ ID NO: 161607 - DNA, 13 bp, Homo sapiens
ttttaccaagttt

SEQ ID NO: 161608 - DNA, 20 bp, Homo sapiens
ttttagatgagattgtttta

SEQ ID NO: 161609 - DNA, 19 bp, Homo sapiens
ttttagctccttgactcct

SEQ ID NO: 161610 - DNA, 14 bp, Homo sapiens
ttttatatgtcaaa

SEQ ID NO: 161611 - DNA, 19 bp, Homo sapiens
ttttatcattttcaaaatg

SEQ ID NO: 161612 - DNA, 23 bp, Homo sapiens
ttttatggaggctttgcatagat

SEQ ID NO: 161613 - DNA, 20 bp, Homo sapiens
agtaagccgtgattttcatt

SEQ ID NO: 161614 - DNA, 22 bp, Homo sapiens
agtaattggtccgatctttgac

SEQ ID NO: 161615 - DNA, 15 bp, Homo sapiens
agtaatttgtagatt

SEQ ID NO: 161616 - DNA, 21 bp, Homo sapiens
agtacaggtaaggtgagggaa

SEQ ID NO: 161617 - DNA, 23 bp, Homo sapiens
agtacaggtaaggtgagggaata

SEQ ID NO: 161618 - DNA, 19 bp, Homo sapiens
agtacatttggagacacaa

SEQ ID NO: 161619 - DNA, 19 bp, Homo sapiens
agtacccgttcacattttt

SEQ ID NO: 161620 - DNA, 21 bp, Homo sapiens
agtacctataaagtaaagcta

SEQ ID NO: 161621 - DNA, 23 bp, Homo sapiens
agtacctataaagtaaagctaaa

SEQ ID NO: 161622 - DNA, 15 bp, Homo sapiens
agtactggcatggta

SEQ ID NO: 161623 - DNA, 16 bp, Homo sapiens
agtactgtgtacagaa

SEQ ID NO: 161624 - DNA, 15 bp, Homo sapiens
agtagatggtgaaat

SEQ ID NO: 161625 - DNA, 19 bp, Homo sapiens
agtagccctttctgtgtgc

SEQ ID NO: 161626 - DNA, 21 bp, Homo sapiens
agtagccctttctgtgtgcac

SEQ ID NO: 161627 - DNA, 16 bp, Homo sapiens
agtagccgagagcctg

SEQ ID NO: 161628 - DNA, 18 bp, Homo sapiens
agtagccgagagcctgct

SEQ ID NO: 161629 - DNA, 13 bp, Homo sapiens
agtagggtcaggc

SEQ ID NO: 161630 - DNA, 16 bp, Homo sapiens
agtagtaatagagcaa

SEQ ID NO: 161631 - DNA, 14 bp, Homo sapiens
agtagtcatttcat

SEQ ID NO: 161632 - DNA, 14 bp, Homo sapiens
agtagttcctgcta

SEQ ID NO: 161633 - DNA, 18 bp, Homo sapiens
agtatcaggtctcccacg

SEQ ID NO: 161634 - DNA, 19 bp, Homo sapiens
agtatctcctcgcaagctg

SEQ ID NO: 161635 - DNA, 15 bp, Homo sapiens
agtatgtaaagtatg

SEQ ID NO: 161636 - DNA, 16 bp, Homo sapiens
agtatgtaaagtatgt

SEQ ID NO: 161637 - DNA, 14 bp, Homo sapiens
agtatgtgtaaaat

SEQ ID NO: 161638 - DNA, 15 bp, Homo sapiens
agtatgttgtcaaag

SEQ ID NO: 161639 - DNA, 18 bp, Homo sapiens
agtatgttgtcaaagaga

SEQ ID NO: 161640 - DNA, 20 bp, Homo sapiens
agtattccattgtgtgagtg

SEQ ID NO: 161641 - DNA, 17 bp, Homo sapiens
agtattgcatctgtata

SEQ ID NO: 161642 - DNA, 22 bp, Homo sapiens
agtattgcatctgtataagtaa

SEQ ID NO: 161643 - DNA, 14 bp, Homo sapiens
agtatttatatatt

SEQ ID NO: 161644 - DNA, 23 bp, Homo sapiens
agtatttatatatttataactca

SEQ ID NO: 161645 - DNA, 16 bp, Homo sapiens
agtatttcaaattgga

SEQ ID NO: 161646 - DNA, 16 bp, Homo sapiens
agtatttgagagttct

SEQ ID NO: 161647 - DNA, 16 bp, Homo sapiens
agtcaaaactcaaatg

SEQ ID NO: 161648 - DNA, 13 bp, Homo sapiens
agtcaaagacatt

SEQ ID NO: 161649 - DNA, 12 bp, Homo sapiens
agtcaaagtaaa

SEQ ID NO: 161650 - DNA, 22 bp, Homo sapiens
agtcacagagataattctagct

SEQ ID NO: 161651 - DNA, 17 bp, Homo sapiens
agtcactgcctctccct

SEQ ID NO: 161652 - DNA, 14 bp, Homo sapiens
agtcagcagaactg

SEQ ID NO: 161653 - DNA, 12 bp, Homo sapiens
agtcaggaaagg

SEQ ID NO: 161654 - DNA, 19 bp, Homo sapiens
agtcagggacccctgccct

SEQ ID NO: 161655 - DNA, 17 bp, Homo sapiens
agtcataccaatgaaaa

SEQ ID NO: 161656 - DNA, 16 bp, Homo sapiens
agtcatgagctgagca

SEQ ID NO: 161657 - DNA, 17 bp, Homo sapiens
agtcatgatctccctgc

SEQ ID NO: 161658 - DNA, 20 bp, Homo sapiens
agtcatgatctccctgccgc

SEQ ID NO: 161659 - DNA, 21 bp, Homo sapiens
agtcattatagatcccccaga

SEQ ID NO: 161660 - DNA, 19 bp, Homo sapiens
agtcatttgctgagcatgt

SEQ ID NO: 161661 - DNA, 20 bp, Homo sapiens
agtccaacgtggggcagcac

SEQ ID NO: 161662 - DNA, 22 bp, Homo sapiens
agtccaacgtggggcagcacag

SEQ ID NO: 161663 - DNA, 20 bp, Homo sapiens
agtccaatctcatggagaag

SEQ ID NO: 161664 - DNA, 17 bp, Homo sapiens
agtccacctgagctgcc

SEQ ID NO: 161665 - DNA, 22 bp, Homo sapiens
agtccaggatgctaacatctaa

SEQ ID NO: 161666 - DNA, 19 bp, Homo sapiens
agtcccagctactcaggag

SEQ ID NO: 161667 - DNA, 16 bp, Homo sapiens
agtccccaggccccag

SEQ ID NO: 161668 - DNA, 23 bp, Homo sapiens
agtccccgtgccccgcctccccg

SEQ ID NO: 161669 - DNA, 15 bp, Homo sapiens
agtcctcccctcaca

SEQ ID NO: 161670 - DNA, 16 bp, Homo sapiens
agtcctcccctcacag

SEQ ID NO: 161671 - DNA, 20 bp, Homo sapiens
agtcggaacggagaaaggtg

SEQ ID NO: 161672 - DNA, 22 bp, Homo sapiens
agtcgtcatcacttttcagtga

SEQ ID NO: 161673 - DNA, 15 bp, Homo sapiens
agtctacgctctcct

SEQ ID NO: 161674 - DNA, 17 bp, Homo sapiens
agtctacgctctccttt

SEQ ID NO: 161675 - DNA, 20 bp, Homo sapiens
agtctacgctctcctttctt

SEQ ID NO: 161676 - DNA, 16 bp, Homo sapiens
agtctaggagctggga

SEQ ID NO: 161677 - DNA, 22 bp, Homo sapiens
agtctcaggaaatcaaatatgc

SEQ ID NO: 161678 - DNA, 14 bp, Homo sapiens
agtctcttctccac

SEQ ID NO: 161679 - DNA, 19 bp, Homo sapiens
agtctcttctccactggat

SEQ ID NO: 161680 - DNA, 18 bp, Homo sapiens
agtctgtgagattcattc

SEQ ID NO: 161681 - DNA, 21 bp, Homo sapiens
agtctgtgagattcattcatg

SEQ ID NO: 161682 - DNA, 22 bp, Homo sapiens
agtctgtgtgatgaactttctc

SEQ ID NO: 161683 - DNA, 19 bp, Homo sapiens
agtcttccatttgcaaggg

SEQ ID NO: 161684 - DNA, 21 bp, Homo sapiens
agtgaacaaatttacagagac

SEQ ID NO: 161685 - DNA, 16 bp, Homo sapiens
agtgaacttgggccac

SEQ ID NO: 161686 - DNA, 16 bp, Homo sapiens
agtgaagaaaagtgaa

SEQ ID NO: 161687 - DNA, 15 bp, Homo sapiens
agtgaaggtttacaa

SEQ ID NO: 161688 - DNA, 18 bp, Homo sapiens
agtgaaggtttacaattt

SEQ ID NO: 161689 - DNA, 14 bp, Homo sapiens
agtgaataaatgtc

SEQ ID NO: 161690 - DNA, 13 bp, Homo sapiens
agtgaatgattca

SEQ ID NO: 161691 - DNA, 16 bp, Homo sapiens
agtgaatgattcagtg

SEQ ID NO: 161692 - DNA, 18 bp, Homo sapiens
agtgacctgaggaagcgt

SEQ ID NO: 161693 - DNA, 17 bp, Homo sapiens
agtgagaataggcagcc

SEQ ID NO: 161694 - DNA, 21 bp, Homo sapiens
agtgagacccagccctcatcc

SEQ ID NO: 161695 - DNA, 17 bp, Homo sapiens
agtgagaccctgtctca

SEQ ID NO: 161696 - DNA, 16 bp, Homo sapiens
agtgagcactcccaag

SEQ ID NO: 161697 - DNA, 19 bp, Homo sapiens
agtgagccgcatcttctcc

SEQ ID NO: 161698 - DNA, 24 bp, Homo sapiens
agtgagccgcatcttctccatctg

SEQ ID NO: 161699 - DNA, 23 bp, Homo sapiens
agtgagctgagatcgtgccgtta

SEQ ID NO: 161700 - DNA, 16 bp, Homo sapiens
agtgagggtcagagag

SEQ ID NO: 161701 - DNA, 22 bp, Homo sapiens
agtgagggtcagagaggagtca

SEQ ID NO: 161702 - DNA, 23 bp, Homo sapiens
agtgagggtcagagaggagtcag

SEQ ID NO: 161703 - DNA, 16 bp, Homo sapiens
agtgattgtatgaatt

SEQ ID NO: 161704 - DNA, 17 bp, Homo sapiens
agtgcaaatcatagctg

SEQ ID NO: 161705 - DNA, 22 bp, Homo sapiens
agtgcaatggtataaatttcaa

SEQ ID NO: 161706 - DNA, 16 bp, Homo sapiens
agtgcagtcctgatca

SEQ ID NO: 161707 - DNA, 22 bp, Homo sapiens
agtgcagtcctgatcagagccg

SEQ ID NO: 161708 - DNA, 17 bp, Homo sapiens
agtgcatctcagcccac

SEQ ID NO: 161709 - DNA, 16 bp, Homo sapiens
agtgcatgctctctgc

SEQ ID NO: 161710 - DNA, 20 bp, Homo sapiens
agtgcatgctctctgcagcc

SEQ ID NO: 161711 - DNA, 22 bp, Homo sapiens
agtgcatgctctctgcagccag

SEQ ID NO: 161712 - DNA, 19 bp, Homo sapiens
agtgccaagcacagtgcct

SEQ ID NO: 161713 - DNA, 18 bp, Homo sapiens
agtgcctctttcatccac

SEQ ID NO: 161714 - DNA, 12 bp, Homo sapiens
agtgcctgctga

SEQ ID NO: 161715 - DNA, 16 bp, Homo sapiens
agtgccttacctcctg

SEQ ID NO: 161716 - DNA, 17 bp, Homo sapiens
agtgccttacctcctgc

SEQ ID NO: 161717 - DNA, 21 bp, Homo sapiens
agtgccttacctcctgcccag

SEQ ID NO: 161718 - DNA, 23 bp, Homo sapiens
agtgccttacctcctgcccagga

SEQ ID NO: 161719 - DNA, 15 bp, Homo sapiens
agtgcgtccacgagc

SEQ ID NO: 161720 - DNA, 17 bp, Homo sapiens
agtgctccctcacatgt

SEQ ID NO: 161721 - DNA, 12 bp, Homo sapiens
agtgctcgcttt

SEQ ID NO: 161722 - DNA, 11 bp, Homo sapiens
agtgctctgat

SEQ ID NO: 161723 - DNA, 21 bp, Homo sapiens
agtgctctgatccctctacag

SEQ ID NO: 161724 - DNA, 15 bp, Homo sapiens
agtgctgaacagtgg

SEQ ID NO: 161725 - DNA, 19 bp, Homo sapiens
agtgcttgagtttggggaa

SEQ ID NO: 161726 - DNA, 19 bp, Homo sapiens
agtggaaaaatagcctgcc

SEQ ID NO: 161727 - DNA, 17 bp, Homo sapiens
agtggctcctcccggtg

SEQ ID NO: 161728 - DNA, 16 bp, Homo sapiens
agtggctgtcatcagc

SEQ ID NO: 161729 - DNA, 20 bp, Homo sapiens
agtgggaacgtgactgcccc

SEQ ID NO: 161730 - DNA, 13 bp, Homo sapiens
agtgggccaggac

SEQ ID NO: 161731 - DNA, 21 bp, Homo sapiens
agtgggccaggacaggcccgg

SEQ ID NO: 161732 - DNA, 18 bp, Homo sapiens
agtggggtctccctctcc

SEQ ID NO: 161733 - DNA, 19 bp, Homo sapiens
agtggggtctccctctcct

SEQ ID NO: 161734 - DNA, 18 bp, Homo sapiens
agtgggtgaataatacag

SEQ ID NO: 161735 - DNA, 17 bp, Homo sapiens
agtggtccacatcccgg

SEQ ID NO: 161736 - DNA, 17 bp, Homo sapiens
agtgtacttaactattc

SEQ ID NO: 161737 - DNA, 14 bp, Homo sapiens
agtgtaggcagaca

SEQ ID NO: 161738 - DNA, 20 bp, Homo sapiens
agtgtaggcagacacaggga

SEQ ID NO: 161739 - DNA, 23 bp, Homo sapiens
agtgtaggcagacacagggactt

SEQ ID NO: 161740 - DNA, 17 bp, Homo sapiens
agtgtatgcacgtgtgc

SEQ ID NO: 161741 - DNA, 15 bp, Homo sapiens
agtgtcccctccact

SEQ ID NO: 161742 - DNA, 19 bp, Homo sapiens
agtgtcccctccactgtca

SEQ ID NO: 161743 - DNA, 18 bp, Homo sapiens
agtgtctcagtccacctg

SEQ ID NO: 161744 - DNA, 17 bp, Homo sapiens
agtgtcttaattaaaag

SEQ ID NO: 161745 - DNA, 15 bp, Homo sapiens
agtgtgaaatagaca

SEQ ID NO: 161746 - DNA, 14 bp, Homo sapiens
agtgtgaccaggca

SEQ ID NO: 161747 - DNA, 12 bp, Homo sapiens
agtgtgagaatc

SEQ ID NO: 161748 - DNA, 18 bp, Homo sapiens
agtgtgaggccagggcag

SEQ ID NO: 161749 - DNA, 20 bp, Homo sapiens
agtgtgcctgaagtcccaga

SEQ ID NO: 161750 - DNA, 14 bp, Homo sapiens
agtgtgtattaaaa

SEQ ID NO: 161751 - DNA, 20 bp, Homo sapiens
agtgtgtattaaaaaaaaca

SEQ ID NO: 161752 - DNA, 22 bp, Homo sapiens
agtgtgtattaaaaaaaacaaa

SEQ ID NO: 161753 - DNA, 17 bp, Homo sapiens
agtgtgtgcaagtatgt

SEQ ID NO: 161754 - DNA, 20 bp, Homo sapiens
agtgtgtttccttcagtgca

SEQ ID NO: 161755 - DNA, 22 bp, Homo sapiens
agtgttattttctttgaaattg

SEQ ID NO: 161756 - DNA, 19 bp, Homo sapiens
agtgtttcgacagctgatt

SEQ ID NO: 161757 - DNA, 15 bp, Homo sapiens
agtgttttctgggat

SEQ ID NO: 161758 - DNA, 12 bp, Homo sapiens
agttaacagaga

SEQ ID NO: 161759 - DNA, 20 bp, Homo sapiens
catctgcattttcaccccac

SEQ ID NO: 161760 - DNA, 15 bp, Homo sapiens
catctgggtccttgc

SEQ ID NO: 161761 - DNA, 18 bp, Homo sapiens
catctgtataccctctgt

SEQ ID NO: 161762 - DNA, 20 bp, Homo sapiens
catctgtataccctctgttt

SEQ ID NO: 161763 - DNA, 15 bp, Homo sapiens
catctgtgtgaaaat

SEQ ID NO: 161764 - DNA, 20 bp, Homo sapiens
catctgttgttttgttttaa

SEQ ID NO: 161765 - DNA, 17 bp, Homo sapiens
catcttctccatctggc

SEQ ID NO: 161766 - DNA, 15 bp, Homo sapiens
catcttgaccaagca

SEQ ID NO: 161767 - DNA, 16 bp, Homo sapiens
catcttgaccaagcag

SEQ ID NO: 161768 - DNA, 17 bp, Homo sapiens
catcttgaccaagcagg

SEQ ID NO: 161769 - DNA, 14 bp, Homo sapiens
catctttcacactt

SEQ ID NO: 161770 - DNA, 21 bp, Homo sapiens
catctttcttctattttattc

SEQ ID NO: 161771 - DNA, 13 bp, Homo sapiens
cccatctctccct

SEQ ID NO: 161772 - DNA, 21 bp, Homo sapiens
cccatctctccctcccctgcc

SEQ ID NO: 161773 - DNA, 15 bp, Homo sapiens
cccatggacactcca

SEQ ID NO: 161774 - DNA, 16 bp, Homo sapiens
cccatggacactccag

SEQ ID NO: 161775 - DNA, 21 bp, Homo sapiens
cccatggacactccagtgcca

SEQ ID NO: 161776 - DNA, 16 bp, Homo sapiens
cccatgtctctcagaa

SEQ ID NO: 161777 - DNA, 14 bp, Homo sapiens
cccatgtgtgagtg

SEQ ID NO: 161778 - DNA, 15 bp, Homo sapiens
cccatgtttctctgg

SEQ ID NO: 161779 - DNA, 19 bp, Homo sapiens
cccattctctctcctgtcc

SEQ ID NO: 161780 - DNA, 14 bp, Homo sapiens
cccattgcctcctc

SEQ ID NO: 161781 - DNA, 23 bp, Homo sapiens
cccattgtggtcacaggaagtag

SEQ ID NO: 161782 - DNA, 21 bp, Homo sapiens
cccatttctaaaggcctcttc

SEQ ID NO: 161783 - DNA, 15 bp, Homo sapiens
cccatttctatttat

SEQ ID NO: 161784 - DNA, 16 bp, Homo sapiens
cccatttctatttatt

SEQ ID NO: 161785 - DNA, 17 bp, Homo sapiens
cccatttctatttattt

SEQ ID NO: 161786 - DNA, 20 bp, Homo sapiens
cccatttctatttatttact

SEQ ID NO: 161787 - DNA, 20 bp, Homo sapiens
cccatttttatatcgatctc

SEQ ID NO: 161788 - DNA, 18 bp, Homo sapiens
ccccaaataagaagggat

SEQ ID NO: 161789 - DNA, 13 bp, Homo sapiens
ccccaactcctgg

SEQ ID NO: 161790 - DNA, 14 bp, Homo sapiens
ccccaactcctgga

SEQ ID NO: 161791 - DNA, 16 bp, Homo sapiens
ccccaagaaagcctca

SEQ ID NO: 161792 - DNA, 18 bp, Homo sapiens
ccccaaggggcagtctgg

SEQ ID NO: 161793 - DNA, 12 bp, Homo sapiens
ccccaccaccta

SEQ ID NO: 161794 - DNA, 17 bp, Homo sapiens
ccccacccccttcagtg

SEQ ID NO: 161795 - DNA, 21 bp, Homo sapiens
ccccacccccttcagtgccca

SEQ ID NO: 161796 - DNA, 11 bp, Homo sapiens
ccccacctggg

SEQ ID NO: 161797 - DNA, 13 bp, Homo sapiens
ccccactccagct

SEQ ID NO: 161798 - DNA, 15 bp, Homo sapiens
ccccactctcattcc

SEQ ID NO: 161799 - DNA, 21 bp, Homo sapiens
ccccactgacagcctcccacc

SEQ ID NO: 161800 - DNA, 12 bp, Homo sapiens
ccccactgcagg

SEQ ID NO: 161801 - DNA, 16 bp, Homo sapiens
ccccactgcctactgc

SEQ ID NO: 161802 - DNA, 14 bp, Homo sapiens
ccccactggggaaa

SEQ ID NO: 161803 - DNA, 22 bp, Homo sapiens
ccccactggggaaataacagct

SEQ ID NO: 161804 - DNA, 20 bp, Homo sapiens
ccccagaacctgtccttgca

SEQ ID NO: 161805 - DNA, 15 bp, Homo sapiens
ccccagacctgagct

SEQ ID NO: 161806 - DNA, 19 bp, Homo sapiens
ccccagcactaaagcagtg

SEQ ID NO: 161807 - DNA, 23 bp, Homo sapiens
ccccagcagttgaatgacaacag

SEQ ID NO: 161808 - DNA, 15 bp, Homo sapiens
ccccagcccctagcc

SEQ ID NO: 161809 - DNA, 14 bp, Homo sapiens
ccccagctgtgagc

SEQ ID NO: 161810 - DNA, 21 bp, Homo sapiens
ccccagctgtgagccttggct

SEQ ID NO: 161811 - DNA, 12 bp, Homo sapiens
ccccaggaagcc

SEQ ID NO: 161812 - DNA, 15 bp, Homo sapiens
ccccaggcctctgtg

SEQ ID NO: 161813 - DNA, 17 bp, Homo sapiens
ccccaggggaaaatgaa

SEQ ID NO: 161814 - DNA, 23 bp, Homo sapiens
ccccaggtgtgttggggccttgg

SEQ ID NO: 161815 - DNA, 22 bp, Homo sapiens
ccccataattttttttttcctt

SEQ ID NO: 161816 - DNA, 14 bp, Homo sapiens
ccccatagccaccc

SEQ ID NO: 161817 - DNA, 15 bp, Homo sapiens
ccccatgtctctcag

SEQ ID NO: 161818 - DNA, 23 bp, Homo sapiens
ccccattcctgggaaatattccc

SEQ ID NO: 161819 - DNA, 13 bp, Homo sapiens
ccccatttctatt

SEQ ID NO: 161820 - DNA, 13 bp, Homo sapiens
cccccaagcctgc

SEQ ID NO: 161821 - DNA, 14 bp, Homo sapiens
cccccaagcctgca

SEQ ID NO: 161822 - DNA, 12 bp, Homo sapiens
cccccgccactc

SEQ ID NO: 161823 - DNA, 13 bp, Homo sapiens
ccccctccccagg

SEQ ID NO: 161824 - DNA, 14 bp, Homo sapiens
ccccctgccagtgc

SEQ ID NO: 161825 - DNA, 20 bp, Homo sapiens
ccccctggggcttctcctga

SEQ ID NO: 161826 - DNA, 23 bp, Homo sapiens
ccccctggggcttctcctgaccc

SEQ ID NO: 161827 - DNA, 21 bp, Homo sapiens
ccccctgtgcagccgctgagc

SEQ ID NO: 161828 - DNA, 17 bp, Homo sapiens
ccccgcagacctcccca

SEQ ID NO: 161829 - DNA, 23 bp, Homo sapiens
ccccgcagacctccccagcccct

SEQ ID NO: 161830 - DNA, 18 bp, Homo sapiens
ccccgcttgtccagcgcc

SEQ ID NO: 161831 - DNA, 16 bp, Homo sapiens
ccccggccacctctgc

SEQ ID NO: 161832 - DNA, 14 bp, Homo sapiens
ccccgtctctacta

SEQ ID NO: 161833 - DNA, 20 bp, Homo sapiens
ccccgtctggggttcagccc

SEQ ID NO: 161834 - DNA, 22 bp, Homo sapiens
ccccgtctggggttcagcccct

SEQ ID NO: 161835 - DNA, 13 bp, Homo sapiens
cccctagcccagg

SEQ ID NO: 161836 - DNA, 18 bp, Homo sapiens
cccctagcccaggagaga

SEQ ID NO: 161837 - DNA, 17 bp, Homo sapiens
cccctatccacccagcc

SEQ ID NO: 161838 - DNA, 16 bp, Homo sapiens
cccctcaacacctctg

SEQ ID NO: 161839 - DNA, 14 bp, Homo sapiens
cccctccactgtca

SEQ ID NO: 161840 - DNA, 11 bp, Homo sapiens
cccctcccaga

SEQ ID NO: 161841 - DNA, 15 bp, Homo sapiens
cccctcccttcaacc

SEQ ID NO: 161842 - DNA, 15 bp, Homo sapiens
cccctccttccttga

SEQ ID NO: 161843 - DNA, 14 bp, Homo sapiens
cccctctgtccagg

SEQ ID NO: 161844 - DNA, 12 bp, Homo sapiens
cccctgattaca

SEQ ID NO: 161845 - DNA, 22 bp, Homo sapiens
cccctgcactggagtccagtct

SEQ ID NO: 161846 - DNA, 14 bp, Homo sapiens
cccctgccagggca

SEQ ID NO: 161847 - DNA, 15 bp, Homo sapiens
cccctgccagggcag

SEQ ID NO: 161848 - DNA, 14 bp, Homo sapiens
cccctgccagtgcc

SEQ ID NO: 161849 - DNA, 14 bp, Homo sapiens
cccctgcccatctg

SEQ ID NO: 161850 - DNA, 18 bp, Homo sapiens
cccctgcccatctgggaa

SEQ ID NO: 161851 - DNA, 19 bp, Homo sapiens
cccctgctgcaggggctct

SEQ ID NO: 161852 - DNA, 22 bp, Homo sapiens
cccctgctgcaggggctctgga

SEQ ID NO: 161853 - DNA, 18 bp, Homo sapiens
cccctggcttttcactgc

SEQ ID NO: 161854 - DNA, 11 bp, Homo sapiens
cccctgtgcag

SEQ ID NO: 161855 - DNA, 15 bp, Homo sapiens
cccctgttcactcta

SEQ ID NO: 161856 - DNA, 14 bp, Homo sapiens
ccccttcagtgccc

SEQ ID NO: 161857 - DNA, 16 bp, Homo sapiens
ccccttctcagaatct

SEQ ID NO: 161858 - DNA, 20 bp, Homo sapiens
ccccttgcccagggctcagc

SEQ ID NO: 161859 - DNA, 23 bp, Homo sapiens
ccccttgcccagggctcagcctg

SEQ ID NO: 161860 - DNA, 12 bp, Homo sapiens
cccgacagaggg

SEQ ID NO: 161861 - DNA, 22 bp, Homo sapiens
cccgcaatgtgcccccagacgc

SEQ ID NO: 161862 - DNA, 18 bp, Homo sapiens
cccgcagacctccccagc

SEQ ID NO: 161863 - DNA, 21 bp, Homo sapiens
cccgcagacctccccagcccc

SEQ ID NO: 161864 - DNA, 23 bp, Homo sapiens
cccgctcagccctccctgcccct

SEQ ID NO: 161865 - DNA, 16 bp, Homo sapiens
cccggcagggtcctag

SEQ ID NO: 161866 - DNA, 15 bp, Homo sapiens
cccggccacctctgc

SEQ ID NO: 161867 - DNA, 19 bp, Homo sapiens
cccggcgcggtggctcacg

SEQ ID NO: 161868 - DNA, 22 bp, Homo sapiens
cccggcgcggtggctcacgcct

SEQ ID NO: 161869 - DNA, 19 bp, Homo sapiens
cccgtcaggacgttgagga

SEQ ID NO: 161870 - DNA, 20 bp, Homo sapiens
cccgtctggggttcagcccc

SEQ ID NO: 161871 - DNA, 13 bp, Homo sapiens
cccgtcttcagcc

SEQ ID NO: 161872 - DNA, 14 bp, Homo sapiens
cccgtcttcagcct

SEQ ID NO: 161873 - DNA, 16 bp, Homo sapiens
cccgtcttcagcctag

SEQ ID NO: 161874 - DNA, 15 bp, Homo sapiens
cccgtgcagactgga

SEQ ID NO: 161875 - DNA, 17 bp, Homo sapiens
ccctaagccaagggcct

SEQ ID NO: 161876 - DNA, 12 bp, Homo sapiens
ccctaatgcctg

SEQ ID NO: 161877 - DNA, 18 bp, Homo sapiens
ccctacacccctcccctg

SEQ ID NO: 161878 - DNA, 14 bp, Homo sapiens
ccctacatgtattg

SEQ ID NO: 161879 - DNA, 19 bp, Homo sapiens
ccctaccacctccccagcc

SEQ ID NO: 161880 - DNA, 17 bp, Homo sapiens
ccctagaaacttccaaa

SEQ ID NO: 161881 - DNA, 16 bp, Homo sapiens
ccctagcccaggagag

SEQ ID NO: 161882 - DNA, 21 bp, Homo sapiens
ccctaggtcagcttgctgccc

SEQ ID NO: 161883 - DNA, 18 bp, Homo sapiens
ccctatccacccagccca

SEQ ID NO: 161884 - DNA, 19 bp, Homo sapiens
ccctatccacccagcccat

SEQ ID NO: 161885 - DNA, 17 bp, Homo sapiens
ccctattggtaaagaat

SEQ ID NO: 161886 - DNA, 16 bp, Homo sapiens
ccctcacagcctctga

SEQ ID NO: 161887 - DNA, 17 bp, Homo sapiens
ccctcacagcctctgac

SEQ ID NO: 161888 - DNA, 12 bp, Homo sapiens
ccctcaccaaca

SEQ ID NO: 161889 - DNA, 21 bp, Homo sapiens
ccctcacctgtagcagccagt

SEQ ID NO: 161890 - DNA, 16 bp, Homo sapiens
ccctcactctggcctc

SEQ ID NO: 161891 - DNA, 17 bp, Homo sapiens
ccctcagaacccttggc

SEQ ID NO: 161892 - DNA, 19 bp, Homo sapiens
ccctcagtttccctatctc

SEQ ID NO: 161893 - DNA, 17 bp, Homo sapiens
ccctcattcaggaaaac

SEQ ID NO: 161894 - DNA, 18 bp, Homo sapiens
ccctccacgttcacccct

SEQ ID NO: 161895 - DNA, 13 bp, Homo sapiens
ccctcccacctct

SEQ ID NO: 161896 - DNA, 14 bp, Homo sapiens
ccctcccacctctg

SEQ ID NO: 161897 - DNA, 19 bp, Homo sapiens
ccctcccacctctgtgacc

SEQ ID NO: 161898 - DNA, 12 bp, Homo sapiens
ccctccccaggg

SEQ ID NO: 161899 - DNA, 16 bp, Homo sapiens
ccctccccatcccatg

SEQ ID NO: 161900 - DNA, 21 bp, Homo sapiens
ccctcccccgccactcctgaa

SEQ ID NO: 161901 - DNA, 15 bp, Homo sapiens
ccctcctcactggcc

SEQ ID NO: 161902 - DNA, 20 bp, Homo sapiens
ccagaagctgagcaccaggg

SEQ ID NO: 161903 - DNA, 19 bp, Homo sapiens
ccagacatgtggtgggaca

SEQ ID NO: 161904 - DNA, 15 bp, Homo sapiens
ccagacccctggctt

SEQ ID NO: 161905 - DNA, 16 bp, Homo sapiens
ccagacccctggcttt

SEQ ID NO: 161906 - DNA, 24 bp, Homo sapiens
ccagacccctggcttttcactgct

SEQ ID NO: 161907 - DNA, 16 bp, Homo sapiens
ccagacggcacccacc

SEQ ID NO: 161908 - DNA, 15 bp, Homo sapiens
ccagagacaggaaaa

SEQ ID NO: 161909 - DNA, 19 bp, Homo sapiens
ccagagaccgtcctcaccc

SEQ ID NO: 161910 - DNA, 20 bp, Homo sapiens
ccagagagcaactctgagat

SEQ ID NO: 161911 - DNA, 16 bp, Homo sapiens
ccagagaggaatcaga

SEQ ID NO: 161912 - DNA, 19 bp, Homo sapiens
ccagagagggactgacacc

SEQ ID NO: 161913 - DNA, 23 bp, Homo sapiens
ccagagagggactgacacccatg

SEQ ID NO: 161914 - DNA, 18 bp, Homo sapiens
ccagagagtggctcctcc

SEQ ID NO: 161915 - DNA, 22 bp, Homo sapiens
ccagagagtggctcctcccggt

SEQ ID NO: 161916 - DNA, 16 bp, Homo sapiens
ccagagatgcctccac

SEQ ID NO: 161917 - DNA, 17 bp, Homo sapiens
ccagagatgcctccacc

SEQ ID NO: 161918 - DNA, 18 bp, Homo sapiens
ccagagatgcctccaccg

SEQ ID NO: 161919 - DNA, 22 bp, Homo sapiens
ccagagatggaggttctctcgg

SEQ ID NO: 161920 - DNA, 16 bp, Homo sapiens
ccagagatgggactgg

SEQ ID NO: 161921 - DNA, 21 bp, Homo sapiens
ccagagatgggactgggaggg

SEQ ID NO: 161922 - DNA, 23 bp, Homo sapiens
ccagagatgggactgggagggcc

SEQ ID NO: 161923 - DNA, 15 bp, Homo sapiens
ccagagcaggaagca

SEQ ID NO: 161924 - DNA, 19 bp, Homo sapiens
ccagaggaactgtccagag

SEQ ID NO: 161925 - DNA, 19 bp, Homo sapiens
ccagaggaaggggccagag

SEQ ID NO: 161926 - DNA, 11 bp, Homo sapiens
ccagaggctcg

SEQ ID NO: 161927 - DNA, 19 bp, Homo sapiens
ccagatattcaagtcacct

SEQ ID NO: 161928 - DNA, 17 bp, Homo sapiens
ccagatcccagaaggac

SEQ ID NO: 161929 - DNA, 19 bp, Homo sapiens
ccagatgaggctggccaag

SEQ ID NO: 161930 - DNA, 22 bp, Homo sapiens
ccagcaatgacatctcaggggc

SEQ ID NO: 161931 - DNA, 23 bp, Homo sapiens
ccagcaatgacatctcaggggcc

SEQ ID NO: 161932 - DNA, 18 bp, Homo sapiens
ccagcacccagcaactcc

SEQ ID NO: 161933 - DNA, 17 bp, Homo sapiens
ccagcactaaagcagtg

SEQ ID NO: 161934 - DNA, 18 bp, Homo sapiens
ccagcactaaagcagtgg

SEQ ID NO: 161935 - DNA, 15 bp, Homo sapiens
ccagcactgcttgag

SEQ ID NO: 161936 - DNA, 15 bp, Homo sapiens
ccagcagatcccagc

SEQ ID NO: 161937 - DNA, 17 bp, Homo sapiens
ccagcagatcccagctc

SEQ ID NO: 161938 - DNA, 18 bp, Homo sapiens
cctagcccaggagagaga

SEQ ID NO: 161939 - DNA, 20 bp, Homo sapiens
cctagccgacctcagccttc

SEQ ID NO: 161940 - DNA, 15 bp, Homo sapiens
cctaggccactcctc

SEQ ID NO: 161941 - DNA, 18 bp, Homo sapiens
cctaggccactcctccaa

SEQ ID NO: 161942 - DNA, 18 bp, Homo sapiens
cctagtgaaggcttctct

SEQ ID NO: 161943 - DNA, 12 bp, Homo sapiens
cctataaaacag

SEQ ID NO: 161944 - DNA, 16 bp, Homo sapiens
cctatatagtttattg

SEQ ID NO: 161945 - DNA, 17 bp, Homo sapiens
cctatcagaagtttctc

SEQ ID NO: 161946 - DNA, 21 bp, Homo sapiens
cctatcagcctgtctcttcca

SEQ ID NO: 161947 - DNA, 12 bp, Homo sapiens
cctatccaccca

SEQ ID NO: 161948 - DNA, 21 bp, Homo sapiens
cctatccacccagcccattct

SEQ ID NO: 161949 - DNA, 23 bp, Homo sapiens
cctcaatgccagtaacgcgtctt

SEQ ID NO: 161950 - DNA, 21 bp, Homo sapiens
cctcaatgtgaatcagaccct

SEQ ID NO: 161951 - DNA, 14 bp, Homo sapiens
cctcacagcctctg

SEQ ID NO: 161952 - DNA, 15 bp, Homo sapiens
cctcacagcctctga

SEQ ID NO: 161953 - DNA, 13 bp, Homo sapiens
cctcacccctgcc

SEQ ID NO: 161954 - DNA, 17 bp, Homo sapiens
cctcacccctgccctgg

SEQ ID NO: 161955 - DNA, 22 bp, Homo sapiens
cctcaccctgccttatcttgca

SEQ ID NO: 161956 - DNA, 21 bp, Homo sapiens
cctcactgctccctgaagcca

SEQ ID NO: 161957 - DNA, 17 bp, Homo sapiens
cctcactggccatccct

SEQ ID NO: 161958 - DNA, 18 bp, Homo sapiens
cctcactggccatccctc

SEQ ID NO: 161959 - DNA, 23 bp, Homo sapiens
cctcactggggtcctggggcctc

SEQ ID NO: 161960 - DNA, 21 bp, Homo sapiens
cctcagaacccttggcttgcc

SEQ ID NO: 161961 - DNA, 21 bp, Homo sapiens
cctcagccatgaggagttgct

SEQ ID NO: 161962 - DNA, 23 bp, Homo sapiens
cctcagccattcactgcccccag

SEQ ID NO: 161963 - DNA, 23 bp, Homo sapiens
cctcagccgactgcacagcggcc

SEQ ID NO: 161964 - DNA, 16 bp, Homo sapiens
cctcagcctgtgctgc

SEQ ID NO: 161965 - DNA, 16 bp, Homo sapiens
cctcaggcactagcct

SEQ ID NO: 161966 - DNA, 18 bp, Homo sapiens
cctcaggcaggtgggatg

SEQ ID NO: 161967 - DNA, 21 bp, Homo sapiens
cctcagggacagagacacctg

SEQ ID NO: 161968 - DNA, 19 bp, Homo sapiens
cctcaggtcagggtgagga

SEQ ID NO: 161969 - DNA, 17 bp, Homo sapiens
cctcaggtgagaagcag

SEQ ID NO: 161970 - DNA, 11 bp, Homo sapiens
cctcagtcctc

SEQ ID NO: 161971 - DNA, 18 bp, Homo sapiens
cctcagtcctcccctcac

SEQ ID NO: 161972 - DNA, 23 bp, Homo sapiens
cctcagtcctcccctcacagcct

SEQ ID NO: 161973 - DNA, 13 bp, Homo sapiens
cctcagtgtattt

SEQ ID NO: 161974 - DNA, 15 bp, Homo sapiens
cctcagtttccctat

SEQ ID NO: 161975 - DNA, 14 bp, Homo sapiens
cctcatccgaggca

SEQ ID NO: 161976 - DNA, 15 bp, Homo sapiens
cctcatcttcttcac

SEQ ID NO: 161977 - DNA, 18 bp, Homo sapiens
cctcatgcatctccacct

SEQ ID NO: 161978 - DNA, 15 bp, Homo sapiens
cctcatgtccactgg

SEQ ID NO: 161979 - DNA, 19 bp, Homo sapiens
cctcattgacaagaactga

SEQ ID NO: 161980 - DNA, 12 bp, Homo sapiens
cctccacagctt

SEQ ID NO: 161981 - DNA, 14 bp, Homo sapiens
cctccacatcctcc

SEQ ID NO: 161982 - DNA, 15 bp, Homo sapiens
cctccacatcctcca

SEQ ID NO: 161983 - DNA, 16 bp, Homo sapiens
cctccacatcctccac

SEQ ID NO: 161984 - DNA, 17 bp, Homo sapiens
cctccaccccccagaac

SEQ ID NO: 161985 - DNA, 13 bp, Homo sapiens
cctccaccgctgc

SEQ ID NO: 161986 - DNA, 17 bp, Homo sapiens
cctccacgttcacccct

SEQ ID NO: 161987 - DNA, 17 bp, Homo sapiens
cctccacgttctgctca

SEQ ID NO: 161988 - DNA, 18 bp, Homo sapiens
cctccacgttctgctcat

SEQ ID NO: 161989 - DNA, 11 bp, Homo sapiens
cctccactcct

SEQ ID NO: 161990 - DNA, 16 bp, Homo sapiens
cctccagggccacgtg

SEQ ID NO: 161991 - DNA, 18 bp, Homo sapiens
cctccagggccacgtgcc

SEQ ID NO: 161992 - DNA, 14 bp, Homo sapiens
cctccatgctgcct

SEQ ID NO: 161993 - DNA, 19 bp, Homo sapiens
cctccatgctgcctccaga

SEQ ID NO: 161994 - DNA, 12 bp, Homo sapiens
cctcccacctct

SEQ ID NO: 161995 - DNA, 13 bp, Homo sapiens
cctcccacctctg

SEQ ID NO: 161996 - DNA, 19 bp, Homo sapiens
cctcccacctctgtgacct

SEQ ID NO: 161997 - DNA, 15 bp, Homo sapiens
cctccccacgccctc

SEQ ID NO: 161998 - DNA, 12 bp, Homo sapiens
cctccccagccc

SEQ ID NO: 161999 - DNA, 13 bp, Homo sapiens
cctccccccactg

SEQ ID NO: 162000 - DNA, 16 bp, Homo sapiens
cctccccccactgcag

SEQ ID NO: 162001 - DNA, 17 bp, Homo sapiens
cctccccccactgcagg

SEQ ID NO: 162002 - DNA, 14 bp, Homo sapiens
cctccccctgccag

SEQ ID NO: 162003 - DNA, 17 bp, Homo sapiens
cctccccctgccagtgc

SEQ ID NO: 162004 - DNA, 19 bp, Homo sapiens
cctccccctgccagtgcct

SEQ ID NO: 162005 - DNA, 23 bp, Homo sapiens
cctccccggctcgagcagtcctg

SEQ ID NO: 162006 - DNA, 18 bp, Homo sapiens
cctcccctatccacccag

SEQ ID NO: 162007 - DNA, 18 bp, Homo sapiens
cctcccctcacagcctct

SEQ ID NO: 162008 - DNA, 13 bp, Homo sapiens
cctcccctgccag

SEQ ID NO: 162009 - DNA, 16 bp, Homo sapiens
cctcccctgccagggc

SEQ ID NO: 162010 - DNA, 20 bp, Homo sapiens
cctcccctgctgcaggggct

SEQ ID NO: 162011 - DNA, 13 bp, Homo sapiens
cctccctcctctg

SEQ ID NO: 162012 - DNA, 18 bp, Homo sapiens
cctccctgcccctccctt

SEQ ID NO: 162013 - DNA, 22 bp, Homo sapiens
cctccctgcccctcccttcaac

SEQ ID NO: 162014 - DNA, 15 bp, Homo sapiens
cctccctgtcctcct

SEQ ID NO: 162015 - DNA, 16 bp, Homo sapiens
cctcccttctcttcac

SEQ ID NO: 162016 - DNA, 13 bp, Homo sapiens
cctcctcaccccg

SEQ ID NO: 162017 - DNA, 15 bp, Homo sapiens
cctcctcaccccgtc

SEQ ID NO: 162018 - DNA, 19 bp, Homo sapiens
cctcctcactggccatccc

SEQ ID NO: 162019 - DNA, 12 bp, Homo sapiens
cctcctccagcc

SEQ ID NO: 162020 - DNA, 12 bp, Homo sapiens
cctcctcctgac

SEQ ID NO: 162021 - DNA, 21 bp, Homo sapiens
cctcctccttcccaaaggact

SEQ ID NO: 162022 - DNA, 14 bp, Homo sapiens
cctcctctgccacc

SEQ ID NO: 162023 - DNA, 20 bp, Homo sapiens
cctcctctgccacctcccct

SEQ ID NO: 162024 - DNA, 12 bp, Homo sapiens
cctcctctgtcc

SEQ ID NO: 162025 - DNA, 15 bp, Homo sapiens
cctcctctgtccagg

SEQ ID NO: 162026 - DNA, 16 bp, Homo sapiens
cctcctctgtccaggg

SEQ ID NO: 162027 - DNA, 12 bp, Homo sapiens
cctcctgagaaa

SEQ ID NO: 162028 - DNA, 14 bp, Homo sapiens
cctcctgcccacct

SEQ ID NO: 162029 - DNA, 12 bp, Homo sapiens
cctcctgcccag

SEQ ID NO: 162030 - DNA, 14 bp, Homo sapiens
cctcctgcccagga

SEQ ID NO: 162031 - DNA, 14 bp, Homo sapiens
cctccttcccaaag

SEQ ID NO: 162032 - DNA, 15 bp, Homo sapiens
cctccttccttgacc

SEQ ID NO: 162033 - DNA, 16 bp, Homo sapiens
cctccttctccctttt

SEQ ID NO: 162034 - DNA, 13 bp, Homo sapiens
cctcgccctgggt

SEQ ID NO: 162035 - DNA, 14 bp, Homo sapiens
cctcgccctgggtc

SEQ ID NO: 162036 - DNA, 13 bp, Homo sapiens
cctcgctgccagc

SEQ ID NO: 162037 - DNA, 14 bp, Homo sapiens
cctcgctgccagct

SEQ ID NO: 162038 - DNA, 19 bp, Homo sapiens
cctcgctgccagctctgta

SEQ ID NO: 162039 - DNA, 14 bp, Homo sapiens
cctcggagcctcat

SEQ ID NO: 162040 - DNA, 16 bp, Homo sapiens
cctcggagcctcatcc

SEQ ID NO: 162041 - DNA, 19 bp, Homo sapiens
cctcgtcctccccctgcca

SEQ ID NO: 162042 - DNA, 18 bp, Homo sapiens
cctcgtggccttccccag

SEQ ID NO: 162043 - DNA, 23 bp, Homo sapiens
cctcgtggccttccccagcctct

SEQ ID NO: 162044 - DNA, 12 bp, Homo sapiens
cctctccactgc

SEQ ID NO: 162045 - DNA, 21 bp, Homo sapiens
accttcgtttactatgcctgt

SEQ ID NO: 162046 - DNA, 20 bp, Homo sapiens
accttcttcagccacctctc

SEQ ID NO: 162047 - DNA, 21 bp, Homo sapiens
accttgaacactgggggaggg

SEQ ID NO: 162048 - DNA, 16 bp, Homo sapiens
acctttattaaaatct

SEQ ID NO: 162049 - DNA, 20 bp, Homo sapiens
acctttattaaaatcttaaa

SEQ ID NO: 162050 - DNA, 14 bp, Homo sapiens
acctttattgtgat

SEQ ID NO: 162051 - DNA, 15 bp, Homo sapiens
accttttatccactt

SEQ ID NO: 162052 - DNA, 17 bp, Homo sapiens
acgaagggaaatgtctt

SEQ ID NO: 162053 - DNA, 16 bp, Homo sapiens
acgagtaatttattgt

SEQ ID NO: 162054 - DNA, 17 bp, Homo sapiens
acgagtcaatcccctca

SEQ ID NO: 162055 - DNA, 15 bp, Homo sapiens
acgatggcacccagt

SEQ ID NO: 162056 - DNA, 17 bp, Homo sapiens
acgatgtggccctggcc

SEQ ID NO: 162057 - DNA, 13 bp, Homo sapiens
acgcacctcccat

SEQ ID NO: 162058 - DNA, 15 bp, Homo sapiens
acgcacctcccatcc

SEQ ID NO: 162059 - DNA, 14 bp, Homo sapiens
acgcagcaggaggc

SEQ ID NO: 162060 - DNA, 19 bp, Homo sapiens
acgcaggcccccaggtgcc

SEQ ID NO: 162061 - DNA, 23 bp, Homo sapiens
acgccaggggaaaatcagcctgc

SEQ ID NO: 162062 - DNA, 14 bp, Homo sapiens
acgcccatgtgtga

SEQ ID NO: 162063 - DNA, 13 bp, Homo sapiens
acgccctattttt

SEQ ID NO: 162064 - DNA, 12 bp, Homo sapiens
acgccctcccct

SEQ ID NO: 162065 - DNA, 14 bp, Homo sapiens
acgccctcccctcc

SEQ ID NO: 162066 - DNA, 21 bp, Homo sapiens
acgccctcccctcccctgctg

SEQ ID NO: 162067 - DNA, 18 bp, Homo sapiens
acgcctgcaaacgctgcc

SEQ ID NO: 162068 - DNA, 21 bp, Homo sapiens
acgcctgcaaacgctgcctgc

SEQ ID NO: 162069 - DNA, 17 bp, Homo sapiens
acgcctgtaatcccagc

SEQ ID NO: 162070 - DNA, 19 bp, Homo sapiens
acgcctgtaatcccagcac

SEQ ID NO: 162071 - DNA, 18 bp, Homo sapiens
acgccttgttcttggcca

SEQ ID NO: 162072 - DNA, 19 bp, Homo sapiens
acgctggtagagatggagg

SEQ ID NO: 162073 - DNA, 15 bp, Homo sapiens
acgcttgctcatttt

SEQ ID NO: 162074 - DNA, 14 bp, Homo sapiens
acggaagttttcaa

SEQ ID NO: 162075 - DNA, 19 bp, Homo sapiens
acggagagcgcctgcccct

SEQ ID NO: 162076 - DNA, 18 bp, Homo sapiens
acggagccactcctctga

SEQ ID NO: 162077 - DNA, 21 bp, Homo sapiens
acggagccactcctctgactc

SEQ ID NO: 162078 - DNA, 21 bp, Homo sapiens
acggagccccaggcctctgtg

SEQ ID NO: 162079 - DNA, 18 bp, Homo sapiens
acggcttttacttaaacc

SEQ ID NO: 162080 - DNA, 12 bp, Homo sapiens
acggggagaaaa

SEQ ID NO: 162081 - DNA, 17 bp, Homo sapiens
acggttttactgcagct

SEQ ID NO: 162082 - DNA, 16 bp, Homo sapiens
acgtcaaacatgaagt

SEQ ID NO: 162083 - DNA, 13 bp, Homo sapiens
acgtccccctggg

SEQ ID NO: 162084 - DNA, 15 bp, Homo sapiens
acgtcctgccacctg

SEQ ID NO: 162085 - DNA, 20 bp, Homo sapiens
acgtcctgccacctggggca

SEQ ID NO: 162086 - DNA, 16 bp, Homo sapiens
acgtctgaccctctcc

SEQ ID NO: 162087 - DNA, 21 bp, Homo sapiens
acgtgactgtggcacacgcct

SEQ ID NO: 162088 - DNA, 17 bp, Homo sapiens
acgtggacgtttttaat

SEQ ID NO: 162089 - DNA, 11 bp, Homo sapiens
acgtgggagac

SEQ ID NO: 162090 - DNA, 15 bp, Homo sapiens
acgtgggcggcagag

SEQ ID NO: 162091 - DNA, 15 bp, Homo sapiens
acgtggggcagcaca

SEQ ID NO: 162092 - DNA, 19 bp, Homo sapiens
acgtggggcagcacagaga

SEQ ID NO: 162093 - DNA, 20 bp, Homo sapiens
acgtggggcagcacagagag

SEQ ID NO: 162094 - DNA, 13 bp, Homo sapiens
actaaactttacc

SEQ ID NO: 162095 - DNA, 17 bp, Homo sapiens
actaaagcagtagaaat

SEQ ID NO: 162096 - DNA, 22 bp, Homo sapiens
actaaagtatgtaaagtatgta

SEQ ID NO: 162097 - DNA, 14 bp, Homo sapiens
actaaatctctaat

SEQ ID NO: 162098 - DNA, 17 bp, Homo sapiens
actaaatctctaatatg

SEQ ID NO: 162099 - DNA, 17 bp, Homo sapiens
ccatttctatttattta

SEQ ID NO: 162100 - DNA, 11 bp, Homo sapiens
ccatttttcct

SEQ ID NO: 162101 - DNA, 18 bp, Homo sapiens
cccaaaaggcagaagcaa

SEQ ID NO: 162102 - DNA, 20 bp, Homo sapiens
cccaaacaaatatgcaaaag

SEQ ID NO: 162103 - DNA, 17 bp, Homo sapiens
cccaaagctttcctgcc

SEQ ID NO: 162104 - DNA, 17 bp, Homo sapiens
cccaaataagaagggat

SEQ ID NO: 162105 - DNA, 19 bp, Homo sapiens
cccaacagcgacatagccc

SEQ ID NO: 162106 - DNA, 14 bp, Homo sapiens
cccaacctgctctc

SEQ ID NO: 162107 - DNA, 13 bp, Homo sapiens
cccaactcctgga

SEQ ID NO: 162108 - DNA, 20 bp, Homo sapiens
cccaagaatagatgctgact

SEQ ID NO: 162109 - DNA, 21 bp, Homo sapiens
cccaagaatagatgctgactg

SEQ ID NO: 162110 - DNA, 22 bp, Homo sapiens
cccaagacttggtgtcctttcc

SEQ ID NO: 162111 - DNA, 17 bp, Homo sapiens
cccaaggctctgagcaa

SEQ ID NO: 162112 - DNA, 23 bp, Homo sapiens
cccaagtgggggcagagggcaga

SEQ ID NO: 162113 - DNA, 21 bp, Homo sapiens
cccacaaaggagagctagcag

SEQ ID NO: 162114 - DNA, 20 bp, Homo sapiens
cccacaagaaatgaaagcag

SEQ ID NO: 162115 - DNA, 23 bp, Homo sapiens
cccacagaaagactgagctcaag

SEQ ID NO: 162116 - DNA, 12 bp, Homo sapiens
cccacagctccc

SEQ ID NO: 162117 - DNA, 18 bp, Homo sapiens
cccaccaccccagctgct

SEQ ID NO: 162118 - DNA, 20 bp, Homo sapiens
cccaccacctaggccactcc

SEQ ID NO: 162119 - DNA, 22 bp, Homo sapiens
cccaccacctaggccactcctc

SEQ ID NO: 162120 - DNA, 21 bp, Homo sapiens
cccacccagcacccagcaact

SEQ ID NO: 162121 - DNA, 19 bp, Homo sapiens
cccaccccctccccagggg

SEQ ID NO: 162122 - DNA, 18 bp, Homo sapiens
cccaccctgaaagccctg

SEQ ID NO: 162123 - DNA, 17 bp, Homo sapiens
cccacctcagcctcctg

SEQ ID NO: 162124 - DNA, 13 bp, Homo sapiens
cccacctccccac

SEQ ID NO: 162125 - DNA, 16 bp, Homo sapiens
cccacctccccacgcc

SEQ ID NO: 162126 - DNA, 23 bp, Homo sapiens
cccacctgtcaaacaaagccaga

SEQ ID NO: 162127 - DNA, 16 bp, Homo sapiens
cccacgagggtcagga

SEQ ID NO: 162128 - DNA, 14 bp, Homo sapiens
cccactctcattcc

SEQ ID NO: 162129 - DNA, 23 bp, Homo sapiens
cccactgcaggccccgcttgtcc

SEQ ID NO: 162130 - DNA, 18 bp, Homo sapiens
cccactgcctactgcatc

SEQ ID NO: 162131 - DNA, 17 bp, Homo sapiens
cccagaacctgtccttg

SEQ ID NO: 162132 - DNA, 21 bp, Homo sapiens
cccagacagctccctctgcct

SEQ ID NO: 162133 - DNA, 21 bp, Homo sapiens
cccagaccttttatccactta

SEQ ID NO: 162134 - DNA, 15 bp, Homo sapiens
cccagagacaggaaa

SEQ ID NO: 162135 - DNA, 19 bp, Homo sapiens
cccagagaggaatcagact

SEQ ID NO: 162136 - DNA, 21 bp, Homo sapiens
cccagagaggaatcagacttc

SEQ ID NO: 162137 - DNA, 21 bp, Homo sapiens
cccagagatgggactgggagg

SEQ ID NO: 162138 - DNA, 14 bp, Homo sapiens
cccagagcagggtg

SEQ ID NO: 162139 - DNA, 15 bp, Homo sapiens
cccagagcagggtgt

SEQ ID NO: 162140 - DNA, 13 bp, Homo sapiens
cccagcacccagc

SEQ ID NO: 162141 - DNA, 16 bp, Homo sapiens
cccagcactaaagcag

SEQ ID NO: 162142 - DNA, 16 bp, Homo sapiens
cccagcagtttgggag

SEQ ID NO: 162143 - DNA, 17 bp, Homo sapiens
cccagccaaaccctgtc

SEQ ID NO: 162144 - DNA, 18 bp, Homo sapiens
cccagcccagctggtggg

SEQ ID NO: 162145 - DNA, 14 bp, Homo sapiens
cccagcccctagcc

SEQ ID NO: 162146 - DNA, 22 bp, Homo sapiens
cccagcctcagtcctcccctca

SEQ ID NO: 162147 - DNA, 18 bp, Homo sapiens
cccagcctccaagctcca

SEQ ID NO: 162148 - DNA, 14 bp, Homo sapiens
cccagctactcagg

SEQ ID NO: 162149 - DNA, 20 bp, Homo sapiens
cccagctatacctgtgcctc

SEQ ID NO: 162150 - DNA, 15 bp, Homo sapiens
cccagctccccaaga

SEQ ID NO: 162151 - DNA, 13 bp, Homo sapiens
cccagctctccct

SEQ ID NO: 162152 - DNA, 16 bp, Homo sapiens
cccagctctccctctg

SEQ ID NO: 162153 - DNA, 12 bp, Homo sapiens
cccagctctgaa

SEQ ID NO: 162154 - DNA, 22 bp, Homo sapiens
cccagctctgaaaccagtgtta

SEQ ID NO: 162155 - DNA, 15 bp, Homo sapiens
cccagctgtgagcct

SEQ ID NO: 162156 - DNA, 19 bp, Homo sapiens
cccagctgtgagccttggc

SEQ ID NO: 162157 - DNA, 22 bp, Homo sapiens
cccagcttaaaggggctagagt

SEQ ID NO: 162158 - DNA, 12 bp, Homo sapiens
cccaggaagccg

SEQ ID NO: 162159 - DNA, 23 bp, Homo sapiens
cccaggacaccacacccagcctc

SEQ ID NO: 162160 - DNA, 23 bp, Homo sapiens
cccaggagagccagccctccctg

SEQ ID NO: 162161 - DNA, 18 bp, Homo sapiens
cccaggccaggctccttc

SEQ ID NO: 162162 - DNA, 15 bp, Homo sapiens
cccaggcctgcctgt

SEQ ID NO: 162163 - DNA, 16 bp, Homo sapiens
cccaggcctgcctgtt

SEQ ID NO: 162164 - DNA, 13 bp, Homo sapiens
cccagggaagtgc

SEQ ID NO: 162165 - DNA, 15 bp, Homo sapiens
cccagggagcggaaa

SEQ ID NO: 162166 - DNA, 20 bp, Homo sapiens
cccagggagcggaaagcagc

SEQ ID NO: 162167 - DNA, 19 bp, Homo sapiens
cccagggcctgagcctggc

SEQ ID NO: 162168 - DNA, 14 bp, Homo sapiens
cccagggcctgcag

SEQ ID NO: 162169 - DNA, 13 bp, Homo sapiens
cccaggggagagg

SEQ ID NO: 162170 - DNA, 15 bp, Homo sapiens
cccaggggagagggt

SEQ ID NO: 162171 - DNA, 22 bp, Homo sapiens
cccaggggagagggtctggaga

SEQ ID NO: 162172 - DNA, 24 bp, Homo sapiens
cccaggggagagggtctggagaag

SEQ ID NO: 162173 - DNA, 19 bp, Homo sapiens
cccaggtggctgacccagt

SEQ ID NO: 162174 - DNA, 14 bp, Homo sapiens
cccagtaagccact

SEQ ID NO: 162175 - DNA, 23 bp, Homo sapiens
cccagtattctaggtagtgccct

SEQ ID NO: 162176 - DNA, 16 bp, Homo sapiens
cccagtccctggggga

SEQ ID NO: 162177 - DNA, 17 bp, Homo sapiens
cccagtctgttccccat

SEQ ID NO: 162178 - DNA, 22 bp, Homo sapiens
cccagtgccaagcacagtgcct

SEQ ID NO: 162179 - DNA, 18 bp, Homo sapiens
cccagtgccgagaaggaa

SEQ ID NO: 162180 - DNA, 16 bp, Homo sapiens
cccatcacgcctgtgc

SEQ ID NO: 162181 - DNA, 22 bp, Homo sapiens
cccatcagtgctccctcacatg

SEQ ID NO: 162182 - DNA, 21 bp, Homo sapiens
cccatcccctggactgggagg

SEQ ID NO: 162183 - DNA, 14 bp, Homo sapiens
cccatccctgcctg

SEQ ID NO: 162184 - DNA, 19 bp, Homo sapiens
cccatctctacaaaaagca

SEQ ID NO: 162185 - DNA, 21 bp, Homo sapiens
cccatctgcacccccctgggc

SEQ ID NO: 162186 - DNA, 15 bp, Homo sapiens
cccatgatccctgtg

SEQ ID NO: 162187 - DNA, 16 bp, Homo sapiens
cctcactgttgaattt

SEQ ID NO: 162188 - DNA, 16 bp, Homo sapiens
cctcagccatgaggag

SEQ ID NO: 162189 - DNA, 16 bp, Homo sapiens
cctcagccattcactg

SEQ ID NO: 162190 - DNA, 15 bp, Homo sapiens
cctcaggcactagcc

SEQ ID NO: 162191 - DNA, 17 bp, Homo sapiens
cctcaggcactagcctt

SEQ ID NO: 162192 - DNA, 19 bp, Homo sapiens
cctcaggcactagcctttg

SEQ ID NO: 162193 - DNA, 12 bp, Homo sapiens
cctcaggctgct

SEQ ID NO: 162194 - DNA, 14 bp, Homo sapiens
cctcaggctgctgg

SEQ ID NO: 162195 - DNA, 20 bp, Homo sapiens
cctcagggacagagacacct

SEQ ID NO: 162196 - DNA, 20 bp, Homo sapiens
cctcagtcctcccctcacag

SEQ ID NO: 162197 - DNA, 19 bp, Homo sapiens
cctcagttttatcattttc

SEQ ID NO: 162198 - DNA, 17 bp, Homo sapiens
cctcatctgtccctccg

SEQ ID NO: 162199 - DNA, 17 bp, Homo sapiens
cctcatcttcttcacca

SEQ ID NO: 162200 - DNA, 15 bp, Homo sapiens
cctcatgcatctcca

SEQ ID NO: 162201 - DNA, 20 bp, Homo sapiens
cctcatgtccactggttctt

SEQ ID NO: 162202 - DNA, 18 bp, Homo sapiens
cctcattagcattttgct

SEQ ID NO: 162203 - DNA, 17 bp, Homo sapiens
cctcatttggggtagct

SEQ ID NO: 162204 - DNA, 20 bp, Homo sapiens
cctcatttggggtagctaga

SEQ ID NO: 162205 - DNA, 23 bp, Homo sapiens
cctccaatcccaccaaccctcag

SEQ ID NO: 162206 - DNA, 11 bp, Homo sapiens
cctccacagct

SEQ ID NO: 162207 - DNA, 20 bp, Homo sapiens
cctccacatcctccacgttc

SEQ ID NO: 162208 - DNA, 18 bp, Homo sapiens
cctccacgttcacccctc

SEQ ID NO: 162209 - DNA, 16 bp, Homo sapiens
cctccactccttcctg

SEQ ID NO: 162210 - DNA, 13 bp, Homo sapiens
cctccactgtcac

SEQ ID NO: 162211 - DNA, 12 bp, Homo sapiens
cctccagggcca

SEQ ID NO: 162212 - DNA, 20 bp, Homo sapiens
cctccagggccacgtgccag

SEQ ID NO: 162213 - DNA, 22 bp, Homo sapiens
cctccagggccacgtgccaggc

SEQ ID NO: 162214 - DNA, 16 bp, Homo sapiens
cctccatgctgcctcc

SEQ ID NO: 162215 - DNA, 14 bp, Homo sapiens
cctcccacctctgt

SEQ ID NO: 162216 - DNA, 15 bp, Homo sapiens
cctcccacctctgtg

SEQ ID NO: 162217 - DNA, 17 bp, Homo sapiens
cctcccagaacacactc

SEQ ID NO: 162218 - DNA, 18 bp, Homo sapiens
cctcccagaacacactcc

SEQ ID NO: 162219 - DNA, 12 bp, Homo sapiens
cctcccagcctg

SEQ ID NO: 162220 - DNA, 16 bp, Homo sapiens
cctcccagtcaccttg

SEQ ID NO: 162221 - DNA, 14 bp, Homo sapiens
cctccccagcccct

SEQ ID NO: 162222 - DNA, 16 bp, Homo sapiens
cctccccagcccctag

SEQ ID NO: 162223 - DNA, 13 bp, Homo sapiens
cctccccaggccg

SEQ ID NO: 162224 - DNA, 14 bp, Homo sapiens
cctccccaggggag

SEQ ID NO: 162225 - DNA, 22 bp, Homo sapiens
cctccccaggggagagggtctg

SEQ ID NO: 162226 - DNA, 18 bp, Homo sapiens
cctccccccactgcaggc

SEQ ID NO: 162227 - DNA, 20 bp, Homo sapiens
cctccccccactgcaggccc

SEQ ID NO: 162228 - DNA, 15 bp, Homo sapiens
cctccccctgccagt

SEQ ID NO: 162229 - DNA, 18 bp, Homo sapiens
cctccccctgccagtgcc

SEQ ID NO: 162230 - DNA, 13 bp, Homo sapiens
cctcccctatcca

SEQ ID NO: 162231 - DNA, 17 bp, Homo sapiens
cctcccctatccaccca

SEQ ID NO: 162232 - DNA, 13 bp, Homo sapiens
cctcccctcacag

SEQ ID NO: 162233 - DNA, 16 bp, Homo sapiens
cctcccctcccctgct

SEQ ID NO: 162234 - DNA, 12 bp, Homo sapiens
cctcccctgcca

SEQ ID NO: 162235 - DNA, 16 bp, Homo sapiens
cctcccctgctgaagg

SEQ ID NO: 162236 - DNA, 16 bp, Homo sapiens
cctcccggtgcccaag

SEQ ID NO: 162237 - DNA, 13 bp, Homo sapiens
cctccctctaatt

SEQ ID NO: 162238 - DNA, 13 bp, Homo sapiens
cctccctgcccct

SEQ ID NO: 162239 - DNA, 24 bp, Homo sapiens
cctccctgcccctcccttcaacca

SEQ ID NO: 162240 - DNA, 11 bp, Homo sapiens
cctccctgtcc

SEQ ID NO: 162241 - DNA, 14 bp, Homo sapiens
cctccctgtcctcc

SEQ ID NO: 162242 - DNA, 16 bp, Homo sapiens
cctccctgtcctcctc

SEQ ID NO: 162243 - DNA, 21 bp, Homo sapiens
cctccctgttgaagctctggt

SEQ ID NO: 162244 - DNA, 14 bp, Homo sapiens
cctccgccaggcga

SEQ ID NO: 162245 - DNA, 16 bp, Homo sapiens
cctccgtatttcagac

SEQ ID NO: 162246 - DNA, 21 bp, Homo sapiens
cctcctccagccgccatgctc

SEQ ID NO: 162247 - DNA, 18 bp, Homo sapiens
cctcctctgtccagggcc

SEQ ID NO: 162248 - DNA, 13 bp, Homo sapiens
cctcctgcccagg

SEQ ID NO: 162249 - DNA, 16 bp, Homo sapiens
cctcctgcccaggaga

SEQ ID NO: 162250 - DNA, 23 bp, Homo sapiens
cctcctgcccaggagagccagcc

SEQ ID NO: 162251 - DNA, 21 bp, Homo sapiens
cctcctgggccctctctgctc

SEQ ID NO: 162252 - DNA, 17 bp, Homo sapiens
cctcctgtgtagctggg

SEQ ID NO: 162253 - DNA, 20 bp, Homo sapiens
cctccttccttgaccagcag

SEQ ID NO: 162254 - DNA, 17 bp, Homo sapiens
cctccttctcccttttt

SEQ ID NO: 162255 - DNA, 19 bp, Homo sapiens
cctcgaagcgcgccactcg

SEQ ID NO: 162256 - DNA, 14 bp, Homo sapiens
cctcgcaagctggg

SEQ ID NO: 162257 - DNA, 12 bp, Homo sapiens
cctcgccctggg

SEQ ID NO: 162258 - DNA, 13 bp, Homo sapiens
cctcgcctgacaa

SEQ ID NO: 162259 - DNA, 17 bp, Homo sapiens
cctcgctggactctcag

SEQ ID NO: 162260 - DNA, 18 bp, Homo sapiens
cctcgctggactctcagt

SEQ ID NO: 162261 - DNA, 14 bp, Homo sapiens
cctcggagaagagc

SEQ ID NO: 162262 - DNA, 18 bp, Homo sapiens
cctcggtgtggagaagcg

SEQ ID NO: 162263 - DNA, 15 bp, Homo sapiens
cctcgtcctccccct

SEQ ID NO: 162264 - DNA, 20 bp, Homo sapiens
cctcgtcctccccctgccag

SEQ ID NO: 162265 - DNA, 22 bp, Homo sapiens
cctcttgccactgcctcttcct

SEQ ID NO: 162266 - DNA, 23 bp, Homo sapiens
cctcttgccactgcctcttcctc

SEQ ID NO: 162267 - DNA, 17 bp, Homo sapiens
cctgaaaacccagagag

SEQ ID NO: 162268 - DNA, 18 bp, Homo sapiens
cctgaaagaggaatgaag

SEQ ID NO: 162269 - DNA, 19 bp, Homo sapiens
cctgaaagaggctgaggcc

SEQ ID NO: 162270 - DNA, 18 bp, Homo sapiens
cctgaaagccctgagctt

SEQ ID NO: 162271 - DNA, 12 bp, Homo sapiens
cctgaagccagc

SEQ ID NO: 162272 - DNA, 17 bp, Homo sapiens
cctgaagccagccttct

SEQ ID NO: 162273 - DNA, 18 bp, Homo sapiens
cctgaagccagccttctt

SEQ ID NO: 162274 - DNA, 16 bp, Homo sapiens
cctgacagaaggactc

SEQ ID NO: 162275 - DNA, 12 bp, Homo sapiens
cctgagcctggc

SEQ ID NO: 162276 - DNA, 15 bp, Homo sapiens
cctgagcctggccag

SEQ ID NO: 162277 - DNA, 13 bp, Homo sapiens
cctgagctcactc

SEQ ID NO: 162278 - DNA, 12 bp, Homo sapiens
cctgagctcccc

SEQ ID NO: 162279 - DNA, 21 bp, Homo sapiens
cctgagctcggtggacccagg

SEQ ID NO: 162280 - DNA, 17 bp, Homo sapiens
cctgagctgccatccag

SEQ ID NO: 162281 - DNA, 16 bp, Homo sapiens
cctgagctttctgcta

SEQ ID NO: 162282 - DNA, 15 bp, Homo sapiens
cctgagtcaccagga

SEQ ID NO: 162283 - DNA, 16 bp, Homo sapiens
cctgagtggtgccaaa

SEQ ID NO: 162284 - DNA, 18 bp, Homo sapiens
cctgatggtacaggaaag

SEQ ID NO: 162285 - DNA, 20 bp, Homo sapiens
cctgattgtgtatattcata

SEQ ID NO: 162286 - DNA, 17 bp, Homo sapiens
cctgcaaaaggactctc

SEQ ID NO: 162287 - DNA, 17 bp, Homo sapiens
cctgcaaacgctgcctg

SEQ ID NO: 162288 - DNA, 22 bp, Homo sapiens
cctgcaaacgctgcctgcccac

SEQ ID NO: 162289 - DNA, 17 bp, Homo sapiens
cctgcaactcaaggact

SEQ ID NO: 162290 - DNA, 15 bp, Homo sapiens
cctgcactggagtcc

SEQ ID NO: 162291 - DNA, 17 bp, Homo sapiens
cctgcactggagtccag

SEQ ID NO: 162292 - DNA, 13 bp, Homo sapiens
cctgcagcctgga

SEQ ID NO: 162293 - DNA, 15 bp, Homo sapiens
cctgcagggccaagc

SEQ ID NO: 162294 - DNA, 18 bp, Homo sapiens
cctgcaggtgctgctgcg

SEQ ID NO: 162295 - DNA, 20 bp, Homo sapiens
cctgcaggtgctgctgcgtg

SEQ ID NO: 162296 - DNA, 20 bp, Homo sapiens
cctgcatgtaaacacgcctg

SEQ ID NO: 162297 - DNA, 22 bp, Homo sapiens
cctgcatgtaaacacgcctgca

SEQ ID NO: 162298 - DNA, 17 bp, Homo sapiens
cctgcattcacccagac

SEQ ID NO: 162299 - DNA, 19 bp, Homo sapiens
cctgcattcacccagacag

SEQ ID NO: 162300 - DNA, 12 bp, Homo sapiens
cctgccacagcc

SEQ ID NO: 162301 - DNA, 13 bp, Homo sapiens
cctgccacctggg

SEQ ID NO: 162302 - DNA, 20 bp, Homo sapiens
cctgccagtgccttacctcc

SEQ ID NO: 162303 - DNA, 22 bp, Homo sapiens
cctgccagtgccttacctcctg

SEQ ID NO: 162304 - DNA, 13 bp, Homo sapiens
cctgcccacctgt

SEQ ID NO: 162305 - DNA, 18 bp, Homo sapiens
cctgcccagatcccagaa

SEQ ID NO: 162306 - DNA, 14 bp, Homo sapiens
cctgccccaggcct

SEQ ID NO: 162307 - DNA, 16 bp, Homo sapiens
cctgccccaggcctga

SEQ ID NO: 162308 - DNA, 15 bp, Homo sapiens
cctgcccccaaataa

SEQ ID NO: 162309 - DNA, 14 bp, Homo sapiens
cctgcccctcccag

SEQ ID NO: 162310 - DNA, 15 bp, Homo sapiens
cctgcccgtaaacac

SEQ ID NO: 162311 - DNA, 20 bp, Homo sapiens
cctgcccgtaaacacgcctg

SEQ ID NO: 162312 - DNA, 22 bp, Homo sapiens
cctgcccgtaaacacgcctgca

SEQ ID NO: 162313 - DNA, 22 bp, Homo sapiens
cctgccctagagcacactgtag

SEQ ID NO: 162314 - DNA, 18 bp, Homo sapiens
cctgccgacctcgtcctc

SEQ ID NO: 162315 - DNA, 15 bp, Homo sapiens
cctgccggtaaacac

SEQ ID NO: 162316 - DNA, 21 bp, Homo sapiens
cctgccggtaaacacgcctgc

SEQ ID NO: 162317 - DNA, 13 bp, Homo sapiens
cctgcctcagcct

SEQ ID NO: 162318 - DNA, 15 bp, Homo sapiens
cctgcctcttctcta

SEQ ID NO: 162319 - DNA, 16 bp, Homo sapiens
cctgccttatcttgca

SEQ ID NO: 162320 - DNA, 14 bp, Homo sapiens
cctgccttcctcct

SEQ ID NO: 162321 - DNA, 17 bp, Homo sapiens
cctgccttcctcctggg

SEQ ID NO: 162322 - DNA, 18 bp, Homo sapiens
cctgccttcttcggggaa

SEQ ID NO: 162323 - DNA, 16 bp, Homo sapiens
cctgcggcctgctgga

SEQ ID NO: 162324 - DNA, 17 bp, Homo sapiens
cctgcggcctgctggag

SEQ ID NO: 162325 - DNA, 16 bp, Homo sapiens
cctgctctcctcttgc

SEQ ID NO: 162326 - DNA, 18 bp, Homo sapiens
cctgctctcctcttgcca

SEQ ID NO: 162327 - DNA, 17 bp, Homo sapiens
cctgctgagggaccagc

SEQ ID NO: 162328 - DNA, 21 bp, Homo sapiens
cctgctgagggaccagccaag

SEQ ID NO: 162329 - DNA, 21 bp, Homo sapiens
cctgctgcaggggctctggag

SEQ ID NO: 162330 - DNA, 13 bp, Homo sapiens
cctgtcctcctcg

SEQ ID NO: 162331 - DNA, 23 bp, Homo sapiens
cctgtcctcctcggatcaccgag

SEQ ID NO: 162332 - DNA, 12 bp, Homo sapiens
cctgtccttgca

SEQ ID NO: 162333 - DNA, 17 bp, Homo sapiens
cctgtctctactaaaaa

SEQ ID NO: 162334 - DNA, 15 bp, Homo sapiens
cctgtctgccagcca

SEQ ID NO: 162335 - DNA, 20 bp, Homo sapiens
cctgtggatgagccctcaga

SEQ ID NO: 162336 - DNA, 18 bp, Homo sapiens
cctgtggatgtaaagtga

SEQ ID NO: 162337 - DNA, 15 bp, Homo sapiens
cctgtggcggtgcct

SEQ ID NO: 162338 - DNA, 17 bp, Homo sapiens
cctgtggcggtgcctgg

SEQ ID NO: 162339 - DNA, 16 bp, Homo sapiens
cctgtgttgtctctag

SEQ ID NO: 162340 - DNA, 21 bp, Homo sapiens
cctgttacctaattagagcag

SEQ ID NO: 162341 - DNA, 21 bp, Homo sapiens
cctgttcactctacttagcat

SEQ ID NO: 162342 - DNA, 12 bp, Homo sapiens
cctgttcccatt

SEQ ID NO: 162343 - DNA, 15 bp, Homo sapiens
cctgtttaatattta

SEQ ID NO: 162344 - DNA, 19 bp, Homo sapiens
cctgtttttaagctgtttc

SEQ ID NO: 162345 - DNA, 17 bp, Homo sapiens
cctgtttttctgggtgg

SEQ ID NO: 162346 - DNA, 20 bp, Homo sapiens
ccttaaacaaaaattaaaat

SEQ ID NO: 162347 - DNA, 15 bp, Homo sapiens
ccttaccaactttct

SEQ ID NO: 162348 - DNA, 19 bp, Homo sapiens
ccttaccaactttctgtaa

SEQ ID NO: 162349 - DNA, 21 bp, Homo sapiens
ccttaccatgtgcctgatcca

SEQ ID NO: 162350 - DNA, 18 bp, Homo sapiens
ccttacctcctgcccagg

SEQ ID NO: 162351 - DNA, 20 bp, Homo sapiens
ccttacctcctgcccaggag

SEQ ID NO: 162352 - DNA, 16 bp, Homo sapiens
ccttagagacatcaaa

SEQ ID NO: 162353 - DNA, 16 bp, Homo sapiens
ccttagcaaattctgt

SEQ ID NO: 162354 - DNA, 19 bp, Homo sapiens
ccttagcttagacctcagc

SEQ ID NO: 162355 - DNA, 16 bp, Homo sapiens
ccttaggcagggaagt

SEQ ID NO: 162356 - DNA, 16 bp, Homo sapiens
ccttattgtacctctc

SEQ ID NO: 162357 - DNA, 23 bp, Homo sapiens
ccttcaagatcatgtaccccaat

SEQ ID NO: 162358 - DNA, 16 bp, Homo sapiens
ccttcagtgcccacca

SEQ ID NO: 162359 - DNA, 19 bp, Homo sapiens
ccttccatgtcgcctctgc

SEQ ID NO: 162360 - DNA, 20 bp, Homo sapiens
ccttccatgtcgcctctgca

SEQ ID NO: 162361 - DNA, 14 bp, Homo sapiens
ccttcccagctctc

SEQ ID NO: 162362 - DNA, 18 bp, Homo sapiens
ccttcccagctctccctc

SEQ ID NO: 162363 - DNA, 21 bp, Homo sapiens
ccttcccagctctccctctgg

SEQ ID NO: 162364 - DNA, 15 bp, Homo sapiens
ccttccccagcctct

SEQ ID NO: 162365 - DNA, 18 bp, Homo sapiens
ccttccccttgcccaggg

SEQ ID NO: 162366 - DNA, 22 bp, Homo sapiens
ccttccccttgcccagggctca

SEQ ID NO: 162367 - DNA, 19 bp, Homo sapiens
ccttccgtaacccaactct

SEQ ID NO: 162368 - DNA, 16 bp, Homo sapiens
ccttcctacagatagt

SEQ ID NO: 162369 - DNA, 16 bp, Homo sapiens
ccttcctctccactgc

SEQ ID NO: 162370 - DNA, 18 bp, Homo sapiens
ccttcctgccacctgctg

SEQ ID NO: 162371 - DNA, 20 bp, Homo sapiens
ccttcctggagactgcccag

SEQ ID NO: 162372 - DNA, 14 bp, Homo sapiens
ccttccttccctgg

SEQ ID NO: 162373 - DNA, 15 bp, Homo sapiens
ccttccttccctggc

SEQ ID NO: 162374 - DNA, 23 bp, Homo sapiens
ccttccttgaccagcagatccca

SEQ ID NO: 162375 - DNA, 15 bp, Homo sapiens
ccttcgatacaccgg

SEQ ID NO: 162376 - DNA, 22 bp, Homo sapiens
ccttcgatacaccgggcctgga

SEQ ID NO: 162377 - DNA, 20 bp, Homo sapiens
ccttcggacaactcagtccc

SEQ ID NO: 162378 - DNA, 19 bp, Homo sapiens
ccttctctcacctcctaaa

SEQ ID NO: 162379 - DNA, 19 bp, Homo sapiens
ccttctgtccctcacagca

SEQ ID NO: 162380 - DNA, 19 bp, Homo sapiens
ccttcttattctcactcca

SEQ ID NO: 162381 - DNA, 21 bp, Homo sapiens
ccttcttcggggaactcctgg

SEQ ID NO: 162382 - DNA, 20 bp, Homo sapiens
ccttgaaaactttatgctaa

SEQ ID NO: 162383 - DNA, 14 bp, Homo sapiens
ccttgaactcctgg

SEQ ID NO: 162384 - DNA, 14 bp, Homo sapiens
ccttgacacctgct

SEQ ID NO: 162385 - DNA, 12 bp, Homo sapiens
ccttgaccagca

SEQ ID NO: 162386 - DNA, 21 bp, Homo sapiens
ccttgagagtatcaggtctcc

SEQ ID NO: 162387 - DNA, 21 bp, Homo sapiens
ccttgagggtgcttgttccct

SEQ ID NO: 162388 - DNA, 22 bp, Homo sapiens
ccttgagttgattcagctctgc

SEQ ID NO: 162389 - DNA, 14 bp, Homo sapiens
ccttgcacccctca

SEQ ID NO: 162390 - DNA, 17 bp, Homo sapiens
ccttgcacccctcactc

SEQ ID NO: 162391 - DNA, 12 bp, Homo sapiens
ccttgcccagag

SEQ ID NO: 162392 - DNA, 13 bp, Homo sapiens
ccttgcccagaga

SEQ ID NO: 162393 - DNA, 19 bp, Homo sapiens
ccttgcccagagatgcctc

SEQ ID NO: 162394 - DNA, 21 bp, Homo sapiens
ccttgcccagagatgcctcca

SEQ ID NO: 162395 - DNA, 23 bp, Homo sapiens
ccttgcccagagatgcctccacc

SEQ ID NO: 162396 - DNA, 17 bp, Homo sapiens
ccttgcccagggctcag

SEQ ID NO: 162397 - DNA, 21 bp, Homo sapiens
ccttgcccagggctcagcctg

SEQ ID NO: 162398 - DNA, 18 bp, Homo sapiens
ccttggataatgctgttg

SEQ ID NO: 162399 - DNA, 17 bp, Homo sapiens
ccttggcatgccttcca

SEQ ID NO: 162400 - DNA, 20 bp, Homo sapiens
ccttggcatgccttccagca

SEQ ID NO: 162401 - DNA, 21 bp, Homo sapiens
ccttggcatgccttccagcac

SEQ ID NO: 162402 - DNA, 20 bp, Homo sapiens
ccttggcttcaggggagtcc

SEQ ID NO: 162403 - DNA, 15 bp, Homo sapiens
ccttggcttgcccac

SEQ ID NO: 162404 - DNA, 18 bp, Homo sapiens
ccttggcttgcccacgtg

SEQ ID NO: 162405 - DNA, 14 bp, Homo sapiens
ccttgggccctttg

SEQ ID NO: 162406 - DNA, 12 bp, Homo sapiens
ccttgggctccc

SEQ ID NO: 162407 - DNA, 13 bp, Homo sapiens
ccttgggctccct

SEQ ID NO: 162408 - DNA, 19 bp, Homo sapiens
ccttgtaattctaaatgaa

SEQ ID NO: 162409 - DNA, 14 bp, Homo sapiens
ccttgtatttaaat

SEQ ID NO: 162410 - DNA, 22 bp, Homo sapiens
ccttgtttgattttagctgcag

SEQ ID NO: 162411 - DNA, 15 bp, Homo sapiens
cctttacttgacctc

SEQ ID NO: 162412 - DNA, 19 bp, Homo sapiens
cctttatatttagtgaact

SEQ ID NO: 162413 - DNA, 19 bp, Homo sapiens
cctttcaccccagggcctg

SEQ ID NO: 162414 - DNA, 13 bp, Homo sapiens
cctttccagcatg

SEQ ID NO: 162415 - DNA, 17 bp, Homo sapiens
cctttccccagcccagg

SEQ ID NO: 162416 - DNA, 12 bp, Homo sapiens
cctttccctcca

SEQ ID NO: 162417 - DNA, 12 bp, Homo sapiens
cctttccttcct

SEQ ID NO: 162418 - DNA, 13 bp, Homo sapiens
cctttccttcctt

SEQ ID NO: 162419 - DNA, 17 bp, Homo sapiens
cctttctcccaggccag

SEQ ID NO: 162420 - DNA, 13 bp, Homo sapiens
cctttctgtgtgc

SEQ ID NO: 162421 - DNA, 13 bp, Homo sapiens
cctttgaagagga

SEQ ID NO: 162422 - DNA, 19 bp, Homo sapiens
cctttgagtgcagtcctga

SEQ ID NO: 162423 - DNA, 21 bp, Homo sapiens
cctttgccccacctttattaa

SEQ ID NO: 162424 - DNA, 17 bp, Homo sapiens
cctttgctgtgaggctg

SEQ ID NO: 162425 - DNA, 15 bp, Homo sapiens
cctttggctctggag

SEQ ID NO: 162426 - DNA, 16 bp, Homo sapiens
cctttggctctggaga

SEQ ID NO: 162427 - DNA, 19 bp, Homo sapiens
cctttggctctggagacag

SEQ ID NO: 162428 - DNA, 22 bp, Homo sapiens
cctttttgaagtgtaggcagac

SEQ ID NO: 162429 - DNA, 23 bp, Homo sapiens
cgaaaggatgtaaacagtgcctg

SEQ ID NO: 162430 - DNA, 20 bp, Homo sapiens
cctgtggcggtgcctgggtg

SEQ ID NO: 162431 - DNA, 13 bp, Homo sapiens
cctgtgtagctgg

SEQ ID NO: 162432 - DNA, 23 bp, Homo sapiens
cctgtgtcttctccaccacgctg

SEQ ID NO: 162433 - DNA, 22 bp, Homo sapiens
cctgtgttgtctctagagcagg

SEQ ID NO: 162434 - DNA, 14 bp, Homo sapiens
cctgtttaatattt

SEQ ID NO: 162435 - DNA, 16 bp, Homo sapiens
cctgtttaatatttaa

SEQ ID NO: 162436 - DNA, 15 bp, Homo sapiens
cctgtttttctgggt

SEQ ID NO: 162437 - DNA, 23 bp, Homo sapiens
ccttaaagaaagtcgaattaata

SEQ ID NO: 162438 - DNA, 22 bp, Homo sapiens
ccttaaaggcaccatctaatag

SEQ ID NO: 162439 - DNA, 17 bp, Homo sapiens
ccttacagtaggagccc

SEQ ID NO: 162440 - DNA, 17 bp, Homo sapiens
ccttaccaactttctgt

SEQ ID NO: 162441 - DNA, 14 bp, Homo sapiens
ccttacccatctgc

SEQ ID NO: 162442 - DNA, 13 bp, Homo sapiens
ccttacctcctgc

SEQ ID NO: 162443 - DNA, 14 bp, Homo sapiens
ccttacctcctgcc

SEQ ID NO: 162444 - DNA, 17 bp, Homo sapiens
ccttacctcctgcccag

SEQ ID NO: 162445 - DNA, 20 bp, Homo sapiens
ccttacctcggtgccttcct

SEQ ID NO: 162446 - DNA, 15 bp, Homo sapiens
ccttagaacctttct

SEQ ID NO: 162447 - DNA, 18 bp, Homo sapiens
ccttagaacctttcttac

SEQ ID NO: 162448 - DNA, 20 bp, Homo sapiens
ccttagcactaccactcctg

SEQ ID NO: 162449 - DNA, 18 bp, Homo sapiens
ccttagcttagacctcag

SEQ ID NO: 162450 - DNA, 21 bp, Homo sapiens
ccttagcttagacctcagcct

SEQ ID NO: 162451 - DNA, 22 bp, Homo sapiens
ccttagcttagacctcagcctg

SEQ ID NO: 162452 - DNA, 23 bp, Homo sapiens
ccttagcttagacctcagcctgt

SEQ ID NO: 162453 - DNA, 13 bp, Homo sapiens
ccttaggcaggga

SEQ ID NO: 162454 - DNA, 16 bp, Homo sapiens
ccttattagagtgtct

SEQ ID NO: 162455 - DNA, 15 bp, Homo sapiens
ccttattgtacctct

SEQ ID NO: 162456 - DNA, 12 bp, Homo sapiens
ccttcagtgccc

SEQ ID NO: 162457 - DNA, 14 bp, Homo sapiens
ccttcagtgcccac

SEQ ID NO: 162458 - DNA, 18 bp, Homo sapiens
ccttcagtgcccaccaac

SEQ ID NO: 162459 - DNA, 16 bp, Homo sapiens
ccttccaacaggagct

SEQ ID NO: 162460 - DNA, 15 bp, Homo sapiens
ccttccactgagggc

SEQ ID NO: 162461 - DNA, 17 bp, Homo sapiens
ccttccactgagggcag

SEQ ID NO: 162462 - DNA, 23 bp, Homo sapiens
ccttccatggtgtgatcgtctga

SEQ ID NO: 162463 - DNA, 15 bp, Homo sapiens
ccttcccatgccctg

SEQ ID NO: 162464 - DNA, 20 bp, Homo sapiens
ccttccccttgcccagggct

SEQ ID NO: 162465 - DNA, 12 bp, Homo sapiens
ccttcctcctgg

SEQ ID NO: 162466 - DNA, 15 bp, Homo sapiens
ccttcctctccactg

SEQ ID NO: 162467 - DNA, 20 bp, Homo sapiens
ccttcctctccactgccttc

SEQ ID NO: 162468 - DNA, 19 bp, Homo sapiens
ccttcctgtcttcctgcat

SEQ ID NO: 162469 - DNA, 16 bp, Homo sapiens
ccttctctcacctcct

SEQ ID NO: 162470 - DNA, 14 bp, Homo sapiens
ccttctcttaattt

SEQ ID NO: 162471 - DNA, 18 bp, Homo sapiens
ccttctgtccctcacagc

SEQ ID NO: 162472 - DNA, 17 bp, Homo sapiens
cgggctgggcagctgtt

SEQ ID NO: 162473 - DNA, 14 bp, Homo sapiens
cggggaactcctgg

SEQ ID NO: 162474 - DNA, 14 bp, Homo sapiens
cggggccccagggc

SEQ ID NO: 162475 - DNA, 19 bp, Homo sapiens
cggtcccttgagacctcag

SEQ ID NO: 162476 - DNA, 11 bp, Homo sapiens
cggtctcaggc

SEQ ID NO: 162477 - DNA, 16 bp, Homo sapiens
cggtgtgcaccagggt

SEQ ID NO: 162478 - DNA, 12 bp, Homo sapiens
cgtaacccaact

SEQ ID NO: 162479 - DNA, 19 bp, Homo sapiens
cgtaacccaactctcctgg

SEQ ID NO: 162480 - DNA, 17 bp, Homo sapiens
cgtcagaagcacccagg

SEQ ID NO: 162481 - DNA, 20 bp, Homo sapiens
cgtcatggcttaatgtttat

SEQ ID NO: 162482 - DNA, 14 bp, Homo sapiens
cgtcctcacccctg

SEQ ID NO: 162483 - DNA, 13 bp, Homo sapiens
cgtcctgccacct

SEQ ID NO: 162484 - DNA, 16 bp, Homo sapiens
cgtcctgccacctggg

SEQ ID NO: 162485 - DNA, 17 bp, Homo sapiens
cgtcgaggggctctcag

SEQ ID NO: 162486 - DNA, 22 bp, Homo sapiens
cgtctctccctccctttgaaat

SEQ ID NO: 162487 - DNA, 23 bp, Homo sapiens
cgtctggggttcagcccctcctc

SEQ ID NO: 162488 - DNA, 12 bp, Homo sapiens
cgtcttcattaa

SEQ ID NO: 162489 - DNA, 19 bp, Homo sapiens
cgtcttctgtatactgtgg

SEQ ID NO: 162490 - DNA, 16 bp, Homo sapiens
cgtgactcacccaagc

SEQ ID NO: 162491 - DNA, 23 bp, Homo sapiens
cgtgactgccccaactcctggaa

SEQ ID NO: 162492 - DNA, 19 bp, Homo sapiens
cgtgccaggcccggggctg

SEQ ID NO: 162493 - DNA, 22 bp, Homo sapiens
cgtggcagataatcagcctctt

SEQ ID NO: 162494 - DNA, 13 bp, Homo sapiens
cgtggcatcacct

SEQ ID NO: 162495 - DNA, 23 bp, Homo sapiens
cgtggcctcttgagcagtggctg

SEQ ID NO: 162496 - DNA, 20 bp, Homo sapiens
cgtggccttccccagcctct

SEQ ID NO: 162497 - DNA, 13 bp, Homo sapiens
cgtggctctgctg

SEQ ID NO: 162498 - DNA, 20 bp, Homo sapiens
cgtggcttcccgctcagccc

SEQ ID NO: 162499 - DNA, 22 bp, Homo sapiens
cgtgggagacaagaaatccctg

SEQ ID NO: 162500 - DNA, 13 bp, Homo sapiens
cgtgggctccctg

SEQ ID NO: 162501 - DNA, 20 bp, Homo sapiens
cgtggggcagcacagagagg

SEQ ID NO: 162502 - DNA, 21 bp, Homo sapiens
cgtggtccccaacagcgacat

SEQ ID NO: 162503 - DNA, 16 bp, Homo sapiens
cgtgtgcgtgcatgtg

SEQ ID NO: 162504 - DNA, 17 bp, Homo sapiens
cgtgtgtccatgtgtgt

SEQ ID NO: 162505 - DNA, 14 bp, Homo sapiens
cgttctgctcatca

SEQ ID NO: 162506 - DNA, 17 bp, Homo sapiens
cgtttactatgcctgtg

SEQ ID NO: 162507 - DNA, 22 bp, Homo sapiens
cgtttcatttagtcatgtgacc

SEQ ID NO: 162508 - DNA, 11 bp, Homo sapiens
cgtttccatca

SEQ ID NO: 162509 - DNA, 22 bp, Homo sapiens
ctaaaaaacataaatttcttta

SEQ ID NO: 162510 - DNA, 11 bp, Homo sapiens
ctaaaaaagat

SEQ ID NO: 162511 - DNA, 13 bp, Homo sapiens
ctaaaaatgcaac

SEQ ID NO: 162512 - DNA, 18 bp, Homo sapiens
ctaaagcagtggacacca

SEQ ID NO: 162513 - DNA, 23 bp, Homo sapiens
ctaaataaagcttgcaacaaaat

SEQ ID NO: 162514 - DNA, 12 bp, Homo sapiens
ctaaatgaatgt

SEQ ID NO: 162515 - DNA, 16 bp, Homo sapiens
ctaaatgaatgtttac

SEQ ID NO: 162516 - DNA, 19 bp, Homo sapiens
ctaaattgacacttaaaaa

SEQ ID NO: 162517 - DNA, 23 bp, Homo sapiens
ctaaattgacacttaaaaatggt

SEQ ID NO: 162518 - DNA, 23 bp, Homo sapiens
ctaaatttgaatgttaagcagat

SEQ ID NO: 162519 - DNA, 14 bp, Homo sapiens
ctaacacccagtct

SEQ ID NO: 162520 - DNA, 12 bp, Homo sapiens
ctaacatataat

SEQ ID NO: 162521 - DNA, 12 bp, Homo sapiens
ctaacctcatct

SEQ ID NO: 162522 - DNA, 12 bp, Homo sapiens
ctaacctgtgac

SEQ ID NO: 162523 - DNA, 19 bp, Homo sapiens
ctaactaaactctctttgg

SEQ ID NO: 162524 - DNA, 14 bp, Homo sapiens
ctaactccagtgaa

SEQ ID NO: 162525 - DNA, 21 bp, Homo sapiens
ctaacttggagccccagtgcc

SEQ ID NO: 162526 - DNA, 18 bp, Homo sapiens
ctaagagtgtcctaggag

SEQ ID NO: 162527 - DNA, 18 bp, Homo sapiens
ctaagcaaaatgtgatat

SEQ ID NO: 162528 - DNA, 19 bp, Homo sapiens
ctaaggatgtcacagggcc

SEQ ID NO: 162529 - DNA, 19 bp, Homo sapiens
ctaaggccgaagaagggtc

SEQ ID NO: 162530 - DNA, 18 bp, Homo sapiens
ctaagtaaaaccacagca

SEQ ID NO: 162531 - DNA, 20 bp, Homo sapiens
ctaagtaaaaccacagcagt

SEQ ID NO: 162532 - DNA, 20 bp, Homo sapiens
ctaagtgaaataagccagac

SEQ ID NO: 162533 - DNA, 14 bp, Homo sapiens
ctaagtgatataaa

SEQ ID NO: 162534 - DNA, 13 bp, Homo sapiens
ctaataaaagcat

SEQ ID NO: 162535 - DNA, 20 bp, Homo sapiens
ctaatagaactcagttttaa

SEQ ID NO: 162536 - DNA, 13 bp, Homo sapiens
ctaatattaaaaa

SEQ ID NO: 162537 - DNA, 18 bp, Homo sapiens
ctaatattaaaaatatgg

SEQ ID NO: 162538 - DNA, 17 bp, Homo sapiens
ctaatcagcattctcac

SEQ ID NO: 162539 - DNA, 19 bp, Homo sapiens
ctaatcagcattctcactc

SEQ ID NO: 162540 - DNA, 19 bp, Homo sapiens
ctaatcagggaggtcattt

SEQ ID NO: 162541 - DNA, 21 bp, Homo sapiens
ctaatcagggaggtcattttg

SEQ ID NO: 162542 - DNA, 23 bp, Homo sapiens
ctaatgaagggaaaggatatttt

SEQ ID NO: 162543 - DNA, 19 bp, Homo sapiens
ctaatgaatgcataaaatg

SEQ ID NO: 162544 - DNA, 19 bp, Homo sapiens
ctaatgtaataactgtgaa

SEQ ID NO: 162545 - DNA, 16 bp, Homo sapiens
ctaatgtactgcatat

SEQ ID NO: 162546 - DNA, 18 bp, Homo sapiens
ctaattatataatatttt

SEQ ID NO: 162547 - DNA, 12 bp, Homo sapiens
ctaatttaaaaa

SEQ ID NO: 162548 - DNA, 14 bp, Homo sapiens
ctaatttaaaaaat

SEQ ID NO: 162549 - DNA, 17 bp, Homo sapiens
ctacaaaaacacagcaa

SEQ ID NO: 162550 - DNA, 16 bp, Homo sapiens
ctacaacaagagttta

SEQ ID NO: 162551 - DNA, 16 bp, Homo sapiens
ctacacccttttccag

SEQ ID NO: 162552 - DNA, 16 bp, Homo sapiens
ctacactccagtgaga

SEQ ID NO: 162553 - DNA, 18 bp, Homo sapiens
ctacagagcttccctgac

SEQ ID NO: 162554 - DNA, 15 bp, Homo sapiens
ctacagatagtcaaa

SEQ ID NO: 162555 - DNA, 18 bp, Homo sapiens
ctacagctaatcagcatt

SEQ ID NO: 162556 - DNA, 21 bp, Homo sapiens
ctacagctaatcagcattctc

SEQ ID NO: 162557 - DNA, 14 bp, Homo sapiens
ctacagtcaggaaa

SEQ ID NO: 162558 - DNA, 21 bp, Homo sapiens
ctacagttgaaaaacagctga

SEQ ID NO: 162559 - DNA, 23 bp, Homo sapiens
ctacataagtaattcaagaaaac

SEQ ID NO: 162560 - DNA, 18 bp, Homo sapiens
ctaccaatagattcccca

SEQ ID NO: 162561 - DNA, 16 bp, Homo sapiens
ctaccacctccccagc

SEQ ID NO: 162562 - DNA, 20 bp, Homo sapiens
ctaccagactgtgtattcat

SEQ ID NO: 162563 - DNA, 16 bp, Homo sapiens
ctacccagggcctgca

SEQ ID NO: 162564 - DNA, 14 bp, Homo sapiens
ctaccccaccacga

SEQ ID NO: 162565 - DNA, 17 bp, Homo sapiens
ctaccgagtctcttctc

SEQ ID NO: 162566 - DNA, 19 bp, Homo sapiens
ctaccgagtctcttctcca

SEQ ID NO: 162567 - DNA, 14 bp, Homo sapiens
ctacgctctccttt

SEQ ID NO: 162568 - DNA, 21 bp, Homo sapiens
ctacgctctcctttctttcta

SEQ ID NO: 162569 - DNA, 23 bp, Homo sapiens
ctactaacaatcagctccttcct

SEQ ID NO: 162570 - DNA, 22 bp, Homo sapiens
ctactagagtctgaacagctgt

SEQ ID NO: 162571 - DNA, 16 bp, Homo sapiens
ctactcagcagccctc

SEQ ID NO: 162572 - DNA, 21 bp, Homo sapiens
ctactcagcagccctcctcac

SEQ ID NO: 162573 - DNA, 15 bp, Homo sapiens
ctactcaggaggctg

SEQ ID NO: 162574 - DNA, 23 bp, Homo sapiens
ctactcaggaggctgaggcagaa

SEQ ID NO: 162575 - DNA, 22 bp, Homo sapiens
ctactctcaggatcaagaaagt

SEQ ID NO: 162576 - DNA, 16 bp, Homo sapiens
ctactgatttttgtga

SEQ ID NO: 162577 - DNA, 17 bp, Homo sapiens
ctacttagcatgtccct

SEQ ID NO: 162578 - DNA, 22 bp, Homo sapiens
ctacttagcatgtccctaccga

SEQ ID NO: 162579 - DNA, 18 bp, Homo sapiens
ctagaacatccctgccag

SEQ ID NO: 162580 - DNA, 18 bp, Homo sapiens
ctagactcccaagctgga

SEQ ID NO: 162581 - DNA, 17 bp, Homo sapiens
ctagagatatggcagcg

SEQ ID NO: 162582 - DNA, 16 bp, Homo sapiens
ctagagtctgaacagc

SEQ ID NO: 162583 - DNA, 20 bp, Homo sapiens
ctagattctacatattcttt

SEQ ID NO: 162584 - DNA, 12 bp, Homo sapiens
ctagcagcaggg

SEQ ID NO: 162585 - DNA, 22 bp, Homo sapiens
ctagcccaggagagagaaagcc

SEQ ID NO: 162586 - DNA, 21 bp, Homo sapiens
ctagcctgtgcctctgggact

SEQ ID NO: 162587 - DNA, 22 bp, Homo sapiens
ctagcctgtgcctctgggactg

SEQ ID NO: 162588 - DNA, 15 bp, Homo sapiens
ctagcctttggctct

SEQ ID NO: 162589 - DNA, 18 bp, Homo sapiens
ctagcctttggctctgga

SEQ ID NO: 162590 - DNA, 11 bp, Homo sapiens
ctaaactgcat

SEQ ID NO: 162591 - DNA, 19 bp, Homo sapiens
ctaaagaaaaagtcatcca

SEQ ID NO: 162592 - DNA, 21 bp, Homo sapiens
ctaaagaaggtttcagaaaga

SEQ ID NO: 162593 - DNA, 13 bp, Homo sapiens
ctaaaggcctctt

SEQ ID NO: 162594 - DNA, 17 bp, Homo sapiens
ctaaagtagacttcatt

SEQ ID NO: 162595 - DNA, 20 bp, Homo sapiens
ctaaagtatgtaaagtatgt

SEQ ID NO: 162596 - DNA, 14 bp, Homo sapiens
ctaaatgaatgttt

SEQ ID NO: 162597 - DNA, 15 bp, Homo sapiens
ctaaatgaatgttta

SEQ ID NO: 162598 - DNA, 13 bp, Homo sapiens
ctaaccacatcaa

SEQ ID NO: 162599 - DNA, 13 bp, Homo sapiens
ctaacccctttcc

SEQ ID NO: 162600 - DNA, 20 bp, Homo sapiens
ctaactgctacaaatactct

SEQ ID NO: 162601 - DNA, 22 bp, Homo sapiens
ctaacttggagccccagtgcca

SEQ ID NO: 162602 - DNA, 15 bp, Homo sapiens
ctaagcaaaatgtga

SEQ ID NO: 162603 - DNA, 14 bp, Homo sapiens
ctaagccaagggcc

SEQ ID NO: 162604 - DNA, 20 bp, Homo sapiens
ctaaggatgtcacagggcca

SEQ ID NO: 162605 - DNA, 19 bp, Homo sapiens
ctaagtaaaaccacagcag

SEQ ID NO: 162606 - DNA, 23 bp, Homo sapiens
ctaagtaaaaccacagcagttga

SEQ ID NO: 162607 - DNA, 16 bp, Homo sapiens
ctaagtctttccattg

SEQ ID NO: 162608 - DNA, 23 bp, Homo sapiens
ctaagtgaaataagccagacatc

SEQ ID NO: 162609 - DNA, 21 bp, Homo sapiens
ctaatatatttttatatttag

SEQ ID NO: 162610 - DNA, 14 bp, Homo sapiens
ctaatattaaaaat

SEQ ID NO: 162611 - DNA, 15 bp, Homo sapiens
ctaatcttcagggca

SEQ ID NO: 162612 - DNA, 18 bp, Homo sapiens
ctaatgaagggaaaggat

SEQ ID NO: 162613 - DNA, 19 bp, Homo sapiens
ctacaaaaagcataaaaat

SEQ ID NO: 162614 - DNA, 21 bp, Homo sapiens
ctcacagttcctcgccctggg

SEQ ID NO: 162615 - DNA, 14 bp, Homo sapiens
ctcaccatgtaaaa

SEQ ID NO: 162616 - DNA, 22 bp, Homo sapiens
ctcacccccaaggggcagtctg

SEQ ID NO: 162617 - DNA, 15 bp, Homo sapiens
ctcacccccttctcc

SEQ ID NO: 162618 - DNA, 18 bp, Homo sapiens
ctcacccctgccctggga

SEQ ID NO: 162619 - DNA, 22 bp, Homo sapiens
ctcacccctgtcctcactgctc

SEQ ID NO: 162620 - DNA, 17 bp, Homo sapiens
ctcaccccttgccataa

SEQ ID NO: 162621 - DNA, 13 bp, Homo sapiens
ctcaccctgcctt

SEQ ID NO: 162622 - DNA, 14 bp, Homo sapiens
ctcacctctgcctc

SEQ ID NO: 162623 - DNA, 19 bp, Homo sapiens
ctcacctctgcctcaatgt

SEQ ID NO: 162624 - DNA, 12 bp, Homo sapiens
ctcacctggggt

SEQ ID NO: 162625 - DNA, 20 bp, Homo sapiens
ctcacgcctgtaatcccagc

SEQ ID NO: 162626 - DNA, 21 bp, Homo sapiens
ctcacgcctgtaatcccagca

SEQ ID NO: 162627 - DNA, 22 bp, Homo sapiens
ctcacgcctgtaatcccagcag

SEQ ID NO: 162628 - DNA, 21 bp, Homo sapiens
ctcacgggcatgggcactccc

SEQ ID NO: 162629 - DNA, 17 bp, Homo sapiens
ctcactataccagtata

SEQ ID NO: 162630 - DNA, 16 bp, Homo sapiens
ctcactccaccaccca

SEQ ID NO: 162631 - DNA, 20 bp, Homo sapiens
ctcactccaccacccaaaag

SEQ ID NO: 162632 - DNA, 21 bp, Homo sapiens
ctcactcccttcccataagct

SEQ ID NO: 162633 - DNA, 15 bp, Homo sapiens
ctcactctggcctca

SEQ ID NO: 162634 - DNA, 19 bp, Homo sapiens
ctcactgctccctgaagcc

SEQ ID NO: 162635 - DNA, 20 bp, Homo sapiens
ctcactgctccctgaagcca

SEQ ID NO: 162636 - DNA, 22 bp, Homo sapiens
ctcactggggtcctggggcctc

SEQ ID NO: 162637 - DNA, 14 bp, Homo sapiens
ctcagaacccttgg

SEQ ID NO: 162638 - DNA, 15 bp, Homo sapiens
ctcagaagcctctgg

SEQ ID NO: 162639 - DNA, 17 bp, Homo sapiens
ctcagaagcctctgggt

SEQ ID NO: 162640 - DNA, 11 bp, Homo sapiens
ctcagaatcta

SEQ ID NO: 162641 - DNA, 20 bp, Homo sapiens
ctcagaatctacccaaagga

SEQ ID NO: 162642 - DNA, 15 bp, Homo sapiens
ctcagacccccactc

SEQ ID NO: 162643 - DNA, 21 bp, Homo sapiens
ctcagagggttgttctcctag

SEQ ID NO: 162644 - DNA, 18 bp, Homo sapiens
ctcagagtcggaacggag

SEQ ID NO: 162645 - DNA, 20 bp, Homo sapiens
ctcagatggaaccgcaggaa

SEQ ID NO: 162646 - DNA, 22 bp, Homo sapiens
ctcagatggaaccgcaggaagc

SEQ ID NO: 162647 - DNA, 12 bp, Homo sapiens
ctcagcacttgg

SEQ ID NO: 162648 - DNA, 14 bp, Homo sapiens
ctcagcagccctcc

SEQ ID NO: 162649 - DNA, 21 bp, Homo sapiens
ctcagccatgaggagttgctg

SEQ ID NO: 162650 - DNA, 19 bp, Homo sapiens
ctcagccctccctgcccct

SEQ ID NO: 162651 - DNA, 20 bp, Homo sapiens
ctcagccctccctgcccctc

SEQ ID NO: 162652 - DNA, 11 bp, Homo sapiens
ctcagccctgg

SEQ ID NO: 162653 - DNA, 12 bp, Homo sapiens
ctcagccctggg

SEQ ID NO: 162654 - DNA, 13 bp, Homo sapiens
ctcagcctcccag

SEQ ID NO: 162655 - DNA, 17 bp, Homo sapiens
ctcagcctctgaatatg

SEQ ID NO: 162656 - DNA, 16 bp, Homo sapiens
ctcagcctggtgggcc

SEQ ID NO: 162657 - DNA, 14 bp, Homo sapiens
ctcagcctgtgctg

SEQ ID NO: 162658 - DNA, 18 bp, Homo sapiens
ctcagcctgtgctgcccg

SEQ ID NO: 162659 - DNA, 23 bp, Homo sapiens
ctcagccttccccttgcccaggg

SEQ ID NO: 162660 - DNA, 13 bp, Homo sapiens
ctcagctcagcgc

SEQ ID NO: 162661 - DNA, 17 bp, Homo sapiens
ctcagctttttgtcttt

SEQ ID NO: 162662 - DNA, 22 bp, Homo sapiens
ctcaggaaatcaaatatgcaaa

SEQ ID NO: 162663 - DNA, 14 bp, Homo sapiens
ctcaggactcagaa

SEQ ID NO: 162664 - DNA, 15 bp, Homo sapiens
ctcaggactcctctc

SEQ ID NO: 162665 - DNA, 20 bp, Homo sapiens
ctcaggaggctgaggcagaa

SEQ ID NO: 162666 - DNA, 14 bp, Homo sapiens
ctcaggatgcccag

SEQ ID NO: 162667 - DNA, 18 bp, Homo sapiens
ctcaggcactagcctttg

SEQ ID NO: 162668 - DNA, 13 bp, Homo sapiens
ctcaggctctgcc

SEQ ID NO: 162669 - DNA, 14 bp, Homo sapiens
ctcaggctctgccc

SEQ ID NO: 162670 - DNA, 17 bp, Homo sapiens
ctcaggctctgccctgc

SEQ ID NO: 162671 - DNA, 22 bp, Homo sapiens
ctcaggctctgccctgccctag

SEQ ID NO: 162672 - DNA, 12 bp, Homo sapiens
ctcaggctgctg

SEQ ID NO: 162673 - DNA, 13 bp, Homo sapiens
ctcaggctgctgg

SEQ ID NO: 162674 - DNA, 16 bp, Homo sapiens
ctcaggctgctggagg

SEQ ID NO: 162675 - DNA, 20 bp, Homo sapiens
ctcagggacagagacacctg

SEQ ID NO: 162676 - DNA, 15 bp, Homo sapiens
ctcagggacagagcc

SEQ ID NO: 162677 - DNA, 19 bp, Homo sapiens
ctcagggacagagccatgc

SEQ ID NO: 162678 - DNA, 13 bp, Homo sapiens
ctcagggccccag

SEQ ID NO: 162679 - DNA, 14 bp, Homo sapiens
ctcagggccccagc

SEQ ID NO: 162680 - DNA, 13 bp, Homo sapiens
ctcaggggccaga

SEQ ID NO: 162681 - DNA, 18 bp, Homo sapiens
ctcaggggccagaggaac

SEQ ID NO: 162682 - DNA, 19 bp, Homo sapiens
ctcaggtcagggtgaggat

SEQ ID NO: 162683 - DNA, 20 bp, Homo sapiens
ctcaggtcagggtgaggatg

SEQ ID NO: 162684 - DNA, 18 bp, Homo sapiens
ctcaggtccctgcagggc

SEQ ID NO: 162685 - DNA, 16 bp, Homo sapiens
ctcaggtgagaagcag

SEQ ID NO: 162686 - DNA, 19 bp, Homo sapiens
ctcaggtgagaagcagagg

SEQ ID NO: 162687 - DNA, 20 bp, Homo sapiens
ctcaggtgagaagcagagga

SEQ ID NO: 162688 - DNA, 22 bp, Homo sapiens
ctcaggttgtctgaagtcactg

SEQ ID NO: 162689 - DNA, 23 bp, Homo sapiens
ctcagtcctcccctcacagcctc

SEQ ID NO: 162690 - DNA, 13 bp, Homo sapiens
ctcagtctctgag

SEQ ID NO: 162691 - DNA, 13 bp, Homo sapiens
ctcagtttcccta

SEQ ID NO: 162692 - DNA, 16 bp, Homo sapiens
ctcagtttccctatct

SEQ ID NO: 162693 - DNA, 17 bp, Homo sapiens
ctcagttttatcatttt

SEQ ID NO: 162694 - DNA, 15 bp, Homo sapiens
ctcatacgtccacca

SEQ ID NO: 162695 - DNA, 17 bp, Homo sapiens
ctcatacgtccaccatg

SEQ ID NO: 162696 - DNA, 21 bp, Homo sapiens
ctcataggaaaagtacattta

SEQ ID NO: 162697 - DNA, 14 bp, Homo sapiens
ctcatagggaagac

SEQ ID NO: 162698 - DNA, 19 bp, Homo sapiens
ctcatagggaagacctgct

SEQ ID NO: 162699 - DNA, 20 bp, Homo sapiens
ctcatattcctgcagcctgg

SEQ ID NO: 162700 - DNA, 24 bp, Homo sapiens
ctcatattcctgcagcctggaggc

SEQ ID NO: 162701 - DNA, 12 bp, Homo sapiens
ctcatatttaaa

SEQ ID NO: 162702 - DNA, 12 bp, Homo sapiens
ctcatattttgt

SEQ ID NO: 162703 - DNA, 13 bp, Homo sapiens
ctcatattttgta

SEQ ID NO: 162704 - DNA, 15 bp, Homo sapiens
ctcatcattctctgt

SEQ ID NO: 162705 - DNA, 17 bp, Homo sapiens
ctcatcattctctgtct

SEQ ID NO: 162706 - DNA, 18 bp, Homo sapiens
ctcatcattctctgtctc

SEQ ID NO: 162707 - DNA, 17 bp, Homo sapiens
ctcatgcatctccacct

SEQ ID NO: 162708 - DNA, 22 bp, Homo sapiens
ctcatgcatctccacctgctcc

SEQ ID NO: 162709 - DNA, 21 bp, Homo sapiens
ctcatggagaagcagaaatac

SEQ ID NO: 162710 - DNA, 19 bp, Homo sapiens
ctcattctgaaggagcccc

SEQ ID NO: 162711 - DNA, 18 bp, Homo sapiens
ctcattggacccttccat

SEQ ID NO: 162712 - DNA, 14 bp, Homo sapiens
ctccaacctggaca

SEQ ID NO: 162713 - DNA, 18 bp, Homo sapiens
ctccaagctccatctcca

SEQ ID NO: 162714 - DNA, 19 bp, Homo sapiens
ctccaagctccatctccac

SEQ ID NO: 162715 - DNA, 20 bp, Homo sapiens
ctccacaccctctcccagga

SEQ ID NO: 162716 - DNA, 13 bp, Homo sapiens
ctccacatcctcc

SEQ ID NO: 162717 - DNA, 14 bp, Homo sapiens
ctccacatcctcca

SEQ ID NO: 162718 - DNA, 23 bp, Homo sapiens
ctccacccatcctatcagcctgt

SEQ ID NO: 162719 - DNA, 15 bp, Homo sapiens
ctccaccgctgccta

SEQ ID NO: 162720 - DNA, 19 bp, Homo sapiens
ctccaccgctgcctaagtg

SEQ ID NO: 162721 - DNA, 17 bp, Homo sapiens
ctccacctcagccttgg

SEQ ID NO: 162722 - DNA, 14 bp, Homo sapiens
ctccactccttcct

SEQ ID NO: 162723 - DNA, 19 bp, Homo sapiens
ctccactccttcctgccac

SEQ ID NO: 162724 - DNA, 22 bp, Homo sapiens
ctccactccttcctgccacctg

SEQ ID NO: 162725 - DNA, 15 bp, Homo sapiens
ctccactgccttcga

SEQ ID NO: 162726 - DNA, 16 bp, Homo sapiens
ctccactgccttcgat

SEQ ID NO: 162727 - DNA, 14 bp, Homo sapiens
ctccactggatgga

SEQ ID NO: 162728 - DNA, 11 bp, Homo sapiens
ctccactgtca

SEQ ID NO: 162729 - DNA, 12 bp, Homo sapiens
ctccactgtcac

SEQ ID NO: 162730 - DNA, 20 bp, Homo sapiens
ctccagacaaaccagaagca

SEQ ID NO: 162731 - DNA, 21 bp, Homo sapiens
ctccagacccctggcttttca

SEQ ID NO: 162732 - DNA, 13 bp, Homo sapiens
ctccagagggcac

SEQ ID NO: 162733 - DNA, 20 bp, Homo sapiens
ctccagagggcactctgctt

SEQ ID NO: 162734 - DNA, 21 bp, Homo sapiens
ctccagagggcactctgcttg

SEQ ID NO: 162735 - DNA, 20 bp, Homo sapiens
ctccagcctgggcaacacag

SEQ ID NO: 162736 - DNA, 19 bp, Homo sapiens
ctccagctgggttggaaaa

SEQ ID NO: 162737 - DNA, 13 bp, Homo sapiens
ctccagctgttca

SEQ ID NO: 162738 - DNA, 19 bp, Homo sapiens
ctccagctgttcagctggt

SEQ ID NO: 162739 - DNA, 17 bp, Homo sapiens
ctccaggctgtctttca

SEQ ID NO: 162740 - DNA, 18 bp, Homo sapiens
ctccagggccacgtgcca

SEQ ID NO: 162741 - DNA, 17 bp, Homo sapiens
ctccaggtctcacgggc

SEQ ID NO: 162742 - DNA, 14 bp, Homo sapiens
ctccagtattcttg

SEQ ID NO: 162743 - DNA, 20 bp, Homo sapiens
ctccatccacatgggagccg

SEQ ID NO: 162744 - DNA, 20 bp, Homo sapiens
ctccatcgctgtcatctcag

SEQ ID NO: 162745 - DNA, 14 bp, Homo sapiens
ctccatctccactc

SEQ ID NO: 162746 - DNA, 15 bp, Homo sapiens
ctcccacaaaggaga

SEQ ID NO: 162747 - DNA, 14 bp, Homo sapiens
ctcccacaggccct

SEQ ID NO: 162748 - DNA, 16 bp, Homo sapiens
ctcccacaggcccttc

SEQ ID NO: 162749 - DNA, 21 bp, Homo sapiens
ctcccacaggcccttcctctc

SEQ ID NO: 162750 - DNA, 18 bp, Homo sapiens
ctcagttcatccattcta

SEQ ID NO: 162751 - DNA, 18 bp, Homo sapiens
ctcagttttatcattttc

SEQ ID NO: 162752 - DNA, 21 bp, Homo sapiens
ctcataaaaagcctgcaattt

SEQ ID NO: 162753 - DNA, 23 bp, Homo sapiens
ctcataggaaaagtacatttaat

SEQ ID NO: 162754 - DNA, 13 bp, Homo sapiens
ctcatatttaaag

SEQ ID NO: 162755 - DNA, 15 bp, Homo sapiens
ctcatatttaaagac

SEQ ID NO: 162756 - DNA, 14 bp, Homo sapiens
aaaaaaatctgcag

SEQ ID NO: 162757 - DNA, 15 bp, Homo sapiens
aaaaaatattttcct

SEQ ID NO: 162758 - DNA, 13 bp, Homo sapiens
aaaaacacagcaa

SEQ ID NO: 162759 - DNA, 18 bp, Homo sapiens
aaaaacacagcaagggtg

SEQ ID NO: 162760 - DNA, 20 bp, Homo sapiens
aaaaactctgggaaataaga

SEQ ID NO: 162761 - DNA, 23 bp, Homo sapiens
aaaaagattttcagaaaatatta

SEQ ID NO: 162762 - DNA, 19 bp, Homo sapiens
aaaaaggaaaaaattaata

SEQ ID NO: 162763 - DNA, 22 bp, Homo sapiens
aaaaagtctacgctctcctttc

SEQ ID NO: 162764 - DNA, 17 bp, Homo sapiens
aaaaagtttgccagaag

SEQ ID NO: 162765 - DNA, 18 bp, Homo sapiens
aaaaagtttgccagaagt

SEQ ID NO: 162766 - DNA, 21 bp, Homo sapiens
aaaaataaatttggttctaat

SEQ ID NO: 162767 - DNA, 12 bp, Homo sapiens
aaaaatataaaa

SEQ ID NO: 162768 - DNA, 13 bp, Homo sapiens
aaaaatatattta

SEQ ID NO: 162769 - DNA, 18 bp, Homo sapiens
aaaaatctgcagaaggaa

SEQ ID NO: 162770 - DNA, 20 bp, Homo sapiens
aaaaatctgcagaaggaaaa

SEQ ID NO: 162771 - DNA, 17 bp, Homo sapiens
aaaaatgacagatgttg

SEQ ID NO: 162772 - DNA, 17 bp, Homo sapiens
aaaaatggtttaaatgg

SEQ ID NO: 162773 - DNA, 12 bp, Homo sapiens
aaaaattaaaat

SEQ ID NO: 162774 - DNA, 21 bp, Homo sapiens
aaaaattgttaatttttccta

SEQ ID NO: 162775 - DNA, 19 bp, Homo sapiens
aaaacaatcatttgctttt

SEQ ID NO: 162776 - DNA, 14 bp, Homo sapiens
aaaacaattgtaat

SEQ ID NO: 162777 - DNA, 14 bp, Homo sapiens
aaaacattaagaaa

SEQ ID NO: 162778 - DNA, 15 bp, Homo sapiens
aaaacattaagaaaa

SEQ ID NO: 162779 - DNA, 18 bp, Homo sapiens
aaaacattaagaaaatca

SEQ ID NO: 162780 - DNA, 19 bp, Homo sapiens
aaaacattaagaaaatcat

SEQ ID NO: 162781 - DNA, 23 bp, Homo sapiens
aaaacattaagaaaatcatattg

SEQ ID NO: 162782 - DNA, 14 bp, Homo sapiens
aaaaccacagcagt

SEQ ID NO: 162783 - DNA, 14 bp, Homo sapiens
aaaaccttttgaaa

SEQ ID NO: 162784 - DNA, 18 bp, Homo sapiens
aaaacggttaaaactgtc

SEQ ID NO: 162785 - DNA, 18 bp, Homo sapiens
aaaactaaatctctaata

SEQ ID NO: 162786 - DNA, 13 bp, Homo sapiens
aaaactcattttt

SEQ ID NO: 162787 - DNA, 19 bp, Homo sapiens
aaaactgaaaatctaatat

SEQ ID NO: 162788 - DNA, 16 bp, Homo sapiens
aaaactgactccttag

SEQ ID NO: 162789 - DNA, 20 bp, Homo sapiens
aaaactttcctcgcctgaca

SEQ ID NO: 162790 - DNA, 16 bp, Homo sapiens
aaaagactcagtgttc

SEQ ID NO: 162791 - DNA, 19 bp, Homo sapiens
aaaagagatggcctgagaa

SEQ ID NO: 162792 - DNA, 14 bp, Homo sapiens
ataaaaatattgtg

SEQ ID NO: 162793 - DNA, 22 bp, Homo sapiens
ataaaaatattgtgttgtgaat

SEQ ID NO: 162794 - DNA, 16 bp, Homo sapiens
ataaaacaggtcaata

SEQ ID NO: 162795 - DNA, 18 bp, Homo sapiens
ataaaacattaagaaaat

SEQ ID NO: 162796 - DNA, 18 bp, Homo sapiens
ataaaagcataaatgcaa

SEQ ID NO: 162797 - DNA, 13 bp, Homo sapiens
ataaaataaagta

SEQ ID NO: 162798 - DNA, 13 bp, Homo sapiens
ataaaataaatat

SEQ ID NO: 162799 - DNA, 13 bp, Homo sapiens
ataaaatgaccag

SEQ ID NO: 162800 - DNA, 15 bp, Homo sapiens
ataaaatgaccagta

SEQ ID NO: 162801 - DNA, 18 bp, Homo sapiens
ataaaatgaggacatgtt

SEQ ID NO: 162802 - DNA, 12 bp, Homo sapiens
ataaaatgttga

SEQ ID NO: 162803 - DNA, 17 bp, Homo sapiens
ataaaatgttgaaaagt

SEQ ID NO: 162804 - DNA, 16 bp, Homo sapiens
ataaaattaaagctga

SEQ ID NO: 162805 - DNA, 17 bp, Homo sapiens
ataaacatcacacacac

SEQ ID NO: 162806 - DNA, 17 bp, Homo sapiens
ataaacctaaaaaagat

SEQ ID NO: 162807 - DNA, 22 bp, Homo sapiens
ataaacctaaaaaagatatatt

SEQ ID NO: 162808 - DNA, 15 bp, Homo sapiens
ataaactctaaacat

SEQ ID NO: 162809 - DNA, 12 bp, Homo sapiens
ataaactgactt

SEQ ID NO: 162810 - DNA, 23 bp, Homo sapiens
ataaagatgatctactcagaaat

SEQ ID NO: 162811 - DNA, 14 bp, Homo sapiens
ataaagcctgcttt

SEQ ID NO: 162812 - DNA, 20 bp, Homo sapiens
ataaagcctgttttgtcttt

SEQ ID NO: 162813 - DNA, 22 bp, Homo sapiens
ataaaggttgacaataaatgtg

SEQ ID NO: 162814 - DNA, 19 bp, Homo sapiens
ataaagtatggtattgaaa

SEQ ID NO: 162815 - DNA, 21 bp, Homo sapiens
ataaagttctgagtgttttta

SEQ ID NO: 162816 - DNA, 15 bp, Homo sapiens
ataaatagtttatga

SEQ ID NO: 162817 - DNA, 21 bp, Homo sapiens
ataaatatatataaacctaaa

SEQ ID NO: 162818 - DNA, 21 bp, Homo sapiens
ataaatatatatatatataaa

SEQ ID NO: 162819 - DNA, 15 bp, Homo sapiens
ataaatgtatcttat

SEQ ID NO: 162820 - DNA, 18 bp, Homo sapiens
ataaatgtatcttattca

SEQ ID NO: 162821 - DNA, 19 bp, Homo sapiens
ataaatgtgccttcatttt

SEQ ID NO: 162822 - DNA, 13 bp, Homo sapiens
ataaattgctcct

SEQ ID NO: 162823 - DNA, 16 bp, Homo sapiens
ataaattgctccttga

SEQ ID NO: 162824 - DNA, 18 bp, Homo sapiens
ataaattgctccttgaca

SEQ ID NO: 162825 - DNA, 20 bp, Homo sapiens
ataaatttggttctaataga

SEQ ID NO: 162826 - DNA, 18 bp, Homo sapiens
ataacctatatgatttat

SEQ ID NO: 162827 - DNA, 14 bp, Homo sapiens
ataactaaataaag

SEQ ID NO: 162828 - DNA, 19 bp, Homo sapiens
ataactactccggagacag

SEQ ID NO: 162829 - DNA, 15 bp, Homo sapiens
ataactatgttgata

SEQ ID NO: 162830 - DNA, 15 bp, Homo sapiens
ataactcatcataaa

SEQ ID NO: 162831 - DNA, 17 bp, Homo sapiens
ataactcatcataaaat

SEQ ID NO: 162832 - DNA, 22 bp, Homo sapiens
ataactctgtggcattattgca

SEQ ID NO: 162833 - DNA, 16 bp, Homo sapiens
ataactgaaggagaag

SEQ ID NO: 162834 - DNA, 12 bp, Homo sapiens
ataactgtgaag

SEQ ID NO: 162835 - DNA, 16 bp, Homo sapiens
ataacttaaaatattt

SEQ ID NO: 162836 - DNA, 17 bp, Homo sapiens
ataacttcttaaaagtt

SEQ ID NO: 162837 - DNA, 21 bp, Homo sapiens
ataagaagggatggattccaa

SEQ ID NO: 162838 - DNA, 15 bp, Homo sapiens
ataagaataaaatgt

SEQ ID NO: 162839 - DNA, 18 bp, Homo sapiens
ataagagaaagaaaatga

SEQ ID NO: 162840 - DNA, 20 bp, Homo sapiens
ataagagagaacaactactg

SEQ ID NO: 162841 - DNA, 16 bp, Homo sapiens
ataagatatttttcat

SEQ ID NO: 162842 - DNA, 14 bp, Homo sapiens
ataagattcatatt

SEQ ID NO: 162843 - DNA, 16 bp, Homo sapiens
ataagcagatttaaca

SEQ ID NO: 162844 - DNA, 16 bp, Homo sapiens
ataagcatcaaactct

SEQ ID NO: 162845 - DNA, 22 bp, Homo sapiens
ataagccagacatcaacagata

SEQ ID NO: 162846 - DNA, 13 bp, Homo sapiens
ataagtaagaaaa

SEQ ID NO: 162847 - DNA, 17 bp, Homo sapiens
ataagtaagaaaatatt

SEQ ID NO: 162848 - DNA, 18 bp, Homo sapiens
ataagtaagaaaatattt

SEQ ID NO: 162849 - DNA, 14 bp, Homo sapiens
ataagtctaaataa

SEQ ID NO: 162850 - DNA, 14 bp, Homo sapiens
ataagtgtacatat

SEQ ID NO: 162851 - DNA, 21 bp, Homo sapiens
ataagtttctgggacctcagt

SEQ ID NO: 162852 - DNA, 14 bp, Homo sapiens
ataataaagtgttt

SEQ ID NO: 162853 - DNA, 15 bp, Homo sapiens
ataataaatgtacat

SEQ ID NO: 162854 - DNA, 19 bp, Homo sapiens
ataatatattttaaatatt

SEQ ID NO: 162855 - DNA, 16 bp, Homo sapiens
ataatcagcctcttaa

SEQ ID NO: 162856 - DNA, 17 bp, Homo sapiens
ataatcagcctcttaaa

SEQ ID NO: 162857 - DNA, 20 bp, Homo sapiens
ataatcagtgtgtctaaatt

SEQ ID NO: 162858 - DNA, 22 bp, Homo sapiens
ataatcggcccacagctcccac

SEQ ID NO: 162859 - DNA, 18 bp, Homo sapiens
ataatctggactcctctg

SEQ ID NO: 162860 - DNA, 19 bp, Homo sapiens
ataatctggactcctctgt

SEQ ID NO: 162861 - DNA, 15 bp, Homo sapiens
ataatgaatgaaaca

SEQ ID NO: 162862 - DNA, 14 bp, Homo sapiens
ataatggttgactg

SEQ ID NO: 162863 - DNA, 19 bp, Homo sapiens
ataatgttgttatttaaag

SEQ ID NO: 162864 - DNA, 20 bp, Homo sapiens
ataattaaattttgagttct

SEQ ID NO: 162865 - DNA, 14 bp, Homo sapiens
ataattctactttg

SEQ ID NO: 162866 - DNA, 19 bp, Homo sapiens
ataattcttgtatattatg

SEQ ID NO: 162867 - DNA, 21 bp, Homo sapiens
ataattttaagaaatcaaaga

SEQ ID NO: 162868 - DNA, 15 bp, Homo sapiens
ataattttatgaatg

SEQ ID NO: 162869 - DNA, 19 bp, Homo sapiens
ataatttttaaagtatata

SEQ ID NO: 162870 - DNA, 16 bp, Homo sapiens
ataattttttattcaa

SEQ ID NO: 162871 - DNA, 22 bp, Homo sapiens
ataatttttttcaatatttatt

SEQ ID NO: 162872 - DNA, 14 bp, Homo sapiens
atacaataacataa

SEQ ID NO: 162873 - DNA, 23 bp, Homo sapiens
atacagaaagatggatgtgcttt

SEQ ID NO: 162874 - DNA, 15 bp, Homo sapiens
atacagaactctttc

SEQ ID NO: 162875 - DNA, 19 bp, Homo sapiens
atacagtcttccatttgca

SEQ ID NO: 162876 - DNA, 20 bp, Homo sapiens
atacagtcttccatttgcaa

SEQ ID NO: 162877 - DNA, 15 bp, Homo sapiens
aaagaaatgtaaggg

SEQ ID NO: 162878 - DNA, 17 bp, Homo sapiens
aaagaatggaaggtgga

SEQ ID NO: 162879 - DNA, 13 bp, Homo sapiens
aaagacacctact

SEQ ID NO: 162880 - DNA, 23 bp, Homo sapiens
aaagactaatttaaaaaataact

SEQ ID NO: 162881 - DNA, 17 bp, Homo sapiens
aaagactattcaaacag

SEQ ID NO: 162882 - DNA, 18 bp, Homo sapiens
aaagactattcaaacagt

SEQ ID NO: 162883 - DNA, 21 bp, Homo sapiens
aaagactattcaaacagtctc

SEQ ID NO: 162884 - DNA, 18 bp, Homo sapiens
aaagagcacttaagagaa

SEQ ID NO: 162885 - DNA, 20 bp, Homo sapiens
aaagagcacttaagagaata

SEQ ID NO: 162886 - DNA, 15 bp, Homo sapiens
aaagaggaatgaagt

SEQ ID NO: 162887 - DNA, 20 bp, Homo sapiens
aaagaggcagcttgaaactg

SEQ ID NO: 162888 - DNA, 19 bp, Homo sapiens
aaagaggctgaggcctgga

SEQ ID NO: 162889 - DNA, 23 bp, Homo sapiens
aaagagtagacatttctcttact

SEQ ID NO: 162890 - DNA, 23 bp, Homo sapiens
aaagatatattaaaaatataaaa

SEQ ID NO: 162891 - DNA, 13 bp, Homo sapiens
aaagatgaaaata

SEQ ID NO: 162892 - DNA, 17 bp, Homo sapiens
aaagatgaaaatatttg

SEQ ID NO: 162893 - DNA, 22 bp, Homo sapiens
aaagatggctgtgcctctgcct

SEQ ID NO: 162894 - DNA, 23 bp, Homo sapiens
aaagatggctgtgcctctgcctg

SEQ ID NO: 162895 - DNA, 13 bp, Homo sapiens
aaagattttcaga

SEQ ID NO: 162896 - DNA, 14 bp, Homo sapiens
aaagattttcagaa

SEQ ID NO: 162897 - DNA, 15 bp, Homo sapiens
aaagattttcagaaa

SEQ ID NO: 162898 - DNA, 16 bp, Homo sapiens
aaagcaaatgtgacct

SEQ ID NO: 162899 - DNA, 20 bp, Homo sapiens
aaagcaaggaaactatgtaa

SEQ ID NO: 162900 - DNA, 13 bp, Homo sapiens
aaagcacctgccg

SEQ ID NO: 162901 - DNA, 21 bp, Homo sapiens
aaagcaggggagtatgcaaaa

SEQ ID NO: 162902 - DNA, 18 bp, Homo sapiens
aaagcaggggctacaaga

SEQ ID NO: 162903 - DNA, 20 bp, Homo sapiens
aaagccaaatcaaaatatgt

SEQ ID NO: 162904 - DNA, 22 bp, Homo sapiens
aaagcccttccatgtcgcctct

SEQ ID NO: 162905 - DNA, 18 bp, Homo sapiens
aaagcctgggtgacattt

SEQ ID NO: 162906 - DNA, 21 bp, Homo sapiens
aaagccttgtgtctacagaga

SEQ ID NO: 162907 - DNA, 16 bp, Homo sapiens
aaagctcctgtcctcc

SEQ ID NO: 162908 - DNA, 15 bp, Homo sapiens
aaagctgaaaactgc

SEQ ID NO: 162909 - DNA, 17 bp, Homo sapiens
aaagctgcctgtagtta

SEQ ID NO: 162910 - DNA, 23 bp, Homo sapiens
aaagctgtggccagcttgttatt

SEQ ID NO: 162911 - DNA, 13 bp, Homo sapiens
aaagcttattaaa

SEQ ID NO: 162912 - DNA, 19 bp, Homo sapiens
aaagcttgcaacaaaattc

SEQ ID NO: 162913 - DNA, 23 bp, Homo sapiens
aaaggaaatctcaccccatccca

SEQ ID NO: 162914 - DNA, 19 bp, Homo sapiens
aaaggagagaagagagaaa

SEQ ID NO: 162915 - DNA, 21 bp, Homo sapiens
aaaggagagctagcagcaggg

SEQ ID NO: 162916 - DNA, 20 bp, Homo sapiens
aaaggatgtaaacagtgcct

SEQ ID NO: 162917 - DNA, 23 bp, Homo sapiens
aaaggatgtgatatataagtgta

SEQ ID NO: 162918 - DNA, 14 bp, Homo sapiens
aaaggcaagcactt

SEQ ID NO: 162919 - DNA, 12 bp, Homo sapiens
aaaggccagctg

SEQ ID NO: 162920 - DNA, 20 bp, Homo sapiens
aaaggccagctggcagcaga

SEQ ID NO: 162921 - DNA, 16 bp, Homo sapiens
aaaggctcgattttgt

SEQ ID NO: 162922 - DNA, 18 bp, Homo sapiens
aaaggctcgattttgtat

SEQ ID NO: 162923 - DNA, 18 bp, Homo sapiens
aaagggaagttgtgcctt

SEQ ID NO: 162924 - DNA, 17 bp, Homo sapiens
aaagggagagagagagg

SEQ ID NO: 162925 - DNA, 20 bp, Homo sapiens
aaagggatggcaagatgtgg

SEQ ID NO: 162926 - DNA, 21 bp, Homo sapiens
aaaggtgaaggaatatatggc

SEQ ID NO: 162927 - DNA, 24 bp, Homo sapiens
aaaggtgaaggaatatatggcaga

SEQ ID NO: 162928 - DNA, 12 bp, Homo sapiens
aaagtaaagcta

SEQ ID NO: 162929 - DNA, 13 bp, Homo sapiens
aaagtaaagctaa

SEQ ID NO: 162930 - DNA, 23 bp, Homo sapiens
aaagtaaagctaaaatgatttta

SEQ ID NO: 162931 - DNA, 17 bp, Homo sapiens
aaagtatatatagaatc

SEQ ID NO: 162932 - DNA, 18 bp, Homo sapiens
aaagtatatatagaatct

SEQ ID NO: 162933 - DNA, 15 bp, Homo sapiens
atatgcacaatagca

SEQ ID NO: 162934 - DNA, 14 bp, Homo sapiens
atatgcacttataa

SEQ ID NO: 162935 - DNA, 14 bp, Homo sapiens
atatgcttatacac

SEQ ID NO: 162936 - DNA, 16 bp, Homo sapiens
atatgcttatacactt

SEQ ID NO: 162937 - DNA, 18 bp, Homo sapiens
atatggaacttctaatat

SEQ ID NO: 162938 - DNA, 18 bp, Homo sapiens
atatggactcagttttct

SEQ ID NO: 162939 - DNA, 15 bp, Homo sapiens
atatggcaagaaagc

SEQ ID NO: 162940 - DNA, 17 bp, Homo sapiens
atatggcaagaaagctg

SEQ ID NO: 162941 - DNA, 16 bp, Homo sapiens
atatggcagagttgta

SEQ ID NO: 162942 - DNA, 19 bp, Homo sapiens
atatggcagagttgtaaat

SEQ ID NO: 162943 - DNA, 15 bp, Homo sapiens
atatggctataaata

SEQ ID NO: 162944 - DNA, 15 bp, Homo sapiens
atatgtaaaataaaa

SEQ ID NO: 162945 - DNA, 19 bp, Homo sapiens
atatgtaccatgtacatga

SEQ ID NO: 162946 - DNA, 11 bp, Homo sapiens
atatgtcctgg

SEQ ID NO: 162947 - DNA, 12 bp, Homo sapiens
atatgttcaact

SEQ ID NO: 162948 - DNA, 16 bp, Homo sapiens
atatgttcaactggag

SEQ ID NO: 162949 - DNA, 14 bp, Homo sapiens
atatgttgatgaaa

SEQ ID NO: 162950 - DNA, 22 bp, Homo sapiens
atatgttgatgaaaaatagcaa

SEQ ID NO: 162951 - DNA, 16 bp, Homo sapiens
atattaaaaatataaa

SEQ ID NO: 162952 - DNA, 18 bp, Homo sapiens
atattaaaaatataaaac

SEQ ID NO: 162953 - DNA, 21 bp, Homo sapiens
atattaaaaatataaaactgc

SEQ ID NO: 162954 - DNA, 17 bp, Homo sapiens
atattataacttaaaaa

SEQ ID NO: 162955 - DNA, 16 bp, Homo sapiens
atattatggaagattt

SEQ ID NO: 162956 - DNA, 13 bp, Homo sapiens
atattatgtgttt

SEQ ID NO: 162957 - DNA, 13 bp, Homo sapiens
atattcatttgga

SEQ ID NO: 162958 - DNA, 17 bp, Homo sapiens
atattccctagaaactt

SEQ ID NO: 162959 - DNA, 23 bp, Homo sapiens
atattcttatgtatgtgaaagtt

SEQ ID NO: 162960 - DNA, 16 bp, Homo sapiens
atattgaaaaaataga

SEQ ID NO: 162961 - DNA, 17 bp, Homo sapiens
atattgcttcttctcct

SEQ ID NO: 162962 - DNA, 17 bp, Homo sapiens
atattgtcagatatttt

SEQ ID NO: 162963 - DNA, 12 bp, Homo sapiens
atatttaaacag

SEQ ID NO: 162964 - DNA, 18 bp, Homo sapiens
atatttaaacagcagtgt

SEQ ID NO: 162965 - DNA, 23 bp, Homo sapiens
atatttaatgataagtaaatgct

SEQ ID NO: 162966 - DNA, 19 bp, Homo sapiens
atatttacttcttatacat

SEQ ID NO: 162967 - DNA, 19 bp, Homo sapiens
atatttagattgttaaaat

SEQ ID NO: 162968 - DNA, 13 bp, Homo sapiens
atatttataactc

SEQ ID NO: 162969 - DNA, 15 bp, Homo sapiens
atatttataactcat

SEQ ID NO: 162970 - DNA, 22 bp, Homo sapiens
atatttataactcatcataaaa

SEQ ID NO: 162971 - DNA, 18 bp, Homo sapiens
atatttatgtctatttaa

SEQ ID NO: 162972 - DNA, 14 bp, Homo sapiens
atatttattacctc

SEQ ID NO: 162973 - DNA, 23 bp, Homo sapiens
atatttattattttcacctgttt

SEQ ID NO: 162974 - DNA, 22 bp, Homo sapiens
atatttgtatcacaaatcttaa

SEQ ID NO: 162975 - DNA, 12 bp, Homo sapiens
atattttaaata

SEQ ID NO: 162976 - DNA, 14 bp, Homo sapiens
atattttataattt

SEQ ID NO: 162977 - DNA, 19 bp, Homo sapiens
atattttcaacgcagccct

SEQ ID NO: 162978 - DNA, 21 bp, Homo sapiens
atattttcaccatttgattat

SEQ ID NO: 162979 - DNA, 13 bp, Homo sapiens
atattttgtatat

SEQ ID NO: 162980 - DNA, 20 bp, Homo sapiens
atatttttaaaatatttatt

SEQ ID NO: 162981 - DNA, 16 bp, Homo sapiens
atatttttatatttag

SEQ ID NO: 162982 - DNA, 18 bp, Homo sapiens
atatttttatatttagtt

SEQ ID NO: 162983 - DNA, 21 bp, Homo sapiens
atatttttcatgattttgaaa

SEQ ID NO: 162984 - DNA, 21 bp, Homo sapiens
atcaaaactttcttttctgga

SEQ ID NO: 162985 - DNA, 14 bp, Homo sapiens
atcaaatatgcaaa

SEQ ID NO: 162986 - DNA, 15 bp, Homo sapiens
atcaaatatgcaaag

SEQ ID NO: 162987 - DNA, 14 bp, Homo sapiens
atcaacagataaat

SEQ ID NO: 162988 - DNA, 21 bp, Homo sapiens
atcaagcttcagtttcctggt

SEQ ID NO: 162989 - DNA, 13 bp, Homo sapiens
atcaatcaaaccc

SEQ ID NO: 162990 - DNA, 20 bp, Homo sapiens
atcaatcatctgtgtgaaaa

SEQ ID NO: 162991 - DNA, 19 bp, Homo sapiens
atcaatttttcttatttca

SEQ ID NO: 162992 - DNA, 11 bp, Homo sapiens
atcacacacac

SEQ ID NO: 162993 - DNA, 21 bp, Homo sapiens
atcacagcctctgaaaaccaa

SEQ ID NO: 162994 - DNA, 13 bp, Homo sapiens
atcaccacagttt

SEQ ID NO: 162995 - DNA, 19 bp, Homo sapiens
atcacccttaccatgtgcc

SEQ ID NO: 162996 - DNA, 23 bp, Homo sapiens
atcacccttaccatgtgcctgat

SEQ ID NO: 162997 - DNA, 22 bp, Homo sapiens
atcaccgacgcgtctcctgttt

SEQ ID NO: 162998 - DNA, 20 bp, Homo sapiens
atcaccgagagtagccgaga

SEQ ID NO: 162999 - DNA, 15 bp, Homo sapiens
atcaccttaggcagg

SEQ ID NO: 163000 - DNA, 19 bp, Homo sapiens
atcactggagcaccaggca

SEQ ID NO: 163001 - DNA, 23 bp, Homo sapiens
atcactggagcaccaggcacgaa

SEQ ID NO: 163002 - DNA, 13 bp, Homo sapiens
atcactggatgaa

SEQ ID NO: 163003 - DNA, 23 bp, Homo sapiens
atcacttgaacccgggaggcaga

SEQ ID NO: 163004 - DNA, 15 bp, Homo sapiens
atcacttttcagtga

SEQ ID NO: 163005 - DNA, 17 bp, Homo sapiens
atcagaagataacttga

SEQ ID NO: 163006 - DNA, 14 bp, Homo sapiens
atcagaccctaccc

SEQ ID NO: 163007 - DNA, 16 bp, Homo sapiens
atcagaccctacccca

SEQ ID NO: 163008 - DNA, 18 bp, Homo sapiens
atcagacttcacactgca

SEQ ID NO: 163009 - DNA, 19 bp, Homo sapiens
atcagcctgctccagctgt

SEQ ID NO: 163010 - DNA, 21 bp, Homo sapiens
atcagcctgggcaatgtgata

SEQ ID NO: 163011 - DNA, 14 bp, Homo sapiens
atcagcctgtctct

SEQ ID NO: 163012 - DNA, 17 bp, Homo sapiens
atcagctgctgaaacaa

SEQ ID NO: 163013 - DNA, 18 bp, Homo sapiens
atcaggacccagaggaag

SEQ ID NO: 163014 - DNA, 20 bp, Homo sapiens
atcaggacccagaggaaggg

SEQ ID NO: 163015 - DNA, 15 bp, Homo sapiens
atcaggttccatccc

SEQ ID NO: 163016 - DNA, 15 bp, Homo sapiens
atcagttactcagcc

SEQ ID NO: 163017 - DNA, 17 bp, Homo sapiens
atcataagatatttttc

SEQ ID NO: 163018 - DNA, 20 bp, Homo sapiens
atcatataataaatgtacat

SEQ ID NO: 163019 - DNA, 20 bp, Homo sapiens
atcatcagcatacctttatt

SEQ ID NO: 163020 - DNA, 22 bp, Homo sapiens
atcatcagcatacctttattgt

SEQ ID NO: 163021 - DNA, 18 bp, Homo sapiens
atcatcctttccagcatg

SEQ ID NO: 163022 - DNA, 20 bp, Homo sapiens
atcatctcctgccttcctcc

SEQ ID NO: 163023 - DNA, 23 bp, Homo sapiens
atcatctcctgccttcctcctgg

SEQ ID NO: 163024 - DNA, 13 bp, Homo sapiens
atcatctgtgtga

SEQ ID NO: 163025 - DNA, 19 bp, Homo sapiens
atcatctgtgtgaaaatgg

SEQ ID NO: 163026 - DNA, 15 bp, Homo sapiens
atcatgaaatatgca

SEQ ID NO: 163027 - DNA, 16 bp, Homo sapiens
atcatgacatgttata

SEQ ID NO: 163028 - DNA, 18 bp, Homo sapiens
atcatgtcaggcctgtgt

SEQ ID NO: 163029 - DNA, 19 bp, Homo sapiens
atcatgtcaggcctgtgtg

SEQ ID NO: 163030 - DNA, 20 bp, Homo sapiens
atcatgtccccaaacctgca

SEQ ID NO: 163031 - DNA, 20 bp, Homo sapiens
atcattataactgaaggaga

SEQ ID NO: 163032 - DNA, 12 bp, Homo sapiens
atcattctctgt

SEQ ID NO: 163033 - DNA, 21 bp, Homo sapiens
atcattctctgtctcatccat

SEQ ID NO: 163034 - DNA, 15 bp, Homo sapiens
atcatttgcccttaa

SEQ ID NO: 163035 - DNA, 13 bp, Homo sapiens
atcatttgctttt

SEQ ID NO: 163036 - DNA, 22 bp, Homo sapiens
atccaatgctcaagaaacaact

SEQ ID NO: 163037 - DNA, 14 bp, Homo sapiens
atccaccacctccc

SEQ ID NO: 163038 - DNA, 14 bp, Homo sapiens
atccacccagccca

SEQ ID NO: 163039 - DNA, 21 bp, Homo sapiens
atccactagtgcaaatcatag

SEQ ID NO: 163040 - DNA, 14 bp, Homo sapiens
atccagcctctccc

SEQ ID NO: 163041 - DNA, 16 bp, Homo sapiens
atccagcctctcccct

SEQ ID NO: 163042 - DNA, 17 bp, Homo sapiens
atccagcctctcccctg

SEQ ID NO: 163043 - DNA, 15 bp, Homo sapiens
atccagctatgttat

SEQ ID NO: 163044 - DNA, 14 bp, Homo sapiens
atccatcatcatgt

SEQ ID NO: 163045 - DNA, 16 bp, Homo sapiens
atccatgtttgtaaaa

SEQ ID NO: 163046 - DNA, 18 bp, Homo sapiens
atccatttcatctatttc

SEQ ID NO: 163047 - DNA, 15 bp, Homo sapiens
atcccaccaaccctc

SEQ ID NO: 163048 - DNA, 19 bp, Homo sapiens
atgaccagtaattgtgaaa

SEQ ID NO: 163049 - DNA, 16 bp, Homo sapiens
atgacctcatgcatct

SEQ ID NO: 163050 - DNA, 23 bp, Homo sapiens
atgactaaaaatattataactta

SEQ ID NO: 163051 - DNA, 17 bp, Homo sapiens
atgactcacatgatgca

SEQ ID NO: 163052 - DNA, 21 bp, Homo sapiens
atgactgctccccagccctgg

SEQ ID NO: 163053 - DNA, 22 bp, Homo sapiens
atgactgctccccagccctggc

SEQ ID NO: 163054 - DNA, 23 bp, Homo sapiens
atgactgctccccagccctggct

SEQ ID NO: 163055 - DNA, 18 bp, Homo sapiens
atgagaccactgttatca

SEQ ID NO: 163056 - DNA, 23 bp, Homo sapiens
atgagccgctgtgagcccctggt

SEQ ID NO: 163057 - DNA, 11 bp, Homo sapiens
atgagcctggc

SEQ ID NO: 163058 - DNA, 14 bp, Homo sapiens
atgagcctggcaag

SEQ ID NO: 163059 - DNA, 15 bp, Homo sapiens
atgagctctacccag

SEQ ID NO: 163060 - DNA, 19 bp, Homo sapiens
atgagctctacccagggcc

SEQ ID NO: 163061 - DNA, 20 bp, Homo sapiens
atgaggatgcagagtcagca

SEQ ID NO: 163062 - DNA, 17 bp, Homo sapiens
atgaggtgctgggaggg

SEQ ID NO: 163063 - DNA, 18 bp, Homo sapiens
atgaggtgctgggaggga

SEQ ID NO: 163064 - DNA, 15 bp, Homo sapiens
atgagtgaataaatg

SEQ ID NO: 163065 - DNA, 16 bp, Homo sapiens
atgagtgaataaatgt

SEQ ID NO: 163066 - DNA, 20 bp, Homo sapiens
atgagttgttttcagactca

SEQ ID NO: 163067 - DNA, 20 bp, Homo sapiens
atgagtttttgatagcttta

SEQ ID NO: 163068 - DNA, 21 bp, Homo sapiens
atgagtttttgatagctttat

SEQ ID NO: 163069 - DNA, 15 bp, Homo sapiens
atgataaaacacaaa

SEQ ID NO: 163070 - DNA, 18 bp, Homo sapiens
atgatccctgtgttgtct

SEQ ID NO: 163071 - DNA, 15 bp, Homo sapiens
atgatcctaatgaat

SEQ ID NO: 163072 - DNA, 16 bp, Homo sapiens
atgatcctaggcattt

SEQ ID NO: 163073 - DNA, 15 bp, Homo sapiens
atgatctactcagaa

SEQ ID NO: 163074 - DNA, 18 bp, Homo sapiens
atgatctactcagaaatt

SEQ ID NO: 163075 - DNA, 19 bp, Homo sapiens
aacacagctgagagacttt

SEQ ID NO: 163076 - DNA, 15 bp, Homo sapiens
aacacgcctgcaaac

SEQ ID NO: 163077 - DNA, 18 bp, Homo sapiens
aacactaacatataatgt

SEQ ID NO: 163078 - DNA, 13 bp, Homo sapiens
aacactctatatt

SEQ ID NO: 163079 - DNA, 19 bp, Homo sapiens
aacactggcaacaacaaag

SEQ ID NO: 163080 - DNA, 23 bp, Homo sapiens
aacactggtggaggatggaaagg

SEQ ID NO: 163081 - DNA, 18 bp, Homo sapiens
aacagacaaaaacagcct

SEQ ID NO: 163082 - DNA, 15 bp, Homo sapiens
aacagagaaggcagg

SEQ ID NO: 163083 - DNA, 16 bp, Homo sapiens
aacagagaaggcagga

SEQ ID NO: 163084 - DNA, 13 bp, Homo sapiens
aacagagatgtga

SEQ ID NO: 163085 - DNA, 20 bp, Homo sapiens
aacagatgtttcttttgtat

SEQ ID NO: 163086 - DNA, 19 bp, Homo sapiens
aacagattattaccttaca

SEQ ID NO: 163087 - DNA, 16 bp, Homo sapiens
aacagcagaggttctt

SEQ ID NO: 163088 - DNA, 13 bp, Homo sapiens
aacagcagtgttc

SEQ ID NO: 163089 - DNA, 21 bp, Homo sapiens
aacagccgctcctgtctgcca

SEQ ID NO: 163090 - DNA, 14 bp, Homo sapiens
aacagcctcacaga

SEQ ID NO: 163091 - DNA, 13 bp, Homo sapiens
aacagctgtggct

SEQ ID NO: 163092 - DNA, 17 bp, Homo sapiens
aacaggagacaggaagg

SEQ ID NO: 163093 - DNA, 19 bp, Homo sapiens
aacaggattagacagtcaa

SEQ ID NO: 163094 - DNA, 19 bp, Homo sapiens
aacaggtctcctcttaaaa

SEQ ID NO: 163095 - DNA, 13 bp, Homo sapiens
aacagtcatttaa

SEQ ID NO: 163096 - DNA, 13 bp, Homo sapiens
aacagtctcagga

SEQ ID NO: 163097 - DNA, 13 bp, Homo sapiens
aacagtgcctgct

SEQ ID NO: 163098 - DNA, 14 bp, Homo sapiens
aacagttccttcag

SEQ ID NO: 163099 - DNA, 21 bp, Homo sapiens
aacagttttttatgctaatca

SEQ ID NO: 163100 - DNA, 17 bp, Homo sapiens
aacataaataaaatgac

SEQ ID NO: 163101 - DNA, 12 bp, Homo sapiens
aacataattaaa

SEQ ID NO: 163102 - DNA, 18 bp, Homo sapiens
aacatataatgttgttat

SEQ ID NO: 163103 - DNA, 14 bp, Homo sapiens
aacatgccctgttc

SEQ ID NO: 163104 - DNA, 21 bp, Homo sapiens
aacatgcctgccccaaacaaa

SEQ ID NO: 163105 - DNA, 20 bp, Homo sapiens
aacatggagaaaccctgtct

SEQ ID NO: 163106 - DNA, 15 bp, Homo sapiens
aacatgtaggaagta

SEQ ID NO: 163107 - DNA, 14 bp, Homo sapiens
aacattaagaaaat

SEQ ID NO: 163108 - DNA, 16 bp, Homo sapiens
aaccaaaggtgaagga

SEQ ID NO: 163109 - DNA, 20 bp, Homo sapiens
aaccaagtcatgtgcatttc

SEQ ID NO: 163110 - DNA, 13 bp, Homo sapiens
aaccaatcctgga

SEQ ID NO: 163111 - DNA, 18 bp, Homo sapiens
aaccataaacttcatggt

SEQ ID NO: 163112 - DNA, 19 bp, Homo sapiens
aaccatcccctccgtggca

SEQ ID NO: 163113 - DNA, 17 bp, Homo sapiens
aaccatgtcagcaaaaa

SEQ ID NO: 163114 - DNA, 18 bp, Homo sapiens
aacccaaatgttcatcaa

SEQ ID NO: 163115 - DNA, 23 bp, Homo sapiens
aacccaaatgttcatcaatgaat

SEQ ID NO: 163116 - DNA, 16 bp, Homo sapiens
aacccaactctcctgg

SEQ ID NO: 163117 - DNA, 20 bp, Homo sapiens
aacccatcaacaaaaattgt

SEQ ID NO: 163118 - DNA, 19 bp, Homo sapiens
aacccatcagaaggagaag

SEQ ID NO: 163119 - DNA, 15 bp, Homo sapiens
aacccatgagattca

SEQ ID NO: 163120 - DNA, 11 bp, Homo sapiens
aacccctttcc

SEQ ID NO: 163121 - DNA, 19 bp, Homo sapiens
aaccctcagagccacccct

SEQ ID NO: 163122 - DNA, 17 bp, Homo sapiens
aaccctgcccccaaata

SEQ ID NO: 163123 - DNA, 19 bp, Homo sapiens
aacccttttgtctgcctct

SEQ ID NO: 163124 - DNA, 14 bp, Homo sapiens
aaccgcaggaagct

SEQ ID NO: 163125 - DNA, 13 bp, Homo sapiens
aacctaaaaaaga

SEQ ID NO: 163126 - DNA, 15 bp, Homo sapiens
aacctaacccctttc

SEQ ID NO: 163127 - DNA, 22 bp, Homo sapiens
aacctactttcatactgaagat

SEQ ID NO: 163128 - DNA, 16 bp, Homo sapiens
aacctatatgatttat

SEQ ID NO: 163129 - DNA, 17 bp, Homo sapiens
aacctcaaaatgtctaa

SEQ ID NO: 163130 - DNA, 19 bp, Homo sapiens
aacctcacgcacctcccat

SEQ ID NO: 163131 - DNA, 15 bp, Homo sapiens
aacctgatgctgact

SEQ ID NO: 163132 - DNA, 19 bp, Homo sapiens
aacctgcctgacatttgga

SEQ ID NO: 163133 - DNA, 15 bp, Homo sapiens
aacctgctctcctct

SEQ ID NO: 163134 - DNA, 20 bp, Homo sapiens
aacctgctctcctcttgcca

SEQ ID NO: 163135 - DNA, 22 bp, Homo sapiens
aacctgtgaccagtctgaccct

SEQ ID NO: 163136 - DNA, 18 bp, Homo sapiens
aaccttattgtacctctc

SEQ ID NO: 163137 - DNA, 18 bp, Homo sapiens
aaccttgaaaactttatg

SEQ ID NO: 163138 - DNA, 14 bp, Homo sapiens
aacctttcaaattt

SEQ ID NO: 163139 - DNA, 11 bp, Homo sapiens
aacgaatgaag

SEQ ID NO: 163140 - DNA, 12 bp, Homo sapiens
aacgatttagaa

SEQ ID NO: 163141 - DNA, 13 bp, Homo sapiens
aacgatttagaaa

SEQ ID NO: 163142 - DNA, 11 bp, Homo sapiens
aacgcagccct

SEQ ID NO: 163143 - DNA, 15 bp, Homo sapiens
aacgctgcctgcccg

SEQ ID NO: 163144 - DNA, 14 bp, Homo sapiens
aacggagaaaggtg

SEQ ID NO: 163145 - DNA, 12 bp, Homo sapiens
aacggggagaaa

SEQ ID NO: 163146 - DNA, 14 bp, Homo sapiens
aacggttaaaactg

SEQ ID NO: 163147 - DNA, 17 bp, Homo sapiens
aacgtggggcagcacag

SEQ ID NO: 163148 - DNA, 14 bp, Homo sapiens
aacgttgctcccca

SEQ ID NO: 163149 - DNA, 16 bp, Homo sapiens
aactaaactctctttg

SEQ ID NO: 163150 - DNA, 17 bp, Homo sapiens
aactactcagggaatga

SEQ ID NO: 163151 - DNA, 19 bp, Homo sapiens
aactagaatttattcaatt

SEQ ID NO: 163152 - DNA, 22 bp, Homo sapiens
aactagaatttattcaattcct

SEQ ID NO: 163153 - DNA, 17 bp, Homo sapiens
aactagggaagataata

SEQ ID NO: 163154 - DNA, 19 bp, Homo sapiens
aactatttgtctttcagga

SEQ ID NO: 163155 - DNA, 22 bp, Homo sapiens
aactcacccccaaggggcagtc

SEQ ID NO: 163156 - DNA, 15 bp, Homo sapiens
aactcatcataaaat

SEQ ID NO: 163157 - DNA, 17 bp, Homo sapiens
aactcatcataaaataa

SEQ ID NO: 163158 - DNA, 22 bp, Homo sapiens
aactcattcctgcctgtctcct

SEQ ID NO: 163159 - DNA, 21 bp, Homo sapiens
aactcatttttgttttcatta

SEQ ID NO: 163160 - DNA, 24 bp, Homo sapiens
aactcatttttgttttcattatct

SEQ ID NO: 163161 - DNA, 15 bp, Homo sapiens
aactccaccaaccca

SEQ ID NO: 163162 - DNA, 13 bp, Homo sapiens
aactccagtagct

SEQ ID NO: 163163 - DNA, 16 bp, Homo sapiens
aactctgcattctagt

SEQ ID NO: 163164 - DNA, 22 bp, Homo sapiens
aactgaatggaaggtttgtata

SEQ ID NO: 163165 - DNA, 14 bp, Homo sapiens
aactgaccagcctc

SEQ ID NO: 163166 - DNA, 13 bp, Homo sapiens
aactgactttatc

SEQ ID NO: 163167 - DNA, 20 bp, Homo sapiens
aactgaggcagacagcagct

SEQ ID NO: 163168 - DNA, 14 bp, Homo sapiens
aactgcagggaaaa

SEQ ID NO: 163169 - DNA, 21 bp, Homo sapiens
aactgcattaccgcgttgtaa

SEQ ID NO: 163170 - DNA, 15 bp, Homo sapiens
aactgctgactgttt

SEQ ID NO: 163171 - DNA, 23 bp, Homo sapiens
aactgctgactgttttctcttga

SEQ ID NO: 163172 - DNA, 19 bp, Homo sapiens
aactggactggttcaaatg

SEQ ID NO: 163173 - DNA, 14 bp, Homo sapiens
aactgtatgtcaga

SEQ ID NO: 163174 - DNA, 14 bp, Homo sapiens
aactgtccagagag

SEQ ID NO: 163175 - DNA, 16 bp, Homo sapiens
aactgtccagagagca

SEQ ID NO: 163176 - DNA, 18 bp, Homo sapiens
aactgttgccagagatgg

SEQ ID NO: 163177 - DNA, 16 bp, Homo sapiens
aacttaaattttaatt

SEQ ID NO: 163178 - DNA, 16 bp, Homo sapiens
aacttagcatgtgttg

SEQ ID NO: 163179 - DNA, 22 bp, Homo sapiens
aacttcaagtgcatgctctctg

SEQ ID NO: 163180 - DNA, 13 bp, Homo sapiens
aacttcagacata

SEQ ID NO: 163181 - DNA, 22 bp, Homo sapiens
aacttgagggcccagagcagga

SEQ ID NO: 163182 - DNA, 12 bp, Homo sapiens
aacttgggaact

SEQ ID NO: 163183 - DNA, 20 bp, Homo sapiens
aactttatgctaagtgaaat

SEQ ID NO: 163184 - DNA, 14 bp, Homo sapiens
aactttcctcgcct

SEQ ID NO: 163185 - DNA, 22 bp, Homo sapiens
aactttttggtttgcagatgac

SEQ ID NO: 163186 - DNA, 19 bp, Homo sapiens
aacttttttgaaataataa

SEQ ID NO: 163187 - DNA, 18 bp, Homo sapiens
aagaaaaatgagcctggc

SEQ ID NO: 163188 - DNA, 13 bp, Homo sapiens
aagaaaatatgca

SEQ ID NO: 163189 - DNA, 15 bp, Homo sapiens
aagaaaatcatattg

SEQ ID NO: 163190 - DNA, 22 bp, Homo sapiens
aagaaacacactgaggcaggga

SEQ ID NO: 163191 - DNA, 16 bp, Homo sapiens
aagaaagaaaatcagg

SEQ ID NO: 163192 - DNA, 14 bp, Homo sapiens
aagaaatccctgtt

SEQ ID NO: 163193 - DNA, 14 bp, Homo sapiens
aagaaatgacactt

SEQ ID NO: 163194 - DNA, 19 bp, Homo sapiens
aagaagccacagacctagg

SEQ ID NO: 163195 - DNA, 14 bp, Homo sapiens
aagaagctctctcc

SEQ ID NO: 163196 - DNA, 15 bp, Homo sapiens
aagaagctctctcct

SEQ ID NO: 163197 - DNA, 13 bp, Homo sapiens
aagaagggatgga

SEQ ID NO: 163198 - DNA, 21 bp, Homo sapiens
aagaagggtccttccctctcc

SEQ ID NO: 163199 - DNA, 20 bp, Homo sapiens
aagaataaaatgttgaaaag

SEQ ID NO: 163200 - DNA, 13 bp, Homo sapiens
aagaatacagaaa

SEQ ID NO: 163201 - DNA, 19 bp, Homo sapiens
aagaatgaacaaattgaac

SEQ ID NO: 163202 - DNA, 23 bp, Homo sapiens
atgtcttgatgcatgcactgttc

SEQ ID NO: 163203 - DNA, 19 bp, Homo sapiens
atgtcttgggtaggcggga

SEQ ID NO: 163204 - DNA, 15 bp, Homo sapiens
atgtgaacacatcag

SEQ ID NO: 163205 - DNA, 21 bp, Homo sapiens
atgtgaatcagaccctacccc

SEQ ID NO: 163206 - DNA, 16 bp, Homo sapiens
atgtgaatgggaaaag

SEQ ID NO: 163207 - DNA, 20 bp, Homo sapiens
atgtgataaggatcagaaca

SEQ ID NO: 163208 - DNA, 19 bp, Homo sapiens
atgtgatatataagtgtac

SEQ ID NO: 163209 - DNA, 23 bp, Homo sapiens
atgtgatatataagtgtacatat

SEQ ID NO: 163210 - DNA, 12 bp, Homo sapiens
atgtgcccccag

SEQ ID NO: 163211 - DNA, 14 bp, Homo sapiens
atgtgcccccagac

SEQ ID NO: 163212 - DNA, 20 bp, Homo sapiens
atgtgcctgatccagcctct

SEQ ID NO: 163213 - DNA, 15 bp, Homo sapiens
atgtgcgtgtgtgca

SEQ ID NO: 163214 - DNA, 18 bp, Homo sapiens
atgtgcgtgtgtgcaagt

SEQ ID NO: 163215 - DNA, 20 bp, Homo sapiens
atgtgcgtgtgtgcaagtgt

SEQ ID NO: 163216 - DNA, 15 bp, Homo sapiens
atgtggaatataaag

SEQ ID NO: 163217 - DNA, 17 bp, Homo sapiens
atgtggaatataaagat

SEQ ID NO: 163218 - DNA, 18 bp, Homo sapiens
aagagaatattttaagta

SEQ ID NO: 163219 - DNA, 14 bp, Homo sapiens
aagagagaaaataa

SEQ ID NO: 163220 - DNA, 19 bp, Homo sapiens
aagagattgtggtttcatt

SEQ ID NO: 163221 - DNA, 16 bp, Homo sapiens
aagagcacttaagaga

SEQ ID NO: 163222 - DNA, 22 bp, Homo sapiens
aagagcctgcaggtgctgctgc

SEQ ID NO: 163223 - DNA, 18 bp, Homo sapiens
aagagctgttcacagcca

SEQ ID NO: 163224 - DNA, 13 bp, Homo sapiens
aagaggaaaatga

SEQ ID NO: 163225 - DNA, 18 bp, Homo sapiens
aagaggctgaggcctgga

SEQ ID NO: 163226 - DNA, 15 bp, Homo sapiens
aagaggggctgggct

SEQ ID NO: 163227 - DNA, 13 bp, Homo sapiens
aagagtagaaact

SEQ ID NO: 163228 - DNA, 12 bp, Homo sapiens
aagataattata

SEQ ID NO: 163229 - DNA, 11 bp, Homo sapiens
aagatatatta

SEQ ID NO: 163230 - DNA, 18 bp, Homo sapiens
aagatgagagaactggag

SEQ ID NO: 163231 - DNA, 14 bp, Homo sapiens
aagatgatcatttg

SEQ ID NO: 163232 - DNA, 17 bp, Homo sapiens
aagatgatctactcaga

SEQ ID NO: 163233 - DNA, 24 bp, Homo sapiens
aagatgcccactgaggaatgatga

SEQ ID NO: 163234 - DNA, 15 bp, Homo sapiens
aagatgctcttttaa

SEQ ID NO: 163235 - DNA, 16 bp, Homo sapiens
aagatgcttctcactg

SEQ ID NO: 163236 - DNA, 21 bp, Homo sapiens
aagatggattggtgtaaaagg

SEQ ID NO: 163237 - DNA, 21 bp, Homo sapiens
aagatggcccagctccccaag

SEQ ID NO: 163238 - DNA, 16 bp, Homo sapiens
aagatggctgtgcctc

SEQ ID NO: 163239 - DNA, 18 bp, Homo sapiens
aagatggctgtgcctctg

SEQ ID NO: 163240 - DNA, 20 bp, Homo sapiens
aagatggctgtgcctctgcc

SEQ ID NO: 163241 - DNA, 13 bp, Homo sapiens
aagattcccagag

SEQ ID NO: 163242 - DNA, 15 bp, Homo sapiens
aagattcccagagac

SEQ ID NO: 163243 - DNA, 13 bp, Homo sapiens
aagattttaaatt

SEQ ID NO: 163244 - DNA, 13 bp, Homo sapiens
aagcaaaatatta

SEQ ID NO: 163245 - DNA, 14 bp, Homo sapiens
aagcaaaatattat

SEQ ID NO: 163246 - DNA, 22 bp, Homo sapiens
aagcaaagactttcctcttagt

SEQ ID NO: 163247 - DNA, 18 bp, Homo sapiens
aagcaaatgtgacctgtg

SEQ ID NO: 163248 - DNA, 15 bp, Homo sapiens
aagcaagaaagaaac

SEQ ID NO: 163249 - DNA, 13 bp, Homo sapiens
aagcaatatgcat

SEQ ID NO: 163250 - DNA, 15 bp, Homo sapiens
aagcacagtgcctgc

SEQ ID NO: 163251 - DNA, 13 bp, Homo sapiens
aagcacctgccga

SEQ ID NO: 163252 - DNA, 15 bp, Homo sapiens
aagcacgaaatgtta

SEQ ID NO: 163253 - DNA, 14 bp, Homo sapiens
aagcagaggaagga

SEQ ID NO: 163254 - DNA, 16 bp, Homo sapiens
aagcagatgcaaagag

SEQ ID NO: 163255 - DNA, 18 bp, Homo sapiens
aagcagatgcaaagaggc

SEQ ID NO: 163256 - DNA, 20 bp, Homo sapiens
aagcagatggaatgctgtgt

SEQ ID NO: 163257 - DNA, 13 bp, Homo sapiens
aagcagctcaaag

SEQ ID NO: 163258 - DNA, 20 bp, Homo sapiens
aagcaggggctacaagaggg

SEQ ID NO: 163259 - DNA, 18 bp, Homo sapiens
aagcagtctacccacctc

SEQ ID NO: 163260 - DNA, 19 bp, Homo sapiens
aagcagtctacccacctca

SEQ ID NO: 163261 - DNA, 18 bp, Homo sapiens
aagcattacatttccaaa

SEQ ID NO: 163262 - DNA, 18 bp, Homo sapiens
aagcattgtaaatgtgct

SEQ ID NO: 163263 - DNA, 16 bp, Homo sapiens
aagccaacaccctgtc

SEQ ID NO: 163264 - DNA, 13 bp, Homo sapiens
aagccaagcagcc

SEQ ID NO: 163265 - DNA, 20 bp, Homo sapiens
aagccagaagctgagcacca

SEQ ID NO: 163266 - DNA, 11 bp, Homo sapiens
aagccagcctt

SEQ ID NO: 163267 - DNA, 17 bp, Homo sapiens
aagccagcgtcctcctc

SEQ ID NO: 163268 - DNA, 18 bp, Homo sapiens
aagcccaatattataatt

SEQ ID NO: 163269 - DNA, 17 bp, Homo sapiens
aagcccctgcccatctg

SEQ ID NO: 163270 - DNA, 21 bp, Homo sapiens
aagccccttgctctcccctgc

SEQ ID NO: 163271 - DNA, 9 bp, Homo sapiens
aagccctcc

SEQ ID NO: 163272 - DNA, 15 bp, Homo sapiens
aagccctccttccac

SEQ ID NO: 163273 - DNA, 15 bp, Homo sapiens
aagcccttccatgtc

SEQ ID NO: 163274 - DNA, 20 bp, Homo sapiens
aagcccttccatgtcgcctc

SEQ ID NO: 163275 - DNA, 23 bp, Homo sapiens
aagcccttccatgtcgcctctgc

SEQ ID NO: 163276 - DNA, 13 bp, Homo sapiens
aagccgtggcttc

SEQ ID NO: 163277 - DNA, 14 bp, Homo sapiens
aagccgtggcttcc

SEQ ID NO: 163278 - DNA, 22 bp, Homo sapiens
aagcctagtgaaggcttctctc

SEQ ID NO: 163279 - DNA, 19 bp, Homo sapiens
aagcctgctttttaagtgt

SEQ ID NO: 163280 - DNA, 17 bp, Homo sapiens
aagcctgtaatcccagc

SEQ ID NO: 163281 - DNA, 18 bp, Homo sapiens
aagcgaggtcaacagaga

SEQ ID NO: 163282 - DNA, 17 bp, Homo sapiens
aagctcagactggttga

SEQ ID NO: 163283 - DNA, 12 bp, Homo sapiens
aagctcatattt

SEQ ID NO: 163284 - DNA, 21 bp, Homo sapiens
aagctcatattttgtatatat

SEQ ID NO: 163285 - DNA, 20 bp, Homo sapiens
aagctccatctccactccag

SEQ ID NO: 163286 - DNA, 13 bp, Homo sapiens
aagctcctgtcct

SEQ ID NO: 163287 - DNA, 15 bp, Homo sapiens
aagctctattaagat

SEQ ID NO: 163288 - DNA, 20 bp, Homo sapiens
aagctctggtgacaccagcc

SEQ ID NO: 163289 - DNA, 21 bp, Homo sapiens
aagctctggtgacaccagcct

SEQ ID NO: 163290 - DNA, 16 bp, Homo sapiens
aagctgcctcaaggaa

SEQ ID NO: 163291 - DNA, 15 bp, Homo sapiens
aagctgcctgtagtt

SEQ ID NO: 163292 - DNA, 15 bp, Homo sapiens
aagctgggcaggttg

SEQ ID NO: 163293 - DNA, 12 bp, Homo sapiens
aagctgtgtcct

SEQ ID NO: 163294 - DNA, 18 bp, Homo sapiens
aagctgttactgtcttca

SEQ ID NO: 163295 - DNA, 23 bp, Homo sapiens
aagcttcctttgtttttttttcc

SEQ ID NO: 163296 - DNA, 20 bp, Homo sapiens
aagcttcttaaatgagaagg

SEQ ID NO: 163297 - DNA, 16 bp, Homo sapiens
aagctttcctgcccca

SEQ ID NO: 163298 - DNA, 21 bp, Homo sapiens
aagctttcctgccccaggcct

SEQ ID NO: 163299 - DNA, 16 bp, Homo sapiens
aaggaaatctcacccc

SEQ ID NO: 163300 - DNA, 22 bp, Homo sapiens
aaggaaatctcaccccatccca

SEQ ID NO: 163301 - DNA, 14 bp, Homo sapiens
aaggaagtctagga

SEQ ID NO: 163302 - DNA, 15 bp, Homo sapiens
aaggaatatatggca

SEQ ID NO: 163303 - DNA, 16 bp, Homo sapiens
aaggaatatatggcag

SEQ ID NO: 163304 - DNA, 23 bp, Homo sapiens
aaggaatatatggcagagttgta

SEQ ID NO: 163305 - DNA, 16 bp, Homo sapiens
aaggagactcacctct

SEQ ID NO: 163306 - DNA, 22 bp, Homo sapiens
aaggagactcacctctgcctca

SEQ ID NO: 163307 - DNA, 12 bp, Homo sapiens
aaggagagaaag

SEQ ID NO: 163308 - DNA, 11 bp, Homo sapiens
aaggaggaaaa

SEQ ID NO: 163309 - DNA, 18 bp, Homo sapiens
aaggaggaagagaaaaaa

SEQ ID NO: 163310 - DNA, 17 bp, Homo sapiens
aaggagggtcaggaagg

SEQ ID NO: 163311 - DNA, 21 bp, Homo sapiens
aaggagggtggatcacctgag

SEQ ID NO: 163312 - DNA, 19 bp, Homo sapiens
aaggatactgtaacacttt

SEQ ID NO: 163313 - DNA, 22 bp, Homo sapiens
aaggatcagaacagcagaggtt

SEQ ID NO: 163314 - DNA, 14 bp, Homo sapiens
aaggatgtcacagg

SEQ ID NO: 163315 - DNA, 17 bp, Homo sapiens
aaggattgtgatatttt

SEQ ID NO: 163316 - DNA, 21 bp, Homo sapiens
aaggcatgatgttaaccagaa

SEQ ID NO: 163317 - DNA, 21 bp, Homo sapiens
aaggccaattcctatacgcag

SEQ ID NO: 163318 - DNA, 18 bp, Homo sapiens
aaggccgagaagcaagaa

SEQ ID NO: 163319 - DNA, 16 bp, Homo sapiens
aaggcctcttccttgc

SEQ ID NO: 163320 - DNA, 22 bp, Homo sapiens
aaggctcgattttgtatctgca

SEQ ID NO: 163321 - DNA, 17 bp, Homo sapiens
aaggctgaggaaaggcc

SEQ ID NO: 163322 - DNA, 19 bp, Homo sapiens
aaggctgaggaaaggccag

SEQ ID NO: 163323 - DNA, 14 bp, Homo sapiens
aaggctgggggaag

SEQ ID NO: 163324 - DNA, 16 bp, Homo sapiens
aagggaaactgccagc

SEQ ID NO: 163325 - DNA, 14 bp, Homo sapiens
aagggaaatatcat

SEQ ID NO: 163326 - DNA, 16 bp, Homo sapiens
aagggagagagagagg

SEQ ID NO: 163327 - DNA, 24 bp, Homo sapiens
aagggagcactgggttgactttca

SEQ ID NO: 163328 - DNA, 18 bp, Homo sapiens
aaggggcagtctggaggg

SEQ ID NO: 163329 - DNA, 14 bp, Homo sapiens
aaggtgaaggaata

SEQ ID NO: 163330 - DNA, 18 bp, Homo sapiens
aaggtgaaggaatatatg

SEQ ID NO: 163331 - DNA, 18 bp, Homo sapiens
aaggtgcctgtgaggcag

SEQ ID NO: 163332 - DNA, 17 bp, Homo sapiens
aaggttcactaaagcag

SEQ ID NO: 163333 - DNA, 14 bp, Homo sapiens
aagtaaaaccacag

SEQ ID NO: 163334 - DNA, 15 bp, Homo sapiens
aagtaaaaccacagc

SEQ ID NO: 163335 - DNA, 12 bp, Homo sapiens
aagtaaaacttg

SEQ ID NO: 163336 - DNA, 12 bp, Homo sapiens
aagtaagaaaat

SEQ ID NO: 163337 - DNA, 13 bp, Homo sapiens
aagtaagaaaata

SEQ ID NO: 163338 - DNA, 15 bp, Homo sapiens
aagtaagaaaatatt

SEQ ID NO: 163339 - DNA, 18 bp, Homo sapiens
aagtacccgttcacattt

SEQ ID NO: 163340 - DNA, 16 bp, Homo sapiens
aagtactgtgtacaga

SEQ ID NO: 163341 - DNA, 21 bp, Homo sapiens
aagtatgagggaaaatgagta

SEQ ID NO: 163342 - DNA, 13 bp, Homo sapiens
aagtatgtaaaca

SEQ ID NO: 163343 - DNA, 21 bp, Homo sapiens
aagtatgtaaacaggagacag

SEQ ID NO: 163344 - DNA, 22 bp, Homo sapiens
aagtatgtaaagtatgtaaaca

SEQ ID NO: 163345 - DNA, 13 bp, Homo sapiens
aagtatgtgagtg

SEQ ID NO: 163346 - DNA, 18 bp, Homo sapiens
aagtatgtgagtgtgtcc

SEQ ID NO: 163347 - DNA, 22 bp, Homo sapiens
aagtattgcatctgtataagta

SEQ ID NO: 163348 - DNA, 23 bp, Homo sapiens
aagtcaaagacattctgacatct

SEQ ID NO: 163349 - DNA, 17 bp, Homo sapiens
aagtcaatgttttcagt

SEQ ID NO: 163350 - DNA, 18 bp, Homo sapiens
aagtcaatgttttcagtt

SEQ ID NO: 163351 - DNA, 12 bp, Homo sapiens
aagtcactgcac

SEQ ID NO: 163352 - DNA, 13 bp, Homo sapiens
aagtcagatgtgg

SEQ ID NO: 163353 - DNA, 21 bp, Homo sapiens
aagtcagatgtggtaactgtt

SEQ ID NO: 163354 - DNA, 17 bp, Homo sapiens
aagtccaagcataccaa

SEQ ID NO: 163355 - DNA, 18 bp, Homo sapiens
aagtccccaggccccagg

SEQ ID NO: 163356 - DNA, 12 bp, Homo sapiens
attctctctcct

SEQ ID NO: 163357 - DNA, 16 bp, Homo sapiens
attctctctcctgtcc

SEQ ID NO: 163358 - DNA, 13 bp, Homo sapiens
attctctgtctca

SEQ ID NO: 163359 - DNA, 12 bp, Homo sapiens
attctcttatcc

SEQ ID NO: 163360 - DNA, 16 bp, Homo sapiens
attctgaaggagcccc

SEQ ID NO: 163361 - DNA, 16 bp, Homo sapiens
aatgaaaatgtcttgt

SEQ ID NO: 163362 - DNA, 11 bp, Homo sapiens
aatgaactgaa

SEQ ID NO: 163363 - DNA, 15 bp, Homo sapiens
aatgaactgaagttt

SEQ ID NO: 163364 - DNA, 16 bp, Homo sapiens
aatgaagtatttctca

SEQ ID NO: 163365 - DNA, 12 bp, Homo sapiens
aatgaatgacct

SEQ ID NO: 163366 - DNA, 22 bp, Homo sapiens
aatgaatggctaagcaaaatgt

SEQ ID NO: 163367 - DNA, 23 bp, Homo sapiens
aatgaatgtttacactctttgta

SEQ ID NO: 163368 - DNA, 16 bp, Homo sapiens
attttaagtattgcat

SEQ ID NO: 163369 - DNA, 23 bp, Homo sapiens
attttaagtattgcatctgtata

SEQ ID NO: 163370 - DNA, 13 bp, Homo sapiens
attttaataatat

SEQ ID NO: 163371 - DNA, 18 bp, Homo sapiens
attttaattatcttttct

SEQ ID NO: 163372 - DNA, 12 bp, Homo sapiens
attttaatttat

SEQ ID NO: 163373 - DNA, 16 bp, Homo sapiens
attttagctgcagaac

SEQ ID NO: 163374 - DNA, 21 bp, Homo sapiens
attttatatcaatttaaaaaa

SEQ ID NO: 163375 - DNA, 14 bp, Homo sapiens
attttatctgtgaa

SEQ ID NO: 163376 - DNA, 21 bp, Homo sapiens
attttatgaaaggtttacatt

SEQ ID NO: 163377 - DNA, 20 bp, Homo sapiens
attttcaacgcagccctgct

SEQ ID NO: 163378 - DNA, 15 bp, Homo sapiens
attttcaccccaccc

SEQ ID NO: 163379 - DNA, 17 bp, Homo sapiens
attttcagaaaatatta

SEQ ID NO: 163380 - DNA, 12 bp, Homo sapiens
attttcagtatt

SEQ ID NO: 163381 - DNA, 14 bp, Homo sapiens
attttcagtatttt

SEQ ID NO: 163382 - DNA, 20 bp, Homo sapiens
attttcataagtatttcaaa

SEQ ID NO: 163383 - DNA, 21 bp, Homo sapiens
attttccacaagattcccaga

SEQ ID NO: 163384 - DNA, 23 bp, Homo sapiens
attttccacaagattcccagaga

SEQ ID NO: 163385 - DNA, 16 bp, Homo sapiens
attttctagactttct

SEQ ID NO: 163386 - DNA, 14 bp, Homo sapiens
attttctttcaaaa

SEQ ID NO: 163387 - DNA, 16 bp, Homo sapiens
attttcttttgtaaat

SEQ ID NO: 163388 - DNA, 21 bp, Homo sapiens
attttgcctcttttctctgtg

SEQ ID NO: 163389 - DNA, 20 bp, Homo sapiens
attttgctaaatgtgaatga

SEQ ID NO: 163390 - DNA, 21 bp, Homo sapiens
attttggagaaattatttaat

SEQ ID NO: 163391 - DNA, 17 bp, Homo sapiens
attttgtaactttctct

SEQ ID NO: 163392 - DNA, 14 bp, Homo sapiens
attttgtatatatc

SEQ ID NO: 163393 - DNA, 22 bp, Homo sapiens
attttgtttttgtcttaaaaag

SEQ ID NO: 163394 - DNA, 19 bp, Homo sapiens
atttttaatatatactatg

SEQ ID NO: 163395 - DNA, 21 bp, Homo sapiens
atttttgttttcattatctca

SEQ ID NO: 163396 - DNA, 19 bp, Homo sapiens
attttttacagctgcctgc

SEQ ID NO: 163397 - DNA, 18 bp, Homo sapiens
attttttgttaaatgatt

SEQ ID NO: 163398 - DNA, 18 bp, Homo sapiens
atttttttaaccaaaggt

SEQ ID NO: 163399 - DNA, 22 bp, Homo sapiens
atttttttcactggagttacat

SEQ ID NO: 163400 - DNA, 14 bp, Homo sapiens
atttttttgcaagt

SEQ ID NO: 163401 - DNA, 23 bp, Homo sapiens
caaaaaaatatatttaatgataa

SEQ ID NO: 163402 - DNA, 13 bp, Homo sapiens
caaaaacacagca

SEQ ID NO: 163403 - DNA, 15 bp, Homo sapiens
caaaaacacagcaag

SEQ ID NO: 163404 - DNA, 14 bp, Homo sapiens
caaaaacagcctca

SEQ ID NO: 163405 - DNA, 21 bp, Homo sapiens
caaaaagaacaaaaaaatctg

SEQ ID NO: 163406 - DNA, 17 bp, Homo sapiens
caaaaatgaactgaagt

SEQ ID NO: 163407 - DNA, 15 bp, Homo sapiens
caaaaattagccggg

SEQ ID NO: 163408 - DNA, 17 bp, Homo sapiens
caaaaattagccgggca

SEQ ID NO: 163409 - DNA, 15 bp, Homo sapiens
caaaacggttttact

SEQ ID NO: 163410 - DNA, 20 bp, Homo sapiens
caaaactcaaatgcttggct

SEQ ID NO: 163411 - DNA, 16 bp, Homo sapiens
caaaagatgcttctca

SEQ ID NO: 163412 - DNA, 23 bp, Homo sapiens
caaaaggtgcctgtgaggcaggg

SEQ ID NO: 163413 - DNA, 20 bp, Homo sapiens
caaaaggttcactaaagcag

SEQ ID NO: 163414 - DNA, 19 bp, Homo sapiens
caaaatcattttatatgtc

SEQ ID NO: 163415 - DNA, 15 bp, Homo sapiens
caaaatgtagggtta

SEQ ID NO: 163416 - DNA, 16 bp, Homo sapiens
caaaattatttcagaa

SEQ ID NO: 163417 - DNA, 17 bp, Homo sapiens
caaaattatttcagaaa

SEQ ID NO: 163418 - DNA, 16 bp, Homo sapiens
caaaattgatgtgttt

SEQ ID NO: 163419 - DNA, 19 bp, Homo sapiens
caaaatttgatgccaggac

SEQ ID NO: 163420 - DNA, 20 bp, Homo sapiens
caaacaaagccagaagctga

SEQ ID NO: 163421 - DNA, 14 bp, Homo sapiens
caaacaaatatgca

SEQ ID NO: 163422 - DNA, 15 bp, Homo sapiens
caaacaaatatgcaa

SEQ ID NO: 163423 - DNA, 17 bp, Homo sapiens
caaacaaatatgcaaaa

SEQ ID NO: 163424 - DNA, 12 bp, Homo sapiens
caaacatgaagt

SEQ ID NO: 163425 - DNA, 13 bp, Homo sapiens
caaaccagaagca

SEQ ID NO: 163426 - DNA, 17 bp, Homo sapiens
caaaccagtatcgctca

SEQ ID NO: 163427 - DNA, 21 bp, Homo sapiens
caaaccccgaccacctgccca

SEQ ID NO: 163428 - DNA, 12 bp, Homo sapiens
caaacgctgcct

SEQ ID NO: 163429 - DNA, 13 bp, Homo sapiens
caaacgctgcctg

SEQ ID NO: 163430 - DNA, 15 bp, Homo sapiens
caaacgctgcctgcc

SEQ ID NO: 163431 - DNA, 16 bp, Homo sapiens
caaactacatgtaatc

SEQ ID NO: 163432 - DNA, 18 bp, Homo sapiens
caaactctgctgtctaac

SEQ ID NO: 163433 - DNA, 19 bp, Homo sapiens
caaactgccttggcttcag

SEQ ID NO: 163434 - DNA, 17 bp, Homo sapiens
caaactggggcctccct

SEQ ID NO: 163435 - DNA, 16 bp, Homo sapiens
caaagagagaaaataa

SEQ ID NO: 163436 - DNA, 14 bp, Homo sapiens
caaagaggcaagag

SEQ ID NO: 163437 - DNA, 21 bp, Homo sapiens
caaagaggttttaaaaaaatc

SEQ ID NO: 163438 - DNA, 18 bp, Homo sapiens
caaagatgtttgtcagat

SEQ ID NO: 163439 - DNA, 18 bp, Homo sapiens
caaagcaggggagtatgc

SEQ ID NO: 163440 - DNA, 22 bp, Homo sapiens
caaagccagcgtcctcctctgt

SEQ ID NO: 163441 - DNA, 18 bp, Homo sapiens
caaagcccttccatgtcg

SEQ ID NO: 163442 - DNA, 21 bp, Homo sapiens
caaagccttgtgtctacagag

SEQ ID NO: 163443 - DNA, 19 bp, Homo sapiens
caaagctgatgacaacttc

SEQ ID NO: 163444 - DNA, 16 bp, Homo sapiens
caaagcttgttaagat

SEQ ID NO: 163445 - DNA, 13 bp, Homo sapiens
caaagctttcctg

SEQ ID NO: 163446 - DNA, 14 bp, Homo sapiens
caaagctttcctgc

SEQ ID NO: 163447 - DNA, 16 bp, Homo sapiens
caaagctttcctgccc

SEQ ID NO: 163448 - DNA, 13 bp, Homo sapiens
caaaggatgtgat

SEQ ID NO: 163449 - DNA, 14 bp, Homo sapiens
caaaggatgtgata

SEQ ID NO: 163450 - DNA, 21 bp, Homo sapiens
caaaggatgtgatatataagt

SEQ ID NO: 163451 - DNA, 15 bp, Homo sapiens
caaagggaaatatca

SEQ ID NO: 163452 - DNA, 22 bp, Homo sapiens
caaagggagcactgggttgact

SEQ ID NO: 163453 - DNA, 13 bp, Homo sapiens
caaaggtgaagga

SEQ ID NO: 163454 - DNA, 19 bp, Homo sapiens
caaaggtgaaggaatatat

SEQ ID NO: 163455 - DNA, 22 bp, Homo sapiens
caaagtcttaaaataacttata

SEQ ID NO: 163456 - DNA, 12 bp, Homo sapiens
caaagtgtgtat

SEQ ID NO: 163457 - DNA, 13 bp, Homo sapiens
caaagtgtgtatt

SEQ ID NO: 163458 - DNA, 14 bp, Homo sapiens
caaagtgtgtatta

SEQ ID NO: 163459 - DNA, 17 bp, Homo sapiens
caaagtgtgtattaaaa

SEQ ID NO: 163460 - DNA, 20 bp, Homo sapiens
caaagttccctacttcctgt

SEQ ID NO: 163461 - DNA, 21 bp, Homo sapiens
caaagttccctacttcctgtg

SEQ ID NO: 163462 - DNA, 14 bp, Homo sapiens
caaatactcttagg

SEQ ID NO: 163463 - DNA, 14 bp, Homo sapiens
caaatataagaata

SEQ ID NO: 163464 - DNA, 18 bp, Homo sapiens
caaatatgcaaagcactg

SEQ ID NO: 163465 - DNA, 21 bp, Homo sapiens
caaatcttaacttgaaggagt

SEQ ID NO: 163466 - DNA, 22 bp, Homo sapiens
caaatgaccagcagattcaaat

SEQ ID NO: 163467 - DNA, 18 bp, Homo sapiens
caaatgctgcgcccttcc

SEQ ID NO: 163468 - DNA, 20 bp, Homo sapiens
caaatgctgcgcccttcccc

SEQ ID NO: 163469 - DNA, 17 bp, Homo sapiens
caaatgcttggcttctc

SEQ ID NO: 163470 - DNA, 12 bp, Homo sapiens
caaattatttgt

SEQ ID NO: 163471 - DNA, 20 bp, Homo sapiens
caaattatttgtgtaataga

SEQ ID NO: 163472 - DNA, 14 bp, Homo sapiens
caaattcatttttt

SEQ ID NO: 163473 - DNA, 22 bp, Homo sapiens
caaattctgcttgcttgctttt

SEQ ID NO: 163474 - DNA, 17 bp, Homo sapiens
caaattgcttgaaagaa

SEQ ID NO: 163475 - DNA, 14 bp, Homo sapiens
caaatttacagaga

SEQ ID NO: 163476 - DNA, 14 bp, Homo sapiens
caacaagagcgaaa

SEQ ID NO: 163477 - DNA, 18 bp, Homo sapiens
caacaatttctactttga

SEQ ID NO: 163478 - DNA, 12 bp, Homo sapiens
caacagaagcag

SEQ ID NO: 163479 - DNA, 18 bp, Homo sapiens
caacagagaaggcaggaa

SEQ ID NO: 163480 - DNA, 14 bp, Homo sapiens
caacagtcaaaaca

SEQ ID NO: 163481 - DNA, 12 bp, Homo sapiens
caacagtgagtc

SEQ ID NO: 163482 - DNA, 22 bp, Homo sapiens
caacatcttggtcagatttgaa

SEQ ID NO: 163483 - DNA, 23 bp, Homo sapiens
caacatgcctgccccaaacaaat

SEQ ID NO: 163484 - DNA, 18 bp, Homo sapiens
caacatggtgaaaccccg

SEQ ID NO: 163485 - DNA, 17 bp, Homo sapiens
caacattgcttgtgcca

SEQ ID NO: 163486 - DNA, 23 bp, Homo sapiens
caaccactggtctgtagggattt

SEQ ID NO: 163487 - DNA, 18 bp, Homo sapiens
caaccatgagaccactgt

SEQ ID NO: 163488 - DNA, 19 bp, Homo sapiens
caacccaaatgttcatcaa

SEQ ID NO: 163489 - DNA, 18 bp, Homo sapiens
caaccctcagagccaccc

SEQ ID NO: 163490 - DNA, 21 bp, Homo sapiens
caaccctcagagccaccccta

SEQ ID NO: 163491 - DNA, 18 bp, Homo sapiens
caacctaacccctttcct

SEQ ID NO: 163492 - DNA, 19 bp, Homo sapiens
caaccttctgtggctcaca

SEQ ID NO: 163493 - DNA, 12 bp, Homo sapiens
caacgcagccct

SEQ ID NO: 163494 - DNA, 12 bp, Homo sapiens
caacgtggggca

SEQ ID NO: 163495 - DNA, 17 bp, Homo sapiens
caactatgatttggaaa

SEQ ID NO: 163496 - DNA, 17 bp, Homo sapiens
caactcttgcaggtctc

SEQ ID NO: 163497 - DNA, 15 bp, Homo sapiens
caactctttgagaaa

SEQ ID NO: 163498 - DNA, 22 bp, Homo sapiens
caactgaaaagactcagtgttc

SEQ ID NO: 163499 - DNA, 18 bp, Homo sapiens
caacttcaagtgcatgct

SEQ ID NO: 163500 - DNA, 20 bp, Homo sapiens
caacttgagggcccagagca

SEQ ID NO: 163501 - DNA, 22 bp, Homo sapiens
caacttgagggcccagagcagg

SEQ ID NO: 163502 - DNA, 11 bp, Homo sapiens
caactttctgt

SEQ ID NO: 163503 - DNA, 15 bp, Homo sapiens
atgcacacaaaacaa

SEQ ID NO: 163504 - DNA, 16 bp, Homo sapiens
atgcagcaaaatgtga

SEQ ID NO: 163505 - DNA, 17 bp, Homo sapiens
atgcagcatctaagtaa

SEQ ID NO: 163506 - DNA, 14 bp, Homo sapiens
atgcatctccacct

SEQ ID NO: 163507 - DNA, 17 bp, Homo sapiens
atgcatgcactgttccc

SEQ ID NO: 163508 - DNA, 16 bp, Homo sapiens
atgccacacatcaccc

SEQ ID NO: 163509 - DNA, 23 bp, Homo sapiens
atgccagtaacgcgtcttcctga

SEQ ID NO: 163510 - DNA, 17 bp, Homo sapiens
atgccatctgtgggcac

SEQ ID NO: 163511 - DNA, 21 bp, Homo sapiens
atgccatttaaagcttattaa

SEQ ID NO: 163512 - DNA, 16 bp, Homo sapiens
atgccccggccacctc

SEQ ID NO: 163513 - DNA, 18 bp, Homo sapiens
atgccccggccacctctg

SEQ ID NO: 163514 - DNA, 14 bp, Homo sapiens
atgcctcagtgtat

SEQ ID NO: 163515 - DNA, 20 bp, Homo sapiens
atgcctcagtgtatttgtat

SEQ ID NO: 163516 - DNA, 18 bp, Homo sapiens
atgccttccagcaccctg

SEQ ID NO: 163517 - DNA, 18 bp, Homo sapiens
atgcgggctgggcagctg

SEQ ID NO: 163518 - DNA, 23 bp, Homo sapiens
atgctaaagaaaaagtcatccaa

SEQ ID NO: 163519 - DNA, 14 bp, Homo sapiens
atgctaacatctaa

SEQ ID NO: 163520 - DNA, 13 bp, Homo sapiens
atgctaagtgaaa

SEQ ID NO: 163521 - DNA, 15 bp, Homo sapiens
atgctcaagtttttc

SEQ ID NO: 163522 - DNA, 19 bp, Homo sapiens
caagatgagagaactggag

SEQ ID NO: 163523 - DNA, 18 bp, Homo sapiens
caagattcccagagacag

SEQ ID NO: 163524 - DNA, 17 bp, Homo sapiens
caagattttccacaaga

SEQ ID NO: 163525 - DNA, 13 bp, Homo sapiens
caagcaagaaaca

SEQ ID NO: 163526 - DNA, 18 bp, Homo sapiens
caagcaagaaacactggg

SEQ ID NO: 163527 - DNA, 18 bp, Homo sapiens
caagcacctagcctcgct

SEQ ID NO: 163528 - DNA, 23 bp, Homo sapiens
caagcaggaaatgaaaatgtctt

SEQ ID NO: 163529 - DNA, 13 bp, Homo sapiens
caagcaggaagct

SEQ ID NO: 163530 - DNA, 17 bp, Homo sapiens
caagcaggaagctcaga

SEQ ID NO: 163531 - DNA, 18 bp, Homo sapiens
caagcagtctacccacct

SEQ ID NO: 163532 - DNA, 15 bp, Homo sapiens
caagccaagcagcca

SEQ ID NO: 163533 - DNA, 16 bp, Homo sapiens
caagccaagcagccaa

SEQ ID NO: 163534 - DNA, 13 bp, Homo sapiens
caagcccctgccc

SEQ ID NO: 163535 - DNA, 18 bp, Homo sapiens
caagcccctgcccatctg

SEQ ID NO: 163536 - DNA, 22 bp, Homo sapiens
caagcctgcagtcatcttgacc

SEQ ID NO: 163537 - DNA, 18 bp, Homo sapiens
caagcctgtaatcccagc

SEQ ID NO: 163538 - DNA, 19 bp, Homo sapiens
caagctcacagttcctcgc

SEQ ID NO: 163539 - DNA, 17 bp, Homo sapiens
caagctccatctccact

SEQ ID NO: 163540 - DNA, 21 bp, Homo sapiens
caagctccatctccactccag

SEQ ID NO: 163541 - DNA, 17 bp, Homo sapiens
caagctccttgggaggc

SEQ ID NO: 163542 - DNA, 22 bp, Homo sapiens
caagctccttgggaggccccac

SEQ ID NO: 163543 - DNA, 20 bp, Homo sapiens
caagctgcaccctcaggcag

SEQ ID NO: 163544 - DNA, 12 bp, Homo sapiens
caagcttcagtt

SEQ ID NO: 163545 - DNA, 13 bp, Homo sapiens
caagcttctttta

SEQ ID NO: 163546 - DNA, 22 bp, Homo sapiens
caaggactgcagggactgccag

SEQ ID NO: 163547 - DNA, 19 bp, Homo sapiens
caaggccgctgttcaccca

SEQ ID NO: 163548 - DNA, 18 bp, Homo sapiens
caaggctgggggaagaag

SEQ ID NO: 163549 - DNA, 15 bp, Homo sapiens
caagggaaaagtctc

SEQ ID NO: 163550 - DNA, 17 bp, Homo sapiens
caagggctccccactgc

SEQ ID NO: 163551 - DNA, 16 bp, Homo sapiens
caaggggcagtctgga

SEQ ID NO: 163552 - DNA, 17 bp, Homo sapiens
caagggtctagggagag

SEQ ID NO: 163553 - DNA, 16 bp, Homo sapiens
caaggtagccctggcc

SEQ ID NO: 163554 - DNA, 21 bp, Homo sapiens
caaggtagccctggccagagg

SEQ ID NO: 163555 - DNA, 17 bp, Homo sapiens
caaggtggccaaattat

SEQ ID NO: 163556 - DNA, 15 bp, Homo sapiens
caagtatgtgagtgt

SEQ ID NO: 163557 - DNA, 20 bp, Homo sapiens
caagtcataggttaatattt

SEQ ID NO: 163558 - DNA, 17 bp, Homo sapiens
caagtcatgtgcatttc

SEQ ID NO: 163559 - DNA, 19 bp, Homo sapiens
caagtctacagagtgatag

SEQ ID NO: 163560 - DNA, 13 bp, Homo sapiens
caagtctgcagcc

SEQ ID NO: 163561 - DNA, 18 bp, Homo sapiens
caagtctggatctgggac

SEQ ID NO: 163562 - DNA, 14 bp, Homo sapiens
caagtgagaccctg

SEQ ID NO: 163563 - DNA, 19 bp, Homo sapiens
caagtgcatgctctctgca

SEQ ID NO: 163564 - DNA, 16 bp, Homo sapiens
caagtgcctgctttta

SEQ ID NO: 163565 - DNA, 14 bp, Homo sapiens
caagtgggggcaga

SEQ ID NO: 163566 - DNA, 14 bp, Homo sapiens
caagtgtatatcag

SEQ ID NO: 163567 - DNA, 22 bp, Homo sapiens
caagtgtggtagagtgtgcctg

SEQ ID NO: 163568 - DNA, 22 bp, Homo sapiens
caagtgtggtagggacttaaaa

SEQ ID NO: 163569 - DNA, 23 bp, Homo sapiens
caagtgtggtagggacttaaaaa

SEQ ID NO: 163570 - DNA, 22 bp, Homo sapiens
caagtgtgtgcacatgtgtgcg

SEQ ID NO: 163571 - DNA, 21 bp, Homo sapiens
caagttgtggtgctgacaaag

SEQ ID NO: 163572 - DNA, 16 bp, Homo sapiens
caagttgtttcattga

SEQ ID NO: 163573 - DNA, 22 bp, Homo sapiens
caagtttctagctagaaatatg

SEQ ID NO: 163574 - DNA, 17 bp, Homo sapiens
caagtttgtatcaggtg

SEQ ID NO: 163575 - DNA, 20 bp, Homo sapiens
caataaaatcttgaaaatgc

SEQ ID NO: 163576 - DNA, 17 bp, Homo sapiens
caataaggtcaatgcca

SEQ ID NO: 163577 - DNA, 14 bp, Homo sapiens
caataatttcaggt

SEQ ID NO: 163578 - DNA, 19 bp, Homo sapiens
caatacagtacaggcagca

SEQ ID NO: 163579 - DNA, 16 bp, Homo sapiens
caatagtcaagaaaaa

SEQ ID NO: 163580 - DNA, 22 bp, Homo sapiens
caatattataatttttttcaat

SEQ ID NO: 163581 - DNA, 16 bp, Homo sapiens
caatattgtcattcct

SEQ ID NO: 163582 - DNA, 15 bp, Homo sapiens
caatcagctccttcc

SEQ ID NO: 163583 - DNA, 15 bp, Homo sapiens
caatcatctgtgtga

SEQ ID NO: 163584 - DNA, 19 bp, Homo sapiens
caatcatctgtgtgaaaat

SEQ ID NO: 163585 - DNA, 23 bp, Homo sapiens
caatcccaccaaccctcagagcc

SEQ ID NO: 163586 - DNA, 11 bp, Homo sapiens
caatcctggac

SEQ ID NO: 163587 - DNA, 20 bp, Homo sapiens
caatctaaccacatcaatat

SEQ ID NO: 163588 - DNA, 22 bp, Homo sapiens
caatgaatgaatgaatggctaa

SEQ ID NO: 163589 - DNA, 19 bp, Homo sapiens
caatgacatctcaggggcc

SEQ ID NO: 163590 - DNA, 16 bp, Homo sapiens
caatgcacacaaaaca

SEQ ID NO: 163591 - DNA, 19 bp, Homo sapiens
caatgggcactgggatgag

SEQ ID NO: 163592 - DNA, 11 bp, Homo sapiens
caatgtcttga

SEQ ID NO: 163593 - DNA, 14 bp, Homo sapiens
caatgtgaatcaga

SEQ ID NO: 163594 - DNA, 22 bp, Homo sapiens
caatgtgacttaatgccactaa

SEQ ID NO: 163595 - DNA, 16 bp, Homo sapiens
caatgtttcttttatc

SEQ ID NO: 163596 - DNA, 14 bp, Homo sapiens
caattcaacccttt

SEQ ID NO: 163597 - DNA, 15 bp, Homo sapiens
caattccctgctgtc

SEQ ID NO: 163598 - DNA, 13 bp, Homo sapiens
caattcctctggg

SEQ ID NO: 163599 - DNA, 14 bp, Homo sapiens
caattcctctggga

SEQ ID NO: 163600 - DNA, 13 bp, Homo sapiens
caatttacaaagt

SEQ ID NO: 163601 - DNA, 15 bp, Homo sapiens
caatttacaaagtgt

SEQ ID NO: 163602 - DNA, 17 bp, Homo sapiens
caatttacaaagtgtgt

SEQ ID NO: 163603 - DNA, 15 bp, Homo sapiens
caatttcctttatat

SEQ ID NO: 163604 - DNA, 19 bp, Homo sapiens
caatttcctttatatttag

SEQ ID NO: 163605 - DNA, 20 bp, Homo sapiens
caatttctacaaaatcctga

SEQ ID NO: 163606 - DNA, 16 bp, Homo sapiens
caatttctactttgaa

SEQ ID NO: 163607 - DNA, 16 bp, Homo sapiens
cacaaaggtataattt

SEQ ID NO: 163608 - DNA, 19 bp, Homo sapiens
cacaactatttttccaaaa

SEQ ID NO: 163609 - DNA, 12 bp, Homo sapiens
cacaacttgttt

SEQ ID NO: 163610 - DNA, 18 bp, Homo sapiens
cacaagaaatgaaagcag

SEQ ID NO: 163611 - DNA, 12 bp, Homo sapiens
cacaagaaattt

SEQ ID NO: 163612 - DNA, 23 bp, Homo sapiens
cacaagacccaaaaggcagaagc

SEQ ID NO: 163613 - DNA, 16 bp, Homo sapiens
cacaagattcccagag

SEQ ID NO: 163614 - DNA, 18 bp, Homo sapiens
cacaagattcccagagac

SEQ ID NO: 163615 - DNA, 17 bp, Homo sapiens
cacaagctgcaccctca

SEQ ID NO: 163616 - DNA, 23 bp, Homo sapiens
cacaagctgcaccctcaggcagg

SEQ ID NO: 163617 - DNA, 16 bp, Homo sapiens
cacacaggcaactgag

SEQ ID NO: 163618 - DNA, 19 bp, Homo sapiens
cacacaggcaactgaggca

SEQ ID NO: 163619 - DNA, 21 bp, Homo sapiens
cacacatataaacatcacaca

SEQ ID NO: 163620 - DNA, 15 bp, Homo sapiens
cacacccagcctcag

SEQ ID NO: 163621 - DNA, 18 bp, Homo sapiens
cacacccagcctcagtcc

SEQ ID NO: 163622 - DNA, 22 bp, Homo sapiens
cacacggacactcaaaagctgg

SEQ ID NO: 163623 - DNA, 24 bp, Homo sapiens
cacacgtctgaccctctccacccc

SEQ ID NO: 163624 - DNA, 19 bp, Homo sapiens
cacactcaaatcaagaaac

SEQ ID NO: 163625 - DNA, 14 bp, Homo sapiens
cacactccatcagc

SEQ ID NO: 163626 - DNA, 13 bp, Homo sapiens
cacactgaggcag

SEQ ID NO: 163627 - DNA, 15 bp, Homo sapiens
cacactgaggcaggg

SEQ ID NO: 163628 - DNA, 14 bp, Homo sapiens
cacacttcaggctc

SEQ ID NO: 163629 - DNA, 22 bp, Homo sapiens
cacacttcaggctcttctcctt

SEQ ID NO: 163630 - DNA, 16 bp, Homo sapiens
cacacttccaccagcc

SEQ ID NO: 163631 - DNA, 22 bp, Homo sapiens
cacacttggttgggtcctcaca

SEQ ID NO: 163632 - DNA, 20 bp, Homo sapiens
cacagacattctgccaggcc

SEQ ID NO: 163633 - DNA, 14 bp, Homo sapiens
cacagagacccccg

SEQ ID NO: 163634 - DNA, 22 bp, Homo sapiens
cacagagacccccggaacaagc

SEQ ID NO: 163635 - DNA, 22 bp, Homo sapiens
cacagagagggggccacctccc

SEQ ID NO: 163636 - DNA, 11 bp, Homo sapiens
cacagatgcct

SEQ ID NO: 163637 - DNA, 17 bp, Homo sapiens
cacagccagactggcac

SEQ ID NO: 163638 - DNA, 21 bp, Homo sapiens
cacagccgattcacctgagca

SEQ ID NO: 163639 - DNA, 19 bp, Homo sapiens
cacagcctcccctgccagg

SEQ ID NO: 163640 - DNA, 13 bp, Homo sapiens
cacagcctctgac

SEQ ID NO: 163641 - DNA, 20 bp, Homo sapiens
cacagcctctgacccctcct

SEQ ID NO: 163642 - DNA, 22 bp, Homo sapiens
cacagcctctgacccctcctca

SEQ ID NO: 163643 - DNA, 14 bp, Homo sapiens
cacagctcccaccc

SEQ ID NO: 163644 - DNA, 16 bp, Homo sapiens
cacagctcccacccca

SEQ ID NO: 163645 - DNA, 22 bp, Homo sapiens
cacgcctgcaaacgctgcctgc

SEQ ID NO: 163646 - DNA, 14 bp, Homo sapiens
cacgcctgtaatcc

SEQ ID NO: 163647 - DNA, 21 bp, Homo sapiens
cacgcctgtaatcccagcact

SEQ ID NO: 163648 - DNA, 16 bp, Homo sapiens
cacgctgtgggcaggt

SEQ ID NO: 163649 - DNA, 14 bp, Homo sapiens
cacggaagttttca

SEQ ID NO: 163650 - DNA, 18 bp, Homo sapiens
cacggacgtttccatcag

SEQ ID NO: 163651 - DNA, 15 bp, Homo sapiens
cacggagccactcct

SEQ ID NO: 163652 - DNA, 17 bp, Homo sapiens
cacggagccactcctct

SEQ ID NO: 163653 - DNA, 23 bp, Homo sapiens
cacggatccatgtagcaggactg

SEQ ID NO: 163654 - DNA, 13 bp, Homo sapiens
cacggatctgaga

SEQ ID NO: 163655 - DNA, 14 bp, Homo sapiens
cacggatctgagaa

SEQ ID NO: 163656 - DNA, 18 bp, Homo sapiens
cacggatctgagaatctt

SEQ ID NO: 163657 - DNA, 23 bp, Homo sapiens
cacggcaggacaacgaggaagcc

SEQ ID NO: 163658 - DNA, 17 bp, Homo sapiens
cacggtgccttttttca

SEQ ID NO: 163659 - DNA, 17 bp, Homo sapiens
cacgtagtagggtcagg

SEQ ID NO: 163660 - DNA, 23 bp, Homo sapiens
cacgtagtagggtcaggccacgg

SEQ ID NO: 163661 - DNA, 13 bp, Homo sapiens
cacgtccccctgg

SEQ ID NO: 163662 - DNA, 16 bp, Homo sapiens
cacgtccccctggggc

SEQ ID NO: 163663 - DNA, 14 bp, Homo sapiens
cacgtgccaggccc

SEQ ID NO: 163664 - DNA, 13 bp, Homo sapiens
cacgtggcctctt

SEQ ID NO: 163665 - DNA, 23 bp, Homo sapiens
cacgtggcctcttgagcagtggc

SEQ ID NO: 163666 - DNA, 21 bp, Homo sapiens
cactaaattgacacttaaaaa

SEQ ID NO: 163667 - DNA, 17 bp, Homo sapiens
cactacataaactgact

SEQ ID NO: 163668 - DNA, 13 bp, Homo sapiens
cactactgacatg

SEQ ID NO: 163669 - DNA, 21 bp, Homo sapiens
cactagggcagggacaggata

SEQ ID NO: 163670 - DNA, 19 bp, Homo sapiens
cactatttatctgtgcaaa

SEQ ID NO: 163671 - DNA, 18 bp, Homo sapiens
cactcaaaagctgggcag

SEQ ID NO: 163672 - DNA, 19 bp, Homo sapiens
cactcaaaagctgggcagg

SEQ ID NO: 163673 - DNA, 16 bp, Homo sapiens
cactcaaatcaagaaa

SEQ ID NO: 163674 - DNA, 15 bp, Homo sapiens
cactccaccacccaa

SEQ ID NO: 163675 - DNA, 16 bp, Homo sapiens
atgctccttgggccct

SEQ ID NO: 163676 - DNA, 19 bp, Homo sapiens
atgctctctgcagccagcc

SEQ ID NO: 163677 - DNA, 14 bp, Homo sapiens
atgctggagaagag

SEQ ID NO: 163678 - DNA, 15 bp, Homo sapiens
atgctggagaagaga

SEQ ID NO: 163679 - DNA, 17 bp, Homo sapiens
atgctggagaagagagg

SEQ ID NO: 163680 - DNA, 18 bp, Homo sapiens
atgctggagaagagagga

SEQ ID NO: 163681 - DNA, 23 bp, Homo sapiens
atgctgggaagacgcctgagctc

SEQ ID NO: 163682 - DNA, 16 bp, Homo sapiens
atgcttctcactgcca

SEQ ID NO: 163683 - DNA, 16 bp, Homo sapiens
atgctttttgaatgtt

SEQ ID NO: 163684 - DNA, 16 bp, Homo sapiens
atggaaacctgaaaaa

SEQ ID NO: 163685 - DNA, 11 bp, Homo sapiens
atggaaagaat

SEQ ID NO: 163686 - DNA, 15 bp, Homo sapiens
atggaaaggagagga

SEQ ID NO: 163687 - DNA, 19 bp, Homo sapiens
atggaaaggagaggaaaga

SEQ ID NO: 163688 - DNA, 17 bp, Homo sapiens
atggaaccgcaggaagc

SEQ ID NO: 163689 - DNA, 20 bp, Homo sapiens
atggaaccgcaggaagctgc

SEQ ID NO: 163690 - DNA, 16 bp, Homo sapiens
atggaatacagtgtta

SEQ ID NO: 163691 - DNA, 17 bp, Homo sapiens
atggaatttctcccagt

SEQ ID NO: 163692 - DNA, 15 bp, Homo sapiens
atggacactccagtg

SEQ ID NO: 163693 - DNA, 13 bp, Homo sapiens
atggacccaatgc

SEQ ID NO: 163694 - DNA, 18 bp, Homo sapiens
atggacccaatgcacaca

SEQ ID NO: 163695 - DNA, 23 bp, Homo sapiens
atggagcccaggcgggagcggtg

SEQ ID NO: 163696 - DNA, 16 bp, Homo sapiens
atggaggaaaaccaag

SEQ ID NO: 163697 - DNA, 11 bp, Homo sapiens
atggaggagaa

SEQ ID NO: 163698 - DNA, 15 bp, Homo sapiens
atggaggagaagaat

SEQ ID NO: 163699 - DNA, 19 bp, Homo sapiens
atggataacctatatgatt

SEQ ID NO: 163700 - DNA, 15 bp, Homo sapiens
atggatttccagcca

SEQ ID NO: 163701 - DNA, 23 bp, Homo sapiens
atggcaagaaagctggtaaacta

SEQ ID NO: 163702 - DNA, 22 bp, Homo sapiens
atggcacttagctatcagaaga

SEQ ID NO: 163703 - DNA, 21 bp, Homo sapiens
atggcagaaggcaaacccatc

SEQ ID NO: 163704 - DNA, 15 bp, Homo sapiens
atggcagagttgtaa

SEQ ID NO: 163705 - DNA, 16 bp, Homo sapiens
atggctataaatatat

SEQ ID NO: 163706 - DNA, 16 bp, Homo sapiens
atggctataggtgcta

SEQ ID NO: 163707 - DNA, 14 bp, Homo sapiens
atggctatatggca

SEQ ID NO: 163708 - DNA, 19 bp, Homo sapiens
atggctatatggcaagaaa

SEQ ID NO: 163709 - DNA, 23 bp, Homo sapiens
atggctccgaacaccctcgaagc

SEQ ID NO: 163710 - DNA, 14 bp, Homo sapiens
atggcttaatgttt

SEQ ID NO: 163711 - DNA, 16 bp, Homo sapiens
atggcttagttttcat

SEQ ID NO: 163712 - DNA, 14 bp, Homo sapiens
atgggaaaagagat

SEQ ID NO: 163713 - DNA, 13 bp, Homo sapiens
atgggacattttt

SEQ ID NO: 163714 - DNA, 15 bp, Homo sapiens
atgggagagtagatg

SEQ ID NO: 163715 - DNA, 16 bp, Homo sapiens
atggggaaggaggctg

SEQ ID NO: 163716 - DNA, 15 bp, Homo sapiens
atggggagaaaagac

SEQ ID NO: 163717 - DNA, 19 bp, Homo sapiens
atggggctgaacggggaga

SEQ ID NO: 163718 - DNA, 23 bp, Homo sapiens
atggtaaaagttacttattctag

SEQ ID NO: 163719 - DNA, 18 bp, Homo sapiens
atggtcagccctagggtg

SEQ ID NO: 163720 - DNA, 22 bp, Homo sapiens
atggtcatcttggagggaccaa

SEQ ID NO: 163721 - DNA, 13 bp, Homo sapiens
atggtccaggaga

SEQ ID NO: 163722 - DNA, 16 bp, Homo sapiens
atggtccaggagaagg

SEQ ID NO: 163723 - DNA, 18 bp, Homo sapiens
atggtccaggagaaggcc

SEQ ID NO: 163724 - DNA, 19 bp, Homo sapiens
atggtccaggagaaggcca

SEQ ID NO: 163725 - DNA, 15 bp, Homo sapiens
atggtccggtgtcct

SEQ ID NO: 163726 - DNA, 24 bp, Homo sapiens
atggtgaaaccccgtctctactaa

SEQ ID NO: 163727 - DNA, 17 bp, Homo sapiens
atggtgaaatttattag

SEQ ID NO: 163728 - DNA, 17 bp, Homo sapiens
atggtgatgaaatgtaa

SEQ ID NO: 163729 - DNA, 20 bp, Homo sapiens
atggttcccctgttcactct

SEQ ID NO: 163730 - DNA, 18 bp, Homo sapiens
atggttgccttaaagaaa

SEQ ID NO: 163731 - DNA, 17 bp, Homo sapiens
atgtaagctgaaaatat

SEQ ID NO: 163732 - DNA, 14 bp, Homo sapiens
atgtaagggaaact

SEQ ID NO: 163733 - DNA, 16 bp, Homo sapiens
atgtaagggaaactgc

SEQ ID NO: 163734 - DNA, 19 bp, Homo sapiens
atgtaatcttgaattgtaa

SEQ ID NO: 163735 - DNA, 15 bp, Homo sapiens
atgtaccatgtacat

SEQ ID NO: 163736 - DNA, 21 bp, Homo sapiens
atgtaccatgtacatgaagaa

SEQ ID NO: 163737 - DNA, 20 bp, Homo sapiens
atgtactcctctttacactg

SEQ ID NO: 163738 - DNA, 18 bp, Homo sapiens
atgtactgagccttgtaa

SEQ ID NO: 163739 - DNA, 19 bp, Homo sapiens
atgtatatttaaaagaaag

SEQ ID NO: 163740 - DNA, 18 bp, Homo sapiens
atgtatggaatacagtgt

SEQ ID NO: 163741 - DNA, 19 bp, Homo sapiens
atgtattctagctaatgta

SEQ ID NO: 163742 - DNA, 12 bp, Homo sapiens
atgtcacagggc

SEQ ID NO: 163743 - DNA, 16 bp, Homo sapiens
atgtcaccaccttccc

SEQ ID NO: 163744 - DNA, 18 bp, Homo sapiens
atgtcaccaccttcccag

SEQ ID NO: 163745 - DNA, 23 bp, Homo sapiens
atgtcagacatccatgtttgtaa

SEQ ID NO: 163746 - DNA, 16 bp, Homo sapiens
atgtcagcaaaaagca

SEQ ID NO: 163747 - DNA, 22 bp, Homo sapiens
atgtcagcaaaaagcaaaatca

SEQ ID NO: 163748 - DNA, 14 bp, Homo sapiens
atgtcatcatacat

SEQ ID NO: 163749 - DNA, 16 bp, Homo sapiens
atgtccactggttctt

SEQ ID NO: 163750 - DNA, 17 bp, Homo sapiens
atgtccactggttcttc

SEQ ID NO: 163751 - DNA, 20 bp, Homo sapiens
atgtcccaacttgtaaaaat

SEQ ID NO: 163752 - DNA, 19 bp, Homo sapiens
atgtccccaaacctgcaag

SEQ ID NO: 163753 - DNA, 15 bp, Homo sapiens
atgtcgcctctgcat

SEQ ID NO: 163754 - DNA, 12 bp, Homo sapiens
atgtctatttaa

SEQ ID NO: 163755 - DNA, 13 bp, Homo sapiens
atgtctatttaag

SEQ ID NO: 163756 - DNA, 23 bp, Homo sapiens
atgtctatttaagcctcatattt

SEQ ID NO: 163757 - DNA, 13 bp, Homo sapiens
atgtctctcagaa

SEQ ID NO: 163758 - DNA, 16 bp, Homo sapiens
atgtctctcagaattc

SEQ ID NO: 163759 - DNA, 20 bp, Homo sapiens
atgtctgctgaataataaac

SEQ ID NO: 163760 - DNA, 20 bp, Homo sapiens
atgtctttgttggaaaagaa

SEQ ID NO: 163761 - DNA, 22 bp, Homo sapiens
atgtgaaaatggtccaggagaa

SEQ ID NO: 163762 - DNA, 12 bp, Homo sapiens
atgtgaatcaga

SEQ ID NO: 163763 - DNA, 13 bp, Homo sapiens
atgtgacatttat

SEQ ID NO: 163764 - DNA, 19 bp, Homo sapiens
atgtgacatttatatattg

SEQ ID NO: 163765 - DNA, 19 bp, Homo sapiens
atgtgaccactctgtcttg

SEQ ID NO: 163766 - DNA, 13 bp, Homo sapiens
atgtgatatataa

SEQ ID NO: 163767 - DNA, 16 bp, Homo sapiens
atgtgatatataagtg

SEQ ID NO: 163768 - DNA, 21 bp, Homo sapiens
atgtgatatataagtgtacat

SEQ ID NO: 163769 - DNA, 16 bp, Homo sapiens
atgtgatccttttatg

SEQ ID NO: 163770 - DNA, 18 bp, Homo sapiens
atgtgatccttttatgtt

SEQ ID NO: 163771 - DNA, 21 bp, Homo sapiens
atgtgatccttttatgttatt

SEQ ID NO: 163772 - DNA, 15 bp, Homo sapiens
atgtgcctgatccag

SEQ ID NO: 163773 - DNA, 15 bp, Homo sapiens
atgtggccctggcct

SEQ ID NO: 163774 - DNA, 10 bp, Homo sapiens
atgtgggagg

SEQ ID NO: 163775 - DNA, 22 bp, Homo sapiens
atgtgtacaaaagtttcatcct

SEQ ID NO: 163776 - DNA, 16 bp, Homo sapiens
atgtgtgagtgtgtgc

SEQ ID NO: 163777 - DNA, 17 bp, Homo sapiens
atgtgtgagtgtgtgca

SEQ ID NO: 163778 - DNA, 15 bp, Homo sapiens
atgtgtgcgagtgtg

SEQ ID NO: 163779 - DNA, 19 bp, Homo sapiens
atgtgtgcgagtgtgtgca

SEQ ID NO: 163780 - DNA, 16 bp, Homo sapiens
atgtgtgtgcaagtgt

SEQ ID NO: 163781 - DNA, 15 bp, Homo sapiens
atgtgtgtgctcagg

SEQ ID NO: 163782 - DNA, 14 bp, Homo sapiens
atgtgttgaaaaaa

SEQ ID NO: 163783 - DNA, 23 bp, Homo sapiens
atgttaaccagaataaagttctg

SEQ ID NO: 163784 - DNA, 12 bp, Homo sapiens
atgttaagcaga

SEQ ID NO: 163785 - DNA, 23 bp, Homo sapiens
atgttaattcagcactgatttca

SEQ ID NO: 163786 - DNA, 15 bp, Homo sapiens
atgttagcaaagagt

SEQ ID NO: 163787 - DNA, 14 bp, Homo sapiens
cagaataatgaatg

SEQ ID NO: 163788 - DNA, 12 bp, Homo sapiens
cagaatatctgg

SEQ ID NO: 163789 - DNA, 13 bp, Homo sapiens
cagaattctgcta

SEQ ID NO: 163790 - DNA, 21 bp, Homo sapiens
cagaattctgctacctcactg

SEQ ID NO: 163791 - DNA, 23 bp, Homo sapiens
cagaattctgctacctcactggg

SEQ ID NO: 163792 - DNA, 20 bp, Homo sapiens
cagacaaaaacagcctcaca

SEQ ID NO: 163793 - DNA, 21 bp, Homo sapiens
cagacaaagtaattcctctca

SEQ ID NO: 163794 - DNA, 14 bp, Homo sapiens
cagacacacacaca

SEQ ID NO: 163795 - DNA, 12 bp, Homo sapiens
cagacagaggat

SEQ ID NO: 163796 - DNA, 19 bp, Homo sapiens
cagacagaggatgagctct

SEQ ID NO: 163797 - DNA, 15 bp, Homo sapiens
cagacagcagctcag

SEQ ID NO: 163798 - DNA, 16 bp, Homo sapiens
cagacagcagctcagg

SEQ ID NO: 163799 - DNA, 20 bp, Homo sapiens
cagacaggaaagggaaggcc

SEQ ID NO: 163800 - DNA, 21 bp, Homo sapiens
cagacaggagaaatgcatcca

SEQ ID NO: 163801 - DNA, 12 bp, Homo sapiens
cagacaggagga

SEQ ID NO: 163802 - DNA, 14 bp, Homo sapiens
cagacaggctctta

SEQ ID NO: 163803 - DNA, 17 bp, Homo sapiens
cagacatagaattaaca

SEQ ID NO: 163804 - DNA, 16 bp, Homo sapiens
cagacattctgccagg

SEQ ID NO: 163805 - DNA, 13 bp, Homo sapiens
cagacccctggct

SEQ ID NO: 163806 - DNA, 14 bp, Homo sapiens
cagacccctggctt

SEQ ID NO: 163807 - DNA, 22 bp, Homo sapiens
cagacccctggcttttcactgc

SEQ ID NO: 163808 - DNA, 15 bp, Homo sapiens
cagaccctaccccac

SEQ ID NO: 163809 - DNA, 17 bp, Homo sapiens
cagaccctaccccacca

SEQ ID NO: 163810 - DNA, 15 bp, Homo sapiens
cagacctccccagcc

SEQ ID NO: 163811 - DNA, 22 bp, Homo sapiens
cagacctccccagcccctagcc

SEQ ID NO: 163812 - DNA, 17 bp, Homo sapiens
cagacctgagctcccca

SEQ ID NO: 163813 - DNA, 22 bp, Homo sapiens
cagactagtttagttaaatgag

SEQ ID NO: 163814 - DNA, 17 bp, Homo sapiens
cagactggtgagcagac

SEQ ID NO: 163815 - DNA, 23 bp, Homo sapiens
cagactgtgtattcattgaagtc

SEQ ID NO: 163816 - DNA, 14 bp, Homo sapiens
cagacttcacactg

SEQ ID NO: 163817 - DNA, 21 bp, Homo sapiens
cagactttacatgacacagct

SEQ ID NO: 163818 - DNA, 20 bp, Homo sapiens
cagagaaggcaggaatgtgt

SEQ ID NO: 163819 - DNA, 11 bp, Homo sapiens
cagagaagttc

SEQ ID NO: 163820 - DNA, 17 bp, Homo sapiens
cagagacacctgcacct

SEQ ID NO: 163821 - DNA, 18 bp, Homo sapiens
cagagacacctgcacctc

SEQ ID NO: 163822 - DNA, 14 bp, Homo sapiens
cagagacaggaaaa

SEQ ID NO: 163823 - DNA, 23 bp, Homo sapiens
cagagacaggaaaatcctctggc

SEQ ID NO: 163824 - DNA, 15 bp, Homo sapiens
cagagaccctctgcc

SEQ ID NO: 163825 - DNA, 20 bp, Homo sapiens
cagagaccctctgccaccag

SEQ ID NO: 163826 - DNA, 17 bp, Homo sapiens
cagagaccgtcctcacc

SEQ ID NO: 163827 - DNA, 18 bp, Homo sapiens
cagagaccgtcctcaccc

SEQ ID NO: 163828 - DNA, 20 bp, Homo sapiens
cagagaccgtcctcacccct

SEQ ID NO: 163829 - DNA, 21 bp, Homo sapiens
cagagactcagggccccagca

SEQ ID NO: 163830 - DNA, 22 bp, Homo sapiens
cagagactcagggccccagcac

SEQ ID NO: 163831 - DNA, 23 bp, Homo sapiens
cagagactcagggccccagcact

SEQ ID NO: 163832 - DNA, 18 bp, Homo sapiens
cagagagcggtctcaggc

SEQ ID NO: 163833 - DNA, 17 bp, Homo sapiens
cagagaggacgtgggcg

SEQ ID NO: 163834 - DNA, 21 bp, Homo sapiens
cagagaggacgtgggcggcag

SEQ ID NO: 163835 - DNA, 15 bp, Homo sapiens
cagagagtggctcct

SEQ ID NO: 163836 - DNA, 14 bp, Homo sapiens
cagagatgcctcca

SEQ ID NO: 163837 - DNA, 18 bp, Homo sapiens
cagagatgggactgggag

SEQ ID NO: 163838 - DNA, 19 bp, Homo sapiens
cagagatgggactgggagg

SEQ ID NO: 163839 - DNA, 20 bp, Homo sapiens
cagagcaagtgagaccctgt

SEQ ID NO: 163840 - DNA, 18 bp, Homo sapiens
cagagcacagcagcccct

SEQ ID NO: 163841 - DNA, 13 bp, Homo sapiens
cagagctgggagg

SEQ ID NO: 163842 - DNA, 14 bp, Homo sapiens
cagagctgggaggc

SEQ ID NO: 163843 - DNA, 20 bp, Homo sapiens
cagagctgggaggcatggcc

SEQ ID NO: 163844 - DNA, 23 bp, Homo sapiens
cagagctgggaggcatggccctg

SEQ ID NO: 163845 - DNA, 19 bp, Homo sapiens
cagaggaactgtccagaga

SEQ ID NO: 163846 - DNA, 21 bp, Homo sapiens
cagaggaactgtccagagagc

SEQ ID NO: 163847 - DNA, 18 bp, Homo sapiens
cagaggaaggggccagag

SEQ ID NO: 163848 - DNA, 19 bp, Homo sapiens
cagaggaaggggccagagg

SEQ ID NO: 163849 - DNA, 21 bp, Homo sapiens
cagaggatgagctctacccag

SEQ ID NO: 163850 - DNA, 14 bp, Homo sapiens
cagagggcactctg

SEQ ID NO: 163851 - DNA, 18 bp, Homo sapiens
cagagggcagaggctgga

SEQ ID NO: 163852 - DNA, 14 bp, Homo sapiens
cagaggtggccaga

SEQ ID NO: 163853 - DNA, 17 bp, Homo sapiens
cagaggtggccagagct

SEQ ID NO: 163854 - DNA, 18 bp, Homo sapiens
cagagtcggaacggagaa

SEQ ID NO: 163855 - DNA, 20 bp, Homo sapiens
cagagtgagacccagccctc

SEQ ID NO: 163856 - DNA, 18 bp, Homo sapiens
cagagttgtaaatatata

SEQ ID NO: 163857 - DNA, 14 bp, Homo sapiens
cagataaacagtag

SEQ ID NO: 163858 - DNA, 17 bp, Homo sapiens
cagataatcagcctctt

SEQ ID NO: 163859 - DNA, 14 bp, Homo sapiens
cagataatgtgaaa

SEQ ID NO: 163860 - DNA, 16 bp, Homo sapiens
cagataatgtgaaaat

SEQ ID NO: 163861 - DNA, 15 bp, Homo sapiens
cagatatgatatgta

SEQ ID NO: 163862 - DNA, 22 bp, Homo sapiens
cagatcccagaaggacctcctg

SEQ ID NO: 163863 - DNA, 22 bp, Homo sapiens
cagatgcctccaccccccagaa

SEQ ID NO: 163864 - DNA, 22 bp, Homo sapiens
cagatggaaccgcaggaagctg

SEQ ID NO: 163865 - DNA, 17 bp, Homo sapiens
cagatggaatgctgtgt

SEQ ID NO: 163866 - DNA, 19 bp, Homo sapiens
cagatggaatgctgtgtta

SEQ ID NO: 163867 - DNA, 22 bp, Homo sapiens
cagatggttttataatctgatt

SEQ ID NO: 163868 - DNA, 16 bp, Homo sapiens
cagcaaaccggggcct

SEQ ID NO: 163869 - DNA, 14 bp, Homo sapiens
cagcaactccaact

SEQ ID NO: 163870 - DNA, 22 bp, Homo sapiens
cagcaagggtgatgggaaagca

SEQ ID NO: 163871 - DNA, 20 bp, Homo sapiens
cagcaatgacatctcagggg

SEQ ID NO: 163872 - DNA, 21 bp, Homo sapiens
cagcaatgacatctcaggggc

SEQ ID NO: 163873 - DNA, 19 bp, Homo sapiens
cagcactaaagcagtggac

SEQ ID NO: 163874 - DNA, 14 bp, Homo sapiens
cagcactgatttca

SEQ ID NO: 163875 - DNA, 12 bp, Homo sapiens
cagcactgtccc

SEQ ID NO: 163876 - DNA, 14 bp, Homo sapiens
cagcactgtccctt

SEQ ID NO: 163877 - DNA, 16 bp, Homo sapiens
cagcactgtcccttgc

SEQ ID NO: 163878 - DNA, 18 bp, Homo sapiens
cagcactgtcccttgcct

SEQ ID NO: 163879 - DNA, 15 bp, Homo sapiens
cagcactttgggagg

SEQ ID NO: 163880 - DNA, 13 bp, Homo sapiens
cagcagagtgtgg

SEQ ID NO: 163881 - DNA, 13 bp, Homo sapiens
cagcagccagctc

SEQ ID NO: 163882 - DNA, 15 bp, Homo sapiens
cagcagccagctctc

SEQ ID NO: 163883 - DNA, 17 bp, Homo sapiens
cagcagccagctctcag

SEQ ID NO: 163884 - DNA, 18 bp, Homo sapiens
cagcagccagctctcagc

SEQ ID NO: 163885 - DNA, 16 bp, Homo sapiens
cagcagcccctgcaca

SEQ ID NO: 163886 - DNA, 12 bp, Homo sapiens
cagcagccctcc

SEQ ID NO: 163887 - DNA, 13 bp, Homo sapiens
cagcagccctcct

SEQ ID NO: 163888 - DNA, 15 bp, Homo sapiens
cagcagccctcctca

SEQ ID NO: 163889 - DNA, 18 bp, Homo sapiens
cagcagccctcctcaccc

SEQ ID NO: 163890 - DNA, 12 bp, Homo sapiens
cagcagcctgga

SEQ ID NO: 163891 - DNA, 22 bp, Homo sapiens
cagcagcctggaccctgtggat

SEQ ID NO: 163892 - DNA, 15 bp, Homo sapiens
cagcaggaggccagg

SEQ ID NO: 163893 - DNA, 18 bp, Homo sapiens
cagcagggagggcttctg

SEQ ID NO: 163894 - DNA, 11 bp, Homo sapiens
cagcagggcta

SEQ ID NO: 163895 - DNA, 20 bp, Homo sapiens
cagcagtgtgaggccagggc

SEQ ID NO: 163896 - DNA, 17 bp, Homo sapiens
cagcagtgttccccatc

SEQ ID NO: 163897 - DNA, 21 bp, Homo sapiens
cagcagtgttccccatctggg

SEQ ID NO: 163898 - DNA, 21 bp, Homo sapiens
cagcagttgaaaagactccaa

SEQ ID NO: 163899 - DNA, 17 bp, Homo sapiens
cagcagtttgggaggtc

SEQ ID NO: 163900 - DNA, 19 bp, Homo sapiens
cagcatacctttattgtga

SEQ ID NO: 163901 - DNA, 14 bp, Homo sapiens
cagcattctcactc

SEQ ID NO: 163902 - DNA, 15 bp, Homo sapiens
cagccaaagcctcct

SEQ ID NO: 163903 - DNA, 17 bp, Homo sapiens
cagccagaacgtggctc

SEQ ID NO: 163904 - DNA, 20 bp, Homo sapiens
cagccagactggcacagttt

SEQ ID NO: 163905 - DNA, 15 bp, Homo sapiens
cagccagcagccagc

SEQ ID NO: 163906 - DNA, 11 bp, Homo sapiens
cagccagccca

SEQ ID NO: 163907 - DNA, 12 bp, Homo sapiens
cagccagcccag

SEQ ID NO: 163908 - DNA, 13 bp, Homo sapiens
cagccagcccagc

SEQ ID NO: 163909 - DNA, 17 bp, Homo sapiens
cagccagcccagcccag

SEQ ID NO: 163910 - DNA, 19 bp, Homo sapiens
cagccagcccagcccagct

SEQ ID NO: 163911 - DNA, 20 bp, Homo sapiens
cagccagcccagcccagctg

SEQ ID NO: 163912 - DNA, 12 bp, Homo sapiens
cagccagctctc

SEQ ID NO: 163913 - DNA, 15 bp, Homo sapiens
cagccagctctcagc

SEQ ID NO: 163914 - DNA, 17 bp, Homo sapiens
cagccagctctcagcca

SEQ ID NO: 163915 - DNA, 22 bp, Homo sapiens
cagccagtcccgtttcatttag

SEQ ID NO: 163916 - DNA, 19 bp, Homo sapiens
cagccattcactgccccca

SEQ ID NO: 163917 - DNA, 19 bp, Homo sapiens
cagcccacatagtgatggt

SEQ ID NO: 163918 - DNA, 19 bp, Homo sapiens
cagccccgtggggttcctc

SEQ ID NO: 163919 - DNA, 12 bp, Homo sapiens
cagcccctagcc

SEQ ID NO: 163920 - DNA, 13 bp, Homo sapiens
cagcccctagccc

SEQ ID NO: 163921 - DNA, 15 bp, Homo sapiens
cagcccctagcccag

SEQ ID NO: 163922 - DNA, 16 bp, Homo sapiens
cagcccctagcccagg

SEQ ID NO: 163923 - DNA, 17 bp, Homo sapiens
cagcccctagcccagga

SEQ ID NO: 163924 - DNA, 22 bp, Homo sapiens
cagcccctagcccaggagagag

SEQ ID NO: 163925 - DNA, 24 bp, Homo sapiens
cagcccctagcccaggagagagaa

SEQ ID NO: 163926 - DNA, 14 bp, Homo sapiens
cagcccctcctctg

SEQ ID NO: 163927 - DNA, 17 bp, Homo sapiens
cagcccctcctctgcca

SEQ ID NO: 163928 - DNA, 13 bp, Homo sapiens
cagcccctgcaca

SEQ ID NO: 163929 - DNA, 19 bp, Homo sapiens
acagcagtgttccccatct

SEQ ID NO: 163930 - DNA, 15 bp, Homo sapiens
acagcagttgaaaag

SEQ ID NO: 163931 - DNA, 15 bp, Homo sapiens
acagccagactggca

SEQ ID NO: 163932 - DNA, 15 bp, Homo sapiens
acagccccagagcag

SEQ ID NO: 163933 - DNA, 20 bp, Homo sapiens
acagccgctcctgtctgcca

SEQ ID NO: 163934 - DNA, 17 bp, Homo sapiens
acagcctcacagaagaa

SEQ ID NO: 163935 - DNA, 20 bp, Homo sapiens
acagcctctgacccctcctc

SEQ ID NO: 163936 - DNA, 21 bp, Homo sapiens
acagcctctgacccctcctca

SEQ ID NO: 163937 - DNA, 23 bp, Homo sapiens
acagcctctgacccctcctcact

SEQ ID NO: 163938 - DNA, 13 bp, Homo sapiens
acagcctctgact

SEQ ID NO: 163939 - DNA, 15 bp, Homo sapiens
acagcctgcaagtca

SEQ ID NO: 163940 - DNA, 11 bp, Homo sapiens
acagcctggca

SEQ ID NO: 163941 - DNA, 20 bp, Homo sapiens
acagcgacatagcccatccc

SEQ ID NO: 163942 - DNA, 15 bp, Homo sapiens
acagcggcccctgca

SEQ ID NO: 163943 - DNA, 14 bp, Homo sapiens
acagctccctctgc

SEQ ID NO: 163944 - DNA, 16 bp, Homo sapiens
acagctccctctgcct

SEQ ID NO: 163945 - DNA, 16 bp, Homo sapiens
acagctgagagacttt

SEQ ID NO: 163946 - DNA, 15 bp, Homo sapiens
acagctgtccctgtc

SEQ ID NO: 163947 - DNA, 16 bp, Homo sapiens
acaggaaagggaaggc

SEQ ID NO: 163948 - DNA, 17 bp, Homo sapiens
acaggaagtcttcaggg

SEQ ID NO: 163949 - DNA, 14 bp, Homo sapiens
acaggactctgcct

SEQ ID NO: 163950 - DNA, 19 bp, Homo sapiens
acaggagagaaaggggatg

SEQ ID NO: 163951 - DNA, 15 bp, Homo sapiens
acaggattagacagt

SEQ ID NO: 163952 - DNA, 14 bp, Homo sapiens
acaggattattgga

SEQ ID NO: 163953 - DNA, 16 bp, Homo sapiens
acaggcaactgaggca

SEQ ID NO: 163954 - DNA, 22 bp, Homo sapiens
acaggcaactgaggcagacagc

SEQ ID NO: 163955 - DNA, 12 bp, Homo sapiens
acaggcacaaaa

SEQ ID NO: 163956 - DNA, 14 bp, Homo sapiens
acaggcagcattta

SEQ ID NO: 163957 - DNA, 12 bp, Homo sapiens
acagggacccac

SEQ ID NO: 163958 - DNA, 16 bp, Homo sapiens
acagggacttgaagtt

SEQ ID NO: 163959 - DNA, 24 bp, Homo sapiens
acagggcatgccccggccacctct

SEQ ID NO: 163960 - DNA, 15 bp, Homo sapiens
acagggtctgctctt

SEQ ID NO: 163961 - DNA, 23 bp, Homo sapiens
acagggtctgctctttctctgcc

SEQ ID NO: 163962 - DNA, 22 bp, Homo sapiens
acagggtttggctgtgtctaaa

SEQ ID NO: 163963 - DNA, 19 bp, Homo sapiens
acaggtctcctcttaaaaa

SEQ ID NO: 163964 - DNA, 14 bp, Homo sapiens
acaggtgtttatac

SEQ ID NO: 163965 - DNA, 22 bp, Homo sapiens
acagtcaaggagtggcttacta

SEQ ID NO: 163966 - DNA, 19 bp, Homo sapiens
acagtcctaactggtatag

SEQ ID NO: 163967 - DNA, 17 bp, Homo sapiens
acagtgaaggctgtcct

SEQ ID NO: 163968 - DNA, 13 bp, Homo sapiens
acagttccttcag

SEQ ID NO: 163969 - DNA, 15 bp, Homo sapiens
acagttgaaaaacag

SEQ ID NO: 163970 - DNA, 16 bp, Homo sapiens
acagttgaaaaacagc

SEQ ID NO: 163971 - DNA, 15 bp, Homo sapiens
acagttgctgtcata

SEQ ID NO: 163972 - DNA, 21 bp, Homo sapiens
acagttgctgtcataagaatg

SEQ ID NO: 163973 - DNA, 21 bp, Homo sapiens
acataagtaattcaagaaaac

SEQ ID NO: 163974 - DNA, 19 bp, Homo sapiens
acataagtttaggataaaa

SEQ ID NO: 163975 - DNA, 18 bp, Homo sapiens
acataattttttattcaa

SEQ ID NO: 163976 - DNA, 14 bp, Homo sapiens
acataccctccccc

SEQ ID NO: 163977 - DNA, 12 bp, Homo sapiens
acatacttcagc

SEQ ID NO: 163978 - DNA, 14 bp, Homo sapiens
acatagaattaaca

SEQ ID NO: 163979 - DNA, 22 bp, Homo sapiens
acatagagatcatcctttccag

SEQ ID NO: 163980 - DNA, 14 bp, Homo sapiens
acatagcccatccc

SEQ ID NO: 163981 - DNA, 22 bp, Homo sapiens
acatagcccatccctgcctggt

SEQ ID NO: 163982 - DNA, 13 bp, Homo sapiens
acatatgtgaata

SEQ ID NO: 163983 - DNA, 16 bp, Homo sapiens
acatcaacatcttggt

SEQ ID NO: 163984 - DNA, 18 bp, Homo sapiens
acatcaacatcttggtca

SEQ ID NO: 163985 - DNA, 18 bp, Homo sapiens
acatcaagcacagaagga

SEQ ID NO: 163986 - DNA, 20 bp, Homo sapiens
acatcaatattgtcattcct

SEQ ID NO: 163987 - DNA, 16 bp, Homo sapiens
acatcaccacagttta

SEQ ID NO: 163988 - DNA, 18 bp, Homo sapiens
acatccatgtttgtaaaa

SEQ ID NO: 163989 - DNA, 20 bp, Homo sapiens
acatccatttcatctatttc

SEQ ID NO: 163990 - DNA, 18 bp, Homo sapiens
acatcccattgccctggt

SEQ ID NO: 163991 - DNA, 16 bp, Homo sapiens
acatccctgccagctc

SEQ ID NO: 163992 - DNA, 17 bp, Homo sapiens
acatccctgccagctct

SEQ ID NO: 163993 - DNA, 21 bp, Homo sapiens
acatcctttctattgaaaaat

SEQ ID NO: 163994 - DNA, 16 bp, Homo sapiens
acatctaacctcatct

SEQ ID NO: 163995 - DNA, 14 bp, Homo sapiens
cagcgccagcctgt

SEQ ID NO: 163996 - DNA, 22 bp, Homo sapiens
cagcgcctagtggggtctccct

SEQ ID NO: 163997 - DNA, 15 bp, Homo sapiens
cagcgtgctttaaaa

SEQ ID NO: 163998 - DNA, 19 bp, Homo sapiens
cagcgtgctttaaaaaata

SEQ ID NO: 163999 - DNA, 16 bp, Homo sapiens
cagctactgatttttg

SEQ ID NO: 164000 - DNA, 17 bp, Homo sapiens
cagctatacctgtgcct

SEQ ID NO: 164001 - DNA, 21 bp, Homo sapiens
cagctatacctgtgcctcggc

SEQ ID NO: 164002 - DNA, 23 bp, Homo sapiens
cagctatacctgtgcctcggctt

SEQ ID NO: 164003 - DNA, 17 bp, Homo sapiens
cagctatctctcagtga

SEQ ID NO: 164004 - DNA, 18 bp, Homo sapiens
cagctatctctcagtgaa

SEQ ID NO: 164005 - DNA, 11 bp, Homo sapiens
cagctcagcgc

SEQ ID NO: 164006 - DNA, 13 bp, Homo sapiens
cagctcagcgcca

SEQ ID NO: 164007 - DNA, 12 bp, Homo sapiens
cagctcaggcac

SEQ ID NO: 164008 - DNA, 21 bp, Homo sapiens
cagctcccaaggctctgagca

SEQ ID NO: 164009 - DNA, 16 bp, Homo sapiens
cagctcccctcggaga

SEQ ID NO: 164010 - DNA, 16 bp, Homo sapiens
cagctccctctgcctg

SEQ ID NO: 164011 - DNA, 13 bp, Homo sapiens
cagctccttcctg

SEQ ID NO: 164012 - DNA, 12 bp, Homo sapiens
cagctctcagcc

SEQ ID NO: 164013 - DNA, 16 bp, Homo sapiens
cagctctccctctggc

SEQ ID NO: 164014 - DNA, 19 bp, Homo sapiens
cagctctccctctggccct

SEQ ID NO: 164015 - DNA, 20 bp, Homo sapiens
cagctctccctctggccctg

SEQ ID NO: 164016 - DNA, 18 bp, Homo sapiens
cagctctgaaaccagtgt

SEQ ID NO: 164017 - DNA, 23 bp, Homo sapiens
cagctcttctgccggccctgggg

SEQ ID NO: 164018 - DNA, 16 bp, Homo sapiens
cagctgacctttgtca

SEQ ID NO: 164019 - DNA, 15 bp, Homo sapiens
cagctgcagagacag

SEQ ID NO: 164020 - DNA, 15 bp, Homo sapiens
cagctgctcccctcc

SEQ ID NO: 164021 - DNA, 18 bp, Homo sapiens
cagctgctcccctccctc

SEQ ID NO: 164022 - DNA, 21 bp, Homo sapiens
cagctgctcccctccctcctc

SEQ ID NO: 164023 - DNA, 20 bp, Homo sapiens
cagctgctgaaacaacaaat

SEQ ID NO: 164024 - DNA, 18 bp, Homo sapiens
cagctggatgatggtctt

SEQ ID NO: 164025 - DNA, 15 bp, Homo sapiens
cagctggcagcagag

SEQ ID NO: 164026 - DNA, 18 bp, Homo sapiens
cagctggcagcagagtgt

SEQ ID NO: 164027 - DNA, 18 bp, Homo sapiens
cagctgtaacacagctga

SEQ ID NO: 164028 - DNA, 16 bp, Homo sapiens
cagctgtaatctatga

SEQ ID NO: 164029 - DNA, 12 bp, Homo sapiens
cagctgtccctg

SEQ ID NO: 164030 - DNA, 17 bp, Homo sapiens
cagctgtccctgtcacc

SEQ ID NO: 164031 - DNA, 13 bp, Homo sapiens
cagctgtgagcct

SEQ ID NO: 164032 - DNA, 15 bp, Homo sapiens
cagctgtgagccttg

SEQ ID NO: 164033 - DNA, 14 bp, Homo sapiens
cagctgtttaagat

SEQ ID NO: 164034 - DNA, 18 bp, Homo sapiens
cagcttctatccttgact

SEQ ID NO: 164035 - DNA, 17 bp, Homo sapiens
cagcttgctgccctagg

SEQ ID NO: 164036 - DNA, 21 bp, Homo sapiens
cagctttaaactcagggacag

SEQ ID NO: 164037 - DNA, 15 bp, Homo sapiens
cagctttacatgcaa

SEQ ID NO: 164038 - DNA, 21 bp, Homo sapiens
cagctttgtttgttgtcagct

SEQ ID NO: 164039 - DNA, 23 bp, Homo sapiens
cagctttgtttgttgtcagctga

SEQ ID NO: 164040 - DNA, 16 bp, Homo sapiens
cagctttttgtctttt

SEQ ID NO: 164041 - DNA, 19 bp, Homo sapiens
caggaaaactgacagagga

SEQ ID NO: 164042 - DNA, 16 bp, Homo sapiens
caggaaaatcctctgg

SEQ ID NO: 164043 - DNA, 21 bp, Homo sapiens
caggaaagggaaggccccaca

SEQ ID NO: 164044 - DNA, 19 bp, Homo sapiens
caggaaatcaaatatgcaa

SEQ ID NO: 164045 - DNA, 12 bp, Homo sapiens
caggaagctcag

SEQ ID NO: 164046 - DNA, 17 bp, Homo sapiens
caggaagctgctccgtg

SEQ ID NO: 164047 - DNA, 18 bp, Homo sapiens
caggaagctgctccgtgc

SEQ ID NO: 164048 - DNA, 18 bp, Homo sapiens
caggaaggatgagcattt

SEQ ID NO: 164049 - DNA, 15 bp, Homo sapiens
caggaagtagaggag

SEQ ID NO: 164050 - DNA, 16 bp, Homo sapiens
caggaagtcttcaggg

SEQ ID NO: 164051 - DNA, 10 bp, Homo sapiens
caggaagtga

SEQ ID NO: 164052 - DNA, 18 bp, Homo sapiens
caggaatgttaaagtcag

SEQ ID NO: 164053 - DNA, 19 bp, Homo sapiens
caggaatgttaaagtcagt

SEQ ID NO: 164054 - DNA, 19 bp, Homo sapiens
caggacaccacacccagcc

SEQ ID NO: 164055 - DNA, 13 bp, Homo sapiens
caggacaggacca

SEQ ID NO: 164056 - DNA, 12 bp, Homo sapiens
caggacaggccc

SEQ ID NO: 164057 - DNA, 14 bp, Homo sapiens
caggacatttctct

SEQ ID NO: 164058 - DNA, 18 bp, Homo sapiens
caggacatttctctaaga

SEQ ID NO: 164059 - DNA, 15 bp, Homo sapiens
caggacccagaggaa

SEQ ID NO: 164060 - DNA, 23 bp, Homo sapiens
caggacctcaggtgagaagcaga

SEQ ID NO: 164061 - DNA, 21 bp, Homo sapiens
caggacctctgaaaccctgga

SEQ ID NO: 164062 - DNA, 14 bp, Homo sapiens
caggacctgcctgt

SEQ ID NO: 164063 - DNA, 15 bp, Homo sapiens
caggacctgcctgta

SEQ ID NO: 164064 - DNA, 19 bp, Homo sapiens
caggacctgcctgtagccc

SEQ ID NO: 164065 - DNA, 18 bp, Homo sapiens
caggactcagaagcctct

SEQ ID NO: 164066 - DNA, 12 bp, Homo sapiens
caggactctgcc

SEQ ID NO: 164067 - DNA, 16 bp, Homo sapiens
caggactctgcctcct

SEQ ID NO: 164068 - DNA, 17 bp, Homo sapiens
caggactgagccccgca

SEQ ID NO: 164069 - DNA, 14 bp, Homo sapiens
caggactgtgactc

SEQ ID NO: 164070 - DNA, 14 bp, Homo sapiens
caggagagagaaag

SEQ ID NO: 164071 - DNA, 17 bp, Homo sapiens
caggagaggggcagaac

SEQ ID NO: 164072 - DNA, 22 bp, Homo sapiens
cagtgcaatggtataaatttca

SEQ ID NO: 164073 - DNA, 12 bp, Homo sapiens
cagtgcatctca

SEQ ID NO: 164074 - DNA, 15 bp, Homo sapiens
cagtgcatctcagcc

SEQ ID NO: 164075 - DNA, 16 bp, Homo sapiens
cagtgcatctcagccc

SEQ ID NO: 164076 - DNA, 21 bp, Homo sapiens
cagtgccagcaatgacatctc

SEQ ID NO: 164077 - DNA, 11 bp, Homo sapiens
cagtgcctgct

SEQ ID NO: 164078 - DNA, 13 bp, Homo sapiens
cagtgcctgctga

SEQ ID NO: 164079 - DNA, 19 bp, Homo sapiens
cagtgccttacctcctgcc

SEQ ID NO: 164080 - DNA, 13 bp, Homo sapiens
cagtggacaccag

SEQ ID NO: 164081 - DNA, 22 bp, Homo sapiens
cagtggacaccaggagtccctg

SEQ ID NO: 164082 - DNA, 14 bp, Homo sapiens
cagtggagaattat

SEQ ID NO: 164083 - DNA, 15 bp, Homo sapiens
cagtggaggaagagg

SEQ ID NO: 164084 - DNA, 19 bp, Homo sapiens
cagtggctggtccagggct

SEQ ID NO: 164085 - DNA, 22 bp, Homo sapiens
cagtgggaacgtgactgcccca

SEQ ID NO: 164086 - DNA, 20 bp, Homo sapiens
cagtggtccacatcccggga

SEQ ID NO: 164087 - DNA, 15 bp, Homo sapiens
cagtgtatttgtatt

SEQ ID NO: 164088 - DNA, 14 bp, Homo sapiens
cagtgtcaatgcag

SEQ ID NO: 164089 - DNA, 19 bp, Homo sapiens
cagtgtcccctccactgtc

SEQ ID NO: 164090 - DNA, 18 bp, Homo sapiens
cagtgtgaggccagggca

SEQ ID NO: 164091 - DNA, 15 bp, Homo sapiens
cagtgttttctggga

SEQ ID NO: 164092 - DNA, 15 bp, Homo sapiens
cagttactcagccct

SEQ ID NO: 164093 - DNA, 17 bp, Homo sapiens
cagttactcagccctgg

SEQ ID NO: 164094 - DNA, 17 bp, Homo sapiens
cagttctgggtgctccc

SEQ ID NO: 164095 - DNA, 18 bp, Homo sapiens
cagttgaaaaacagctga

SEQ ID NO: 164096 - DNA, 18 bp, Homo sapiens
cagttgaaaagactccaa

SEQ ID NO: 164097 - DNA, 21 bp, Homo sapiens
cagttgaaaagactccaaaga

SEQ ID NO: 164098 - DNA, 23 bp, Homo sapiens
cagttgaaaagactccaaagaaa

SEQ ID NO: 164099 - DNA, 16 bp, Homo sapiens
cagttgcacttggcct

SEQ ID NO: 164100 - DNA, 18 bp, Homo sapiens
cagtttcaattcagtgct

SEQ ID NO: 164101 - DNA, 22 bp, Homo sapiens
cagtttgcagaaaagcacctgc

SEQ ID NO: 164102 - DNA, 23 bp, Homo sapiens
cagtttgcagaaaagcacctgcc

SEQ ID NO: 164103 - DNA, 15 bp, Homo sapiens
cagttttctgagaaa

SEQ ID NO: 164104 - DNA, 20 bp, Homo sapiens
cagttttctgagaaagacta

SEQ ID NO: 164105 - DNA, 16 bp, Homo sapiens
cagttttttatgctaa

SEQ ID NO: 164106 - DNA, 16 bp, Homo sapiens
cataaaacattaagaa

SEQ ID NO: 164107 - DNA, 13 bp, Homo sapiens
cataaactgactt

SEQ ID NO: 164108 - DNA, 15 bp, Homo sapiens
cataaactgacttta

SEQ ID NO: 164109 - DNA, 17 bp, Homo sapiens
cataacaattcctctac

SEQ ID NO: 164110 - DNA, 12 bp, Homo sapiens
cataagaatgaa

SEQ ID NO: 164111 - DNA, 22 bp, Homo sapiens
cataagctatagacccgaggaa

SEQ ID NO: 164112 - DNA, 17 bp, Homo sapiens
cataagtaattcaagaa

SEQ ID NO: 164113 - DNA, 18 bp, Homo sapiens
cataagtaattcaagaaa

SEQ ID NO: 164114 - DNA, 21 bp, Homo sapiens
cataatctggactcctctgtc

SEQ ID NO: 164115 - DNA, 18 bp, Homo sapiens
cataatgttacattatta

SEQ ID NO: 164116 - DNA, 16 bp, Homo sapiens
cataattcttgtatat

SEQ ID NO: 164117 - DNA, 18 bp, Homo sapiens
cataattcttgtatatta

SEQ ID NO: 164118 - DNA, 14 bp, Homo sapiens
cataccaatgaaaa

SEQ ID NO: 164119 - DNA, 13 bp, Homo sapiens
cataccctccccc

SEQ ID NO: 164120 - DNA, 18 bp, Homo sapiens
catacctgctggtgcaga

SEQ ID NO: 164121 - DNA, 17 bp, Homo sapiens
catagagatcatccttt

SEQ ID NO: 164122 - DNA, 17 bp, Homo sapiens
catagattccctgagca

SEQ ID NO: 164123 - DNA, 23 bp, Homo sapiens
catagcaagattgcttaaaatag

SEQ ID NO: 164124 - DNA, 18 bp, Homo sapiens
catagcagattttaattt

SEQ ID NO: 164125 - DNA, 16 bp, Homo sapiens
catagcccagacacag

SEQ ID NO: 164126 - DNA, 18 bp, Homo sapiens
catagcccagacacagaa

SEQ ID NO: 164127 - DNA, 19 bp, Homo sapiens
cataggaaaagtacattta

SEQ ID NO: 164128 - DNA, 16 bp, Homo sapiens
catagtaccaatcatt

SEQ ID NO: 164129 - DNA, 18 bp, Homo sapiens
catagtattccattgtgt

SEQ ID NO: 164130 - DNA, 22 bp, Homo sapiens
catagtgatggttcccctgttc

SEQ ID NO: 164131 - DNA, 19 bp, Homo sapiens
catataaacatcacacaca

SEQ ID NO: 164132 - DNA, 16 bp, Homo sapiens
catatgacctcatgca

SEQ ID NO: 164133 - DNA, 18 bp, Homo sapiens
catatgacctcatgcatc

SEQ ID NO: 164134 - DNA, 21 bp, Homo sapiens
catattcctgcagcctggagg

SEQ ID NO: 164135 - DNA, 14 bp, Homo sapiens
catattggtattca

SEQ ID NO: 164136 - DNA, 21 bp, Homo sapiens
catcaagcacagaaggaggag

SEQ ID NO: 164137 - DNA, 19 bp, Homo sapiens
catcaatattgtcattcct

SEQ ID NO: 164138 - DNA, 17 bp, Homo sapiens
catcaccttaggcaggg

SEQ ID NO: 164139 - DNA, 19 bp, Homo sapiens
catcaccttaggcagggaa

SEQ ID NO: 164140 - DNA, 20 bp, Homo sapiens
catcaccttaggcagggaag

SEQ ID NO: 164141 - DNA, 14 bp, Homo sapiens
catcacgcctgtgc

SEQ ID NO: 164142 - DNA, 15 bp, Homo sapiens
catcacgcctgtgca

SEQ ID NO: 164143 - DNA, 18 bp, Homo sapiens
catcagcatacctttatt

SEQ ID NO: 164144 - DNA, 14 bp, Homo sapiens
catcagggacagga

SEQ ID NO: 164145 - DNA, 18 bp, Homo sapiens
catcagggacaggatgac

SEQ ID NO: 164146 - DNA, 16 bp, Homo sapiens
catcaggttccatccc

SEQ ID NO: 164147 - DNA, 15 bp, Homo sapiens
catcagtgctccctc

SEQ ID NO: 164148 - DNA, 24 bp, Homo sapiens
catcagtgctccctcacatgtcag

SEQ ID NO: 164149 - DNA, 20 bp, Homo sapiens
catcataaaataaagtatat

SEQ ID NO: 164150 - DNA, 13 bp, Homo sapiens
atttagttatagt

SEQ ID NO: 164151 - DNA, 14 bp, Homo sapiens
atttagttatagtt

SEQ ID NO: 164152 - DNA, 16 bp, Homo sapiens
atttagttatagtttc

SEQ ID NO: 164153 - DNA, 15 bp, Homo sapiens
atttagtttgattat

SEQ ID NO: 164154 - DNA, 22 bp, Homo sapiens
atttataaatatatttaagata

SEQ ID NO: 164155 - DNA, 17 bp, Homo sapiens
atttataactcatcata

SEQ ID NO: 164156 - DNA, 22 bp, Homo sapiens
atttataactcatcataaaata

SEQ ID NO: 164157 - DNA, 14 bp, Homo sapiens
atttataagcagat

SEQ ID NO: 164158 - DNA, 15 bp, Homo sapiens
atttatatattggta

SEQ ID NO: 164159 - DNA, 14 bp, Homo sapiens
atttatatatttat

SEQ ID NO: 164160 - DNA, 16 bp, Homo sapiens
atttatatatttataa

SEQ ID NO: 164161 - DNA, 19 bp, Homo sapiens
atttatatttttaaaatat

SEQ ID NO: 164162 - DNA, 19 bp, Homo sapiens
atttatctctatttaatat

SEQ ID NO: 164163 - DNA, 16 bp, Homo sapiens
atttatctgtgcaaat

SEQ ID NO: 164164 - DNA, 23 bp, Homo sapiens
atttatgtaaactgcattagaaa

SEQ ID NO: 164165 - DNA, 21 bp, Homo sapiens
atttattaaaatgattgtaaa

SEQ ID NO: 164166 - DNA, 23 bp, Homo sapiens
atttattaaaatgattgtaaaat

SEQ ID NO: 164167 - DNA, 14 bp, Homo sapiens
atttattacctctg

SEQ ID NO: 164168 - DNA, 21 bp, Homo sapiens
atttattattttcacctgttt

SEQ ID NO: 164169 - DNA, 12 bp, Homo sapiens
atttatttaaat

SEQ ID NO: 164170 - DNA, 17 bp, Homo sapiens
atttcaaattggagctt

SEQ ID NO: 164171 - DNA, 21 bp, Homo sapiens
atttcacattaatatttgctg

SEQ ID NO: 164172 - DNA, 21 bp, Homo sapiens
atttcaggttttgtaaagatg

SEQ ID NO: 164173 - DNA, 20 bp, Homo sapiens
atttcatacctatcatctta

SEQ ID NO: 164174 - DNA, 16 bp, Homo sapiens
atttcatatgctgtat

SEQ ID NO: 164175 - DNA, 16 bp, Homo sapiens
atttcatctatttctg

SEQ ID NO: 164176 - DNA, 12 bp, Homo sapiens
atttcatttctt

SEQ ID NO: 164177 - DNA, 17 bp, Homo sapiens
atttccaaataaaatga

SEQ ID NO: 164178 - DNA, 22 bp, Homo sapiens
atttccatataaatattagaaa

SEQ ID NO: 164179 - DNA, 15 bp, Homo sapiens
atttccattccagaa

SEQ ID NO: 164180 - DNA, 20 bp, Homo sapiens
atttccccaggggaaaatga

SEQ ID NO: 164181 - DNA, 21 bp, Homo sapiens
atttccccaggggaaaatgaa

SEQ ID NO: 164182 - DNA, 21 bp, Homo sapiens
atttcgtctgtttataaacat

SEQ ID NO: 164183 - DNA, 23 bp, Homo sapiens
atttctattcaaggtggccaaat

SEQ ID NO: 164184 - DNA, 20 bp, Homo sapiens
atttctcctccatgggagaa

SEQ ID NO: 164185 - DNA, 20 bp, Homo sapiens
atttctcttactgcaaatgt

SEQ ID NO: 164186 - DNA, 23 bp, Homo sapiens
atttctgagtttcattctcctgc

SEQ ID NO: 164187 - DNA, 13 bp, Homo sapiens
atttcttacaggc

SEQ ID NO: 164188 - DNA, 13 bp, Homo sapiens
atttcttcactgt

SEQ ID NO: 164189 - DNA, 19 bp, Homo sapiens
atttgaatgttaagcagat

SEQ ID NO: 164190 - DNA, 14 bp, Homo sapiens
atttgagtgctctg

SEQ ID NO: 164191 - DNA, 15 bp, Homo sapiens
atttgatgccaggac

SEQ ID NO: 164192 - DNA, 21 bp, Homo sapiens
atttggagtgttccccttcca

SEQ ID NO: 164193 - DNA, 20 bp, Homo sapiens
atttgtaattgcttacattt

SEQ ID NO: 164194 - DNA, 23 bp, Homo sapiens
atttgtaattgcttacattttta

SEQ ID NO: 164195 - DNA, 21 bp, Homo sapiens
atttgtacatatgtaaaataa

SEQ ID NO: 164196 - DNA, 17 bp, Homo sapiens
atttgtatttttttgca

SEQ ID NO: 164197 - DNA, 21 bp, Homo sapiens
atttgtatttttttgcaagtg

SEQ ID NO: 164198 - DNA, 13 bp, Homo sapiens
atttgtgtaatag

SEQ ID NO: 164199 - DNA, 14 bp, Homo sapiens
atttgtgtgtgtgc

SEQ ID NO: 164200 - DNA, 20 bp, Homo sapiens
atttgtgtgtgtgcaagtgt

SEQ ID NO: 164201 - DNA, 14 bp, Homo sapiens
atttgttataatga

SEQ ID NO: 164202 - DNA, 18 bp, Homo sapiens
atttgttgaaattatgta

SEQ ID NO: 164203 - DNA, 21 bp, Homo sapiens
atttgttttgacggatgattg

SEQ ID NO: 164204 - DNA, 14 bp, Homo sapiens
attttaaaaagtct

SEQ ID NO: 164205 - DNA, 18 bp, Homo sapiens
attttaaaaagtcttcac

SEQ ID NO: 164206 - DNA, 17 bp, Homo sapiens
attttaaacaaaataga

SEQ ID NO: 164207 - DNA, 22 bp, Homo sapiens
attttaaattataacttaaaat

SEQ ID NO: 164208 - DNA, 19 bp, Homo sapiens
attttaagtattgcatctg

SEQ ID NO: 164209 - DNA, 23 bp, Homo sapiens
attttaatgaagaaagtggaaaa

SEQ ID NO: 164210 - DNA, 13 bp, Homo sapiens
attttaattatta

SEQ ID NO: 164211 - DNA, 18 bp, Homo sapiens
attttaatttatgagttt

SEQ ID NO: 164212 - DNA, 16 bp, Homo sapiens
attttatatgtcaaag

SEQ ID NO: 164213 - DNA, 19 bp, Homo sapiens
caacttctacttctgccct

SEQ ID NO: 164214 - DNA, 13 bp, Homo sapiens
caacttgagggcc

SEQ ID NO: 164215 - DNA, 19 bp, Homo sapiens
caacttgagggcccagagc

SEQ ID NO: 164216 - DNA, 12 bp, Homo sapiens
caacttgggaac

SEQ ID NO: 164217 - DNA, 15 bp, Homo sapiens
caagaaactcacccc

SEQ ID NO: 164218 - DNA, 14 bp, Homo sapiens
caagaaatccctgt

SEQ ID NO: 164219 - DNA, 13 bp, Homo sapiens
caagaaatgaaag

SEQ ID NO: 164220 - DNA, 19 bp, Homo sapiens
caagaaatgaaagcaggga

SEQ ID NO: 164221 - DNA, 13 bp, Homo sapiens
caagaaatttgat

SEQ ID NO: 164222 - DNA, 20 bp, Homo sapiens
caagacttggcaacagaagc

SEQ ID NO: 164223 - DNA, 21 bp, Homo sapiens
caagacttggtgtcctttccc

SEQ ID NO: 164224 - DNA, 18 bp, Homo sapiens
caagagcgaaactccgtc

SEQ ID NO: 164225 - DNA, 14 bp, Homo sapiens
caagagggcactgg

SEQ ID NO: 164226 - DNA, 14 bp, Homo sapiens
caagattcccagag

SEQ ID NO: 164227 - DNA, 16 bp, Homo sapiens
caagattcccagagac

SEQ ID NO: 164228 - DNA, 18 bp, Homo sapiens
caagattgcttaaaatag

SEQ ID NO: 164229 - DNA, 19 bp, Homo sapiens
caagcaaaggtgaagagac

SEQ ID NO: 164230 - DNA, 17 bp, Homo sapiens
caagcacatctgcattt

SEQ ID NO: 164231 - DNA, 20 bp, Homo sapiens
caagcagaggtggccagagc

SEQ ID NO: 164232 - DNA, 13 bp, Homo sapiens
caagcagccaagc

SEQ ID NO: 164233 - DNA, 14 bp, Homo sapiens
caagcagccaagct

SEQ ID NO: 164234 - DNA, 14 bp, Homo sapiens
caagcaggaagctc

SEQ ID NO: 164235 - DNA, 15 bp, Homo sapiens
caagcaggaagctca

SEQ ID NO: 164236 - DNA, 21 bp, Homo sapiens
caagcaggaagctcagactgg

SEQ ID NO: 164237 - DNA, 13 bp, Homo sapiens
caagccaagcagc

SEQ ID NO: 164238 - DNA, 19 bp, Homo sapiens
caagccaagcagccaagct

SEQ ID NO: 164239 - DNA, 21 bp, Homo sapiens
caagccctccccatcccatgt

SEQ ID NO: 164240 - DNA, 17 bp, Homo sapiens
caagcgaggtcaacaga

SEQ ID NO: 164241 - DNA, 14 bp, Homo sapiens
caagctgcaccctc

SEQ ID NO: 164242 - DNA, 21 bp, Homo sapiens
caagctgcaccctcaggcagg

SEQ ID NO: 164243 - DNA, 12 bp, Homo sapiens
caaggaagtcaa

SEQ ID NO: 164244 - DNA, 12 bp, Homo sapiens
caaggaggaaaa

SEQ ID NO: 164245 - DNA, 19 bp, Homo sapiens
caaggctagatcatgaaga

SEQ ID NO: 164246 - DNA, 12 bp, Homo sapiens
caaggctgcagt

SEQ ID NO: 164247 - DNA, 15 bp, Homo sapiens
caaggctgcagtgag

SEQ ID NO: 164248 - DNA, 22 bp, Homo sapiens
caaggctgcagtgagccgagat

SEQ ID NO: 164249 - DNA, 16 bp, Homo sapiens
caagggaaaagtctct

SEQ ID NO: 164250 - DNA, 17 bp, Homo sapiens
caagggcaaaattccca

SEQ ID NO: 164251 - DNA, 12 bp, Homo sapiens
caagggcctctt

SEQ ID NO: 164252 - DNA, 14 bp, Homo sapiens
caagggctccccac

SEQ ID NO: 164253 - DNA, 19 bp, Homo sapiens
caaggggcagtctggaggg

SEQ ID NO: 164254 - DNA, 19 bp, Homo sapiens
caagggttcagagactcag

SEQ ID NO: 164255 - DNA, 23 bp, Homo sapiens
caaggtagccctggccagaggct

SEQ ID NO: 164256 - DNA, 13 bp, Homo sapiens
caagtcaagtgaa

SEQ ID NO: 164257 - DNA, 18 bp, Homo sapiens
caagtcctgtgaatttct

SEQ ID NO: 164258 - DNA, 15 bp, Homo sapiens
caagtctacagagtg

SEQ ID NO: 164259 - DNA, 16 bp, Homo sapiens
caagtctacagagtga

SEQ ID NO: 164260 - DNA, 18 bp, Homo sapiens
caagtctctgctggccca

SEQ ID NO: 164261 - DNA, 23 bp, Homo sapiens
caagtctctgctggcccagccaa

SEQ ID NO: 164262 - DNA, 13 bp, Homo sapiens
caagtctggatct

SEQ ID NO: 164263 - DNA, 23 bp, Homo sapiens
caagtgaaaaaggaggaagagaa

SEQ ID NO: 164264 - DNA, 11 bp, Homo sapiens
caagtgaaggt

SEQ ID NO: 164265 - DNA, 15 bp, Homo sapiens
caagtgagaccctgt

SEQ ID NO: 164266 - DNA, 19 bp, Homo sapiens
caagtgagaccctgtctca

SEQ ID NO: 164267 - DNA, 14 bp, Homo sapiens
caagtgctgaacag

SEQ ID NO: 164268 - DNA, 16 bp, Homo sapiens
caagtgctgaacagtg

SEQ ID NO: 164269 - DNA, 16 bp, Homo sapiens
caagtgtatatcagaa

SEQ ID NO: 164270 - DNA, 18 bp, Homo sapiens
caagtgtatatcagaaaa

SEQ ID NO: 164271 - DNA, 11 bp, Homo sapiens
caagtgtgtgc

SEQ ID NO: 164272 - DNA, 14 bp, Homo sapiens
caagtgtgtgcaca

SEQ ID NO: 164273 - DNA, 20 bp, Homo sapiens
caagtgtgtgcatgtgtgcg

SEQ ID NO: 164274 - DNA, 20 bp, Homo sapiens
caagttattgtacagctgtt

SEQ ID NO: 164275 - DNA, 12 bp, Homo sapiens
caataaagagat

SEQ ID NO: 164276 - DNA, 19 bp, Homo sapiens
caataagcatcaaactctt

SEQ ID NO: 164277 - DNA, 19 bp, Homo sapiens
caataataaatatttttgc

SEQ ID NO: 164278 - DNA, 17 bp, Homo sapiens
caatacatgctgctaat

SEQ ID NO: 164279 - DNA, 19 bp, Homo sapiens
caatagcagacagtgtttt

SEQ ID NO: 164280 - DNA, 23 bp, Homo sapiens
caataggcaaaggggggaaggga

SEQ ID NO: 164281 - DNA, 16 bp, Homo sapiens
caatagtttgcataga

SEQ ID NO: 164282 - DNA, 12 bp, Homo sapiens
caatatttatta

SEQ ID NO: 164283 - DNA, 12 bp, Homo sapiens
caatatttttct

SEQ ID NO: 164284 - DNA, 17 bp, Homo sapiens
caatcatctgtgtgaaa

SEQ ID NO: 164285 - DNA, 20 bp, Homo sapiens
caatcatctgtgtgaaaatg

SEQ ID NO: 164286 - DNA, 16 bp, Homo sapiens
caatcccaccaaccct

SEQ ID NO: 164287 - DNA, 22 bp, Homo sapiens
caatcccaccaaccctcagagc

SEQ ID NO: 164288 - DNA, 22 bp, Homo sapiens
caatcccctcattcaggaaaac

SEQ ID NO: 164289 - DNA, 14 bp, Homo sapiens
caatcctatgtttt

SEQ ID NO: 164290 - DNA, 16 bp, Homo sapiens
caatgacatctcaggg

SEQ ID NO: 164291 - DNA, 14 bp, Homo sapiens
caatgccatcatct

SEQ ID NO: 164292 - DNA, 22 bp, Homo sapiens
caatggctatatggcaagaaag

SEQ ID NO: 164293 - DNA, 17 bp, Homo sapiens
caatgggcactgggatg

SEQ ID NO: 164294 - DNA, 22 bp, Homo sapiens
caatggggatgttgtgtttctg

SEQ ID NO: 164295 - DNA, 17 bp, Homo sapiens
caatgtagaaagctttg

SEQ ID NO: 164296 - DNA, 23 bp, Homo sapiens
caatgtcttgatgcatgcactgt

SEQ ID NO: 164297 - DNA, 22 bp, Homo sapiens
caatgtgaaaagaaaaatgagc

SEQ ID NO: 164298 - DNA, 21 bp, Homo sapiens
caatgtggcctaaaaatgcaa

SEQ ID NO: 164299 - DNA, 14 bp, Homo sapiens
caatgttcatccca

SEQ ID NO: 164300 - DNA, 14 bp, Homo sapiens
caatgttctctctt

SEQ ID NO: 164301 - DNA, 17 bp, Homo sapiens
caatgtttcttctaggt

SEQ ID NO: 164302 - DNA, 18 bp, Homo sapiens
caatgtttcttttatcac

SEQ ID NO: 164303 - DNA, 15 bp, Homo sapiens
caattaataaaaaat

SEQ ID NO: 164304 - DNA, 13 bp, Homo sapiens
caattccacctgc

SEQ ID NO: 164305 - DNA, 16 bp, Homo sapiens
caattggttaatcttt

SEQ ID NO: 164306 - DNA, 14 bp, Homo sapiens
caatttacaaagtg

SEQ ID NO: 164307 - DNA, 20 bp, Homo sapiens
caatttacaaagtgtgtatt

SEQ ID NO: 164308 - DNA, 21 bp, Homo sapiens
caatttacaaagtgtgtatta

SEQ ID NO: 164309 - DNA, 22 bp, Homo sapiens
caatttattaaaatgattgtaa

SEQ ID NO: 164310 - DNA, 16 bp, Homo sapiens
caatttcctttatatt

SEQ ID NO: 164311 - DNA, 21 bp, Homo sapiens
caatttcctttatatttagtg

SEQ ID NO: 164312 - DNA, 17 bp, Homo sapiens
caattttaatgctattt

SEQ ID NO: 164313 - DNA, 22 bp, Homo sapiens
caatttttcttatttcatttct

SEQ ID NO: 164314 - DNA, 17 bp, Homo sapiens
cacaaccttctgtggct

SEQ ID NO: 164315 - DNA, 19 bp, Homo sapiens
cacaaccttctgtggctca

SEQ ID NO: 164316 - DNA, 20 bp, Homo sapiens
cacaagaaatgaaagcaggg

SEQ ID NO: 164317 - DNA, 14 bp, Homo sapiens
cacaagattcccag

SEQ ID NO: 164318 - DNA, 21 bp, Homo sapiens
cacaataaggtcaatgccaga

SEQ ID NO: 164319 - DNA, 21 bp, Homo sapiens
cacacaaaatgtacccagtat

SEQ ID NO: 164320 - DNA, 18 bp, Homo sapiens
cacacaaaggtataattt

SEQ ID NO: 164321 - DNA, 13 bp, Homo sapiens
cacacacaggcaa

SEQ ID NO: 164322 - DNA, 13 bp, Homo sapiens
cacacaccccaat

SEQ ID NO: 164323 - DNA, 15 bp, Homo sapiens
cacacacctgtagtc

SEQ ID NO: 164324 - DNA, 13 bp, Homo sapiens
cacacaggcaact

SEQ ID NO: 164325 - DNA, 14 bp, Homo sapiens
cacacccactcagc

SEQ ID NO: 164326 - DNA, 12 bp, Homo sapiens
cacacccagcct

SEQ ID NO: 164327 - DNA, 13 bp, Homo sapiens
cacacccagcctc

SEQ ID NO: 164328 - DNA, 14 bp, Homo sapiens
cacaccctgtttta

SEQ ID NO: 164329 - DNA, 16 bp, Homo sapiens
cacacctgtagtccca

SEQ ID NO: 164330 - DNA, 15 bp, Homo sapiens
cacactccatcagct

SEQ ID NO: 164331 - DNA, 14 bp, Homo sapiens
cacactgaggcagg

SEQ ID NO: 164332 - DNA, 16 bp, Homo sapiens
cacactgaggcaggga

SEQ ID NO: 164333 - DNA, 17 bp, Homo sapiens
cacactgcaagagcctt

SEQ ID NO: 164334 - DNA, 18 bp, Homo sapiens
cacactgcaagagccttg

SEQ ID NO: 164335 - DNA, 18 bp, Homo sapiens
cacacttcaggctcttct

SEQ ID NO: 164336 - DNA, 17 bp, Homo sapiens
cacactttttaagaaat

SEQ ID NO: 164337 - DNA, 18 bp, Homo sapiens
cacagaaacacaatattt

SEQ ID NO: 164338 - DNA, 18 bp, Homo sapiens
cacagaaagactgagctc

SEQ ID NO: 164339 - DNA, 16 bp, Homo sapiens
cacagacgtccctcca

SEQ ID NO: 164340 - DNA, 23 bp, Homo sapiens
cacagagacccccggaacaagcc

SEQ ID NO: 164341 - DNA, 18 bp, Homo sapiens
cacagcagcatcttcaaa

SEQ ID NO: 164342 - DNA, 18 bp, Homo sapiens
cacagccagactggcaca

SEQ ID NO: 164343 - DNA, 20 bp, Homo sapiens
cacagccgattcacctgagc

SEQ ID NO: 164344 - DNA, 21 bp, Homo sapiens
cacagcctcccctgccagggc

SEQ ID NO: 164345 - DNA, 23 bp, Homo sapiens
cacagcctctgacccctcctcac

SEQ ID NO: 164346 - DNA, 17 bp, Homo sapiens
cacagcgagactccgtc

SEQ ID NO: 164347 - DNA, 19 bp, Homo sapiens
cacagctgagagactttta

SEQ ID NO: 164348 - DNA, 23 bp, Homo sapiens
cacagcttcccctctctcctcct

SEQ ID NO: 164349 - DNA, 15 bp, Homo sapiens
cacaggaagtagagg

SEQ ID NO: 164350 - DNA, 15 bp, Homo sapiens
cacaggactctgcct

SEQ ID NO: 164351 - DNA, 16 bp, Homo sapiens
cacaggactctgcctc

SEQ ID NO: 164352 - DNA, 18 bp, Homo sapiens
cacaggcaactgaggcag

SEQ ID NO: 164353 - DNA, 23 bp, Homo sapiens
cacaggcaactgaggcagacagc

SEQ ID NO: 164354 - DNA, 15 bp, Homo sapiens
cacaggcagcattta

SEQ ID NO: 164355 - DNA, 19 bp, Homo sapiens
cacaggcccttcctctcca

SEQ ID NO: 164356 - DNA, 16 bp, Homo sapiens
aggctcgattttgtat

SEQ ID NO: 164357 - DNA, 17 bp, Homo sapiens
aggctcgattttgtatc

SEQ ID NO: 164358 - DNA, 22 bp, Homo sapiens
aggctcgattttgtatctgcag

SEQ ID NO: 164359 - DNA, 23 bp, Homo sapiens
aggctcgattttgtatctgcagg

SEQ ID NO: 164360 - DNA, 19 bp, Homo sapiens
aggctctgacccagtgaga

SEQ ID NO: 164361 - DNA, 19 bp, Homo sapiens
aggctcttagcagcttcca

SEQ ID NO: 164362 - DNA, 22 bp, Homo sapiens
aggctcttagcagcttccagat

SEQ ID NO: 164363 - DNA, 14 bp, Homo sapiens
aggctgaggcctgg

SEQ ID NO: 164364 - DNA, 18 bp, Homo sapiens
aggctggagcccagggag

SEQ ID NO: 164365 - DNA, 13 bp, Homo sapiens
aggctggaggcag

SEQ ID NO: 164366 - DNA, 18 bp, Homo sapiens
aggctggaggcagggcct

SEQ ID NO: 164367 - DNA, 20 bp, Homo sapiens
aggctggagtggagtggcgt

SEQ ID NO: 164368 - DNA, 14 bp, Homo sapiens
aggctggcttgtcc

SEQ ID NO: 164369 - DNA, 22 bp, Homo sapiens
aggctggcttgtcccctcctca

SEQ ID NO: 164370 - DNA, 12 bp, Homo sapiens
aggctggtggga

SEQ ID NO: 164371 - DNA, 21 bp, Homo sapiens
aggctgtcctgtacattgtgg

SEQ ID NO: 164372 - DNA, 19 bp, Homo sapiens
agggaaactgccagcaacg

SEQ ID NO: 164373 - DNA, 21 bp, Homo sapiens
agggaaactgccagcaacgca

SEQ ID NO: 164374 - DNA, 18 bp, Homo sapiens
agggaaaggatattttct

SEQ ID NO: 164375 - DNA, 15 bp, Homo sapiens
agggaaatagaaaaa

SEQ ID NO: 164376 - DNA, 22 bp, Homo sapiens
agggaaatagaaaaaccctgcc

SEQ ID NO: 164377 - DNA, 19 bp, Homo sapiens
agggaacagacaggagaaa

SEQ ID NO: 164378 - DNA, 21 bp, Homo sapiens
agggaacagacaggagaaatg

SEQ ID NO: 164379 - DNA, 12 bp, Homo sapiens
agggaagagcag

SEQ ID NO: 164380 - DNA, 16 bp, Homo sapiens
agggaagcctgaaaaa

SEQ ID NO: 164381 - DNA, 13 bp, Homo sapiens
agggaagggcctg

SEQ ID NO: 164382 - DNA, 18 bp, Homo sapiens
agggaagggcctgccaca

SEQ ID NO: 164383 - DNA, 18 bp, Homo sapiens
agggaatccccgaaggtg

SEQ ID NO: 164384 - DNA, 10 bp, Homo sapiens
agggacagag

SEQ ID NO: 164385 - DNA, 17 bp, Homo sapiens
agggacaggataagagg

SEQ ID NO: 164386 - DNA, 15 bp, Homo sapiens
agggacatattcatt

SEQ ID NO: 164387 - DNA, 15 bp, Homo sapiens
agggaccagccaaga

SEQ ID NO: 164388 - DNA, 15 bp, Homo sapiens
agggacccctgccct

SEQ ID NO: 164389 - DNA, 13 bp, Homo sapiens
agggacttaaaaa

SEQ ID NO: 164390 - DNA, 17 bp, Homo sapiens
agggacttaaaaaactt

SEQ ID NO: 164391 - DNA, 23 bp, Homo sapiens
agggacttctgtcttcacaacag

SEQ ID NO: 164392 - DNA, 15 bp, Homo sapiens
agggacttgaagttg

SEQ ID NO: 164393 - DNA, 13 bp, Homo sapiens
agggagcactggg

SEQ ID NO: 164394 - DNA, 15 bp, Homo sapiens
agggataaggtacct

SEQ ID NO: 164395 - DNA, 16 bp, Homo sapiens
agggatccctcatctg

SEQ ID NO: 164396 - DNA, 19 bp, Homo sapiens
agggatccctcatctgtcc

SEQ ID NO: 164397 - DNA, 22 bp, Homo sapiens
agggatccctcatctgtccctc

SEQ ID NO: 164398 - DNA, 19 bp, Homo sapiens
agggattaacctctgcact

SEQ ID NO: 164399 - DNA, 17 bp, Homo sapiens
agggcactggtggcccg

SEQ ID NO: 164400 - DNA, 15 bp, Homo sapiens
agggcagaggctgga

SEQ ID NO: 164401 - DNA, 20 bp, Homo sapiens
agggcagaggctggaggcag

SEQ ID NO: 164402 - DNA, 19 bp, Homo sapiens
agggcagagtgagacccag

SEQ ID NO: 164403 - DNA, 15 bp, Homo sapiens
agggcatgccccggc

SEQ ID NO: 164404 - DNA, 20 bp, Homo sapiens
agggcatgccccggccacct

SEQ ID NO: 164405 - DNA, 23 bp, Homo sapiens
agggccaacttgagggcccagag

SEQ ID NO: 164406 - DNA, 16 bp, Homo sapiens
agggccaagacttggc

SEQ ID NO: 164407 - DNA, 14 bp, Homo sapiens
agggccactctgcc

SEQ ID NO: 164408 - DNA, 19 bp, Homo sapiens
agggccaggactgagcccc

SEQ ID NO: 164409 - DNA, 12 bp, Homo sapiens
agggcccagagc

SEQ ID NO: 164410 - DNA, 13 bp, Homo sapiens
agggcccagagca

SEQ ID NO: 164411 - DNA, 14 bp, Homo sapiens
agggcccagagcag

SEQ ID NO: 164412 - DNA, 14 bp, Homo sapiens
agggccccagcact

SEQ ID NO: 164413 - DNA, 20 bp, Homo sapiens
agggcctgagcctggccagc

SEQ ID NO: 164414 - DNA, 12 bp, Homo sapiens
agggccttgccc

SEQ ID NO: 164415 - DNA, 17 bp, Homo sapiens
agggcgtgactcaccca

SEQ ID NO: 164416 - DNA, 21 bp, Homo sapiens
agggctaagagctagcgctgc

SEQ ID NO: 164417 - DNA, 22 bp, Homo sapiens
agggctaagagctagcgctgcc

SEQ ID NO: 164418 - DNA, 23 bp, Homo sapiens
agggctaagagctagcgctgccg

SEQ ID NO: 164419 - DNA, 19 bp, Homo sapiens
agggctaccctcccccagg

SEQ ID NO: 164420 - DNA, 18 bp, Homo sapiens
agggctaccctgagctga

SEQ ID NO: 164421 - DNA, 21 bp, Homo sapiens
agggctaccctgagctgaggc

SEQ ID NO: 164422 - DNA, 12 bp, Homo sapiens
agggctcagcct

SEQ ID NO: 164423 - DNA, 21 bp, Homo sapiens
agggctgacacgtccacccca

SEQ ID NO: 164424 - DNA, 18 bp, Homo sapiens
agggctttgttttgcaca

SEQ ID NO: 164425 - DNA, 18 bp, Homo sapiens
aggggaaaatcagcctgc

SEQ ID NO: 164426 - DNA, 22 bp, Homo sapiens
aggggaaaatcagcctgctcca

SEQ ID NO: 164427 - DNA, 17 bp, Homo sapiens
aggggagagggtctgga

SEQ ID NO: 164428 - DNA, 14 bp, Homo sapiens
aggggaggagggcg

SEQ ID NO: 164429 - DNA, 14 bp, Homo sapiens
aggggatgggaggt

SEQ ID NO: 164430 - DNA, 19 bp, Homo sapiens
aggggatgtatccatgggg

SEQ ID NO: 164431 - DNA, 22 bp, Homo sapiens
aggggatgtatccatgggggca

SEQ ID NO: 164432 - DNA, 18 bp, Homo sapiens
aggggcatggccagcagc

SEQ ID NO: 164433 - DNA, 12 bp, Homo sapiens
aggggccagagg

SEQ ID NO: 164434 - DNA, 15 bp, Homo sapiens
aggggcctggcagcc

SEQ ID NO: 164435 - DNA, 16 bp, Homo sapiens
aggggcgcccacctcc

SEQ ID NO: 164436 - DNA, 14 bp, Homo sapiens
ctcttctccactgg

SEQ ID NO: 164437 - DNA, 15 bp, Homo sapiens
ctcttctccactgga

SEQ ID NO: 164438 - DNA, 19 bp, Homo sapiens
ctcttctccactggatgga

SEQ ID NO: 164439 - DNA, 15 bp, Homo sapiens
ctcttctcctttcac

SEQ ID NO: 164440 - DNA, 21 bp, Homo sapiens
ctcttctgccggccctggggc

SEQ ID NO: 164441 - DNA, 22 bp, Homo sapiens
ctcccacccccatctctccctc

SEQ ID NO: 164442 - DNA, 12 bp, Homo sapiens
ctcccacctctg

SEQ ID NO: 164443 - DNA, 14 bp, Homo sapiens
ctcccacctctgtg

SEQ ID NO: 164444 - DNA, 15 bp, Homo sapiens
ctcccacctctgtga

SEQ ID NO: 164445 - DNA, 19 bp, Homo sapiens
ctcccacctctgtgacctc

SEQ ID NO: 164446 - DNA, 14 bp, Homo sapiens
ctcccacgtgggag

SEQ ID NO: 164447 - DNA, 19 bp, Homo sapiens
ctcccaggcgccccttccc

SEQ ID NO: 164448 - DNA, 16 bp, Homo sapiens
ctcccatcccctggac

SEQ ID NO: 164449 - DNA, 19 bp, Homo sapiens
ctccccaccaccccagctg

SEQ ID NO: 164450 - DNA, 16 bp, Homo sapiens
ctccccactgcctact

SEQ ID NO: 164451 - DNA, 11 bp, Homo sapiens
ctccccagccc

SEQ ID NO: 164452 - DNA, 22 bp, Homo sapiens
ctccccagcccctagcccagga

SEQ ID NO: 164453 - DNA, 13 bp, Homo sapiens
ctccccagccctg

SEQ ID NO: 164454 - DNA, 11 bp, Homo sapiens
ctccccagggg

SEQ ID NO: 164455 - DNA, 21 bp, Homo sapiens
ctccccaggggagagggtctg

SEQ ID NO: 164456 - DNA, 14 bp, Homo sapiens
ctccccatcccatg

SEQ ID NO: 164457 - DNA, 14 bp, Homo sapiens
ctcccccaccccct

SEQ ID NO: 164458 - DNA, 19 bp, Homo sapiens
ctcccccaccccctcccca

SEQ ID NO: 164459 - DNA, 14 bp, Homo sapiens
ctccccggctcgag

SEQ ID NO: 164460 - DNA, 16 bp, Homo sapiens
ctcccctcacagcctc

SEQ ID NO: 164461 - DNA, 17 bp, Homo sapiens
ctcccctcacagcctct

SEQ ID NO: 164462 - DNA, 18 bp, Homo sapiens
ctcccctcacagcctctg

SEQ ID NO: 164463 - DNA, 15 bp, Homo sapiens
ctcccctgcactgga

SEQ ID NO: 164464 - DNA, 16 bp, Homo sapiens
ctcccctgccagggca

SEQ ID NO: 164465 - DNA, 21 bp, Homo sapiens
ctcccctgccagggcagggcc

SEQ ID NO: 164466 - DNA, 13 bp, Homo sapiens
ctcccctgccctg

SEQ ID NO: 164467 - DNA, 15 bp, Homo sapiens
ctcccctgctgcagg

SEQ ID NO: 164468 - DNA, 16 bp, Homo sapiens
ctcccctgctgcaggg

SEQ ID NO: 164469 - DNA, 13 bp, Homo sapiens
ctccctaccacct

SEQ ID NO: 164470 - DNA, 12 bp, Homo sapiens
ctccctcctctg

SEQ ID NO: 164471 - DNA, 15 bp, Homo sapiens
ctccctcctctgtcc

SEQ ID NO: 164472 - DNA, 15 bp, Homo sapiens
ctccctctcctgcct

SEQ ID NO: 164473 - DNA, 13 bp, Homo sapiens
ctccctgaagcca

SEQ ID NO: 164474 - DNA, 15 bp, Homo sapiens
ctccctgaagccagc

SEQ ID NO: 164475 - DNA, 18 bp, Homo sapiens
ctccctgcccctcccttc

SEQ ID NO: 164476 - DNA, 15 bp, Homo sapiens
ctccctgccgcctca

SEQ ID NO: 164477 - DNA, 18 bp, Homo sapiens
ctccctgccgcctcaatg

SEQ ID NO: 164478 - DNA, 12 bp, Homo sapiens
ctccctggccct

SEQ ID NO: 164479 - DNA, 13 bp, Homo sapiens
ctccctgtcctcc

SEQ ID NO: 164480 - DNA, 12 bp, Homo sapiens
ctcccttcaacc

SEQ ID NO: 164481 - DNA, 19 bp, Homo sapiens
ctcccttcaaccattcccc

SEQ ID NO: 164482 - DNA, 20 bp, Homo sapiens
ctcccttcaaccattcccca

SEQ ID NO: 164483 - DNA, 21 bp, Homo sapiens
ctcccttcaaccattccccat

SEQ ID NO: 164484 - DNA, 23 bp, Homo sapiens
ctcccttcaaccattccccatgg

SEQ ID NO: 164485 - DNA, 14 bp, Homo sapiens
ctccctttttatat

SEQ ID NO: 164486 - DNA, 21 bp, Homo sapiens
ctccctttttatatcccattt

SEQ ID NO: 164487 - DNA, 22 bp, Homo sapiens
ctccgaacaccctcgaagcgcg

SEQ ID NO: 164488 - DNA, 13 bp, Homo sapiens
ctccgccaggcga

SEQ ID NO: 164489 - DNA, 15 bp, Homo sapiens
ctccgggacctggtg

SEQ ID NO: 164490 - DNA, 14 bp, Homo sapiens
ctccgtatttcaga

SEQ ID NO: 164491 - DNA, 22 bp, Homo sapiens
ctcctagtactaactcctagga

SEQ ID NO: 164492 - DNA, 15 bp, Homo sapiens
ctcctccagccgcca

SEQ ID NO: 164493 - DNA, 22 bp, Homo sapiens
ctcctcccaggcgccccttccc

SEQ ID NO: 164494 - DNA, 15 bp, Homo sapiens
ctcctcccggtgccc

SEQ ID NO: 164495 - DNA, 17 bp, Homo sapiens
ctcctcgcaagctgggt

SEQ ID NO: 164496 - DNA, 15 bp, Homo sapiens
ctcctctcccctcta

SEQ ID NO: 164497 - DNA, 13 bp, Homo sapiens
ctcctctgactca

SEQ ID NO: 164498 - DNA, 19 bp, Homo sapiens
ctcctctgactcagggctc

SEQ ID NO: 164499 - DNA, 11 bp, Homo sapiens
ctcctctgcca

SEQ ID NO: 164500 - DNA, 14 bp, Homo sapiens
ctcctctgccacct

SEQ ID NO: 164501 - DNA, 15 bp, Homo sapiens
ctcctctgccacctc

SEQ ID NO: 164502 - DNA, 12 bp, Homo sapiens
ctcctctgtcca

SEQ ID NO: 164503 - DNA, 15 bp, Homo sapiens
ctcctctgtccaggc

SEQ ID NO: 164504 - DNA, 13 bp, Homo sapiens
ctcctctgtgacc

SEQ ID NO: 164505 - DNA, 18 bp, Homo sapiens
ctcctcttgccactgcct

SEQ ID NO: 164506 - DNA, 13 bp, Homo sapiens
ctcctgcccagga

SEQ ID NO: 164507 - DNA, 15 bp, Homo sapiens
ctcctgcctgtagca

SEQ ID NO: 164508 - DNA, 16 bp, Homo sapiens
ctcctgcctgtagcag

SEQ ID NO: 164509 - DNA, 19 bp, Homo sapiens
ctcctgccttcctcctggg

SEQ ID NO: 164510 - DNA, 15 bp, Homo sapiens
ctcctggaagctgtg

SEQ ID NO: 164511 - DNA, 23 bp, Homo sapiens
ctcctggaagctgtgtccttgca

SEQ ID NO: 164512 - DNA, 22 bp, Homo sapiens
ctcctggactgccttgaatatc

SEQ ID NO: 164513 - DNA, 18 bp, Homo sapiens
ctcctggcccactgcatc

SEQ ID NO: 164514 - DNA, 12 bp, Homo sapiens
ctcctgggccct

SEQ ID NO: 164515 - DNA, 20 bp, Homo sapiens
ctcctgggccctctctgctc

SEQ ID NO: 164516 - DNA, 14 bp, Homo sapiens
ctcctgggggttct

SEQ ID NO: 164517 - DNA, 22 bp, Homo sapiens
ctcctgggggttctttcttcct

SEQ ID NO: 164518 - DNA, 20 bp, Homo sapiens
ctccttagagacatcaaaat

SEQ ID NO: 164519 - DNA, 21 bp, Homo sapiens
ctccttagagacatcaaaatc

SEQ ID NO: 164520 - DNA, 15 bp, Homo sapiens
ctccttcctgtcttc

SEQ ID NO: 164521 - DNA, 17 bp, Homo sapiens
ctccttccttgaccagc

SEQ ID NO: 164522 - DNA, 16 bp, Homo sapiens
ctccttgggccctttg

SEQ ID NO: 164523 - DNA, 17 bp, Homo sapiens
ctccttgggccctttga

SEQ ID NO: 164524 - DNA, 18 bp, Homo sapiens
ctccttgtggtttatgtc

SEQ ID NO: 164525 - DNA, 16 bp, Homo sapiens
ctcctttcacaacctt

SEQ ID NO: 164526 - DNA, 14 bp, Homo sapiens
ctcctttctttcta

SEQ ID NO: 164527 - DNA, 16 bp, Homo sapiens
ctcctttgcaggctca

SEQ ID NO: 164528 - DNA, 23 bp, Homo sapiens
ctcgaacatggaactcattcctg

SEQ ID NO: 164529 - DNA, 20 bp, Homo sapiens
ctcgaagcgcgccactcgct

SEQ ID NO: 164530 - DNA, 16 bp, Homo sapiens
ctcgattttgtatctg

SEQ ID NO: 164531 - DNA, 13 bp, Homo sapiens
ctcgcaagctggg

SEQ ID NO: 164532 - DNA, 19 bp, Homo sapiens
ctcgccacccctccttcct

SEQ ID NO: 164533 - DNA, 12 bp, Homo sapiens
ctcgctgccagc

SEQ ID NO: 164534 - DNA, 19 bp, Homo sapiens
ctcgctgccagctctgtat

SEQ ID NO: 164535 - DNA, 12 bp, Homo sapiens
ctcggagaagag

SEQ ID NO: 164536 - DNA, 17 bp, Homo sapiens
ctcggagtatctgggaa

SEQ ID NO: 164537 - DNA, 20 bp, Homo sapiens
ctcggatcaccgagagtagc

SEQ ID NO: 164538 - DNA, 18 bp, Homo sapiens
ctcggcttttctcagctg

SEQ ID NO: 164539 - DNA, 15 bp, Homo sapiens
ctcgggacacctgcc

SEQ ID NO: 164540 - DNA, 21 bp, Homo sapiens
ctcgggcgagtcactgcctct

SEQ ID NO: 164541 - DNA, 20 bp, Homo sapiens
ctcgtatatgtctcaggtcc

SEQ ID NO: 164542 - DNA, 16 bp, Homo sapiens
ctcgtcctccccctgc

SEQ ID NO: 164543 - DNA, 17 bp, Homo sapiens
ctcgtcctccccctgcc

SEQ ID NO: 164544 - DNA, 18 bp, Homo sapiens
ctcgtcctccccctgcca

SEQ ID NO: 164545 - DNA, 20 bp, Homo sapiens
ctcgtcctccccctgccagt

SEQ ID NO: 164546 - DNA, 14 bp, Homo sapiens
ctcgtcttcattaa

SEQ ID NO: 164547 - DNA, 14 bp, Homo sapiens
ctcgtggccttccc

SEQ ID NO: 164548 - DNA, 21 bp, Homo sapiens
ctcgtggccttccccagcctc

SEQ ID NO: 164549 - DNA, 16 bp, Homo sapiens
ctcgtggtccccaaca

SEQ ID NO: 164550 - DNA, 21 bp, Homo sapiens
ctcgtttttcttcttaagact

SEQ ID NO: 164551 - DNA, 16 bp, Homo sapiens
ctctacccatattaca

SEQ ID NO: 164552 - DNA, 19 bp, Homo sapiens
ctctacccatattacagat

SEQ ID NO: 164553 - DNA, 22 bp, Homo sapiens
ctctacctgacactcccttggg

SEQ ID NO: 164554 - DNA, 16 bp, Homo sapiens
ctctacttagcatgtc

SEQ ID NO: 164555 - DNA, 17 bp, Homo sapiens
ctctacttagcatgtcc

SEQ ID NO: 164556 - DNA, 13 bp, Homo sapiens
ctctagagcaggg

SEQ ID NO: 164557 - DNA, 16 bp, Homo sapiens
ctctagagcagggatt

SEQ ID NO: 164558 - DNA, 23 bp, Homo sapiens
ctctagggaaaaaccagcgtgtg

SEQ ID NO: 164559 - DNA, 11 bp, Homo sapiens
ctctatattta

SEQ ID NO: 164560 - DNA, 19 bp, Homo sapiens
ctctatgttctaagaagtg

SEQ ID NO: 164561 - DNA, 18 bp, Homo sapiens
ctctattaagatttccaa

SEQ ID NO: 164562 - DNA, 17 bp, Homo sapiens
ctctatttaatatttat

SEQ ID NO: 164563 - DNA, 12 bp, Homo sapiens
ctctcacctcct

SEQ ID NO: 164564 - DNA, 21 bp, Homo sapiens
ctctcactaaactttacccaa

SEQ ID NO: 164565 - DNA, 14 bp, Homo sapiens
ctctcagtctctga

SEQ ID NO: 164566 - DNA, 16 bp, Homo sapiens
ctctcagtctctgagc

SEQ ID NO: 164567 - DNA, 17 bp, Homo sapiens
ctctcagtctctgagca

SEQ ID NO: 164568 - DNA, 14 bp, Homo sapiens
ctctcattccccag

SEQ ID NO: 164569 - DNA, 12 bp, Homo sapiens
ctctccacctca

SEQ ID NO: 164570 - DNA, 13 bp, Homo sapiens
ctctccacctcag

SEQ ID NO: 164571 - DNA, 14 bp, Homo sapiens
ctctccacctcagc

SEQ ID NO: 164572 - DNA, 16 bp, Homo sapiens
ctctccactgccttcg

SEQ ID NO: 164573 - DNA, 18 bp, Homo sapiens
ctctcccctgccctgctg

SEQ ID NO: 164574 - DNA, 13 bp, Homo sapiens
ctctccctcccct

SEQ ID NO: 164575 - DNA, 21 bp, Homo sapiens
ctctccctctggccctgcctt

SEQ ID NO: 164576 - DNA, 14 bp, Homo sapiens
ctctcctcttgcca

SEQ ID NO: 164577 - DNA, 17 bp, Homo sapiens
ctctcctcttgccactg

SEQ ID NO: 164578 - DNA, 21 bp, Homo sapiens
ctctcctgatagtctttcagt

SEQ ID NO: 164579 - DNA, 13 bp, Homo sapiens
ctctcctgcctac

SEQ ID NO: 164580 - DNA, 19 bp, Homo sapiens
ctgcctgtagcccactctg

SEQ ID NO: 164581 - DNA, 23 bp, Homo sapiens
ctgcctgtagcccactctgctcg

SEQ ID NO: 164582 - DNA, 19 bp, Homo sapiens
ctgcctgtagttaggaaat

SEQ ID NO: 164583 - DNA, 19 bp, Homo sapiens
ctgcctgttcccattcttg

SEQ ID NO: 164584 - DNA, 15 bp, Homo sapiens
ctgccttatcttgca

SEQ ID NO: 164585 - DNA, 20 bp, Homo sapiens
ctgcctttagtcgctgagga

SEQ ID NO: 164586 - DNA, 13 bp, Homo sapiens
ctgcggaccccag

SEQ ID NO: 164587 - DNA, 23 bp, Homo sapiens
ctgcggaccccagctgtgagcct

SEQ ID NO: 164588 - DNA, 19 bp, Homo sapiens
ctgcgtcatgcttgtgtta

SEQ ID NO: 164589 - DNA, 14 bp, Homo sapiens
ctgctaatcttcag

SEQ ID NO: 164590 - DNA, 13 bp, Homo sapiens
ctgctacctcact

SEQ ID NO: 164591 - DNA, 16 bp, Homo sapiens
ctgctcatcattctct

SEQ ID NO: 164592 - DNA, 18 bp, Homo sapiens
ctgctcatcattctctgt

SEQ ID NO: 164593 - DNA, 19 bp, Homo sapiens
ctgctccccagccctggct

SEQ ID NO: 164594 - DNA, 17 bp, Homo sapiens
ctgctcccctccctcct

SEQ ID NO: 164595 - DNA, 15 bp, Homo sapiens
ctgctccctgaagcc

SEQ ID NO: 164596 - DNA, 19 bp, Homo sapiens
ctgctccctgaagccagcc

SEQ ID NO: 164597 - DNA, 12 bp, Homo sapiens
ctgctcctccag

SEQ ID NO: 164598 - DNA, 13 bp, Homo sapiens
ctgctcctccagg

SEQ ID NO: 164599 - DNA, 16 bp, Homo sapiens
ctgctcctccagggcc

SEQ ID NO: 164600 - DNA, 17 bp, Homo sapiens
ctgctcctccagggcca

SEQ ID NO: 164601 - DNA, 15 bp, Homo sapiens
ctgctcgccttagca

SEQ ID NO: 164602 - DNA, 16 bp, Homo sapiens
ctgctcgccttagcac

SEQ ID NO: 164603 - DNA, 20 bp, Homo sapiens
ctgctctcctcttgccactg

SEQ ID NO: 164604 - DNA, 14 bp, Homo sapiens
ctgctctttctctg

SEQ ID NO: 164605 - DNA, 15 bp, Homo sapiens
ctgctctttctctgc

SEQ ID NO: 164606 - DNA, 16 bp, Homo sapiens
ctgctctttctctgcc

SEQ ID NO: 164607 - DNA, 17 bp, Homo sapiens
ctgctctttctctgcca

SEQ ID NO: 164608 - DNA, 16 bp, Homo sapiens
ctgctgaataataaac

SEQ ID NO: 164609 - DNA, 18 bp, Homo sapiens
ctgctgacctccacagct

SEQ ID NO: 164610 - DNA, 15 bp, Homo sapiens
ctgctgagagaccca

SEQ ID NO: 164611 - DNA, 21 bp, Homo sapiens
ctgctgagagacccaaggagg

SEQ ID NO: 164612 - DNA, 22 bp, Homo sapiens
ctgctgagagacccaaggagga

SEQ ID NO: 164613 - DNA, 16 bp, Homo sapiens
ctgctgcaggggctct

SEQ ID NO: 164614 - DNA, 17 bp, Homo sapiens
ctgctgcaggggctctg

SEQ ID NO: 164615 - DNA, 19 bp, Homo sapiens
ctgctgccgcctcccagcc

SEQ ID NO: 164616 - DNA, 13 bp, Homo sapiens
ctgctgcttctta

SEQ ID NO: 164617 - DNA, 12 bp, Homo sapiens
ctgctggctgcc

SEQ ID NO: 164618 - DNA, 14 bp, Homo sapiens
ctgctggctgcctt

SEQ ID NO: 164619 - DNA, 19 bp, Homo sapiens
ctgctgggttttcctccgg

SEQ ID NO: 164620 - DNA, 20 bp, Homo sapiens
ctgctgtctaacctgtgacc

SEQ ID NO: 164621 - DNA, 18 bp, Homo sapiens
ctgcttacaattccctgc

SEQ ID NO: 164622 - DNA, 12 bp, Homo sapiens
ctgcttgaggaa

SEQ ID NO: 164623 - DNA, 21 bp, Homo sapiens
ctgctttgactgagcagactg

SEQ ID NO: 164624 - DNA, 16 bp, Homo sapiens
ctgctttgggctgccc

SEQ ID NO: 164625 - DNA, 17 bp, Homo sapiens
ctgctttgggctgccct

SEQ ID NO: 164626 - DNA, 19 bp, Homo sapiens
ctgctttgggctgccctgg

SEQ ID NO: 164627 - DNA, 20 bp, Homo sapiens
ctgctttgggctgccctggt

SEQ ID NO: 164628 - DNA, 21 bp, Homo sapiens
ctgctttgggctgccctggtg

SEQ ID NO: 164629 - DNA, 21 bp, Homo sapiens
ctgcttttccctaagccaagg

SEQ ID NO: 164630 - DNA, 22 bp, Homo sapiens
ctggaagctgtgtccttgcacc

SEQ ID NO: 164631 - DNA, 15 bp, Homo sapiens
ctggacaagcagagg

SEQ ID NO: 164632 - DNA, 21 bp, Homo sapiens
ctggaccagtggtctcacatg

SEQ ID NO: 164633 - DNA, 15 bp, Homo sapiens
ctggaccctgtggat

SEQ ID NO: 164634 - DNA, 20 bp, Homo sapiens
ctggactcaggatgcccagg

SEQ ID NO: 164635 - DNA, 22 bp, Homo sapiens
ctggactcaggatgcccagggc

SEQ ID NO: 164636 - DNA, 19 bp, Homo sapiens
ctggactctcagtctctga

SEQ ID NO: 164637 - DNA, 23 bp, Homo sapiens
ctggactctcagtctctgagcag

SEQ ID NO: 164638 - DNA, 22 bp, Homo sapiens
ctggactgccttgaatatcccc

SEQ ID NO: 164639 - DNA, 13 bp, Homo sapiens
ctggactttcctg

SEQ ID NO: 164640 - DNA, 15 bp, Homo sapiens
ctggactttcctgca

SEQ ID NO: 164641 - DNA, 18 bp, Homo sapiens
ctggactttcctgcaact

SEQ ID NO: 164642 - DNA, 14 bp, Homo sapiens
ctggagaagagagg

SEQ ID NO: 164643 - DNA, 21 bp, Homo sapiens
ctggagaagcagtgagccgca

SEQ ID NO: 164644 - DNA, 20 bp, Homo sapiens
ctggagacagccccagagca

SEQ ID NO: 164645 - DNA, 22 bp, Homo sapiens
ctggagagaaacaataaagaga

SEQ ID NO: 164646 - DNA, 13 bp, Homo sapiens
ctggagcaccagg

SEQ ID NO: 164647 - DNA, 23 bp, Homo sapiens
ctggagcaccaggcacgaaccca

SEQ ID NO: 164648 - DNA, 12 bp, Homo sapiens
ctggagctctgc

SEQ ID NO: 164649 - DNA, 13 bp, Homo sapiens
ctggagctctgcc

SEQ ID NO: 164650 - DNA, 12 bp, Homo sapiens
ctggaggcaggg

SEQ ID NO: 164651 - DNA, 23 bp, Homo sapiens
ctggaggcagggccttgcccaga

SEQ ID NO: 164652 - DNA, 21 bp, Homo sapiens
ctggaggccgggtgctcaggg

SEQ ID NO: 164653 - DNA, 15 bp, Homo sapiens
ctggaggggacgctg

SEQ ID NO: 164654 - DNA, 16 bp, Homo sapiens
ctggaggggacgctgg

SEQ ID NO: 164655 - DNA, 14 bp, Homo sapiens
ctggaggggcatgg

SEQ ID NO: 164656 - DNA, 14 bp, Homo sapiens
ctggaggtgggagc

SEQ ID NO: 164657 - DNA, 16 bp, Homo sapiens
ctggaggtgggagcag

SEQ ID NO: 164658 - DNA, 22 bp, Homo sapiens
ctggaggtgggagcaggagatt

SEQ ID NO: 164659 - DNA, 15 bp, Homo sapiens
ctggagtccagtctc

SEQ ID NO: 164660 - DNA, 20 bp, Homo sapiens
ctggatctccattctctcag

SEQ ID NO: 164661 - DNA, 11 bp, Homo sapiens
ctggatggagc

SEQ ID NO: 164662 - DNA, 16 bp, Homo sapiens
ctggatggagcccagg

SEQ ID NO: 164663 - DNA, 20 bp, Homo sapiens
ctggatgttttttccctgtt

SEQ ID NO: 164664 - DNA, 14 bp, Homo sapiens
ctggcaagaatgtg

SEQ ID NO: 164665 - DNA, 22 bp, Homo sapiens
ctggcaatgaaaaattctcagt

SEQ ID NO: 164666 - DNA, 16 bp, Homo sapiens
ctggcacagggcagtg

SEQ ID NO: 164667 - DNA, 19 bp, Homo sapiens
ctggcacatttccccagac

SEQ ID NO: 164668 - DNA, 14 bp, Homo sapiens
ctggcactgctgtg

SEQ ID NO: 164669 - DNA, 16 bp, Homo sapiens
ctggcactgctgtgct

SEQ ID NO: 164670 - DNA, 14 bp, Homo sapiens
ctggcacttggaga

SEQ ID NO: 164671 - DNA, 15 bp, Homo sapiens
ctggcagcagagtgt

SEQ ID NO: 164672 - DNA, 11 bp, Homo sapiens
ctggcagccca

SEQ ID NO: 164673 - DNA, 13 bp, Homo sapiens
ctggcagccgtgc

SEQ ID NO: 164674 - DNA, 18 bp, Homo sapiens
ctggcagccgtgccttca

SEQ ID NO: 164675 - DNA, 20 bp, Homo sapiens
ctggcagccgtgccttcagc

SEQ ID NO: 164676 - DNA, 22 bp, Homo sapiens
ctggcagccgtgccttcagctc

SEQ ID NO: 164677 - DNA, 17 bp, Homo sapiens
ctggccatccctcgtgg

SEQ ID NO: 164678 - DNA, 23 bp, Homo sapiens
ctggccatccctcgtggtcccca

SEQ ID NO: 164679 - DNA, 13 bp, Homo sapiens
ctggcccactgca

SEQ ID NO: 164680 - DNA, 21 bp, Homo sapiens
ctggccccatgtctctcagaa

SEQ ID NO: 164681 - DNA, 23 bp, Homo sapiens
ctggccctcacccctgccctggg

SEQ ID NO: 164682 - DNA, 17 bp, Homo sapiens
ctggcggctactcagca

SEQ ID NO: 164683 - DNA, 18 bp, Homo sapiens
ctggcggctactcagcag

SEQ ID NO: 164684 - DNA, 21 bp, Homo sapiens
ctggctcatattcctgcagcc

SEQ ID NO: 164685 - DNA, 22 bp, Homo sapiens
ctggctcatattcctgcagcct

SEQ ID NO: 164686 - DNA, 24 bp, Homo sapiens
ctggctcatattcctgcagcctgg

SEQ ID NO: 164687 - DNA, 19 bp, Homo sapiens
ctggctcccacaggccctt

SEQ ID NO: 164688 - DNA, 20 bp, Homo sapiens
ctggctcttgtgctggatgg

SEQ ID NO: 164689 - DNA, 17 bp, Homo sapiens
ctggcttgtaactccac

SEQ ID NO: 164690 - DNA, 16 bp, Homo sapiens
ctggcttttcactgct

SEQ ID NO: 164691 - DNA, 19 bp, Homo sapiens
ctggcttttcactgctggc

SEQ ID NO: 164692 - DNA, 23 bp, Homo sapiens
ctggcttttcactgctggctgcc

SEQ ID NO: 164693 - DNA, 18 bp, Homo sapiens
ctgggaaatattccctag

SEQ ID NO: 164694 - DNA, 22 bp, Homo sapiens
ctgggaccacaggttcatgcca

SEQ ID NO: 164695 - DNA, 19 bp, Homo sapiens
ctgggaggcatggccctgg

SEQ ID NO: 164696 - DNA, 22 bp, Homo sapiens
ctgggaggcatggccctggggt

SEQ ID NO: 164697 - DNA, 20 bp, Homo sapiens
ctgggagggcagcagggcta

SEQ ID NO: 164698 - DNA, 13 bp, Homo sapiens
ctgggatcctaag

SEQ ID NO: 164699 - DNA, 14 bp, Homo sapiens
ctgggatgtccaca

SEQ ID NO: 164700 - DNA, 13 bp, Homo sapiens
ctgggccctctct

SEQ ID NO: 164701 - DNA, 15 bp, Homo sapiens
ctgggctctccacct

SEQ ID NO: 164702 - DNA, 20 bp, Homo sapiens
ctgggctctccacctcagcc

SEQ ID NO: 164703 - DNA, 16 bp, Homo sapiens
ctgggctgagggagcc

SEQ ID NO: 164704 - DNA, 19 bp, Homo sapiens
ctgggcttggggcttccta

SEQ ID NO: 164705 - DNA, 18 bp, Homo sapiens
ctgggcttgtctgtagat

SEQ ID NO: 164706 - DNA, 15 bp, Homo sapiens
ctggggcagtcacct

SEQ ID NO: 164707 - DNA, 19 bp, Homo sapiens
ctggggctaggctggagcc

SEQ ID NO: 164708 - DNA, 16 bp, Homo sapiens
ctggggcttctcctga

SEQ ID NO: 164709 - DNA, 14 bp, Homo sapiens
ctgggggaagccct

SEQ ID NO: 164710 - DNA, 17 bp, Homo sapiens
ctgggggaagccctgga

SEQ ID NO: 164711 - DNA, 14 bp, Homo sapiens
ctgggggtgccagg

SEQ ID NO: 164712 - DNA, 20 bp, Homo sapiens
ctgggggttctttcttcctc

SEQ ID NO: 164713 - DNA, 19 bp, Homo sapiens
ctggggttcagcccctcct

SEQ ID NO: 164714 - DNA, 21 bp, Homo sapiens
ctggggttcagcccctcctct

SEQ ID NO: 164715 - DNA, 23 bp, Homo sapiens
ctggggttcagcccctcctctgc

SEQ ID NO: 164716 - DNA, 20 bp, Homo sapiens
ctgggtaactagggaagata

SEQ ID NO: 164717 - DNA, 22 bp, Homo sapiens
ctgggtccaggggatgggaggt

SEQ ID NO: 164718 - DNA, 22 bp, Homo sapiens
ctgggtgacagagcaagactct

SEQ ID NO: 164719 - DNA, 15 bp, Homo sapiens
ctgggtgctccctac

SEQ ID NO: 164720 - DNA, 23 bp, Homo sapiens
ctgggtggcaccagcagcctgga

SEQ ID NO: 164721 - DNA, 12 bp, Homo sapiens
agattctttccc

SEQ ID NO: 164722 - DNA, 17 bp, Homo sapiens
agattgagaaggagaga

SEQ ID NO: 164723 - DNA, 15 bp, Homo sapiens
agattgcttaaaata

SEQ ID NO: 164724 - DNA, 21 bp, Homo sapiens
agattgtgcccctgcactcca

SEQ ID NO: 164725 - DNA, 22 bp, Homo sapiens
agattgttttatcatgacatgt

SEQ ID NO: 164726 - DNA, 18 bp, Homo sapiens
agatttccatataaatat

SEQ ID NO: 164727 - DNA, 17 bp, Homo sapiens
agatttgaactcttcaa

SEQ ID NO: 164728 - DNA, 17 bp, Homo sapiens
agattttaattttgaat

SEQ ID NO: 164729 - DNA, 21 bp, Homo sapiens
agattttgaaatttttattaa

SEQ ID NO: 164730 - DNA, 15 bp, Homo sapiens
agcaaaaagcaaaat

SEQ ID NO: 164731 - DNA, 21 bp, Homo sapiens
agcaaaagggtgtctgagccc

SEQ ID NO: 164732 - DNA, 23 bp, Homo sapiens
agcaaaatgtgaatgggaaaaga

SEQ ID NO: 164733 - DNA, 13 bp, Homo sapiens
agcaaaattgatg

SEQ ID NO: 164734 - DNA, 23 bp, Homo sapiens
agcaaaattgatgtgtttattta

SEQ ID NO: 164735 - DNA, 15 bp, Homo sapiens
agcaaactctgctgt

SEQ ID NO: 164736 - DNA, 19 bp, Homo sapiens
agcaaataaactaggaaat

SEQ ID NO: 164737 - DNA, 23 bp, Homo sapiens
agcaacgcaggcccccaggtgcc

SEQ ID NO: 164738 - DNA, 20 bp, Homo sapiens
agcaagcatttatgtttatt

SEQ ID NO: 164739 - DNA, 19 bp, Homo sapiens
agcaatgacatctcagggg

SEQ ID NO: 164740 - DNA, 20 bp, Homo sapiens
agcaatgacatctcaggggc

SEQ ID NO: 164741 - DNA, 21 bp, Homo sapiens
agcaatgacatctcaggggcc

SEQ ID NO: 164742 - DNA, 20 bp, Homo sapiens
agcaatttatacaatatcat

SEQ ID NO: 164743 - DNA, 19 bp, Homo sapiens
agcacagagagggggccac

SEQ ID NO: 164744 - DNA, 21 bp, Homo sapiens
agcacagcagcccctgcacaa

SEQ ID NO: 164745 - DNA, 14 bp, Homo sapiens
agcacagtgcctgc

SEQ ID NO: 164746 - DNA, 16 bp, Homo sapiens
agcacatctgcatttt

SEQ ID NO: 164747 - DNA, 23 bp, Homo sapiens
agcacatctgcattttcacccca

SEQ ID NO: 164748 - DNA, 14 bp, Homo sapiens
agcaccaggcacga

SEQ ID NO: 164749 - DNA, 18 bp, Homo sapiens
agcacctagtccagtgac

SEQ ID NO: 164750 - DNA, 11 bp, Homo sapiens
agcacctgccg

SEQ ID NO: 164751 - DNA, 21 bp, Homo sapiens
agcacctgccgacctcgtcct

SEQ ID NO: 164752 - DNA, 22 bp, Homo sapiens
agcacctgccgacctcgtcctc

SEQ ID NO: 164753 - DNA, 22 bp, Homo sapiens
agcacctgtctcctttcacccc

SEQ ID NO: 164754 - DNA, 14 bp, Homo sapiens
agcactaaagcagt

SEQ ID NO: 164755 - DNA, 16 bp, Homo sapiens
agcactaaagcagtgg

SEQ ID NO: 164756 - DNA, 17 bp, Homo sapiens
agcactacataaactga

SEQ ID NO: 164757 - DNA, 14 bp, Homo sapiens
agcactcccaagtc

SEQ ID NO: 164758 - DNA, 16 bp, Homo sapiens
agcactgacttctaag

SEQ ID NO: 164759 - DNA, 16 bp, Homo sapiens
agcactgagcaaagca

SEQ ID NO: 164760 - DNA, 16 bp, Homo sapiens
agcactgtcccttgcc

SEQ ID NO: 164761 - DNA, 22 bp, Homo sapiens
agcactgtcccttgcctcaatg

SEQ ID NO: 164762 - DNA, 13 bp, Homo sapiens
agcacttaagaga

SEQ ID NO: 164763 - DNA, 15 bp, Homo sapiens
agcacttaagagaat

SEQ ID NO: 164764 - DNA, 23 bp, Homo sapiens
agcacttggagccaagggttcag

SEQ ID NO: 164765 - DNA, 20 bp, Homo sapiens
agcactttgggaggccaagg

SEQ ID NO: 164766 - DNA, 21 bp, Homo sapiens
agcagaacggagccccaggcc

SEQ ID NO: 164767 - DNA, 21 bp, Homo sapiens
agcagacagtgttttctggga

SEQ ID NO: 164768 - DNA, 13 bp, Homo sapiens
agcagatgcaaag

SEQ ID NO: 164769 - DNA, 17 bp, Homo sapiens
agcagatgcaaagaggc

SEQ ID NO: 164770 - DNA, 20 bp, Homo sapiens
agcagatgcaaagaggcaag

SEQ ID NO: 164771 - DNA, 20 bp, Homo sapiens
agcagattggagaaaccctt

SEQ ID NO: 164772 - DNA, 13 bp, Homo sapiens
agcagattttaat

SEQ ID NO: 164773 - DNA, 22 bp, Homo sapiens
agcagattttaattttgaataa

SEQ ID NO: 164774 - DNA, 21 bp, Homo sapiens
cttcagcctagccgacctcag

SEQ ID NO: 164775 - DNA, 23 bp, Homo sapiens
cttcagcctagccgacctcagcc

SEQ ID NO: 164776 - DNA, 15 bp, Homo sapiens
cttcagcctgaaaga

SEQ ID NO: 164777 - DNA, 19 bp, Homo sapiens
cttcagctgacttttctgt

SEQ ID NO: 164778 - DNA, 15 bp, Homo sapiens
cttcaggctcttctc

SEQ ID NO: 164779 - DNA, 16 bp, Homo sapiens
cttcaggctcttctcc

SEQ ID NO: 164780 - DNA, 16 bp, Homo sapiens
cttcaggtggaaaaac

SEQ ID NO: 164781 - DNA, 15 bp, Homo sapiens
cttcagtaagccgtg

SEQ ID NO: 164782 - DNA, 18 bp, Homo sapiens
cttcagtatgttgtcaaa

SEQ ID NO: 164783 - DNA, 23 bp, Homo sapiens
cttcagtatgttgtcaaagagag

SEQ ID NO: 164784 - DNA, 13 bp, Homo sapiens
cttcagtgcccac

SEQ ID NO: 164785 - DNA, 13 bp, Homo sapiens
cttcagtgggaga

SEQ ID NO: 164786 - DNA, 15 bp, Homo sapiens
cttcagtgggagaaa

SEQ ID NO: 164787 - DNA, 19 bp, Homo sapiens
cttcataacaattttagga

SEQ ID NO: 164788 - DNA, 18 bp, Homo sapiens
cttcatagcagattttaa

SEQ ID NO: 164789 - DNA, 21 bp, Homo sapiens
cttcatggcagaaggcaaacc

SEQ ID NO: 164790 - DNA, 13 bp, Homo sapiens
cttcatttggaga

SEQ ID NO: 164791 - DNA, 19 bp, Homo sapiens
cttccaaatcccctaagca

SEQ ID NO: 164792 - DNA, 20 bp, Homo sapiens
cttccaaatcccctaagcag

SEQ ID NO: 164793 - DNA, 18 bp, Homo sapiens
cttccaacaggagctggg

SEQ ID NO: 164794 - DNA, 14 bp, Homo sapiens
cttccaccagcctg

SEQ ID NO: 164795 - DNA, 15 bp, Homo sapiens
cttccactgagggca

SEQ ID NO: 164796 - DNA, 18 bp, Homo sapiens
cttccactgagggcagtc

SEQ ID NO: 164797 - DNA, 16 bp, Homo sapiens
cttccagcaccctgca

SEQ ID NO: 164798 - DNA, 16 bp, Homo sapiens
cttccaggtgcccagc

SEQ ID NO: 164799 - DNA, 19 bp, Homo sapiens
cttccaggtgcccagctat

SEQ ID NO: 164800 - DNA, 17 bp, Homo sapiens
cttccagtccaatctca

SEQ ID NO: 164801 - DNA, 17 bp, Homo sapiens
cttccatcccaggacac

SEQ ID NO: 164802 - DNA, 22 bp, Homo sapiens
cttccatcccaggacaccacac

SEQ ID NO: 164803 - DNA, 15 bp, Homo sapiens
cttccatctcgccac

SEQ ID NO: 164804 - DNA, 21 bp, Homo sapiens
cttcccaaaggactccaccca

SEQ ID NO: 164805 - DNA, 14 bp, Homo sapiens
cttcccagctctcc

SEQ ID NO: 164806 - DNA, 21 bp, Homo sapiens
cttcccagctctccctctggc

SEQ ID NO: 164807 - DNA, 17 bp, Homo sapiens
cttcccatcactggagc

SEQ ID NO: 164808 - DNA, 15 bp, Homo sapiens
cttcccccatagcca

SEQ ID NO: 164809 - DNA, 12 bp, Homo sapiens
cttccccctcca

SEQ ID NO: 164810 - DNA, 15 bp, Homo sapiens
cttccccctccaatc

SEQ ID NO: 164811 - DNA, 23 bp, Homo sapiens
cttccccttgcccagggctcagc

SEQ ID NO: 164812 - DNA, 17 bp, Homo sapiens
cttcccgctcagccctc

SEQ ID NO: 164813 - DNA, 17 bp, Homo sapiens
cttccctacagttgaaa

SEQ ID NO: 164814 - DNA, 15 bp, Homo sapiens
cttcctccctcattc

SEQ ID NO: 164815 - DNA, 14 bp, Homo sapiens
cttcctctccactg

SEQ ID NO: 164816 - DNA, 21 bp, Homo sapiens
cttcctctccactgccttcga

SEQ ID NO: 164817 - DNA, 17 bp, Homo sapiens
cttcctgcattcaccca

SEQ ID NO: 164818 - DNA, 22 bp, Homo sapiens
cttcctgcattcacccagacag

SEQ ID NO: 164819 - DNA, 16 bp, Homo sapiens
cttcctgtgacttcag

SEQ ID NO: 164820 - DNA, 13 bp, Homo sapiens
cttccttccctgg

SEQ ID NO: 164821 - DNA, 17 bp, Homo sapiens
cttccttccctggcttg

SEQ ID NO: 164822 - DNA, 16 bp, Homo sapiens
cttccttgaccagcag

SEQ ID NO: 164823 - DNA, 20 bp, Homo sapiens
cttcgggaggtcgaggcagg

SEQ ID NO: 164824 - DNA, 19 bp, Homo sapiens
cttcgtttactatgcctgt

SEQ ID NO: 164825 - DNA, 17 bp, Homo sapiens
cttctaagtaaaaccac

SEQ ID NO: 164826 - DNA, 21 bp, Homo sapiens
cttctaagtaaaaccacagca

SEQ ID NO: 164827 - DNA, 12 bp, Homo sapiens
cttctaatatat

SEQ ID NO: 164828 - DNA, 18 bp, Homo sapiens
cttctaatatatttttat

SEQ ID NO: 164829 - DNA, 13 bp, Homo sapiens
cttctagaaccag

SEQ ID NO: 164830 - DNA, 17 bp, Homo sapiens
cttctagaaccaggcaa

SEQ ID NO: 164831 - DNA, 16 bp, Homo sapiens
cttctaggttctaaaa

SEQ ID NO: 164832 - DNA, 14 bp, Homo sapiens
cttctcagaatcta

SEQ ID NO: 164833 - DNA, 18 bp, Homo sapiens
cttctcagaatctaccca

SEQ ID NO: 164834 - DNA, 20 bp, Homo sapiens
cttctcaggctctgccctgc

SEQ ID NO: 164835 - DNA, 13 bp, Homo sapiens
cttctccactgga

SEQ ID NO: 164836 - DNA, 15 bp, Homo sapiens
cttctccactggatg

SEQ ID NO: 164837 - DNA, 15 bp, Homo sapiens
cttctctcacctcct

SEQ ID NO: 164838 - DNA, 16 bp, Homo sapiens
cttctctcacctccta

SEQ ID NO: 164839 - DNA, 13 bp, Homo sapiens
cttctctctgtgg

SEQ ID NO: 164840 - DNA, 14 bp, Homo sapiens
cttctcttaattta

SEQ ID NO: 164841 - DNA, 15 bp, Homo sapiens
cttctcttaatttaa

SEQ ID NO: 164842 - DNA, 17 bp, Homo sapiens
cttctgccggccctggg

SEQ ID NO: 164843 - DNA, 18 bp, Homo sapiens
cttctgccggccctgggg

SEQ ID NO: 164844 - DNA, 19 bp, Homo sapiens
cttctgccggccctggggc

SEQ ID NO: 164845 - DNA, 22 bp, Homo sapiens
cttctgggagggcagcagggct

SEQ ID NO: 164846 - DNA, 18 bp, Homo sapiens
cttctgtatactgtggag

SEQ ID NO: 164847 - DNA, 16 bp, Homo sapiens
cttcttaaatgagaag

SEQ ID NO: 164848 - DNA, 21 bp, Homo sapiens
cttcttaaccccagtaagcca

SEQ ID NO: 164849 - DNA, 13 bp, Homo sapiens
cttcttatacatt

SEQ ID NO: 164850 - DNA, 19 bp, Homo sapiens
cttcttccaggtgcccagc

SEQ ID NO: 164851 - DNA, 18 bp, Homo sapiens
cttcttccatcccaggac

SEQ ID NO: 164852 - DNA, 20 bp, Homo sapiens
cttcttcggggaactcctgg

SEQ ID NO: 164853 - DNA, 16 bp, Homo sapiens
cttcttggtcttattt

SEQ ID NO: 164854 - DNA, 13 bp, Homo sapiens
cttcttgttcccc

SEQ ID NO: 164855 - DNA, 15 bp, Homo sapiens
cttgaacccaggaga

SEQ ID NO: 164856 - DNA, 19 bp, Homo sapiens
cttgaacccgggaggcaga

SEQ ID NO: 164857 - DNA, 22 bp, Homo sapiens
cttgaagttgttactaactaaa

SEQ ID NO: 164858 - DNA, 20 bp, Homo sapiens
cttgaattgtaactgttctt

SEQ ID NO: 164859 - DNA, 13 bp, Homo sapiens
cttgacacctgct

SEQ ID NO: 164860 - DNA, 23 bp, Homo sapiens
cttgaccaagcaggaagctcaga

SEQ ID NO: 164861 - DNA, 13 bp, Homo sapiens
cttgactccttgt

SEQ ID NO: 164862 - DNA, 13 bp, Homo sapiens
cttgagaaacctt

SEQ ID NO: 164863 - DNA, 14 bp, Homo sapiens
gaagtgaacatttc

SEQ ID NO: 164864 - DNA, 18 bp, Homo sapiens
gaagtggaccaggacagg

SEQ ID NO: 164865 - DNA, 15 bp, Homo sapiens
gaagtgtaggcagac

SEQ ID NO: 164866 - DNA, 17 bp, Homo sapiens
gaagtgtaggcagacac

SEQ ID NO: 164867 - DNA, 18 bp, Homo sapiens
gaagttactgttatagag

SEQ ID NO: 164868 - DNA, 17 bp, Homo sapiens
gaagtttacattgtaaa

SEQ ID NO: 164869 - DNA, 20 bp, Homo sapiens
gaagtttgagatcagcctgg

SEQ ID NO: 164870 - DNA, 17 bp, Homo sapiens
gaataaaatgttgaaaa

SEQ ID NO: 164871 - DNA, 22 bp, Homo sapiens
gaataataattatccagagttt

SEQ ID NO: 164872 - DNA, 11 bp, Homo sapiens
gaatatattat

SEQ ID NO: 164873 - DNA, 12 bp, Homo sapiens
gaatatattata

SEQ ID NO: 164874 - DNA, 14 bp, Homo sapiens
gaatatctgggatt

SEQ ID NO: 164875 - DNA, 15 bp, Homo sapiens
gaatatttattacct

SEQ ID NO: 164876 - DNA, 18 bp, Homo sapiens
gaatatttattacctctg

SEQ ID NO: 164877 - DNA, 16 bp, Homo sapiens
gaatattttaacttcc

SEQ ID NO: 164878 - DNA, 13 bp, Homo sapiens
gaatcaaaactct

SEQ ID NO: 164879 - DNA, 15 bp, Homo sapiens
gaatcaaaactctcc

SEQ ID NO: 164880 - DNA, 20 bp, Homo sapiens
gaatcatgtcaggcctgtgt

SEQ ID NO: 164881 - DNA, 22 bp, Homo sapiens
gaatcatttctatttctcctcc

SEQ ID NO: 164882 - DNA, 16 bp, Homo sapiens
gaatccaagcgaggtc

SEQ ID NO: 164883 - DNA, 16 bp, Homo sapiens
gaatctacccaaagga

SEQ ID NO: 164884 - DNA, 17 bp, Homo sapiens
gaatctacccaaaggat

SEQ ID NO: 164885 - DNA, 18 bp, Homo sapiens
gaatctctttttgctttc

SEQ ID NO: 164886 - DNA, 22 bp, Homo sapiens
gaatctttagagaagtatacat

SEQ ID NO: 164887 - DNA, 23 bp, Homo sapiens
gaatctttagagaagtatacata

SEQ ID NO: 164888 - DNA, 17 bp, Homo sapiens
gaatctttattgagaaa

SEQ ID NO: 164889 - DNA, 19 bp, Homo sapiens
gaatctttattgagaaaga

SEQ ID NO: 164890 - DNA, 17 bp, Homo sapiens
gaatgaaggtgtcagaa

SEQ ID NO: 164891 - DNA, 13 bp, Homo sapiens
gaatgacaaagag

SEQ ID NO: 164892 - DNA, 13 bp, Homo sapiens
gaatgatgaagct

SEQ ID NO: 164893 - DNA, 16 bp, Homo sapiens
gaatgatttccaaaga

SEQ ID NO: 164894 - DNA, 13 bp, Homo sapiens
gaatgggaaaaga

SEQ ID NO: 164895 - DNA, 11 bp, Homo sapiens
gaatgtaatca

SEQ ID NO: 164896 - DNA, 13 bp, Homo sapiens
gaatgtaatcaat

SEQ ID NO: 164897 - DNA, 19 bp, Homo sapiens
gaatgtaatcaatgtttct

SEQ ID NO: 164898 - DNA, 20 bp, Homo sapiens
gaatgttacattgtttgtct

SEQ ID NO: 164899 - DNA, 14 bp, Homo sapiens
gaatgtttgtctca

SEQ ID NO: 164900 - DNA, 15 bp, Homo sapiens
gaattaatagctttt

SEQ ID NO: 164901 - DNA, 22 bp, Homo sapiens
gaattaatatccctacatgtat

SEQ ID NO: 164902 - DNA, 19 bp, Homo sapiens
gaattctgctacctcactg

SEQ ID NO: 164903 - DNA, 16 bp, Homo sapiens
gaattgaacccaggag

SEQ ID NO: 164904 - DNA, 16 bp, Homo sapiens
gaattgtaactgttct

SEQ ID NO: 164905 - DNA, 16 bp, Homo sapiens
gaatttaataatctgt

SEQ ID NO: 164906 - DNA, 20 bp, Homo sapiens
gaatttcttcactgttgaaa

SEQ ID NO: 164907 - DNA, 14 bp, Homo sapiens
gaattttcagaccc

SEQ ID NO: 164908 - DNA, 22 bp, Homo sapiens
gaattttctttttaataaaaag

SEQ ID NO: 164909 - DNA, 22 bp, Homo sapiens
gacaaatgctgcgcccttcccc

SEQ ID NO: 164910 - DNA, 19 bp, Homo sapiens
gacaaccactggtctgtag

SEQ ID NO: 164911 - DNA, 14 bp, Homo sapiens
gacaacgaggaagc

SEQ ID NO: 164912 - DNA, 15 bp, Homo sapiens
gacaagaaatccctg

SEQ ID NO: 164913 - DNA, 16 bp, Homo sapiens
gacaagaaatccctgt

SEQ ID NO: 164914 - DNA, 19 bp, Homo sapiens
gacaagacttcagtatgtt

SEQ ID NO: 164915 - DNA, 12 bp, Homo sapiens
gacaagcagagg

SEQ ID NO: 164916 - DNA, 23 bp, Homo sapiens
gacaaggtagccctggccagagg

SEQ ID NO: 164917 - DNA, 19 bp, Homo sapiens
gacaatgtgaaaagaaaaa

SEQ ID NO: 164918 - DNA, 23 bp, Homo sapiens
gacacagctttatcaccagagag

SEQ ID NO: 164919 - DNA, 14 bp, Homo sapiens
gacaccacacccag

SEQ ID NO: 164920 - DNA, 18 bp, Homo sapiens
gacaccacacccagcctc

SEQ ID NO: 164921 - DNA, 19 bp, Homo sapiens
gacaccaggagtccctggt

SEQ ID NO: 164922 - DNA, 20 bp, Homo sapiens
gacaccaggagtccctggta

SEQ ID NO: 164923 - DNA, 15 bp, Homo sapiens
gacacccattttcac

SEQ ID NO: 164924 - DNA, 17 bp, Homo sapiens
gacacctactgagtggc

SEQ ID NO: 164925 - DNA, 13 bp, Homo sapiens
gacacctgcacct

SEQ ID NO: 164926 - DNA, 22 bp, Homo sapiens
gacacctgcacctccccccact

SEQ ID NO: 164927 - DNA, 14 bp, Homo sapiens
gacacctgccctgc

SEQ ID NO: 164928 - DNA, 15 bp, Homo sapiens
gacacctgccctgcc

SEQ ID NO: 164929 - DNA, 12 bp, Homo sapiens
gacactccagtg

SEQ ID NO: 164930 - DNA, 14 bp, Homo sapiens
gacactccagtgcc

SEQ ID NO: 164931 - DNA, 23 bp, Homo sapiens
gacactggctcatattcctgcag

SEQ ID NO: 164932 - DNA, 20 bp, Homo sapiens
gacagaaagcagaacagtga

SEQ ID NO: 164933 - DNA, 15 bp, Homo sapiens
gacagagacacctgc

SEQ ID NO: 164934 - DNA, 18 bp, Homo sapiens
gacagagacacctgcacc

SEQ ID NO: 164935 - DNA, 20 bp, Homo sapiens
gacagagaccctctgccacc

SEQ ID NO: 164936 - DNA, 18 bp, Homo sapiens
gacagagaggacgtgggc

SEQ ID NO: 164937 - DNA, 19 bp, Homo sapiens
gacagagaggacgtgggcg

SEQ ID NO: 164938 - DNA, 13 bp, Homo sapiens
gacagagccatgc

SEQ ID NO: 164939 - DNA, 13 bp, Homo sapiens
gacagagggaaga

SEQ ID NO: 164940 - DNA, 16 bp, Homo sapiens
gacagagggaagaaaa

SEQ ID NO: 164941 - DNA, 19 bp, Homo sapiens
gacagatgaatgccgtgga

SEQ ID NO: 164942 - DNA, 13 bp, Homo sapiens
gacagcagctcag

SEQ ID NO: 164943 - DNA, 14 bp, Homo sapiens
gacagcagctcagg

SEQ ID NO: 164944 - DNA, 20 bp, Homo sapiens
gacagcagctcaggcacact

SEQ ID NO: 164945 - DNA, 14 bp, Homo sapiens
gacagccccagagc

SEQ ID NO: 164946 - DNA, 16 bp, Homo sapiens
gacagccccagagcag

SEQ ID NO: 164947 - DNA, 12 bp, Homo sapiens
ctgtccttaccc

SEQ ID NO: 164948 - DNA, 23 bp, Homo sapiens
ctgtccttctctcacctcctaaa

SEQ ID NO: 164949 - DNA, 13 bp, Homo sapiens
ctgtctaaaaaac

SEQ ID NO: 164950 - DNA, 13 bp, Homo sapiens
ctgtctattctag

SEQ ID NO: 164951 - DNA, 16 bp, Homo sapiens
ctgtctcaaaaaaaga

SEQ ID NO: 164952 - DNA, 18 bp, Homo sapiens
ctgtctcaaaaaaagaaa

SEQ ID NO: 164953 - DNA, 22 bp, Homo sapiens
ctgtctcaaaaaaagaaaaaga

SEQ ID NO: 164954 - DNA, 14 bp, Homo sapiens
ctgtctcagcctcc

SEQ ID NO: 164955 - DNA, 17 bp, Homo sapiens
ctgtctcagcctcccag

SEQ ID NO: 164956 - DNA, 12 bp, Homo sapiens
ctgtctcatcca

SEQ ID NO: 164957 - DNA, 17 bp, Homo sapiens
ctgtctcatccatcatc

SEQ ID NO: 164958 - DNA, 18 bp, Homo sapiens
ctgtctccatgtttgatg

SEQ ID NO: 164959 - DNA, 14 bp, Homo sapiens
ctgtctgccagcca

SEQ ID NO: 164960 - DNA, 18 bp, Homo sapiens
ctgtcttcacaacagatt

SEQ ID NO: 164961 - DNA, 22 bp, Homo sapiens
ctgtcttcatagcagattttaa

SEQ ID NO: 164962 - DNA, 17 bp, Homo sapiens
ctgtcttctcaggctct

SEQ ID NO: 164963 - DNA, 15 bp, Homo sapiens
ctgtgaagagaacca

SEQ ID NO: 164964 - DNA, 17 bp, Homo sapiens
ctgtgaccaatgtcttg

SEQ ID NO: 164965 - DNA, 22 bp, Homo sapiens
ctgtgacctcaggcactagcct

SEQ ID NO: 164966 - DNA, 23 bp, Homo sapiens
ctgtgacctcaggcactagcctt

SEQ ID NO: 164967 - DNA, 22 bp, Homo sapiens
ctgtgacttcagctctgtttta

SEQ ID NO: 164968 - DNA, 15 bp, Homo sapiens
ctgtgagcaagaagt

SEQ ID NO: 164969 - DNA, 16 bp, Homo sapiens
ctgtgagcccctggtc

SEQ ID NO: 164970 - DNA, 21 bp, Homo sapiens
ctgtgagcccctggtcctgag

SEQ ID NO: 164971 - DNA, 12 bp, Homo sapiens
ctgtgagccttg

SEQ ID NO: 164972 - DNA, 12 bp, Homo sapiens
ctgtgaggctgt

SEQ ID NO: 164973 - DNA, 17 bp, Homo sapiens
ctgtgagtttaaagcaa

SEQ ID NO: 164974 - DNA, 16 bp, Homo sapiens
ctgtgcagccgctgag

SEQ ID NO: 164975 - DNA, 21 bp, Homo sapiens
ctgtgcagccgctgagcgagg

SEQ ID NO: 164976 - DNA, 22 bp, Homo sapiens
ctgtgcctcggcttttctcagc

SEQ ID NO: 164977 - DNA, 23 bp, Homo sapiens
ctgtgcctcggcttttctcagct

SEQ ID NO: 164978 - DNA, 14 bp, Homo sapiens
ctgtgcctctgcct

SEQ ID NO: 164979 - DNA, 17 bp, Homo sapiens
ctgtgctcaggactcag

SEQ ID NO: 164980 - DNA, 18 bp, Homo sapiens
ctgtgctcaggactcaga

SEQ ID NO: 164981 - DNA, 20 bp, Homo sapiens
ctgtgctgcccgtcttcagc

SEQ ID NO: 164982 - DNA, 17 bp, Homo sapiens
ctgtgcttcgggccctt

SEQ ID NO: 164983 - DNA, 21 bp, Homo sapiens
ctgtgcttcgggcccttccca

SEQ ID NO: 164984 - DNA, 14 bp, Homo sapiens
ctgtggagactggg

SEQ ID NO: 164985 - DNA, 15 bp, Homo sapiens
ctgtggatgagccct

SEQ ID NO: 164986 - DNA, 17 bp, Homo sapiens
ctgtggatgagccctca

SEQ ID NO: 164987 - DNA, 20 bp, Homo sapiens
ctgtggatgagccctcagaa

SEQ ID NO: 164988 - DNA, 17 bp, Homo sapiens
ctgtggatgataaaaca

SEQ ID NO: 164989 - DNA, 23 bp, Homo sapiens
ctgtggccagcttgttatttata

SEQ ID NO: 164990 - DNA, 14 bp, Homo sapiens
ctgtggcggtgcct

SEQ ID NO: 164991 - DNA, 17 bp, Homo sapiens
ctgtggctgctagcact

SEQ ID NO: 164992 - DNA, 14 bp, Homo sapiens
ctgtgggatgggat

SEQ ID NO: 164993 - DNA, 22 bp, Homo sapiens
ctgtgggcacgctgtgggcagg

SEQ ID NO: 164994 - DNA, 22 bp, Homo sapiens
ctgtggtgtgtccccctctgtc

SEQ ID NO: 164995 - DNA, 21 bp, Homo sapiens
ctgtgtacagaattctgctac

SEQ ID NO: 164996 - DNA, 19 bp, Homo sapiens
ctgtgtccttgcacctgca

SEQ ID NO: 164997 - DNA, 13 bp, Homo sapiens
ctgtgtgaaaatg

SEQ ID NO: 164998 - DNA, 19 bp, Homo sapiens
ctgtgtgaaataccagtgt

SEQ ID NO: 164999 - DNA, 21 bp, Homo sapiens
ctgtgtgcaccttaccaactt

SEQ ID NO: 165000 - DNA, 17 bp, Homo sapiens
ctgtgtgcagtgaaggt

SEQ ID NO: 165001 - DNA, 14 bp, Homo sapiens
ctgtgttgtctcta

SEQ ID NO: 165002 - DNA, 19 bp, Homo sapiens
ctgtgttgtctctagagca

SEQ ID NO: 165003 - DNA, 22 bp, Homo sapiens
ctgtgttgtctctagagcaggg

SEQ ID NO: 165004 - DNA, 19 bp, Homo sapiens
ctgttaaaagatgaaaata

SEQ ID NO: 165005 - DNA, 14 bp, Homo sapiens
gaggaaaggccagc

SEQ ID NO: 165006 - DNA, 19 bp, Homo sapiens
gaggaaaggccagctggca

SEQ ID NO: 165007 - DNA, 15 bp, Homo sapiens
gaggaactgtccaga

SEQ ID NO: 165008 - DNA, 14 bp, Homo sapiens
gaggaaggagagaa

SEQ ID NO: 165009 - DNA, 16 bp, Homo sapiens
gaggaaggagagaagg

SEQ ID NO: 165010 - DNA, 20 bp, Homo sapiens
gaggaatcatgtcaggcctg

SEQ ID NO: 165011 - DNA, 13 bp, Homo sapiens
gaggaatgtatat

SEQ ID NO: 165012 - DNA, 13 bp, Homo sapiens
gccagcagccagc

SEQ ID NO: 165013 - DNA, 15 bp, Homo sapiens
gccagcagccagctc

SEQ ID NO: 165014 - DNA, 19 bp, Homo sapiens
gccagcagccagctctcag

SEQ ID NO: 165015 - DNA, 22 bp, Homo sapiens
gccagcagccagctctcagcca

SEQ ID NO: 165016 - DNA, 23 bp, Homo sapiens
gccagcagccagctctcagccaa

SEQ ID NO: 165017 - DNA, 13 bp, Homo sapiens
gccagccagcagc

SEQ ID NO: 165018 - DNA, 22 bp, Homo sapiens
gccagccagtgacctgaggaag

SEQ ID NO: 165019 - DNA, 13 bp, Homo sapiens
gccagccctccct

SEQ ID NO: 165020 - DNA, 17 bp, Homo sapiens
gccagccctccctgtcc

SEQ ID NO: 165021 - DNA, 22 bp, Homo sapiens
gccagccctccctgtcctcctc

SEQ ID NO: 165022 - DNA, 19 bp, Homo sapiens
gccagccttcttccatccc

SEQ ID NO: 165023 - DNA, 13 bp, Homo sapiens
gccagcgtcctcc

SEQ ID NO: 165024 - DNA, 15 bp, Homo sapiens
gccagctctgtatca

SEQ ID NO: 165025 - DNA, 14 bp, Homo sapiens
gccagctggcagca

SEQ ID NO: 165026 - DNA, 17 bp, Homo sapiens
gccagctggcagcagag

SEQ ID NO: 165027 - DNA, 22 bp, Homo sapiens
gccaggaccagtcaacctgggc

SEQ ID NO: 165028 - DNA, 16 bp, Homo sapiens
gccaggactgagcccc

SEQ ID NO: 165029 - DNA, 19 bp, Homo sapiens
gccaggcaggtagccaggg

SEQ ID NO: 165030 - DNA, 18 bp, Homo sapiens
gccaggcaggtgcctgga

SEQ ID NO: 165031 - DNA, 18 bp, Homo sapiens
gccaggcccccaagcctg

SEQ ID NO: 165032 - DNA, 23 bp, Homo sapiens
gccaggcccccaagcctgcagtc

SEQ ID NO: 165033 - DNA, 16 bp, Homo sapiens
gccaggcccggggctg

SEQ ID NO: 165034 - DNA, 20 bp, Homo sapiens
gccaggccggcgagccctgt

SEQ ID NO: 165035 - DNA, 15 bp, Homo sapiens
gccaggctccttcct

SEQ ID NO: 165036 - DNA, 20 bp, Homo sapiens
gccaggctccttcctgtctt

SEQ ID NO: 165037 - DNA, 16 bp, Homo sapiens
gccagggcagagtgag

SEQ ID NO: 165038 - DNA, 22 bp, Homo sapiens
gccagggcccctcaccctgcct

SEQ ID NO: 165039 - DNA, 17 bp, Homo sapiens
gccaggggaaaatcagc

SEQ ID NO: 165040 - DNA, 20 bp, Homo sapiens
gccagggggactagcccctg

SEQ ID NO: 165041 - DNA, 19 bp, Homo sapiens
gccagtaacgcgtcttcct

SEQ ID NO: 165042 - DNA, 20 bp, Homo sapiens
gccagtaacgcgtcttcctg

SEQ ID NO: 165043 - DNA, 17 bp, Homo sapiens
gccagtgacctgaggaa

SEQ ID NO: 165044 - DNA, 20 bp, Homo sapiens
gccataaaacattaagaaaa

SEQ ID NO: 165045 - DNA, 21 bp, Homo sapiens
gccataaaacattaagaaaat

SEQ ID NO: 165046 - DNA, 21 bp, Homo sapiens
gccatccctcgtggtccccaa

SEQ ID NO: 165047 - DNA, 15 bp, Homo sapiens
gccatctgtgggcac

SEQ ID NO: 165048 - DNA, 14 bp, Homo sapiens
gccatgctcctggc

SEQ ID NO: 165049 - DNA, 16 bp, Homo sapiens
gccatggaggcacaca

SEQ ID NO: 165050 - DNA, 18 bp, Homo sapiens
gccatggaggcacacagc

SEQ ID NO: 165051 - DNA, 18 bp, Homo sapiens
gccattcactgcccccag

SEQ ID NO: 165052 - DNA, 19 bp, Homo sapiens
gccattgcactccagcctg

SEQ ID NO: 165053 - DNA, 21 bp, Homo sapiens
gccattgcactccagcctggg

SEQ ID NO: 165054 - DNA, 17 bp, Homo sapiens
gcccaaagtctgtgtga

SEQ ID NO: 165055 - DNA, 21 bp, Homo sapiens
gcccaagttgtggtgctgaca

SEQ ID NO: 165056 - DNA, 18 bp, Homo sapiens
gcccaatattataatttt

SEQ ID NO: 165057 - DNA, 13 bp, Homo sapiens
gcccacacacccc

SEQ ID NO: 165058 - DNA, 17 bp, Homo sapiens
gcccacagctcccaccc

SEQ ID NO: 165059 - DNA, 21 bp, Homo sapiens
gcccaccaacatcccattgcc

SEQ ID NO: 165060 - DNA, 15 bp, Homo sapiens
gcccacctccccacg

SEQ ID NO: 165061 - DNA, 17 bp, Homo sapiens
gcccactctgctcgcct

SEQ ID NO: 165062 - DNA, 16 bp, Homo sapiens
gcccagagatgcctcc

SEQ ID NO: 165063 - DNA, 17 bp, Homo sapiens
gcccagagatgcctcca

SEQ ID NO: 165064 - DNA, 19 bp, Homo sapiens
gcccagagatgcctccacc

SEQ ID NO: 165065 - DNA, 21 bp, Homo sapiens
gcccagagatgggactgggag

SEQ ID NO: 165066 - DNA, 15 bp, Homo sapiens
gcccagatcccagaa

SEQ ID NO: 165067 - DNA, 14 bp, Homo sapiens
gcccagcccagctg

SEQ ID NO: 165068 - DNA, 15 bp, Homo sapiens
gcccagcccagctgg

SEQ ID NO: 165069 - DNA, 20 bp, Homo sapiens
gcccagctatacctgtgcct

SEQ ID NO: 165070 - DNA, 15 bp, Homo sapiens
gcccagctcagaggg

SEQ ID NO: 165071 - DNA, 10 bp, Homo sapiens
gcccaggaga

SEQ ID NO: 165072 - DNA, 17 bp, Homo sapiens
gcccaggagagagaaag

SEQ ID NO: 165073 - DNA, 23 bp, Homo sapiens
gcccaggagagagaaagccaggc

SEQ ID NO: 165074 - DNA, 22 bp, Homo sapiens
gcccaggcgggagcggtggccc

SEQ ID NO: 165075 - DNA, 19 bp, Homo sapiens
gcccaggctggagtgcagt

SEQ ID NO: 165076 - DNA, 17 bp, Homo sapiens
gcccagggagcggaaag

SEQ ID NO: 165077 - DNA, 20 bp, Homo sapiens
gcccagggagcggaaagcag

SEQ ID NO: 165078 - DNA, 19 bp, Homo sapiens
gcccagggccactctgcct

SEQ ID NO: 165079 - DNA, 20 bp, Homo sapiens
gcccagggccactctgcctc

SEQ ID NO: 165080 - DNA, 17 bp, Homo sapiens
gcccatcaattatagaa

SEQ ID NO: 165081 - DNA, 19 bp, Homo sapiens
gcccatccctgcctggtca

SEQ ID NO: 165082 - DNA, 20 bp, Homo sapiens
gcccatgtgtgagtgtgtgc

SEQ ID NO: 165083 - DNA, 20 bp, Homo sapiens
gcccattctctctcctgtcc

SEQ ID NO: 165084 - DNA, 16 bp, Homo sapiens
gccccaactcctggaa

SEQ ID NO: 165085 - DNA, 20 bp, Homo sapiens
gccccacctttattaaaatc

SEQ ID NO: 165086 - DNA, 19 bp, Homo sapiens
gccccagcactaaagcagt

SEQ ID NO: 165087 - DNA, 23 bp, Homo sapiens
gccccagcactaaagcagtggac

SEQ ID NO: 165088 - DNA, 16 bp, Homo sapiens
gccccagggctaccct

SEQ ID NO: 165089 - DNA, 21 bp, Homo sapiens
gccccataattttttttttcc

SEQ ID NO: 165090 - DNA, 14 bp, Homo sapiens
gccccatcagtgct

SEQ ID NO: 165091 - DNA, 16 bp, Homo sapiens
gccccatgtctctcag

SEQ ID NO: 165092 - DNA, 18 bp, Homo sapiens
gcccccagctgtgggtac

SEQ ID NO: 165093 - DNA, 19 bp, Homo sapiens
gccccgcagacctccccag

SEQ ID NO: 165094 - DNA, 20 bp, Homo sapiens
gccccgcagacctccccagc

SEQ ID NO: 165095 - DNA, 13 bp, Homo sapiens
gccccggccacct

SEQ ID NO: 165096 - DNA, 18 bp, Homo sapiens
gccccggccacctctgcg

SEQ ID NO: 165097 - DNA, 17 bp, Homo sapiens
gccccgtggggttcctc

SEQ ID NO: 165098 - DNA, 19 bp, Homo sapiens
gcccctagcccaggagaga

SEQ ID NO: 165099 - DNA, 12 bp, Homo sapiens
gcccctcccttc

SEQ ID NO: 165100 - DNA, 15 bp, Homo sapiens
gcccctcctctgcca

SEQ ID NO: 165101 - DNA, 18 bp, Homo sapiens
gcccctcctctgccacct

SEQ ID NO: 165102 - DNA, 13 bp, Homo sapiens
gcccctgcacaaa

SEQ ID NO: 165103 - DNA, 14 bp, Homo sapiens
gcccctgcatcccc

SEQ ID NO: 165104 - DNA, 23 bp, Homo sapiens
gcccctgcatccccttggctgtg

SEQ ID NO: 165105 - DNA, 22 bp, Homo sapiens
gcccctgttacctaattagagc

SEQ ID NO: 165106 - DNA, 17 bp, Homo sapiens
gccccttctcagaatct

SEQ ID NO: 165107 - DNA, 15 bp, Homo sapiens
gcccgacagcctggc

SEQ ID NO: 165108 - DNA, 19 bp, Homo sapiens
gcccgacagcctggcacag

SEQ ID NO: 165109 - DNA, 14 bp, Homo sapiens
gcccggatgcttct

SEQ ID NO: 165110 - DNA, 14 bp, Homo sapiens
gcccgtcttcagcc

SEQ ID NO: 165111 - DNA, 19 bp, Homo sapiens
gccctagagcacactgtag

SEQ ID NO: 165112 - DNA, 21 bp, Homo sapiens
gccctagagcacactgtagca

SEQ ID NO: 165113 - DNA, 17 bp, Homo sapiens
gccctatttttgcaatg

SEQ ID NO: 165114 - DNA, 13 bp, Homo sapiens
gccctcacccctg

SEQ ID NO: 165115 - DNA, 19 bp, Homo sapiens
gccctcacccctgccctgg

SEQ ID NO: 165116 - DNA, 20 bp, Homo sapiens
gccctcacccctgccctggg

SEQ ID NO: 165117 - DNA, 23 bp, Homo sapiens
gccctcagaacccttggcttgcc

SEQ ID NO: 165118 - DNA, 23 bp, Homo sapiens
gccctcaggtcagggtgaggatg

SEQ ID NO: 165119 - DNA, 17 bp, Homo sapiens
gccctccacatccctga

SEQ ID NO: 165120 - DNA, 22 bp, Homo sapiens
gccctcccctcccctgctgcag

SEQ ID NO: 165121 - DNA, 21 bp, Homo sapiens
gccctccctgcccctcccttc

SEQ ID NO: 165122 - DNA, 14 bp, Homo sapiens
gccctccctgtcct

SEQ ID NO: 165123 - DNA, 13 bp, Homo sapiens
gccctcctcaccc

SEQ ID NO: 165124 - DNA, 14 bp, Homo sapiens
gccctcctcacccc

SEQ ID NO: 165125 - DNA, 21 bp, Homo sapiens
gccctcctcaccccgtctggg

SEQ ID NO: 165126 - DNA, 10 bp, Homo sapiens
gccctccttc

SEQ ID NO: 165127 - DNA, 14 bp, Homo sapiens
gccctcgctgccag

SEQ ID NO: 165128 - DNA, 11 bp, Homo sapiens
gccctcttcca

SEQ ID NO: 165129 - DNA, 14 bp, Homo sapiens
gccctcttccatca

SEQ ID NO: 165130 - DNA, 15 bp, Homo sapiens
gccctgagctcggtg

SEQ ID NO: 165131 - DNA, 18 bp, Homo sapiens
gccctgcaaaaggactct

SEQ ID NO: 165132 - DNA, 18 bp, Homo sapiens
gccctgccctagctccac

SEQ ID NO: 165133 - DNA, 23 bp, Homo sapiens
gccctgctttgggctgccctggt

SEQ ID NO: 165134 - DNA, 15 bp, Homo sapiens
gccctggccagaggc

SEQ ID NO: 165135 - DNA, 14 bp, Homo sapiens
gccctggcctgctg

SEQ ID NO: 165136 - DNA, 15 bp, Homo sapiens
gccctggctcccaca

SEQ ID NO: 165137 - DNA, 12 bp, Homo sapiens
gccctggctctg

SEQ ID NO: 165138 - DNA, 14 bp, Homo sapiens
gccctggctctgca

SEQ ID NO: 165139 - DNA, 17 bp, Homo sapiens
gccctggtgctgccaca

SEQ ID NO: 165140 - DNA, 17 bp, Homo sapiens
gccctgtccctcccacc

SEQ ID NO: 165141 - DNA, 19 bp, Homo sapiens
gccctgtccctcccacctc

SEQ ID NO: 165142 - DNA, 11 bp, Homo sapiens
gccctgtctgt

SEQ ID NO: 165143 - DNA, 13 bp, Homo sapiens
gccctgttaaaag

SEQ ID NO: 165144 - DNA, 17 bp, Homo sapiens
gccctgttaaaagatga

SEQ ID NO: 165145 - DNA, 18 bp, Homo sapiens
gcccttatctgtgctcag

SEQ ID NO: 165146 - DNA, 22 bp, Homo sapiens
gcccttccatgtcgcctctgca

SEQ ID NO: 165147 - DNA, 20 bp, Homo sapiens
gccttggctgttggcagtga

SEQ ID NO: 165148 - DNA, 16 bp, Homo sapiens
gccttggtgtccacct

SEQ ID NO: 165149 - DNA, 17 bp, Homo sapiens
gccttggtgtccacctg

SEQ ID NO: 165150 - DNA, 22 bp, Homo sapiens
gccttggtgtccacctggcccc

SEQ ID NO: 165151 - DNA, 12 bp, Homo sapiens
gccttgtgtaca

SEQ ID NO: 165152 - DNA, 23 bp, Homo sapiens
gcctttctcccaggccaggctcc

SEQ ID NO: 165153 - DNA, 20 bp, Homo sapiens
gccttttttcacggaagttt

SEQ ID NO: 165154 - DNA, 12 bp, Homo sapiens
gcgacagtgaga

SEQ ID NO: 165155 - DNA, 22 bp, Homo sapiens
gcgacagtgagactctgtctca

SEQ ID NO: 165156 - DNA, 18 bp, Homo sapiens
gcgacatagcccatccct

SEQ ID NO: 165157 - DNA, 16 bp, Homo sapiens
gcgaggaggctccaga

SEQ ID NO: 165158 - DNA, 17 bp, Homo sapiens
gcgaggaggctccagag

SEQ ID NO: 165159 - DNA, 18 bp, Homo sapiens
gcgaggtcaacagagaag

SEQ ID NO: 165160 - DNA, 19 bp, Homo sapiens
gcgaggtcaacagagaagg

SEQ ID NO: 165161 - DNA, 22 bp, Homo sapiens
gcgaggtcaacagagaaggcag

SEQ ID NO: 165162 - DNA, 20 bp, Homo sapiens
gcgagtgtgtgcatgtgtgt

SEQ ID NO: 165163 - DNA, 21 bp, Homo sapiens
gcgcaagcctgtaatcccagc

SEQ ID NO: 165164 - DNA, 16 bp, Homo sapiens
gcgccactcgcttccc

SEQ ID NO: 165165 - DNA, 16 bp, Homo sapiens
gcgccattgcactcca

SEQ ID NO: 165166 - DNA, 12 bp, Homo sapiens
gcgcccacctcc

SEQ ID NO: 165167 - DNA, 20 bp, Homo sapiens
gcgcctagtggggtctccct

SEQ ID NO: 165168 - DNA, 21 bp, Homo sapiens
gcgcctagtggggtctccctc

SEQ ID NO: 165169 - DNA, 14 bp, Homo sapiens
gcgcgccactcgct

SEQ ID NO: 165170 - DNA, 19 bp, Homo sapiens
gcgctgccgcaccccagag

SEQ ID NO: 165171 - DNA, 21 bp, Homo sapiens
gcgctgccgcaccccagagtg

SEQ ID NO: 165172 - DNA, 16 bp, Homo sapiens
gcggcctttggcttca

SEQ ID NO: 165173 - DNA, 13 bp, Homo sapiens
gcggctactcagc

SEQ ID NO: 165174 - DNA, 20 bp, Homo sapiens
gcggctactcagcagccctc

SEQ ID NO: 165175 - DNA, 22 bp, Homo sapiens
gcggctactcagcagccctcct

SEQ ID NO: 165176 - DNA, 20 bp, Homo sapiens
gcgggaccggtacagaaagg

SEQ ID NO: 165177 - DNA, 22 bp, Homo sapiens
gcggtcccctccgccaggcgag

SEQ ID NO: 165178 - DNA, 16 bp, Homo sapiens
gcgtcctcctctgtga

SEQ ID NO: 165179 - DNA, 11 bp, Homo sapiens
gcgtctcctgt

SEQ ID NO: 165180 - DNA, 20 bp, Homo sapiens
gcgtctcctgtttttctggg

SEQ ID NO: 165181 - DNA, 21 bp, Homo sapiens
gcgtctcctgtttttctgggt

SEQ ID NO: 165182 - DNA, 12 bp, Homo sapiens
gcgtcttcctga

SEQ ID NO: 165183 - DNA, 21 bp, Homo sapiens
gcgtcttcctgagtggtgcca

SEQ ID NO: 165184 - DNA, 15 bp, Homo sapiens
gcgtgaaggccgaga

SEQ ID NO: 165185 - DNA, 18 bp, Homo sapiens
gcgtgaggatgggaagga

SEQ ID NO: 165186 - DNA, 11 bp, Homo sapiens
gcgtgtggctc

SEQ ID NO: 165187 - DNA, 14 bp, Homo sapiens
gcgttgtaaaatat

SEQ ID NO: 165188 - DNA, 16 bp, Homo sapiens
gctaaatgtgaatgat

SEQ ID NO: 165189 - DNA, 18 bp, Homo sapiens
gctaagagctagcgctgc

SEQ ID NO: 165190 - DNA, 20 bp, Homo sapiens
gctaagagctagcgctgccg

SEQ ID NO: 165191 - DNA, 16 bp, Homo sapiens
gctaatcagcattctc

SEQ ID NO: 165192 - DNA, 18 bp, Homo sapiens
gctacaaaaacacagcaa

SEQ ID NO: 165193 - DNA, 19 bp, Homo sapiens
gctacacccttttccagct

SEQ ID NO: 165194 - DNA, 16 bp, Homo sapiens
gctaccctgagctgag

SEQ ID NO: 165195 - DNA, 16 bp, Homo sapiens
gctactcaggaggctg

SEQ ID NO: 165196 - DNA, 18 bp, Homo sapiens
gctactgcagctttacat

SEQ ID NO: 165197 - DNA, 20 bp, Homo sapiens
gctagaagtgggccaggaca

SEQ ID NO: 165198 - DNA, 20 bp, Homo sapiens
gctagaggaaccaaccccca

SEQ ID NO: 165199 - DNA, 21 bp, Homo sapiens
gctagcgctgccgcaccccag

SEQ ID NO: 165200 - DNA, 22 bp, Homo sapiens
gctagcgctgccgcaccccaga

SEQ ID NO: 165201 - DNA, 14 bp, Homo sapiens
gctagtgacttgtg

SEQ ID NO: 165202 - DNA, 20 bp, Homo sapiens
gctataactatgttgataaa

SEQ ID NO: 165203 - DNA, 23 bp, Homo sapiens
gctatacctgggcatactaataa

SEQ ID NO: 165204 - DNA, 19 bp, Homo sapiens
gctatagacccgaggaaac

SEQ ID NO: 165205 - DNA, 23 bp, Homo sapiens
gctatagacccgaggaaactcag

SEQ ID NO: 165206 - DNA, 23 bp, Homo sapiens
gctatctctcagtgaactgtgag

SEQ ID NO: 165207 - DNA, 22 bp, Homo sapiens
gctatgtatggaatacagtgtt

SEQ ID NO: 165208 - DNA, 19 bp, Homo sapiens
gctatgttttgacattttt

SEQ ID NO: 165209 - DNA, 14 bp, Homo sapiens
gctcaaaggcacag

SEQ ID NO: 165210 - DNA, 17 bp, Homo sapiens
gctcaaggaaaggcctg

SEQ ID NO: 165211 - DNA, 16 bp, Homo sapiens
gctcaatcaagaaaat

SEQ ID NO: 165212 - DNA, 16 bp, Homo sapiens
gctcacagttcctcgc

SEQ ID NO: 165213 - DNA, 22 bp, Homo sapiens
gctcacccccttctccatccac

SEQ ID NO: 165214 - DNA, 22 bp, Homo sapiens
gctcacctggggtgtgggaggc

SEQ ID NO: 165215 - DNA, 21 bp, Homo sapiens
gctcacgcctgtaatcccagc

SEQ ID NO: 165216 - DNA, 14 bp, Homo sapiens
gctcacgtcacact

SEQ ID NO: 165217 - DNA, 22 bp, Homo sapiens
gctcacgtgagagtgtcttcac

SEQ ID NO: 165218 - DNA, 15 bp, Homo sapiens
gctcacgtgtgtgac

SEQ ID NO: 165219 - DNA, 17 bp, Homo sapiens
gctcacgtgtgtgactc

SEQ ID NO: 165220 - DNA, 22 bp, Homo sapiens
gctcagcaaaagatgcttctca

SEQ ID NO: 165221 - DNA, 17 bp, Homo sapiens
gctcagccctccctgcc

SEQ ID NO: 165222 - DNA, 21 bp, Homo sapiens
gctcagccctccctgcccctc

SEQ ID NO: 165223 - DNA, 14 bp, Homo sapiens
gctcagcctggtgg

SEQ ID NO: 165224 - DNA, 15 bp, Homo sapiens
gctcagcctggtggg

SEQ ID NO: 165225 - DNA, 19 bp, Homo sapiens
gctcagcctggtgggcctc

SEQ ID NO: 165226 - DNA, 20 bp, Homo sapiens
gctcagcctggtgggcctcc

SEQ ID NO: 165227 - DNA, 15 bp, Homo sapiens
gctcagcgccagcct

SEQ ID NO: 165228 - DNA, 16 bp, Homo sapiens
gctcaggactcagaag

SEQ ID NO: 165229 - DNA, 18 bp, Homo sapiens
gctcaggactcagaagcc

SEQ ID NO: 165230 - DNA, 19 bp, Homo sapiens
gctcaggcgatccacctgt

SEQ ID NO: 165231 - DNA, 16 bp, Homo sapiens
gctcatattcctgcag

SEQ ID NO: 165232 - DNA, 18 bp, Homo sapiens
gctcatcattctctgtct

SEQ ID NO: 165233 - DNA, 19 bp, Homo sapiens
gctcatcattctctgtctc

SEQ ID NO: 165234 - DNA, 15 bp, Homo sapiens
gctcattttttctta

SEQ ID NO: 165235 - DNA, 22 bp, Homo sapiens
gctccacaccctctcccaggac

SEQ ID NO: 165236 - DNA, 23 bp, Homo sapiens
gctccacaccctctcccaggacc

SEQ ID NO: 165237 - DNA, 12 bp, Homo sapiens
gctccactgtca

SEQ ID NO: 165238 - DNA, 11 bp, Homo sapiens
gctccagctgt

SEQ ID NO: 165239 - DNA, 20 bp, Homo sapiens
gctccagctgttcagctggt

SEQ ID NO: 165240 - DNA, 19 bp, Homo sapiens
gctccccactgcctactgc

SEQ ID NO: 165241 - DNA, 15 bp, Homo sapiens
gctccccagccctgg

SEQ ID NO: 165242 - DNA, 20 bp, Homo sapiens
gctccccagccctggctctg

SEQ ID NO: 165243 - DNA, 22 bp, Homo sapiens
gctccccagccctggctctgca

SEQ ID NO: 165244 - DNA, 15 bp, Homo sapiens
gctcccctccctcct

SEQ ID NO: 165245 - DNA, 21 bp, Homo sapiens
gctcccctcggagaagagctg

SEQ ID NO: 165246 - DNA, 15 bp, Homo sapiens
gctccctaccacctc

SEQ ID NO: 165247 - DNA, 16 bp, Homo sapiens
gctccctaccacctcc

SEQ ID NO: 165248 - DNA, 12 bp, Homo sapiens
gctccctgaagc

SEQ ID NO: 165249 - DNA, 24 bp, Homo sapiens
gctccctgaagccagccttcttcc

SEQ ID NO: 165250 - DNA, 13 bp, Homo sapiens
gctccgcctctgc

SEQ ID NO: 165251 - DNA, 15 bp, Homo sapiens
gctcctccagggcca

SEQ ID NO: 165252 - DNA, 23 bp, Homo sapiens
gctcctccagggccacgtgccag

SEQ ID NO: 165253 - DNA, 19 bp, Homo sapiens
gctcctggcccactgcatc

SEQ ID NO: 165254 - DNA, 20 bp, Homo sapiens
gctcctggcccactgcatcg

SEQ ID NO: 165255 - DNA, 23 bp, Homo sapiens
gctcctgggggttctttcttcct

SEQ ID NO: 165256 - DNA, 13 bp, Homo sapiens
gctcctgtcctcc

SEQ ID NO: 165257 - DNA, 22 bp, Homo sapiens
gctcctgtcctcccatcccctg

SEQ ID NO: 165258 - DNA, 19 bp, Homo sapiens
gctccttcctgtcttcctg

SEQ ID NO: 165259 - DNA, 14 bp, Homo sapiens
gctccttgggccct

SEQ ID NO: 165260 - DNA, 19 bp, Homo sapiens
gctccttgggccctttgag

SEQ ID NO: 165261 - DNA, 14 bp, Homo sapiens
gctcgaaaacaatt

SEQ ID NO: 165262 - DNA, 21 bp, Homo sapiens
gctcgagcagtcctgcctcag

SEQ ID NO: 165263 - DNA, 18 bp, Homo sapiens
gctcggtggacccaggga

SEQ ID NO: 165264 - DNA, 10 bp, Homo sapiens
gctctcagcc

SEQ ID NO: 165265 - DNA, 16 bp, Homo sapiens
gctctcagctcagcgc

SEQ ID NO: 165266 - DNA, 20 bp, Homo sapiens
gctctccacctcagccttgg

SEQ ID NO: 165267 - DNA, 14 bp, Homo sapiens
gctctccctctggc

SEQ ID NO: 165268 - DNA, 21 bp, Homo sapiens
gctctccctctggccctgcct

SEQ ID NO: 165269 - DNA, 14 bp, Homo sapiens
gctctctgcagcca

SEQ ID NO: 165270 - DNA, 21 bp, Homo sapiens
gctctgagcaaatgtggctcc

SEQ ID NO: 165271 - DNA, 21 bp, Homo sapiens
gctctgcccatcctgcccctg

SEQ ID NO: 165272 - DNA, 22 bp, Homo sapiens
gctctgcgtgtcacctgtgctt

SEQ ID NO: 165273 - DNA, 14 bp, Homo sapiens
gctctggaagagag

SEQ ID NO: 165274 - DNA, 13 bp, Homo sapiens
gctctggagagaa

SEQ ID NO: 165275 - DNA, 15 bp, Homo sapiens
gctctggagagaaac

SEQ ID NO: 165276 - DNA, 18 bp, Homo sapiens
gctctggtgacaccagcc

SEQ ID NO: 165277 - DNA, 22 bp, Homo sapiens
gctctgtatcaggacccagagg

SEQ ID NO: 165278 - DNA, 23 bp, Homo sapiens
gctctgtatcaggacccagagga

SEQ ID NO: 165279 - DNA, 16 bp, Homo sapiens
gctcttagcagcttcc

SEQ ID NO: 165280 - DNA, 19 bp, Homo sapiens
gctcttagcagcttccaga

SEQ ID NO: 165281 - DNA, 19 bp, Homo sapiens
gctcttcagtgggagaaaa

SEQ ID NO: 165282 - DNA, 21 bp, Homo sapiens
gctctttatgaatgaaaaaac

SEQ ID NO: 165283 - DNA, 18 bp, Homo sapiens
gctctttctctgccagtg

SEQ ID NO: 165284 - DNA, 16 bp, Homo sapiens
gctgaaacaacaaata

SEQ ID NO: 165285 - DNA, 20 bp, Homo sapiens
gctgaaatactgaggggtct

SEQ ID NO: 165286 - DNA, 13 bp, Homo sapiens
gctgaacagtgga

SEQ ID NO: 165287 - DNA, 16 bp, Homo sapiens
gcattgaatatattat

SEQ ID NO: 165288 - DNA, 23 bp, Homo sapiens
gcatttgctgaatacagaggcaa

SEQ ID NO: 165289 - DNA, 18 bp, Homo sapiens
gcattttcaccccaccct

SEQ ID NO: 165290 - DNA, 20 bp, Homo sapiens
gcatttttgatttatgcatg

SEQ ID NO: 165291 - DNA, 15 bp, Homo sapiens
gccaaacagccacac

SEQ ID NO: 165292 - DNA, 16 bp, Homo sapiens
gccaaaggatgtgata

SEQ ID NO: 165293 - DNA, 19 bp, Homo sapiens
gccaaattatttgtgtaat

SEQ ID NO: 165294 - DNA, 23 bp, Homo sapiens
gccaaattatttgtgtaatagaa

SEQ ID NO: 165295 - DNA, 20 bp, Homo sapiens
gccaacagtcaaaacagaga

SEQ ID NO: 165296 - DNA, 22 bp, Homo sapiens
gccaacttgagggcccagagca

SEQ ID NO: 165297 - DNA, 23 bp, Homo sapiens
gccaacttgagggcccagagcag

SEQ ID NO: 165298 - DNA, 20 bp, Homo sapiens
gccaagcacagtgcctgcat

SEQ ID NO: 165299 - DNA, 16 bp, Homo sapiens
gccaagggctttgttt

SEQ ID NO: 165300 - DNA, 23 bp, Homo sapiens
gccaaggtgggaggattgcttga

SEQ ID NO: 165301 - DNA, 16 bp, Homo sapiens
gccaatggagactgtc

SEQ ID NO: 165302 - DNA, 19 bp, Homo sapiens
gccaatggagactgtctca

SEQ ID NO: 165303 - DNA, 23 bp, Homo sapiens
gccacaagaaatttgatttctat

SEQ ID NO: 165304 - DNA, 16 bp, Homo sapiens
gccacagcctcccctg

SEQ ID NO: 165305 - DNA, 12 bp, Homo sapiens
gccaccaactct

SEQ ID NO: 165306 - DNA, 22 bp, Homo sapiens
gccaccaagagggacgcctggg

SEQ ID NO: 165307 - DNA, 22 bp, Homo sapiens
gccaccatgcccagctcagagg

SEQ ID NO: 165308 - DNA, 14 bp, Homo sapiens
gccaccatggccag

SEQ ID NO: 165309 - DNA, 18 bp, Homo sapiens
gccaccatggccagccaa

SEQ ID NO: 165310 - DNA, 20 bp, Homo sapiens
gccacctcccctatccaccc

SEQ ID NO: 165311 - DNA, 22 bp, Homo sapiens
gccacctcccctatccacccag

SEQ ID NO: 165312 - DNA, 11 bp, Homo sapiens
gccacctctgc

SEQ ID NO: 165313 - DNA, 22 bp, Homo sapiens
gccacctctgcggaccccagct

SEQ ID NO: 165314 - DNA, 13 bp, Homo sapiens
gccacggcagcct

SEQ ID NO: 165315 - DNA, 14 bp, Homo sapiens
gccacggcagccta

SEQ ID NO: 165316 - DNA, 14 bp, Homo sapiens
gccacgtgccaggc

SEQ ID NO: 165317 - DNA, 16 bp, Homo sapiens
gccacgtgccaggccc

SEQ ID NO: 165318 - DNA, 18 bp, Homo sapiens
gccacgtgccaggcccgg

SEQ ID NO: 165319 - DNA, 23 bp, Homo sapiens
gccacgtgtttgtgctgtggtgt

SEQ ID NO: 165320 - DNA, 22 bp, Homo sapiens
gccacgttcttactagtttccc

SEQ ID NO: 165321 - DNA, 14 bp, Homo sapiens
gccactcctctgac

SEQ ID NO: 165322 - DNA, 15 bp, Homo sapiens
gccactcctctgact

SEQ ID NO: 165323 - DNA, 18 bp, Homo sapiens
gccactgtgaagagaacc

SEQ ID NO: 165324 - DNA, 12 bp, Homo sapiens
gccagaaataaa

SEQ ID NO: 165325 - DNA, 22 bp, Homo sapiens
gccagaacgtggctctgctggc

SEQ ID NO: 165326 - DNA, 21 bp, Homo sapiens
gccagaagtttgtcaagtcaa

SEQ ID NO: 165327 - DNA, 22 bp, Homo sapiens
gccagacggcacccacccagca

SEQ ID NO: 165328 - DNA, 23 bp, Homo sapiens
gccagacggcacccacccagcac

SEQ ID NO: 165329 - DNA, 14 bp, Homo sapiens
gccagaggaactgt

SEQ ID NO: 165330 - DNA, 20 bp, Homo sapiens
gccagaggaactgtccagag

SEQ ID NO: 165331 - DNA, 22 bp, Homo sapiens
gccagaggaactgtccagagag

SEQ ID NO: 165332 - DNA, 20 bp, Homo sapiens
gccagcagccagctctcagc

SEQ ID NO: 165333 - DNA, 12 bp, Homo sapiens
gccagccagcag

SEQ ID NO: 165334 - DNA, 12 bp, Homo sapiens
ggaaggagagaa

SEQ ID NO: 165335 - DNA, 13 bp, Homo sapiens
ggaaggagggagg

SEQ ID NO: 165336 - DNA, 20 bp, Homo sapiens
ggaaggagggttagggaggg

SEQ ID NO: 165337 - DNA, 18 bp, Homo sapiens
ggaaggggcccgtgggag

SEQ ID NO: 165338 - DNA, 14 bp, Homo sapiens
ggaagtctaggagc

SEQ ID NO: 165339 - DNA, 11 bp, Homo sapiens
ggaagttttca

SEQ ID NO: 165340 - DNA, 18 bp, Homo sapiens
ggaatcatgtcaggcctg

SEQ ID NO: 165341 - DNA, 22 bp, Homo sapiens
ggaatgcggccgcattccctga

SEQ ID NO: 165342 - DNA, 23 bp, Homo sapiens
ggacaaatcaagcttcagtttcc

SEQ ID NO: 165343 - DNA, 17 bp, Homo sapiens
ggacaacgaggaagccc

SEQ ID NO: 165344 - DNA, 19 bp, Homo sapiens
ggacaatcatgaaatatgc

SEQ ID NO: 165345 - DNA, 19 bp, Homo sapiens
ggacaccacacccagcctc

SEQ ID NO: 165346 - DNA, 22 bp, Homo sapiens
ggacaccacacccagcctcagt

SEQ ID NO: 165347 - DNA, 13 bp, Homo sapiens
ggacaccaggagt

SEQ ID NO: 165348 - DNA, 14 bp, Homo sapiens
ggacacctgccctg

SEQ ID NO: 165349 - DNA, 14 bp, Homo sapiens
ggacactccagtgc

SEQ ID NO: 165350 - DNA, 15 bp, Homo sapiens
ggacactccagtgcc

SEQ ID NO: 165351 - DNA, 16 bp, Homo sapiens
ggacactccagtgcca

SEQ ID NO: 165352 - DNA, 21 bp, Homo sapiens
ggacactccagtgccagcaat

SEQ ID NO: 165353 - DNA, 14 bp, Homo sapiens
ggacagagccatgc

SEQ ID NO: 165354 - DNA, 11 bp, Homo sapiens
ggacaggcccg

SEQ ID NO: 165355 - DNA, 14 bp, Homo sapiens
ggacatttctctaa

SEQ ID NO: 165356 - DNA, 14 bp, Homo sapiens
ggaccaggacagga

SEQ ID NO: 165357 - DNA, 14 bp, Homo sapiens
ggaccatcctattt

SEQ ID NO: 165358 - DNA, 18 bp, Homo sapiens
ggaccccagctgtgagcc

SEQ ID NO: 165359 - DNA, 21 bp, Homo sapiens
ggaccccagctgtgagccttg

SEQ ID NO: 165360 - DNA, 23 bp, Homo sapiens
ggacctcaggtgagaagcagagg

SEQ ID NO: 165361 - DNA, 13 bp, Homo sapiens
ggacctcctgagc

SEQ ID NO: 165362 - DNA, 17 bp, Homo sapiens
ggacctggtgctgcctc

SEQ ID NO: 165363 - DNA, 19 bp, Homo sapiens
ggacgcctgggggtgccag

SEQ ID NO: 165364 - DNA, 18 bp, Homo sapiens
ggacgtcctgccacctgg

SEQ ID NO: 165365 - DNA, 14 bp, Homo sapiens
ggactagcccctgt

SEQ ID NO: 165366 - DNA, 14 bp, Homo sapiens
ggactattataatt

SEQ ID NO: 165367 - DNA, 17 bp, Homo sapiens
ggactcagaagcctctg

SEQ ID NO: 165368 - DNA, 17 bp, Homo sapiens
ggactcaggatgcccag

SEQ ID NO: 165369 - DNA, 22 bp, Homo sapiens
ggactcattttaaaaaatggaa

SEQ ID NO: 165370 - DNA, 11 bp, Homo sapiens
ggactccaccc

SEQ ID NO: 165371 - DNA, 20 bp, Homo sapiens
ggactccacccatcctatca

SEQ ID NO: 165372 - DNA, 21 bp, Homo sapiens
ggactctcagtctctgagcag

SEQ ID NO: 165373 - DNA, 15 bp, Homo sapiens
ggactgagccccgca

SEQ ID NO: 165374 - DNA, 20 bp, Homo sapiens
ggacttagaaagcaggggct

SEQ ID NO: 165375 - DNA, 13 bp, Homo sapiens
ggacttgaagttg

SEQ ID NO: 165376 - DNA, 23 bp, Homo sapiens
ggactttcttttcgccgtggctg

SEQ ID NO: 165377 - DNA, 16 bp, Homo sapiens
ggactttgcagccggc

SEQ ID NO: 165378 - DNA, 21 bp, Homo sapiens
ggagaactcctagggtggctg

SEQ ID NO: 165379 - DNA, 22 bp, Homo sapiens
ggagaagaattttcagacccca

SEQ ID NO: 165380 - DNA, 15 bp, Homo sapiens
ggagaagagaggaga

SEQ ID NO: 165381 - DNA, 16 bp, Homo sapiens
ggagaagagaggagag

SEQ ID NO: 165382 - DNA, 14 bp, Homo sapiens
ggagacagccccag

SEQ ID NO: 165383 - DNA, 23 bp, Homo sapiens
ggagacagccccagagcagggtg

SEQ ID NO: 165384 - DNA, 12 bp, Homo sapiens
ggagacagggtt

SEQ ID NO: 165385 - DNA, 13 bp, Homo sapiens
ggagactcacctc

SEQ ID NO: 165386 - DNA, 19 bp, Homo sapiens
ggagactcacctctgcctc

SEQ ID NO: 165387 - DNA, 20 bp, Homo sapiens
ggagactggtcctgtgtgca

SEQ ID NO: 165388 - DNA, 18 bp, Homo sapiens
ggagagaaacaataaaga

SEQ ID NO: 165389 - DNA, 16 bp, Homo sapiens
ggagagaaagtgggtg

SEQ ID NO: 165390 - DNA, 12 bp, Homo sapiens
ggagagagaaag

SEQ ID NO: 165391 - DNA, 14 bp, Homo sapiens
ggagagagaaagcc

SEQ ID NO: 165392 - DNA, 18 bp, Homo sapiens
ggagagagaaagccaggc

SEQ ID NO: 165393 - DNA, 21 bp, Homo sapiens
ggagagagaaagccaggcagg

SEQ ID NO: 165394 - DNA, 14 bp, Homo sapiens
ggagagccagccct

SEQ ID NO: 165395 - DNA, 15 bp, Homo sapiens
ggagagccagccctc

SEQ ID NO: 165396 - DNA, 18 bp, Homo sapiens
ggagagccagccctccct

SEQ ID NO: 165397 - DNA, 23 bp, Homo sapiens
ggagagccagccctccctgtcct

SEQ ID NO: 165398 - DNA, 18 bp, Homo sapiens
ggagagcgcctgcccctc

SEQ ID NO: 165399 - DNA, 21 bp, Homo sapiens
ggagagctagcagcagggagg

SEQ ID NO: 165400 - DNA, 13 bp, Homo sapiens
ggagaggagagag

SEQ ID NO: 165401 - DNA, 14 bp, Homo sapiens
ggagaggagagagg

SEQ ID NO: 165402 - DNA, 18 bp, Homo sapiens
ggagaggagagaggcaga

SEQ ID NO: 165403 - DNA, 15 bp, Homo sapiens
ggagaggggcacagg

SEQ ID NO: 165404 - DNA, 14 bp, Homo sapiens
ggagagggtctgga

SEQ ID NO: 165405 - DNA, 23 bp, Homo sapiens
ggagagggtctggagaagcagtg

SEQ ID NO: 165406 - DNA, 14 bp, Homo sapiens
ggagattgagaagg

SEQ ID NO: 165407 - DNA, 16 bp, Homo sapiens
ggagattgagaaggag

SEQ ID NO: 165408 - DNA, 21 bp, Homo sapiens
ggagattgagaaggagagaaa

SEQ ID NO: 165409 - DNA, 17 bp, Homo sapiens
ggagcaccaggcacgaa

SEQ ID NO: 165410 - DNA, 20 bp, Homo sapiens
ggagcagacaggaggaatca

SEQ ID NO: 165411 - DNA, 22 bp, Homo sapiens
ggagcaggagattgagaaggag

SEQ ID NO: 165412 - DNA, 19 bp, Homo sapiens
ggagccactcctctgactc

SEQ ID NO: 165413 - DNA, 13 bp, Homo sapiens
ggagccccaggcc

SEQ ID NO: 165414 - DNA, 23 bp, Homo sapiens
ggagccccaggcctctgtgtcct

SEQ ID NO: 165415 - DNA, 22 bp, Homo sapiens
ggagcccttatctgtgctcagg

SEQ ID NO: 165416 - DNA, 16 bp, Homo sapiens
ggagctgagtggggga

SEQ ID NO: 165417 - DNA, 21 bp, Homo sapiens
ggaggaaaaccaagccgtggc

SEQ ID NO: 165418 - DNA, 23 bp, Homo sapiens
ggaggatcacttgagtccagaag

SEQ ID NO: 165419 - DNA, 17 bp, Homo sapiens
ggaggatctcttgagcc

SEQ ID NO: 165420 - DNA, 18 bp, Homo sapiens
ggaggcagggccttgccc

SEQ ID NO: 165421 - DNA, 19 bp, Homo sapiens
ggaggcagggccttgccca

SEQ ID NO: 165422 - DNA, 21 bp, Homo sapiens
ggaggcagggccttgcccaga

SEQ ID NO: 165423 - DNA, 16 bp, Homo sapiens
ggaggcatggccctgg

SEQ ID NO: 165424 - DNA, 17 bp, Homo sapiens
ggaggcatggccctggg

SEQ ID NO: 165425 - DNA, 18 bp, Homo sapiens
ggaggccgggtgctcagg

SEQ ID NO: 165426 - DNA, 21 bp, Homo sapiens
ggaggctcacccccttctcca

SEQ ID NO: 165427 - DNA, 14 bp, Homo sapiens
ggaggctgaggcag

SEQ ID NO: 165428 - DNA, 14 bp, Homo sapiens
ggggaagccctgga

SEQ ID NO: 165429 - DNA, 21 bp, Homo sapiens
ggggacgctggtagagatgga

SEQ ID NO: 165430 - DNA, 14 bp, Homo sapiens
ggggatgtgggagg

SEQ ID NO: 165431 - DNA, 13 bp, Homo sapiens
ggggcagaacagc

SEQ ID NO: 165432 - DNA, 22 bp, Homo sapiens
ggggcagagggcagaggctgga

SEQ ID NO: 165433 - DNA, 12 bp, Homo sapiens
ggggccagaggc

SEQ ID NO: 165434 - DNA, 14 bp, Homo sapiens
ggggcgcccacctc

SEQ ID NO: 165435 - DNA, 17 bp, Homo sapiens
ggggctacaagagggaa

SEQ ID NO: 165436 - DNA, 16 bp, Homo sapiens
ggggctctcagctcag

SEQ ID NO: 165437 - DNA, 20 bp, Homo sapiens
ggggctctcagctcagcgcc

SEQ ID NO: 165438 - DNA, 14 bp, Homo sapiens
ggggctctggagag

SEQ ID NO: 165439 - DNA, 18 bp, Homo sapiens
ggggctctggagagaaac

SEQ ID NO: 165440 - DNA, 18 bp, Homo sapiens
ggggctgaacggggagaa

SEQ ID NO: 165441 - DNA, 19 bp, Homo sapiens
ggggctgaggtgggaggat

SEQ ID NO: 165442 - DNA, 14 bp, Homo sapiens
ggggctgctcctcc

SEQ ID NO: 165443 - DNA, 15 bp, Homo sapiens
ggggctgctcctcca

SEQ ID NO: 165444 - DNA, 16 bp, Homo sapiens
gggggactagcccctg

SEQ ID NO: 165445 - DNA, 11 bp, Homo sapiens
gggggcagagg

SEQ ID NO: 165446 - DNA, 20 bp, Homo sapiens
ggggtctccctctcctgcct

SEQ ID NO: 165447 - DNA, 23 bp, Homo sapiens
ggggtctgggaggaatggacaga

SEQ ID NO: 165448 - DNA, 22 bp, Homo sapiens
ggggtctttgtgagagtgagct

SEQ ID NO: 165449 - DNA, 22 bp, Homo sapiens
ggggttcagcccctcctctgcc

SEQ ID NO: 165450 - DNA, 13 bp, Homo sapiens
gggtaaactgtgg

SEQ ID NO: 165451 - DNA, 12 bp, Homo sapiens
gggtaggcggga

SEQ ID NO: 165452 - DNA, 16 bp, Homo sapiens
gggtaggcgggaagga

SEQ ID NO: 165453 - DNA, 19 bp, Homo sapiens
gggtcagacgcctgaggaa

SEQ ID NO: 165454 - DNA, 15 bp, Homo sapiens
gggtcaggccacggc

SEQ ID NO: 165455 - DNA, 17 bp, Homo sapiens
gggtcaggccacggcag

SEQ ID NO: 165456 - DNA, 18 bp, Homo sapiens
gggtctccaggaggagac

SEQ ID NO: 165457 - DNA, 15 bp, Homo sapiens
gggtctccctctcct

SEQ ID NO: 165458 - DNA, 19 bp, Homo sapiens
gggtctccctctcctgcct

SEQ ID NO: 165459 - DNA, 19 bp, Homo sapiens
gggtggcaccagcagcctg

SEQ ID NO: 165460 - DNA, 17 bp, Homo sapiens
gggtgggatggaggaga

SEQ ID NO: 165461 - DNA, 19 bp, Homo sapiens
gggttcagagactcagggc

SEQ ID NO: 165462 - DNA, 16 bp, Homo sapiens
gggttcagcccctcct

SEQ ID NO: 165463 - DNA, 16 bp, Homo sapiens
gggttctcctctcccc

SEQ ID NO: 165464 - DNA, 20 bp, Homo sapiens
gggttttattgtttaaaatc

SEQ ID NO: 165465 - DNA, 18 bp, Homo sapiens
gggttttgtattctctga

SEQ ID NO: 165466 - DNA, 20 bp, Homo sapiens
ggtaaataccaagtatttat

SEQ ID NO: 165467 - DNA, 18 bp, Homo sapiens
ggtaactagggaagataa

SEQ ID NO: 165468 - DNA, 20 bp, Homo sapiens
ggtagccctggccagaggct

SEQ ID NO: 165469 - DNA, 15 bp, Homo sapiens
ggtagctagaggaac

SEQ ID NO: 165470 - DNA, 18 bp, Homo sapiens
ggtagctgcccctggctc

SEQ ID NO: 165471 - DNA, 19 bp, Homo sapiens
ggtatcattttctgcattt

SEQ ID NO: 165472 - DNA, 19 bp, Homo sapiens
ggtcaacatggtgaaaccc

SEQ ID NO: 165473 - DNA, 17 bp, Homo sapiens
ggtcaatcctgtgggtg

SEQ ID NO: 165474 - DNA, 18 bp, Homo sapiens
ggtcacaggactctgcct

SEQ ID NO: 165475 - DNA, 15 bp, Homo sapiens
ggtcactgccatgga

SEQ ID NO: 165476 - DNA, 22 bp, Homo sapiens
ggtcaggaaggatgagcattta

SEQ ID NO: 165477 - DNA, 17 bp, Homo sapiens
ggtccagcttgctcttc

SEQ ID NO: 165478 - DNA, 13 bp, Homo sapiens
ggtccatgggcag

SEQ ID NO: 165479 - DNA, 16 bp, Homo sapiens
ggtccatgggcagagc

SEQ ID NO: 165480 - DNA, 18 bp, Homo sapiens
ggtccatgggcagagccc

SEQ ID NO: 165481 - DNA, 20 bp, Homo sapiens
ggtcccttgagacctcagcc

SEQ ID NO: 165482 - DNA, 13 bp, Homo sapiens
ggtcgaggcagga

SEQ ID NO: 165483 - DNA, 14 bp, Homo sapiens
ggtctagggagaga

SEQ ID NO: 165484 - DNA, 20 bp, Homo sapiens
ggtctcacagtgttgcccag

SEQ ID NO: 165485 - DNA, 14 bp, Homo sapiens
ggtctccctctcct

SEQ ID NO: 165486 - DNA, 14 bp, Homo sapiens
ggtctgcaggcagg

SEQ ID NO: 165487 - DNA, 22 bp, Homo sapiens
ggtctgctctttctctgccagt

SEQ ID NO: 165488 - DNA, 23 bp, Homo sapiens
ggtgaaatttattagttaatata

SEQ ID NO: 165489 - DNA, 16 bp, Homo sapiens
ggtgacaccagccttt

SEQ ID NO: 165490 - DNA, 15 bp, Homo sapiens
ggtgagaagcagagg

SEQ ID NO: 165491 - DNA, 21 bp, Homo sapiens
ggtgagatgctggagaagaga

SEQ ID NO: 165492 - DNA, 18 bp, Homo sapiens
ggtgcctgggtggggctg

SEQ ID NO: 165493 - DNA, 19 bp, Homo sapiens
ggtgcctgggtggggctgc

SEQ ID NO: 165494 - DNA, 22 bp, Homo sapiens
ggtgcctgggtggggctgctcc

SEQ ID NO: 165495 - DNA, 18 bp, Homo sapiens
ggtgcctgtgaggcaggg

SEQ ID NO: 165496 - DNA, 23 bp, Homo sapiens
ggtgccttcttattctcactcca

SEQ ID NO: 165497 - DNA, 16 bp, Homo sapiens
ggtgctcagggctgac

SEQ ID NO: 165498 - DNA, 17 bp, Homo sapiens
ggtgctgcctctacctg

SEQ ID NO: 165499 - DNA, 21 bp, Homo sapiens
ggtgctggaggtgggagcagg

SEQ ID NO: 165500 - DNA, 22 bp, Homo sapiens
ggtgctggaggtgggagcagga

SEQ ID NO: 165501 - DNA, 19 bp, Homo sapiens
ggtggaagccctccttcca

SEQ ID NO: 165502 - DNA, 19 bp, Homo sapiens
ggtggacttagaaagcagg

SEQ ID NO: 165503 - DNA, 23 bp, Homo sapiens
ggtggacttagaaagcaggggct

SEQ ID NO: 165504 - DNA, 15 bp, Homo sapiens
ggtggatcacagagg

SEQ ID NO: 165505 - DNA, 22 bp, Homo sapiens
ggtggccactccagacccctgg

SEQ ID NO: 165506 - DNA, 19 bp, Homo sapiens
ggtggcccgacagcctggc

SEQ ID NO: 165507 - DNA, 20 bp, Homo sapiens
ggtggcccgacagcctggca

SEQ ID NO: 165508 - DNA, 13 bp, Homo sapiens
ggtggccctgtcc

SEQ ID NO: 165509 - DNA, 12 bp, Homo sapiens
ggtggcctcggg

SEQ ID NO: 165510 - DNA, 13 bp, Homo sapiens
ggtggctgaccca

SEQ ID NO: 165511 - DNA, 18 bp, Homo sapiens
ggtggctgacccagtccc

SEQ ID NO: 165512 - DNA, 22 bp, Homo sapiens
ggtggctgacccagtccctggg

SEQ ID NO: 165513 - DNA, 17 bp, Homo sapiens
ggtggggctgctcctcc

SEQ ID NO: 165514 - DNA, 10 bp, Homo sapiens
ggtgggtcca

SEQ ID NO: 165515 - DNA, 17 bp, Homo sapiens
ggtgggttttcttccca

SEQ ID NO: 165516 - DNA, 16 bp, Homo sapiens
ggtgtgaccactgcag

SEQ ID NO: 165517 - DNA, 18 bp, Homo sapiens
ggtgtgatcgtctgactg

SEQ ID NO: 165518 - DNA, 16 bp, Homo sapiens
ggtgtgcaccagggtt

SEQ ID NO: 165519 - DNA, 21 bp, Homo sapiens
ggtgttgccaaatatgtcctg

SEQ ID NO: 165520 - DNA, 11 bp, Homo sapiens
ggttaaaactg

SEQ ID NO: 165521 - DNA, 17 bp, Homo sapiens
ggttaatctttcctgat

SEQ ID NO: 165522 - DNA, 13 bp, Homo sapiens
ggttcaccagcct

SEQ ID NO: 165523 - DNA, 22 bp, Homo sapiens
ggttcacgcctgtaatcccagc

SEQ ID NO: 165524 - DNA, 14 bp, Homo sapiens
ggttcagcccctcc

SEQ ID NO: 165525 - DNA, 21 bp, Homo sapiens
ggttcagcccctcctctgcca

SEQ ID NO: 165526 - DNA, 21 bp, Homo sapiens
ggttccggaatcctgtcctca

SEQ ID NO: 165527 - DNA, 18 bp, Homo sapiens
ggttctcaggtgttgcca

SEQ ID NO: 165528 - DNA, 14 bp, Homo sapiens
ggttctttcttcct

SEQ ID NO: 165529 - DNA, 16 bp, Homo sapiens
ggttctttcttcctct

SEQ ID NO: 165530 - DNA, 17 bp, Homo sapiens
ggttctttcttcctctg

SEQ ID NO: 165531 - DNA, 15 bp, Homo sapiens
ggttgaccccagagg

SEQ ID NO: 165532 - DNA, 16 bp, Homo sapiens
ggttgcaaggccgctg

SEQ ID NO: 165533 - DNA, 18 bp, Homo sapiens
ggttggcaaaaaggcagg

SEQ ID NO: 165534 - DNA, 17 bp, Homo sapiens
ggtttacaatttacaaa

SEQ ID NO: 165535 - DNA, 15 bp, Homo sapiens
ggttttatattttta

SEQ ID NO: 165536 - DNA, 18 bp, Homo sapiens
ggttttgtattctctgag

SEQ ID NO: 165537 - DNA, 14 bp, Homo sapiens
gtaaaaataaaatt

SEQ ID NO: 165538 - DNA, 15 bp, Homo sapiens
gtaaaaccacagcag

SEQ ID NO: 165539 - DNA, 16 bp, Homo sapiens
gtaaaaccacagcagt

SEQ ID NO: 165540 - DNA, 13 bp, Homo sapiens
gtaaaactgaggc

SEQ ID NO: 165541 - DNA, 21 bp, Homo sapiens
gtaaaatatagctgtacaaat

SEQ ID NO: 165542 - DNA, 17 bp, Homo sapiens
gtaaacagtgcctgctg

SEQ ID NO: 165543 - DNA, 22 bp, Homo sapiens
gtaaacagtgcctgctgaatga

SEQ ID NO: 165544 - DNA, 24 bp, Homo sapiens
gtaaactgtgcaccaagcaggaaa

SEQ ID NO: 165545 - DNA, 16 bp, Homo sapiens
gtaaactgtggatgat

SEQ ID NO: 165546 - DNA, 20 bp, Homo sapiens
gtaaagctaaaatgatttta

SEQ ID NO: 165547 - DNA, 21 bp, Homo sapiens
gtaaagtatgtaaacaggaga

SEQ ID NO: 165548 - DNA, 18 bp, Homo sapiens
gtaaagtgataatttctg

SEQ ID NO: 165549 - DNA, 17 bp, Homo sapiens
gtaacccaactctcctg

SEQ ID NO: 165550 - DNA, 17 bp, Homo sapiens
gtaactccaccaaccca

SEQ ID NO: 165551 - DNA, 19 bp, Homo sapiens
gtaactgttaaattgctgt

SEQ ID NO: 165552 - DNA, 13 bp, Homo sapiens
gtaactgttcttg

SEQ ID NO: 165553 - DNA, 22 bp, Homo sapiens
gtaagaaaatattttgtctaaa

SEQ ID NO: 165554 - DNA, 20 bp, Homo sapiens
gtaagaaacacactgaggca

SEQ ID NO: 165555 - DNA, 19 bp, Homo sapiens
gtaataatgctaaagaaaa

SEQ ID NO: 165556 - DNA, 16 bp, Homo sapiens
gtaatattgacttgta

SEQ ID NO: 165557 - DNA, 12 bp, Homo sapiens
gtaatcccagca

SEQ ID NO: 165558 - DNA, 21 bp, Homo sapiens
gtaatcccagctactcaggag

SEQ ID NO: 165559 - DNA, 23 bp, Homo sapiens
gtaatcctagcactttgggaggc

SEQ ID NO: 165560 - DNA, 22 bp, Homo sapiens
gtaatctatgaattctaagtga

SEQ ID NO: 165561 - DNA, 22 bp, Homo sapiens
gtaatgtcaccaccttcccagc

SEQ ID NO: 165562 - DNA, 15 bp, Homo sapiens
gtaattagtaacatg

SEQ ID NO: 165563 - DNA, 23 bp, Homo sapiens
gtaattagtaacatgtgttaagt

SEQ ID NO: 165564 - DNA, 14 bp, Homo sapiens
gtaattcaagaaaa

SEQ ID NO: 165565 - DNA, 12 bp, Homo sapiens
gtaattctaaat

SEQ ID NO: 165566 - DNA, 15 bp, Homo sapiens
gtaattctaaatgaa

SEQ ID NO: 165567 - DNA, 18 bp, Homo sapiens
gtaattctaaatgaatgt

SEQ ID NO: 165568 - DNA, 22 bp, Homo sapiens
gtaattctaaatgaatgtttac

SEQ ID NO: 165569 - DNA, 22 bp, Homo sapiens
gtaattgcttacatttttacaa

SEQ ID NO: 165570 - DNA, 15 bp, Homo sapiens
gctcccccaccccct

SEQ ID NO: 165571 - DNA, 14 bp, Homo sapiens
gctccctgaagcca

SEQ ID NO: 165572 - DNA, 17 bp, Homo sapiens
gctccctgaagccagcc

SEQ ID NO: 165573 - DNA, 20 bp, Homo sapiens
gctccctgaagccagccttc

SEQ ID NO: 165574 - DNA, 16 bp, Homo sapiens
gctccctgactgggag

SEQ ID NO: 165575 - DNA, 18 bp, Homo sapiens
gctccctgactgggagtt

SEQ ID NO: 165576 - DNA, 15 bp, Homo sapiens
gctcccttgtgcgtg

SEQ ID NO: 165577 - DNA, 17 bp, Homo sapiens
gctccgcctctgctggc

SEQ ID NO: 165578 - DNA, 14 bp, Homo sapiens
gctcctcccggtgc

SEQ ID NO: 165579 - DNA, 19 bp, Homo sapiens
gctcctcccggtgcccaag

SEQ ID NO: 165580 - DNA, 15 bp, Homo sapiens
gctcctggcccactg

SEQ ID NO: 165581 - DNA, 15 bp, Homo sapiens
gctcctgtcctccca

SEQ ID NO: 165582 - DNA, 14 bp, Homo sapiens
gctcctgtctgcca

SEQ ID NO: 165583 - DNA, 17 bp, Homo sapiens
gctcctgtctgccagcc

SEQ ID NO: 165584 - DNA, 18 bp, Homo sapiens
gctcctgtctgccagcca

SEQ ID NO: 165585 - DNA, 19 bp, Homo sapiens
gctcctgtctgccagccag

SEQ ID NO: 165586 - DNA, 13 bp, Homo sapiens
gctccttgggagg

SEQ ID NO: 165587 - DNA, 12 bp, Homo sapiens
gctcggtggacc

SEQ ID NO: 165588 - DNA, 20 bp, Homo sapiens
gctctacagctaatcagcat

SEQ ID NO: 165589 - DNA, 22 bp, Homo sapiens
gctctacagctaatcagcattc

SEQ ID NO: 165590 - DNA, 19 bp, Homo sapiens
gctctacccagggcctgca

SEQ ID NO: 165591 - DNA, 11 bp, Homo sapiens
gctctcagcca

SEQ ID NO: 165592 - DNA, 14 bp, Homo sapiens
gctctccacctcag

SEQ ID NO: 165593 - DNA, 21 bp, Homo sapiens
gctctccacctcagccttgga

SEQ ID NO: 165594 - DNA, 11 bp, Homo sapiens
gctctccctct

SEQ ID NO: 165595 - DNA, 16 bp, Homo sapiens
gctctcctttctttct

SEQ ID NO: 165596 - DNA, 13 bp, Homo sapiens
gctctctgcagcc

SEQ ID NO: 165597 - DNA, 15 bp, Homo sapiens
gctctctgcagccag

SEQ ID NO: 165598 - DNA, 20 bp, Homo sapiens
gctctctgcagccagcccag

SEQ ID NO: 165599 - DNA, 16 bp, Homo sapiens
gctctgaaaccagtgt

SEQ ID NO: 165600 - DNA, 21 bp, Homo sapiens
gctctgaccgaaacagcgctg

SEQ ID NO: 165601 - DNA, 13 bp, Homo sapiens
gctctgatccctc

SEQ ID NO: 165602 - DNA, 23 bp, Homo sapiens
gctctgatccctctacagagctt

SEQ ID NO: 165603 - DNA, 23 bp, Homo sapiens
gctctgcaagaattgaagcagga

SEQ ID NO: 165604 - DNA, 15 bp, Homo sapiens
gctctgccctgccct

SEQ ID NO: 165605 - DNA, 21 bp, Homo sapiens
gctctgggatagctgacccag

SEQ ID NO: 165606 - DNA, 17 bp, Homo sapiens
gctcttctcctttcaca

SEQ ID NO: 165607 - DNA, 21 bp, Homo sapiens
gctcttctgccggccctgggg

SEQ ID NO: 165608 - DNA, 15 bp, Homo sapiens
gctctttctctgcca

SEQ ID NO: 165609 - DNA, 17 bp, Homo sapiens
gctctttctctgccagt

SEQ ID NO: 165610 - DNA, 12 bp, Homo sapiens
gctgaaatactg

SEQ ID NO: 165611 - DNA, 22 bp, Homo sapiens
gctgaacagtggaggaagaggg

SEQ ID NO: 165612 - DNA, 17 bp, Homo sapiens
gctgaacggggagaaaa

SEQ ID NO: 165613 - DNA, 22 bp, Homo sapiens
gctgacccagccccttgagaaa

SEQ ID NO: 165614 - DNA, 13 bp, Homo sapiens
gctgacccagtcc

SEQ ID NO: 165615 - DNA, 15 bp, Homo sapiens
gctgacccagtccct

SEQ ID NO: 165616 - DNA, 16 bp, Homo sapiens
gctgacccagtccctg

SEQ ID NO: 165617 - DNA, 16 bp, Homo sapiens
gctgacctccacagct

SEQ ID NO: 165618 - DNA, 18 bp, Homo sapiens
gctgactgatgttgaggg

SEQ ID NO: 165619 - DNA, 20 bp, Homo sapiens
gctgactgatgttgagggaa

SEQ ID NO: 165620 - DNA, 22 bp, Homo sapiens
gctgagagacccaaggaggaaa

SEQ ID NO: 165621 - DNA, 22 bp, Homo sapiens
gctgagaggcagacttccctga

SEQ ID NO: 165622 - DNA, 23 bp, Homo sapiens
gctgagcgaggagatgctccttg

SEQ ID NO: 165623 - DNA, 16 bp, Homo sapiens
gctgaggcagaagaat

SEQ ID NO: 165624 - DNA, 13 bp, Homo sapiens
gctgaggcctgga

SEQ ID NO: 165625 - DNA, 16 bp, Homo sapiens
gctgagggaccagcca

SEQ ID NO: 165626 - DNA, 18 bp, Homo sapiens
gctgagggtgagtgggtg

SEQ ID NO: 165627 - DNA, 23 bp, Homo sapiens
gctgagggtgagtgggtgaataa

SEQ ID NO: 165628 - DNA, 22 bp, Homo sapiens
gctgagtcatgatctccctgcc

SEQ ID NO: 165629 - DNA, 23 bp, Homo sapiens
gctgagtcatgatctccctgccg

SEQ ID NO: 165630 - DNA, 22 bp, Homo sapiens
gctgagtgggggatcacagcct

SEQ ID NO: 165631 - DNA, 21 bp, Homo sapiens
gctgattaaaccaaggctaga

SEQ ID NO: 165632 - DNA, 20 bp, Homo sapiens
gctgcaagtgacatctcttt

SEQ ID NO: 165633 - DNA, 16 bp, Homo sapiens
gctgcaccctcaggca

SEQ ID NO: 165634 - DNA, 19 bp, Homo sapiens
gctgcaccctcaggcaggt

SEQ ID NO: 165635 - DNA, 13 bp, Homo sapiens
gctgcaggggctc

SEQ ID NO: 165636 - DNA, 15 bp, Homo sapiens
gctgcaggggctctg

SEQ ID NO: 165637 - DNA, 15 bp, Homo sapiens
gctgccacacttcag

SEQ ID NO: 165638 - DNA, 21 bp, Homo sapiens
gctgcccgtcttcagcctagc

SEQ ID NO: 165639 - DNA, 22 bp, Homo sapiens
gctgccctggtgctgccacact

SEQ ID NO: 165640 - DNA, 15 bp, Homo sapiens
gctgccgcaccccag

SEQ ID NO: 165641 - DNA, 13 bp, Homo sapiens
gctgccgcctccc

SEQ ID NO: 165642 - DNA, 19 bp, Homo sapiens
gctgccgcctcccagcctg

SEQ ID NO: 165643 - DNA, 17 bp, Homo sapiens
gctgcctaagtggctgc

SEQ ID NO: 165644 - DNA, 21 bp, Homo sapiens
gctgcctggcccccagctgtg

SEQ ID NO: 165645 - DNA, 12 bp, Homo sapiens
gctgcctgtagt

SEQ ID NO: 165646 - DNA, 20 bp, Homo sapiens
gctgcctgtagttaggaaat

SEQ ID NO: 165647 - DNA, 15 bp, Homo sapiens
gctgccttagaacct

SEQ ID NO: 165648 - DNA, 20 bp, Homo sapiens
gctgccttagaacctttctt

SEQ ID NO: 165649 - DNA, 18 bp, Homo sapiens
gctgctaatcttcagggc

SEQ ID NO: 165650 - DNA, 20 bp, Homo sapiens
gctgctaatcttcagggcac

SEQ ID NO: 165651 - DNA, 19 bp, Homo sapiens
gctgctagcacttggagcc

SEQ ID NO: 165652 - DNA, 23 bp, Homo sapiens
gctgctagcacttggagccaagg

SEQ ID NO: 165653 - DNA, 12 bp, Homo sapiens
gctgctcctcca

SEQ ID NO: 165654 - DNA, 23 bp, Homo sapiens
gctgctcctccagggccacgtgc

SEQ ID NO: 165655 - DNA, 13 bp, Homo sapiens
gctgctgaaacaa

SEQ ID NO: 165656 - DNA, 19 bp, Homo sapiens
gctgctgacctccacagct

SEQ ID NO: 165657 - DNA, 12 bp, Homo sapiens
gctgcttttcct

SEQ ID NO: 165658 - DNA, 22 bp, Homo sapiens
gctgcttttccttggggcaggc

SEQ ID NO: 165659 - DNA, 23 bp, Homo sapiens
gctgcttttccttggggcaggca

SEQ ID NO: 165660 - DNA, 13 bp, Homo sapiens
gctggaagggtca

SEQ ID NO: 165661 - DNA, 22 bp, Homo sapiens
gctggactctcagtctctgagc

SEQ ID NO: 165662 - DNA, 18 bp, Homo sapiens
gtgagatgctggagaaga

SEQ ID NO: 165663 - DNA, 19 bp, Homo sapiens
gtgagatgctggagaagag

SEQ ID NO: 165664 - DNA, 22 bp, Homo sapiens
gtgagatgctggagaagagagg

SEQ ID NO: 165665 - DNA, 22 bp, Homo sapiens
gtgagcattgtggctgtcagca

SEQ ID NO: 165666 - DNA, 17 bp, Homo sapiens
gtgagcccctggtcctg

SEQ ID NO: 165667 - DNA, 12 bp, Homo sapiens
gtgagccgcatc

SEQ ID NO: 165668 - DNA, 21 bp, Homo sapiens
gtgagccgcatcttctccatc

SEQ ID NO: 165669 - DNA, 14 bp, Homo sapiens
gtgagccttggctg

SEQ ID NO: 165670 - DNA, 22 bp, Homo sapiens
gtgaggatgtcactcagatgga

SEQ ID NO: 165671 - DNA, 12 bp, Homo sapiens
gtgaggcagggg

SEQ ID NO: 165672 - DNA, 17 bp, Homo sapiens
gtgaggcaggggcggag

SEQ ID NO: 165673 - DNA, 19 bp, Homo sapiens
gtgaggtgcagagtgccca

SEQ ID NO: 165674 - DNA, 21 bp, Homo sapiens
gtgaggtgcagagtgcccaga

SEQ ID NO: 165675 - DNA, 23 bp, Homo sapiens
gtgatatataagtgtacatatgt

SEQ ID NO: 165676 - DNA, 14 bp, Homo sapiens
gtgatccttttatg

SEQ ID NO: 165677 - DNA, 13 bp, Homo sapiens
gtgatgcctccct

SEQ ID NO: 165678 - DNA, 23 bp, Homo sapiens
gtgatggttcccctgttcactct

SEQ ID NO: 165679 - DNA, 16 bp, Homo sapiens
gtgattaccagggact

SEQ ID NO: 165680 - DNA, 21 bp, Homo sapiens
gtgattcctttgaagaggaaa

SEQ ID NO: 165681 - DNA, 21 bp, Homo sapiens
gtgatttagaactgtatgtca

SEQ ID NO: 165682 - DNA, 12 bp, Homo sapiens
gtgattttcatt

SEQ ID NO: 165683 - DNA, 22 bp, Homo sapiens
gtgcaagtgtgtgcacatgtgt

SEQ ID NO: 165684 - DNA, 20 bp, Homo sapiens
gtgcaagtgtgtgcatgtgt

SEQ ID NO: 165685 - DNA, 16 bp, Homo sapiens
gtgcaccatccctttt

SEQ ID NO: 165686 - DNA, 16 bp, Homo sapiens
gtgcagagtgcccaga

SEQ ID NO: 165687 - DNA, 23 bp, Homo sapiens
gtgcagctcaaggaaaggcctga

SEQ ID NO: 165688 - DNA, 19 bp, Homo sapiens
gtgcataagttaacttcca

SEQ ID NO: 165689 - DNA, 18 bp, Homo sapiens
gtgcatgcagcatctaag

SEQ ID NO: 165690 - DNA, 21 bp, Homo sapiens
gtgcatgctctctgcagccag

SEQ ID NO: 165691 - DNA, 16 bp, Homo sapiens
gtgccaagcacagtgc

SEQ ID NO: 165692 - DNA, 13 bp, Homo sapiens
gtgccaggaccag

SEQ ID NO: 165693 - DNA, 13 bp, Homo sapiens
gtgccaggcccgg

SEQ ID NO: 165694 - DNA, 23 bp, Homo sapiens
gtgcccaagttgtggtgctgaca

SEQ ID NO: 165695 - DNA, 23 bp, Homo sapiens
gtgcccaccaacatcccattgcc

SEQ ID NO: 165696 - DNA, 23 bp, Homo sapiens
gtgcccagctatacctgtgcctc

SEQ ID NO: 165697 - DNA, 12 bp, Homo sapiens
gtgcccccagac

SEQ ID NO: 165698 - DNA, 13 bp, Homo sapiens
gtgccccccttgc

SEQ ID NO: 165699 - DNA, 16 bp, Homo sapiens
gtgccccgcctccccg

SEQ ID NO: 165700 - DNA, 17 bp, Homo sapiens
gtgccccgcctccccga

SEQ ID NO: 165701 - DNA, 15 bp, Homo sapiens
gtgccgttactctcc

SEQ ID NO: 165702 - DNA, 18 bp, Homo sapiens
gtgccgttactctccaac

SEQ ID NO: 165703 - DNA, 21 bp, Homo sapiens
gtgccgttactctccaacctg

SEQ ID NO: 165704 - DNA, 22 bp, Homo sapiens
gtgcctcggcttttctcagctg

SEQ ID NO: 165705 - DNA, 12 bp, Homo sapiens
gtgcctctggga

SEQ ID NO: 165706 - DNA, 15 bp, Homo sapiens
gtgcctctgggactg

SEQ ID NO: 165707 - DNA, 22 bp, Homo sapiens
gtgcctggacatttgccttgct

SEQ ID NO: 165708 - DNA, 17 bp, Homo sapiens
gtgcctgggtggggctg

SEQ ID NO: 165709 - DNA, 18 bp, Homo sapiens
gtgcctgggtggggctgc

SEQ ID NO: 165710 - DNA, 17 bp, Homo sapiens
gtgcctgtgaggcaggg

SEQ ID NO: 165711 - DNA, 21 bp, Homo sapiens
tccatttcatctatttctgag

SEQ ID NO: 165712 - DNA, 22 bp, Homo sapiens
tcccaaagccttgtgtctacag

SEQ ID NO: 165713 - DNA, 16 bp, Homo sapiens
tcccaaaggactccac

SEQ ID NO: 165714 - DNA, 22 bp, Homo sapiens
tcccaaaggactccacccatcc

SEQ ID NO: 165715 - DNA, 18 bp, Homo sapiens
tcccaaggctctgagcaa

SEQ ID NO: 165716 - DNA, 21 bp, Homo sapiens
tcccacaggacatttctctaa

SEQ ID NO: 165717 - DNA, 13 bp, Homo sapiens
tcccaccccaccc

SEQ ID NO: 165718 - DNA, 16 bp, Homo sapiens
tcccaccccaccccct

SEQ ID NO: 165719 - DNA, 22 bp, Homo sapiens
tcccaccccacccccttcagtg

SEQ ID NO: 165720 - DNA, 15 bp, Homo sapiens
tcccacgaatttgct

SEQ ID NO: 165721 - DNA, 18 bp, Homo sapiens
tcccacgaatttgctggg

SEQ ID NO: 165722 - DNA, 21 bp, Homo sapiens
tcccacgaatttgctggggaa

SEQ ID NO: 165723 - DNA, 17 bp, Homo sapiens
tcccactcaagccaagc

SEQ ID NO: 165724 - DNA, 15 bp, Homo sapiens
tcccacttgcccctg

SEQ ID NO: 165725 - DNA, 20 bp, Homo sapiens
tcccagaacacactccatca

SEQ ID NO: 165726 - DNA, 18 bp, Homo sapiens
tcccagaaggacctcctg

SEQ ID NO: 165727 - DNA, 16 bp, Homo sapiens
tcccagagacaggaaa

SEQ ID NO: 165728 - DNA, 15 bp, Homo sapiens
tcccagagtgctggg

SEQ ID NO: 165729 - DNA, 16 bp, Homo sapiens
tcccagcactttggga

SEQ ID NO: 165730 - DNA, 10 bp, Homo sapiens
tcccagcctg

SEQ ID NO: 165731 - DNA, 14 bp, Homo sapiens
tcccagctctccct

SEQ ID NO: 165732 - DNA, 22 bp, Homo sapiens
tcccagctctccctctggccct

SEQ ID NO: 165733 - DNA, 21 bp, Homo sapiens
tcccaggccaggctccttcct

SEQ ID NO: 165734 - DNA, 18 bp, Homo sapiens
tcccagggaagtgctctg

SEQ ID NO: 165735 - DNA, 14 bp, Homo sapiens
tcccagtcatttaa

SEQ ID NO: 165736 - DNA, 15 bp, Homo sapiens
tcccagtgaattctt

SEQ ID NO: 165737 - DNA, 19 bp, Homo sapiens
tcccagtgccgagaaggaa

SEQ ID NO: 165738 - DNA, 22 bp, Homo sapiens
tcccagtgccgagaaggaagcc

SEQ ID NO: 165739 - DNA, 15 bp, Homo sapiens
tcccataagctatag

SEQ ID NO: 165740 - DNA, 14 bp, Homo sapiens
tcccatcaaaactc

SEQ ID NO: 165741 - DNA, 15 bp, Homo sapiens
tcccatgatccctgt

SEQ ID NO: 165742 - DNA, 14 bp, Homo sapiens
tcccatggacactc

SEQ ID NO: 165743 - DNA, 24 bp, Homo sapiens
tcccatttctaaaggcctcttcct

SEQ ID NO: 165744 - DNA, 16 bp, Homo sapiens
tccccaaacctgcaag

SEQ ID NO: 165745 - DNA, 17 bp, Homo sapiens
tccccaagaaagcctca

SEQ ID NO: 165746 - DNA, 15 bp, Homo sapiens
tccccaccaccccag

SEQ ID NO: 165747 - DNA, 13 bp, Homo sapiens
tccccacctggga

SEQ ID NO: 165748 - DNA, 20 bp, Homo sapiens
tccccaccttcttcagccac

SEQ ID NO: 165749 - DNA, 23 bp, Homo sapiens
tccccagcctttgatcaggtggg

SEQ ID NO: 165750 - DNA, 21 bp, Homo sapiens
tccccaggccgtggctgccca

SEQ ID NO: 165751 - DNA, 19 bp, Homo sapiens
tccccaggtggctgaccca

SEQ ID NO: 165752 - DNA, 20 bp, Homo sapiens
tccccaggtggctgacccag

SEQ ID NO: 165753 - DNA, 19 bp, Homo sapiens
tcccccaccccctccccag

SEQ ID NO: 165754 - DNA, 20 bp, Homo sapiens
tcccccaccccctccccagg

SEQ ID NO: 165755 - DNA, 12 bp, Homo sapiens
tcccccagcctc

SEQ ID NO: 165756 - DNA, 18 bp, Homo sapiens
tccccccactgcaggccc

SEQ ID NO: 165757 - DNA, 16 bp, Homo sapiens
tcccccccctgtatag

SEQ ID NO: 165758 - DNA, 15 bp, Homo sapiens
tccccctctgtccag

SEQ ID NO: 165759 - DNA, 16 bp, Homo sapiens
tccccctgccagtgcc

SEQ ID NO: 165760 - DNA, 24 bp, Homo sapiens
tccccgaaacaggctactctcctc

SEQ ID NO: 165761 - DNA, 15 bp, Homo sapiens
tcccctatccaccca

SEQ ID NO: 165762 - DNA, 16 bp, Homo sapiens
tcccctatccacccag

SEQ ID NO: 165763 - DNA, 23 bp, Homo sapiens
taaatgtgcattcttttaaaaga

SEQ ID NO: 165764 - DNA, 16 bp, Homo sapiens
taaatgtgccttcatt

SEQ ID NO: 165765 - DNA, 17 bp, Homo sapiens
taaattataacttaaaa

SEQ ID NO: 165766 - DNA, 22 bp, Homo sapiens
taaattataacttaaaatattt

SEQ ID NO: 165767 - DNA, 20 bp, Homo sapiens
taaattgacacttaaaaatg

SEQ ID NO: 165768 - DNA, 23 bp, Homo sapiens
taaattgacacttaaaaatggtt

SEQ ID NO: 165769 - DNA, 15 bp, Homo sapiens
taaatttatttcaaa

SEQ ID NO: 165770 - DNA, 19 bp, Homo sapiens
taaattttgagttctacat

SEQ ID NO: 165771 - DNA, 20 bp, Homo sapiens
taaattttgtctttaactca

SEQ ID NO: 165772 - DNA, 20 bp, Homo sapiens
taacaaaaaaatatatttaa

SEQ ID NO: 165773 - DNA, 23 bp, Homo sapiens
taacaaaaaaatatatttaatga

SEQ ID NO: 165774 - DNA, 16 bp, Homo sapiens
taacaactatgatttg

SEQ ID NO: 165775 - DNA, 21 bp, Homo sapiens
taacaactatgatttggaaaa

SEQ ID NO: 165776 - DNA, 14 bp, Homo sapiens
taacaagaaactca

SEQ ID NO: 165777 - DNA, 14 bp, Homo sapiens
taacaattcctcta

SEQ ID NO: 165778 - DNA, 18 bp, Homo sapiens
taacacaagtcctgtgaa

SEQ ID NO: 165779 - DNA, 15 bp, Homo sapiens
taacactttacaatg

SEQ ID NO: 165780 - DNA, 16 bp, Homo sapiens
taacaggattagacag

SEQ ID NO: 165781 - DNA, 13 bp, Homo sapiens
taacaggtctcct

SEQ ID NO: 165782 - DNA, 15 bp, Homo sapiens
taacaggtctcctct

SEQ ID NO: 165783 - DNA, 19 bp, Homo sapiens
taacaggtctcctcttaaa

SEQ ID NO: 165784 - DNA, 13 bp, Homo sapiens
taacagtcattta

SEQ ID NO: 165785 - DNA, 15 bp, Homo sapiens
taacagtcatttaaa

SEQ ID NO: 165786 - DNA, 21 bp, Homo sapiens
taacagtcctaactggtatag

SEQ ID NO: 165787 - DNA, 19 bp, Homo sapiens
taacataatttgtacatat

SEQ ID NO: 165788 - DNA, 23 bp, Homo sapiens
taacatataatgttgttatttaa

SEQ ID NO: 165789 - DNA, 13 bp, Homo sapiens
taacatatttact

SEQ ID NO: 165790 - DNA, 20 bp, Homo sapiens
taacatctaaaaatagactt

SEQ ID NO: 165791 - DNA, 18 bp, Homo sapiens
taacatggacatgatctt

SEQ ID NO: 165792 - DNA, 24 bp, Homo sapiens
taaccacatcaatattgtcattcc

SEQ ID NO: 165793 - DNA, 22 bp, Homo sapiens
taacctatatgatttatagttt

SEQ ID NO: 165794 - DNA, 14 bp, Homo sapiens
taacctcatcttct

SEQ ID NO: 165795 - DNA, 22 bp, Homo sapiens
taacgttagaccacaaatagtg

SEQ ID NO: 165796 - DNA, 21 bp, Homo sapiens
taactactccggagacagggt

SEQ ID NO: 165797 - DNA, 23 bp, Homo sapiens
taactatagtccagctttgttct

SEQ ID NO: 165798 - DNA, 15 bp, Homo sapiens
taactcatcataaaa

SEQ ID NO: 165799 - DNA, 11 bp, Homo sapiens
taactccacca

SEQ ID NO: 165800 - DNA, 22 bp, Homo sapiens
taactccaccaacccatcagaa

SEQ ID NO: 165801 - DNA, 20 bp, Homo sapiens
taactgcaattttaattgat

SEQ ID NO: 165802 - DNA, 13 bp, Homo sapiens
taactggtataga

SEQ ID NO: 165803 - DNA, 13 bp, Homo sapiens
taactgtgaagtt

SEQ ID NO: 165804 - DNA, 17 bp, Homo sapiens
taactgtgaagtttaca

SEQ ID NO: 165805 - DNA, 21 bp, Homo sapiens
taacttccttggactcatttt

SEQ ID NO: 165806 - DNA, 21 bp, Homo sapiens
taagaaaatattttgtctaaa

SEQ ID NO: 165807 - DNA, 15 bp, Homo sapiens
taagaataaaatgtt

SEQ ID NO: 165808 - DNA, 20 bp, Homo sapiens
taagaataaaatgttgaaaa

SEQ ID NO: 165809 - DNA, 14 bp, Homo sapiens
taagaatctttaga

SEQ ID NO: 165810 - DNA, 17 bp, Homo sapiens
taagaatggttgcctta

SEQ ID NO: 165811 - DNA, 20 bp, Homo sapiens
taagacactgaaaaatctaa

SEQ ID NO: 165812 - DNA, 23 bp, Homo sapiens
taagacactgaaaaatctaagtg

SEQ ID NO: 165813 - DNA, 20 bp, Homo sapiens
taagacggatttatttttcc

SEQ ID NO: 165814 - DNA, 16 bp, Homo sapiens
taagagctagcgctgc

SEQ ID NO: 165815 - DNA, 18 bp, Homo sapiens
taagatatttttcatgat

SEQ ID NO: 165816 - DNA, 18 bp, Homo sapiens
taagatggaagcttccag

SEQ ID NO: 165817 - DNA, 18 bp, Homo sapiens
taagatgggcagctagtt

SEQ ID NO: 165818 - DNA, 13 bp, Homo sapiens
taagattagaatg

SEQ ID NO: 165819 - DNA, 15 bp, Homo sapiens
taagattagaatgaa

SEQ ID NO: 165820 - DNA, 21 bp, Homo sapiens
taagattccagagagtggctc

SEQ ID NO: 165821 - DNA, 23 bp, Homo sapiens
taagcaaagggagcactgggttg

SEQ ID NO: 165822 - DNA, 16 bp, Homo sapiens
taagcactacataaac

SEQ ID NO: 165823 - DNA, 22 bp, Homo sapiens
taagcagatggaatgctgtgtt

SEQ ID NO: 165824 - DNA, 16 bp, Homo sapiens
taagccacaagaaatt

SEQ ID NO: 165825 - DNA, 14 bp, Homo sapiens
taagctgaaaatat

SEQ ID NO: 165826 - DNA, 11 bp, Homo sapiens
taagctgtttc

SEQ ID NO: 165827 - DNA, 18 bp, Homo sapiens
taaggacaaaaatgaact

SEQ ID NO: 165828 - DNA, 16 bp, Homo sapiens
taaggccgaagaaggg

SEQ ID NO: 165829 - DNA, 20 bp, Homo sapiens
taaggccgaagaagggtcct

SEQ ID NO: 165830 - DNA, 14 bp, Homo sapiens
taagggaaatagaa

SEQ ID NO: 165831 - DNA, 20 bp, Homo sapiens
taagggttagtttacaatca

SEQ ID NO: 165832 - DNA, 21 bp, Homo sapiens
taaggtacctttcacatagag

SEQ ID NO: 165833 - DNA, 13 bp, Homo sapiens
taagtaaatgcta

SEQ ID NO: 165834 - DNA, 20 bp, Homo sapiens
taagtatgtgtaaaatgtga

SEQ ID NO: 165835 - DNA, 17 bp, Homo sapiens
taagtatttatatattt

SEQ ID NO: 165836 - DNA, 18 bp, Homo sapiens
taagtatttatatattta

SEQ ID NO: 165837 - DNA, 13 bp, Homo sapiens
taagtatttcaaa

SEQ ID NO: 165838 - DNA, 15 bp, Homo sapiens
taagtcaacctgcct

SEQ ID NO: 165839 - DNA, 17 bp, Homo sapiens
taagtcaacctgcctga

SEQ ID NO: 165840 - DNA, 21 bp, Homo sapiens
taagtcatgttccttcaagat

SEQ ID NO: 165841 - DNA, 18 bp, Homo sapiens
taagtgtacatatgtgct

SEQ ID NO: 165842 - DNA, 14 bp, Homo sapiens
taataaaaaggcac

SEQ ID NO: 165843 - DNA, 21 bp, Homo sapiens
taataactgtgaagtttacat

SEQ ID NO: 165844 - DNA, 20 bp, Homo sapiens
taatacactaattcctttct

SEQ ID NO: 165845 - DNA, 16 bp, Homo sapiens
taataccacagctttt

SEQ ID NO: 165846 - DNA, 18 bp, Homo sapiens
taatagaaaactgaaaat

SEQ ID NO: 165847 - DNA, 22 bp, Homo sapiens
taatagcgggttactttcacat

SEQ ID NO: 165848 - DNA, 22 bp, Homo sapiens
taatatatttttatatttagtt

SEQ ID NO: 165849 - DNA, 10 bp, Homo sapiens
taatatgcat

SEQ ID NO: 165850 - DNA, 16 bp, Homo sapiens
taatatggcaaaaatg

SEQ ID NO: 165851 - DNA, 20 bp, Homo sapiens
taatattaaggaagacaatg

SEQ ID NO: 165852 - DNA, 14 bp, Homo sapiens
tacttgacctccta

SEQ ID NO: 165853 - DNA, 16 bp, Homo sapiens
tagaaaactgaaaatc

SEQ ID NO: 165854 - DNA, 23 bp, Homo sapiens
tagaaaatttgttattttgcaac

SEQ ID NO: 165855 - DNA, 14 bp, Homo sapiens
tagaaacataaata

SEQ ID NO: 165856 - DNA, 23 bp, Homo sapiens
tagaaagaagcccaatattataa

SEQ ID NO: 165857 - DNA, 22 bp, Homo sapiens
tagaaagccaaatcaaaatatg

SEQ ID NO: 165858 - DNA, 15 bp, Homo sapiens
tagaaataatatgca

SEQ ID NO: 165859 - DNA, 16 bp, Homo sapiens
tagaaataatatgcat

SEQ ID NO: 165860 - DNA, 14 bp, Homo sapiens
tagaaatatgattt

SEQ ID NO: 165861 - DNA, 17 bp, Homo sapiens
tagaacagataatcagt

SEQ ID NO: 165862 - DNA, 12 bp, Homo sapiens
tagaaccaggca

SEQ ID NO: 165863 - DNA, 16 bp, Homo sapiens
tagaacttgaccccct

SEQ ID NO: 165864 - DNA, 22 bp, Homo sapiens
tagaacttggatgtacctgccc

SEQ ID NO: 165865 - DNA, 20 bp, Homo sapiens
tagaagactctaccagactg

SEQ ID NO: 165866 - DNA, 21 bp, Homo sapiens
tagaagactctaccagactgt

SEQ ID NO: 165867 - DNA, 18 bp, Homo sapiens
tagaagtggaccaggaca

SEQ ID NO: 165868 - DNA, 16 bp, Homo sapiens
tagaagtgggccagga

SEQ ID NO: 165869 - DNA, 19 bp, Homo sapiens
tagaagtgggccaggacag

SEQ ID NO: 165870 - DNA, 21 bp, Homo sapiens
tagaattccctctctctgact

SEQ ID NO: 165871 - DNA, 23 bp, Homo sapiens
tagaatttattcaattcctctgg

SEQ ID NO: 165872 - DNA, 19 bp, Homo sapiens
tagacatttgtaaatgtaa

SEQ ID NO: 165873 - DNA, 22 bp, Homo sapiens
tagaccacaaatagtgctcgct

SEQ ID NO: 165874 - DNA, 11 bp, Homo sapiens
tagacctcagc

SEQ ID NO: 165875 - DNA, 20 bp, Homo sapiens
tagacctcagcctgtgctgc

SEQ ID NO: 165876 - DNA, 19 bp, Homo sapiens
tagacttctgctttccaca

SEQ ID NO: 165877 - DNA, 12 bp, Homo sapiens
tagactttctgt

SEQ ID NO: 165878 - DNA, 13 bp, Homo sapiens
tagagaaggaccc

SEQ ID NO: 165879 - DNA, 23 bp, Homo sapiens
tagagatcatcctttccagcatg

SEQ ID NO: 165880 - DNA, 14 bp, Homo sapiens
tagagatggaggag

SEQ ID NO: 165881 - DNA, 19 bp, Homo sapiens
tagagatggaggaggaggc

SEQ ID NO: 165882 - DNA, 18 bp, Homo sapiens
tagagattacctcctgag

SEQ ID NO: 165883 - DNA, 22 bp, Homo sapiens
tagagcaaaattgatgtgttta

SEQ ID NO: 165884 - DNA, 20 bp, Homo sapiens
tagagcacctagtccagtga

SEQ ID NO: 165885 - DNA, 19 bp, Homo sapiens
tagagcagatgacccctcc

SEQ ID NO: 165886 - DNA, 23 bp, Homo sapiens
tagagcagggattaacctctgca

SEQ ID NO: 165887 - DNA, 20 bp, Homo sapiens
tagagctgtattaagccact

SEQ ID NO: 165888 - DNA, 15 bp, Homo sapiens
tagaggccagcctgg

SEQ ID NO: 165889 - DNA, 16 bp, Homo sapiens
tagaggccagcctggc

SEQ ID NO: 165890 - DNA, 23 bp, Homo sapiens
tagaggtaccagcaatatgtaaa

SEQ ID NO: 165891 - DNA, 16 bp, Homo sapiens
tagaggtgagggaagc

SEQ ID NO: 165892 - DNA, 14 bp, Homo sapiens
tagagtatatgcac

SEQ ID NO: 165893 - DNA, 19 bp, Homo sapiens
tagagtccaacgtggggca

SEQ ID NO: 165894 - DNA, 17 bp, Homo sapiens
tagagtctgaacagctg

SEQ ID NO: 165895 - DNA, 12 bp, Homo sapiens
tagagtttaaca

SEQ ID NO: 165896 - DNA, 15 bp, Homo sapiens
tagatcccccagact

SEQ ID NO: 165897 - DNA, 14 bp, Homo sapiens
tagatggtgaaatt

SEQ ID NO: 165898 - DNA, 20 bp, Homo sapiens
tagattagatcttttaagcc

SEQ ID NO: 165899 - DNA, 22 bp, Homo sapiens
tagattttagaccctattgctg

SEQ ID NO: 165900 - DNA, 12 bp, Homo sapiens
tagcaaatacat

SEQ ID NO: 165901 - DNA, 20 bp, Homo sapiens
tagcaagattgcttaaaata

SEQ ID NO: 165902 - DNA, 15 bp, Homo sapiens
tagcagcttccagat

SEQ ID NO: 165903 - DNA, 16 bp, Homo sapiens
tagcattttgctaaat

SEQ ID NO: 165904 - DNA, 14 bp, Homo sapiens
tagcccaggagaga

SEQ ID NO: 165905 - DNA, 22 bp, Homo sapiens
tagcccaggagagagaaagcca

SEQ ID NO: 165906 - DNA, 15 bp, Homo sapiens
tagcccatccctgcc

SEQ ID NO: 165907 - DNA, 17 bp, Homo sapiens
tagcccatccctgcctg

SEQ ID NO: 165908 - DNA, 13 bp, Homo sapiens
tagccccataatt

SEQ ID NO: 165909 - DNA, 18 bp, Homo sapiens
tagcccccaggctgctgg

SEQ ID NO: 165910 - DNA, 14 bp, Homo sapiens
tagccgacctcagc

SEQ ID NO: 165911 - DNA, 15 bp, Homo sapiens
tagccgacctcagcc

SEQ ID NO: 165912 - DNA, 16 bp, Homo sapiens
tagccgacctcagcct

SEQ ID NO: 165913 - DNA, 19 bp, Homo sapiens
tagccgggcatggtggcgc

SEQ ID NO: 165914 - DNA, 18 bp, Homo sapiens
tagcctgtgcctctggga

SEQ ID NO: 165915 - DNA, 20 bp, Homo sapiens
tagcctgtgcctctgggact

SEQ ID NO: 165916 - DNA, 18 bp, Homo sapiens
tagcctttggctctggag

SEQ ID NO: 165917 - DNA, 21 bp, Homo sapiens
tagcgctgccgcaccccagag

SEQ ID NO: 165918 - DNA, 19 bp, Homo sapiens
tagctagaaatatgatttt

SEQ ID NO: 165919 - DNA, 20 bp, Homo sapiens
tagctagaagtgggccagga

SEQ ID NO: 165920 - DNA, 13 bp, Homo sapiens
tagctattactgt

SEQ ID NO: 165921 - DNA, 14 bp, Homo sapiens
tagctattactgtc

SEQ ID NO: 165922 - DNA, 17 bp, Homo sapiens
tccttgtggtttatgtc

SEQ ID NO: 165923 - DNA, 19 bp, Homo sapiens
tccttgtggtttatgtcat

SEQ ID NO: 165924 - DNA, 22 bp, Homo sapiens
tccttgtggtttatgtcatcat

SEQ ID NO: 165925 - DNA, 17 bp, Homo sapiens
tcctttaaatccttcca

SEQ ID NO: 165926 - DNA, 16 bp, Homo sapiens
tcctttatatttagtg

SEQ ID NO: 165927 - DNA, 16 bp, Homo sapiens
tcctttcacaaccttc

SEQ ID NO: 165928 - DNA, 19 bp, Homo sapiens
tcctttcacaaccttctgt

SEQ ID NO: 165929 - DNA, 20 bp, Homo sapiens
tcctttcacaaccttctgtg

SEQ ID NO: 165930 - DNA, 17 bp, Homo sapiens
tcctttcaccccagggc

SEQ ID NO: 165931 - DNA, 18 bp, Homo sapiens
tcctttcaccccagggcc

SEQ ID NO: 165932 - DNA, 21 bp, Homo sapiens
tcctttcaccccagggcctga

SEQ ID NO: 165933 - DNA, 18 bp, Homo sapiens
tcctttccccagcccagg

SEQ ID NO: 165934 - DNA, 15 bp, Homo sapiens
tcctttctattgaaa

SEQ ID NO: 165935 - DNA, 14 bp, Homo sapiens
tcctttgaagagga

SEQ ID NO: 165936 - DNA, 23 bp, Homo sapiens
tcctttgtttttttttcctgtcc

SEQ ID NO: 165937 - DNA, 12 bp, Homo sapiens
tccttttatgtt

SEQ ID NO: 165938 - DNA, 23 bp, Homo sapiens
tcgaagcgcgccactcgcttccc

SEQ ID NO: 165939 - DNA, 21 bp, Homo sapiens
tcgaattaatagcttttattg

SEQ ID NO: 165940 - DNA, 19 bp, Homo sapiens
tcgaccccaaagccccttg

SEQ ID NO: 165941 - DNA, 17 bp, Homo sapiens
tcgagcagtcctgcctc

SEQ ID NO: 165942 - DNA, 14 bp, Homo sapiens
tcgaggggctctca

SEQ ID NO: 165943 - DNA, 23 bp, Homo sapiens
tcgatgggggagtctgaagcaga

SEQ ID NO: 165944 - DNA, 13 bp, Homo sapiens
tcgattttgtatc

SEQ ID NO: 165945 - DNA, 20 bp, Homo sapiens
tcgcctgacaaccactggtc

SEQ ID NO: 165946 - DNA, 20 bp, Homo sapiens
tcgctgccagctctgtatca

SEQ ID NO: 165947 - DNA, 23 bp, Homo sapiens
tcgctggactctcagtctctgag

SEQ ID NO: 165948 - DNA, 16 bp, Homo sapiens
tcgcttcatgtaacta

SEQ ID NO: 165949 - DNA, 14 bp, Homo sapiens
tcgcttcccccata

SEQ ID NO: 165950 - DNA, 16 bp, Homo sapiens
tcgcttcccccatagc

SEQ ID NO: 165951 - DNA, 12 bp, Homo sapiens
tcggagaagagc

SEQ ID NO: 165952 - DNA, 23 bp, Homo sapiens
tcggagcctcatccgaggcaggg

SEQ ID NO: 165953 - DNA, 16 bp, Homo sapiens
tcggggaactcctgga

SEQ ID NO: 165954 - DNA, 23 bp, Homo sapiens
tcgtcctccccctgccagtgcct

SEQ ID NO: 165955 - DNA, 18 bp, Homo sapiens
tcgtctgtttataaacat

SEQ ID NO: 165956 - DNA, 20 bp, Homo sapiens
tcgtgccgttactctccaac

SEQ ID NO: 165957 - DNA, 20 bp, Homo sapiens
tcgtggcagataatcagcct

SEQ ID NO: 165958 - DNA, 23 bp, Homo sapiens
tcgtggcagataatcagcctctt

SEQ ID NO: 165959 - DNA, 19 bp, Homo sapiens
tcgtggccttccccagcct

SEQ ID NO: 165960 - DNA, 20 bp, Homo sapiens
tcgtggccttccccagcctc

SEQ ID NO: 165961 - DNA, 15 bp, Homo sapiens
tcgtttactatgcct

SEQ ID NO: 165962 - DNA, 17 bp, Homo sapiens
tcgtttgaatcacagta

SEQ ID NO: 165963 - DNA, 22 bp, Homo sapiens
tctaaaatgcctcagtgtattt

SEQ ID NO: 165964 - DNA, 14 bp, Homo sapiens
tctaaactgcatta

SEQ ID NO: 165965 - DNA, 21 bp, Homo sapiens
tctaaactggattcacagctc

SEQ ID NO: 165966 - DNA, 13 bp, Homo sapiens
tctaaatttgaat

SEQ ID NO: 165967 - DNA, 19 bp, Homo sapiens
tctaacaaaaaaatatatt

SEQ ID NO: 165968 - DNA, 23 bp, Homo sapiens
tctaacaagtcataggttaatat

SEQ ID NO: 165969 - DNA, 13 bp, Homo sapiens
tctaacctcatct

SEQ ID NO: 165970 - DNA, 18 bp, Homo sapiens
tctaacctcatcttcttc

SEQ ID NO: 165971 - DNA, 20 bp, Homo sapiens
tctaagagaacaatgtgcta

SEQ ID NO: 165972 - DNA, 19 bp, Homo sapiens
tctaaggatgtcacagggc

SEQ ID NO: 165973 - DNA, 20 bp, Homo sapiens
tctaaggatgtcacagggcc

SEQ ID NO: 165974 - DNA, 23 bp, Homo sapiens
tctaaggatgtcacagggccaac

SEQ ID NO: 165975 - DNA, 14 bp, Homo sapiens
tctaagtaaaacca

SEQ ID NO: 165976 - DNA, 15 bp, Homo sapiens
tctaagtaaaaccac

SEQ ID NO: 165977 - DNA, 21 bp, Homo sapiens
tctaagtaaaaccacagcagt

SEQ ID NO: 165978 - DNA, 13 bp, Homo sapiens
tctaagtctttcc

SEQ ID NO: 165979 - DNA, 19 bp, Homo sapiens
tctaatagaactcagtttt

SEQ ID NO: 165980 - DNA, 15 bp, Homo sapiens
tctaatatattttta

SEQ ID NO: 165981 - DNA, 20 bp, Homo sapiens
tctaatatggcaaaaatggc

SEQ ID NO: 165982 - DNA, 17 bp, Homo sapiens
tctaatattaaaaatat

SEQ ID NO: 165983 - DNA, 23 bp, Homo sapiens
tctaatttatcttgtctctgggc

SEQ ID NO: 165984 - DNA, 18 bp, Homo sapiens
tctacaaaatcctgatga

SEQ ID NO: 165985 - DNA, 16 bp, Homo sapiens
tctacagagcttccct

SEQ ID NO: 165986 - DNA, 23 bp, Homo sapiens
tctacagctaatcagcattctca

SEQ ID NO: 165987 - DNA, 16 bp, Homo sapiens
tctacatattctttaa

SEQ ID NO: 165988 - DNA, 17 bp, Homo sapiens
tctaccagactgtgtat

SEQ ID NO: 165989 - DNA, 21 bp, Homo sapiens
tctaccagactgtgtattcat

SEQ ID NO: 165990 - DNA, 16 bp, Homo sapiens
tctacccagggcctgc

SEQ ID NO: 165991 - DNA, 12 bp, Homo sapiens
tctactaaaaat

SEQ ID NO: 165992 - DNA, 15 bp, Homo sapiens
tctactaaaaataca

SEQ ID NO: 165993 - DNA, 13 bp, Homo sapiens
tctgctttccaca

SEQ ID NO: 165994 - DNA, 21 bp, Homo sapiens
tctgctttgactgagcagact

SEQ ID NO: 165995 - DNA, 16 bp, Homo sapiens
tctggaatgtaatcaa

SEQ ID NO: 165996 - DNA, 16 bp, Homo sapiens
tctggagaagcagtga

SEQ ID NO: 165997 - DNA, 17 bp, Homo sapiens
tctggagacagccccag

SEQ ID NO: 165998 - DNA, 18 bp, Homo sapiens
tctggagacagccccaga

SEQ ID NO: 165999 - DNA, 15 bp, Homo sapiens
tctggagagaaacaa

SEQ ID NO: 166000 - DNA, 14 bp, Homo sapiens
tctggatctgggac

SEQ ID NO: 166001 - DNA, 14 bp, Homo sapiens
tctggccctgcctt

SEQ ID NO: 166002 - DNA, 18 bp, Homo sapiens
tctggctgaacactggca

SEQ ID NO: 166003 - DNA, 21 bp, Homo sapiens
tctggctggctaactggaagc

SEQ ID NO: 166004 - DNA, 16 bp, Homo sapiens
tctgggaccctttcct

SEQ ID NO: 166005 - DNA, 23 bp, Homo sapiens
tctgggaggaatggacagacaga

SEQ ID NO: 166006 - DNA, 13 bp, Homo sapiens
tctgggagggcag

SEQ ID NO: 166007 - DNA, 19 bp, Homo sapiens
tctgggagggcagcagggc

SEQ ID NO: 166008 - DNA, 21 bp, Homo sapiens
tctgggagggcagcagggcta

SEQ ID NO: 166009 - DNA, 18 bp, Homo sapiens
tctgggccaagtcaaaga

SEQ ID NO: 166010 - DNA, 21 bp, Homo sapiens
tctggtaatattgacttgtat

SEQ ID NO: 166011 - DNA, 18 bp, Homo sapiens
tctgtaaactcaaaactt

SEQ ID NO: 166012 - DNA, 20 bp, Homo sapiens
tctgtagggtaattagtaac

SEQ ID NO: 166013 - DNA, 13 bp, Homo sapiens
tctgtcacttaat

SEQ ID NO: 166014 - DNA, 21 bp, Homo sapiens
tctgtcagcgcaggtttagtt

SEQ ID NO: 166015 - DNA, 24 bp, Homo sapiens
tctgtccaggcactgctgcccagc

SEQ ID NO: 166016 - DNA, 17 bp, Homo sapiens
tctgtccagggccctga

SEQ ID NO: 166017 - DNA, 15 bp, Homo sapiens
tctgtccctcacagc

SEQ ID NO: 166018 - DNA, 19 bp, Homo sapiens
tctgtcccttctgtccctc

SEQ ID NO: 166019 - DNA, 19 bp, Homo sapiens
tctgtccgagctttgaaaa

SEQ ID NO: 166020 - DNA, 20 bp, Homo sapiens
tctgtccgtttactccaagg

SEQ ID NO: 166021 - DNA, 21 bp, Homo sapiens
tctgtctcaaaaaataaaaat

SEQ ID NO: 166022 - DNA, 13 bp, Homo sapiens
tctgtctcatcca

SEQ ID NO: 166023 - DNA, 20 bp, Homo sapiens
tctgtgaaatgctggcattt

SEQ ID NO: 166024 - DNA, 21 bp, Homo sapiens
tctgtgaacgatttagaaaga

SEQ ID NO: 166025 - DNA, 13 bp, Homo sapiens
tctgtgacctcag

SEQ ID NO: 166026 - DNA, 14 bp, Homo sapiens
tctgtgacctcagg

SEQ ID NO: 166027 - DNA, 16 bp, Homo sapiens
tctgtgacctcaggca

SEQ ID NO: 166028 - DNA, 23 bp, Homo sapiens
tctgtgacctcaggcactagcct

SEQ ID NO: 166029 - DNA, 18 bp, Homo sapiens
tctgtgtgatgaactttc

SEQ ID NO: 166030 - DNA, 14 bp, Homo sapiens
tctgtttttctttt

SEQ ID NO: 166031 - DNA, 18 bp, Homo sapiens
tcttaaaaagtggaaaaa

SEQ ID NO: 166032 - DNA, 23 bp, Homo sapiens
tcttaaaagttgtgattccagat

SEQ ID NO: 166033 - DNA, 23 bp, Homo sapiens
tcttaaggattgtgatattttta

SEQ ID NO: 166034 - DNA, 15 bp, Homo sapiens
tcttaatataactgc

SEQ ID NO: 166035 - DNA, 14 bp, Homo sapiens
tcttaattaaaaga

SEQ ID NO: 166036 - DNA, 18 bp, Homo sapiens
tcttaattaaaagaatat

SEQ ID NO: 166037 - DNA, 17 bp, Homo sapiens
tcttacaggcacaaaat

SEQ ID NO: 166038 - DNA, 18 bp, Homo sapiens
tcttacgatggcacccag

SEQ ID NO: 166039 - DNA, 15 bp, Homo sapiens
tcttactgcaaatgt

SEQ ID NO: 166040 - DNA, 20 bp, Homo sapiens
tcttagacttctgctttcca

SEQ ID NO: 166041 - DNA, 16 bp, Homo sapiens
tcttagcagcttccag

SEQ ID NO: 166042 - DNA, 19 bp, Homo sapiens
tcttaggaagagaaaccag

SEQ ID NO: 166043 - DNA, 22 bp, Homo sapiens
tcttatccaacatcaacatctt

SEQ ID NO: 166044 - DNA, 22 bp, Homo sapiens
tcttattagaacaggcaagtga

SEQ ID NO: 166045 - DNA, 16 bp, Homo sapiens
tcttcaactgaccagc

SEQ ID NO: 166046 - DNA, 17 bp, Homo sapiens
tcttcaccatttggcaa

SEQ ID NO: 166047 - DNA, 14 bp, Homo sapiens
tcttcacggcagga

SEQ ID NO: 166048 - DNA, 14 bp, Homo sapiens
tcttcagaggccct

SEQ ID NO: 166049 - DNA, 15 bp, Homo sapiens
tcttcagaggccctc

SEQ ID NO: 166050 - DNA, 16 bp, Homo sapiens
tcttcagccacctctc

SEQ ID NO: 166051 - DNA, 22 bp, Homo sapiens
tcttcagcctagccgacctcag

SEQ ID NO: 166052 - DNA, 23 bp, Homo sapiens
tcttcagcctagccgacctcagc

SEQ ID NO: 166053 - DNA, 15 bp, Homo sapiens
tcttcagggcactgc

SEQ ID NO: 166054 - DNA, 15 bp, Homo sapiens
tcttcagggggccag

SEQ ID NO: 166055 - DNA, 18 bp, Homo sapiens
tcttcatccggcagcctg

SEQ ID NO: 166056 - DNA, 20 bp, Homo sapiens
tcttcatccggcagcctgga

SEQ ID NO: 166057 - DNA, 24 bp, Homo sapiens
tcttccaagcaaaggtgaagagac

SEQ ID NO: 166058 - DNA, 16 bp, Homo sapiens
tcttccatcatgtccc

SEQ ID NO: 166059 - DNA, 14 bp, Homo sapiens
tcttccatttgcaa

SEQ ID NO: 166060 - DNA, 17 bp, Homo sapiens
tcttcccatcactggag

SEQ ID NO: 166061 - DNA, 17 bp, Homo sapiens
tcttcccgaaccccaag

SEQ ID NO: 166062 - DNA, 18 bp, Homo sapiens
tcttcctgagtggtgcca

SEQ ID NO: 166063 - DNA, 23 bp, Homo sapiens
tcttctagagccgtgatgcctcc

SEQ ID NO: 166064 - DNA, 15 bp, Homo sapiens
tcttctattttattc

SEQ ID NO: 166065 - DNA, 14 bp, Homo sapiens
tcttctccatctgg

SEQ ID NO: 166066 - DNA, 17 bp, Homo sapiens
tcttctcctatgtgtaa

SEQ ID NO: 166067 - DNA, 19 bp, Homo sapiens
tcttctgccggccctgggg

SEQ ID NO: 166068 - DNA, 19 bp, Homo sapiens
tcttctgtatactgtggag

SEQ ID NO: 166069 - DNA, 14 bp, Homo sapiens
tcttcttcaccatt

SEQ ID NO: 166070 - DNA, 16 bp, Homo sapiens
tcttcttggtctcagt

SEQ ID NO: 166071 - DNA, 17 bp, Homo sapiens
tcttctttttttgtgat

SEQ ID NO: 166072 - DNA, 13 bp, Homo sapiens
tcttgaatttaat

SEQ ID NO: 166073 - DNA, 23 bp, Homo sapiens
tcttgaatttaataatctgtagg

SEQ ID NO: 166074 - DNA, 19 bp, Homo sapiens
tcttgaccaagcaggaagc

SEQ ID NO: 166075 - DNA, 22 bp, Homo sapiens
tcttgagcagtggctggtccag

SEQ ID NO: 166076 - DNA, 13 bp, Homo sapiens
tcttgagcctggg

SEQ ID NO: 166077 - DNA, 21 bp, Homo sapiens
tcttgatgcatgcactgttcc

SEQ ID NO: 166078 - DNA, 19 bp, Homo sapiens
tcttggcagcacctgtctc

SEQ ID NO: 166079 - DNA, 13 bp, Homo sapiens
tcttgtctctggg

SEQ ID NO: 166080 - DNA, 18 bp, Homo sapiens
tattaaaaatataaaact

SEQ ID NO: 166081 - DNA, 19 bp, Homo sapiens
tattaaaaatataaaactg

SEQ ID NO: 166082 - DNA, 12 bp, Homo sapiens
tattaaaactca

SEQ ID NO: 166083 - DNA, 17 bp, Homo sapiens
tattaaaatgattgtaa

SEQ ID NO: 166084 - DNA, 16 bp, Homo sapiens
tattaacaaattatgt

SEQ ID NO: 166085 - DNA, 17 bp, Homo sapiens
tattaagatttccaagt

SEQ ID NO: 166086 - DNA, 12 bp, Homo sapiens
tattataattta

SEQ ID NO: 166087 - DNA, 21 bp, Homo sapiens
tattatggaagattttaaatt

SEQ ID NO: 166088 - DNA, 15 bp, Homo sapiens
tattattgtgtgtta

SEQ ID NO: 166089 - DNA, 16 bp, Homo sapiens
tattatttcaatgtga

SEQ ID NO: 166090 - DNA, 16 bp, Homo sapiens
tattattttcacctgt

SEQ ID NO: 166091 - DNA, 23 bp, Homo sapiens
tattcaaacagtctcaggaaatc

SEQ ID NO: 166092 - DNA, 16 bp, Homo sapiens
tattcaagttattgta

SEQ ID NO: 166093 - DNA, 15 bp, Homo sapiens
tattccatatttatt

SEQ ID NO: 166094 - DNA, 19 bp, Homo sapiens
tattcctgcatttgtgaaa

SEQ ID NO: 166095 - DNA, 15 bp, Homo sapiens
tattctcactccacc

SEQ ID NO: 166096 - DNA, 14 bp, Homo sapiens
tattctgattccac

SEQ ID NO: 166097 - DNA, 14 bp, Homo sapiens
tattcttcataaca

SEQ ID NO: 166098 - DNA, 13 bp, Homo sapiens
tattgacaataat

SEQ ID NO: 166099 - DNA, 14 bp, Homo sapiens
tattgacttgtata

SEQ ID NO: 166100 - DNA, 17 bp, Homo sapiens
tattgacttgtatattt

SEQ ID NO: 166101 - DNA, 20 bp, Homo sapiens
tattgatatgcttatacact

SEQ ID NO: 166102 - DNA, 16 bp, Homo sapiens
tattgcatctgtataa

SEQ ID NO: 166103 - DNA, 15 bp, Homo sapiens
tattggtaacatcct

SEQ ID NO: 166104 - DNA, 22 bp, Homo sapiens
tattggtaacatcctttctatt

SEQ ID NO: 166105 - DNA, 22 bp, Homo sapiens
tattggtccagcttgctcttca

SEQ ID NO: 166106 - DNA, 16 bp, Homo sapiens
tattgtataaactatc

SEQ ID NO: 166107 - DNA, 16 bp, Homo sapiens
tattgtcagatatttt

SEQ ID NO: 166108 - DNA, 17 bp, Homo sapiens
tattgtccattgtccaa

SEQ ID NO: 166109 - DNA, 22 bp, Homo sapiens
tatttaaatattaaatatgtta

SEQ ID NO: 166110 - DNA, 21 bp, Homo sapiens
tatttaactgccttgtgtaca

SEQ ID NO: 166111 - DNA, 20 bp, Homo sapiens
tatttaagataattataata

SEQ ID NO: 166112 - DNA, 20 bp, Homo sapiens
tatttaagcctcatatttaa

SEQ ID NO: 166113 - DNA, 14 bp, Homo sapiens
tatttactgagctt

SEQ ID NO: 166114 - DNA, 22 bp, Homo sapiens
tatttagattgttaaaataact

SEQ ID NO: 166115 - DNA, 15 bp, Homo sapiens
tatttagttatagtt

SEQ ID NO: 166116 - DNA, 17 bp, Homo sapiens
tatttagttatagtttc

SEQ ID NO: 166117 - DNA, 20 bp, Homo sapiens
tatttagttatagtttcaga

SEQ ID NO: 166118 - DNA, 16 bp, Homo sapiens
tatttataaatatatt

SEQ ID NO: 166119 - DNA, 20 bp, Homo sapiens
tatttataacaacctaaatt

SEQ ID NO: 166120 - DNA, 13 bp, Homo sapiens
tatttataactca

SEQ ID NO: 166121 - DNA, 20 bp, Homo sapiens
tatttataactcatcataaa

SEQ ID NO: 166122 - DNA, 17 bp, Homo sapiens
tatttatatatttataa

SEQ ID NO: 166123 - DNA, 13 bp, Homo sapiens
tatttattacctc

SEQ ID NO: 166124 - DNA, 15 bp, Homo sapiens
tatttattacctctg

SEQ ID NO: 166125 - DNA, 13 bp, Homo sapiens
tatttatttaaat

SEQ ID NO: 166126 - DNA, 14 bp, Homo sapiens
tatttatttaaatt

SEQ ID NO: 166127 - DNA, 16 bp, Homo sapiens
tatttatttaagctta

SEQ ID NO: 166128 - DNA, 17 bp, Homo sapiens
tatttcatgaaaattgt

SEQ ID NO: 166129 - DNA, 15 bp, Homo sapiens
tatttcgaaagctgc

SEQ ID NO: 166130 - DNA, 16 bp, Homo sapiens
tatttgagagttctaa

SEQ ID NO: 166131 - DNA, 22 bp, Homo sapiens
tatttgcataacaattcctcta

SEQ ID NO: 166132 - DNA, 21 bp, Homo sapiens
tatttgtatttttttgcaagt

SEQ ID NO: 166133 - DNA, 18 bp, Homo sapiens
tattttaaaatctgtcac

SEQ ID NO: 166134 - DNA, 12 bp, Homo sapiens
tattttaaacaa

SEQ ID NO: 166135 - DNA, 16 bp, Homo sapiens
tgaaatctcagaattc

SEQ ID NO: 166136 - DNA, 18 bp, Homo sapiens
tgaaattgtttaagtgtt

SEQ ID NO: 166137 - DNA, 23 bp, Homo sapiens
tgaaattgtttaagtgttgtaaa

SEQ ID NO: 166138 - DNA, 20 bp, Homo sapiens
tgaaatttattagttaatat

SEQ ID NO: 166139 - DNA, 17 bp, Homo sapiens
tgaaattttctagactt

SEQ ID NO: 166140 - DNA, 15 bp, Homo sapiens
tgaaatttttattaa

SEQ ID NO: 166141 - DNA, 19 bp, Homo sapiens
tgaaatttttattaaatta

SEQ ID NO: 166142 - DNA, 21 bp, Homo sapiens
tgaacaaattgaactctttga

SEQ ID NO: 166143 - DNA, 13 bp, Homo sapiens
tgaacaaatttac

SEQ ID NO: 166144 - DNA, 18 bp, Homo sapiens
tgaacaaatttacagaga

SEQ ID NO: 166145 - DNA, 20 bp, Homo sapiens
tgaacaaatttacagagaca

SEQ ID NO: 166146 - DNA, 22 bp, Homo sapiens
tgaacaagttgtttcattgact

SEQ ID NO: 166147 - DNA, 22 bp, Homo sapiens
tgaacactgggggaggggacat

SEQ ID NO: 166148 - DNA, 19 bp, Homo sapiens
tgaacccaggaggtggagg

SEQ ID NO: 166149 - DNA, 15 bp, Homo sapiens
tgaacccttgcttgc

SEQ ID NO: 166150 - DNA, 15 bp, Homo sapiens
tgaacggggagaaaa

SEQ ID NO: 166151 - DNA, 23 bp, Homo sapiens
tgaactagggtggtgcatttttg

SEQ ID NO: 166152 - DNA, 17 bp, Homo sapiens
tgaactcaactttgaca

SEQ ID NO: 166153 - DNA, 13 bp, Homo sapiens
tgaactgaagttt

SEQ ID NO: 166154 - DNA, 22 bp, Homo sapiens
tgaactttctcttcatactttt

SEQ ID NO: 166155 - DNA, 13 bp, Homo sapiens
tgaagaacagtaa

SEQ ID NO: 166156 - DNA, 15 bp, Homo sapiens
tgaagaacagtaact

SEQ ID NO: 166157 - DNA, 20 bp, Homo sapiens
tgaagaacagtaactgccat

SEQ ID NO: 166158 - DNA, 16 bp, Homo sapiens
tgaagagatttttcat

SEQ ID NO: 166159 - DNA, 19 bp, Homo sapiens
tgaagaggaaaatgaataa

SEQ ID NO: 166160 - DNA, 13 bp, Homo sapiens
tgaagatgatcat

SEQ ID NO: 166161 - DNA, 21 bp, Homo sapiens
tgaagatgctgaaacaggaga

SEQ ID NO: 166162 - DNA, 18 bp, Homo sapiens
tgaagatgtagaggagaa

SEQ ID NO: 166163 - DNA, 19 bp, Homo sapiens
tgaagattctcctgtgcta

SEQ ID NO: 166164 - DNA, 13 bp, Homo sapiens
tgaagccagcctt

SEQ ID NO: 166165 - DNA, 14 bp, Homo sapiens
tgaagccagccttc

SEQ ID NO: 166166 - DNA, 21 bp, Homo sapiens
tgaaggaatatatggcagagt

SEQ ID NO: 166167 - DNA, 22 bp, Homo sapiens
tgaaggaatatatggcagagtt

SEQ ID NO: 166168 - DNA, 19 bp, Homo sapiens
tgaaggccgagaagcaaga

SEQ ID NO: 166169 - DNA, 18 bp, Homo sapiens
tgaagggaaaggatattt

SEQ ID NO: 166170 - DNA, 22 bp, Homo sapiens
tgaagggaaaggatattttctt

SEQ ID NO: 166171 - DNA, 14 bp, Homo sapiens
tgaaggtgtcagaa

SEQ ID NO: 166172 - DNA, 20 bp, Homo sapiens
tgaaggttaggatttaacag

SEQ ID NO: 166173 - DNA, 21 bp, Homo sapiens
tgaaggtttacaatttacaaa

SEQ ID NO: 166174 - DNA, 23 bp, Homo sapiens
tgaaggtttacaatttacaaagt

SEQ ID NO: 166175 - DNA, 14 bp, Homo sapiens
tgaagtaagcaaag

SEQ ID NO: 166176 - DNA, 15 bp, Homo sapiens
tgaagtaagcaaaga

SEQ ID NO: 166177 - DNA, 18 bp, Homo sapiens
tgaagtacccgttcacat

SEQ ID NO: 166178 - DNA, 17 bp, Homo sapiens
tgaagtgtaggcagaca

SEQ ID NO: 166179 - DNA, 18 bp, Homo sapiens
tgaagtgtgtttccttca

SEQ ID NO: 166180 - DNA, 15 bp, Homo sapiens
tgaagttgttactaa

SEQ ID NO: 166181 - DNA, 22 bp, Homo sapiens
tgaagttgttactaactaaact

SEQ ID NO: 166182 - DNA, 14 bp, Homo sapiens
tgaataaagacacc

SEQ ID NO: 166183 - DNA, 12 bp, Homo sapiens
tgaataaatgtc

SEQ ID NO: 166184 - DNA, 14 bp, Homo sapiens
tgaataaatgtctt

SEQ ID NO: 166185 - DNA, 18 bp, Homo sapiens
tgaatatattataatctt

SEQ ID NO: 166186 - DNA, 13 bp, Homo sapiens
tgaatatcccctc

SEQ ID NO: 166187 - DNA, 20 bp, Homo sapiens
tgaatatgaacggtgagcat

SEQ ID NO: 166188 - DNA, 15 bp, Homo sapiens
tgaatgacaaagagt

SEQ ID NO: 166189 - DNA, 19 bp, Homo sapiens
tgaatgctttttgaatgtt

SEQ ID NO: 166190 - DNA, 14 bp, Homo sapiens
tgaatgggaaaaga

SEQ ID NO: 166191 - DNA, 19 bp, Homo sapiens
tgaattaatatccctacat

SEQ ID NO: 166192 - DNA, 23 bp, Homo sapiens
tgaattaatatccctacatgtat

SEQ ID NO: 166193 - DNA, 20 bp, Homo sapiens
tgaattaatgacagagccag

SEQ ID NO: 166194 - DNA, 21 bp, Homo sapiens
tgaattagaaacataaataaa

SEQ ID NO: 166195 - DNA, 12 bp, Homo sapiens
tgaattcagatt

SEQ ID NO: 166196 - DNA, 17 bp, Homo sapiens
tgaattcagattttaaa

SEQ ID NO: 166197 - DNA, 19 bp, Homo sapiens
tgaatttaataatctgtag

SEQ ID NO: 166198 - DNA, 23 bp, Homo sapiens
tgaatttcttcactgttgaaaat

SEQ ID NO: 166199 - DNA, 18 bp, Homo sapiens
tgacaaaaattcaactca

SEQ ID NO: 166200 - DNA, 19 bp, Homo sapiens
tgacaaagaaacccaagtg

SEQ ID NO: 166201 - DNA, 22 bp, Homo sapiens
tgacaacagaagcttcagaagt

SEQ ID NO: 166202 - DNA, 19 bp, Homo sapiens
tgacaaccatgagaccact

SEQ ID NO: 166203 - DNA, 12 bp, Homo sapiens
tgacaccagcct

SEQ ID NO: 166204 - DNA, 15 bp, Homo sapiens
tgacaccagcctttc

SEQ ID NO: 166205 - DNA, 22 bp, Homo sapiens
tgacaccagcctttctcccagg

SEQ ID NO: 166206 - DNA, 23 bp, Homo sapiens
tgacaccagcctttctcccaggc

SEQ ID NO: 166207 - DNA, 13 bp, Homo sapiens
tgacacccatgtt

SEQ ID NO: 166208 - DNA, 19 bp, Homo sapiens
tgacacccatgtttctctg

SEQ ID NO: 166209 - DNA, 17 bp, Homo sapiens
tgacacgtccaccccag

SEQ ID NO: 166210 - DNA, 16 bp, Homo sapiens
tgacacttaaaaatgg

SEQ ID NO: 166211 - DNA, 11 bp, Homo sapiens
tgacagcctcc

SEQ ID NO: 166212 - DNA, 12 bp, Homo sapiens
tgacagcctccc

SEQ ID NO: 166213 - DNA, 21 bp, Homo sapiens
tgacagctgtccctgtcacca

SEQ ID NO: 166214 - DNA, 17 bp, Homo sapiens
tgacatcaccacagttt

SEQ ID NO: 166215 - DNA, 17 bp, Homo sapiens
tgacatccaagcttcct

SEQ ID NO: 166216 - DNA, 13 bp, Homo sapiens
tgacatctctttg

SEQ ID NO: 166217 - DNA, 18 bp, Homo sapiens
tgacatgcgggctgggca

SEQ ID NO: 166218 - DNA, 16 bp, Homo sapiens
tgacatgtccctacac

SEQ ID NO: 166219 - DNA, 17 bp, Homo sapiens
tgacatgtggggccagg

SEQ ID NO: 166220 - DNA, 18 bp, Homo sapiens
tgacattgtagagcttct

SEQ ID NO: 166221 - DNA, 19 bp, Homo sapiens
tgacatttatatattgaat

SEQ ID NO: 166222 - DNA, 21 bp, Homo sapiens
tgacatttgggagacatgtga

SEQ ID NO: 166223 - DNA, 16 bp, Homo sapiens
tgaccaacatggagaa

SEQ ID NO: 166224 - DNA, 14 bp, Homo sapiens
tgaccaatgtcttg

SEQ ID NO: 166225 - DNA, 21 bp, Homo sapiens
tgaccacgctttctagctgtt

SEQ ID NO: 166226 - DNA, 16 bp, Homo sapiens
tgaccactctgtcttg

SEQ ID NO: 166227 - DNA, 16 bp, Homo sapiens
tgaccactgcagaaga

SEQ ID NO: 166228 - DNA, 20 bp, Homo sapiens
tgaccagcagatcccagctc

SEQ ID NO: 166229 - DNA, 22 bp, Homo sapiens
tgaccagcagatcccagctcac

SEQ ID NO: 166230 - DNA, 16 bp, Homo sapiens
tgaccaggcatcctcc

SEQ ID NO: 166231 - DNA, 15 bp, Homo sapiens
tgaccagtctgaccc

SEQ ID NO: 166232 - DNA, 20 bp, Homo sapiens
tgaccagttgcacttggcct

SEQ ID NO: 166233 - DNA, 18 bp, Homo sapiens
tcacccccttctccatcc

SEQ ID NO: 166234 - DNA, 14 bp, Homo sapiens
tcaccccgtctggg

SEQ ID NO: 166235 - DNA, 12 bp, Homo sapiens
tcacccctccac

SEQ ID NO: 166236 - DNA, 14 bp, Homo sapiens
tcacccctgccctg

SEQ ID NO: 166237 - DNA, 17 bp, Homo sapiens
tcacccctgtcctcact

SEQ ID NO: 166238 - DNA, 13 bp, Homo sapiens
tcaccctccacct

SEQ ID NO: 166239 - DNA, 15 bp, Homo sapiens
tcaccctccacctct

SEQ ID NO: 166240 - DNA, 20 bp, Homo sapiens
tcaccctccacctcttcacc

SEQ ID NO: 166241 - DNA, 15 bp, Homo sapiens
tcaccctgccttatc

SEQ ID NO: 166242 - DNA, 13 bp, Homo sapiens
tcaccctttgctg

SEQ ID NO: 166243 - DNA, 15 bp, Homo sapiens
tcaccggatcctggg

SEQ ID NO: 166244 - DNA, 19 bp, Homo sapiens
tcaccgtgggctccctgac

SEQ ID NO: 166245 - DNA, 14 bp, Homo sapiens
tcacctctgcctca

SEQ ID NO: 166246 - DNA, 22 bp, Homo sapiens
tcacctgagcccggatgcttct

SEQ ID NO: 166247 - DNA, 23 bp, Homo sapiens
tcacctgagcccggatgcttctc

SEQ ID NO: 166248 - DNA, 23 bp, Homo sapiens
tcacctgcccagatcccagaagg

SEQ ID NO: 166249 - DNA, 14 bp, Homo sapiens
tcacctgtgcttcg

SEQ ID NO: 166250 - DNA, 22 bp, Homo sapiens
tcacctgtttttaagctgtttc

SEQ ID NO: 166251 - DNA, 18 bp, Homo sapiens
tcaccttaggcagggaag

SEQ ID NO: 166252 - DNA, 20 bp, Homo sapiens
tcaccttaggcagggaagtg

SEQ ID NO: 166253 - DNA, 21 bp, Homo sapiens
tcaccttcgtttactatgcct

SEQ ID NO: 166254 - DNA, 22 bp, Homo sapiens
tcaccttcgtttactatgcctg

SEQ ID NO: 166255 - DNA, 15 bp, Homo sapiens
tcacgcacctcccat

SEQ ID NO: 166256 - DNA, 17 bp, Homo sapiens
tcacgcacctcccatcc

SEQ ID NO: 166257 - DNA, 14 bp, Homo sapiens
tcacgcacctgggt

SEQ ID NO: 166258 - DNA, 21 bp, Homo sapiens
tcacgcctgtaatcccagcag

SEQ ID NO: 166259 - DNA, 20 bp, Homo sapiens
tcacgcctgtaatcctagca

SEQ ID NO: 166260 - DNA, 16 bp, Homo sapiens
tcacggaagttttcaa

SEQ ID NO: 166261 - DNA, 23 bp, Homo sapiens
tcacggcaggacaacgaggaagc

SEQ ID NO: 166262 - DNA, 20 bp, Homo sapiens
tcacgggcatgggcactccc

SEQ ID NO: 166263 - DNA, 13 bp, Homo sapiens
tcacgtcacactt

SEQ ID NO: 166264 - DNA, 12 bp, Homo sapiens
tcacgtgtgtga

SEQ ID NO: 166265 - DNA, 13 bp, Homo sapiens
tcactaaacttta

SEQ ID NO: 166266 - DNA, 15 bp, Homo sapiens
tcactcctacctggt

SEQ ID NO: 166267 - DNA, 19 bp, Homo sapiens
tcactctacttagcatgtc

SEQ ID NO: 166268 - DNA, 15 bp, Homo sapiens
tcactctctgaagat

SEQ ID NO: 166269 - DNA, 20 bp, Homo sapiens
tcactgcacagtgcatctca

SEQ ID NO: 166270 - DNA, 18 bp, Homo sapiens
tcactgccatgccagctt

SEQ ID NO: 166271 - DNA, 19 bp, Homo sapiens
tcactgcctctccctggcc

SEQ ID NO: 166272 - DNA, 14 bp, Homo sapiens
tcactgctccctga

SEQ ID NO: 166273 - DNA, 23 bp, Homo sapiens
tcactgctccctgaagccagcct

SEQ ID NO: 166274 - DNA, 16 bp, Homo sapiens
tcactgctggctgcct

SEQ ID NO: 166275 - DNA, 22 bp, Homo sapiens
tcactgctggctgccttagaac

SEQ ID NO: 166276 - DNA, 16 bp, Homo sapiens
tcatcttgaccaagca

SEQ ID NO: 166277 - DNA, 21 bp, Homo sapiens
tcatcttgaccaagcaggaag

SEQ ID NO: 166278 - DNA, 14 bp, Homo sapiens
tcatgatctccctg

SEQ ID NO: 166279 - DNA, 22 bp, Homo sapiens
tcatggcagaaggcaaacccat

SEQ ID NO: 166280 - DNA, 15 bp, Homo sapiens
tcatggcttaatgtt

SEQ ID NO: 166281 - DNA, 16 bp, Homo sapiens
tcatgtaaactgtgca

SEQ ID NO: 166282 - DNA, 14 bp, Homo sapiens
tcatgtcaggcctg

SEQ ID NO: 166283 - DNA, 19 bp, Homo sapiens
tcatgtcaggcctgtgtgt

SEQ ID NO: 166284 - DNA, 17 bp, Homo sapiens
tcatgtccccaaacctg

SEQ ID NO: 166285 - DNA, 17 bp, Homo sapiens
tcatgtgaccactctgt

SEQ ID NO: 166286 - DNA, 15 bp, Homo sapiens
tcatgtgatcctttt

SEQ ID NO: 166287 - DNA, 20 bp, Homo sapiens
tcatgtgatccttttatgtt

SEQ ID NO: 166288 - DNA, 19 bp, Homo sapiens
tcatgtggaatataaagat

SEQ ID NO: 166289 - DNA, 23 bp, Homo sapiens
tcatgtgtgtccacgactgtctc

SEQ ID NO: 166290 - DNA, 14 bp, Homo sapiens
tcatgttccttcaa

SEQ ID NO: 166291 - DNA, 16 bp, Homo sapiens
tcatgtttaagaaatt

SEQ ID NO: 166292 - DNA, 22 bp, Homo sapiens
tcattaagccctcttccatcat

SEQ ID NO: 166293 - DNA, 17 bp, Homo sapiens
tcattatagatccccca

SEQ ID NO: 166294 - DNA, 18 bp, Homo sapiens
tcattatagatcccccag

SEQ ID NO: 166295 - DNA, 13 bp, Homo sapiens
tcattatctcaaa

SEQ ID NO: 166296 - DNA, 13 bp, Homo sapiens
tcattcaggaaaa

SEQ ID NO: 166297 - DNA, 12 bp, Homo sapiens
tcattctcctgc

SEQ ID NO: 166298 - DNA, 13 bp, Homo sapiens
tcattctcctgcc

SEQ ID NO: 166299 - DNA, 18 bp, Homo sapiens
tcattctctgtctcatcc

SEQ ID NO: 166300 - DNA, 17 bp, Homo sapiens
tcattgaagtcagatgt

SEQ ID NO: 166301 - DNA, 20 bp, Homo sapiens
tcattgactatcaaactgaa

SEQ ID NO: 166302 - DNA, 13 bp, Homo sapiens
tcatttaaaatga

SEQ ID NO: 166303 - DNA, 16 bp, Homo sapiens
tcatttaaaatgatta

SEQ ID NO: 166304 - DNA, 19 bp, Homo sapiens
tcatttagtttgattattc

SEQ ID NO: 166305 - DNA, 16 bp, Homo sapiens
tcatttctgcatcagc

SEQ ID NO: 166306 - DNA, 13 bp, Homo sapiens
tcattttaattat

SEQ ID NO: 166307 - DNA, 16 bp, Homo sapiens
tcattttatatgtcaa

SEQ ID NO: 166308 - DNA, 22 bp, Homo sapiens
tcattttggtaaaatacttctt

SEQ ID NO: 166309 - DNA, 13 bp, Homo sapiens
tcattttttctta

SEQ ID NO: 166310 - DNA, 19 bp, Homo sapiens
tccaaaaagattttcagaa

SEQ ID NO: 166311 - DNA, 22 bp, Homo sapiens
tccaaaaagattttcagaaaat

SEQ ID NO: 166312 - DNA, 12 bp, Homo sapiens
tccaaagaaatg

SEQ ID NO: 166313 - DNA, 17 bp, Homo sapiens
tccaaagaaatgtaagg

SEQ ID NO: 166314 - DNA, 23 bp, Homo sapiens
tccaaaggaagtctaggagctgg

SEQ ID NO: 166315 - DNA, 14 bp, Homo sapiens
tccaacaggagctg

SEQ ID NO: 166316 - DNA, 16 bp, Homo sapiens
tccaacaggagctggg

SEQ ID NO: 166317 - DNA, 19 bp, Homo sapiens
tccaaccccaactccagta

SEQ ID NO: 166318 - DNA, 18 bp, Homo sapiens
tccaagatattttaaaat

SEQ ID NO: 166319 - DNA, 22 bp, Homo sapiens
tccaagatattttaaaatctgt

SEQ ID NO: 166320 - DNA, 15 bp, Homo sapiens
tccaagtgccaatat

SEQ ID NO: 166321 - DNA, 13 bp, Homo sapiens
tccaagtgtgtgt

SEQ ID NO: 166322 - DNA, 17 bp, Homo sapiens
tccaatgtttagcaaat

SEQ ID NO: 166323 - DNA, 19 bp, Homo sapiens
tccaatgtttagcaaatac

SEQ ID NO: 166324 - DNA, 12 bp, Homo sapiens
tccacaaaataa

SEQ ID NO: 166325 - DNA, 20 bp, Homo sapiens
tccacaaaataaccaatcct

SEQ ID NO: 166326 - DNA, 18 bp, Homo sapiens
tccacaagattcccagag

SEQ ID NO: 166327 - DNA, 18 bp, Homo sapiens
tccacaccctctcccagg

SEQ ID NO: 166328 - DNA, 22 bp, Homo sapiens
tccacacctggcactgctgtgc

SEQ ID NO: 166329 - DNA, 14 bp, Homo sapiens
tccacatcccggga

SEQ ID NO: 166330 - DNA, 13 bp, Homo sapiens
tccacatcctcca

SEQ ID NO: 166331 - DNA, 18 bp, Homo sapiens
tccaccacctccctcacc

SEQ ID NO: 166332 - DNA, 14 bp, Homo sapiens
tccaccagcctgca

SEQ ID NO: 166333 - DNA, 16 bp, Homo sapiens
tccaccagcctgcact

SEQ ID NO: 166334 - DNA, 21 bp, Homo sapiens
tccaccatggggtcctaccaa

SEQ ID NO: 166335 - DNA, 13 bp, Homo sapiens
tccacccagccca

SEQ ID NO: 166336 - DNA, 23 bp, Homo sapiens
tccaccccagtgcacccactctg

SEQ ID NO: 166337 - DNA, 13 bp, Homo sapiens
tccaccgctgcct

SEQ ID NO: 166338 - DNA, 15 bp, Homo sapiens
tccaccgctgcctaa

SEQ ID NO: 166339 - DNA, 19 bp, Homo sapiens
tccaccgctgcctaagtgg

SEQ ID NO: 166340 - DNA, 17 bp, Homo sapiens
tccacctcagccttgga

SEQ ID NO: 166341 - DNA, 18 bp, Homo sapiens
tccacctcttcacccccc

SEQ ID NO: 166342 - DNA, 17 bp, Homo sapiens
tccacctgagctgccat

SEQ ID NO: 166343 - DNA, 13 bp, Homo sapiens
tccacctgctccc

SEQ ID NO: 166344 - DNA, 13 bp, Homo sapiens
tccacctggcccc

SEQ ID NO: 166345 - DNA, 18 bp, Homo sapiens
tccaccttcccatgccct

SEQ ID NO: 166346 - DNA, 14 bp, Homo sapiens
tccacggagccact

SEQ ID NO: 166347 - DNA, 22 bp, Homo sapiens
tccacggagccactcctctgac

SEQ ID NO: 166348 - DNA, 13 bp, Homo sapiens
tccactccttcct

SEQ ID NO: 166349 - DNA, 21 bp, Homo sapiens
tccactccttcctgccacctg

SEQ ID NO: 166350 - DNA, 22 bp, Homo sapiens
tccactgccttcgatacaccgg

SEQ ID NO: 166351 - DNA, 22 bp, Homo sapiens
tccactggttcttcttggtctc

SEQ ID NO: 166352 - DNA, 22 bp, Homo sapiens
tccactgtcactgtttctctgc

SEQ ID NO: 166353 - DNA, 17 bp, Homo sapiens
tccagacccctggcttt

SEQ ID NO: 166354 - DNA, 22 bp, Homo sapiens
tccagagagtggctcctcccgg

SEQ ID NO: 166355 - DNA, 17 bp, Homo sapiens
tccagattgacgacaag

SEQ ID NO: 166356 - DNA, 20 bp, Homo sapiens
tccagcctgagcgacagtga

SEQ ID NO: 166357 - DNA, 11 bp, Homo sapiens
tccagcctggg

SEQ ID NO: 166358 - DNA, 17 bp, Homo sapiens
tccagctgttcagctgg

SEQ ID NO: 166359 - DNA, 15 bp, Homo sapiens
tccagcttgctcttc

SEQ ID NO: 166360 - DNA, 16 bp, Homo sapiens
tccaggcactgagata

SEQ ID NO: 166361 - DNA, 22 bp, Homo sapiens
tccaggcctgtgaggtgcagag

SEQ ID NO: 166362 - DNA, 19 bp, Homo sapiens
tccaggcgatgtgcaagtg

SEQ ID NO: 166363 - DNA, 22 bp, Homo sapiens
tccagggccacgtgccaggccc

SEQ ID NO: 166364 - DNA, 20 bp, Homo sapiens
tccagggccctgagctcggt

SEQ ID NO: 166365 - DNA, 14 bp, Homo sapiens
tccagggctagtga

SEQ ID NO: 166366 - DNA, 17 bp, Homo sapiens
tccaggggatgggaggt

SEQ ID NO: 166367 - DNA, 13 bp, Homo sapiens
tccagtattcttg

SEQ ID NO: 166368 - DNA, 19 bp, Homo sapiens
tccagtattcttgtcaaaa

SEQ ID NO: 166369 - DNA, 20 bp, Homo sapiens
tccagtcaggcctatctaaa

SEQ ID NO: 166370 - DNA, 21 bp, Homo sapiens
tccataatctggactcctctg

SEQ ID NO: 166371 - DNA, 13 bp, Homo sapiens
tccatataaatat

SEQ ID NO: 166372 - DNA, 19 bp, Homo sapiens
tccatataaatattagaaa

SEQ ID NO: 166373 - DNA, 22 bp, Homo sapiens
tccatcagcttaggggctgctg

SEQ ID NO: 166374 - DNA, 15 bp, Homo sapiens
tccatcccaggacac

SEQ ID NO: 166375 - DNA, 17 bp, Homo sapiens
tccatgggcagagccca

SEQ ID NO: 166376 - DNA, 18 bp, Homo sapiens
tccatgggcagagcccaa

SEQ ID NO: 166377 - DNA, 16 bp, Homo sapiens
tccatggggaagggat

SEQ ID NO: 166378 - DNA, 14 bp, Homo sapiens
tccatgtagcagga

SEQ ID NO: 166379 - DNA, 17 bp, Homo sapiens
tccatgtagcaggactg

SEQ ID NO: 166380 - DNA, 16 bp, Homo sapiens
tccatgtcgcctctgc

SEQ ID NO: 166381 - DNA, 19 bp, Homo sapiens
tccatgtcgcctctgcatt

SEQ ID NO: 166382 - DNA, 11 bp, Homo sapiens
tccatgtgtgt

SEQ ID NO: 166383 - DNA, 13 bp, Homo sapiens
tccatgtttgtaa

SEQ ID NO: 166384 - DNA, 22 bp, Homo sapiens
tccattaacttagcatgtgttg

SEQ ID NO: 166385 - DNA, 12 bp, Homo sapiens
tccattatttat

SEQ ID NO: 166386 - DNA, 15 bp, Homo sapiens
tccattcctcaggga

SEQ ID NO: 166387 - DNA, 23 bp, Homo sapiens
tccatttcatctatttctgagaa

SEQ ID NO: 166388 - DNA, 20 bp, Homo sapiens
tccatttcgcccctcattta

SEQ ID NO: 166389 - DNA, 13 bp, Homo sapiens
tcccacaccctgg

SEQ ID NO: 166390 - DNA, 18 bp, Homo sapiens
tcccacaggacatttctc

SEQ ID NO: 166391 - DNA, 21 bp, Homo sapiens
tcccacaggcccttcctctcc

SEQ ID NO: 166392 - DNA, 14 bp, Homo sapiens
tgatttccaaagag

SEQ ID NO: 166393 - DNA, 19 bp, Homo sapiens
tgatttgttttcctcttaa

SEQ ID NO: 166394 - DNA, 20 bp, Homo sapiens
tgcaaaagactaatttaaaa

SEQ ID NO: 166395 - DNA, 23 bp, Homo sapiens
tgcaaaagactaatttaaaaaat

SEQ ID NO: 166396 - DNA, 22 bp, Homo sapiens
tgcaaaatttgatgccaggaca

SEQ ID NO: 166397 - DNA, 14 bp, Homo sapiens
tgcaaacgctgcct

SEQ ID NO: 166398 - DNA, 19 bp, Homo sapiens
tgcaaacgctgcctgccca

SEQ ID NO: 166399 - DNA, 19 bp, Homo sapiens
tgcaaagaggcaagaggct

SEQ ID NO: 166400 - DNA, 23 bp, Homo sapiens
tgcaaagttccctacttcctgtg

SEQ ID NO: 166401 - DNA, 20 bp, Homo sapiens
tgcaacctcgctggactctc

SEQ ID NO: 166402 - DNA, 16 bp, Homo sapiens
tgcaactcaaggactt

SEQ ID NO: 166403 - DNA, 21 bp, Homo sapiens
tgcaacttctttttattttct

SEQ ID NO: 166404 - DNA, 23 bp, Homo sapiens
tgcaagagccttggtgtccacct

SEQ ID NO: 166405 - DNA, 23 bp, Homo sapiens
tgcaaggccgctgttcacccaca

SEQ ID NO: 166406 - DNA, 15 bp, Homo sapiens
tgcaagggctcccca

SEQ ID NO: 166407 - DNA, 18 bp, Homo sapiens
tgcaagtgaaggtttaca

SEQ ID NO: 166408 - DNA, 21 bp, Homo sapiens
tgcaagtgtatgcacgtgtgc

SEQ ID NO: 166409 - DNA, 22 bp, Homo sapiens
tgcaagtgtgtatgtgcgtgtg

SEQ ID NO: 166410 - DNA, 18 bp, Homo sapiens
tgcaatggctatatggca

SEQ ID NO: 166411 - DNA, 14 bp, Homo sapiens
tgcaatttattaaa

SEQ ID NO: 166412 - DNA, 18 bp, Homo sapiens
tgcaatttattaaaatga

SEQ ID NO: 166413 - DNA, 22 bp, Homo sapiens
tgcaatttattaaaatgattgt

SEQ ID NO: 166414 - DNA, 15 bp, Homo sapiens
tgcacaagctgcacc

SEQ ID NO: 166415 - DNA, 18 bp, Homo sapiens
tgcacaagctgcaccctc

SEQ ID NO: 166416 - DNA, 16 bp, Homo sapiens
tgcacacccactcagc

SEQ ID NO: 166417 - DNA, 17 bp, Homo sapiens
tgcacacccactcagct

SEQ ID NO: 166418 - DNA, 22 bp, Homo sapiens
tcccatggacactccagtgcca

SEQ ID NO: 166419 - DNA, 14 bp, Homo sapiens
tcccattgccctgg

SEQ ID NO: 166420 - DNA, 15 bp, Homo sapiens
tcccattgccctggt

SEQ ID NO: 166421 - DNA, 21 bp, Homo sapiens
tcccatttctaaaggcctctt

SEQ ID NO: 166422 - DNA, 12 bp, Homo sapiens
tccccaccctga

SEQ ID NO: 166423 - DNA, 23 bp, Homo sapiens
tccccaccctgaaagccctgagc

SEQ ID NO: 166424 - DNA, 20 bp, Homo sapiens
tccccactgcctactgcatc

SEQ ID NO: 166425 - DNA, 13 bp, Homo sapiens
tccccagacctga

SEQ ID NO: 166426 - DNA, 10 bp, Homo sapiens
tccccagccc

SEQ ID NO: 166427 - DNA, 14 bp, Homo sapiens
tccccagcccaggg

SEQ ID NO: 166428 - DNA, 15 bp, Homo sapiens
tccccagcccagggt

SEQ ID NO: 166429 - DNA, 20 bp, Homo sapiens
tccccagcccctagcccagg

SEQ ID NO: 166430 - DNA, 13 bp, Homo sapiens
tccccagccctgg

SEQ ID NO: 166431 - DNA, 13 bp, Homo sapiens
tccccaggcccca

SEQ ID NO: 166432 - DNA, 23 bp, Homo sapiens
tccccaggccgtggctgcccaca

SEQ ID NO: 166433 - DNA, 19 bp, Homo sapiens
tccccaggggaaaatgaag

SEQ ID NO: 166434 - DNA, 15 bp, Homo sapiens
tccccaggtggctga

SEQ ID NO: 166435 - DNA, 18 bp, Homo sapiens
tccccaggtggctgaccc

SEQ ID NO: 166436 - DNA, 18 bp, Homo sapiens
tccccattgcctcctcct

SEQ ID NO: 166437 - DNA, 21 bp, Homo sapiens
tcccccaccccctccccaggg

SEQ ID NO: 166438 - DNA, 14 bp, Homo sapiens
tcccccactgccat

SEQ ID NO: 166439 - DNA, 12 bp, Homo sapiens
tcccccatagcc

SEQ ID NO: 166440 - DNA, 14 bp, Homo sapiens
tcccccatagccac

SEQ ID NO: 166441 - DNA, 15 bp, Homo sapiens
tcccccatagccacc

SEQ ID NO: 166442 - DNA, 12 bp, Homo sapiens
tccccccactgc

SEQ ID NO: 166443 - DNA, 19 bp, Homo sapiens
tccccccactgcaggcccc

SEQ ID NO: 166444 - DNA, 23 bp, Homo sapiens
tccccccactgcaggccccgctt

SEQ ID NO: 166445 - DNA, 17 bp, Homo sapiens
tcccccccctgtatagt

SEQ ID NO: 166446 - DNA, 20 bp, Homo sapiens
tcccccgcaatgtgccccca

SEQ ID NO: 166447 - DNA, 21 bp, Homo sapiens
tcccccgcaatgtgcccccag

SEQ ID NO: 166448 - DNA, 12 bp, Homo sapiens
tccccctctgtc

SEQ ID NO: 166449 - DNA, 20 bp, Homo sapiens
tccccctggggcttctcctg

SEQ ID NO: 166450 - DNA, 21 bp, Homo sapiens
tccccctggggcttctcctga

SEQ ID NO: 166451 - DNA, 19 bp, Homo sapiens
tccccgaaggtgctggagg

SEQ ID NO: 166452 - DNA, 13 bp, Homo sapiens
tccccggctcgag

SEQ ID NO: 166453 - DNA, 13 bp, Homo sapiens
tcccctcacagcc

SEQ ID NO: 166454 - DNA, 14 bp, Homo sapiens
tcccctcacagcct

SEQ ID NO: 166455 - DNA, 19 bp, Homo sapiens
tcccctcacagcctctgac

SEQ ID NO: 166456 - DNA, 14 bp, Homo sapiens
tcccctcccctgct

SEQ ID NO: 166457 - DNA, 16 bp, Homo sapiens
tcccctccctcctctg

SEQ ID NO: 166458 - DNA, 17 bp, Homo sapiens
tcccctccgccaggcga

SEQ ID NO: 166459 - DNA, 18 bp, Homo sapiens
tcccctccttctcccttt

SEQ ID NO: 166460 - DNA, 14 bp, Homo sapiens
tcccctgcactgga

SEQ ID NO: 166461 - DNA, 12 bp, Homo sapiens
tcccctgccagg

SEQ ID NO: 166462 - DNA, 15 bp, Homo sapiens
tcccctgccagggca

SEQ ID NO: 166463 - DNA, 15 bp, Homo sapiens
tcccctgccctgctg

SEQ ID NO: 166464 - DNA, 16 bp, Homo sapiens
tcccctgccctgctgc

SEQ ID NO: 166465 - DNA, 15 bp, Homo sapiens
tcccctggactggga

SEQ ID NO: 166466 - DNA, 16 bp, Homo sapiens
tcccctggactgggag

SEQ ID NO: 166467 - DNA, 17 bp, Homo sapiens
tcccctggactgggagg

SEQ ID NO: 166468 - DNA, 22 bp, Homo sapiens
tcccctgtagagtgggagctga

SEQ ID NO: 166469 - DNA, 18 bp, Homo sapiens
tccccttccactgagggc

SEQ ID NO: 166470 - DNA, 17 bp, Homo sapiens
tccccttgcccagggct

SEQ ID NO: 166471 - DNA, 22 bp, Homo sapiens
tccccttgcccagggctcagcc

SEQ ID NO: 166472 - DNA, 24 bp, Homo sapiens
tccccttgcccagggctcagcctg

SEQ ID NO: 166473 - DNA, 22 bp, Homo sapiens
tcccgagcacctccacatcctc

SEQ ID NO: 166474 - DNA, 13 bp, Homo sapiens
tcccgctcagccc

SEQ ID NO: 166475 - DNA, 16 bp, Homo sapiens
tcccgctcagccctcc

SEQ ID NO: 166476 - DNA, 18 bp, Homo sapiens
tccctaaaaacacagaca

SEQ ID NO: 166477 - DNA, 13 bp, Homo sapiens
tccctacatgtat

SEQ ID NO: 166478 - DNA, 23 bp, Homo sapiens
tccctaccgagtctcttctccac

SEQ ID NO: 166479 - DNA, 16 bp, Homo sapiens
tccctacttcctgtga

SEQ ID NO: 166480 - DNA, 19 bp, Homo sapiens
tccctagaaacttccaaat

SEQ ID NO: 166481 - DNA, 16 bp, Homo sapiens
tccctattagagaaga

SEQ ID NO: 166482 - DNA, 16 bp, Homo sapiens
tccctcaaccccacca

SEQ ID NO: 166483 - DNA, 20 bp, Homo sapiens
tccctcacctgtagcagcca

SEQ ID NO: 166484 - DNA, 16 bp, Homo sapiens
tccctcatctgtccct

SEQ ID NO: 166485 - DNA, 21 bp, Homo sapiens
tccctcatctgtccctccggg

SEQ ID NO: 166486 - DNA, 19 bp, Homo sapiens
tccctcccacctctgtgac

SEQ ID NO: 166487 - DNA, 15 bp, Homo sapiens
tccctcctctgtccc

SEQ ID NO: 166488 - DNA, 19 bp, Homo sapiens
tccctcgctgcacaaatac

SEQ ID NO: 166489 - DNA, 22 bp, Homo sapiens
tccctcgctgcacaaatactcc

SEQ ID NO: 166490 - DNA, 15 bp, Homo sapiens
tccctctcctgccta

SEQ ID NO: 166491 - DNA, 13 bp, Homo sapiens
tccctctctctga

SEQ ID NO: 166492 - DNA, 17 bp, Homo sapiens
tccctctctctgactct

SEQ ID NO: 166493 - DNA, 15 bp, Homo sapiens
tccctgaaaacccag

SEQ ID NO: 166494 - DNA, 18 bp, Homo sapiens
tccctgaaaacccagaga

SEQ ID NO: 166495 - DNA, 19 bp, Homo sapiens
tccctgaaaacccagagag

SEQ ID NO: 166496 - DNA, 15 bp, Homo sapiens
tccctgaagccagcc

SEQ ID NO: 166497 - DNA, 21 bp, Homo sapiens
tccctgacctccctctaattt

SEQ ID NO: 166498 - DNA, 16 bp, Homo sapiens
tccctgactcattctg

SEQ ID NO: 166499 - DNA, 15 bp, Homo sapiens
tccctgactgggagt

SEQ ID NO: 166500 - DNA, 17 bp, Homo sapiens
tccctgcatttctgagt

SEQ ID NO: 166501 - DNA, 13 bp, Homo sapiens
tccctgccagctc

SEQ ID NO: 166502 - DNA, 18 bp, Homo sapiens
tccctggcttgtaactcc

SEQ ID NO: 166503 - DNA, 20 bp, Homo sapiens
tccctgggggaagccctgga

SEQ ID NO: 166504 - DNA, 14 bp, Homo sapiens
tccctgtcaccaag

SEQ ID NO: 166505 - DNA, 11 bp, Homo sapiens
tccctgtttaa

SEQ ID NO: 166506 - DNA, 16 bp, Homo sapiens
tccctgtttaatattt

SEQ ID NO: 166507 - DNA, 22 bp, Homo sapiens
tcccttcaaccattccccatgg

SEQ ID NO: 166508 - DNA, 17 bp, Homo sapiens
tcccttctgtccctcac

SEQ ID NO: 166509 - DNA, 22 bp, Homo sapiens
tcccttctgtccctcacagcac

SEQ ID NO: 166510 - DNA, 13 bp, Homo sapiens
tcccttgagacct

SEQ ID NO: 166511 - DNA, 17 bp, Homo sapiens
tcccttgagacctcagc

SEQ ID NO: 166512 - DNA, 19 bp, Homo sapiens
tcccttggtggcaagagcc

SEQ ID NO: 166513 - DNA, 15 bp, Homo sapiens
tccctttgaaatgaa

SEQ ID NO: 166514 - DNA, 20 bp, Homo sapiens
tccctttttatatcccattt

SEQ ID NO: 166515 - DNA, 12 bp, Homo sapiens
tccgaggcaggg

SEQ ID NO: 166516 - DNA, 14 bp, Homo sapiens
tccgaggcagggtc

SEQ ID NO: 166517 - DNA, 17 bp, Homo sapiens
tccggtccctgtcccag

SEQ ID NO: 166518 - DNA, 16 bp, Homo sapiens
tccgtaacccaactct

SEQ ID NO: 166519 - DNA, 13 bp, Homo sapiens
tccgtatttcaga

SEQ ID NO: 166520 - DNA, 20 bp, Homo sapiens
tccgtctaagtcatgagctg

SEQ ID NO: 166521 - DNA, 18 bp, Homo sapiens
tcctaataaagttctgta

SEQ ID NO: 166522 - DNA, 14 bp, Homo sapiens
tcctaatcatccaa

SEQ ID NO: 166523 - DNA, 22 bp, Homo sapiens
tcctaatgaatgcataaaatgt

SEQ ID NO: 166524 - DNA, 15 bp, Homo sapiens
tcctacaaagatgtt

SEQ ID NO: 166525 - DNA, 14 bp, Homo sapiens
tcctaggaaaatac

SEQ ID NO: 166526 - DNA, 13 bp, Homo sapiens
tcctaggcatttg

SEQ ID NO: 166527 - DNA, 14 bp, Homo sapiens
tcctagtgaaagag

SEQ ID NO: 166528 - DNA, 18 bp, Homo sapiens
tcctatacgcagcgtgct

SEQ ID NO: 166529 - DNA, 19 bp, Homo sapiens
tcctatacgcagcgtgctt

SEQ ID NO: 166530 - DNA, 20 bp, Homo sapiens
tcctcaaaacttcagacata

SEQ ID NO: 166531 - DNA, 12 bp, Homo sapiens
tcctcaatccag

SEQ ID NO: 166532 - DNA, 20 bp, Homo sapiens
tcctcacatctttcacactt

SEQ ID NO: 166533 - DNA, 13 bp, Homo sapiens
tcctcacccctgt

SEQ ID NO: 166534 - DNA, 14 bp, Homo sapiens
tcctcacccctgtc

SEQ ID NO: 166535 - DNA, 17 bp, Homo sapiens
tcctcacccctgtcctc

SEQ ID NO: 166536 - DNA, 21 bp, Homo sapiens
tcctcactcccttcccataag

SEQ ID NO: 166537 - DNA, 15 bp, Homo sapiens
tcctcactgctccct

SEQ ID NO: 166538 - DNA, 18 bp, Homo sapiens
tcctcactggccatccct

SEQ ID NO: 166539 - DNA, 13 bp, Homo sapiens
tcctcaggctgct

SEQ ID NO: 166540 - DNA, 16 bp, Homo sapiens
tcctcagggacagaga

SEQ ID NO: 166541 - DNA, 22 bp, Homo sapiens
tcctcagggacagagacacctg

SEQ ID NO: 166542 - DNA, 24 bp, Homo sapiens
tcctcagggacagagacacctgca

SEQ ID NO: 166543 - DNA, 18 bp, Homo sapiens
tcctcattagcattttgc

SEQ ID NO: 166544 - DNA, 23 bp, Homo sapiens
tcctcatttggggtagctagagg

SEQ ID NO: 166545 - DNA, 19 bp, Homo sapiens
tcctccacgttctgctcat

SEQ ID NO: 166546 - DNA, 20 bp, Homo sapiens
tgcccaggagagccagccct

SEQ ID NO: 166547 - DNA, 17 bp, Homo sapiens
tgcccaggcctgcctgt

SEQ ID NO: 166548 - DNA, 17 bp, Homo sapiens
tgcccaggctggtctca

SEQ ID NO: 166549 - DNA, 21 bp, Homo sapiens
tgcccagggccactctgcctc

SEQ ID NO: 166550 - DNA, 22 bp, Homo sapiens
tgcccagggccactctgcctct

SEQ ID NO: 166551 - DNA, 14 bp, Homo sapiens
tgcccagggctcag

SEQ ID NO: 166552 - DNA, 15 bp, Homo sapiens
tgcccagggctcagc

SEQ ID NO: 166553 - DNA, 18 bp, Homo sapiens
tgcccagggctcagcctg

SEQ ID NO: 166554 - DNA, 13 bp, Homo sapiens
tgccccaactcct

SEQ ID NO: 166555 - DNA, 16 bp, Homo sapiens
tgccccgtgcagactg

SEQ ID NO: 166556 - DNA, 12 bp, Homo sapiens
tgcccctcccag

SEQ ID NO: 166557 - DNA, 21 bp, Homo sapiens
tgcccctcccagaacacactc

SEQ ID NO: 166558 - DNA, 20 bp, Homo sapiens
tgcccgtaaacacgcctgca

SEQ ID NO: 166559 - DNA, 13 bp, Homo sapiens
tgcccgtcttcag

SEQ ID NO: 166560 - DNA, 16 bp, Homo sapiens
tgcccgtcttcagcct

SEQ ID NO: 166561 - DNA, 20 bp, Homo sapiens
tgctttcgtctccagcccct

SEQ ID NO: 166562 - DNA, 17 bp, Homo sapiens
tgctttgggctgccctg

SEQ ID NO: 166563 - DNA, 20 bp, Homo sapiens
tgctttgggctgccctggtg

SEQ ID NO: 166564 - DNA, 21 bp, Homo sapiens
tgctttgggctgccctggtgc

SEQ ID NO: 166565 - DNA, 17 bp, Homo sapiens
tgcttttaaaaaaaaat

SEQ ID NO: 166566 - DNA, 22 bp, Homo sapiens
tgcttttccttggggcaggcag

SEQ ID NO: 166567 - DNA, 23 bp, Homo sapiens
tgctttttaatattgatatgctt

SEQ ID NO: 166568 - DNA, 17 bp, Homo sapiens
tggaaaacaaggaagtc

SEQ ID NO: 166569 - DNA, 19 bp, Homo sapiens
tggaaaagaatacagaaag

SEQ ID NO: 166570 - DNA, 11 bp, Homo sapiens
tggaaaataaa

SEQ ID NO: 166571 - DNA, 15 bp, Homo sapiens
tggaaaataaattat

SEQ ID NO: 166572 - DNA, 17 bp, Homo sapiens
tggaaactgttgccaga

SEQ ID NO: 166573 - DNA, 15 bp, Homo sapiens
tggaaaggagaggaa

SEQ ID NO: 166574 - DNA, 21 bp, Homo sapiens
tggaacaatctaaaagtttaa

SEQ ID NO: 166575 - DNA, 20 bp, Homo sapiens
tggaacataaaatacaatgt

SEQ ID NO: 166576 - DNA, 20 bp, Homo sapiens
tggaaccgcaggaagctgct

SEQ ID NO: 166577 - DNA, 19 bp, Homo sapiens
tggaactcattcctgcctg

SEQ ID NO: 166578 - DNA, 21 bp, Homo sapiens
tggaacttctaatatattttt

SEQ ID NO: 166579 - DNA, 14 bp, Homo sapiens
tggaagattttaaa

SEQ ID NO: 166580 - DNA, 17 bp, Homo sapiens
tggaagcatgtaggaga

SEQ ID NO: 166581 - DNA, 22 bp, Homo sapiens
tggaagcatgtaggagaatcca

SEQ ID NO: 166582 - DNA, 19 bp, Homo sapiens
tggaagccctccttccacg

SEQ ID NO: 166583 - DNA, 16 bp, Homo sapiens
tggaagctgtgtcctt

SEQ ID NO: 166584 - DNA, 20 bp, Homo sapiens
tggaatactaaaaatcatga

SEQ ID NO: 166585 - DNA, 22 bp, Homo sapiens
tggaatactaaaaatcatgaga

SEQ ID NO: 166586 - DNA, 13 bp, Homo sapiens
tggaatataaaga

SEQ ID NO: 166587 - DNA, 18 bp, Homo sapiens
tggacaccaggagtccct

SEQ ID NO: 166588 - DNA, 20 bp, Homo sapiens
tggacaccaggagtccctgg

SEQ ID NO: 166589 - DNA, 18 bp, Homo sapiens
tggacatgaagattcttt

SEQ ID NO: 166590 - DNA, 22 bp, Homo sapiens
tggacatgaagattctttccca

SEQ ID NO: 166591 - DNA, 18 bp, Homo sapiens
tggaccagtggtctcaca

SEQ ID NO: 166592 - DNA, 18 bp, Homo sapiens
tggactattataatttaa

SEQ ID NO: 166593 - DNA, 16 bp, Homo sapiens
tggactcaggatgccc

SEQ ID NO: 166594 - DNA, 18 bp, Homo sapiens
tggactcaggatgcccag

SEQ ID NO: 166595 - DNA, 21 bp, Homo sapiens
tggacttagaaagcaggggct

SEQ ID NO: 166596 - DNA, 13 bp, Homo sapiens
tggactttcctgc

SEQ ID NO: 166597 - DNA, 18 bp, Homo sapiens
tggactttcctgcaactc

SEQ ID NO: 166598 - DNA, 14 bp, Homo sapiens
tggagaactagaga

SEQ ID NO: 166599 - DNA, 19 bp, Homo sapiens
tggagaagagaggagagga

SEQ ID NO: 166600 - DNA, 13 bp, Homo sapiens
tggagaagcggct

SEQ ID NO: 166601 - DNA, 21 bp, Homo sapiens
tggagaagctccctgaagtaa

SEQ ID NO: 166602 - DNA, 14 bp, Homo sapiens
tggagaattatata

SEQ ID NO: 166603 - DNA, 13 bp, Homo sapiens
tggagacagcccc

SEQ ID NO: 166604 - DNA, 20 bp, Homo sapiens
tggagacagccccagagcag

SEQ ID NO: 166605 - DNA, 17 bp, Homo sapiens
tggagactgtctcaaga

SEQ ID NO: 166606 - DNA, 21 bp, Homo sapiens
tggagagaaacaataaagaga

SEQ ID NO: 166607 - DNA, 13 bp, Homo sapiens
tggagagggatga

SEQ ID NO: 166608 - DNA, 17 bp, Homo sapiens
tggagccaagggttcag

SEQ ID NO: 166609 - DNA, 20 bp, Homo sapiens
tggagcccagggagcggaaa

SEQ ID NO: 166610 - DNA, 21 bp, Homo sapiens
tggagcttcatggcagaaggc

SEQ ID NO: 166611 - DNA, 21 bp, Homo sapiens
tggaggaaaaccaagccgtgg

SEQ ID NO: 166612 - DNA, 14 bp, Homo sapiens
tggaggagaagaat

SEQ ID NO: 166613 - DNA, 16 bp, Homo sapiens
tggaggaggaggcaat

SEQ ID NO: 166614 - DNA, 21 bp, Homo sapiens
tggaggccgggtgctcagggc

SEQ ID NO: 166615 - DNA, 22 bp, Homo sapiens
tggaggctgtcttctcaggctc

SEQ ID NO: 166616 - DNA, 20 bp, Homo sapiens
tggaggggcatggccagcag

SEQ ID NO: 166617 - DNA, 20 bp, Homo sapiens
tggaggttaaggctgaggaa

SEQ ID NO: 166618 - DNA, 24 bp, Homo sapiens
tggaggttaaggctgaggaaaggc

SEQ ID NO: 166619 - DNA, 14 bp, Homo sapiens
tggagtccagtctc

SEQ ID NO: 166620 - DNA, 15 bp, Homo sapiens
tggagtccagtctct

SEQ ID NO: 166621 - DNA, 22 bp, Homo sapiens
tggagtgttccccttccactga

SEQ ID NO: 166622 - DNA, 22 bp, Homo sapiens
tggatgaagattctcctgtgct

SEQ ID NO: 166623 - DNA, 20 bp, Homo sapiens
tggatgatggtcttcagcct

SEQ ID NO: 166624 - DNA, 14 bp, Homo sapiens
tggattattcattt

SEQ ID NO: 166625 - DNA, 19 bp, Homo sapiens
tggattattcatttaaaat

SEQ ID NO: 166626 - DNA, 20 bp, Homo sapiens
tggattattcatttaaaatg

SEQ ID NO: 166627 - DNA, 16 bp, Homo sapiens
tggcaaaaaggcagga

SEQ ID NO: 166628 - DNA, 13 bp, Homo sapiens
tggcaacagaagc

SEQ ID NO: 166629 - DNA, 16 bp, Homo sapiens
tggcaagcccctgccc

SEQ ID NO: 166630 - DNA, 13 bp, Homo sapiens
tggcaagctgtga

SEQ ID NO: 166631 - DNA, 18 bp, Homo sapiens
tggcacagttttctgaga

SEQ ID NO: 166632 - DNA, 20 bp, Homo sapiens
tggcacagttttctgagaaa

SEQ ID NO: 166633 - DNA, 16 bp, Homo sapiens
tggcagagttgtaaat

SEQ ID NO: 166634 - DNA, 17 bp, Homo sapiens
tggcagagttgtaaata

SEQ ID NO: 166635 - DNA, 21 bp, Homo sapiens
tggcagataatcagcctctta

SEQ ID NO: 166636 - DNA, 18 bp, Homo sapiens
tggcagccgtgccttcag

SEQ ID NO: 166637 - DNA, 19 bp, Homo sapiens
tggcaggagttggaagtgt

SEQ ID NO: 166638 - DNA, 13 bp, Homo sapiens
tggcagtctatat

SEQ ID NO: 166639 - DNA, 17 bp, Homo sapiens
tggcagtgagtgagcct

SEQ ID NO: 166640 - DNA, 18 bp, Homo sapiens
tggcagtgagtgagcctg

SEQ ID NO: 166641 - DNA, 19 bp, Homo sapiens
tggcatgccttccagcacc

SEQ ID NO: 166642 - DNA, 20 bp, Homo sapiens
tggccactccagacccctgg

SEQ ID NO: 166643 - DNA, 13 bp, Homo sapiens
tggccagcagctt

SEQ ID NO: 166644 - DNA, 21 bp, Homo sapiens
tggccagccaacttttgcatg

SEQ ID NO: 166645 - DNA, 15 bp, Homo sapiens
tggccaggtggccac

SEQ ID NO: 166646 - DNA, 17 bp, Homo sapiens
tggccaggtggccactc

SEQ ID NO: 166647 - DNA, 13 bp, Homo sapiens
tggcccacgcact

SEQ ID NO: 166648 - DNA, 22 bp, Homo sapiens
tggcccagccaaaccctgtctg

SEQ ID NO: 166649 - DNA, 15 bp, Homo sapiens
tggcccagctcccca

SEQ ID NO: 166650 - DNA, 23 bp, Homo sapiens
tggccccatgtctctcagaattc

SEQ ID NO: 166651 - DNA, 16 bp, Homo sapiens
tggcccgacagcctgg

SEQ ID NO: 166652 - DNA, 16 bp, Homo sapiens
tggccctcacccctgc

SEQ ID NO: 166653 - DNA, 11 bp, Homo sapiens
tggccctgcct

SEQ ID NO: 166654 - DNA, 16 bp, Homo sapiens
tggccctgccttcttc

SEQ ID NO: 166655 - DNA, 13 bp, Homo sapiens
tggccctggggtc

SEQ ID NO: 166656 - DNA, 13 bp, Homo sapiens
tggccctgtccct

SEQ ID NO: 166657 - DNA, 20 bp, Homo sapiens
tggccctgtccctcccacct

SEQ ID NO: 166658 - DNA, 17 bp, Homo sapiens
tggcctattatattaaa

SEQ ID NO: 166659 - DNA, 21 bp, Homo sapiens
tggcctattatattaaaatat

SEQ ID NO: 166660 - DNA, 23 bp, Homo sapiens
tggcctcgggacacctgccctgc

SEQ ID NO: 166661 - DNA, 14 bp, Homo sapiens
tggcctgagaagag

SEQ ID NO: 166662 - DNA, 22 bp, Homo sapiens
tggcctgctgggctctccacct

SEQ ID NO: 166663 - DNA, 18 bp, Homo sapiens
tggcctgtttcaacacag

SEQ ID NO: 166664 - DNA, 16 bp, Homo sapiens
tggccttccccagcct

SEQ ID NO: 166665 - DNA, 13 bp, Homo sapiens
tggcgctaggcat

SEQ ID NO: 166666 - DNA, 13 bp, Homo sapiens
tggctataaatat

SEQ ID NO: 166667 - DNA, 21 bp, Homo sapiens
tggctatatggcaagaaagct

SEQ ID NO: 166668 - DNA, 19 bp, Homo sapiens
tggctcatattcctgcagc

SEQ ID NO: 166669 - DNA, 20 bp, Homo sapiens
tggctcccacaggcccttcc

SEQ ID NO: 166670 - DNA, 18 bp, Homo sapiens
tggctcctcccggtgccc

SEQ ID NO: 166671 - DNA, 19 bp, Homo sapiens
tggctcctcccggtgccca

SEQ ID NO: 166672 - DNA, 11 bp, Homo sapiens
tggctctgctg

SEQ ID NO: 166673 - DNA, 13 bp, Homo sapiens
tggctctggagac

SEQ ID NO: 166674 - DNA, 22 bp, Homo sapiens
tggctctggagacagccccaga

SEQ ID NO: 166675 - DNA, 20 bp, Homo sapiens
tggctgacccagtccctggg

SEQ ID NO: 166676 - DNA, 21 bp, Homo sapiens
tggctgacccagtccctgggg

SEQ ID NO: 166677 - DNA, 17 bp, Homo sapiens
tggctgcggcacccttg

SEQ ID NO: 166678 - DNA, 15 bp, Homo sapiens
tggctgctagcactt

SEQ ID NO: 166679 - DNA, 19 bp, Homo sapiens
tggctggatgaaattttct

SEQ ID NO: 166680 - DNA, 22 bp, Homo sapiens
tggctggctaactggaagcatg

SEQ ID NO: 166681 - DNA, 15 bp, Homo sapiens
tggctggtccagggc

SEQ ID NO: 166682 - DNA, 16 bp, Homo sapiens
tggctggtccagggct

SEQ ID NO: 166683 - DNA, 19 bp, Homo sapiens
tggctgtgcctctgcctgt

SEQ ID NO: 166684 - DNA, 22 bp, Homo sapiens
tggctgtgcctctgcctgtctc

SEQ ID NO: 166685 - DNA, 19 bp, Homo sapiens
tggctgtgtctaaactgca

SEQ ID NO: 166686 - DNA, 14 bp, Homo sapiens
tggcttaatgttta

SEQ ID NO: 166687 - DNA, 15 bp, Homo sapiens
tggcttaatgtttat

SEQ ID NO: 166688 - DNA, 17 bp, Homo sapiens
tggcttcccgctcagcc

SEQ ID NO: 166689 - DNA, 19 bp, Homo sapiens
tggcttcccgctcagccct

SEQ ID NO: 166690 - DNA, 21 bp, Homo sapiens
tggcttcccgctcagccctcc

SEQ ID NO: 166691 - DNA, 22 bp, Homo sapiens
tggcttcccgctcagccctccc

SEQ ID NO: 166692 - DNA, 13 bp, Homo sapiens
tggcttctcatac

SEQ ID NO: 166693 - DNA, 19 bp, Homo sapiens
tggcttttcactgctggct

SEQ ID NO: 166694 - DNA, 14 bp, Homo sapiens
tgggaaagcattgt

SEQ ID NO: 166695 - DNA, 17 bp, Homo sapiens
tgggaaataagagagaa

SEQ ID NO: 166696 - DNA, 18 bp, Homo sapiens
tgggaacgtgactgcccc

SEQ ID NO: 166697 - DNA, 21 bp, Homo sapiens
tgggaagacgcctgagctcac

SEQ ID NO: 166698 - DNA, 13 bp, Homo sapiens
tgggaagggagag

SEQ ID NO: 166699 - DNA, 20 bp, Homo sapiens
tgggaatgttacattgtttg

SEQ ID NO: 166700 - DNA, 16 bp, Homo sapiens
tgggacagggcatggc

SEQ ID NO: 166701 - DNA, 17 bp, Homo sapiens
tgggaccctttccttcc

SEQ ID NO: 166702 - DNA, 15 bp, Homo sapiens
tgtaggcagacacag

SEQ ID NO: 166703 - DNA, 16 bp, Homo sapiens
tgtaggcagacacagg

SEQ ID NO: 166704 - DNA, 14 bp, Homo sapiens
tgtagtctcaggac

SEQ ID NO: 166705 - DNA, 15 bp, Homo sapiens
tgtagttaggaaata

SEQ ID NO: 166706 - DNA, 18 bp, Homo sapiens
tgtataacttcttaaaag

SEQ ID NO: 166707 - DNA, 17 bp, Homo sapiens
tgtataagtaagaaaat

SEQ ID NO: 166708 - DNA, 17 bp, Homo sapiens
tgtatatatattaagag

SEQ ID NO: 166709 - DNA, 21 bp, Homo sapiens
tgtatattatggaagatttta

SEQ ID NO: 166710 - DNA, 15 bp, Homo sapiens
tgtatcacaaatctt

SEQ ID NO: 166711 - DNA, 19 bp, Homo sapiens
tgtatccatgggggcaggg

SEQ ID NO: 166712 - DNA, 15 bp, Homo sapiens
tgtatcggatgcttt

SEQ ID NO: 166713 - DNA, 20 bp, Homo sapiens
tgtatctgatagctctttgg

SEQ ID NO: 166714 - DNA, 22 bp, Homo sapiens
tgtatctgcaggcagacacgga

SEQ ID NO: 166715 - DNA, 18 bp, Homo sapiens
tgtatgcacgtgtgcaca

SEQ ID NO: 166716 - DNA, 19 bp, Homo sapiens
tgtatggaatacagtgtta

SEQ ID NO: 166717 - DNA, 10 bp, Homo sapiens
tgtatgtaaa

SEQ ID NO: 166718 - DNA, 14 bp, Homo sapiens
tgtatgtaaatgtg

SEQ ID NO: 166719 - DNA, 21 bp, Homo sapiens
tgtatgtcagacatccatgtt

SEQ ID NO: 166720 - DNA, 13 bp, Homo sapiens
tgtatgtttacat

SEQ ID NO: 166721 - DNA, 22 bp, Homo sapiens
tgtattctagctaatgtaataa

SEQ ID NO: 166722 - DNA, 21 bp, Homo sapiens
tgtattctctgagctgtgcag

SEQ ID NO: 166723 - DNA, 22 bp, Homo sapiens
tgtattgaacttggaaagaaat

SEQ ID NO: 166724 - DNA, 14 bp, Homo sapiens
tgtatttataaata

SEQ ID NO: 166725 - DNA, 23 bp, Homo sapiens
tgtatttccccaacatgtaataa

SEQ ID NO: 166726 - DNA, 23 bp, Homo sapiens
tgtcaaaaatgtcttgggtaggc

SEQ ID NO: 166727 - DNA, 12 bp, Homo sapiens
tgtcaaagcagg

SEQ ID NO: 166728 - DNA, 12 bp, Homo sapiens
tgtcacagggcc

SEQ ID NO: 166729 - DNA, 14 bp, Homo sapiens
tgtcacagggccaa

SEQ ID NO: 166730 - DNA, 16 bp, Homo sapiens
tgtcaccaccttccca

SEQ ID NO: 166731 - DNA, 21 bp, Homo sapiens
tgtcaccaccttcccagctct

SEQ ID NO: 166732 - DNA, 15 bp, Homo sapiens
tgtcagatatgatat

SEQ ID NO: 166733 - DNA, 21 bp, Homo sapiens
tgtcagatattttttcagaaa

SEQ ID NO: 166734 - DNA, 19 bp, Homo sapiens
tgtcagcaaaaagcaaaat

SEQ ID NO: 166735 - DNA, 17 bp, Homo sapiens
tgtcataagaatgaata

SEQ ID NO: 166736 - DNA, 23 bp, Homo sapiens
tgtcatttgctggagctctgccc

SEQ ID NO: 166737 - DNA, 15 bp, Homo sapiens
tgtccaacctaaccc

SEQ ID NO: 166738 - DNA, 18 bp, Homo sapiens
tgtccaagtgtgtgtgcg

SEQ ID NO: 166739 - DNA, 13 bp, Homo sapiens
tgtccacctggcc

SEQ ID NO: 166740 - DNA, 15 bp, Homo sapiens
tgtccacctggcccc

SEQ ID NO: 166741 - DNA, 14 bp, Homo sapiens
tgtccagcgcctag

SEQ ID NO: 166742 - DNA, 19 bp, Homo sapiens
tgtccaggcactgctgccc

SEQ ID NO: 166743 - DNA, 19 bp, Homo sapiens
tgtccagggccctgagctc

SEQ ID NO: 166744 - DNA, 14 bp, Homo sapiens
tgtccattgtccaa

SEQ ID NO: 166745 - DNA, 18 bp, Homo sapiens
tgtcccatggacactcca

SEQ ID NO: 166746 - DNA, 22 bp, Homo sapiens
tgtcccatggacactccagtgc

SEQ ID NO: 166747 - DNA, 20 bp, Homo sapiens
tgtcccatttctaaaggcct

SEQ ID NO: 166748 - DNA, 21 bp, Homo sapiens
tgtccctaccgagtctcttct

SEQ ID NO: 166749 - DNA, 15 bp, Homo sapiens
tgtccctcccacctc

SEQ ID NO: 166750 - DNA, 20 bp, Homo sapiens
tgtccctcccacctctgtga

SEQ ID NO: 166751 - DNA, 21 bp, Homo sapiens
tgtccctgtcaccaagctcac

SEQ ID NO: 166752 - DNA, 18 bp, Homo sapiens
tgtcccttctgtccctca

SEQ ID NO: 166753 - DNA, 22 bp, Homo sapiens
tgtcccttgcctcaatgccagt

SEQ ID NO: 166754 - DNA, 13 bp, Homo sapiens
tgtccgagctttg

SEQ ID NO: 166755 - DNA, 19 bp, Homo sapiens
tgtcctcactgctccctga

SEQ ID NO: 166756 - DNA, 22 bp, Homo sapiens
tgtcctcactgctccctgaagc

SEQ ID NO: 166757 - DNA, 17 bp, Homo sapiens
tgtcctcccatcccctg

SEQ ID NO: 166758 - DNA, 22 bp, Homo sapiens
tgtcctcccatcccctggactg

SEQ ID NO: 166759 - DNA, 23 bp, Homo sapiens
tgtcctcccatcccctggactgg

SEQ ID NO: 166760 - DNA, 10 bp, Homo sapiens
tgtcctcctc

SEQ ID NO: 166761 - DNA, 20 bp, Homo sapiens
tgtccttacccatctgcacc

SEQ ID NO: 166762 - DNA, 16 bp, Homo sapiens
tgtccttccctgcatt

SEQ ID NO: 166763 - DNA, 22 bp, Homo sapiens
tgtccttccctgcatttctgag

SEQ ID NO: 166764 - DNA, 18 bp, Homo sapiens
tgtccttctctcacctcc

SEQ ID NO: 166765 - DNA, 19 bp, Homo sapiens
tgtccttctctcacctcct

SEQ ID NO: 166766 - DNA, 21 bp, Homo sapiens
tgtctcaaaaaaagaaaaaga

SEQ ID NO: 166767 - DNA, 19 bp, Homo sapiens
tgtctcaagagggcactgg

SEQ ID NO: 166768 - DNA, 14 bp, Homo sapiens
tgtctcagcctccc

SEQ ID NO: 166769 - DNA, 17 bp, Homo sapiens
tgtctcaggtccctgca

SEQ ID NO: 166770 - DNA, 11 bp, Homo sapiens
tgtctcatcca

SEQ ID NO: 166771 - DNA, 11 bp, Homo sapiens
tgtctcatccc

SEQ ID NO: 166772 - DNA, 21 bp, Homo sapiens
tgtctcttccatatgacctca

SEQ ID NO: 166773 - DNA, 17 bp, Homo sapiens
tgtctgaagtcactgca

SEQ ID NO: 166774 - DNA, 18 bp, Homo sapiens
tgtctgaagtcactgcac

SEQ ID NO: 166775 - DNA, 19 bp, Homo sapiens
tgtctgaagtcactgcaca

SEQ ID NO: 166776 - DNA, 17 bp, Homo sapiens
tgtctgagccctcaaag

SEQ ID NO: 166777 - DNA, 19 bp, Homo sapiens
tgtctgccagccagcagcc

SEQ ID NO: 166778 - DNA, 21 bp, Homo sapiens
tgtctgtgtgcaagtgtgtgc

SEQ ID NO: 166779 - DNA, 15 bp, Homo sapiens
tgtcttcatagcaga

SEQ ID NO: 166780 - DNA, 23 bp, Homo sapiens
tgtcttctcaggctctgccctgc

SEQ ID NO: 166781 - DNA, 15 bp, Homo sapiens
tgtgaaaagaaaaat

SEQ ID NO: 166782 - DNA, 22 bp, Homo sapiens
tgtgaaaatggtccaggagaag

SEQ ID NO: 166783 - DNA, 22 bp, Homo sapiens
tgtgaagatcacgttccttccc

SEQ ID NO: 166784 - DNA, 14 bp, Homo sapiens
tgtgaagtttacat

SEQ ID NO: 166785 - DNA, 20 bp, Homo sapiens
tgtgaagtttacattgtaaa

SEQ ID NO: 166786 - DNA, 14 bp, Homo sapiens
tgtgaatcagaccc

SEQ ID NO: 166787 - DNA, 13 bp, Homo sapiens
tgtgaattcagat

SEQ ID NO: 166788 - DNA, 19 bp, Homo sapiens
tgtgacatgcgggctgggc

SEQ ID NO: 166789 - DNA, 16 bp, Homo sapiens
tgtgaccaatgtcttg

SEQ ID NO: 166790 - DNA, 13 bp, Homo sapiens
tgtgacctcaggc

SEQ ID NO: 166791 - DNA, 14 bp, Homo sapiens
tgtgacctcaggca

SEQ ID NO: 166792 - DNA, 18 bp, Homo sapiens
tgtgacttcagctctgtt

SEQ ID NO: 166793 - DNA, 15 bp, Homo sapiens
tgtgacttctccagg

SEQ ID NO: 166794 - DNA, 19 bp, Homo sapiens
tgtgagcaagcatttatgt

SEQ ID NO: 166795 - DNA, 21 bp, Homo sapiens
tgtgagcccctggtcctgagg

SEQ ID NO: 166796 - DNA, 13 bp, Homo sapiens
tgtgaggccaggg

SEQ ID NO: 166797 - DNA, 13 bp, Homo sapiens
tgtgaggcccctg

SEQ ID NO: 166798 - DNA, 21 bp, Homo sapiens
tgtgaggtgcagagtgcccag

SEQ ID NO: 166799 - DNA, 20 bp, Homo sapiens
tgtgagtgtgtccaagtgtg

SEQ ID NO: 166800 - DNA, 16 bp, Homo sapiens
tgtgagtttaaagcaa

SEQ ID NO: 166801 - DNA, 23 bp, Homo sapiens
tgtgagtttaccttgtatactgt

SEQ ID NO: 166802 - DNA, 18 bp, Homo sapiens
tgtgataaggatcagaac

SEQ ID NO: 166803 - DNA, 17 bp, Homo sapiens
tgtgatccttttatgtt

SEQ ID NO: 166804 - DNA, 13 bp, Homo sapiens
tgtgatcgtctga

SEQ ID NO: 166805 - DNA, 20 bp, Homo sapiens
tgtgattcctttgaagagga

SEQ ID NO: 166806 - DNA, 12 bp, Homo sapiens
tgtgcaaatcct

SEQ ID NO: 166807 - DNA, 15 bp, Homo sapiens
tgtgcaaattaacag

SEQ ID NO: 166808 - DNA, 16 bp, Homo sapiens
tgtgcaagtgtatgca

SEQ ID NO: 166809 - DNA, 13 bp, Homo sapiens
tgtgcaccagggt

SEQ ID NO: 166810 - DNA, 21 bp, Homo sapiens
tgtgcaccttaccaactttct

SEQ ID NO: 166811 - DNA, 16 bp, Homo sapiens
tgtgcaggtggggaga

SEQ ID NO: 166812 - DNA, 20 bp, Homo sapiens
tgtgcagtgaaggttgctga

SEQ ID NO: 166813 - DNA, 15 bp, Homo sapiens
tgtgcatgtgtgtgc

SEQ ID NO: 166814 - DNA, 23 bp, Homo sapiens
tgtgcattcttttaaaagacaag

SEQ ID NO: 166815 - DNA, 12 bp, Homo sapiens
tgtgcctcggct

SEQ ID NO: 166816 - DNA, 13 bp, Homo sapiens
tgtgcctctggga

SEQ ID NO: 166817 - DNA, 15 bp, Homo sapiens
tgtgccttttatagc

SEQ ID NO: 166818 - DNA, 13 bp, Homo sapiens
tgtgctagatgtg

SEQ ID NO: 166819 - DNA, 18 bp, Homo sapiens
tgtgctcaggactcagaa

SEQ ID NO: 166820 - DNA, 19 bp, Homo sapiens
tgtgctggatggagcccag

SEQ ID NO: 166821 - DNA, 21 bp, Homo sapiens
tgtggaggtacactcttatag

SEQ ID NO: 166822 - DNA, 15 bp, Homo sapiens
tgtggctgtcagcag

SEQ ID NO: 166823 - DNA, 12 bp, Homo sapiens
tgtgggaacaga

SEQ ID NO: 166824 - DNA, 19 bp, Homo sapiens
tgtgggatgttcagcactg

SEQ ID NO: 166825 - DNA, 22 bp, Homo sapiens
tgtgggatgttcagcactgtcc

SEQ ID NO: 166826 - DNA, 15 bp, Homo sapiens
tgtggggccaggtca

SEQ ID NO: 166827 - DNA, 14 bp, Homo sapiens
tgtggtttatgtca

SEQ ID NO: 166828 - DNA, 21 bp, Homo sapiens
tgtgtaacaattttaatgcta

SEQ ID NO: 166829 - DNA, 15 bp, Homo sapiens
tgtgtacgtggagag

SEQ ID NO: 166830 - DNA, 19 bp, Homo sapiens
tgtgtattaaaaaaaacaa

SEQ ID NO: 166831 - DNA, 19 bp, Homo sapiens
tgtgtccaagtgtgtgtgc

SEQ ID NO: 166832 - DNA, 17 bp, Homo sapiens
tgtgtccacgactgtct

SEQ ID NO: 166833 - DNA, 18 bp, Homo sapiens
tgtgtccatgtgtgtgca

SEQ ID NO: 166834 - DNA, 20 bp, Homo sapiens
tgtgtccttgcacctgcatc

SEQ ID NO: 166835 - DNA, 22 bp, Homo sapiens
tgtgtctaaatttgaatgttaa

SEQ ID NO: 166836 - DNA, 13 bp, Homo sapiens
tgtgtctacagag

SEQ ID NO: 166837 - DNA, 17 bp, Homo sapiens
tgtgtgatgaactttct

SEQ ID NO: 166838 - DNA, 23 bp, Homo sapiens
tgtgtgcaccttaccaactttct

SEQ ID NO: 166839 - DNA, 13 bp, Homo sapiens
tgtgtgcagtgaa

SEQ ID NO: 166840 - DNA, 23 bp, Homo sapiens
tgtgtgccatagagtttaacaca

SEQ ID NO: 166841 - DNA, 22 bp, Homo sapiens
tgtgtgtccacgactgtctcca

SEQ ID NO: 166842 - DNA, 14 bp, Homo sapiens
tgtgttatttaaat

SEQ ID NO: 166843 - DNA, 22 bp, Homo sapiens
tgtgttgggattgagtctgtgc

SEQ ID NO: 166844 - DNA, 18 bp, Homo sapiens
ttacttaggtgtggggga

SEQ ID NO: 166845 - DNA, 21 bp, Homo sapiens
ttactttcctttccccagccc

SEQ ID NO: 166846 - DNA, 14 bp, Homo sapiens
ttagaaaccttaat

SEQ ID NO: 166847 - DNA, 18 bp, Homo sapiens
ttagaaaccttaatatgt

SEQ ID NO: 166848 - DNA, 13 bp, Homo sapiens
ttagaatgaaaat

SEQ ID NO: 166849 - DNA, 15 bp, Homo sapiens
ttagaccacaaatag

SEQ ID NO: 166850 - DNA, 11 bp, Homo sapiens
ttagacctcag

SEQ ID NO: 166851 - DNA, 12 bp, Homo sapiens
ttagacctcagc

SEQ ID NO: 166852 - DNA, 13 bp, Homo sapiens
ttagacctcagcc

SEQ ID NO: 166853 - DNA, 14 bp, Homo sapiens
ttagacctcagcct

SEQ ID NO: 166854 - DNA, 16 bp, Homo sapiens
ttagacctcagcctgt

SEQ ID NO: 166855 - DNA, 21 bp, Homo sapiens
ttagagcagatgacccctccc

SEQ ID NO: 166856 - DNA, 19 bp, Homo sapiens
ttagaggaaaaaaatgact

SEQ ID NO: 166857 - DNA, 12 bp, Homo sapiens
ttagaggccagc

SEQ ID NO: 166858 - DNA, 20 bp, Homo sapiens
ttagatgttctaagtctttc

SEQ ID NO: 166859 - DNA, 13 bp, Homo sapiens
ttagcaaagagtt

SEQ ID NO: 166860 - DNA, 19 bp, Homo sapiens
ttagcaaagagttaatata

SEQ ID NO: 166861 - DNA, 15 bp, Homo sapiens
ttagcagcttccaga

SEQ ID NO: 166862 - DNA, 15 bp, Homo sapiens
ttagctgtgtgaaat

SEQ ID NO: 166863 - DNA, 17 bp, Homo sapiens
ttagcttagacctcagc

SEQ ID NO: 166864 - DNA, 19 bp, Homo sapiens
tctcaggctggtgggaggg

SEQ ID NO: 166865 - DNA, 13 bp, Homo sapiens
tctcagggcctgg

SEQ ID NO: 166866 - DNA, 14 bp, Homo sapiens
tctcagggcctggt

SEQ ID NO: 166867 - DNA, 15 bp, Homo sapiens
tctcagtcagtaatt

SEQ ID NO: 166868 - DNA, 23 bp, Homo sapiens
tctcagtccatgaagatgtagag

SEQ ID NO: 166869 - DNA, 15 bp, Homo sapiens
tctcagtctctgagc

SEQ ID NO: 166870 - DNA, 21 bp, Homo sapiens
tctcagtgtcaatgcagcccc

SEQ ID NO: 166871 - DNA, 14 bp, Homo sapiens
tctcatacgtccac

SEQ ID NO: 166872 - DNA, 17 bp, Homo sapiens
tctcatacgtccaccat

SEQ ID NO: 166873 - DNA, 19 bp, Homo sapiens
tctcataggaaaagtacat

SEQ ID NO: 166874 - DNA, 22 bp, Homo sapiens
tctcataggaaaagtacattta

SEQ ID NO: 166875 - DNA, 23 bp, Homo sapiens
tctcataggaaaagtacatttaa

SEQ ID NO: 166876 - DNA, 14 bp, Homo sapiens
tctcatccatcatc

SEQ ID NO: 166877 - DNA, 10 bp, Homo sapiens
tctcatccca

SEQ ID NO: 166878 - DNA, 20 bp, Homo sapiens
tctcatggagaagcagaaat

SEQ ID NO: 166879 - DNA, 22 bp, Homo sapiens
tctcatggagaagcagaaatac

SEQ ID NO: 166880 - DNA, 16 bp, Homo sapiens
tctcattccccaggtg

SEQ ID NO: 166881 - DNA, 20 bp, Homo sapiens
tctcattggacccttccatg

SEQ ID NO: 166882 - DNA, 17 bp, Homo sapiens
tctccacctcagccttg

SEQ ID NO: 166883 - DNA, 16 bp, Homo sapiens
tctccacctgctccca

SEQ ID NO: 166884 - DNA, 22 bp, Homo sapiens
tctccagccccttctcagaatc

SEQ ID NO: 166885 - DNA, 18 bp, Homo sapiens
tctccatggccctgcaaa

SEQ ID NO: 166886 - DNA, 16 bp, Homo sapiens
tctcccacgtgggaga

SEQ ID NO: 166887 - DNA, 18 bp, Homo sapiens
tctcccagataatgtgaa

SEQ ID NO: 166888 - DNA, 18 bp, Homo sapiens
tctcccaggccaggctcc

SEQ ID NO: 166889 - DNA, 15 bp, Homo sapiens
tctcccagtcattta

SEQ ID NO: 166890 - DNA, 17 bp, Homo sapiens
tctcccctgccctgctg

SEQ ID NO: 166891 - DNA, 18 bp, Homo sapiens
tctccctctcctgcctac

SEQ ID NO: 166892 - DNA, 14 bp, Homo sapiens
tctccctctggccc

SEQ ID NO: 166893 - DNA, 16 bp, Homo sapiens
tctccctctggccctg

SEQ ID NO: 166894 - DNA, 18 bp, Homo sapiens
tctccctctggccctgcc

SEQ ID NO: 166895 - DNA, 20 bp, Homo sapiens
tctccctctggccctgcctt

SEQ ID NO: 166896 - DNA, 17 bp, Homo sapiens
tctcctagactgaccct

SEQ ID NO: 166897 - DNA, 23 bp, Homo sapiens
tctcctagactgaccctgatcag

SEQ ID NO: 166898 - DNA, 14 bp, Homo sapiens
tctcctcctgccca

SEQ ID NO: 166899 - DNA, 16 bp, Homo sapiens
tctcctctcccctcta

SEQ ID NO: 166900 - DNA, 23 bp, Homo sapiens
tctcctcttaaaaaataaaaact

SEQ ID NO: 166901 - DNA, 16 bp, Homo sapiens
tctcctcttgccactg

SEQ ID NO: 166902 - DNA, 17 bp, Homo sapiens
tctcctcttgccactgc

SEQ ID NO: 166903 - DNA, 22 bp, Homo sapiens
tctcctcttgccactgcctctt

SEQ ID NO: 166904 - DNA, 22 bp, Homo sapiens
tctcctgcctgtagcagtgaga

SEQ ID NO: 166905 - DNA, 20 bp, Homo sapiens
tctcctgccttcctcctggg

SEQ ID NO: 166906 - DNA, 23 bp, Homo sapiens
tctcctttcaccccagggcctga

SEQ ID NO: 166907 - DNA, 17 bp, Homo sapiens
tctcggttccacgtccc

SEQ ID NO: 166908 - DNA, 12 bp, Homo sapiens
tctcgtttttct

SEQ ID NO: 166909 - DNA, 14 bp, Homo sapiens
tctctatttaatat

SEQ ID NO: 166910 - DNA, 17 bp, Homo sapiens
tctctatttaatattta

SEQ ID NO: 166911 - DNA, 18 bp, Homo sapiens
tctctcggttccacgtcc

SEQ ID NO: 166912 - DNA, 23 bp, Homo sapiens
tctctcggttccacgtccccctg

SEQ ID NO: 166913 - DNA, 13 bp, Homo sapiens
tctctctcctgtc

SEQ ID NO: 166914 - DNA, 11 bp, Homo sapiens
tctctctgtgg

SEQ ID NO: 166915 - DNA, 13 bp, Homo sapiens
tctctgaagatga

SEQ ID NO: 166916 - DNA, 15 bp, Homo sapiens
tctctgcagccagcc

SEQ ID NO: 166917 - DNA, 14 bp, Homo sapiens
tctctgccagtgac

SEQ ID NO: 166918 - DNA, 15 bp, Homo sapiens
tctctgccagtgaca

SEQ ID NO: 166919 - DNA, 19 bp, Homo sapiens
tctctgctggcccagccaa

SEQ ID NO: 166920 - DNA, 19 bp, Homo sapiens
tctctggcccttcttgcct

SEQ ID NO: 166921 - DNA, 17 bp, Homo sapiens
tctctggtaatattgac

SEQ ID NO: 166922 - DNA, 18 bp, Homo sapiens
tctcttaatttaatcttt

SEQ ID NO: 166923 - DNA, 21 bp, Homo sapiens
tctcttatagaatatttatta

SEQ ID NO: 166924 - DNA, 14 bp, Homo sapiens
tctcttcatacttt

SEQ ID NO: 166925 - DNA, 11 bp, Homo sapiens
tctcttctcca

SEQ ID NO: 166926 - DNA, 12 bp, Homo sapiens
tctcttctttaa

SEQ ID NO: 166927 - DNA, 14 bp, Homo sapiens
tctcttgagagggt

SEQ ID NO: 166928 - DNA, 14 bp, Homo sapiens
tctcttgagcctgg

SEQ ID NO: 166929 - DNA, 17 bp, Homo sapiens
tctcttgagcctgggag

SEQ ID NO: 166930 - DNA, 18 bp, Homo sapiens
tctcttgagcctgggagg

SEQ ID NO: 166931 - DNA, 15 bp, Homo sapiens
tctgaaaccagtgtt

SEQ ID NO: 166932 - DNA, 20 bp, Homo sapiens
tctgaaaccagtgttaggga

SEQ ID NO: 166933 - DNA, 12 bp, Homo sapiens
tctgaagcagat

SEQ ID NO: 166934 - DNA, 20 bp, Homo sapiens
tctgaaggagccccattcct

SEQ ID NO: 166935 - DNA, 21 bp, Homo sapiens
tctgaaggagccccattcctg

SEQ ID NO: 166936 - DNA, 18 bp, Homo sapiens
tctgacccctcctcactg

SEQ ID NO: 166937 - DNA, 13 bp, Homo sapiens
tctgactcagggc

SEQ ID NO: 166938 - DNA, 20 bp, Homo sapiens
tctgacttaagctgcctcaa

SEQ ID NO: 166939 - DNA, 20 bp, Homo sapiens
tctgagaaagactattcaaa

SEQ ID NO: 166940 - DNA, 22 bp, Homo sapiens
tctgagaaagactattcaaaca

SEQ ID NO: 166941 - DNA, 20 bp, Homo sapiens
tctgagaaggtccttaatga

SEQ ID NO: 166942 - DNA, 22 bp, Homo sapiens
tctgagaatctttattgagaaa

SEQ ID NO: 166943 - DNA, 19 bp, Homo sapiens
tctgagcagtgaatgattc

SEQ ID NO: 166944 - DNA, 22 bp, Homo sapiens
tctgaggagaaacaaataagac

SEQ ID NO: 166945 - DNA, 22 bp, Homo sapiens
tctgagtttcattctcctgcct

SEQ ID NO: 166946 - DNA, 21 bp, Homo sapiens
tctgatccctctacagagctt

SEQ ID NO: 166947 - DNA, 16 bp, Homo sapiens
tctgatgcaagcaaga

SEQ ID NO: 166948 - DNA, 20 bp, Homo sapiens
tctgcaaaatgaggaatgta

SEQ ID NO: 166949 - DNA, 20 bp, Homo sapiens
tctgcaagcacatctgcatt

SEQ ID NO: 166950 - DNA, 16 bp, Homo sapiens
tctgcacccccctggg

SEQ ID NO: 166951 - DNA, 18 bp, Homo sapiens
tctgcagataaacagtag

SEQ ID NO: 166952 - DNA, 14 bp, Homo sapiens
tctgcatcagctgc

SEQ ID NO: 166953 - DNA, 21 bp, Homo sapiens
tctgcatcagctgctgaaaca

SEQ ID NO: 166954 - DNA, 16 bp, Homo sapiens
tctgccagccagcagc

SEQ ID NO: 166955 - DNA, 17 bp, Homo sapiens
tctgccagccagcagcc

SEQ ID NO: 166956 - DNA, 21 bp, Homo sapiens
tctgccagtgacagacaggct

SEQ ID NO: 166957 - DNA, 15 bp, Homo sapiens
tctgccggccctggg

SEQ ID NO: 166958 - DNA, 21 bp, Homo sapiens
tctgcctcaatgtgaatcaga

SEQ ID NO: 166959 - DNA, 12 bp, Homo sapiens
tctgcctgtctc

SEQ ID NO: 166960 - DNA, 22 bp, Homo sapiens
tctgcggaccccagctgtgagc

SEQ ID NO: 166961 - DNA, 16 bp, Homo sapiens
tctgcgtcatgcttgt

SEQ ID NO: 166962 - DNA, 22 bp, Homo sapiens
tctgctcatcattctctgtctc

SEQ ID NO: 166963 - DNA, 16 bp, Homo sapiens
tctgctctgcgtgtca

SEQ ID NO: 166964 - DNA, 21 bp, Homo sapiens
tctgctctgcgtgtcacctgt

SEQ ID NO: 166965 - DNA, 15 bp, Homo sapiens
tctgctctttctctg

SEQ ID NO: 166966 - DNA, 18 bp, Homo sapiens
tctgctctttctctgcca

SEQ ID NO: 166967 - DNA, 19 bp, Homo sapiens
tctgctctttctctgccag

SEQ ID NO: 166968 - DNA, 20 bp, Homo sapiens
tctgctctttctctgccagt

SEQ ID NO: 166969 - DNA, 13 bp, Homo sapiens
tctgctgaaggaa

SEQ ID NO: 166970 - DNA, 20 bp, Homo sapiens
tctgctggcccagccaaacc

SEQ ID NO: 166971 - DNA, 17 bp, Homo sapiens
tctgcttacaattccct

SEQ ID NO: 166972 - DNA, 20 bp, Homo sapiens
tctgcttacaattccctgct

SEQ ID NO: 166973 - DNA, 21 bp, Homo sapiens
tctgcttacaattccctgctg

SEQ ID NO: 166974 - DNA, 23 bp, Homo sapiens
tctgcttacaattccctgctgtc

SEQ ID NO: 166975 - DNA, 19 bp, Homo sapiens
tctgcttgttattagagat

SEQ ID NO: 166976 - DNA, 20 bp, Homo sapiens
tctggaagagaggaatgcct

SEQ ID NO: 166977 - DNA, 15 bp, Homo sapiens
tctggaatgtaatca

SEQ ID NO: 166978 - DNA, 22 bp, Homo sapiens
tctggaatgtaatcaatgtttc

SEQ ID NO: 166979 - DNA, 22 bp, Homo sapiens
tctggactcctctgtccaggca

SEQ ID NO: 166980 - DNA, 22 bp, Homo sapiens
tctggagaagcagtgagccgca

SEQ ID NO: 166981 - DNA, 12 bp, Homo sapiens
tctggagacagc

SEQ ID NO: 166982 - DNA, 15 bp, Homo sapiens
tctggagacagcccc

SEQ ID NO: 166983 - DNA, 20 bp, Homo sapiens
tctggagacagccccagagc

SEQ ID NO: 166984 - DNA, 22 bp, Homo sapiens
tctggagacagccccagagcag

SEQ ID NO: 166985 - DNA, 24 bp, Homo sapiens
tctggagacagccccagagcaggg

SEQ ID NO: 166986 - DNA, 16 bp, Homo sapiens
ttcaggctcttctcct

SEQ ID NO: 166987 - DNA, 13 bp, Homo sapiens
ttcagggggccag

SEQ ID NO: 166988 - DNA, 17 bp, Homo sapiens
ttcagtattttggagaa

SEQ ID NO: 166989 - DNA, 19 bp, Homo sapiens
ttcagtattttggagaaat

SEQ ID NO: 166990 - DNA, 20 bp, Homo sapiens
ttcagtattttggagaaatt

SEQ ID NO: 166991 - DNA, 14 bp, Homo sapiens
ttcagtggggcagt

SEQ ID NO: 166992 - DNA, 19 bp, Homo sapiens
ttcagtttcaattcagtgc

SEQ ID NO: 166993 - DNA, 20 bp, Homo sapiens
ttcatattgtggcacaagca

SEQ ID NO: 166994 - DNA, 16 bp, Homo sapiens
ttcatcccatgatgta

SEQ ID NO: 166995 - DNA, 21 bp, Homo sapiens
ttcatcccatgatgtagtgcc

SEQ ID NO: 166996 - DNA, 18 bp, Homo sapiens
ttcatccggcagcctgga

SEQ ID NO: 166997 - DNA, 17 bp, Homo sapiens
ttcatgatttcatttca

SEQ ID NO: 166998 - DNA, 19 bp, Homo sapiens
ttcatgccaccatggccag

SEQ ID NO: 166999 - DNA, 22 bp, Homo sapiens
ttcatgccaccatggccagcca

SEQ ID NO: 167000 - DNA, 17 bp, Homo sapiens
ttcatgtaaactgtgca

SEQ ID NO: 167001 - DNA, 14 bp, Homo sapiens
ttcattatctcaaa

SEQ ID NO: 167002 - DNA, 15 bp, Homo sapiens
ttcatttaaaatgat

SEQ ID NO: 167003 - DNA, 19 bp, Homo sapiens
ttcatttggaaataagctg

SEQ ID NO: 167004 - DNA, 23 bp, Homo sapiens
ttcatttttttcactggagttac

SEQ ID NO: 167005 - DNA, 12 bp, Homo sapiens
ttccaaaataat

SEQ ID NO: 167006 - DNA, 13 bp, Homo sapiens
ttccaaaataatt

SEQ ID NO: 167007 - DNA, 15 bp, Homo sapiens
ttccaaataaaatga

SEQ ID NO: 167008 - DNA, 19 bp, Homo sapiens
ttccacacctagcatctca

SEQ ID NO: 167009 - DNA, 21 bp, Homo sapiens
ttccacacctggcactgctgt

SEQ ID NO: 167010 - DNA, 14 bp, Homo sapiens
ttccacgatgaaaa

SEQ ID NO: 167011 - DNA, 19 bp, Homo sapiens
ttccacgatgaaaaacttc

SEQ ID NO: 167012 - DNA, 15 bp, Homo sapiens
ttccacggagccact

SEQ ID NO: 167013 - DNA, 21 bp, Homo sapiens
ttccacggagccactcctctg

SEQ ID NO: 167014 - DNA, 16 bp, Homo sapiens
ttccactgagggcagt

SEQ ID NO: 167015 - DNA, 21 bp, Homo sapiens
ttccacttagaaattgcattt

SEQ ID NO: 167016 - DNA, 19 bp, Homo sapiens
ttccagagagtggctcctc

SEQ ID NO: 167017 - DNA, 20 bp, Homo sapiens
ttccagatgccttctccaga

SEQ ID NO: 167018 - DNA, 17 bp, Homo sapiens
ttccaggtttaagctgt

SEQ ID NO: 167019 - DNA, 20 bp, Homo sapiens
ttccatatgacctcatgcat

SEQ ID NO: 167020 - DNA, 23 bp, Homo sapiens
ttccatctcgccacccctccttc

SEQ ID NO: 167021 - DNA, 16 bp, Homo sapiens
ttccatgtcgcctctg

SEQ ID NO: 167022 - DNA, 18 bp, Homo sapiens
ttccatgtcgcctctgca

SEQ ID NO: 167023 - DNA, 19 bp, Homo sapiens
ttccatgtcgcctctgcat

SEQ ID NO: 167024 - DNA, 21 bp, Homo sapiens
ttccatgtcgcctctgcattc

SEQ ID NO: 167025 - DNA, 16 bp, Homo sapiens
ttccattggatctcat

SEQ ID NO: 167026 - DNA, 16 bp, Homo sapiens
ttcccaaaggactcca

SEQ ID NO: 167027 - DNA, 20 bp, Homo sapiens
ttcccaaaggactccaccca

SEQ ID NO: 167028 - DNA, 12 bp, Homo sapiens
ttcccaaatttc

SEQ ID NO: 167029 - DNA, 14 bp, Homo sapiens
ttcccagctctccc

SEQ ID NO: 167030 - DNA, 16 bp, Homo sapiens
ttcccagctctccctc

SEQ ID NO: 167031 - DNA, 18 bp, Homo sapiens
ttcccagctctccctctg

SEQ ID NO: 167032 - DNA, 20 bp, Homo sapiens
ttcccagctctccctctggc

SEQ ID NO: 167033 - DNA, 14 bp, Homo sapiens
ttcccagggaagtg

SEQ ID NO: 167034 - DNA, 14 bp, Homo sapiens
ttcccattcttgca

SEQ ID NO: 167035 - DNA, 13 bp, Homo sapiens
ttccccagcccag

SEQ ID NO: 167036 - DNA, 18 bp, Homo sapiens
ttccccaggggaaaatga

SEQ ID NO: 167037 - DNA, 16 bp, Homo sapiens
ttccccattgcctcct

SEQ ID NO: 167038 - DNA, 15 bp, Homo sapiens
ttcccccactgatca

SEQ ID NO: 167039 - DNA, 15 bp, Homo sapiens
ttcccccatagccac

SEQ ID NO: 167040 - DNA, 19 bp, Homo sapiens
ttccccctccaatcccacc

SEQ ID NO: 167041 - DNA, 16 bp, Homo sapiens
ttccccggtcccttga

SEQ ID NO: 167042 - DNA, 14 bp, Homo sapiens
ttcccctgttcact

SEQ ID NO: 167043 - DNA, 23 bp, Homo sapiens
ttccccttgcccagggctcagcc

SEQ ID NO: 167044 - DNA, 23 bp, Homo sapiens
ttcccgaaccccaaggagggaga

SEQ ID NO: 167045 - DNA, 15 bp, Homo sapiens
ttcccgctcagccct

SEQ ID NO: 167046 - DNA, 17 bp, Homo sapiens
ttccctacttcctgtga

SEQ ID NO: 167047 - DNA, 15 bp, Homo sapiens
ttccctctctctgac

SEQ ID NO: 167048 - DNA, 19 bp, Homo sapiens
ttccctgaaaacccagaga

SEQ ID NO: 167049 - DNA, 13 bp, Homo sapiens
ttccctgactcat

SEQ ID NO: 167050 - DNA, 19 bp, Homo sapiens
ttccctgcatttctgagtt

SEQ ID NO: 167051 - DNA, 23 bp, Homo sapiens
ttccctggcttgtaactccacca

SEQ ID NO: 167052 - DNA, 17 bp, Homo sapiens
ttccgtaacccaactct

SEQ ID NO: 167053 - DNA, 16 bp, Homo sapiens
ttcctaataaagttct

SEQ ID NO: 167054 - DNA, 22 bp, Homo sapiens
ttcctaataaagttctgtactc

SEQ ID NO: 167055 - DNA, 15 bp, Homo sapiens
ttcctatttcttata

SEQ ID NO: 167056 - DNA, 23 bp, Homo sapiens
ttcctcagttcatccattctatt

SEQ ID NO: 167057 - DNA, 11 bp, Homo sapiens
ttcctcctggg

SEQ ID NO: 167058 - DNA, 15 bp, Homo sapiens
ttcctcctgggccct

SEQ ID NO: 167059 - DNA, 21 bp, Homo sapiens
ttcctcctgggccctctctgc

SEQ ID NO: 167060 - DNA, 13 bp, Homo sapiens
ttcctctccactg

SEQ ID NO: 167061 - DNA, 14 bp, Homo sapiens
ttcctctccactgc

SEQ ID NO: 167062 - DNA, 16 bp, Homo sapiens
ttcctctccactgcct

SEQ ID NO: 167063 - DNA, 19 bp, Homo sapiens
ttcctctccactgccttcg

SEQ ID NO: 167064 - DNA, 12 bp, Homo sapiens
ttcctctgggaa

SEQ ID NO: 167065 - DNA, 17 bp, Homo sapiens
ttcctgataataattga

SEQ ID NO: 167066 - DNA, 22 bp, Homo sapiens
ttcctgatggtacaggaaagct

SEQ ID NO: 167067 - DNA, 19 bp, Homo sapiens
ttcctgcaactcaaggact

SEQ ID NO: 167068 - DNA, 18 bp, Homo sapiens
ttcctgcatttgtgaaat

SEQ ID NO: 167069 - DNA, 16 bp, Homo sapiens
ttcctgccccaggcct

SEQ ID NO: 167070 - DNA, 18 bp, Homo sapiens
ttcctgccccaggcctga

SEQ ID NO: 167071 - DNA, 14 bp, Homo sapiens
ttcctggcttctta

SEQ ID NO: 167072 - DNA, 17 bp, Homo sapiens
ttcctgggaaatattcc

SEQ ID NO: 167073 - DNA, 14 bp, Homo sapiens
ttcctgtcttcctg

SEQ ID NO: 167074 - DNA, 22 bp, Homo sapiens
ttccttagcttagacctcagcc

SEQ ID NO: 167075 - DNA, 14 bp, Homo sapiens
ttccttccttccct

SEQ ID NO: 167076 - DNA, 17 bp, Homo sapiens
ttccttctgtgaaagta

SEQ ID NO: 167077 - DNA, 13 bp, Homo sapiens
ttccttgaccagc

SEQ ID NO: 167078 - DNA, 21 bp, Homo sapiens
ttccttgagttgattcagctc

SEQ ID NO: 167079 - DNA, 18 bp, Homo sapiens
ttccttggcatgccttcc

SEQ ID NO: 167080 - DNA, 15 bp, Homo sapiens
ttccttgtatttaaa

SEQ ID NO: 167081 - DNA, 14 bp, Homo sapiens
ttcctttatattta

SEQ ID NO: 167082 - DNA, 16 bp, Homo sapiens
ttcctttccccagccc

SEQ ID NO: 167083 - DNA, 17 bp, Homo sapiens
ttcctttccccagccca

SEQ ID NO: 167084 - DNA, 14 bp, Homo sapiens
ttcctttgaagagg

SEQ ID NO: 167085 - DNA, 23 bp, Homo sapiens
ttcgcacctaccatcagggacag

SEQ ID NO: 167086 - DNA, 15 bp, Homo sapiens
ttctaaatgaatgtt

SEQ ID NO: 167087 - DNA, 18 bp, Homo sapiens
ttctaaatgaatgtttac

SEQ ID NO: 167088 - DNA, 14 bp, Homo sapiens
ttctaacaagtcat

SEQ ID NO: 167089 - DNA, 12 bp, Homo sapiens
ttctaatagaac

SEQ ID NO: 167090 - DNA, 18 bp, Homo sapiens
ttctaatagaactcagtt

SEQ ID NO: 167091 - DNA, 18 bp, Homo sapiens
ttctacaaaatcctgatg

SEQ ID NO: 167092 - DNA, 15 bp, Homo sapiens
ttctacatactatgg

SEQ ID NO: 167093 - DNA, 21 bp, Homo sapiens
ttctagaacatccctgccagc

SEQ ID NO: 167094 - DNA, 22 bp, Homo sapiens
ttctagaacatccctgccagct

SEQ ID NO: 167095 - DNA, 17 bp, Homo sapiens
ttctagctaatgtaata

SEQ ID NO: 167096 - DNA, 16 bp, Homo sapiens
ttctagctagaaatat

SEQ ID NO: 167097 - DNA, 19 bp, Homo sapiens
ttctagctagaaatatgat

SEQ ID NO: 167098 - DNA, 13 bp, Homo sapiens
ttctaggcctggg

SEQ ID NO: 167099 - DNA, 19 bp, Homo sapiens
ttctagttttcagtttgta

SEQ ID NO: 167100 - DNA, 23 bp, Homo sapiens
ttctatcctacaacaagagttta

SEQ ID NO: 167101 - DNA, 13 bp, Homo sapiens
ttctcagaatcta

SEQ ID NO: 167102 - DNA, 13 bp, Homo sapiens
ttctcagctccca

SEQ ID NO: 167103 - DNA, 16 bp, Homo sapiens
ttctcaggtgttgcca

SEQ ID NO: 167104 - DNA, 20 bp, Homo sapiens
ttctcataggaaaagtacat

SEQ ID NO: 167105 - DNA, 21 bp, Homo sapiens
ttctccacctcccacaaagga

SEQ ID NO: 167106 - DNA, 12 bp, Homo sapiens
ttctccactgga

SEQ ID NO: 167107 - DNA, 23 bp, Homo sapiens
ttctccatgagacacatctcctc

SEQ ID NO: 167108 - DNA, 23 bp, Homo sapiens
ttctcccaggccaggctccttcc

SEQ ID NO: 167109 - DNA, 23 bp, Homo sapiens
ttctcctccatgggagaaaatag

SEQ ID NO: 167110 - DNA, 18 bp, Homo sapiens
ttctctgagctgtgcagg

SEQ ID NO: 167111 - DNA, 22 bp, Homo sapiens
ttctctgagtatctcctcgcaa

SEQ ID NO: 167112 - DNA, 17 bp, Homo sapiens
ttctctgtctcatccat

SEQ ID NO: 167113 - DNA, 12 bp, Homo sapiens
ttctctgtgaac

SEQ ID NO: 167114 - DNA, 16 bp, Homo sapiens
ttctcttactgcaaat

SEQ ID NO: 167115 - DNA, 14 bp, Homo sapiens
ttctgagtgttttt

SEQ ID NO: 167116 - DNA, 17 bp, Homo sapiens
ttctgattacacaaaac

SEQ ID NO: 167117 - DNA, 22 bp, Homo sapiens
ttctgcaagcacatctgcattt

SEQ ID NO: 167118 - DNA, 17 bp, Homo sapiens
ttctgccggccctgggg

SEQ ID NO: 167119 - DNA, 22 bp, Homo sapiens
ttctggaatgtaatcaatgttt

SEQ ID NO: 167120 - DNA, 19 bp, Homo sapiens
ttctggctgaacactggca

SEQ ID NO: 167121 - DNA, 20 bp, Homo sapiens
ttctgtaaactcaaaactta

SEQ ID NO: 167122 - DNA, 16 bp, Homo sapiens
ttctgtggctcacaga

SEQ ID NO: 167123 - DNA, 20 bp, Homo sapiens
ttctgtgtgttttcataata

SEQ ID NO: 167124 - DNA, 13 bp, Homo sapiens
ttcttacataatt

SEQ ID NO: 167125 - DNA, 16 bp, Homo sapiens
ttcttacataattttt

SEQ ID NO: 167126 - DNA, 21 bp, Homo sapiens
ttcttatgtatgtgaaagtta

SEQ ID NO: 167127 - DNA, 18 bp, Homo sapiens
ttcttcataacaatttta

SEQ ID NO: 167128 - DNA, 13 bp, Homo sapiens
ttgtatgtaaatg

SEQ ID NO: 167129 - DNA, 22 bp, Homo sapiens
ttgtattctctgagctgtgcag

SEQ ID NO: 167130 - DNA, 20 bp, Homo sapiens
ttgtcccactcaagccaagc

SEQ ID NO: 167131 - DNA, 15 bp, Homo sapiens
ttgtccccgtggtct

SEQ ID NO: 167132 - DNA, 22 bp, Homo sapiens
ttgtgaagtacccgttcacatt

SEQ ID NO: 167133 - DNA, 18 bp, Homo sapiens
ttgtgagccaccacgtcc

SEQ ID NO: 167134 - DNA, 18 bp, Homo sapiens
ttgtgatgtcccaacttg

SEQ ID NO: 167135 - DNA, 21 bp, Homo sapiens
ttgtggaaaatgaaaattagg

SEQ ID NO: 167136 - DNA, 13 bp, Homo sapiens
ttgtggcctggga

SEQ ID NO: 167137 - DNA, 13 bp, Homo sapiens
ttgtggttaatct

SEQ ID NO: 167138 - DNA, 22 bp, Homo sapiens
ttgtgtaacaattttaatgcta

SEQ ID NO: 167139 - DNA, 19 bp, Homo sapiens
ttgtgtcatgtttaagaaa

SEQ ID NO: 167140 - DNA, 15 bp, Homo sapiens
ttgtgtgttatttaa

SEQ ID NO: 167141 - DNA, 20 bp, Homo sapiens
ttgtgtgttatttaaatgag

SEQ ID NO: 167142 - DNA, 21 bp, Homo sapiens
ttgtgtgttatttaaatgagt

SEQ ID NO: 167143 - DNA, 20 bp, Homo sapiens
ttgtgttaagtatgtgtaaa

SEQ ID NO: 167144 - DNA, 17 bp, Homo sapiens
ttgttactaactaaact

SEQ ID NO: 167145 - DNA, 21 bp, Homo sapiens
ttgttccacaagttaaataaa

SEQ ID NO: 167146 - DNA, 14 bp, Homo sapiens
ttgttccctctccc

SEQ ID NO: 167147 - DNA, 14 bp, Homo sapiens
ttgtttaaaatcat

SEQ ID NO: 167148 - DNA, 20 bp, Homo sapiens
ttgtttcattgactatcaaa

SEQ ID NO: 167149 - DNA, 20 bp, Homo sapiens
ttgttttcttctgtatgtta

SEQ ID NO: 167150 - DNA, 19 bp, Homo sapiens
ttgtttttcattcagtctt

SEQ ID NO: 167151 - DNA, 20 bp, Homo sapiens
tttaaaaaataactaccaag

SEQ ID NO: 167152 - DNA, 15 bp, Homo sapiens
tttaaaaagtcttca

SEQ ID NO: 167153 - DNA, 16 bp, Homo sapiens
tttaaaagacaagact

SEQ ID NO: 167154 - DNA, 16 bp, Homo sapiens
tttaaaatcatttctg

SEQ ID NO: 167155 - DNA, 15 bp, Homo sapiens
tttaaaatctgtcac

SEQ ID NO: 167156 - DNA, 22 bp, Homo sapiens
tttaaaggggcagaaaaactct

SEQ ID NO: 167157 - DNA, 19 bp, Homo sapiens
tttaaattcacaatagaaa

SEQ ID NO: 167158 - DNA, 13 bp, Homo sapiens
tttaaccaaaggt

SEQ ID NO: 167159 - DNA, 15 bp, Homo sapiens
tttaaccaaaggtga

SEQ ID NO: 167160 - DNA, 23 bp, Homo sapiens
tttaaccaaaggtgaaggaatat

SEQ ID NO: 167161 - DNA, 22 bp, Homo sapiens
tttaagaaaaaataacacacat

SEQ ID NO: 167162 - DNA, 15 bp, Homo sapiens
tttaagataattata

SEQ ID NO: 167163 - DNA, 20 bp, Homo sapiens
tttaagggtttgtggaaaat

SEQ ID NO: 167164 - DNA, 16 bp, Homo sapiens
tttaaggtttttactg

SEQ ID NO: 167165 - DNA, 12 bp, Homo sapiens
tttaagtattta

SEQ ID NO: 167166 - DNA, 14 bp, Homo sapiens
tttaagtatttata

SEQ ID NO: 167167 - DNA, 20 bp, Homo sapiens
tttaagtatttatatattta

SEQ ID NO: 167168 - DNA, 12 bp, Homo sapiens
tttaatatttaa

SEQ ID NO: 167169 - DNA, 22 bp, Homo sapiens
agcagccaagctccttgggagg

SEQ ID NO: 167170 - DNA, 14 bp, Homo sapiens
agcagccagctctc

SEQ ID NO: 167171 - DNA, 12 bp, Homo sapiens
agcagccctcct

SEQ ID NO: 167172 - DNA, 16 bp, Homo sapiens
agcagccctcctcacc

SEQ ID NO: 167173 - DNA, 17 bp, Homo sapiens
agcagccctcctcaccc

SEQ ID NO: 167174 - DNA, 19 bp, Homo sapiens
agcagctatctctcagtga

SEQ ID NO: 167175 - DNA, 15 bp, Homo sapiens
agcagctcaaaggca

SEQ ID NO: 167176 - DNA, 19 bp, Homo sapiens
agcagctcaaaggcacagt

SEQ ID NO: 167177 - DNA, 20 bp, Homo sapiens
agcagctcaaaggcacagtg

SEQ ID NO: 167178 - DNA, 14 bp, Homo sapiens
agcagcttccagat

SEQ ID NO: 167179 - DNA, 23 bp, Homo sapiens
agcaggaaatgaaaatgtcttgt

SEQ ID NO: 167180 - DNA, 15 bp, Homo sapiens
agcaggaagctcaga

SEQ ID NO: 167181 - DNA, 13 bp, Homo sapiens
agcaggacctctg

SEQ ID NO: 167182 - DNA, 21 bp, Homo sapiens
agcaggagattgagaaggaga

SEQ ID NO: 167183 - DNA, 17 bp, Homo sapiens
agcaggctactgtcagc

SEQ ID NO: 167184 - DNA, 20 bp, Homo sapiens
agcaggctactgtcagctcc

SEQ ID NO: 167185 - DNA, 16 bp, Homo sapiens
agcaggggctacaaga

SEQ ID NO: 167186 - DNA, 21 bp, Homo sapiens
agcagtctacccacctcagcc

SEQ ID NO: 167187 - DNA, 23 bp, Homo sapiens
agcagtctacccacctcagcctc

SEQ ID NO: 167188 - DNA, 16 bp, Homo sapiens
agcagtgagaaaaagc

SEQ ID NO: 167189 - DNA, 21 bp, Homo sapiens
agcagtggctggtccagggct

SEQ ID NO: 167190 - DNA, 22 bp, Homo sapiens
agcagtggctggtccagggcta

SEQ ID NO: 167191 - DNA, 16 bp, Homo sapiens
agcagttgaaaagact

SEQ ID NO: 167192 - DNA, 13 bp, Homo sapiens
agcataaatgcaa

SEQ ID NO: 167193 - DNA, 12 bp, Homo sapiens
agcatatgagga

SEQ ID NO: 167194 - DNA, 13 bp, Homo sapiens
agcatcaaactct

SEQ ID NO: 167195 - DNA, 18 bp, Homo sapiens
agcatggctcaaagtgca

SEQ ID NO: 167196 - DNA, 15 bp, Homo sapiens
agcattcagagagca

SEQ ID NO: 167197 - DNA, 18 bp, Homo sapiens
agcattctcactcctacc

SEQ ID NO: 167198 - DNA, 13 bp, Homo sapiens
agcatttatgttt

SEQ ID NO: 167199 - DNA, 16 bp, Homo sapiens
agcatttttgatttat

SEQ ID NO: 167200 - DNA, 18 bp, Homo sapiens
agccaacagaagcttcca

SEQ ID NO: 167201 - DNA, 19 bp, Homo sapiens
agccaagattgcgccattg

SEQ ID NO: 167202 - DNA, 23 bp, Homo sapiens
agccaagctccttgggaggcccc

SEQ ID NO: 167203 - DNA, 18 bp, Homo sapiens
agccaagggttcagagac

SEQ ID NO: 167204 - DNA, 23 bp, Homo sapiens
agccaagtgtggtagagtgtgcc

SEQ ID NO: 167205 - DNA, 22 bp, Homo sapiens
agccacgttccttactgcagaa

SEQ ID NO: 167206 - DNA, 12 bp, Homo sapiens
agccactcctct

SEQ ID NO: 167207 - DNA, 22 bp, Homo sapiens
agccactcctctgactcagggc

SEQ ID NO: 167208 - DNA, 23 bp, Homo sapiens
agccagaaataaagttggtgaca

SEQ ID NO: 167209 - DNA, 20 bp, Homo sapiens
agccagaacgtggctctgct

SEQ ID NO: 167210 - DNA, 15 bp, Homo sapiens
agccagaagctgagc

SEQ ID NO: 167211 - DNA, 19 bp, Homo sapiens
agccagactggcacagttt

SEQ ID NO: 167212 - DNA, 13 bp, Homo sapiens
agccagcagccag

SEQ ID NO: 167213 - DNA, 12 bp, Homo sapiens
agccagcccagc

SEQ ID NO: 167214 - DNA, 18 bp, Homo sapiens
agccagcccagcccagct

SEQ ID NO: 167215 - DNA, 12 bp, Homo sapiens
agccagccctcc

SEQ ID NO: 167216 - DNA, 20 bp, Homo sapiens
agccagccctccctgtcctc

SEQ ID NO: 167217 - DNA, 17 bp, Homo sapiens
agccagcgtcctcctct

SEQ ID NO: 167218 - DNA, 21 bp, Homo sapiens
agccagcgtcctcctctgtga

SEQ ID NO: 167219 - DNA, 15 bp, Homo sapiens
agccagctctcagcc

SEQ ID NO: 167220 - DNA, 22 bp, Homo sapiens
agccagggctatgggagcagct

SEQ ID NO: 167221 - DNA, 21 bp, Homo sapiens
agccagggggactagcccctg

SEQ ID NO: 167222 - DNA, 17 bp, Homo sapiens
agccagtgacctgagga

SEQ ID NO: 167223 - DNA, 20 bp, Homo sapiens
agccatgaggagttgctgtt

SEQ ID NO: 167224 - DNA, 15 bp, Homo sapiens
agccatgctgggaag

SEQ ID NO: 167225 - DNA, 19 bp, Homo sapiens
agccatgctgggaagacgc

SEQ ID NO: 167226 - DNA, 15 bp, Homo sapiens
agcccacccctcaac

SEQ ID NO: 167227 - DNA, 13 bp, Homo sapiens
agcccactctgct

SEQ ID NO: 167228 - DNA, 15 bp, Homo sapiens
agcccagacacagaa

SEQ ID NO: 167229 - DNA, 15 bp, Homo sapiens
agcccagcactgctt

SEQ ID NO: 167230 - DNA, 16 bp, Homo sapiens
agcccagctggtggga

SEQ ID NO: 167231 - DNA, 22 bp, Homo sapiens
agcccaggagagagaaagccag

SEQ ID NO: 167232 - DNA, 21 bp, Homo sapiens
agcccaggcgggagcggtggc

SEQ ID NO: 167233 - DNA, 18 bp, Homo sapiens
agcccagggagcggaaag

SEQ ID NO: 167234 - DNA, 19 bp, Homo sapiens
agcccagggagcggaaagc

SEQ ID NO: 167235 - DNA, 13 bp, Homo sapiens
agcccatcaatta

SEQ ID NO: 167236 - DNA, 13 bp, Homo sapiens
agcccatccctgc

SEQ ID NO: 167237 - DNA, 15 bp, Homo sapiens
agcccatccctgcct

SEQ ID NO: 167238 - DNA, 19 bp, Homo sapiens
agcccattctctctcctgt

SEQ ID NO: 167239 - DNA, 12 bp, Homo sapiens
agccccaggcct

SEQ ID NO: 167240 - DNA, 16 bp, Homo sapiens
agccccaggcctctgt

SEQ ID NO: 167241 - DNA, 13 bp, Homo sapiens
agccccagtgcca

SEQ ID NO: 167242 - DNA, 16 bp, Homo sapiens
agcccccttgacaccg

SEQ ID NO: 167243 - DNA, 14 bp, Homo sapiens
agccccgcagacct

SEQ ID NO: 167244 - DNA, 22 bp, Homo sapiens
agccccgcagacctccccagcc

SEQ ID NO: 167245 - DNA, 14 bp, Homo sapiens
agcccctagcccag

SEQ ID NO: 167246 - DNA, 16 bp, Homo sapiens
agcccctagcccagga

SEQ ID NO: 167247 - DNA, 22 bp, Homo sapiens
agcccctagcccaggagagaga

SEQ ID NO: 167248 - DNA, 11 bp, Homo sapiens
agcccctcctc

SEQ ID NO: 167249 - DNA, 14 bp, Homo sapiens
agcccctcctctgc

SEQ ID NO: 167250 - DNA, 15 bp, Homo sapiens
agcccctgtggagac

SEQ ID NO: 167251 - DNA, 18 bp, Homo sapiens
agcccctgtggagactgg

SEQ ID NO: 167252 - DNA, 16 bp, Homo sapiens
agccccttctcagaat

SEQ ID NO: 167253 - DNA, 23 bp, Homo sapiens
agccccttgctctcccctgccct

SEQ ID NO: 167254 - DNA, 20 bp, Homo sapiens
agcccggcgccaccatcctg

SEQ ID NO: 167255 - DNA, 13 bp, Homo sapiens
agccctcaaagtg

SEQ ID NO: 167256 - DNA, 14 bp, Homo sapiens
agccctcagaaccc

SEQ ID NO: 167257 - DNA, 16 bp, Homo sapiens
agccctcatcccgagc

SEQ ID NO: 167258 - DNA, 17 bp, Homo sapiens
agccctccctgcccctc

SEQ ID NO: 167259 - DNA, 22 bp, Homo sapiens
agccctccctgcccctcccttc

SEQ ID NO: 167260 - DNA, 23 bp, Homo sapiens
agccctccctgcccctcccttca

SEQ ID NO: 167261 - DNA, 16 bp, Homo sapiens
agccctccctgtcctc

SEQ ID NO: 167262 - DNA, 19 bp, Homo sapiens
agccctccctgtcctcctc

SEQ ID NO: 167263 - DNA, 22 bp, Homo sapiens
agccctccctgtcctcctcgga

SEQ ID NO: 167264 - DNA, 11 bp, Homo sapiens
agccctcttcc

SEQ ID NO: 167265 - DNA, 16 bp, Homo sapiens
agccctcttccatcat

SEQ ID NO: 167266 - DNA, 20 bp, Homo sapiens
agccctgctttgggctgccc

SEQ ID NO: 167267 - DNA, 23 bp, Homo sapiens
agccctgctttgggctgccctgg

SEQ ID NO: 167268 - DNA, 13 bp, Homo sapiens
agccctggccaga

SEQ ID NO: 167269 - DNA, 14 bp, Homo sapiens
agccctggccagag

SEQ ID NO: 167270 - DNA, 15 bp, Homo sapiens
tttgcaagtgaaggt

SEQ ID NO: 167271 - DNA, 15 bp, Homo sapiens
tttgcagatgacaaa

SEQ ID NO: 167272 - DNA, 16 bp, Homo sapiens
tttgcagatgacaaaa

SEQ ID NO: 167273 - DNA, 18 bp, Homo sapiens
tttgcataacaattcctc

SEQ ID NO: 167274 - DNA, 22 bp, Homo sapiens
tttgcataacaattcctctact

SEQ ID NO: 167275 - DNA, 20 bp, Homo sapiens
tttgctggagctctgcccat

SEQ ID NO: 167276 - DNA, 17 bp, Homo sapiens
tttgctgtgaggctgtc

SEQ ID NO: 167277 - DNA, 22 bp, Homo sapiens
tttggagaaattatttaataaa

SEQ ID NO: 167278 - DNA, 17 bp, Homo sapiens
tttgggaatgtttgtct

SEQ ID NO: 167279 - DNA, 20 bp, Homo sapiens
tttggggtagctagaggaac

SEQ ID NO: 167280 - DNA, 20 bp, Homo sapiens
tttggtaaaatacttcttga

SEQ ID NO: 167281 - DNA, 18 bp, Homo sapiens
tttgtaattgcttacatt

SEQ ID NO: 167282 - DNA, 19 bp, Homo sapiens
tttgtacatatgtaaaata

SEQ ID NO: 167283 - DNA, 19 bp, Homo sapiens
tttgtataacttcttaaaa

SEQ ID NO: 167284 - DNA, 22 bp, Homo sapiens
tttgtatctgcaggcagacacg

SEQ ID NO: 167285 - DNA, 12 bp, Homo sapiens
tttgtatgtaaa

SEQ ID NO: 167286 - DNA, 16 bp, Homo sapiens
tttgtatgtaaatgtg

SEQ ID NO: 167287 - DNA, 16 bp, Homo sapiens
tttgtattctctgagc

SEQ ID NO: 167288 - DNA, 17 bp, Homo sapiens
tttgtctgtcttcatag

SEQ ID NO: 167289 - DNA, 22 bp, Homo sapiens
tttgtgaaatgatggtgaaagt

SEQ ID NO: 167290 - DNA, 14 bp, Homo sapiens
tttgtgtgtagtct

SEQ ID NO: 167291 - DNA, 20 bp, Homo sapiens
tttgtgttgttggaaaaagt

SEQ ID NO: 167292 - DNA, 22 bp, Homo sapiens
tttgtgtttcagccatgtattt

SEQ ID NO: 167293 - DNA, 15 bp, Homo sapiens
tttgttgaaattatg

SEQ ID NO: 167294 - DNA, 13 bp, Homo sapiens
tttgtttttaatt

SEQ ID NO: 167295 - DNA, 12 bp, Homo sapiens
tttgtttttcat

SEQ ID NO: 167296 - DNA, 21 bp, Homo sapiens
ttttaaaaaactgctgactgt

SEQ ID NO: 167297 - DNA, 22 bp, Homo sapiens
ttttaaaaattaaatcaacctt

SEQ ID NO: 167298 - DNA, 15 bp, Homo sapiens
ttttaaaagacaaga

SEQ ID NO: 167299 - DNA, 23 bp, Homo sapiens
ttttaaaagacaagacttcagta

SEQ ID NO: 167300 - DNA, 16 bp, Homo sapiens
ttttaaacaaaataga

SEQ ID NO: 167301 - DNA, 12 bp, Homo sapiens
ttttaaccaaag

SEQ ID NO: 167302 - DNA, 15 bp, Homo sapiens
ttttaaccaaaggtg

SEQ ID NO: 167303 - DNA, 19 bp, Homo sapiens
ttttaagtatttatatatt

SEQ ID NO: 167304 - DNA, 21 bp, Homo sapiens
ttttaatttatttatactatt

SEQ ID NO: 167305 - DNA, 17 bp, Homo sapiens
ttttacaataaaatctt

SEQ ID NO: 167306 - DNA, 22 bp, Homo sapiens
ttttacttgcattgaatatatt

SEQ ID NO: 167307 - DNA, 20 bp, Homo sapiens
ttttagtttaaaaaccttgt

SEQ ID NO: 167308 - DNA, 20 bp, Homo sapiens
ttttatatcaatttaaaaaa

SEQ ID NO: 167309 - DNA, 13 bp, Homo sapiens
ttttatatttagt

SEQ ID NO: 167310 - DNA, 17 bp, Homo sapiens
ttttatccctcacctgt

SEQ ID NO: 167311 - DNA, 13 bp, Homo sapiens
ttttcaccccacc

SEQ ID NO: 167312 - DNA, 18 bp, Homo sapiens
ttttcacggaagttttca

SEQ ID NO: 167313 - DNA, 20 bp, Homo sapiens
ttttcactgctggctgcctt

SEQ ID NO: 167314 - DNA, 21 bp, Homo sapiens
ttttcactggagttacattaa

SEQ ID NO: 167315 - DNA, 15 bp, Homo sapiens
ttttcagaaaatatt

SEQ ID NO: 167316 - DNA, 15 bp, Homo sapiens
ttttcagaaatatgt

SEQ ID NO: 167317 - DNA, 16 bp, Homo sapiens
ttttcagtattttgga

SEQ ID NO: 167318 - DNA, 23 bp, Homo sapiens
ttttcagtattttggagaaatta

SEQ ID NO: 167319 - DNA, 21 bp, Homo sapiens
ttttcatgattttgaaatcat

SEQ ID NO: 167320 - DNA, 14 bp, Homo sapiens
ttttcatgtgtgat

SEQ ID NO: 167321 - DNA, 15 bp, Homo sapiens
ttttccaaaataatt

SEQ ID NO: 167322 - DNA, 18 bp, Homo sapiens
agcctgtgcctctgggac

SEQ ID NO: 167323 - DNA, 19 bp, Homo sapiens
agcctgtgcctctgggact

SEQ ID NO: 167324 - DNA, 21 bp, Homo sapiens
agcctgtgcctctgggactgg

SEQ ID NO: 167325 - DNA, 17 bp, Homo sapiens
agcctgtggcggtgcct

SEQ ID NO: 167326 - DNA, 20 bp, Homo sapiens
agccttccccttgcccaggg

SEQ ID NO: 167327 - DNA, 18 bp, Homo sapiens
agccttcttccatcccag

SEQ ID NO: 167328 - DNA, 19 bp, Homo sapiens
agccttgcggaaggttcta

SEQ ID NO: 167329 - DNA, 20 bp, Homo sapiens
agccttggataatgctgttg

SEQ ID NO: 167330 - DNA, 23 bp, Homo sapiens
agccttggataatgctgttgcct

SEQ ID NO: 167331 - DNA, 16 bp, Homo sapiens
agccttggtgtccacc

SEQ ID NO: 167332 - DNA, 22 bp, Homo sapiens
agccttggtgtccacctggccc

SEQ ID NO: 167333 - DNA, 16 bp, Homo sapiens
agccttgtaattctaa

SEQ ID NO: 167334 - DNA, 17 bp, Homo sapiens
agccttgtgtctacaga

SEQ ID NO: 167335 - DNA, 20 bp, Homo sapiens
agccttgtgtctacagagaa

SEQ ID NO: 167336 - DNA, 16 bp, Homo sapiens
agcctttctcccaggc

SEQ ID NO: 167337 - DNA, 15 bp, Homo sapiens
agcgaggaggctcca

SEQ ID NO: 167338 - DNA, 19 bp, Homo sapiens
agcgaggaggctccagagg

SEQ ID NO: 167339 - DNA, 22 bp, Homo sapiens
agcgcctagtggggtctccctc

SEQ ID NO: 167340 - DNA, 15 bp, Homo sapiens
agcgcctgcccctcc

SEQ ID NO: 167341 - DNA, 19 bp, Homo sapiens
agcgcgccactcgcttccc

SEQ ID NO: 167342 - DNA, 19 bp, Homo sapiens
agcgctgccgcaccccaga

SEQ ID NO: 167343 - DNA, 16 bp, Homo sapiens
agcggctgagtcatga

SEQ ID NO: 167344 - DNA, 19 bp, Homo sapiens
agcggctgagtcatgatct

SEQ ID NO: 167345 - DNA, 23 bp, Homo sapiens
agcggtctcaggctggtgggagg

SEQ ID NO: 167346 - DNA, 17 bp, Homo sapiens
agcgtcctcctctgtga

SEQ ID NO: 167347 - DNA, 19 bp, Homo sapiens
agcgtgcaccatccctttt

SEQ ID NO: 167348 - DNA, 17 bp, Homo sapiens
agcgtgctttaaaaaat

SEQ ID NO: 167349 - DNA, 20 bp, Homo sapiens
agctaaaatgattttatctg

SEQ ID NO: 167350 - DNA, 18 bp, Homo sapiens
agctactcaggaggctga

SEQ ID NO: 167351 - DNA, 14 bp, Homo sapiens
agctacttgggagg

SEQ ID NO: 167352 - DNA, 16 bp, Homo sapiens
agctacttgggaggct

SEQ ID NO: 167353 - DNA, 19 bp, Homo sapiens
agctagaagtgggccagga

SEQ ID NO: 167354 - DNA, 20 bp, Homo sapiens
agctagaggaaccaaccccc

SEQ ID NO: 167355 - DNA, 21 bp, Homo sapiens
agctagcgctgccgcacccca

SEQ ID NO: 167356 - DNA, 20 bp, Homo sapiens
agctatcagaagaccacaaa

SEQ ID NO: 167357 - DNA, 17 bp, Homo sapiens
agctatctctcagtgaa

SEQ ID NO: 167358 - DNA, 18 bp, Homo sapiens
agctatgttatattgaaa

SEQ ID NO: 167359 - DNA, 22 bp, Homo sapiens
agctatgttatattgaaaaaat

SEQ ID NO: 167360 - DNA, 15 bp, Homo sapiens
agctattactgtctg

SEQ ID NO: 167361 - DNA, 20 bp, Homo sapiens
agctattactgtctggtttt

SEQ ID NO: 167362 - DNA, 18 bp, Homo sapiens
agctatttccattccaga

SEQ ID NO: 167363 - DNA, 19 bp, Homo sapiens
agctcaaggaaaggcctga

SEQ ID NO: 167364 - DNA, 15 bp, Homo sapiens
agctcagacccccac

SEQ ID NO: 167365 - DNA, 12 bp, Homo sapiens
agctcagcgcca

SEQ ID NO: 167366 - DNA, 21 bp, Homo sapiens
agctcagctactgatttttgt

SEQ ID NO: 167367 - DNA, 21 bp, Homo sapiens
agctccacaccctctcccagg

SEQ ID NO: 167368 - DNA, 13 bp, Homo sapiens
agctccatctcca

SEQ ID NO: 167369 - DNA, 14 bp, Homo sapiens
agctccccaccacc

SEQ ID NO: 167370 - DNA, 17 bp, Homo sapiens
agctcccctcggagaag

SEQ ID NO: 167371 - DNA, 14 bp, Homo sapiens
agctccctctgcct

SEQ ID NO: 167372 - DNA, 13 bp, Homo sapiens
agctcctcttcct

SEQ ID NO: 167373 - DNA, 14 bp, Homo sapiens
agctcctgtcctcc

SEQ ID NO: 167374 - DNA, 15 bp, Homo sapiens
agctcctgtcctccc

SEQ ID NO: 167375 - DNA, 19 bp, Homo sapiens
agctccttgggaggcccca

SEQ ID NO: 167376 - DNA, 22 bp, Homo sapiens
agctccttgggaggccccactg

SEQ ID NO: 167377 - DNA, 18 bp, Homo sapiens
agctcggtggacccaggg

SEQ ID NO: 167378 - DNA, 20 bp, Homo sapiens
agctcggtggacccagggat

SEQ ID NO: 167379 - DNA, 20 bp, Homo sapiens
agctctacccagggcctgca

SEQ ID NO: 167380 - DNA, 20 bp, Homo sapiens
agctctattaagatttccaa

SEQ ID NO: 167381 - DNA, 13 bp, Homo sapiens
agctctccctctg

SEQ ID NO: 167382 - DNA, 17 bp, Homo sapiens
agctctccctctggccc

SEQ ID NO: 167383 - DNA, 20 bp, Homo sapiens
agctctccctctggccctgc

SEQ ID NO: 167384 - DNA, 18 bp, Homo sapiens
agctctgaaaccagtgtt

SEQ ID NO: 167385 - DNA, 19 bp, Homo sapiens
agctctggtgacaccagcc

SEQ ID NO: 167386 - DNA, 12 bp, Homo sapiens
agctctgtatca

SEQ ID NO: 167387 - DNA, 22 bp, Homo sapiens
agctctgtatcaggacccagag

SEQ ID NO: 167388 - DNA, 20 bp, Homo sapiens
agctcttctccccaggtgtg

SEQ ID NO: 167389 - DNA, 23 bp, Homo sapiens
agctcttctgccggccctggggc

SEQ ID NO: 167390 - DNA, 23 bp, Homo sapiens
agctgacccagccccttgagaaa

SEQ ID NO: 167391 - DNA, 15 bp, Homo sapiens
agctgagcagggaga

SEQ ID NO: 167392 - DNA, 16 bp, Homo sapiens
agctgaggcagcagtg

SEQ ID NO: 167393 - DNA, 17 bp, Homo sapiens
agctgaggcagcagtgt

SEQ ID NO: 167394 - DNA, 18 bp, Homo sapiens
agctgcaagtgacatctc

SEQ ID NO: 167395 - DNA, 22 bp, Homo sapiens
agctgcaccctcaggcaggtgg

SEQ ID NO: 167396 - DNA, 11 bp, Homo sapiens
agctgcagaac

SEQ ID NO: 167397 - DNA, 15 bp, Homo sapiens
agctgcagagacaga

SEQ ID NO: 167398 - DNA, 17 bp, Homo sapiens
agctgccatccagggat

SEQ ID NO: 167399 - DNA, 14 bp, Homo sapiens
agctgcccctggct

SEQ ID NO: 167400 - DNA, 19 bp, Homo sapiens
agctgcctgtagttaggaa

SEQ ID NO: 167401 - DNA, 20 bp, Homo sapiens
agctgcctgtagttaggaaa

SEQ ID NO: 167402 - DNA, 23 bp, Homo sapiens
agctgcctgtagttaggaaataa

SEQ ID NO: 167403 - DNA, 12 bp, Homo sapiens
agctgctcccct

SEQ ID NO: 167404 - DNA, 12 bp, Homo sapiens
agctgggaggaa

SEQ ID NO: 167405 - DNA, 13 bp, Homo sapiens
agctgggaggaaa

SEQ ID NO: 167406 - DNA, 14 bp, Homo sapiens
agctgggaggaaaa

SEQ ID NO: 167407 - DNA, 22 bp, Homo sapiens
agctgggaggcatggccctggg

SEQ ID NO: 167408 - DNA, 14 bp, Homo sapiens
agctgggcaggttg

SEQ ID NO: 167409 - DNA, 20 bp, Homo sapiens
agctgggtaatcgatggggg

SEQ ID NO: 167410 - DNA, 15 bp, Homo sapiens
agctggtgggaagcg

SEQ ID NO: 167411 - DNA, 22 bp, Homo sapiens
aaaagtttacaagtgtatatca

SEQ ID NO: 167412 - DNA, 19 bp, Homo sapiens
aaaataaaattaaagctga

SEQ ID NO: 167413 - DNA, 14 bp, Homo sapiens
aaaataaatatata

SEQ ID NO: 167414 - DNA, 15 bp, Homo sapiens
aaaatagaagctgta

SEQ ID NO: 167415 - DNA, 22 bp, Homo sapiens
aaaatagataagagtagaaact

SEQ ID NO: 167416 - DNA, 21 bp, Homo sapiens
aaaatagcaacactctatatt

SEQ ID NO: 167417 - DNA, 22 bp, Homo sapiens
aaaatagcaacactctatattt

SEQ ID NO: 167418 - DNA, 13 bp, Homo sapiens
aaaatagcttgta

SEQ ID NO: 167419 - DNA, 14 bp, Homo sapiens
aaaatataaaactg

SEQ ID NO: 167420 - DNA, 11 bp, Homo sapiens
aaaatatgcat

SEQ ID NO: 167421 - DNA, 11 bp, Homo sapiens
aaaatatttat

SEQ ID NO: 167422 - DNA, 13 bp, Homo sapiens
aaaatattttata

SEQ ID NO: 167423 - DNA, 18 bp, Homo sapiens
aaaatattttataatttt

SEQ ID NO: 167424 - DNA, 20 bp, Homo sapiens
aaaatattttgtctaaaatg

SEQ ID NO: 167425 - DNA, 12 bp, Homo sapiens
aaaatcatttct

SEQ ID NO: 167426 - DNA, 12 bp, Homo sapiens
aaaccagaagca

SEQ ID NO: 167427 - DNA, 19 bp, Homo sapiens
aaaccagtgttagggaagg

SEQ ID NO: 167428 - DNA, 15 bp, Homo sapiens
aaaccataaacttca

SEQ ID NO: 167429 - DNA, 13 bp, Homo sapiens
aaaccatgtagaa

SEQ ID NO: 167430 - DNA, 12 bp, Homo sapiens
aaacccagagag

SEQ ID NO: 167431 - DNA, 17 bp, Homo sapiens
aaaccccatctctacaa

SEQ ID NO: 167432 - DNA, 16 bp, Homo sapiens
aaacccgacagaggga

SEQ ID NO: 167433 - DNA, 16 bp, Homo sapiens
aaacccttgaaaagac

SEQ ID NO: 167434 - DNA, 17 bp, Homo sapiens
aaacctaaaaaagatat

SEQ ID NO: 167435 - DNA, 22 bp, Homo sapiens
aaacctgaaaaaaagtttacaa

SEQ ID NO: 167436 - DNA, 19 bp, Homo sapiens
aaacgagtcaatcccctca

SEQ ID NO: 167437 - DNA, 16 bp, Homo sapiens
aaacgctgcctgccca

SEQ ID NO: 167438 - DNA, 12 bp, Homo sapiens
aaacgtgaaaat

SEQ ID NO: 167439 - DNA, 17 bp, Homo sapiens
aaactaggaaatttttt

SEQ ID NO: 167440 - DNA, 16 bp, Homo sapiens
aaactatcagtttgtc

SEQ ID NO: 167441 - DNA, 13 bp, Homo sapiens
aaactcaaaactt

SEQ ID NO: 167442 - DNA, 13 bp, Homo sapiens
aaactcagggaca

SEQ ID NO: 167443 - DNA, 17 bp, Homo sapiens
aaactcagggacagagc

SEQ ID NO: 167444 - DNA, 23 bp, Homo sapiens
aaactctctttgggaatgtttgt

SEQ ID NO: 167445 - DNA, 17 bp, Homo sapiens
aaactgaaaatctaata

SEQ ID NO: 167446 - DNA, 14 bp, Homo sapiens
aaactgccagcaac

SEQ ID NO: 167447 - DNA, 15 bp, Homo sapiens
aaactgccagcaacg

SEQ ID NO: 167448 - DNA, 19 bp, Homo sapiens
aaactgccagcaacgcagg

SEQ ID NO: 167449 - DNA, 17 bp, Homo sapiens
aaactgcgttaaaggct

SEQ ID NO: 167450 - DNA, 22 bp, Homo sapiens
aaactgttgccagagatggagg

SEQ ID NO: 167451 - DNA, 17 bp, Homo sapiens
aaacttaacatatttac

SEQ ID NO: 167452 - DNA, 23 bp, Homo sapiens
aaacttccatgaggccaaacgtt

SEQ ID NO: 167453 - DNA, 18 bp, Homo sapiens
aaactttcctcgcctgac

SEQ ID NO: 167454 - DNA, 20 bp, Homo sapiens
aaagaagcccaatattataa

SEQ ID NO: 167455 - DNA, 18 bp, Homo sapiens
aaagaagtggggacagag

SEQ ID NO: 167456 - DNA, 13 bp, Homo sapiens
aaagacaagactt

SEQ ID NO: 167457 - DNA, 17 bp, Homo sapiens
aaagacaagacttcagt

SEQ ID NO: 167458 - DNA, 14 bp, Homo sapiens
aaagactattcaaa

SEQ ID NO: 167459 - DNA, 16 bp, Homo sapiens
aaagactgagctcaag

SEQ ID NO: 167460 - DNA, 18 bp, Homo sapiens
aaagagatggcctgagaa

SEQ ID NO: 167461 - DNA, 23 bp, Homo sapiens
aaagagcaagtctggatctggga

SEQ ID NO: 167462 - DNA, 15 bp, Homo sapiens
aaagaggcagcttga

SEQ ID NO: 167463 - DNA, 20 bp, Homo sapiens
aaagaggctgaggcctggac

SEQ ID NO: 167464 - DNA, 21 bp, Homo sapiens
aaagatacagaactctttcaa

SEQ ID NO: 167465 - DNA, 20 bp, Homo sapiens
aaagatatattaaaaatata

SEQ ID NO: 167466 - DNA, 21 bp, Homo sapiens
aaagattttcagaaaatatta

SEQ ID NO: 167467 - DNA, 14 bp, Homo sapiens
aaagcaaggaaact

SEQ ID NO: 167468 - DNA, 14 bp, Homo sapiens
aaagcaatatgcat

SEQ ID NO: 167469 - DNA, 17 bp, Homo sapiens
aaagcagggacttgaac

SEQ ID NO: 167470 - DNA, 21 bp, Homo sapiens
aaagcaggggctacaagaggg

SEQ ID NO: 167471 - DNA, 15 bp, Homo sapiens
aaagcataaatgcaa

SEQ ID NO: 167472 - DNA, 15 bp, Homo sapiens
aaagcattgtaaatg

SEQ ID NO: 167473 - DNA, 17 bp, Homo sapiens
aaagcattgtaaatgtg

SEQ ID NO: 167474 - DNA, 14 bp, Homo sapiens
aaagccagaagctg

SEQ ID NO: 167475 - DNA, 21 bp, Homo sapiens
aaagccagcgtcctcctctgt

SEQ ID NO: 167476 - DNA, 16 bp, Homo sapiens
aaagcctcctccagcc

SEQ ID NO: 167477 - DNA, 17 bp, Homo sapiens
aaagcctgggtgacatt

SEQ ID NO: 167478 - DNA, 13 bp, Homo sapiens
aaagctcatattt

SEQ ID NO: 167479 - DNA, 21 bp, Homo sapiens
aaagctcatattttgtatata

SEQ ID NO: 167480 - DNA, 15 bp, Homo sapiens
aaagcttgttaagat

SEQ ID NO: 167481 - DNA, 23 bp, Homo sapiens
aaagctttcctgccccaggcctg

SEQ ID NO: 167482 - DNA, 21 bp, Homo sapiens
aaagctttgcttatggtaata

SEQ ID NO: 167483 - DNA, 17 bp, Homo sapiens
aaaggaatcatttctat

SEQ ID NO: 167484 - DNA, 19 bp, Homo sapiens
aaaggagcccttatctgtg

SEQ ID NO: 167485 - DNA, 15 bp, Homo sapiens
aaaggatattttctt

SEQ ID NO: 167486 - DNA, 21 bp, Homo sapiens
aaaggatgtaaacagtgcctg

SEQ ID NO: 167487 - DNA, 12 bp, Homo sapiens
aaaggatgtgat

SEQ ID NO: 167488 - DNA, 17 bp, Homo sapiens
aaaggatgtgatatata

SEQ ID NO: 167489 - DNA, 17 bp, Homo sapiens
aaaggcaccatctaata

SEQ ID NO: 167490 - DNA, 21 bp, Homo sapiens
aaaggcacctataaaacaggt

SEQ ID NO: 167491 - DNA, 14 bp, Homo sapiens
aaaggccagctggc

SEQ ID NO: 167492 - DNA, 18 bp, Homo sapiens
aaaggccagctggcagca

SEQ ID NO: 167493 - DNA, 14 bp, Homo sapiens
aaagggaaactatt

SEQ ID NO: 167494 - DNA, 18 bp, Homo sapiens
aaaggggcagaaaaactc

SEQ ID NO: 167495 - DNA, 14 bp, Homo sapiens
aaaggtataatttt

SEQ ID NO: 167496 - DNA, 16 bp, Homo sapiens
aaaggtataattttat

SEQ ID NO: 167497 - DNA, 21 bp, Homo sapiens
aaaggtgcctgtgaggcaggg

SEQ ID NO: 167498 - DNA, 12 bp, Homo sapiens
aaagtacattta

SEQ ID NO: 167499 - DNA, 13 bp, Homo sapiens
aaagtatatatag

SEQ ID NO: 167500 - DNA, 14 bp, Homo sapiens
aaagtatatattta

SEQ ID NO: 167501 - DNA, 19 bp, Homo sapiens
aaagtatgtaaagtatgta

SEQ ID NO: 167502 - DNA, 18 bp, Homo sapiens
aaagtcaatgttttcagt

SEQ ID NO: 167503 - DNA, 13 bp, Homo sapiens
aaagtggaaaaat

SEQ ID NO: 167504 - DNA, 12 bp, Homo sapiens
aaagtgtgtatt

SEQ ID NO: 167505 - DNA, 17 bp, Homo sapiens
aaagtgtgtattaaaaa

SEQ ID NO: 167506 - DNA, 14 bp, Homo sapiens
aaagttctgtactc

SEQ ID NO: 167507 - DNA, 19 bp, Homo sapiens
aaagtttacaagtgtatat

SEQ ID NO: 167508 - DNA, 15 bp, Homo sapiens
aaagtttgccagaag

SEQ ID NO: 167509 - DNA, 12 bp, Homo sapiens
aaataaaacctt

SEQ ID NO: 167510 - DNA, 15 bp, Homo sapiens
aaataaaatgaccag

SEQ ID NO: 167511 - DNA, 16 bp, Homo sapiens
aaataaaatgaccagt

SEQ ID NO: 167512 - DNA, 22 bp, Homo sapiens
aaataaaattaaagctgaaaac

SEQ ID NO: 167513 - DNA, 20 bp, Homo sapiens
aaataaagcttgcaacaaaa

SEQ ID NO: 167514 - DNA, 13 bp, Homo sapiens
aaataaagtatat

SEQ ID NO: 167515 - DNA, 12 bp, Homo sapiens
aaataaatatat

SEQ ID NO: 167516 - DNA, 11 bp, Homo sapiens
aaataaattat

SEQ ID NO: 167517 - DNA, 17 bp, Homo sapiens
aaataactagtgttgct

SEQ ID NO: 167518 - DNA, 12 bp, Homo sapiens
aaataataaatc

SEQ ID NO: 167519 - DNA, 14 bp, Homo sapiens
aaataatatgcatt

SEQ ID NO: 167520 - DNA, 23 bp, Homo sapiens
aaatacagtcttccatttgcaag

SEQ ID NO: 167521 - DNA, 21 bp, Homo sapiens
aaataccatgccatttaaagc

SEQ ID NO: 167522 - DNA, 18 bp, Homo sapiens
aaataccccatcattcat

SEQ ID NO: 167523 - DNA, 22 bp, Homo sapiens
aaatactgtttttaacaactat

SEQ ID NO: 167524 - DNA, 19 bp, Homo sapiens
aaatagagtatatgcactt

SEQ ID NO: 167525 - DNA, 16 bp, Homo sapiens
aaatagcttgtatagt

SEQ ID NO: 167526 - DNA, 16 bp, Homo sapiens
aaatagtaaaaataaa

SEQ ID NO: 167527 - DNA, 21 bp, Homo sapiens
aaatagtgcagaatctcatag

SEQ ID NO: 167528 - DNA, 17 bp, Homo sapiens
aaatatagctgtacaaa

SEQ ID NO: 167529 - DNA, 20 bp, Homo sapiens
aaatatagctgtacaaatat

SEQ ID NO: 167530 - DNA, 21 bp, Homo sapiens
aaatatagctgtacaaatata

SEQ ID NO: 167531 - DNA, 17 bp, Homo sapiens
aaatatataaatatata

SEQ ID NO: 167532 - DNA, 10 bp, Homo sapiens
aaatatatat

SEQ ID NO: 167533 - DNA, 12 bp, Homo sapiens
aaatatatttaa

SEQ ID NO: 167534 - DNA, 15 bp, Homo sapiens
aaatatatttaatga

SEQ ID NO: 167535 - DNA, 18 bp, Homo sapiens
aaatatcagttactcagc

SEQ ID NO: 167536 - DNA, 20 bp, Homo sapiens
aaatatcagttactcagccc

SEQ ID NO: 167537 - DNA, 10 bp, Homo sapiens
aaatatgcaa

SEQ ID NO: 167538 - DNA, 16 bp, Homo sapiens
aaatatgcaaagcact

SEQ ID NO: 167539 - DNA, 16 bp, Homo sapiens
aaatatggaacttcta

SEQ ID NO: 167540 - DNA, 17 bp, Homo sapiens
aaatatggaacttctaa

SEQ ID NO: 167541 - DNA, 18 bp, Homo sapiens
aaatatggaacttctaat

SEQ ID NO: 167542 - DNA, 17 bp, Homo sapiens
aaatattagaaacagct

SEQ ID NO: 167543 - DNA, 20 bp, Homo sapiens
aaatattataacttaaaaaa

SEQ ID NO: 167544 - DNA, 19 bp, Homo sapiens
aaatattccctagaaactt

SEQ ID NO: 167545 - DNA, 12 bp, Homo sapiens
aaatattttgtc

SEQ ID NO: 167546 - DNA, 16 bp, Homo sapiens
aaatattttgtctaaa

SEQ ID NO: 167547 - DNA, 17 bp, Homo sapiens
aaatattttgtctaaaa

SEQ ID NO: 167548 - DNA, 21 bp, Homo sapiens
aaatcatgaagatatttttcc

SEQ ID NO: 167549 - DNA, 21 bp, Homo sapiens
aaatcatttctgcatcagctg

SEQ ID NO: 167550 - DNA, 15 bp, Homo sapiens
aaatcccatttaaaa

SEQ ID NO: 167551 - DNA, 18 bp, Homo sapiens
aaatcccttacctcggtg

SEQ ID NO: 167552 - DNA, 19 bp, Homo sapiens
aaatctacactccagtgag

SEQ ID NO: 167553 - DNA, 17 bp, Homo sapiens
aaatctcaccccatccc

SEQ ID NO: 167554 - DNA, 20 bp, Homo sapiens
aaagcaggggagtatgcaaa

SEQ ID NO: 167555 - DNA, 22 bp, Homo sapiens
aaagcagtagaaataatatgca

SEQ ID NO: 167556 - DNA, 19 bp, Homo sapiens
aaagcattgtaaatgtgct

SEQ ID NO: 167557 - DNA, 20 bp, Homo sapiens
aaagcattgtaaatgtgctt

SEQ ID NO: 167558 - DNA, 23 bp, Homo sapiens
aaagccaacagtcaaaacagaga

SEQ ID NO: 167559 - DNA, 18 bp, Homo sapiens
aaagccacgttccttact

SEQ ID NO: 167560 - DNA, 23 bp, Homo sapiens
aaagccttgtgtctacagagaac

SEQ ID NO: 167561 - DNA, 13 bp, Homo sapiens
aaagctcctgtcc

SEQ ID NO: 167562 - DNA, 15 bp, Homo sapiens
aaagctgcctgtagt

SEQ ID NO: 167563 - DNA, 16 bp, Homo sapiens
aaagctgcctgtagtt

SEQ ID NO: 167564 - DNA, 23 bp, Homo sapiens
aaagctgcctgtagttaggaaat

SEQ ID NO: 167565 - DNA, 12 bp, Homo sapiens
aaagctttcctg

SEQ ID NO: 167566 - DNA, 13 bp, Homo sapiens
aaagctttcctgc

SEQ ID NO: 167567 - DNA, 17 bp, Homo sapiens
aaaggaaatctcacccc

SEQ ID NO: 167568 - DNA, 14 bp, Homo sapiens
aaaggaagtctagg

SEQ ID NO: 167569 - DNA, 17 bp, Homo sapiens
aaaggagagctagcagc

SEQ ID NO: 167570 - DNA, 19 bp, Homo sapiens
aaaggatgtaaacagtgcc

SEQ ID NO: 167571 - DNA, 14 bp, Homo sapiens
aaaggatgtgatat

SEQ ID NO: 167572 - DNA, 18 bp, Homo sapiens
aaaggattcatgtggaat

SEQ ID NO: 167573 - DNA, 12 bp, Homo sapiens
aaaggcacagtg

SEQ ID NO: 167574 - DNA, 17 bp, Homo sapiens
aaaggcacctataaaac

SEQ ID NO: 167575 - DNA, 20 bp, Homo sapiens
aaaggcacctataaaacagg

SEQ ID NO: 167576 - DNA, 14 bp, Homo sapiens
aaaggcagaagcaa

SEQ ID NO: 167577 - DNA, 11 bp, Homo sapiens
aaaggcctctt

SEQ ID NO: 167578 - DNA, 14 bp, Homo sapiens
aaaggcctcttcct

SEQ ID NO: 167579 - DNA, 17 bp, Homo sapiens
aaaggctcgattttgta

SEQ ID NO: 167580 - DNA, 23 bp, Homo sapiens
aaaggctcgattttgtatctgca

SEQ ID NO: 167581 - DNA, 18 bp, Homo sapiens
aaatgtgccttcattttt

SEQ ID NO: 167582 - DNA, 15 bp, Homo sapiens
aaatgtggctcctgg

SEQ ID NO: 167583 - DNA, 15 bp, Homo sapiens
aaatgttctttgggg

SEQ ID NO: 167584 - DNA, 21 bp, Homo sapiens
aaatgttgaaaagtcaaactg

SEQ ID NO: 167585 - DNA, 13 bp, Homo sapiens
aaattaaagctga

SEQ ID NO: 167586 - DNA, 23 bp, Homo sapiens
aaattagaaaccttaatatgtgg

SEQ ID NO: 167587 - DNA, 16 bp, Homo sapiens
aaattataacttaaaa

SEQ ID NO: 167588 - DNA, 19 bp, Homo sapiens
aaattataacttaaaatat

SEQ ID NO: 167589 - DNA, 13 bp, Homo sapiens
aaattatttcaga

SEQ ID NO: 167590 - DNA, 23 bp, Homo sapiens
aaattatttgtgtaatagaaaac

SEQ ID NO: 167591 - DNA, 22 bp, Homo sapiens
aaattccttagcttagacctca

SEQ ID NO: 167592 - DNA, 18 bp, Homo sapiens
aaattgcatttcctgaca

SEQ ID NO: 167593 - DNA, 14 bp, Homo sapiens
aaattgctccttga

SEQ ID NO: 167594 - DNA, 14 bp, Homo sapiens
aaattgctgtgtat

SEQ ID NO: 167595 - DNA, 16 bp, Homo sapiens
aaatttggttctaata

SEQ ID NO: 167596 - DNA, 22 bp, Homo sapiens
aaatttgttttgacggatgatt

SEQ ID NO: 167597 - DNA, 14 bp, Homo sapiens
aaattttctagact

SEQ ID NO: 167598 - DNA, 19 bp, Homo sapiens
aaattttctagactttctg

SEQ ID NO: 167599 - DNA, 15 bp, Homo sapiens
aaatttttatttttc

SEQ ID NO: 167600 - DNA, 11 bp, Homo sapiens
aacaaaaagaa

SEQ ID NO: 167601 - DNA, 14 bp, Homo sapiens
aacaaagccagaag

SEQ ID NO: 167602 - DNA, 12 bp, Homo sapiens
aacaaatatgca

SEQ ID NO: 167603 - DNA, 16 bp, Homo sapiens
aacaaattgaactctt

SEQ ID NO: 167604 - DNA, 19 bp, Homo sapiens
aacaagagcgaaactccgt

SEQ ID NO: 167605 - DNA, 15 bp, Homo sapiens
aacaataaatgtgca

SEQ ID NO: 167606 - DNA, 19 bp, Homo sapiens
aacacaaacgggctcagca

SEQ ID NO: 167607 - DNA, 16 bp, Homo sapiens
aacacaagtcctgtga

SEQ ID NO: 167608 - DNA, 19 bp, Homo sapiens
aacacactgaggcagggaa

SEQ ID NO: 167609 - DNA, 20 bp, Homo sapiens
aacacagacattctgccagg

SEQ ID NO: 167610 - DNA, 16 bp, Homo sapiens
aacaccctatattttg

SEQ ID NO: 167611 - DNA, 22 bp, Homo sapiens
aacactgtgcacatctgtgtct

SEQ ID NO: 167612 - DNA, 14 bp, Homo sapiens
aacagaagcttcca

SEQ ID NO: 167613 - DNA, 21 bp, Homo sapiens
aacagacaaaaacagcctcac

SEQ ID NO: 167614 - DNA, 15 bp, Homo sapiens
aacagacaggagaaa

SEQ ID NO: 167615 - DNA, 13 bp, Homo sapiens
aacagataatcag

SEQ ID NO: 167616 - DNA, 16 bp, Homo sapiens
aacagatcaatttgta

SEQ ID NO: 167617 - DNA, 15 bp, Homo sapiens
aacagcagtgttccc

SEQ ID NO: 167618 - DNA, 22 bp, Homo sapiens
aacaggaaaggctcgaaataca

SEQ ID NO: 167619 - DNA, 16 bp, Homo sapiens
aacaggattagacagt

SEQ ID NO: 167620 - DNA, 13 bp, Homo sapiens
aacaggtctcctc

SEQ ID NO: 167621 - DNA, 14 bp, Homo sapiens
aacaggtggagaaa

SEQ ID NO: 167622 - DNA, 12 bp, Homo sapiens
aacagtagcata

SEQ ID NO: 167623 - DNA, 19 bp, Homo sapiens
aacagtctcaggaaatcaa

SEQ ID NO: 167624 - DNA, 17 bp, Homo sapiens
aacagtcttcaggcaaa

SEQ ID NO: 167625 - DNA, 15 bp, Homo sapiens
aacagtgattaccag

SEQ ID NO: 167626 - DNA, 22 bp, Homo sapiens
aacagtgattaccagggactga

SEQ ID NO: 167627 - DNA, 12 bp, Homo sapiens
aacagtgcctgc

SEQ ID NO: 167628 - DNA, 14 bp, Homo sapiens
aacagtgcctgctg

SEQ ID NO: 167629 - DNA, 17 bp, Homo sapiens
aacataattcttgtata

SEQ ID NO: 167630 - DNA, 14 bp, Homo sapiens
aacatcaacatctt

SEQ ID NO: 167631 - DNA, 16 bp, Homo sapiens
aacatcccattgccct

SEQ ID NO: 167632 - DNA, 19 bp, Homo sapiens
aacatcccattgccctggt

SEQ ID NO: 167633 - DNA, 22 bp, Homo sapiens
aacatcctttctattgaaaaat

SEQ ID NO: 167634 - DNA, 22 bp, Homo sapiens
aacatgcaattttgcatttgaa

SEQ ID NO: 167635 - DNA, 22 bp, Homo sapiens
aacatgcctgccccaaacaaat

SEQ ID NO: 167636 - DNA, 13 bp, Homo sapiens
aacattaagaaaa

SEQ ID NO: 167637 - DNA, 19 bp, Homo sapiens
aacattaagaaaatcatat

SEQ ID NO: 167638 - DNA, 10 bp, Homo sapiens
aaccaaaggt

SEQ ID NO: 167639 - DNA, 14 bp, Homo sapiens
aaccaaaggtgaag

SEQ ID NO: 167640 - DNA, 15 bp, Homo sapiens
aaccaagtcaagtga

SEQ ID NO: 167641 - DNA, 16 bp, Homo sapiens
aaccaagtcatgtgca

SEQ ID NO: 167642 - DNA, 12 bp, Homo sapiens
aaccacagcagt

SEQ ID NO: 167643 - DNA, 19 bp, Homo sapiens
aaccagggaagctgtccct

SEQ ID NO: 167644 - DNA, 21 bp, Homo sapiens
aaccagggagcccctttgatg

SEQ ID NO: 167645 - DNA, 13 bp, Homo sapiens
aaccataaacttc

SEQ ID NO: 167646 - DNA, 16 bp, Homo sapiens
aaccatgaagacagga

SEQ ID NO: 167647 - DNA, 17 bp, Homo sapiens
aaccatgaagacaggat

SEQ ID NO: 167648 - DNA, 22 bp, Homo sapiens
aaccatgagaccactgttatca

SEQ ID NO: 167649 - DNA, 20 bp, Homo sapiens
aaccatgtaaagaacataaa

SEQ ID NO: 167650 - DNA, 17 bp, Homo sapiens
aaccatgtagaaaattt

SEQ ID NO: 167651 - DNA, 13 bp, Homo sapiens
aacccaaatgttc

SEQ ID NO: 167652 - DNA, 16 bp, Homo sapiens
aacccaagtgggggca

SEQ ID NO: 167653 - DNA, 13 bp, Homo sapiens
aacccaatagttg

SEQ ID NO: 167654 - DNA, 19 bp, Homo sapiens
aacccacaggcccacagta

SEQ ID NO: 167655 - DNA, 11 bp, Homo sapiens
aacccagagag

SEQ ID NO: 167656 - DNA, 12 bp, Homo sapiens
aacccaggaggt

SEQ ID NO: 167657 - DNA, 16 bp, Homo sapiens
aacccgacagagggaa

SEQ ID NO: 167658 - DNA, 20 bp, Homo sapiens
aacccgacagagggaagaaa

SEQ ID NO: 167659 - DNA, 16 bp, Homo sapiens
aacccgggaggcagag

SEQ ID NO: 167660 - DNA, 21 bp, Homo sapiens
aaccgcaggaagctgctccgt

SEQ ID NO: 167661 - DNA, 15 bp, Homo sapiens
aaccgtcaataggca

SEQ ID NO: 167662 - DNA, 22 bp, Homo sapiens
aacctcacgcacctcccatcct

SEQ ID NO: 167663 - DNA, 16 bp, Homo sapiens
aacctcatcttcttca

SEQ ID NO: 167664 - DNA, 16 bp, Homo sapiens
aacctcattgacaaga

SEQ ID NO: 167665 - DNA, 19 bp, Homo sapiens
aacctcgctggactctcag

SEQ ID NO: 167666 - DNA, 18 bp, Homo sapiens
aacctgagccccaaaagg

SEQ ID NO: 167667 - DNA, 11 bp, Homo sapiens
aacctgtcctt

SEQ ID NO: 167668 - DNA, 19 bp, Homo sapiens
aaccttattgtacctctct

SEQ ID NO: 167669 - DNA, 13 bp, Homo sapiens
aaccttccatctc

SEQ ID NO: 167670 - DNA, 20 bp, Homo sapiens
aacgcaggcccccaggtgcc

SEQ ID NO: 167671 - DNA, 11 bp, Homo sapiens
aacgctgcctg

SEQ ID NO: 167672 - DNA, 13 bp, Homo sapiens
aacgctgcctgcc

SEQ ID NO: 167673 - DNA, 15 bp, Homo sapiens
aacgtggctctgctg

SEQ ID NO: 167674 - DNA, 18 bp, Homo sapiens
aacgtggggcagcacaga

SEQ ID NO: 167675 - DNA, 22 bp, Homo sapiens
aacgtggggcagcacagagagg

SEQ ID NO: 167676 - DNA, 19 bp, Homo sapiens
aactacgcttgctcatttt

SEQ ID NO: 167677 - DNA, 19 bp, Homo sapiens
aactactccggagacaggg

SEQ ID NO: 167678 - DNA, 17 bp, Homo sapiens
aactagaatttattcaa

SEQ ID NO: 167679 - DNA, 23 bp, Homo sapiens
aactattcaggagagtagaacag

SEQ ID NO: 167680 - DNA, 17 bp, Homo sapiens
aactcaaactcttaaaa

SEQ ID NO: 167681 - DNA, 22 bp, Homo sapiens
aactcaaatgcttggcttctca

SEQ ID NO: 167682 - DNA, 16 bp, Homo sapiens
aactcaccatgtaaaa

SEQ ID NO: 167683 - DNA, 21 bp, Homo sapiens
aactcaccatgtaaaagagtc

SEQ ID NO: 167684 - DNA, 13 bp, Homo sapiens
aactcagggacag

SEQ ID NO: 167685 - DNA, 17 bp, Homo sapiens
aactcagggacagagcc

SEQ ID NO: 167686 - DNA, 15 bp, Homo sapiens
aactcagttttaact

SEQ ID NO: 167687 - DNA, 15 bp, Homo sapiens
aactcattcctgcct

SEQ ID NO: 167688 - DNA, 19 bp, Homo sapiens
aactcattcctgcctgtct

SEQ ID NO: 167689 - DNA, 18 bp, Homo sapiens
aactcctggaaatatcag

SEQ ID NO: 167690 - DNA, 16 bp, Homo sapiens
aactctgtggcattat

SEQ ID NO: 167691 - DNA, 12 bp, Homo sapiens
aactctttcaaa

SEQ ID NO: 167692 - DNA, 14 bp, Homo sapiens
aactctttgagaaa

SEQ ID NO: 167693 - DNA, 20 bp, Homo sapiens
aactgaaaagactcagtgtt

SEQ ID NO: 167694 - DNA, 19 bp, Homo sapiens
aactgaaaatctaatatta

SEQ ID NO: 167695 - DNA, 13 bp, Homo sapiens
aactgaagccaga

SEQ ID NO: 167696 - DNA, 15 bp, Homo sapiens
aactgaaggagaagg

SEQ ID NO: 167697 - DNA, 14 bp, Homo sapiens
aacaatgaagataa

SEQ ID NO: 167698 - DNA, 21 bp, Homo sapiens
aacaatttcctttatatttag

SEQ ID NO: 167699 - DNA, 22 bp, Homo sapiens
aacaatttcctttatatttagt

SEQ ID NO: 167700 - DNA, 23 bp, Homo sapiens
aacaattttaggaggaccagagc

SEQ ID NO: 167701 - DNA, 14 bp, Homo sapiens
aacacacaaaggta

SEQ ID NO: 167702 - DNA, 18 bp, Homo sapiens
aacacactgaggcaggga

SEQ ID NO: 167703 - DNA, 21 bp, Homo sapiens
aacacactgaggcagggaagt

SEQ ID NO: 167704 - DNA, 19 bp, Homo sapiens
aacacagacattctgccag

SEQ ID NO: 167705 - DNA, 12 bp, Homo sapiens
aacacatcagct

SEQ ID NO: 167706 - DNA, 18 bp, Homo sapiens
aacacatttgattctgtg

SEQ ID NO: 167707 - DNA, 20 bp, Homo sapiens
aacacccagtctgttcccca

SEQ ID NO: 167708 - DNA, 18 bp, Homo sapiens
aacaccctcgaagcgcgc

SEQ ID NO: 167709 - DNA, 19 bp, Homo sapiens
aacacctctgcacaagctg

SEQ ID NO: 167710 - DNA, 20 bp, Homo sapiens
aacacgcctgcaaacgctgc

SEQ ID NO: 167711 - DNA, 20 bp, Homo sapiens
aacactgtgcacatctgtgt

SEQ ID NO: 167712 - DNA, 18 bp, Homo sapiens
aacactttacaatgttca

SEQ ID NO: 167713 - DNA, 22 bp, Homo sapiens
aacagaaagcctgggtgacatt

SEQ ID NO: 167714 - DNA, 16 bp, Homo sapiens
aacagaagcttccatt

SEQ ID NO: 167715 - DNA, 13 bp, Homo sapiens
aacagagaaggca

SEQ ID NO: 167716 - DNA, 24 bp, Homo sapiens
aacagatgtttcttttgtatgtaa

SEQ ID NO: 167717 - DNA, 21 bp, Homo sapiens
aacagcagaggttcttttaaa

SEQ ID NO: 167718 - DNA, 20 bp, Homo sapiens
aacagccgctcctgtctgcc

SEQ ID NO: 167719 - DNA, 13 bp, Homo sapiens
aacagcctcacag

SEQ ID NO: 167720 - DNA, 16 bp, Homo sapiens
aacagcttctcaattt

SEQ ID NO: 167721 - DNA, 21 bp, Homo sapiens
aacaggagctgggatcctaag

SEQ ID NO: 167722 - DNA, 15 bp, Homo sapiens
aacaggtctcctctt

SEQ ID NO: 167723 - DNA, 18 bp, Homo sapiens
aacaggtctcctcttaaa

SEQ ID NO: 167724 - DNA, 20 bp, Homo sapiens
aacaggtctcctcttaaaaa

SEQ ID NO: 167725 - DNA, 22 bp, Homo sapiens
aacagtagtgatagttgtaccg

SEQ ID NO: 167726 - DNA, 17 bp, Homo sapiens
aacagtctcaggaaatc

SEQ ID NO: 167727 - DNA, 15 bp, Homo sapiens
aacagtgcctgctga

SEQ ID NO: 167728 - DNA, 18 bp, Homo sapiens
aacataaataaaatgacc

SEQ ID NO: 167729 - DNA, 17 bp, Homo sapiens
aacatcactgaaatgct

SEQ ID NO: 167730 - DNA, 18 bp, Homo sapiens
aacatcccattgccctgg

SEQ ID NO: 167731 - DNA, 22 bp, Homo sapiens
aacatcctatcaacaacaaggt

SEQ ID NO: 167732 - DNA, 20 bp, Homo sapiens
aacatgaccctaaatcttga

SEQ ID NO: 167733 - DNA, 22 bp, Homo sapiens
aacatggaactcattcctgcct

SEQ ID NO: 167734 - DNA, 19 bp, Homo sapiens
aacatggagaaaccctgtc

SEQ ID NO: 167735 - DNA, 15 bp, Homo sapiens
aagaataaaatgttg

SEQ ID NO: 167736 - DNA, 13 bp, Homo sapiens
aagacaatataat

SEQ ID NO: 167737 - DNA, 19 bp, Homo sapiens
aagacaatgtgaaaagaaa

SEQ ID NO: 167738 - DNA, 22 bp, Homo sapiens
aagacaggatgggggctggcct

SEQ ID NO: 167739 - DNA, 23 bp, Homo sapiens
aagaccttgcttatgattgcaga

SEQ ID NO: 167740 - DNA, 21 bp, Homo sapiens
aagacctttggagcaaagctg

SEQ ID NO: 167741 - DNA, 19 bp, Homo sapiens
aagactaatttaaaaaata

SEQ ID NO: 167742 - DNA, 13 bp, Homo sapiens
aagactattcaaa

SEQ ID NO: 167743 - DNA, 14 bp, Homo sapiens
aagactattcaaac

SEQ ID NO: 167744 - DNA, 14 bp, Homo sapiens
aagactcagtgttc

SEQ ID NO: 167745 - DNA, 18 bp, Homo sapiens
aagacttcagtatgttgt

SEQ ID NO: 167746 - DNA, 17 bp, Homo sapiens
aagagaggagaggagag

SEQ ID NO: 167747 - DNA, 16 bp, Homo sapiens
aagagattgtggtttc

SEQ ID NO: 167748 - DNA, 13 bp, Homo sapiens
aagagatttttca

SEQ ID NO: 167749 - DNA, 14 bp, Homo sapiens
aagagatttttcat

SEQ ID NO: 167750 - DNA, 15 bp, Homo sapiens
aagagcaagtctgga

SEQ ID NO: 167751 - DNA, 20 bp, Homo sapiens
aagagccttggtgtccacct

SEQ ID NO: 167752 - DNA, 20 bp, Homo sapiens
aagagctagcgctgccgcac

SEQ ID NO: 167753 - DNA, 19 bp, Homo sapiens
aagagctgttcacagccag

SEQ ID NO: 167754 - DNA, 21 bp, Homo sapiens
aagaggaaaatgaataataca

SEQ ID NO: 167755 - DNA, 23 bp, Homo sapiens
aagaggaatgaagtactcataca

SEQ ID NO: 167756 - DNA, 22 bp, Homo sapiens
aagagggaatccccgaaggtgc

SEQ ID NO: 167757 - DNA, 17 bp, Homo sapiens
aagagggacgcctgggg

SEQ ID NO: 167758 - DNA, 18 bp, Homo sapiens
aagaggttttaaaaaaat

SEQ ID NO: 167759 - DNA, 22 bp, Homo sapiens
aagagtagttgatgttgcattt

SEQ ID NO: 167760 - DNA, 23 bp, Homo sapiens
aagagtgtcctaggagtatcctc

SEQ ID NO: 167761 - DNA, 14 bp, Homo sapiens
aagataaagatgat

SEQ ID NO: 167762 - DNA, 17 bp, Homo sapiens
aagataaagatgatcta

SEQ ID NO: 167763 - DNA, 19 bp, Homo sapiens
aagataatattaaggaaga

SEQ ID NO: 167764 - DNA, 15 bp, Homo sapiens
aagatagcagggcat

SEQ ID NO: 167765 - DNA, 15 bp, Homo sapiens
aagatatattaaaaa

SEQ ID NO: 167766 - DNA, 19 bp, Homo sapiens
aagatatattaaaaatata

SEQ ID NO: 167767 - DNA, 17 bp, Homo sapiens
aagatatttttcatgat

SEQ ID NO: 167768 - DNA, 13 bp, Homo sapiens
aagatatttttcc

SEQ ID NO: 167769 - DNA, 22 bp, Homo sapiens
aagatcaaaagcttattcatct

SEQ ID NO: 167770 - DNA, 14 bp, Homo sapiens
aagatgaaaatatt

SEQ ID NO: 167771 - DNA, 17 bp, Homo sapiens
aagatgagagaactgga

SEQ ID NO: 167772 - DNA, 19 bp, Homo sapiens
aagatgcttctcactgcca

SEQ ID NO: 167773 - DNA, 17 bp, Homo sapiens
aagatggctgactttgc

SEQ ID NO: 167774 - DNA, 21 bp, Homo sapiens
aagatggctgtgcctctgcct

SEQ ID NO: 167775 - DNA, 23 bp, Homo sapiens
aagatggctgtgcctctgcctgt

SEQ ID NO: 167776 - DNA, 18 bp, Homo sapiens
aagatgggcagctagttc

SEQ ID NO: 167777 - DNA, 13 bp, Homo sapiens
aagatgtagagga

SEQ ID NO: 167778 - DNA, 22 bp, Homo sapiens
aagatgtagaggagaaactgga

SEQ ID NO: 167779 - DNA, 16 bp, Homo sapiens
aagattctttcccaat

SEQ ID NO: 167780 - DNA, 17 bp, Homo sapiens
aagatttccaagtgcca

SEQ ID NO: 167781 - DNA, 16 bp, Homo sapiens
aagatttccatataaa

SEQ ID NO: 167782 - DNA, 17 bp, Homo sapiens
aagatttggaataaagt

SEQ ID NO: 167783 - DNA, 13 bp, Homo sapiens
aagattttcagaa

SEQ ID NO: 167784 - DNA, 11 bp, Homo sapiens
aagcaaaggtg

SEQ ID NO: 167785 - DNA, 17 bp, Homo sapiens
aagcaacccaaatgttc

SEQ ID NO: 167786 - DNA, 19 bp, Homo sapiens
aagcaatatgcatttaaat

SEQ ID NO: 167787 - DNA, 12 bp, Homo sapiens
aagcacctgccg

SEQ ID NO: 167788 - DNA, 20 bp, Homo sapiens
aagcacctgccgacctcgtc

SEQ ID NO: 167789 - DNA, 17 bp, Homo sapiens
aagcactgacttctaag

SEQ ID NO: 167790 - DNA, 20 bp, Homo sapiens
aagcactgacttctaagtaa

SEQ ID NO: 167791 - DNA, 19 bp, Homo sapiens
aagcagatggaatgctgtg

SEQ ID NO: 167792 - DNA, 14 bp, Homo sapiens
aagcagccaagctc

SEQ ID NO: 167793 - DNA, 16 bp, Homo sapiens
aagcagccaagctcct

SEQ ID NO: 167794 - DNA, 16 bp, Homo sapiens
aagcagctcaaaggca

SEQ ID NO: 167795 - DNA, 12 bp, Homo sapiens
aagcaggaagct

SEQ ID NO: 167796 - DNA, 17 bp, Homo sapiens
aagcaggggagtatgca

SEQ ID NO: 167797 - DNA, 19 bp, Homo sapiens
aagcaggggagtatgcaaa

SEQ ID NO: 167798 - DNA, 22 bp, Homo sapiens
aagcaggggctacaagagggaa

SEQ ID NO: 167799 - DNA, 16 bp, Homo sapiens
aagcaggtttttctcc

SEQ ID NO: 167800 - DNA, 22 bp, Homo sapiens
aagcagtagaaataatatgcat

SEQ ID NO: 167801 - DNA, 22 bp, Homo sapiens
aagcataaatgcaaacacacaa

SEQ ID NO: 167802 - DNA, 14 bp, Homo sapiens
aagcatcaaactct

SEQ ID NO: 167803 - DNA, 22 bp, Homo sapiens
aagcatcattatttgcagagac

SEQ ID NO: 167804 - DNA, 16 bp, Homo sapiens
aagcatgtaggagaat

SEQ ID NO: 167805 - DNA, 13 bp, Homo sapiens
aagcattgtaaat

SEQ ID NO: 167806 - DNA, 17 bp, Homo sapiens
aagccaacagtcaaaac

SEQ ID NO: 167807 - DNA, 17 bp, Homo sapiens
aagccaagcagccaagc

SEQ ID NO: 167808 - DNA, 13 bp, Homo sapiens
aagccaagggcct

SEQ ID NO: 167809 - DNA, 16 bp, Homo sapiens
aagccaagggcctctt

SEQ ID NO: 167810 - DNA, 18 bp, Homo sapiens
aagccacttaaaatgttc

SEQ ID NO: 167811 - DNA, 14 bp, Homo sapiens
aagccagcgtcctc

SEQ ID NO: 167812 - DNA, 20 bp, Homo sapiens
aagcccagcactgcttgagg

SEQ ID NO: 167813 - DNA, 23 bp, Homo sapiens
aagcccagcactgcttgaggaaa

SEQ ID NO: 167814 - DNA, 11 bp, Homo sapiens
aagccctcctt

SEQ ID NO: 167815 - DNA, 12 bp, Homo sapiens
aagccctccttc

SEQ ID NO: 167816 - DNA, 14 bp, Homo sapiens
aagccctcttccat

SEQ ID NO: 167817 - DNA, 16 bp, Homo sapiens
aagccctcttccatca

SEQ ID NO: 167818 - DNA, 18 bp, Homo sapiens
aagccctcttccatcatg

SEQ ID NO: 167819 - DNA, 21 bp, Homo sapiens
aagccctcttccatcatgtcc

SEQ ID NO: 167820 - DNA, 19 bp, Homo sapiens
aagccctgagctttctgct

SEQ ID NO: 167821 - DNA, 13 bp, Homo sapiens
aagccgctgctgg

SEQ ID NO: 167822 - DNA, 22 bp, Homo sapiens
aagcctcaactagtcatttttt

SEQ ID NO: 167823 - DNA, 20 bp, Homo sapiens
aagcctcatatttaaagaca

SEQ ID NO: 167824 - DNA, 16 bp, Homo sapiens
aagcctcccacgactg

SEQ ID NO: 167825 - DNA, 22 bp, Homo sapiens
aagcctgcaatttcatatgctg

SEQ ID NO: 167826 - DNA, 19 bp, Homo sapiens
aagctagtggcttcaaaat

SEQ ID NO: 167827 - DNA, 20 bp, Homo sapiens
aagctatagacccgaggaaa

SEQ ID NO: 167828 - DNA, 20 bp, Homo sapiens
aagctcatattttgtatata

SEQ ID NO: 167829 - DNA, 16 bp, Homo sapiens
aagctccactgtcacc

SEQ ID NO: 167830 - DNA, 19 bp, Homo sapiens
aagctccactgtcaccctc

SEQ ID NO: 167831 - DNA, 18 bp, Homo sapiens
aagctcgaaaacaattgt

SEQ ID NO: 167832 - DNA, 12 bp, Homo sapiens
aagctgaaaata

SEQ ID NO: 167833 - DNA, 13 bp, Homo sapiens
aagctgcaccctc

SEQ ID NO: 167834 - DNA, 14 bp, Homo sapiens
aagctgcctgtagt

SEQ ID NO: 167835 - DNA, 19 bp, Homo sapiens
aagctgcctgtagttagga

SEQ ID NO: 167836 - DNA, 22 bp, Homo sapiens
aagctgcctgtagttaggaaat

SEQ ID NO: 167837 - DNA, 11 bp, Homo sapiens
aagctgggcag

SEQ ID NO: 167838 - DNA, 15 bp, Homo sapiens
aagaatctttagaga

SEQ ID NO: 167839 - DNA, 18 bp, Homo sapiens
aagaattgaacccaggag

SEQ ID NO: 167840 - DNA, 19 bp, Homo sapiens
aagaattgaacccaggagg

SEQ ID NO: 167841 - DNA, 13 bp, Homo sapiens
aagaatttttaaa

SEQ ID NO: 167842 - DNA, 15 bp, Homo sapiens
aagacatgaatatga

SEQ ID NO: 167843 - DNA, 12 bp, Homo sapiens
aagaccagtcca

SEQ ID NO: 167844 - DNA, 13 bp, Homo sapiens
aagaccatttttc

SEQ ID NO: 167845 - DNA, 14 bp, Homo sapiens
aagacgcctgagct

SEQ ID NO: 167846 - DNA, 18 bp, Homo sapiens
aagacgtcccttttttct

SEQ ID NO: 167847 - DNA, 14 bp, Homo sapiens
aagactccaaagaa

SEQ ID NO: 167848 - DNA, 12 bp, Homo sapiens
aagactgtggct

SEQ ID NO: 167849 - DNA, 15 bp, Homo sapiens
aagactgtggctgct

SEQ ID NO: 167850 - DNA, 21 bp, Homo sapiens
aagacttcagtatgttgtcaa

SEQ ID NO: 167851 - DNA, 22 bp, Homo sapiens
aagagaaaaaaagtttgccaga

SEQ ID NO: 167852 - DNA, 13 bp, Homo sapiens
aagagaatatttt

SEQ ID NO: 167853 - DNA, 20 bp, Homo sapiens
aagagaatattttaagtatt

SEQ ID NO: 167854 - DNA, 22 bp, Homo sapiens
aagagaatattttaagtattgc

SEQ ID NO: 167855 - DNA, 17 bp, Homo sapiens
aagagatggcctgagaa

SEQ ID NO: 167856 - DNA, 12 bp, Homo sapiens
aagagcctgcag

SEQ ID NO: 167857 - DNA, 16 bp, Homo sapiens
aagagcctgcaggtgc

SEQ ID NO: 167858 - DNA, 14 bp, Homo sapiens
aagaggaaaatgaa

SEQ ID NO: 167859 - DNA, 14 bp, Homo sapiens
aagaggcaagaggc

SEQ ID NO: 167860 - DNA, 20 bp, Homo sapiens
aagaggctgaggcctggact

SEQ ID NO: 167861 - DNA, 13 bp, Homo sapiens
aagaggctggttc

SEQ ID NO: 167862 - DNA, 16 bp, Homo sapiens
aagagggacgcctggg

SEQ ID NO: 167863 - DNA, 20 bp, Homo sapiens
aagagtagaaactgcaggga

SEQ ID NO: 167864 - DNA, 13 bp, Homo sapiens
aagagtagacatt

SEQ ID NO: 167865 - DNA, 22 bp, Homo sapiens
aagagtgacagtggattgcatt

SEQ ID NO: 167866 - DNA, 23 bp, Homo sapiens
aagagttcttaaggattgtgata

SEQ ID NO: 167867 - DNA, 12 bp, Homo sapiens
aagataaagatg

SEQ ID NO: 167868 - DNA, 15 bp, Homo sapiens
aagataacttgagca

SEQ ID NO: 167869 - DNA, 21 bp, Homo sapiens
aagataatattaaggaagaca

SEQ ID NO: 167870 - DNA, 20 bp, Homo sapiens
aagatacagaactctttcaa

SEQ ID NO: 167871 - DNA, 14 bp, Homo sapiens
aagatagcagggca

SEQ ID NO: 167872 - DNA, 21 bp, Homo sapiens
aagatatattaaaaatataaa

SEQ ID NO: 167873 - DNA, 16 bp, Homo sapiens
aagatatgggacattt

SEQ ID NO: 167874 - DNA, 19 bp, Homo sapiens
aagatatgggacatttttg

SEQ ID NO: 167875 - DNA, 19 bp, Homo sapiens
aagatattttaaaatctgt

SEQ ID NO: 167876 - DNA, 15 bp, Homo sapiens
aagatatttttcatg

SEQ ID NO: 167877 - DNA, 18 bp, Homo sapiens
aagatgatctactcagaa

SEQ ID NO: 167878 - DNA, 21 bp, Homo sapiens
aagatgctgaaacaggagaga

SEQ ID NO: 167879 - DNA, 22 bp, Homo sapiens
aagatggcccagctccccaaga

SEQ ID NO: 167880 - DNA, 14 bp, Homo sapiens
aagatgggtgggga

SEQ ID NO: 167881 - DNA, 13 bp, Homo sapiens
aagattagaatga

SEQ ID NO: 167882 - DNA, 17 bp, Homo sapiens
aagattcatccatttat

SEQ ID NO: 167883 - DNA, 14 bp, Homo sapiens
aagattcccagaga

SEQ ID NO: 167884 - DNA, 18 bp, Homo sapiens
aagattcccagagacagg

SEQ ID NO: 167885 - DNA, 13 bp, Homo sapiens
aagattctttccc

SEQ ID NO: 167886 - DNA, 19 bp, Homo sapiens
aagattttgaaatttttat

SEQ ID NO: 167887 - DNA, 13 bp, Homo sapiens
aagcaaaatgtga

SEQ ID NO: 167888 - DNA, 17 bp, Homo sapiens
aagcaaaggtgaagaga

SEQ ID NO: 167889 - DNA, 13 bp, Homo sapiens
aaaaaaaaagttc

SEQ ID NO: 167890 - DNA, 12 bp, Homo sapiens
aaaaaaatgaca

SEQ ID NO: 167891 - DNA, 20 bp, Homo sapiens
aaaaaagtttacaagtgtat

SEQ ID NO: 167892 - DNA, 13 bp, Homo sapiens
aaaaaatctgcag

SEQ ID NO: 167893 - DNA, 16 bp, Homo sapiens
aaaaaatgtatatgca

SEQ ID NO: 167894 - DNA, 12 bp, Homo sapiens
aaaaacacagca

SEQ ID NO: 167895 - DNA, 17 bp, Homo sapiens
aaaaagatatattaaaa

SEQ ID NO: 167896 - DNA, 22 bp, Homo sapiens
aaaaagatatattaaaaatata

SEQ ID NO: 167897 - DNA, 19 bp, Homo sapiens
aaaaagctcatattttgta

SEQ ID NO: 167898 - DNA, 14 bp, Homo sapiens
aaaaaggaggaaga

SEQ ID NO: 167899 - DNA, 17 bp, Homo sapiens
aaaaagtttacaagtgt

SEQ ID NO: 167900 - DNA, 21 bp, Homo sapiens
aaaaataaaaactgactcctt

SEQ ID NO: 167901 - DNA, 18 bp, Homo sapiens
aaaaatgcccttaaatca

SEQ ID NO: 167902 - DNA, 16 bp, Homo sapiens
aaaaatgtatatgcac

SEQ ID NO: 167903 - DNA, 22 bp, Homo sapiens
aaaaatgtcttgggtaggcggg

SEQ ID NO: 167904 - DNA, 14 bp, Homo sapiens
aaaaattgtgatca

SEQ ID NO: 167905 - DNA, 12 bp, Homo sapiens
aaaacacagcaa

SEQ ID NO: 167906 - DNA, 13 bp, Homo sapiens
aaaacacagcaag

SEQ ID NO: 167907 - DNA, 18 bp, Homo sapiens
aaaacaggtggagaaatt

SEQ ID NO: 167908 - DNA, 19 bp, Homo sapiens
aaaaccaagccgtggcttc

SEQ ID NO: 167909 - DNA, 15 bp, Homo sapiens
aaaaccaatgttctc

SEQ ID NO: 167910 - DNA, 13 bp, Homo sapiens
aaaaccacagcag

SEQ ID NO: 167911 - DNA, 13 bp, Homo sapiens
aaaacctttcaaa

SEQ ID NO: 167912 - DNA, 20 bp, Homo sapiens
aaaacctttcaaatttcaca

SEQ ID NO: 167913 - DNA, 16 bp, Homo sapiens
aaaacggttaaaactg

SEQ ID NO: 167914 - DNA, 18 bp, Homo sapiens
aaaactgaaaatctaata

SEQ ID NO: 167915 - DNA, 22 bp, Homo sapiens
aaaactgctgactgttttctct

SEQ ID NO: 167916 - DNA, 23 bp, Homo sapiens
aaaactgctgactgttttctctt

SEQ ID NO: 167917 - DNA, 19 bp, Homo sapiens
aaaacttaacatatttact

SEQ ID NO: 167918 - DNA, 15 bp, Homo sapiens
aaaacttcagacata

SEQ ID NO: 167919 - DNA, 22 bp, Homo sapiens
aaaacttgatgtgttatctctt

SEQ ID NO: 167920 - DNA, 21 bp, Homo sapiens
aaaactttatgctaagtgaaa

SEQ ID NO: 167921 - DNA, 14 bp, Homo sapiens
aaaactttcctcgc

SEQ ID NO: 167922 - DNA, 16 bp, Homo sapiens
aaaactttcctcgcct

SEQ ID NO: 167923 - DNA, 13 bp, Homo sapiens
aaaagataaagat

SEQ ID NO: 167924 - DNA, 14 bp, Homo sapiens
aaaagataaagatg

SEQ ID NO: 167925 - DNA, 17 bp, Homo sapiens
aaaagataaagatgatc

SEQ ID NO: 167926 - DNA, 18 bp, Homo sapiens
aaaagataaagatgatct

SEQ ID NO: 167927 - DNA, 17 bp, Homo sapiens
aaaagatgaaaatattt

SEQ ID NO: 167928 - DNA, 13 bp, Homo sapiens
aaaagatgcttct

SEQ ID NO: 167929 - DNA, 15 bp, Homo sapiens
aaaagcataaatgca

SEQ ID NO: 167930 - DNA, 13 bp, Homo sapiens
aaaagctcctgtc

SEQ ID NO: 167931 - DNA, 22 bp, Homo sapiens
aaaaggtgcctgtgaggcaggg

SEQ ID NO: 167932 - DNA, 17 bp, Homo sapiens
aaaagtacatttaatac

SEQ ID NO: 167933 - DNA, 21 bp, Homo sapiens
aaaagtacatttaatacagca

SEQ ID NO: 167934 - DNA, 17 bp, Homo sapiens
aaaagttctgacttgac

SEQ ID NO: 167935 - DNA, 17 bp, Homo sapiens
aaaagtttgccagaagt

SEQ ID NO: 167936 - DNA, 14 bp, Homo sapiens
aaaataacacacat

SEQ ID NO: 167937 - DNA, 16 bp, Homo sapiens
aaaataacttcaagca

SEQ ID NO: 167938 - DNA, 15 bp, Homo sapiens
aaaatactattctga

SEQ ID NO: 167939 - DNA, 12 bp, Homo sapiens
aaaatagcctgc

SEQ ID NO: 167940 - DNA, 20 bp, Homo sapiens
aaaatatagctgtacaaata

SEQ ID NO: 167941 - DNA, 21 bp, Homo sapiens
aaaatatagctgtacaaatat

SEQ ID NO: 167942 - DNA, 15 bp, Homo sapiens
aaaatatatttaatg

SEQ ID NO: 167943 - DNA, 14 bp, Homo sapiens
aaaatattatgtgt

SEQ ID NO: 167944 - DNA, 17 bp, Homo sapiens
aaaatattttataattt

SEQ ID NO: 167945 - DNA, 12 bp, Homo sapiens
aaaatattttgt

SEQ ID NO: 167946 - DNA, 16 bp, Homo sapiens
aaaatattttgtctaa

SEQ ID NO: 167947 - DNA, 21 bp, Homo sapiens
aaaatcagcctgctccagctg

SEQ ID NO: 167948 - DNA, 13 bp, Homo sapiens
aaaatcatattgc

SEQ ID NO: 167949 - DNA, 14 bp, Homo sapiens
aaaatcatattgct

SEQ ID NO: 167950 - DNA, 18 bp, Homo sapiens
aaaatcatattgcttctt

SEQ ID NO: 167951 - DNA, 20 bp, Homo sapiens
aaaatcattttatatgtcaa

SEQ ID NO: 167952 - DNA, 22 bp, Homo sapiens
aaaatcattttatatgtcaaag

SEQ ID NO: 167953 - DNA, 22 bp, Homo sapiens
aaaatcccttacctcggtgcct

SEQ ID NO: 167954 - DNA, 19 bp, Homo sapiens
aaaatctgcagaaggaaaa

SEQ ID NO: 167955 - DNA, 17 bp, Homo sapiens
aaaatcttggcacagaa

SEQ ID NO: 167956 - DNA, 15 bp, Homo sapiens
aaaatgacagatgtt

SEQ ID NO: 167957 - DNA, 18 bp, Homo sapiens
aaaatgacagatgttgaa

SEQ ID NO: 167958 - DNA, 20 bp, Homo sapiens
aaaatgaccagtaattgtga

SEQ ID NO: 167959 - DNA, 15 bp, Homo sapiens
aaaatgaggaatgta

SEQ ID NO: 167960 - DNA, 16 bp, Homo sapiens
aaaatgaggacatgtt

SEQ ID NO: 167961 - DNA, 19 bp, Homo sapiens
aaaatgattgtaaaatagc

SEQ ID NO: 167962 - DNA, 17 bp, Homo sapiens
aaaatgcccttaaatca

SEQ ID NO: 167963 - DNA, 19 bp, Homo sapiens
aaaatgcctcagtgtattt

SEQ ID NO: 167964 - DNA, 13 bp, Homo sapiens
aaaatggaaagaa

SEQ ID NO: 167965 - DNA, 18 bp, Homo sapiens
aaaatggtttaaatggtc

SEQ ID NO: 167966 - DNA, 12 bp, Homo sapiens
aaaatgtgaagt

SEQ ID NO: 167967 - DNA, 16 bp, Homo sapiens
aaaatgtgtaattttg

SEQ ID NO: 167968 - DNA, 20 bp, Homo sapiens
aaaatgtgtaattttgttct

SEQ ID NO: 167969 - DNA, 19 bp, Homo sapiens
aaaattaggatttcatgat

SEQ ID NO: 167970 - DNA, 19 bp, Homo sapiens
aaaattattttaaacaaaa

SEQ ID NO: 167971 - DNA, 20 bp, Homo sapiens
aaaattctgtaggttctgtg

SEQ ID NO: 167972 - DNA, 13 bp, Homo sapiens
aaaattcttggaa

SEQ ID NO: 167973 - DNA, 12 bp, Homo sapiens
aaaattgatgtg

SEQ ID NO: 167974 - DNA, 14 bp, Homo sapiens
aaaattgatgtgtt

SEQ ID NO: 167975 - DNA, 20 bp, Homo sapiens
aaaattgttaatttttccta

SEQ ID NO: 167976 - DNA, 18 bp, Homo sapiens
aaaatttgttattttgca

SEQ ID NO: 167977 - DNA, 13 bp, Homo sapiens
aaaattttattcc

SEQ ID NO: 167978 - DNA, 19 bp, Homo sapiens
aaacaaaaattaaaatcct

SEQ ID NO: 167979 - DNA, 16 bp, Homo sapiens
aaacaacaatttctac

SEQ ID NO: 167980 - DNA, 24 bp, Homo sapiens
aaacactcagttgttcaataataa

SEQ ID NO: 167981 - DNA, 16 bp, Homo sapiens
aaacaggagacaggaa

SEQ ID NO: 167982 - DNA, 17 bp, Homo sapiens
aaacaggagacaggaag

SEQ ID NO: 167983 - DNA, 20 bp, Homo sapiens
aaacagtctcaggaaatcaa

SEQ ID NO: 167984 - DNA, 12 bp, Homo sapiens
aaacagtgcctg

SEQ ID NO: 167985 - DNA, 18 bp, Homo sapiens
aaacagtgcctgctgaat

SEQ ID NO: 167986 - DNA, 14 bp, Homo sapiens
aaacatcacacaca

SEQ ID NO: 167987 - DNA, 12 bp, Homo sapiens
aaacattaagaa

SEQ ID NO: 167988 - DNA, 16 bp, Homo sapiens
aaacattaagaaaatc

SEQ ID NO: 167989 - DNA, 14 bp, Homo sapiens
aaaccaagccgtgg

SEQ ID NO: 167990 - DNA, 23 bp, Homo sapiens
aaaccaagtcaagtgaaaaagga

SEQ ID NO: 167991 - DNA, 22 bp, Homo sapiens
aggaatcatgtcaggcctgtgt

SEQ ID NO: 167992 - DNA, 23 bp, Homo sapiens
aggaatcatgtcaggcctgtgtg

SEQ ID NO: 167993 - DNA, 14 bp, Homo sapiens
aggaatgttaaagt

SEQ ID NO: 167994 - DNA, 22 bp, Homo sapiens
aggaatgttaaagtcagtggga

SEQ ID NO: 167995 - DNA, 19 bp, Homo sapiens
aggaattgacccacaagaa

SEQ ID NO: 167996 - DNA, 14 bp, Homo sapiens
aggacaacgaggaa

SEQ ID NO: 167997 - DNA, 16 bp, Homo sapiens
aggacaacgaggaagc

SEQ ID NO: 167998 - DNA, 15 bp, Homo sapiens
aggacaccacaccca

SEQ ID NO: 167999 - DNA, 18 bp, Homo sapiens
aggacaccacacccagcc

SEQ ID NO: 168000 - DNA, 21 bp, Homo sapiens
aggacaccacacccagcctca

SEQ ID NO: 168001 - DNA, 22 bp, Homo sapiens
aggacaccacacccagcctcag

SEQ ID NO: 168002 - DNA, 18 bp, Homo sapiens
aggacaggaccagatttt

SEQ ID NO: 168003 - DNA, 20 bp, Homo sapiens
aggacataaattagaggtct

SEQ ID NO: 168004 - DNA, 21 bp, Homo sapiens
aggacatgtttttgttttctt

SEQ ID NO: 168005 - DNA, 18 bp, Homo sapiens
aggacccatcacgcctgt

SEQ ID NO: 168006 - DNA, 20 bp, Homo sapiens
aggacccggaggggcctggc

SEQ ID NO: 168007 - DNA, 22 bp, Homo sapiens
aggacccggaggggcctggcag

SEQ ID NO: 168008 - DNA, 20 bp, Homo sapiens
aggacctcaggtgagaagca

SEQ ID NO: 168009 - DNA, 20 bp, Homo sapiens
aggacctctgaaaccctgga

SEQ ID NO: 168010 - DNA, 13 bp, Homo sapiens
aggacctgcctgt

SEQ ID NO: 168011 - DNA, 14 bp, Homo sapiens
aggacgtgggcggc

SEQ ID NO: 168012 - DNA, 18 bp, Homo sapiens
aggactcagaagcctctg

SEQ ID NO: 168013 - DNA, 15 bp, Homo sapiens
aggactctgcccaga

SEQ ID NO: 168014 - DNA, 12 bp, Homo sapiens
aggactctgcct

SEQ ID NO: 168015 - DNA, 18 bp, Homo sapiens
aggactctgcctcctctt

SEQ ID NO: 168016 - DNA, 17 bp, Homo sapiens
aggactgaattgtcccc

SEQ ID NO: 168017 - DNA, 20 bp, Homo sapiens
aggactgaattgtccccagt

SEQ ID NO: 168018 - DNA, 21 bp, Homo sapiens
aggactgccccgtgcagactg

SEQ ID NO: 168019 - DNA, 17 bp, Homo sapiens
aggagaaactggaactc

SEQ ID NO: 168020 - DNA, 16 bp, Homo sapiens
aggagaatccaagcga

SEQ ID NO: 168021 - DNA, 18 bp, Homo sapiens
aggagaatccaagcgagg

SEQ ID NO: 168022 - DNA, 14 bp, Homo sapiens
aggagactcacctc

SEQ ID NO: 168023 - DNA, 16 bp, Homo sapiens
aggagactcacctctg

SEQ ID NO: 168024 - DNA, 18 bp, Homo sapiens
aggagactcacctctgcc

SEQ ID NO: 168025 - DNA, 21 bp, Homo sapiens
aggagactcacctctgcctca

SEQ ID NO: 168026 - DNA, 17 bp, Homo sapiens
aggagagaaggggagga

SEQ ID NO: 168027 - DNA, 16 bp, Homo sapiens
aggagagcccttcatt

SEQ ID NO: 168028 - DNA, 15 bp, Homo sapiens
aggagagctagcagc

SEQ ID NO: 168029 - DNA, 15 bp, Homo sapiens
aggagaggagagagg

SEQ ID NO: 168030 - DNA, 16 bp, Homo sapiens
aggagaggagagaggc

SEQ ID NO: 168031 - DNA, 17 bp, Homo sapiens
aggagaggagagaggca

SEQ ID NO: 168032 - DNA, 14 bp, Homo sapiens
aggagaggggcaca

SEQ ID NO: 168033 - DNA, 18 bp, Homo sapiens
aggagaggggcagaacag

SEQ ID NO: 168034 - DNA, 19 bp, Homo sapiens
aggagaggggcagaacagc

SEQ ID NO: 168035 - DNA, 20 bp, Homo sapiens
aggagatggaagttgcagtg

SEQ ID NO: 168036 - DNA, 15 bp, Homo sapiens
aggagattgagaagg

SEQ ID NO: 168037 - DNA, 16 bp, Homo sapiens
aggagattgagaagga

SEQ ID NO: 168038 - DNA, 17 bp, Homo sapiens
aggagattgagaaggag

SEQ ID NO: 168039 - DNA, 22 bp, Homo sapiens
aggagattgagaaggagagaaa

SEQ ID NO: 168040 - DNA, 19 bp, Homo sapiens
aggagcaggagcctgagcc

SEQ ID NO: 168041 - DNA, 16 bp, Homo sapiens
aggagccccattcctg

SEQ ID NO: 168042 - DNA, 21 bp, Homo sapiens
aggagccccattcctgggaaa

SEQ ID NO: 168043 - DNA, 21 bp, Homo sapiens
aggagcccttatctgtgctca

SEQ ID NO: 168044 - DNA, 22 bp, Homo sapiens
aggaggaatcatgtcaggcctg

SEQ ID NO: 168045 - DNA, 23 bp, Homo sapiens
aggaggaatcatgtcaggcctgt

SEQ ID NO: 168046 - DNA, 12 bp, Homo sapiens
aggaggaggagg

SEQ ID NO: 168047 - DNA, 13 bp, Homo sapiens
aggaggctccaga

SEQ ID NO: 168048 - DNA, 17 bp, Homo sapiens
aggaggctccagagggc

SEQ ID NO: 168049 - DNA, 18 bp, Homo sapiens
aggaggctccagagggca

SEQ ID NO: 168050 - DNA, 17 bp, Homo sapiens
aggaggctgaggcagaa

SEQ ID NO: 168051 - DNA, 23 bp, Homo sapiens
aggagggaggtattcgtgcagca

SEQ ID NO: 168052 - DNA, 18 bp, Homo sapiens
aggagggtcaggaaggat

SEQ ID NO: 168053 - DNA, 20 bp, Homo sapiens
aggaggtggaggttgcagtg

SEQ ID NO: 168054 - DNA, 16 bp, Homo sapiens
aggagtgtgagaatca

SEQ ID NO: 168055 - DNA, 17 bp, Homo sapiens
aggagttagaggccagc

SEQ ID NO: 168056 - DNA, 20 bp, Homo sapiens
aggagttagaggccagcctg

SEQ ID NO: 168057 - DNA, 15 bp, Homo sapiens
aggatcaagaaagtg

SEQ ID NO: 168058 - DNA, 17 bp, Homo sapiens
aggatctcttgagcctg

SEQ ID NO: 168059 - DNA, 18 bp, Homo sapiens
aggatctcttgagcctgg

SEQ ID NO: 168060 - DNA, 22 bp, Homo sapiens
aggatctcttgagcctgggagg

SEQ ID NO: 168061 - DNA, 19 bp, Homo sapiens
aggatgagctctacccagg

SEQ ID NO: 168062 - DNA, 20 bp, Homo sapiens
aggatgagctctacccaggg

SEQ ID NO: 168063 - DNA, 17 bp, Homo sapiens
aggatgctaacatctaa

SEQ ID NO: 168064 - DNA, 22 bp, Homo sapiens
aggatgctaacatctaaaaata

SEQ ID NO: 168065 - DNA, 23 bp, Homo sapiens
aggatgctaacatctaaaaatag

SEQ ID NO: 168066 - DNA, 17 bp, Homo sapiens
aggatggagccagctct

SEQ ID NO: 168067 - DNA, 12 bp, Homo sapiens
aggatgggaagg

SEQ ID NO: 168068 - DNA, 17 bp, Homo sapiens
aggatgggaaggaggga

SEQ ID NO: 168069 - DNA, 15 bp, Homo sapiens
aggatgtcacagggc

SEQ ID NO: 168070 - DNA, 18 bp, Homo sapiens
aggatgtcacagggccaa

SEQ ID NO: 168071 - DNA, 19 bp, Homo sapiens
aggatgtcactcagatgga

SEQ ID NO: 168072 - DNA, 15 bp, Homo sapiens
ttaacctctgcacta

SEQ ID NO: 168073 - DNA, 20 bp, Homo sapiens
ttaagacactgaaaaatcta

SEQ ID NO: 168074 - DNA, 17 bp, Homo sapiens
ttaagcactacataaac

SEQ ID NO: 168075 - DNA, 21 bp, Homo sapiens
ttaagcagatggaatgctgtg

SEQ ID NO: 168076 - DNA, 14 bp, Homo sapiens
ttaagctgtttcca

SEQ ID NO: 168077 - DNA, 19 bp, Homo sapiens
ttaaggacaaaaatgaact

SEQ ID NO: 168078 - DNA, 15 bp, Homo sapiens
ttaagtattgcatct

SEQ ID NO: 168079 - DNA, 16 bp, Homo sapiens
ttaagtatttatatat

SEQ ID NO: 168080 - DNA, 12 bp, Homo sapiens
ttaagttacttc

SEQ ID NO: 168081 - DNA, 18 bp, Homo sapiens
ttaagttgctgatgaact

SEQ ID NO: 168082 - DNA, 15 bp, Homo sapiens
ttaataaaaaggcac

SEQ ID NO: 168083 - DNA, 15 bp, Homo sapiens
ttaataagtttcact

SEQ ID NO: 168084 - DNA, 20 bp, Homo sapiens
ttaatagcttttattgtata

SEQ ID NO: 168085 - DNA, 15 bp, Homo sapiens
ttaatataactgcct

SEQ ID NO: 168086 - DNA, 23 bp, Homo sapiens
ttaatataactgccttaaaactt

SEQ ID NO: 168087 - DNA, 19 bp, Homo sapiens
ttaatatccctacatgtat

SEQ ID NO: 168088 - DNA, 19 bp, Homo sapiens
ttaatatttgctgacagct

SEQ ID NO: 168089 - DNA, 22 bp, Homo sapiens
ttaatcattttgcctcttttct

SEQ ID NO: 168090 - DNA, 14 bp, Homo sapiens
ttaatctttcctga

SEQ ID NO: 168091 - DNA, 19 bp, Homo sapiens
ttaatgacagagccagtgg

SEQ ID NO: 168092 - DNA, 15 bp, Homo sapiens
ttaattatcttttct

SEQ ID NO: 168093 - DNA, 14 bp, Homo sapiens
ttaattattattta

SEQ ID NO: 168094 - DNA, 22 bp, Homo sapiens
ttaattgattattctgattcca

SEQ ID NO: 168095 - DNA, 15 bp, Homo sapiens
ttaatttatgagttt

SEQ ID NO: 168096 - DNA, 18 bp, Homo sapiens
ttaatttatgagtttttg

SEQ ID NO: 168097 - DNA, 18 bp, Homo sapiens
ttaatttttttaaccaaa

SEQ ID NO: 168098 - DNA, 13 bp, Homo sapiens
ttacaaagtgtgt

SEQ ID NO: 168099 - DNA, 17 bp, Homo sapiens
ttacaaagtgtgtatta

SEQ ID NO: 168100 - DNA, 22 bp, Homo sapiens
ttacaaagtgtgtattaaaaaa

SEQ ID NO: 168101 - DNA, 21 bp, Homo sapiens
ttacaataaaactttgctgcc

SEQ ID NO: 168102 - DNA, 16 bp, Homo sapiens
ttacaatgttcatccc

SEQ ID NO: 168103 - DNA, 19 bp, Homo sapiens
ttacaattccctgctgtcg

SEQ ID NO: 168104 - DNA, 16 bp, Homo sapiens
ttacaatttacaaagt

SEQ ID NO: 168105 - DNA, 15 bp, Homo sapiens
ttacagcctctgact

SEQ ID NO: 168106 - DNA, 17 bp, Homo sapiens
ttacatgaattgcattt

SEQ ID NO: 168107 - DNA, 19 bp, Homo sapiens
ttacattattatcaacaat

SEQ ID NO: 168108 - DNA, 13 bp, Homo sapiens
ttacattgtaaat

SEQ ID NO: 168109 - DNA, 17 bp, Homo sapiens
ttacatttccaaatgaa

SEQ ID NO: 168110 - DNA, 15 bp, Homo sapiens
ttacatttttacaat

SEQ ID NO: 168111 - DNA, 18 bp, Homo sapiens
ttacatttttacaataaa

SEQ ID NO: 168112 - DNA, 13 bp, Homo sapiens
ttaccaactttct

SEQ ID NO: 168113 - DNA, 16 bp, Homo sapiens
ttaccatgtgcctgat

SEQ ID NO: 168114 - DNA, 15 bp, Homo sapiens
ttaccgcgttgtaaa

SEQ ID NO: 168115 - DNA, 16 bp, Homo sapiens
ttaccgcgttgtaaaa

SEQ ID NO: 168116 - DNA, 21 bp, Homo sapiens
ttaccgcgttgtaaaatatag

SEQ ID NO: 168117 - DNA, 13 bp, Homo sapiens
ttacctaattaga

SEQ ID NO: 168118 - DNA, 13 bp, Homo sapiens
ttacctcctgccc

SEQ ID NO: 168119 - DNA, 11 bp, Homo sapiens
ttacctctgat

SEQ ID NO: 168120 - DNA, 18 bp, Homo sapiens
ttacctgggcattcttgt

SEQ ID NO: 168121 - DNA, 22 bp, Homo sapiens
ttacctgttttcgcacctacca

SEQ ID NO: 168122 - DNA, 23 bp, Homo sapiens
ttacctgttttcgcacctaccat

SEQ ID NO: 168123 - DNA, 21 bp, Homo sapiens
ttactaagccacaagaaattt

SEQ ID NO: 168124 - DNA, 13 bp, Homo sapiens
ttactacagttgt

SEQ ID NO: 168125 - DNA, 23 bp, Homo sapiens
ttactagggatccctcatctgtc

SEQ ID NO: 168126 - DNA, 17 bp, Homo sapiens
ttactagtttcccttgc

SEQ ID NO: 168127 - DNA, 21 bp, Homo sapiens
ttactatcatgtcaaacgtga

SEQ ID NO: 168128 - DNA, 16 bp, Homo sapiens
ttactatgcacaattt

SEQ ID NO: 168129 - DNA, 14 bp, Homo sapiens
ttactcagccctgg

SEQ ID NO: 168130 - DNA, 13 bp, Homo sapiens
ttactgagcttct

SEQ ID NO: 168131 - DNA, 17 bp, Homo sapiens
ttactgagcttctctgt

SEQ ID NO: 168132 - DNA, 18 bp, Homo sapiens
ttactgagcttctctgtg

SEQ ID NO: 168133 - DNA, 19 bp, Homo sapiens
ttactgagcttctctgtga

SEQ ID NO: 168134 - DNA, 22 bp, Homo sapiens
ttactgcagcctttgcctcccc

SEQ ID NO: 168135 - DNA, 15 bp, Homo sapiens
ttactgcagctttgt

SEQ ID NO: 168136 - DNA, 14 bp, Homo sapiens
ttacttgacctcct

SEQ ID NO: 168137 - DNA, 19 bp, Homo sapiens
ttacttgcattgaatatat

SEQ ID NO: 168138 - DNA, 17 bp, Homo sapiens
ttagaaattgcatttcc

SEQ ID NO: 168139 - DNA, 22 bp, Homo sapiens
ttagaacaggcaagtgaagaaa

SEQ ID NO: 168140 - DNA, 13 bp, Homo sapiens
ttagaacctttct

SEQ ID NO: 168141 - DNA, 23 bp, Homo sapiens
ttagacagtcaaggagtggctta

SEQ ID NO: 168142 - DNA, 18 bp, Homo sapiens
ttagactaaggccattat

SEQ ID NO: 168143 - DNA, 17 bp, Homo sapiens
ttagaggaaaaaaatga

SEQ ID NO: 168144 - DNA, 21 bp, Homo sapiens
ttccagagagtggctcctccc

SEQ ID NO: 168145 - DNA, 18 bp, Homo sapiens
ttccagataaccagctgt

SEQ ID NO: 168146 - DNA, 22 bp, Homo sapiens
ttccataatctggactcctctg

SEQ ID NO: 168147 - DNA, 17 bp, Homo sapiens
ttccatgtcgcctctgc

SEQ ID NO: 168148 - DNA, 13 bp, Homo sapiens
ttccattccagaa

SEQ ID NO: 168149 - DNA, 17 bp, Homo sapiens
ttccattggatctcatt

SEQ ID NO: 168150 - DNA, 13 bp, Homo sapiens
ttccatttgcaag

SEQ ID NO: 168151 - DNA, 17 bp, Homo sapiens
ttcccaaaggactccac

SEQ ID NO: 168152 - DNA, 15 bp, Homo sapiens
ttcccagagacagga

SEQ ID NO: 168153 - DNA, 19 bp, Homo sapiens
ttcccagctctccctctgg

SEQ ID NO: 168154 - DNA, 23 bp, Homo sapiens
ttcccagctctccctctggccct

SEQ ID NO: 168155 - DNA, 17 bp, Homo sapiens
ttcccagtgaattcttg

SEQ ID NO: 168156 - DNA, 23 bp, Homo sapiens
ttcccatcactggagcaccaggc

SEQ ID NO: 168157 - DNA, 15 bp, Homo sapiens
ttccccaaagtctta

SEQ ID NO: 168158 - DNA, 21 bp, Homo sapiens
ttccccactgacagcctccca

SEQ ID NO: 168159 - DNA, 15 bp, Homo sapiens
ttccccagcccaggg

SEQ ID NO: 168160 - DNA, 15 bp, Homo sapiens
ttccccatctgggtc

SEQ ID NO: 168161 - DNA, 14 bp, Homo sapiens
ttcccccatagcca

SEQ ID NO: 168162 - DNA, 18 bp, Homo sapiens
ttcccccatagccacccc

SEQ ID NO: 168163 - DNA, 21 bp, Homo sapiens
ttccccttccactgagggcag

SEQ ID NO: 168164 - DNA, 22 bp, Homo sapiens
ttccccttgcccagggctcagc

SEQ ID NO: 168165 - DNA, 12 bp, Homo sapiens
ttcccgctcagc

SEQ ID NO: 168166 - DNA, 18 bp, Homo sapiens
ttcccgctcagccctccc

SEQ ID NO: 168167 - DNA, 19 bp, Homo sapiens
ttccctaagccaagggcct

SEQ ID NO: 168168 - DNA, 18 bp, Homo sapiens
ttccctgagtcaccagga

SEQ ID NO: 168169 - DNA, 13 bp, Homo sapiens
ttccgcttggagc

SEQ ID NO: 168170 - DNA, 15 bp, Homo sapiens
ttcctaataaagttc

SEQ ID NO: 168171 - DNA, 16 bp, Homo sapiens
ttcctacaaagatgtt

SEQ ID NO: 168172 - DNA, 18 bp, Homo sapiens
ttcctacagatagtcaaa

SEQ ID NO: 168173 - DNA, 13 bp, Homo sapiens
ttcctatacgcag

SEQ ID NO: 168174 - DNA, 19 bp, Homo sapiens
ttcctatacgcagcgtgct

SEQ ID NO: 168175 - DNA, 22 bp, Homo sapiens
ttcctatatagtttattgacaa

SEQ ID NO: 168176 - DNA, 14 bp, Homo sapiens
ttcctcctgggccc

SEQ ID NO: 168177 - DNA, 14 bp, Homo sapiens
ttcctcgccctggg

SEQ ID NO: 168178 - DNA, 18 bp, Homo sapiens
ttcctctcactaaacttt

SEQ ID NO: 168179 - DNA, 19 bp, Homo sapiens
ttcctctcactaaacttta

SEQ ID NO: 168180 - DNA, 22 bp, Homo sapiens
ttcctctttttatttagttcct

SEQ ID NO: 168181 - DNA, 15 bp, Homo sapiens
ttcctgaacctgatg

SEQ ID NO: 168182 - DNA, 19 bp, Homo sapiens
ttcctgatggtacaggaaa

SEQ ID NO: 168183 - DNA, 15 bp, Homo sapiens
ttcctgcagcctgga

SEQ ID NO: 168184 - DNA, 18 bp, Homo sapiens
ttcctgcagcctggaggc

SEQ ID NO: 168185 - DNA, 15 bp, Homo sapiens
ttcctgcatttgtga

SEQ ID NO: 168186 - DNA, 18 bp, Homo sapiens
ttcctgccgcaacagttt

SEQ ID NO: 168187 - DNA, 16 bp, Homo sapiens
ttccttactgcagaat

SEQ ID NO: 168188 - DNA, 23 bp, Homo sapiens
ttccttagcttagacctcagcct

SEQ ID NO: 168189 - DNA, 22 bp, Homo sapiens
ttccttcagtgcatctgggaag

SEQ ID NO: 168190 - DNA, 12 bp, Homo sapiens
ttccttccctgg

SEQ ID NO: 168191 - DNA, 16 bp, Homo sapiens
ttccttccttccctgg

SEQ ID NO: 168192 - DNA, 20 bp, Homo sapiens
ttccttctgtgaaagtacat

SEQ ID NO: 168193 - DNA, 20 bp, Homo sapiens
ttccttgagttgattcagct

SEQ ID NO: 168194 - DNA, 17 bp, Homo sapiens
ttccttggactcatttt

SEQ ID NO: 168195 - DNA, 20 bp, Homo sapiens
ttccttttaaaacacttcca

SEQ ID NO: 168196 - DNA, 18 bp, Homo sapiens
ttctaaaaattgtgatca

SEQ ID NO: 168197 - DNA, 20 bp, Homo sapiens
ttctaaaggcctcttccttg

SEQ ID NO: 168198 - DNA, 20 bp, Homo sapiens
ttctaacaaaaaaatatatt

SEQ ID NO: 168199 - DNA, 23 bp, Homo sapiens
ttctaagaagtgaaaatctacac

SEQ ID NO: 168200 - DNA, 19 bp, Homo sapiens
ttctaagtaaaaccacagc

SEQ ID NO: 168201 - DNA, 20 bp, Homo sapiens
ttctaagtaaaaccacagca

SEQ ID NO: 168202 - DNA, 12 bp, Homo sapiens
ttctaagtcttt

SEQ ID NO: 168203 - DNA, 15 bp, Homo sapiens
ttctaagtctttcca

SEQ ID NO: 168204 - DNA, 14 bp, Homo sapiens
ttctaatagaactc

SEQ ID NO: 168205 - DNA, 14 bp, Homo sapiens
ttctaatagtttta

SEQ ID NO: 168206 - DNA, 23 bp, Homo sapiens
ttctaatgtgtgaatcagagcac

SEQ ID NO: 168207 - DNA, 17 bp, Homo sapiens
ttctagctagaaatatg

SEQ ID NO: 168208 - DNA, 20 bp, Homo sapiens
ttctagctgttgagctgttt

SEQ ID NO: 168209 - DNA, 21 bp, Homo sapiens
ttctagctgttgagctgtttt

SEQ ID NO: 168210 - DNA, 14 bp, Homo sapiens
ttctagttttcagt

SEQ ID NO: 168211 - DNA, 23 bp, Homo sapiens
ttctagttttcagtttgtatata

SEQ ID NO: 168212 - DNA, 22 bp, Homo sapiens
ttctattcaaggtggccaaatt

SEQ ID NO: 168213 - DNA, 13 bp, Homo sapiens
ttctattgaaaaa

SEQ ID NO: 168214 - DNA, 15 bp, Homo sapiens
ttctattgttgtaca

SEQ ID NO: 168215 - DNA, 19 bp, Homo sapiens
ttctatttctcctccatgg

SEQ ID NO: 168216 - DNA, 16 bp, Homo sapiens
ttctcactccaccacc

SEQ ID NO: 168217 - DNA, 15 bp, Homo sapiens
ttctcagaatctacc

SEQ ID NO: 168218 - DNA, 22 bp, Homo sapiens
ttctcagtcagtaattgccaaa

SEQ ID NO: 168219 - DNA, 20 bp, Homo sapiens
ttctcattccaacagtgagt

SEQ ID NO: 168220 - DNA, 20 bp, Homo sapiens
ttctccatccacatgggagc

SEQ ID NO: 168221 - DNA, 15 bp, Homo sapiens
ttctcctatgtgtaa

SEQ ID NO: 168222 - DNA, 12 bp, Homo sapiens
ttctcctgtgct

SEQ ID NO: 168223 - DNA, 13 bp, Homo sapiens
ttctctcacctcc

SEQ ID NO: 168224 - DNA, 16 bp, Homo sapiens
ttctctctcctgtcca

SEQ ID NO: 168225 - DNA, 12 bp, Homo sapiens
ttctctgccagt

SEQ ID NO: 168226 - DNA, 20 bp, Homo sapiens
ttctctgtgaacgatttaga

SEQ ID NO: 168227 - DNA, 23 bp, Homo sapiens
ttctcttactgcaaatgtcatca

SEQ ID NO: 168228 - DNA, 18 bp, Homo sapiens
ttctgagaaggtccttaa

SEQ ID NO: 168229 - DNA, 19 bp, Homo sapiens
ttgacaggattattggaaa

SEQ ID NO: 168230 - DNA, 16 bp, Homo sapiens
ttgaccaagcaggaag

SEQ ID NO: 168231 - DNA, 14 bp, Homo sapiens
ttgacccacaagaa

SEQ ID NO: 168232 - DNA, 15 bp, Homo sapiens
ttgacggatgattgg

SEQ ID NO: 168233 - DNA, 16 bp, Homo sapiens
ttgagaaggagagaaa

SEQ ID NO: 168234 - DNA, 15 bp, Homo sapiens
ttgagacctcagcca

SEQ ID NO: 168235 - DNA, 23 bp, Homo sapiens
ttgagctcagacccccactctca

SEQ ID NO: 168236 - DNA, 18 bp, Homo sapiens
ttgagctgttttccctga

SEQ ID NO: 168237 - DNA, 21 bp, Homo sapiens
ttgaggtaggagaattgcttg

SEQ ID NO: 168238 - DNA, 22 bp, Homo sapiens
ttgaggtggaagccctccttcc

SEQ ID NO: 168239 - DNA, 14 bp, Homo sapiens
ttgagtctgtgcca

SEQ ID NO: 168240 - DNA, 14 bp, Homo sapiens
ttgagtgctctgat

SEQ ID NO: 168241 - DNA, 15 bp, Homo sapiens
ttgagtgctctgatc

SEQ ID NO: 168242 - DNA, 16 bp, Homo sapiens
ttgagttcaggtagct

SEQ ID NO: 168243 - DNA, 22 bp, Homo sapiens
ttgagtttcctcaggctgctgg

SEQ ID NO: 168244 - DNA, 19 bp, Homo sapiens
ttgagttttcagtggggca

SEQ ID NO: 168245 - DNA, 19 bp, Homo sapiens
ttgatagctttatttttta

SEQ ID NO: 168246 - DNA, 17 bp, Homo sapiens
ttgatcaaattcatttt

SEQ ID NO: 168247 - DNA, 19 bp, Homo sapiens
ttgatcgcctttcccaggt

SEQ ID NO: 168248 - DNA, 15 bp, Homo sapiens
ttgatgccaggacac

SEQ ID NO: 168249 - DNA, 15 bp, Homo sapiens
ttgattattcagtgt

SEQ ID NO: 168250 - DNA, 17 bp, Homo sapiens
ttgattattcagtgtca

SEQ ID NO: 168251 - DNA, 12 bp, Homo sapiens
ttgatttatgca

SEQ ID NO: 168252 - DNA, 19 bp, Homo sapiens
ttgatttatgcatggaaac

SEQ ID NO: 168253 - DNA, 17 bp, Homo sapiens
ttgcaaaagactaattt

SEQ ID NO: 168254 - DNA, 12 bp, Homo sapiens
ttgcaaatagtc

SEQ ID NO: 168255 - DNA, 23 bp, Homo sapiens
ttgcaaggccgctgttcacccac

SEQ ID NO: 168256 - DNA, 19 bp, Homo sapiens
ttgcaatggctatatggca

SEQ ID NO: 168257 - DNA, 16 bp, Homo sapiens
ttgcaccactgcactc

SEQ ID NO: 168258 - DNA, 18 bp, Homo sapiens
ttgcaccactgcactcca

SEQ ID NO: 168259 - DNA, 21 bp, Homo sapiens
ttgcaccccaaagctttcctg

SEQ ID NO: 168260 - DNA, 24 bp, Homo sapiens
ttgcacccctcactctggcctcag

SEQ ID NO: 168261 - DNA, 18 bp, Homo sapiens
ttgcacgcccatgtgtga

SEQ ID NO: 168262 - DNA, 15 bp, Homo sapiens
ttgcacgtggcctct

SEQ ID NO: 168263 - DNA, 15 bp, Homo sapiens
ttgcactaaagtatg

SEQ ID NO: 168264 - DNA, 15 bp, Homo sapiens
ttgcactccagcctg

SEQ ID NO: 168265 - DNA, 19 bp, Homo sapiens
ttgcagatgacaaaaattc

SEQ ID NO: 168266 - DNA, 18 bp, Homo sapiens
ttgcagccggcacagggt

SEQ ID NO: 168267 - DNA, 13 bp, Homo sapiens
ttgcagtgagcca

SEQ ID NO: 168268 - DNA, 19 bp, Homo sapiens
ttgcataacaattcctcta

SEQ ID NO: 168269 - DNA, 18 bp, Homo sapiens
ttgccactgcctcttcct

SEQ ID NO: 168270 - DNA, 14 bp, Homo sapiens
ttgccagagatgga

SEQ ID NO: 168271 - DNA, 17 bp, Homo sapiens
ttgcccagggctcagcc

SEQ ID NO: 168272 - DNA, 18 bp, Homo sapiens
ttgcccagggctcagcct

SEQ ID NO: 168273 - DNA, 19 bp, Homo sapiens
ttgcccagggctcagcctg

SEQ ID NO: 168274 - DNA, 16 bp, Homo sapiens
ttgcccttcacagtgt

SEQ ID NO: 168275 - DNA, 17 bp, Homo sapiens
ttgccttctacttttaa

SEQ ID NO: 168276 - DNA, 18 bp, Homo sapiens
ttgctgcagtatgaaaat

SEQ ID NO: 168277 - DNA, 20 bp, Homo sapiens
ttgctgccccatcagtgctc

SEQ ID NO: 168278 - DNA, 16 bp, Homo sapiens
ttgctgcttgaggcaa

SEQ ID NO: 168279 - DNA, 23 bp, Homo sapiens
ttgctgcttttccttggggcagg

SEQ ID NO: 168280 - DNA, 23 bp, Homo sapiens
ttgctggacggggactggggatg

SEQ ID NO: 168281 - DNA, 15 bp, Homo sapiens
ttgctggtcactgcc

SEQ ID NO: 168282 - DNA, 15 bp, Homo sapiens
ttgctgtgaggctgt

SEQ ID NO: 168283 - DNA, 22 bp, Homo sapiens
ttgcttcttctcctatgtgtaa

SEQ ID NO: 168284 - DNA, 12 bp, Homo sapiens
ttgcttgaaaga

SEQ ID NO: 168285 - DNA, 14 bp, Homo sapiens
ttggacccttccat

SEQ ID NO: 168286 - DNA, 14 bp, Homo sapiens
ttggagaaattatt

SEQ ID NO: 168287 - DNA, 18 bp, Homo sapiens
ttggagacacaactattt

SEQ ID NO: 168288 - DNA, 20 bp, Homo sapiens
ttggagacacaactattttt

SEQ ID NO: 168289 - DNA, 13 bp, Homo sapiens
ttggagagtaaaa

SEQ ID NO: 168290 - DNA, 17 bp, Homo sapiens
ttggagagtaaaaactg

SEQ ID NO: 168291 - DNA, 22 bp, Homo sapiens
ttggagtgttccccttccactg

SEQ ID NO: 168292 - DNA, 13 bp, Homo sapiens
ttggattattcat

SEQ ID NO: 168293 - DNA, 17 bp, Homo sapiens
ttggcaaaaaggcagga

SEQ ID NO: 168294 - DNA, 15 bp, Homo sapiens
ttggcaacagaagca

SEQ ID NO: 168295 - DNA, 15 bp, Homo sapiens
ttggcagcacctgtc

SEQ ID NO: 168296 - DNA, 23 bp, Homo sapiens
ttggcagtgagtgagcctggctc

SEQ ID NO: 168297 - DNA, 17 bp, Homo sapiens
ttggcctcccctgctga

SEQ ID NO: 168298 - DNA, 20 bp, Homo sapiens
ttggctggatgaaattttct

SEQ ID NO: 168299 - DNA, 21 bp, Homo sapiens
ttggctggatgaaattttcta

SEQ ID NO: 168300 - DNA, 14 bp, Homo sapiens
ttggctgtgtctaa

SEQ ID NO: 168301 - DNA, 17 bp, Homo sapiens
ttggctgtgtctaaact

SEQ ID NO: 168302 - DNA, 18 bp, Homo sapiens
ttggctgtgtctaaactg

SEQ ID NO: 168303 - DNA, 22 bp, Homo sapiens
ttggctttaaacacccttcaca

SEQ ID NO: 168304 - DNA, 17 bp, Homo sapiens
ttgggagacatgtgaca

SEQ ID NO: 168305 - DNA, 17 bp, Homo sapiens
ttgggaggccccactgg

SEQ ID NO: 168306 - DNA, 16 bp, Homo sapiens
ttgggatactgcaggg

SEQ ID NO: 168307 - DNA, 18 bp, Homo sapiens
ttgggatgatgcctcatg

SEQ ID NO: 168308 - DNA, 21 bp, Homo sapiens
ttgggtgtaacaggtctcctc

SEQ ID NO: 168309 - DNA, 23 bp, Homo sapiens
ttgggtgtaacaggtctcctctt

SEQ ID NO: 168310 - DNA, 16 bp, Homo sapiens
ttggtaacatcctttc

SEQ ID NO: 168311 - DNA, 18 bp, Homo sapiens
ttggttcccccactgatc

SEQ ID NO: 168312 - DNA, 18 bp, Homo sapiens
ttggtttttaaaacccag

SEQ ID NO: 168313 - DNA, 15 bp, Homo sapiens
ttgtaaaatagcttg

SEQ ID NO: 168314 - DNA, 20 bp, Homo sapiens
ttgtaaaatggtgtgaccac

SEQ ID NO: 168315 - DNA, 13 bp, Homo sapiens
ttgtaaatatata

SEQ ID NO: 168316 - DNA, 18 bp, Homo sapiens
ttgtaaatatataaatat

SEQ ID NO: 168317 - DNA, 11 bp, Homo sapiens
ttgtaaatgtg

SEQ ID NO: 168318 - DNA, 20 bp, Homo sapiens
ttgtaggggtcaaagaaatg

SEQ ID NO: 168319 - DNA, 21 bp, Homo sapiens
ttgtataagattagaatgaaa

SEQ ID NO: 168320 - DNA, 14 bp, Homo sapiens
ttgtatagtgtaaa

SEQ ID NO: 168321 - DNA, 13 bp, Homo sapiens
ttgtatatatctg

SEQ ID NO: 168322 - DNA, 16 bp, Homo sapiens
ttgtatcacaaatctt

SEQ ID NO: 168323 - DNA, 13 bp, Homo sapiens
ttgtatctctttt

SEQ ID NO: 168324 - DNA, 14 bp, Homo sapiens
tttaagataattat

SEQ ID NO: 168325 - DNA, 20 bp, Homo sapiens
tttaagcactacataaactg

SEQ ID NO: 168326 - DNA, 23 bp, Homo sapiens
tttaagcactacataaactgact

SEQ ID NO: 168327 - DNA, 19 bp, Homo sapiens
tttaagcctcatatttaaa

SEQ ID NO: 168328 - DNA, 11 bp, Homo sapiens
tttaagctgtt

SEQ ID NO: 168329 - DNA, 21 bp, Homo sapiens
tttaagctgttactgtcttca

SEQ ID NO: 168330 - DNA, 12 bp, Homo sapiens
tttaagctgttt

SEQ ID NO: 168331 - DNA, 13 bp, Homo sapiens
tttaagctgtttc

SEQ ID NO: 168332 - DNA, 22 bp, Homo sapiens
tttaagggtttgtggaaaatga

SEQ ID NO: 168333 - DNA, 13 bp, Homo sapiens
tttaatatttaaa

SEQ ID NO: 168334 - DNA, 14 bp, Homo sapiens
tttaatgagataat

SEQ ID NO: 168335 - DNA, 23 bp, Homo sapiens
tttaattattatttatatatgta

SEQ ID NO: 168336 - DNA, 21 bp, Homo sapiens
tttacaatcagccacattcta

SEQ ID NO: 168337 - DNA, 23 bp, Homo sapiens
tttacaattgtaaaactgaggca

SEQ ID NO: 168338 - DNA, 18 bp, Homo sapiens
tttacatgaattgcattt

SEQ ID NO: 168339 - DNA, 20 bp, Homo sapiens
tttacatgcaatttattaaa

SEQ ID NO: 168340 - DNA, 13 bp, Homo sapiens
tttacattgtaaa

SEQ ID NO: 168341 - DNA, 15 bp, Homo sapiens
tttacattgtaaata

SEQ ID NO: 168342 - DNA, 18 bp, Homo sapiens
tttactagggatccctca

SEQ ID NO: 168343 - DNA, 19 bp, Homo sapiens
tttagaccctattgctgct

SEQ ID NO: 168344 - DNA, 22 bp, Homo sapiens
tttagaccctattgctgcttga

SEQ ID NO: 168345 - DNA, 14 bp, Homo sapiens
tttagggccaggca

SEQ ID NO: 168346 - DNA, 21 bp, Homo sapiens
tttagtagatattaccagttt

SEQ ID NO: 168347 - DNA, 15 bp, Homo sapiens
tttagtcatgtgacc

SEQ ID NO: 168348 - DNA, 18 bp, Homo sapiens
tttagtctgcaaaatgag

SEQ ID NO: 168349 - DNA, 14 bp, Homo sapiens
tttagttatagttt

SEQ ID NO: 168350 - DNA, 15 bp, Homo sapiens
tttagttatagtttc

SEQ ID NO: 168351 - DNA, 14 bp, Homo sapiens
tttagtttactcaa

SEQ ID NO: 168352 - DNA, 19 bp, Homo sapiens
tttataactagtcctttac

SEQ ID NO: 168353 - DNA, 20 bp, Homo sapiens
tttataagcagatttaacaa

SEQ ID NO: 168354 - DNA, 17 bp, Homo sapiens
tttatagctattactgt

SEQ ID NO: 168355 - DNA, 17 bp, Homo sapiens
tttatagtttgtacatg

SEQ ID NO: 168356 - DNA, 13 bp, Homo sapiens
tttatatatgtat

SEQ ID NO: 168357 - DNA, 15 bp, Homo sapiens
tttatatatttataa

SEQ ID NO: 168358 - DNA, 14 bp, Homo sapiens
tttatatttagtta

SEQ ID NO: 168359 - DNA, 16 bp, Homo sapiens
tttatccctcacctgt

SEQ ID NO: 168360 - DNA, 22 bp, Homo sapiens
tttatggggctgaacggggaga

SEQ ID NO: 168361 - DNA, 13 bp, Homo sapiens
tttattaaaatct

SEQ ID NO: 168362 - DNA, 18 bp, Homo sapiens
tttattaacaaattatgt

SEQ ID NO: 168363 - DNA, 20 bp, Homo sapiens
tttattacctctgatacctc

SEQ ID NO: 168364 - DNA, 17 bp, Homo sapiens
tttattcaagttattgt

SEQ ID NO: 168365 - DNA, 22 bp, Homo sapiens
tttattcctatatagtttattg

SEQ ID NO: 168366 - DNA, 13 bp, Homo sapiens
tttattgtgatct

SEQ ID NO: 168367 - DNA, 22 bp, Homo sapiens
tttattgtttaaaatcatttct

SEQ ID NO: 168368 - DNA, 13 bp, Homo sapiens
tttatttatttat

SEQ ID NO: 168369 - DNA, 22 bp, Homo sapiens
tttatttttccatttacaacaa

SEQ ID NO: 168370 - DNA, 22 bp, Homo sapiens
tttcaattccacctgcaatcaa

SEQ ID NO: 168371 - DNA, 20 bp, Homo sapiens
tttcaattgcatctcccaga

SEQ ID NO: 168372 - DNA, 22 bp, Homo sapiens
tttcacaaccttctgtggctca

SEQ ID NO: 168373 - DNA, 22 bp, Homo sapiens
tttcaccatttgattatgtagc

SEQ ID NO: 168374 - DNA, 19 bp, Homo sapiens
tttcacggaagttttcaat

SEQ ID NO: 168375 - DNA, 14 bp, Homo sapiens
tttcactgctggct

SEQ ID NO: 168376 - DNA, 20 bp, Homo sapiens
tttcactgctggctgcctta

SEQ ID NO: 168377 - DNA, 22 bp, Homo sapiens
tttcactgctggctgccttaga

SEQ ID NO: 168378 - DNA, 24 bp, Homo sapiens
tttcactgctggctgccttagaac

SEQ ID NO: 168379 - DNA, 18 bp, Homo sapiens
tttcactggagttacatt

SEQ ID NO: 168380 - DNA, 21 bp, Homo sapiens
tttcagtattttggagaaatt

SEQ ID NO: 168381 - DNA, 20 bp, Homo sapiens
tttcatccactagtgcaaat

SEQ ID NO: 168382 - DNA, 16 bp, Homo sapiens
tttcatgattttgaaa

SEQ ID NO: 168383 - DNA, 22 bp, Homo sapiens
tttcattgactatcaaactgaa

SEQ ID NO: 168384 - DNA, 22 bp, Homo sapiens
tttcattgctgggcttgtctgt

SEQ ID NO: 168385 - DNA, 17 bp, Homo sapiens
tttccacacctggcact

SEQ ID NO: 168386 - DNA, 14 bp, Homo sapiens
tttccattccagaa

SEQ ID NO: 168387 - DNA, 14 bp, Homo sapiens
tttccccaaagtct

SEQ ID NO: 168388 - DNA, 13 bp, Homo sapiens
tttccccagccca

SEQ ID NO: 168389 - DNA, 16 bp, Homo sapiens
tttccctattagagaa

SEQ ID NO: 168390 - DNA, 21 bp, Homo sapiens
tttcctaataaagttctgtac

SEQ ID NO: 168391 - DNA, 22 bp, Homo sapiens
tttcctcttagtcgagccaagt

SEQ ID NO: 168392 - DNA, 16 bp, Homo sapiens
tttccttccttccctg

SEQ ID NO: 168393 - DNA, 19 bp, Homo sapiens
tttcctttatatttagtga

SEQ ID NO: 168394 - DNA, 21 bp, Homo sapiens
tttctaacaaaaaaatatatt

SEQ ID NO: 168395 - DNA, 18 bp, Homo sapiens
tttctactttgaagtcat

SEQ ID NO: 168396 - DNA, 19 bp, Homo sapiens
tttctagctagaaatatga

SEQ ID NO: 168397 - DNA, 21 bp, Homo sapiens
tttctagctgttgagctgttt

SEQ ID NO: 168398 - DNA, 20 bp, Homo sapiens
tttctcccaggccaggctcc

SEQ ID NO: 168399 - DNA, 17 bp, Homo sapiens
tttctcttactgcaaat

SEQ ID NO: 168400 - DNA, 16 bp, Homo sapiens
tttctcttcatacttt

SEQ ID NO: 168401 - DNA, 13 bp, Homo sapiens
tttctgagaaaga

SEQ ID NO: 168402 - DNA, 15 bp, Homo sapiens
tttctgagaaagact

SEQ ID NO: 168403 - DNA, 16 bp, Homo sapiens
tttctgaggagaaaca

SEQ ID NO: 168404 - DNA, 23 bp, Homo sapiens
tttctgatctgatgcaagcaaga

SEQ ID NO: 168405 - DNA, 18 bp, Homo sapiens
tttctggaatgtaatcaa

SEQ ID NO: 168406 - DNA, 15 bp, Homo sapiens
tttctgtcccttctg

SEQ ID NO: 168407 - DNA, 20 bp, Homo sapiens
tttctgtgtgcaccttacca

SEQ ID NO: 168408 - DNA, 17 bp, Homo sapiens
tttcttacataattttt

SEQ ID NO: 168409 - DNA, 14 bp, Homo sapiens
tttcttcccatcac

SEQ ID NO: 168410 - DNA, 13 bp, Homo sapiens
tttcttcctctgc

SEQ ID NO: 168411 - DNA, 12 bp, Homo sapiens
tttcttctattt

SEQ ID NO: 168412 - DNA, 22 bp, Homo sapiens
tttgaagtcataccaatgaaaa

SEQ ID NO: 168413 - DNA, 14 bp, Homo sapiens
tttgaatgacaaag

SEQ ID NO: 168414 - DNA, 14 bp, Homo sapiens
tttgacggatgatt

SEQ ID NO: 168415 - DNA, 12 bp, Homo sapiens
tttgactctttt

SEQ ID NO: 168416 - DNA, 21 bp, Homo sapiens
tttgagaaacaacaatttcta

SEQ ID NO: 168417 - DNA, 13 bp, Homo sapiens
tttgagagttcta

SEQ ID NO: 168418 - DNA, 13 bp, Homo sapiens
tttgagttctaca

SEQ ID NO: 168419 - DNA, 16 bp, Homo sapiens
tttgatacatatgtga

SEQ ID NO: 168420 - DNA, 19 bp, Homo sapiens
tttgatacatatgtgaata

SEQ ID NO: 168421 - DNA, 16 bp, Homo sapiens
tttgcaagtgaaggtt

SEQ ID NO: 168422 - DNA, 21 bp, Homo sapiens
tttgcaagtgaaggtttacaa

SEQ ID NO: 168423 - DNA, 22 bp, Homo sapiens
tttgcaagtgaaggtttacaat

SEQ ID NO: 168424 - DNA, 19 bp, Homo sapiens
tttgcagaaaagcacctgc

SEQ ID NO: 168425 - DNA, 22 bp, Homo sapiens
tttgcagaaaagcacctgccga

SEQ ID NO: 168426 - DNA, 21 bp, Homo sapiens
tttgcagctgagagaaaataa

SEQ ID NO: 168427 - DNA, 15 bp, Homo sapiens
tttgccagtgggaac

SEQ ID NO: 168428 - DNA, 15 bp, Homo sapiens
tttgcccttaaggac

SEQ ID NO: 168429 - DNA, 12 bp, Homo sapiens
tttgccctttga

SEQ ID NO: 168430 - DNA, 19 bp, Homo sapiens
tttgctgtgaggctgtcct

SEQ ID NO: 168431 - DNA, 12 bp, Homo sapiens
tttggaaaataa

SEQ ID NO: 168432 - DNA, 13 bp, Homo sapiens
tttggaataaagt

SEQ ID NO: 168433 - DNA, 22 bp, Homo sapiens
tttggattggatgaattccaaa

SEQ ID NO: 168434 - DNA, 17 bp, Homo sapiens
tttggcaatgccatcat

SEQ ID NO: 168435 - DNA, 22 bp, Homo sapiens
tttggcaggggcagaaaactct

SEQ ID NO: 168436 - DNA, 20 bp, Homo sapiens
tttggcatctgtttaaagta

SEQ ID NO: 168437 - DNA, 17 bp, Homo sapiens
tttggctgtgtctaaac

SEQ ID NO: 168438 - DNA, 19 bp, Homo sapiens
tttggctgtgtctaaactg

SEQ ID NO: 168439 - DNA, 18 bp, Homo sapiens
tttgggagacatgtgaca

SEQ ID NO: 168440 - DNA, 22 bp, Homo sapiens
tttgggaggccaaggtgggagg

SEQ ID NO: 168441 - DNA, 22 bp, Homo sapiens
tttgggggaaaatttagaaata

SEQ ID NO: 168442 - DNA, 13 bp, Homo sapiens
tttggttctaata

SEQ ID NO: 168443 - DNA, 20 bp, Homo sapiens
tttgtaattgcttacatttt

SEQ ID NO: 168444 - DNA, 21 bp, Homo sapiens
tttgtaggggtcaaagaaatg

SEQ ID NO: 168445 - DNA, 12 bp, Homo sapiens
tttgtatattgt

SEQ ID NO: 168446 - DNA, 14 bp, Homo sapiens
tttgtattctctga

SEQ ID NO: 168447 - DNA, 21 bp, Homo sapiens
tttgtattgtttcaattgcat

SEQ ID NO: 168448 - DNA, 11 bp, Homo sapiens
tttgtctaaaa

SEQ ID NO: 168449 - DNA, 14 bp, Homo sapiens
tttgtctcatccca

SEQ ID NO: 168450 - DNA, 13 bp, Homo sapiens
tttgtcttaaaaa

SEQ ID NO: 168451 - DNA, 14 bp, Homo sapiens
tttgtcttaaaaag

SEQ ID NO: 168452 - DNA, 17 bp, Homo sapiens
tttgtgatttagaactg

SEQ ID NO: 168453 - DNA, 13 bp, Homo sapiens
tttgttttctttg

SEQ ID NO: 168454 - DNA, 12 bp, Homo sapiens
tttgttttgcac

SEQ ID NO: 168455 - DNA, 16 bp, Homo sapiens
ttttaaaacacttcca

SEQ ID NO: 168456 - DNA, 22 bp, Homo sapiens
ttttaaaacacttccataatct

SEQ ID NO: 168457 - DNA, 23 bp, Homo sapiens
ttttaaacaaaatagaagctgta

SEQ ID NO: 168458 - DNA, 18 bp, Homo sapiens
ttttaaatattttttctt

SEQ ID NO: 168459 - DNA, 14 bp, Homo sapiens
ttttaaccaaaggt

SEQ ID NO: 168460 - DNA, 16 bp, Homo sapiens
ttttaaccaaaggtga

SEQ ID NO: 168461 - DNA, 15 bp, Homo sapiens
atgacagctgtccct

SEQ ID NO: 168462 - DNA, 21 bp, Homo sapiens
atgacagctgtccctgtcacc

SEQ ID NO: 168463 - DNA, 15 bp, Homo sapiens
atgacatgttatata

SEQ ID NO: 168464 - DNA, 23 bp, Homo sapiens
atgacatgttatatattttttgt

SEQ ID NO: 168465 - DNA, 14 bp, Homo sapiens
atgactaaaaatat

SEQ ID NO: 168466 - DNA, 14 bp, Homo sapiens
atgactcagaatat

SEQ ID NO: 168467 - DNA, 21 bp, Homo sapiens
atgagacccattcctatttct

SEQ ID NO: 168468 - DNA, 18 bp, Homo sapiens
atgagattgttttatcat

SEQ ID NO: 168469 - DNA, 16 bp, Homo sapiens
atgagctctacccagg

SEQ ID NO: 168470 - DNA, 18 bp, Homo sapiens
atgagctctacccagggc

SEQ ID NO: 168471 - DNA, 17 bp, Homo sapiens
atgaggaatgtatatgt

SEQ ID NO: 168472 - DNA, 22 bp, Homo sapiens
atgaggatgcagagtcagcaga

SEQ ID NO: 168473 - DNA, 17 bp, Homo sapiens
atgaggtactgagagtg

SEQ ID NO: 168474 - DNA, 19 bp, Homo sapiens
atgaggtgctgggagggat

SEQ ID NO: 168475 - DNA, 22 bp, Homo sapiens
atgagttgttttcagactcaga

SEQ ID NO: 168476 - DNA, 19 bp, Homo sapiens
atgagtttttgatagcttt

SEQ ID NO: 168477 - DNA, 17 bp, Homo sapiens
atgataagtaaatgcta

SEQ ID NO: 168478 - DNA, 22 bp, Homo sapiens
atgatatgtaaacataattctt

SEQ ID NO: 168479 - DNA, 20 bp, Homo sapiens
atgatccctgtgttgtctct

SEQ ID NO: 168480 - DNA, 14 bp, Homo sapiens
atgatctactcaga

SEQ ID NO: 168481 - DNA, 12 bp, Homo sapiens
atgatctccctg

SEQ ID NO: 168482 - DNA, 18 bp, Homo sapiens
atgatcttctttataatt

SEQ ID NO: 168483 - DNA, 16 bp, Homo sapiens
atgatctttaaaatac

SEQ ID NO: 168484 - DNA, 18 bp, Homo sapiens
atgatgatctttaaaata

SEQ ID NO: 168485 - DNA, 18 bp, Homo sapiens
atgatggttgcaaaagac

SEQ ID NO: 168486 - DNA, 22 bp, Homo sapiens
atgattccttgatggagatatt

SEQ ID NO: 168487 - DNA, 15 bp, Homo sapiens
atgattggattattc

SEQ ID NO: 168488 - DNA, 15 bp, Homo sapiens
atgattgtaaaatag

SEQ ID NO: 168489 - DNA, 18 bp, Homo sapiens
atgattgtaaaatagctt

SEQ ID NO: 168490 - DNA, 22 bp, Homo sapiens
atgattgtgcacatacttgaga

SEQ ID NO: 168491 - DNA, 13 bp, Homo sapiens
atgatttatagtt

SEQ ID NO: 168492 - DNA, 15 bp, Homo sapiens
atgatttatagtttg

SEQ ID NO: 168493 - DNA, 20 bp, Homo sapiens
atgatttccaaagagaaaaa

SEQ ID NO: 168494 - DNA, 23 bp, Homo sapiens
atgcaaaaggttcactaaagcag

SEQ ID NO: 168495 - DNA, 14 bp, Homo sapiens
atgcacacaaaaca

SEQ ID NO: 168496 - DNA, 22 bp, Homo sapiens
atgcactgttccccctgtgcag

SEQ ID NO: 168497 - DNA, 15 bp, Homo sapiens
atgcagagtcagcag

SEQ ID NO: 168498 - DNA, 16 bp, Homo sapiens
atgcagagtcagcaga

SEQ ID NO: 168499 - DNA, 17 bp, Homo sapiens
atgcagagtcagcagaa

SEQ ID NO: 168500 - DNA, 14 bp, Homo sapiens
atgcatccattcct

SEQ ID NO: 168501 - DNA, 22 bp, Homo sapiens
atgcatccattcctcagggaca

SEQ ID NO: 168502 - DNA, 17 bp, Homo sapiens
atgcatctccacctgct

SEQ ID NO: 168503 - DNA, 23 bp, Homo sapiens
atgcatggaaacctgaaaaaaag

SEQ ID NO: 168504 - DNA, 16 bp, Homo sapiens
atgcccagctcagagg

SEQ ID NO: 168505 - DNA, 17 bp, Homo sapiens
atgcccagggccactct

SEQ ID NO: 168506 - DNA, 17 bp, Homo sapiens
atgccccggccacctct

SEQ ID NO: 168507 - DNA, 14 bp, Homo sapiens
atgccctggatcca

SEQ ID NO: 168508 - DNA, 20 bp, Homo sapiens
atgcctccaccccccagaac

SEQ ID NO: 168509 - DNA, 13 bp, Homo sapiens
atgcctccaccgc

SEQ ID NO: 168510 - DNA, 19 bp, Homo sapiens
atgcggccgcattccctga

SEQ ID NO: 168511 - DNA, 19 bp, Homo sapiens
atgctaacatctaaaaata

SEQ ID NO: 168512 - DNA, 18 bp, Homo sapiens
atgctaggttaattccaa

SEQ ID NO: 168513 - DNA, 14 bp, Homo sapiens
atgctcctggccca

SEQ ID NO: 168514 - DNA, 15 bp, Homo sapiens
atgctccttgggccc

SEQ ID NO: 168515 - DNA, 14 bp, Homo sapiens
atgctctcctttcc

SEQ ID NO: 168516 - DNA, 22 bp, Homo sapiens
atgctctctgcagccagcccag

SEQ ID NO: 168517 - DNA, 15 bp, Homo sapiens
atgctgaaacaggag

SEQ ID NO: 168518 - DNA, 18 bp, Homo sapiens
atgctgaaacaggagaga

SEQ ID NO: 168519 - DNA, 17 bp, Homo sapiens
atgctgcctaggctgac

SEQ ID NO: 168520 - DNA, 12 bp, Homo sapiens
atgctgcctcca

SEQ ID NO: 168521 - DNA, 18 bp, Homo sapiens
atgctgcgcccttcccca

SEQ ID NO: 168522 - DNA, 19 bp, Homo sapiens
atgctggagaagagaggag

SEQ ID NO: 168523 - DNA, 19 bp, Homo sapiens
atgctggatgctccttcca

SEQ ID NO: 168524 - DNA, 23 bp, Homo sapiens
atgctggcatttgcacctacctc

SEQ ID NO: 168525 - DNA, 19 bp, Homo sapiens
atgctgtatatcctttcta

SEQ ID NO: 168526 - DNA, 14 bp, Homo sapiens
atgctgtatatgtt

SEQ ID NO: 168527 - DNA, 15 bp, Homo sapiens
atgctgttgcctcat

SEQ ID NO: 168528 - DNA, 18 bp, Homo sapiens
atgctgttgcctcatcta

SEQ ID NO: 168529 - DNA, 19 bp, Homo sapiens
atgcttatcatctaaagat

SEQ ID NO: 168530 - DNA, 20 bp, Homo sapiens
atgcttctcactgccatgcc

SEQ ID NO: 168531 - DNA, 22 bp, Homo sapiens
atgctttttgaatgttatttgt

SEQ ID NO: 168532 - DNA, 23 bp, Homo sapiens
atggaaacctgaaaaaaagttta

SEQ ID NO: 168533 - DNA, 17 bp, Homo sapiens
atggaaagaatctaata

SEQ ID NO: 168534 - DNA, 22 bp, Homo sapiens
atggaaaggagaggaaagaact

SEQ ID NO: 168535 - DNA, 19 bp, Homo sapiens
atggaactcattcctgcct

SEQ ID NO: 168536 - DNA, 19 bp, Homo sapiens
atggaacttctaatatatt

SEQ ID NO: 168537 - DNA, 16 bp, Homo sapiens
atggaagattttaaat

SEQ ID NO: 168538 - DNA, 22 bp, Homo sapiens
atggaaggtttgtatattgtca

SEQ ID NO: 168539 - DNA, 17 bp, Homo sapiens
atggaatgctgtgttaa

SEQ ID NO: 168540 - DNA, 11 bp, Homo sapiens
atggacactcc

SEQ ID NO: 168541 - DNA, 19 bp, Homo sapiens
atggacactccagtgccag

SEQ ID NO: 168542 - DNA, 21 bp, Homo sapiens
atggacccaatatttaccaga

SEQ ID NO: 168543 - DNA, 14 bp, Homo sapiens
atggagaaaccctg

SEQ ID NO: 168544 - DNA, 18 bp, Homo sapiens
atggagactgtctcaaga

SEQ ID NO: 168545 - DNA, 21 bp, Homo sapiens
atggagccagctctgcattat

SEQ ID NO: 168546 - DNA, 14 bp, Homo sapiens
atggagcccaggcg

SEQ ID NO: 168547 - DNA, 22 bp, Homo sapiens
atggaggaaaaccaagccgtgg

SEQ ID NO: 168548 - DNA, 17 bp, Homo sapiens
atggaggagaagaattt

SEQ ID NO: 168549 - DNA, 14 bp, Homo sapiens
atggaggaggaggc

SEQ ID NO: 168550 - DNA, 18 bp, Homo sapiens
atggatttccagccaaag

SEQ ID NO: 168551 - DNA, 19 bp, Homo sapiens
atggcaccaaagccaccag

SEQ ID NO: 168552 - DNA, 18 bp, Homo sapiens
atggcagagttgtaaata

SEQ ID NO: 168553 - DNA, 21 bp, Homo sapiens
atggccgggcgcggtggctca

SEQ ID NO: 168554 - DNA, 17 bp, Homo sapiens
atggcctgagaagagag

SEQ ID NO: 168555 - DNA, 18 bp, Homo sapiens
atggctaatgtactgcat

SEQ ID NO: 168556 - DNA, 15 bp, Homo sapiens
atggctataaatata

SEQ ID NO: 168557 - DNA, 15 bp, Homo sapiens
atggctataggtgct

SEQ ID NO: 168558 - DNA, 23 bp, Homo sapiens
atggctataggtgctacaaaaac

SEQ ID NO: 168559 - DNA, 19 bp, Homo sapiens
atggctgtgcctctgcctg

SEQ ID NO: 168560 - DNA, 21 bp, Homo sapiens
atggcttaatgtttattcctg

SEQ ID NO: 168561 - DNA, 14 bp, Homo sapiens
atgggaaggaggga

SEQ ID NO: 168562 - DNA, 19 bp, Homo sapiens
atgggaaggagggaggtat

SEQ ID NO: 168563 - DNA, 17 bp, Homo sapiens
atgggactgggagggcc

SEQ ID NO: 168564 - DNA, 17 bp, Homo sapiens
atgggagacccttgaca

SEQ ID NO: 168565 - DNA, 18 bp, Homo sapiens
atgggatggtggagggcc

SEQ ID NO: 168566 - DNA, 19 bp, Homo sapiens
atgggggagtctgaagcag

SEQ ID NO: 168567 - DNA, 17 bp, Homo sapiens
atggtcttcagcctctt

SEQ ID NO: 168568 - DNA, 14 bp, Homo sapiens
atggtgatgaaatg

SEQ ID NO: 168569 - DNA, 13 bp, Homo sapiens
atggtggagggcc

SEQ ID NO: 168570 - DNA, 19 bp, Homo sapiens
atggttcccctgttcactc

SEQ ID NO: 168571 - DNA, 15 bp, Homo sapiens
atggttgccttaaag

SEQ ID NO: 168572 - DNA, 17 bp, Homo sapiens
atggttgccttaaagaa

SEQ ID NO: 168573 - DNA, 22 bp, Homo sapiens
atggtttgactcccgaacatca

SEQ ID NO: 168574 - DNA, 15 bp, Homo sapiens
atgtaaacagtgcct

SEQ ID NO: 168575 - DNA, 16 bp, Homo sapiens
atgtaaacagtgcctg

SEQ ID NO: 168576 - DNA, 22 bp, Homo sapiens
atgtaaacagtgcctgctgaat

SEQ ID NO: 168577 - DNA, 13 bp, Homo sapiens
atgtaaagtatgt

SEQ ID NO: 168578 - DNA, 17 bp, Homo sapiens
atgtaaagtatgtaaac

SEQ ID NO: 168579 - DNA, 16 bp, Homo sapiens
atgtaaagtgatattt

SEQ ID NO: 168580 - DNA, 17 bp, Homo sapiens
atgtaaatagtgcagaa

SEQ ID NO: 168581 - DNA, 12 bp, Homo sapiens
atgtaaatgtgc

SEQ ID NO: 168582 - DNA, 14 bp, Homo sapiens
atgtaactagaatt

SEQ ID NO: 168583 - DNA, 19 bp, Homo sapiens
atgtaagggaaactgccag

SEQ ID NO: 168584 - DNA, 20 bp, Homo sapiens
atgtaagggaaactgccagc

SEQ ID NO: 168585 - DNA, 17 bp, Homo sapiens
atgtaataactgtgaag

SEQ ID NO: 168586 - DNA, 17 bp, Homo sapiens
atgtactcctctttaca

SEQ ID NO: 168587 - DNA, 14 bp, Homo sapiens
atgtagaaaatttg

SEQ ID NO: 168588 - DNA, 17 bp, Homo sapiens
atgtagaggagaaactg

SEQ ID NO: 168589 - DNA, 14 bp, Homo sapiens
atgtaggaagtagg

SEQ ID NO: 168590 - DNA, 19 bp, Homo sapiens
atgtatattttatatcaat

SEQ ID NO: 168591 - DNA, 15 bp, Homo sapiens
atgtatctgagcagg

SEQ ID NO: 168592 - DNA, 20 bp, Homo sapiens
atgtatggaatacagtgtta

SEQ ID NO: 168593 - DNA, 12 bp, Homo sapiens
atgtatgtttac

SEQ ID NO: 168594 - DNA, 13 bp, Homo sapiens
atgtatgtttaca

SEQ ID NO: 168595 - DNA, 14 bp, Homo sapiens
atgtatgtttacat

SEQ ID NO: 168596 - DNA, 24 bp, Homo sapiens
atgtattcagctttagtagatatt

SEQ ID NO: 168597 - DNA, 17 bp, Homo sapiens
atgtattgcacattgta

SEQ ID NO: 168598 - DNA, 22 bp, Homo sapiens
atgtattgcacattgtaaaaag

SEQ ID NO: 168599 - DNA, 20 bp, Homo sapiens
atgtcaccaccttcccagct

SEQ ID NO: 168600 - DNA, 13 bp, Homo sapiens
atgtcagcaaaaa

SEQ ID NO: 168601 - DNA, 23 bp, Homo sapiens
atgtcagcaaaaagcaaaatcat

SEQ ID NO: 168602 - DNA, 12 bp, Homo sapiens
atgtcaggcctg

SEQ ID NO: 168603 - DNA, 14 bp, Homo sapiens
atgtcgcctctgca

SEQ ID NO: 168604 - DNA, 17 bp, Homo sapiens
atgtctcaggtccctgc

SEQ ID NO: 168605 - DNA, 21 bp, Homo sapiens
atgtctctcagaattcttcag

SEQ ID NO: 168606 - DNA, 11 bp, Homo sapiens
atgtcttgtgt

SEQ ID NO: 168607 - DNA, 21 bp, Homo sapiens
atgtgaaaatggtccaggaga

SEQ ID NO: 168608 - DNA, 19 bp, Homo sapiens
atgtgacatgcgggctggg

SEQ ID NO: 168609 - DNA, 15 bp, Homo sapiens
atgtgatatataagt

SEQ ID NO: 168610 - DNA, 22 bp, Homo sapiens
atgtgatatataagtgtacata

SEQ ID NO: 168611 - DNA, 17 bp, Homo sapiens
atgtgatccttttatgt

SEQ ID NO: 168612 - DNA, 17 bp, Homo sapiens
atgtgatgaatactgta

SEQ ID NO: 168613 - DNA, 19 bp, Homo sapiens
atgtgatgaatactgtatt

SEQ ID NO: 168614 - DNA, 23 bp, Homo sapiens
atgtgattcctttgaagaggaaa

SEQ ID NO: 168615 - DNA, 16 bp, Homo sapiens
atgtgcaagtgtatgc

SEQ ID NO: 168616 - DNA, 19 bp, Homo sapiens
atgtgcattcttttaaaag

SEQ ID NO: 168617 - DNA, 20 bp, Homo sapiens
atgtgcattcttttaaaaga

SEQ ID NO: 168618 - DNA, 16 bp, Homo sapiens
atgtggccctggcctg

SEQ ID NO: 168619 - DNA, 19 bp, Homo sapiens
atgtggccctggcctgctg

SEQ ID NO: 168620 - DNA, 20 bp, Homo sapiens
atgtggccctggcctgctgg

SEQ ID NO: 168621 - DNA, 19 bp, Homo sapiens
atgtggcctaaaaatgcaa

SEQ ID NO: 168622 - DNA, 11 bp, Homo sapiens
atgtgggaggg

SEQ ID NO: 168623 - DNA, 18 bp, Homo sapiens
atgtgggcagtgatgtca

SEQ ID NO: 168624 - DNA, 13 bp, Homo sapiens
atgtggggccagg

SEQ ID NO: 168625 - DNA, 19 bp, Homo sapiens
atgtggtttatagagggcc

SEQ ID NO: 168626 - DNA, 18 bp, Homo sapiens
atgtgtatcggatgcttt

SEQ ID NO: 168627 - DNA, 13 bp, Homo sapiens
atgtgtgagtgtg

SEQ ID NO: 168628 - DNA, 18 bp, Homo sapiens
atgtgtgccatagagttt

SEQ ID NO: 168629 - DNA, 19 bp, Homo sapiens
atgtgtgtgcaagtgtgtg

SEQ ID NO: 168630 - DNA, 13 bp, Homo sapiens
atgttaagcagat

SEQ ID NO: 168631 - DNA, 16 bp, Homo sapiens
atgttagggtgctctg

SEQ ID NO: 168632 - DNA, 20 bp, Homo sapiens
atgttatttgttattttcag

SEQ ID NO: 168633 - DNA, 17 bp, Homo sapiens
atgttattttttaatta

SEQ ID NO: 168634 - DNA, 20 bp, Homo sapiens
atgttattttttaattatta

SEQ ID NO: 168635 - DNA, 14 bp, Homo sapiens
atgttcacttttga

SEQ ID NO: 168636 - DNA, 20 bp, Homo sapiens
atgttcacttttgacaaagg

SEQ ID NO: 168637 - DNA, 22 bp, Homo sapiens
atgttcacttttgacaaaggca

SEQ ID NO: 168638 - DNA, 15 bp, Homo sapiens
atgttcctagtgaaa

SEQ ID NO: 168639 - DNA, 20 bp, Homo sapiens
atgttccttcaagatcatgt

SEQ ID NO: 168640 - DNA, 16 bp, Homo sapiens
atgttctctcttctcc

SEQ ID NO: 168641 - DNA, 17 bp, Homo sapiens
atgttctctcttctcca

SEQ ID NO: 168642 - DNA, 14 bp, Homo sapiens
atgttgttatttaa

SEQ ID NO: 168643 - DNA, 17 bp, Homo sapiens
atgttgttatttaaaga

SEQ ID NO: 168644 - DNA, 20 bp, Homo sapiens
atgtttacatatcacctcat

SEQ ID NO: 168645 - DNA, 18 bp, Homo sapiens
atgtttcttttgtatgta

SEQ ID NO: 168646 - DNA, 23 bp, Homo sapiens
atgtttgggagactgctgagtca

SEQ ID NO: 168647 - DNA, 14 bp, Homo sapiens
atgtttgtaaaact

SEQ ID NO: 168648 - DNA, 14 bp, Homo sapiens
attaaaaaaaacaa

SEQ ID NO: 168649 - DNA, 15 bp, Homo sapiens
attaaaaaaaacaaa

SEQ ID NO: 168650 - DNA, 19 bp, Homo sapiens
attaaaaaaaacaaaaaga

SEQ ID NO: 168651 - DNA, 20 bp, Homo sapiens
attaaaaaaaacaaaaagaa

SEQ ID NO: 168652 - DNA, 16 bp, Homo sapiens
attaaaagaatatttt

SEQ ID NO: 168653 - DNA, 14 bp, Homo sapiens
attaaaatcctcaa

SEQ ID NO: 168654 - DNA, 15 bp, Homo sapiens
attaaaatcttaaac

SEQ ID NO: 168655 - DNA, 22 bp, Homo sapiens
attaaatatgttagcaaagagt

SEQ ID NO: 168656 - DNA, 14 bp, Homo sapiens
attaacaaattatg

SEQ ID NO: 168657 - DNA, 13 bp, Homo sapiens
attaacctctcac

SEQ ID NO: 168658 - DNA, 15 bp, Homo sapiens
attaacttagcatgt

SEQ ID NO: 168659 - DNA, 20 bp, Homo sapiens
attaagaaaatcatattgct

SEQ ID NO: 168660 - DNA, 13 bp, Homo sapiens
attaagatttcca

SEQ ID NO: 168661 - DNA, 24 bp, Homo sapiens
attaagtctgtgagattcattcat

SEQ ID NO: 168662 - DNA, 18 bp, Homo sapiens
attaatagcttttattgt

SEQ ID NO: 168663 - DNA, 18 bp, Homo sapiens
attaatatccctacatgt

SEQ ID NO: 168664 - DNA, 16 bp, Homo sapiens
attaatgacagagcca

SEQ ID NO: 168665 - DNA, 12 bp, Homo sapiens
attaatgttaat

SEQ ID NO: 168666 - DNA, 13 bp, Homo sapiens
attaatgttaatt

SEQ ID NO: 168667 - DNA, 19 bp, Homo sapiens
attaattcaccttccagtg

SEQ ID NO: 168668 - DNA, 17 bp, Homo sapiens
attacacaaaacaaatg

SEQ ID NO: 168669 - DNA, 15 bp, Homo sapiens
attacagaggaagtt

SEQ ID NO: 168670 - DNA, 22 bp, Homo sapiens
attacatttccaaatgaatgac

SEQ ID NO: 168671 - DNA, 23 bp, Homo sapiens
attaccagacggttcaccagcct

SEQ ID NO: 168672 - DNA, 22 bp, Homo sapiens
attaccccctcattgtttatta

SEQ ID NO: 168673 - DNA, 17 bp, Homo sapiens
attaccgcgttgtaaaa

SEQ ID NO: 168674 - DNA, 20 bp, Homo sapiens
attaccgcgttgtaaaatat

SEQ ID NO: 168675 - DNA, 21 bp, Homo sapiens
attaccgcgttgtaaaatata

SEQ ID NO: 168676 - DNA, 21 bp, Homo sapiens
attacctagtagtcatttcat

SEQ ID NO: 168677 - DNA, 12 bp, Homo sapiens
attacctcctga

SEQ ID NO: 168678 - DNA, 18 bp, Homo sapiens
attactatgactgctccc

SEQ ID NO: 168679 - DNA, 17 bp, Homo sapiens
attagaaacataaataa

SEQ ID NO: 168680 - DNA, 18 bp, Homo sapiens
attagaacaggcaagtga

SEQ ID NO: 168681 - DNA, 23 bp, Homo sapiens
attagaacaggcaagtgaagaaa

SEQ ID NO: 168682 - DNA, 16 bp, Homo sapiens
attagagtgtctttcc

SEQ ID NO: 168683 - DNA, 23 bp, Homo sapiens
attagagtgtctttccacggagc

SEQ ID NO: 168684 - DNA, 16 bp, Homo sapiens
attagctgtgtgaaat

SEQ ID NO: 168685 - DNA, 16 bp, Homo sapiens
attagggagagaagat

SEQ ID NO: 168686 - DNA, 15 bp, Homo sapiens
attataacttaaaat

SEQ ID NO: 168687 - DNA, 22 bp, Homo sapiens
attataatttttttcaatattt

SEQ ID NO: 168688 - DNA, 13 bp, Homo sapiens
attatattaaaat

SEQ ID NO: 168689 - DNA, 15 bp, Homo sapiens
attatgtatgtttac

SEQ ID NO: 168690 - DNA, 13 bp, Homo sapiens
attattcatttaa

SEQ ID NO: 168691 - DNA, 15 bp, Homo sapiens
attattcatttaaaa

SEQ ID NO: 168692 - DNA, 16 bp, Homo sapiens
attattcatttaaaat

SEQ ID NO: 168693 - DNA, 21 bp, Homo sapiens
attattcatttaaaatgatta

SEQ ID NO: 168694 - DNA, 11 bp, Homo sapiens
attatttcaga

SEQ ID NO: 168695 - DNA, 17 bp, Homo sapiens
attatttgtgtaataga

SEQ ID NO: 168696 - DNA, 18 bp, Homo sapiens
attatttgtgtaatagaa

SEQ ID NO: 168697 - DNA, 15 bp, Homo sapiens
attcaagttattgta

SEQ ID NO: 168698 - DNA, 17 bp, Homo sapiens
attcaattcctctggga

SEQ ID NO: 168699 - DNA, 18 bp, Homo sapiens
attcacaagacccaaaag

SEQ ID NO: 168700 - DNA, 19 bp, Homo sapiens
attcacaagacccaaaagg

SEQ ID NO: 168701 - DNA, 17 bp, Homo sapiens
cacaggcccttcctctc

SEQ ID NO: 168702 - DNA, 18 bp, Homo sapiens
cacaggcccttcctctcc

SEQ ID NO: 168703 - DNA, 22 bp, Homo sapiens
cacaggcccttcctctccactg

SEQ ID NO: 168704 - DNA, 23 bp, Homo sapiens
cacaggcccttcctctccactgc

SEQ ID NO: 168705 - DNA, 16 bp, Homo sapiens
cacagggacttgaagt

SEQ ID NO: 168706 - DNA, 23 bp, Homo sapiens
cacagggtctgctctttctctgc

SEQ ID NO: 168707 - DNA, 14 bp, Homo sapiens
cacagtgcatctca

SEQ ID NO: 168708 - DNA, 13 bp, Homo sapiens
cacagtgtgtttg

SEQ ID NO: 168709 - DNA, 16 bp, Homo sapiens
cacagtgtgtttgtga

SEQ ID NO: 168710 - DNA, 10 bp, Homo sapiens
cacagtgttt

SEQ ID NO: 168711 - DNA, 19 bp, Homo sapiens
cacagttcctcgccctggg

SEQ ID NO: 168712 - DNA, 22 bp, Homo sapiens
cacagttggctggatgaaattt

SEQ ID NO: 168713 - DNA, 15 bp, Homo sapiens
cacagttttctgaga

SEQ ID NO: 168714 - DNA, 16 bp, Homo sapiens
cacagttttctgagaa

SEQ ID NO: 168715 - DNA, 20 bp, Homo sapiens
cacagttttctgagaaagac

SEQ ID NO: 168716 - DNA, 23 bp, Homo sapiens
cacatcagcttgccctgttaaaa

SEQ ID NO: 168717 - DNA, 21 bp, Homo sapiens
cacatctgcattttcacccca

SEQ ID NO: 168718 - DNA, 16 bp, Homo sapiens
cacatctgtgtcttgt

SEQ ID NO: 168719 - DNA, 17 bp, Homo sapiens
cacatctgtgtcttgtt

SEQ ID NO: 168720 - DNA, 23 bp, Homo sapiens
cacatctgtgtcttgtttggaat

SEQ ID NO: 168721 - DNA, 12 bp, Homo sapiens
cacatctttcac

SEQ ID NO: 168722 - DNA, 21 bp, Homo sapiens
cacatctttcacacttccacc

SEQ ID NO: 168723 - DNA, 21 bp, Homo sapiens
cacatgagatctaggtgagga

SEQ ID NO: 168724 - DNA, 20 bp, Homo sapiens
cacatggtgctacgcctgca

SEQ ID NO: 168725 - DNA, 19 bp, Homo sapiens
cacattaatatttgctgac

SEQ ID NO: 168726 - DNA, 16 bp, Homo sapiens
cacattcaataagcat

SEQ ID NO: 168727 - DNA, 23 bp, Homo sapiens
caccaacatcccattgccctggt

SEQ ID NO: 168728 - DNA, 15 bp, Homo sapiens
caccaagaaagcagg

SEQ ID NO: 168729 - DNA, 20 bp, Homo sapiens
caccaagctcacagttcctc

SEQ ID NO: 168730 - DNA, 17 bp, Homo sapiens
caccacacccagcctca

SEQ ID NO: 168731 - DNA, 16 bp, Homo sapiens
caccaccccagctgct

SEQ ID NO: 168732 - DNA, 23 bp, Homo sapiens
caccacctaggccactcctccaa

SEQ ID NO: 168733 - DNA, 13 bp, Homo sapiens
caccacctccctc

SEQ ID NO: 168734 - DNA, 21 bp, Homo sapiens
caccaccttcccagctctccc

SEQ ID NO: 168735 - DNA, 22 bp, Homo sapiens
caccacgatgtggccctggcct

SEQ ID NO: 168736 - DNA, 16 bp, Homo sapiens
caccacttcttttata

SEQ ID NO: 168737 - DNA, 11 bp, Homo sapiens
caccagagacc

SEQ ID NO: 168738 - DNA, 16 bp, Homo sapiens
caccagagaccgtcct

SEQ ID NO: 168739 - DNA, 20 bp, Homo sapiens
caccagagaccgtcctcacc

SEQ ID NO: 168740 - DNA, 21 bp, Homo sapiens
caccagagaccgtcctcaccc

SEQ ID NO: 168741 - DNA, 13 bp, Homo sapiens
caccagcctgcac

SEQ ID NO: 168742 - DNA, 21 bp, Homo sapiens
caccaggcacgaacccacctg

SEQ ID NO: 168743 - DNA, 22 bp, Homo sapiens
caccaggcacgaacccacctgc

SEQ ID NO: 168744 - DNA, 22 bp, Homo sapiens
caccagggttgaccccagagga

SEQ ID NO: 168745 - DNA, 14 bp, Homo sapiens
caccagtgtcccct

SEQ ID NO: 168746 - DNA, 16 bp, Homo sapiens
caccagtgtcccctcc

SEQ ID NO: 168747 - DNA, 18 bp, Homo sapiens
caccagtgtcccctccac

SEQ ID NO: 168748 - DNA, 16 bp, Homo sapiens
caccatccctttttga

SEQ ID NO: 168749 - DNA, 18 bp, Homo sapiens
caccatggggtcctacca

SEQ ID NO: 168750 - DNA, 18 bp, Homo sapiens
caccatgtttgagctcag

SEQ ID NO: 168751 - DNA, 19 bp, Homo sapiens
caccatgtttgagctcaga

SEQ ID NO: 168752 - DNA, 14 bp, Homo sapiens
cacccactcagctc

SEQ ID NO: 168753 - DNA, 10 bp, Homo sapiens
cacccagccc

SEQ ID NO: 168754 - DNA, 13 bp, Homo sapiens
cacccagcccatt

SEQ ID NO: 168755 - DNA, 22 bp, Homo sapiens
cacccagcccattctctctcct

SEQ ID NO: 168756 - DNA, 23 bp, Homo sapiens
cacccagcccattctctctcctg

SEQ ID NO: 168757 - DNA, 15 bp, Homo sapiens
cacccagcctcagtc

SEQ ID NO: 168758 - DNA, 22 bp, Homo sapiens
cacccagcctcagtcctcccct

SEQ ID NO: 168759 - DNA, 20 bp, Homo sapiens
cacccagtgagcactcccaa

SEQ ID NO: 168760 - DNA, 17 bp, Homo sapiens
cacccatgtttctctgg

SEQ ID NO: 168761 - DNA, 19 bp, Homo sapiens
caccccaaagctttcctgc

SEQ ID NO: 168762 - DNA, 22 bp, Homo sapiens
caccccagctgctcccctccct

SEQ ID NO: 168763 - DNA, 17 bp, Homo sapiens
caccccagtgcacccac

SEQ ID NO: 168764 - DNA, 12 bp, Homo sapiens
caccccatccca

SEQ ID NO: 168765 - DNA, 14 bp, Homo sapiens
caccccctccccag

SEQ ID NO: 168766 - DNA, 17 bp, Homo sapiens
caccccctccccagggg

SEQ ID NO: 168767 - DNA, 23 bp, Homo sapiens
caccccgtctggggttcagcccc

SEQ ID NO: 168768 - DNA, 15 bp, Homo sapiens
cacccctaaagagat

SEQ ID NO: 168769 - DNA, 17 bp, Homo sapiens
cacccctcactctggcc

SEQ ID NO: 168770 - DNA, 21 bp, Homo sapiens
cacccctgtcctcactgctcc

SEQ ID NO: 168771 - DNA, 19 bp, Homo sapiens
caccctcgaagcgcgccac

SEQ ID NO: 168772 - DNA, 15 bp, Homo sapiens
caccctctcccagga

SEQ ID NO: 168773 - DNA, 20 bp, Homo sapiens
cacccttcacataccctccc

SEQ ID NO: 168774 - DNA, 13 bp, Homo sapiens
cacccttcccctc

SEQ ID NO: 168775 - DNA, 20 bp, Homo sapiens
cacccttggaggctgtcttc

SEQ ID NO: 168776 - DNA, 19 bp, Homo sapiens
caccgacgcgtctcctgtt

SEQ ID NO: 168777 - DNA, 21 bp, Homo sapiens
caccgagagtagccgagagcc

SEQ ID NO: 168778 - DNA, 19 bp, Homo sapiens
caccgctgcctaagtggct

SEQ ID NO: 168779 - DNA, 22 bp, Homo sapiens
caccgctgcctaagtggctgct

SEQ ID NO: 168780 - DNA, 15 bp, Homo sapiens
caccggatcctgggt

SEQ ID NO: 168781 - DNA, 19 bp, Homo sapiens
caccgtcatggcttaatgt

SEQ ID NO: 168782 - DNA, 23 bp, Homo sapiens
caccgtcatggcttaatgtttat

SEQ ID NO: 168783 - DNA, 18 bp, Homo sapiens
caccgtgggctccctgac

SEQ ID NO: 168784 - DNA, 18 bp, Homo sapiens
cacctaccatcagggaca

SEQ ID NO: 168785 - DNA, 21 bp, Homo sapiens
cacctactacatcgccctcca

SEQ ID NO: 168786 - DNA, 12 bp, Homo sapiens
cacctactgagt

SEQ ID NO: 168787 - DNA, 18 bp, Homo sapiens
cacctaggccactcctcc

SEQ ID NO: 168788 - DNA, 15 bp, Homo sapiens
cacctagtccagtga

SEQ ID NO: 168789 - DNA, 16 bp, Homo sapiens
cacctataaaacaggt

SEQ ID NO: 168790 - DNA, 16 bp, Homo sapiens
cacctcccatcctaat

SEQ ID NO: 168791 - DNA, 13 bp, Homo sapiens
cacctccccacgc

SEQ ID NO: 168792 - DNA, 21 bp, Homo sapiens
cacctccccacgccctcccct

SEQ ID NO: 168793 - DNA, 14 bp, Homo sapiens
cacctccccagcct

SEQ ID NO: 168794 - DNA, 15 bp, Homo sapiens
cacctccccaggccg

SEQ ID NO: 168795 - DNA, 21 bp, Homo sapiens
cacctccccaggccgtggctg

SEQ ID NO: 168796 - DNA, 16 bp, Homo sapiens
cacctccccccactgc

SEQ ID NO: 168797 - DNA, 21 bp, Homo sapiens
cacctccccccactgcaggcc

SEQ ID NO: 168798 - DNA, 19 bp, Homo sapiens
cacctcccctatccaccca

SEQ ID NO: 168799 - DNA, 18 bp, Homo sapiens
cacctctgcacaagctgc

SEQ ID NO: 168800 - DNA, 19 bp, Homo sapiens
cacctctgcacaagctgca

SEQ ID NO: 168801 - DNA, 14 bp, Homo sapiens
cacctctgcctcaa

SEQ ID NO: 168802 - DNA, 21 bp, Homo sapiens
cacctctgcggaccccagctg

SEQ ID NO: 168803 - DNA, 14 bp, Homo sapiens
cacctctgtgacct

SEQ ID NO: 168804 - DNA, 19 bp, Homo sapiens
cacctgagcaggacctctg

SEQ ID NO: 168805 - DNA, 20 bp, Homo sapiens
cccctggggcttctcctgac

SEQ ID NO: 168806 - DNA, 14 bp, Homo sapiens
cccctgtactccag

SEQ ID NO: 168807 - DNA, 16 bp, Homo sapiens
cccctgtcctcactgc

SEQ ID NO: 168808 - DNA, 19 bp, Homo sapiens
cccctgtgcagccgctgag

SEQ ID NO: 168809 - DNA, 20 bp, Homo sapiens
cccctgtgcagccgctgagc

SEQ ID NO: 168810 - DNA, 21 bp, Homo sapiens
ccccttgcccagggctcagcc

SEQ ID NO: 168811 - DNA, 15 bp, Homo sapiens
cccgacagagggaag

SEQ ID NO: 168812 - DNA, 14 bp, Homo sapiens
cccgacagcctggc

SEQ ID NO: 168813 - DNA, 15 bp, Homo sapiens
cccgacagcctggca

SEQ ID NO: 168814 - DNA, 12 bp, Homo sapiens
cccgcagacctc

SEQ ID NO: 168815 - DNA, 14 bp, Homo sapiens
cccgctcagccctc

SEQ ID NO: 168816 - DNA, 15 bp, Homo sapiens
cccgcttgtccagcg

SEQ ID NO: 168817 - DNA, 12 bp, Homo sapiens
cccggccacctc

SEQ ID NO: 168818 - DNA, 20 bp, Homo sapiens
cccggccacctctgcggacc

SEQ ID NO: 168819 - DNA, 18 bp, Homo sapiens
cccggtgcccaagaatag

SEQ ID NO: 168820 - DNA, 21 bp, Homo sapiens
cccgtctggggttcagcccct

SEQ ID NO: 168821 - DNA, 12 bp, Homo sapiens
cccgtcttcagc

SEQ ID NO: 168822 - DNA, 17 bp, Homo sapiens
cccgtcttcagcctagc

SEQ ID NO: 168823 - DNA, 18 bp, Homo sapiens
cccgtcttcagcctagcc

SEQ ID NO: 168824 - DNA, 18 bp, Homo sapiens
cccgtgcagactggaggg

SEQ ID NO: 168825 - DNA, 15 bp, Homo sapiens
cccgtggggttcctc

SEQ ID NO: 168826 - DNA, 14 bp, Homo sapiens
ccctaccccaccac

SEQ ID NO: 168827 - DNA, 21 bp, Homo sapiens
ccctaccgagtctcttctcca

SEQ ID NO: 168828 - DNA, 16 bp, Homo sapiens
ccctagagtgttgttg

SEQ ID NO: 168829 - DNA, 17 bp, Homo sapiens
ccctagcccaggagaga

SEQ ID NO: 168830 - DNA, 18 bp, Homo sapiens
ccctagcccaggagagag

SEQ ID NO: 168831 - DNA, 22 bp, Homo sapiens
ccctaggtcagcttgctgccct

SEQ ID NO: 168832 - DNA, 18 bp, Homo sapiens
ccctatggggatggtcca

SEQ ID NO: 168833 - DNA, 14 bp, Homo sapiens
ccctcactctggcc

SEQ ID NO: 168834 - DNA, 21 bp, Homo sapiens
ccctcagaacccttggcttgc

SEQ ID NO: 168835 - DNA, 23 bp, Homo sapiens
ccctcagaacccttggcttgccc

SEQ ID NO: 168836 - DNA, 15 bp, Homo sapiens
ccctcattcaggaaa

SEQ ID NO: 168837 - DNA, 22 bp, Homo sapiens
ccctcattccaccttcccatgc

SEQ ID NO: 168838 - DNA, 17 bp, Homo sapiens
ccctccactccttcctg

SEQ ID NO: 168839 - DNA, 15 bp, Homo sapiens
ccctcccacctctgt

SEQ ID NO: 168840 - DNA, 13 bp, Homo sapiens
ccctccccagggg

SEQ ID NO: 168841 - DNA, 11 bp, Homo sapiens
ccctccctgtc

SEQ ID NO: 168842 - DNA, 18 bp, Homo sapiens
ccctccgccaggcgagat

SEQ ID NO: 168843 - DNA, 18 bp, Homo sapiens
ccctccgtggcatcacct

SEQ ID NO: 168844 - DNA, 13 bp, Homo sapiens
ccctcctcacccc

SEQ ID NO: 168845 - DNA, 14 bp, Homo sapiens
ccctcctcactggc

SEQ ID NO: 168846 - DNA, 11 bp, Homo sapiens
ccctcctctgc

SEQ ID NO: 168847 - DNA, 13 bp, Homo sapiens
ccctcctctgcca

SEQ ID NO: 168848 - DNA, 21 bp, Homo sapiens
ccctcgaagcgcgccactcgc

SEQ ID NO: 168849 - DNA, 14 bp, Homo sapiens
ccctcgctgccagc

SEQ ID NO: 168850 - DNA, 16 bp, Homo sapiens
ccctcgtggccttccc

SEQ ID NO: 168851 - DNA, 18 bp, Homo sapiens
ccctcgtggtccccaaca

SEQ ID NO: 168852 - DNA, 20 bp, Homo sapiens
ccctcgtggtccccaacagc

SEQ ID NO: 168853 - DNA, 18 bp, Homo sapiens
ccctctacagagcttccc

SEQ ID NO: 168854 - DNA, 13 bp, Homo sapiens
ccctctcccagga

SEQ ID NO: 168855 - DNA, 13 bp, Homo sapiens
ccctctcctgcct

SEQ ID NO: 168856 - DNA, 12 bp, Homo sapiens
ccctctgccacc

SEQ ID NO: 168857 - DNA, 14 bp, Homo sapiens
ccctctgccaccag

SEQ ID NO: 168858 - DNA, 16 bp, Homo sapiens
ccctctggccctgcct

SEQ ID NO: 168859 - DNA, 11 bp, Homo sapiens
ccctcttccat

SEQ ID NO: 168860 - DNA, 17 bp, Homo sapiens
ccctgaaaacccagaga

SEQ ID NO: 168861 - DNA, 16 bp, Homo sapiens
ccctgaaagccctgag

SEQ ID NO: 168862 - DNA, 11 bp, Homo sapiens
ccctgaagcca

SEQ ID NO: 168863 - DNA, 16 bp, Homo sapiens
ccctgaagccagcctt

SEQ ID NO: 168864 - DNA, 22 bp, Homo sapiens
ccctgagctcggtggacccagg

SEQ ID NO: 168865 - DNA, 14 bp, Homo sapiens
ccctgagctgaggc

SEQ ID NO: 168866 - DNA, 18 bp, Homo sapiens
ccctgcaaaaggactctc

SEQ ID NO: 168867 - DNA, 12 bp, Homo sapiens
ccctgcatcccc

SEQ ID NO: 168868 - DNA, 14 bp, Homo sapiens
ccctgccagggcag

SEQ ID NO: 168869 - DNA, 14 bp, Homo sapiens
ccctgccagtgcct

SEQ ID NO: 168870 - DNA, 15 bp, Homo sapiens
ccctgccagtgcctt

SEQ ID NO: 168871 - DNA, 20 bp, Homo sapiens
ctaacgaagtatccttcagc

SEQ ID NO: 168872 - DNA, 16 bp, Homo sapiens
ctaagagctagcgctg

SEQ ID NO: 168873 - DNA, 18 bp, Homo sapiens
ctaagagctagcgctgcc

SEQ ID NO: 168874 - DNA, 16 bp, Homo sapiens
ctaagatagtaacaat

SEQ ID NO: 168875 - DNA, 14 bp, Homo sapiens
ctaaggttctcata

SEQ ID NO: 168876 - DNA, 14 bp, Homo sapiens
ctaagtaaaaccac

SEQ ID NO: 168877 - DNA, 14 bp, Homo sapiens
ctaagtctttccat

SEQ ID NO: 168878 - DNA, 16 bp, Homo sapiens
ctaagtgatataaatc

SEQ ID NO: 168879 - DNA, 23 bp, Homo sapiens
ctaatagcgggttactttcacat

SEQ ID NO: 168880 - DNA, 17 bp, Homo sapiens
ctaatatacagggtagc

SEQ ID NO: 168881 - DNA, 12 bp, Homo sapiens
ctaatatatttt

SEQ ID NO: 168882 - DNA, 15 bp, Homo sapiens
ctaatatatttttat

SEQ ID NO: 168883 - DNA, 16 bp, Homo sapiens
ctaatattaaaaatat

SEQ ID NO: 168884 - DNA, 16 bp, Homo sapiens
ctaatcatccaatgct

SEQ ID NO: 168885 - DNA, 13 bp, Homo sapiens
ctaatccaaccca

SEQ ID NO: 168886 - DNA, 17 bp, Homo sapiens
ggcagacacagggactt

SEQ ID NO: 168887 - DNA, 20 bp, Homo sapiens
ggcagacagcagctcaggca

SEQ ID NO: 168888 - DNA, 19 bp, Homo sapiens
ggcagagagcggtctcagg

SEQ ID NO: 168889 - DNA, 12 bp, Homo sapiens
ggcagagcccaa

SEQ ID NO: 168890 - DNA, 16 bp, Homo sapiens
ggcagagcccaaggga

SEQ ID NO: 168891 - DNA, 13 bp, Homo sapiens
ggcagaggctgga

SEQ ID NO: 168892 - DNA, 21 bp, Homo sapiens
ggcagaggctggaggcagggc

SEQ ID NO: 168893 - DNA, 21 bp, Homo sapiens
ggcagaggttgcagtgagccg

SEQ ID NO: 168894 - DNA, 20 bp, Homo sapiens
ggcagataatcagcctctta

SEQ ID NO: 168895 - DNA, 21 bp, Homo sapiens
ggcagcacctgtctcctttca

SEQ ID NO: 168896 - DNA, 21 bp, Homo sapiens
ggcagcagggctaccctgagc

SEQ ID NO: 168897 - DNA, 19 bp, Homo sapiens
ggcagcagtgtgaggccag

SEQ ID NO: 168898 - DNA, 18 bp, Homo sapiens
ggcaggaggatcacttga

SEQ ID NO: 168899 - DNA, 10 bp, Homo sapiens
ggcaggcagt

SEQ ID NO: 168900 - DNA, 18 bp, Homo sapiens
ggcagggccttgcccaga

SEQ ID NO: 168901 - DNA, 20 bp, Homo sapiens
ggcagggccttgcccagaga

SEQ ID NO: 168902 - DNA, 21 bp, Homo sapiens
ggcagggccttgcccagagat

SEQ ID NO: 168903 - DNA, 16 bp, Homo sapiens
ggcagggtgggatgga

SEQ ID NO: 168904 - DNA, 14 bp, Homo sapiens
ggcaggtagccagg

SEQ ID NO: 168905 - DNA, 20 bp, Homo sapiens
ggcaggtagccagggggact

SEQ ID NO: 168906 - DNA, 12 bp, Homo sapiens
ggcaggtgggag

SEQ ID NO: 168907 - DNA, 23 bp, Homo sapiens
ggcagtagctgtggtgaggtggg

SEQ ID NO: 168908 - DNA, 19 bp, Homo sapiens
ggcagtcacctgcccagat

SEQ ID NO: 168909 - DNA, 14 bp, Homo sapiens
ggcagtctggaggg

SEQ ID NO: 168910 - DNA, 16 bp, Homo sapiens
ggcagtctggaggggc

SEQ ID NO: 168911 - DNA, 18 bp, Homo sapiens
ggcagtgatgctggatgc

SEQ ID NO: 168912 - DNA, 20 bp, Homo sapiens
ggcatcaccttaggcaggga

SEQ ID NO: 168913 - DNA, 13 bp, Homo sapiens
ggcatggccctgg

SEQ ID NO: 168914 - DNA, 16 bp, Homo sapiens
ggcatggccctggggt

SEQ ID NO: 168915 - DNA, 17 bp, Homo sapiens
ggcatggccctggggtc

SEQ ID NO: 168916 - DNA, 14 bp, Homo sapiens
ggcatggctgggaa

SEQ ID NO: 168917 - DNA, 14 bp, Homo sapiens
ggcatttgctgaat

SEQ ID NO: 168918 - DNA, 13 bp, Homo sapiens
ggccaaggtggga

SEQ ID NO: 168919 - DNA, 18 bp, Homo sapiens
ggccacatgggaggctca

SEQ ID NO: 168920 - DNA, 11 bp, Homo sapiens
ggccacgtgcc

SEQ ID NO: 168921 - DNA, 18 bp, Homo sapiens
ggccacgtgccaggcccg

SEQ ID NO: 168922 - DNA, 15 bp, Homo sapiens
ggccactctgcctct

SEQ ID NO: 168923 - DNA, 22 bp, Homo sapiens
ggccactctgcctctgcctgca

SEQ ID NO: 168924 - DNA, 14 bp, Homo sapiens
ggccagagctggga

SEQ ID NO: 168925 - DNA, 21 bp, Homo sapiens
ggccagaggaactgtccagag

SEQ ID NO: 168926 - DNA, 15 bp, Homo sapiens
ggccaggacaggccc

SEQ ID NO: 168927 - DNA, 15 bp, Homo sapiens
ggccaggactgagcc

SEQ ID NO: 168928 - DNA, 20 bp, Homo sapiens
ggccaggactgagccccgca

SEQ ID NO: 168929 - DNA, 23 bp, Homo sapiens
ggccagggcccctcaccctgcct

SEQ ID NO: 168930 - DNA, 20 bp, Homo sapiens
ggccagtaagggaaatagaa

SEQ ID NO: 168931 - DNA, 20 bp, Homo sapiens
ggcccacagctcccacccca

SEQ ID NO: 168932 - DNA, 16 bp, Homo sapiens
ggcccagagcaggaag

SEQ ID NO: 168933 - DNA, 14 bp, Homo sapiens
ggccccaccaccta

SEQ ID NO: 168934 - DNA, 21 bp, Homo sapiens
ggccccagcactaaagcagtg

SEQ ID NO: 168935 - DNA, 14 bp, Homo sapiens
ggccccaggaagcc

SEQ ID NO: 168936 - DNA, 15 bp, Homo sapiens
ggcccgacagcctgg

SEQ ID NO: 168937 - DNA, 13 bp, Homo sapiens
ggcccggggctgg

SEQ ID NO: 168938 - DNA, 15 bp, Homo sapiens
ggccctcacccctgc

SEQ ID NO: 168939 - DNA, 18 bp, Homo sapiens
ggccctcacccctgccct

SEQ ID NO: 168940 - DNA, 21 bp, Homo sapiens
ggccctcacccctgccctggg

SEQ ID NO: 168941 - DNA, 19 bp, Homo sapiens
ggccctcgctgccagctct

SEQ ID NO: 168942 - DNA, 21 bp, Homo sapiens
ggccctcgctgccagctctgt

SEQ ID NO: 168943 - DNA, 14 bp, Homo sapiens
ggccctctctgctc

SEQ ID NO: 168944 - DNA, 19 bp, Homo sapiens
ggccctgagctcggtggac

SEQ ID NO: 168945 - DNA, 22 bp, Homo sapiens
ggccctggcctgctgggctctc

SEQ ID NO: 168946 - DNA, 11 bp, Homo sapiens
ggccctggggc

SEQ ID NO: 168947 - DNA, 16 bp, Homo sapiens
ggccctgtccctccca

SEQ ID NO: 168948 - DNA, 16 bp, Homo sapiens
gaaataaaacctttca

SEQ ID NO: 168949 - DNA, 18 bp, Homo sapiens
gaaataaagttggtgaca

SEQ ID NO: 168950 - DNA, 17 bp, Homo sapiens
gaaatacatatttccaa

SEQ ID NO: 168951 - DNA, 23 bp, Homo sapiens
gaaatagaaaaaccctgccccca

SEQ ID NO: 168952 - DNA, 22 bp, Homo sapiens
gaaatatcagttactcagccct

SEQ ID NO: 168953 - DNA, 13 bp, Homo sapiens
gaaatatcattta

SEQ ID NO: 168954 - DNA, 14 bp, Homo sapiens
gaaatatcatttat

SEQ ID NO: 168955 - DNA, 15 bp, Homo sapiens
gaaatattccctaga

SEQ ID NO: 168956 - DNA, 20 bp, Homo sapiens
gaaatcaaatatgcaaagca

SEQ ID NO: 168957 - DNA, 21 bp, Homo sapiens
gaaatcaaatatgcaaagcac

SEQ ID NO: 168958 - DNA, 18 bp, Homo sapiens
gaaatcagtaatatttat

SEQ ID NO: 168959 - DNA, 23 bp, Homo sapiens
gaaatccctgtttaatatttaaa

SEQ ID NO: 168960 - DNA, 12 bp, Homo sapiens
gaaatgaatata

SEQ ID NO: 168961 - DNA, 18 bp, Homo sapiens
gaaatgctgatggataac

SEQ ID NO: 168962 - DNA, 22 bp, Homo sapiens
gaaatgtaagggaaactgccag

SEQ ID NO: 168963 - DNA, 19 bp, Homo sapiens
gaaatttattagttaatat

SEQ ID NO: 168964 - DNA, 17 bp, Homo sapiens
gaaatttgttataatga

SEQ ID NO: 168965 - DNA, 18 bp, Homo sapiens
gaaattttctagactttc

SEQ ID NO: 168966 - DNA, 17 bp, Homo sapiens
gaaatttttatttttct

SEQ ID NO: 168967 - DNA, 21 bp, Homo sapiens
gaacaaaaaaatctgcagaag

SEQ ID NO: 168968 - DNA, 15 bp, Homo sapiens
gaacaactactgtga

SEQ ID NO: 168969 - DNA, 13 bp, Homo sapiens
gaacaagcctaaa

SEQ ID NO: 168970 - DNA, 21 bp, Homo sapiens
gaacaatgtgctatgtgaaga

SEQ ID NO: 168971 - DNA, 15 bp, Homo sapiens
gaacagacaggagaa

SEQ ID NO: 168972 - DNA, 16 bp, Homo sapiens
gaacagacaggagaaa

SEQ ID NO: 168973 - DNA, 19 bp, Homo sapiens
gaacaggcaagtgaagaaa

SEQ ID NO: 168974 - DNA, 14 bp, Homo sapiens
gaacagtaactgcc

SEQ ID NO: 168975 - DNA, 15 bp, Homo sapiens
gaacataaaatacaa

SEQ ID NO: 168976 - DNA, 17 bp, Homo sapiens
gaacccaagtccaagca

SEQ ID NO: 168977 - DNA, 13 bp, Homo sapiens
gaacccacctgct

SEQ ID NO: 168978 - DNA, 15 bp, Homo sapiens
gaacccacctgctga

SEQ ID NO: 168979 - DNA, 19 bp, Homo sapiens
gaacccgggaggcagaggt

SEQ ID NO: 168980 - DNA, 17 bp, Homo sapiens
gaacccttggcttgccc

SEQ ID NO: 168981 - DNA, 13 bp, Homo sapiens
gaaccgcaggaag

SEQ ID NO: 168982 - DNA, 14 bp, Homo sapiens
gaaccgcaggaagc

SEQ ID NO: 168983 - DNA, 20 bp, Homo sapiens
gaaccgcaggaagctgctcc

SEQ ID NO: 168984 - DNA, 17 bp, Homo sapiens
gaacctcacgcacctcc

SEQ ID NO: 168985 - DNA, 20 bp, Homo sapiens
gaacctcacgcacctcccat

SEQ ID NO: 168986 - DNA, 21 bp, Homo sapiens
gaacctcacgcacctcccatc

SEQ ID NO: 168987 - DNA, 18 bp, Homo sapiens
gaacgatttagaaagaag

SEQ ID NO: 168988 - DNA, 22 bp, Homo sapiens
gaacggagccccaggcctctgt

SEQ ID NO: 168989 - DNA, 22 bp, Homo sapiens
gaacgtgactgccccaactcct

SEQ ID NO: 168990 - DNA, 20 bp, Homo sapiens
gaactaccttggttccccca

SEQ ID NO: 168991 - DNA, 23 bp, Homo sapiens
gaactagccaccaactcttgcag

SEQ ID NO: 168992 - DNA, 15 bp, Homo sapiens
gaactcaactttgac

SEQ ID NO: 168993 - DNA, 16 bp, Homo sapiens
gaactcaactttgaca

SEQ ID NO: 168994 - DNA, 15 bp, Homo sapiens
gaactcctaaatcaa

SEQ ID NO: 168995 - DNA, 20 bp, Homo sapiens
gaactcctggaaatatcagt

SEQ ID NO: 168996 - DNA, 13 bp, Homo sapiens
gaactcttaatca

SEQ ID NO: 168997 - DNA, 20 bp, Homo sapiens
gaactcttaatcaaatagca

SEQ ID NO: 168998 - DNA, 15 bp, Homo sapiens
gaactggactcagga

SEQ ID NO: 168999 - DNA, 13 bp, Homo sapiens
gaactgtccagag

SEQ ID NO: 169000 - DNA, 14 bp, Homo sapiens
gaactgtccagaga

SEQ ID NO: 169001 - DNA, 15 bp, Homo sapiens
gaactgtccagagag

SEQ ID NO: 169002 - DNA, 17 bp, Homo sapiens
gaactgtccagagagca

SEQ ID NO: 169003 - DNA, 20 bp, Homo sapiens
gaacttatcctaaaacaaat

SEQ ID NO: 169004 - DNA, 13 bp, Homo sapiens
gaacttctaatat

SEQ ID NO: 169005 - DNA, 14 bp, Homo sapiens
gaacttctaatata

SEQ ID NO: 169006 - DNA, 22 bp, Homo sapiens
gaacttgctgctgagtgcacca

SEQ ID NO: 169007 - DNA, 19 bp, Homo sapiens
gaacttggaaagaaatgcc

SEQ ID NO: 169008 - DNA, 15 bp, Homo sapiens
gaagaaagtggaaaa

SEQ ID NO: 169009 - DNA, 19 bp, Homo sapiens
gaagaattgaacccaggag

SEQ ID NO: 169010 - DNA, 15 bp, Homo sapiens
gaagaattttcagac

SEQ ID NO: 169011 - DNA, 23 bp, Homo sapiens
gaagacaatgtgaaaagaaaaat

SEQ ID NO: 169012 - DNA, 13 bp, Homo sapiens
gaagactgtggct

SEQ ID NO: 169013 - DNA, 13 bp, Homo sapiens
gaagagaggagag

SEQ ID NO: 169014 - DNA, 14 bp, Homo sapiens
gaagatatttttcc

SEQ ID NO: 169015 - DNA, 21 bp, Homo sapiens
cgtggagagggatgaggtgct

SEQ ID NO: 169016 - DNA, 16 bp, Homo sapiens
cgtggcatagcccaga

SEQ ID NO: 169017 - DNA, 15 bp, Homo sapiens
cgtggcctcttgagc

SEQ ID NO: 169018 - DNA, 14 bp, Homo sapiens
cgtggctctgctgg

SEQ ID NO: 169019 - DNA, 21 bp, Homo sapiens
cgtggctgcccacacacccca

SEQ ID NO: 169020 - DNA, 18 bp, Homo sapiens
cgtggcttcccgctcagc

SEQ ID NO: 169021 - DNA, 19 bp, Homo sapiens
cgtggcttcccgctcagcc

SEQ ID NO: 169022 - DNA, 21 bp, Homo sapiens
cgtggcttcccgctcagccct

SEQ ID NO: 169023 - DNA, 22 bp, Homo sapiens
cgtgggtcttcagggggccagg

SEQ ID NO: 169024 - DNA, 20 bp, Homo sapiens
cgtgtggctcacgtgtgtga

SEQ ID NO: 169025 - DNA, 15 bp, Homo sapiens
cgttcacccctccac

SEQ ID NO: 169026 - DNA, 18 bp, Homo sapiens
cgttccttactgcagaat

SEQ ID NO: 169027 - DNA, 20 bp, Homo sapiens
cgtttactatgcctgtgtct

SEQ ID NO: 169028 - DNA, 19 bp, Homo sapiens
ctaaaaaagatatattaaa

SEQ ID NO: 169029 - DNA, 21 bp, Homo sapiens
ctaaaaatagacttaaatctc

SEQ ID NO: 169030 - DNA, 22 bp, Homo sapiens
ctaaaaatattataacttaaaa

SEQ ID NO: 169031 - DNA, 14 bp, Homo sapiens
ctaaaatgatttta

SEQ ID NO: 169032 - DNA, 22 bp, Homo sapiens
ctaaactctctttgggaatgtt

SEQ ID NO: 169033 - DNA, 18 bp, Homo sapiens
ctaaagaaaaagtcatcc

SEQ ID NO: 169034 - DNA, 11 bp, Homo sapiens
ctaaagcagtg

SEQ ID NO: 169035 - DNA, 16 bp, Homo sapiens
ctaaagtatgtaaagt

SEQ ID NO: 169036 - DNA, 17 bp, Homo sapiens
ctaaatcctttactgtt

SEQ ID NO: 169037 - DNA, 21 bp, Homo sapiens
ctaaatcctttactgttagtc

SEQ ID NO: 169038 - DNA, 13 bp, Homo sapiens
ctaaatgaagtgc

SEQ ID NO: 169039 - DNA, 17 bp, Homo sapiens
ctaacatgccctgttca

SEQ ID NO: 169040 - DNA, 16 bp, Homo sapiens
ctaacccctttcctgc

SEQ ID NO: 169041 - DNA, 15 bp, Homo sapiens
ctaacctcatcttct

SEQ ID NO: 169042 - DNA, 12 bp, Homo sapiens
ctaactaaactc

SEQ ID NO: 169043 - DNA, 13 bp, Homo sapiens
ctaactaaactct

SEQ ID NO: 169044 - DNA, 13 bp, Homo sapiens
ctaactggaagca

SEQ ID NO: 169045 - DNA, 14 bp, Homo sapiens
ctaactggactggt

SEQ ID NO: 169046 - DNA, 17 bp, Homo sapiens
ctaacttggagccccag

SEQ ID NO: 169047 - DNA, 20 bp, Homo sapiens
ctaacttggagccccagtgc

SEQ ID NO: 169048 - DNA, 19 bp, Homo sapiens
ctaagagctagcgctgccg

SEQ ID NO: 169049 - DNA, 20 bp, Homo sapiens
ctaagagctagcgctgccgc

SEQ ID NO: 169050 - DNA, 12 bp, Homo sapiens
ctaagagtgtcc

SEQ ID NO: 169051 - DNA, 14 bp, Homo sapiens
ctaagcaaaatgtg

SEQ ID NO: 169052 - DNA, 11 bp, Homo sapiens
ctaagccaagg

SEQ ID NO: 169053 - DNA, 18 bp, Homo sapiens
ctaagccaagggcctctt

SEQ ID NO: 169054 - DNA, 22 bp, Homo sapiens
ctaagctcaaggcgtgaggatg

SEQ ID NO: 169055 - DNA, 18 bp, Homo sapiens
ctaaggatgtcacagggc

SEQ ID NO: 169056 - DNA, 22 bp, Homo sapiens
ctaagtaaaaccacagcagttg

SEQ ID NO: 169057 - DNA, 13 bp, Homo sapiens
ctaagtgatataa

SEQ ID NO: 169058 - DNA, 13 bp, Homo sapiens
ctaatagaactca

SEQ ID NO: 169059 - DNA, 23 bp, Homo sapiens
ctaatagttttattaataaacat

SEQ ID NO: 169060 - DNA, 11 bp, Homo sapiens
ctaatatattt

SEQ ID NO: 169061 - DNA, 13 bp, Homo sapiens
ctaatatggcaaa

SEQ ID NO: 169062 - DNA, 20 bp, Homo sapiens
ctaatcagcattctcactcc

SEQ ID NO: 169063 - DNA, 21 bp, Homo sapiens
ctaatcagcattctcactcct

SEQ ID NO: 169064 - DNA, 20 bp, Homo sapiens
ctaatcagggaggtcatttt

SEQ ID NO: 169065 - DNA, 15 bp, Homo sapiens
ctaatccaacccatg

SEQ ID NO: 169066 - DNA, 22 bp, Homo sapiens
ctaatgaatgcataaaatgtta

SEQ ID NO: 169067 - DNA, 22 bp, Homo sapiens
ctaatgacatcaccacagttta

SEQ ID NO: 169068 - DNA, 19 bp, Homo sapiens
ctaatgggtatttaaacaa

SEQ ID NO: 169069 - DNA, 14 bp, Homo sapiens
ctaattagagcaga

SEQ ID NO: 169070 - DNA, 16 bp, Homo sapiens
ctaattatataatatt

SEQ ID NO: 169071 - DNA, 18 bp, Homo sapiens
ctacaaaaacacagcaag

SEQ ID NO: 169072 - DNA, 20 bp, Homo sapiens
ctacaaaaacacagcaaggg

SEQ ID NO: 169073 - DNA, 17 bp, Homo sapiens
ctacaacttcagcagta

SEQ ID NO: 169074 - DNA, 16 bp, Homo sapiens
ctacagagcttccctg

SEQ ID NO: 169075 - DNA, 19 bp, Homo sapiens
ctacagttgaaaaacagct

SEQ ID NO: 169076 - DNA, 20 bp, Homo sapiens
ctacagttgttttttgaaaa

SEQ ID NO: 169077 - DNA, 12 bp, Homo sapiens
ctacataaactg

SEQ ID NO: 169078 - DNA, 15 bp, Homo sapiens
ctacataaactgact

SEQ ID NO: 169079 - DNA, 17 bp, Homo sapiens
ctacataaactgacttt

SEQ ID NO: 169080 - DNA, 22 bp, Homo sapiens
ctacataaactgactttatcct

SEQ ID NO: 169081 - DNA, 15 bp, Homo sapiens
ctacatcgccctcca

SEQ ID NO: 169082 - DNA, 17 bp, Homo sapiens
ctacatcgccctccaca

SEQ ID NO: 169083 - DNA, 15 bp, Homo sapiens
ctacatgaggtactg

SEQ ID NO: 169084 - DNA, 20 bp, Homo sapiens
ctacatgaggtactgagagt

SEQ ID NO: 169085 - DNA, 18 bp, Homo sapiens
ctacatgtattgcacatt

SEQ ID NO: 169086 - DNA, 21 bp, Homo sapiens
ctacatgtattgcacattgta

SEQ ID NO: 169087 - DNA, 14 bp, Homo sapiens
ctaccacctcccca

SEQ ID NO: 169088 - DNA, 12 bp, Homo sapiens
ctaccactcctg

SEQ ID NO: 169089 - DNA, 14 bp, Homo sapiens
ctaccactcctgcc

SEQ ID NO: 169090 - DNA, 16 bp, Homo sapiens
ctaccagactgtgtat

SEQ ID NO: 169091 - DNA, 14 bp, Homo sapiens
ctaccatcagggac

SEQ ID NO: 169092 - DNA, 18 bp, Homo sapiens
ctaccatcccctgtagag

SEQ ID NO: 169093 - DNA, 14 bp, Homo sapiens
ctaccctcccccag

SEQ ID NO: 169094 - DNA, 18 bp, Homo sapiens
ctaccctgagctgaggca

SEQ ID NO: 169095 - DNA, 23 bp, Homo sapiens
ctaccgagtctcttctccactgg

SEQ ID NO: 169096 - DNA, 19 bp, Homo sapiens
ctacctgacactcccttgg

SEQ ID NO: 169097 - DNA, 18 bp, Homo sapiens
ctaccttccagttcctca

SEQ ID NO: 169098 - DNA, 21 bp, Homo sapiens
ctaccttggttcccccactga

SEQ ID NO: 169099 - DNA, 14 bp, Homo sapiens
ctacgcctgcatgt

SEQ ID NO: 169100 - DNA, 18 bp, Homo sapiens
ctactacatcgccctcca

SEQ ID NO: 169101 - DNA, 15 bp, Homo sapiens
ccttttgtctgcctc

SEQ ID NO: 169102 - DNA, 12 bp, Homo sapiens
cctttttgaagt

SEQ ID NO: 169103 - DNA, 13 bp, Homo sapiens
cctttttgaagtg

SEQ ID NO: 169104 - DNA, 20 bp, Homo sapiens
cgaaaggatgaaagtgacca

SEQ ID NO: 169105 - DNA, 22 bp, Homo sapiens
cgaaaggatgtaaacagtgcct

SEQ ID NO: 169106 - DNA, 18 bp, Homo sapiens
cgaacaccctcgaagcgc

SEQ ID NO: 169107 - DNA, 22 bp, Homo sapiens
cgaacaccctcgaagcgcgcca

SEQ ID NO: 169108 - DNA, 16 bp, Homo sapiens
cgaacccacctgctga

SEQ ID NO: 169109 - DNA, 11 bp, Homo sapiens
cgaagcgcgcc

SEQ ID NO: 169110 - DNA, 23 bp, Homo sapiens
cgaagcgcgccactcgcttcccc

SEQ ID NO: 169111 - DNA, 13 bp, Homo sapiens
cgaaggtgctgga

SEQ ID NO: 169112 - DNA, 16 bp, Homo sapiens
cgaaggtgctggaggt

SEQ ID NO: 169113 - DNA, 22 bp, Homo sapiens
cgaatctctttttgctttcgaa

SEQ ID NO: 169114 - DNA, 13 bp, Homo sapiens
cgacagcctggca

SEQ ID NO: 169115 - DNA, 15 bp, Homo sapiens
cgacctcagccttcc

SEQ ID NO: 169116 - DNA, 19 bp, Homo sapiens
cgacctcgtcctccccctg

SEQ ID NO: 169117 - DNA, 23 bp, Homo sapiens
cgacctcgtcctccccctgccag

SEQ ID NO: 169118 - DNA, 18 bp, Homo sapiens
cgactctatagactctag

SEQ ID NO: 169119 - DNA, 15 bp, Homo sapiens
cgagagcctgctccc

SEQ ID NO: 169120 - DNA, 18 bp, Homo sapiens
cgagcaggctactgtcag

SEQ ID NO: 169121 - DNA, 15 bp, Homo sapiens
cgagcagtcctgcct

SEQ ID NO: 169122 - DNA, 14 bp, Homo sapiens
cgaggcagggtcag

SEQ ID NO: 169123 - DNA, 22 bp, Homo sapiens
cgaggcagggtcaggagagggg

SEQ ID NO: 169124 - DNA, 22 bp, Homo sapiens
cgaggtggatcacagaggcttc

SEQ ID NO: 169125 - DNA, 20 bp, Homo sapiens
cgagtcaaaactcaaatgct

SEQ ID NO: 169126 - DNA, 16 bp, Homo sapiens
cgagtcaatcccctca

SEQ ID NO: 169127 - DNA, 12 bp, Homo sapiens
cgagtcactgcc

SEQ ID NO: 169128 - DNA, 18 bp, Homo sapiens
cgagtctcttctccactg

SEQ ID NO: 169129 - DNA, 11 bp, Homo sapiens
cgagtgtgtgc

SEQ ID NO: 169130 - DNA, 18 bp, Homo sapiens
cgatacaccgggcctgga

SEQ ID NO: 169131 - DNA, 20 bp, Homo sapiens
cgatacaccgggcctggaga

SEQ ID NO: 169132 - DNA, 17 bp, Homo sapiens
cgatctcttattttaca

SEQ ID NO: 169133 - DNA, 13 bp, Homo sapiens
cgatgtggccctg

SEQ ID NO: 169134 - DNA, 16 bp, Homo sapiens
cgatgtggccctggcc

SEQ ID NO: 169135 - DNA, 18 bp, Homo sapiens
cgatgtggccctggcctg

SEQ ID NO: 169136 - DNA, 13 bp, Homo sapiens
cgattttgtatct

SEQ ID NO: 169137 - DNA, 18 bp, Homo sapiens
cgattttgtatctgcagg

SEQ ID NO: 169138 - DNA, 11 bp, Homo sapiens
cgcaatgtgac

SEQ ID NO: 169139 - DNA, 20 bp, Homo sapiens
cgcaatgtgcccccagacgc

SEQ ID NO: 169140 - DNA, 16 bp, Homo sapiens
cgcacctcccatccta

SEQ ID NO: 169141 - DNA, 22 bp, Homo sapiens
cgcactacatgtggtttataga

SEQ ID NO: 169142 - DNA, 23 bp, Homo sapiens
cgcacttcgggaggtcgaggcag

SEQ ID NO: 169143 - DNA, 12 bp, Homo sapiens
cgcagacctccc

SEQ ID NO: 169144 - DNA, 16 bp, Homo sapiens
cgcagacctccccagc

SEQ ID NO: 169145 - DNA, 17 bp, Homo sapiens
cgcagacctccccagcc

SEQ ID NO: 169146 - DNA, 18 bp, Homo sapiens
cgcagacctccccagccc

SEQ ID NO: 169147 - DNA, 19 bp, Homo sapiens
cgcagacctccccagcccc

SEQ ID NO: 169148 - DNA, 18 bp, Homo sapiens
cgcagcaggaggccaggc

SEQ ID NO: 169149 - DNA, 24 bp, Homo sapiens
cgcagccctgctttgggctgccct

SEQ ID NO: 169150 - DNA, 18 bp, Homo sapiens
cgcaggcccccaggtgcc

SEQ ID NO: 169151 - DNA, 15 bp, Homo sapiens
cgcatcttctccatc

SEQ ID NO: 169152 - DNA, 23 bp, Homo sapiens
cgccactcgcttcccccatagcc

SEQ ID NO: 169153 - DNA, 23 bp, Homo sapiens
cgccaggggaaaatcagcctgct

SEQ ID NO: 169154 - DNA, 15 bp, Homo sapiens
cgccatgctcctggc

SEQ ID NO: 169155 - DNA, 17 bp, Homo sapiens
cgccatgctcctggccc

SEQ ID NO: 169156 - DNA, 12 bp, Homo sapiens
cgcccacctccc

SEQ ID NO: 169157 - DNA, 13 bp, Homo sapiens
cgcccatgtgtga

SEQ ID NO: 169158 - DNA, 14 bp, Homo sapiens
cgcctcccagcctg

SEQ ID NO: 169159 - DNA, 20 bp, Homo sapiens
cgcctgacaaccactggtct

SEQ ID NO: 169160 - DNA, 21 bp, Homo sapiens
cgcctgacaaccactggtctg

SEQ ID NO: 169161 - DNA, 16 bp, Homo sapiens
cgcctgagctcactcg

SEQ ID NO: 169162 - DNA, 15 bp, Homo sapiens
cgcctgcccctccca

SEQ ID NO: 169163 - DNA, 18 bp, Homo sapiens
cgcctgtaatcccagcag

SEQ ID NO: 169164 - DNA, 13 bp, Homo sapiens
cgcctttcccagg

SEQ ID NO: 169165 - DNA, 13 bp, Homo sapiens
cgcgtctcctgtt

SEQ ID NO: 169166 - DNA, 12 bp, Homo sapiens
cgcgtcttcctg

SEQ ID NO: 169167 - DNA, 16 bp, Homo sapiens
cgcgtcttcctgagtg

SEQ ID NO: 169168 - DNA, 17 bp, Homo sapiens
cgcgttgtaaaatatag

SEQ ID NO: 169169 - DNA, 12 bp, Homo sapiens
cgctcagccctc

SEQ ID NO: 169170 - DNA, 16 bp, Homo sapiens
cgctcagccctccctg

SEQ ID NO: 169171 - DNA, 17 bp, Homo sapiens
cgctctcctttctttct

SEQ ID NO: 169172 - DNA, 13 bp, Homo sapiens
cgctgccgcaccc

SEQ ID NO: 169173 - DNA, 21 bp, Homo sapiens
cgctgccgcaccccagagtgt

SEQ ID NO: 169174 - DNA, 15 bp, Homo sapiens
cgctggtagagatgg

SEQ ID NO: 169175 - DNA, 14 bp, Homo sapiens
cgctgtgggcaggt

SEQ ID NO: 169176 - DNA, 18 bp, Homo sapiens
cgcttcccccatagccac

SEQ ID NO: 169177 - DNA, 20 bp, Homo sapiens
cgcttcccccatagccaccc

SEQ ID NO: 169178 - DNA, 14 bp, Homo sapiens
cgcttggagcagag

SEQ ID NO: 169179 - DNA, 20 bp, Homo sapiens
cgcttgtccagcgcctagtg

SEQ ID NO: 169180 - DNA, 13 bp, Homo sapiens
cggaaagcagctc

SEQ ID NO: 169181 - DNA, 15 bp, Homo sapiens
cggaacaagcctaaa

SEQ ID NO: 169182 - DNA, 12 bp, Homo sapiens
cggaagttttca

SEQ ID NO: 169183 - DNA, 14 bp, Homo sapiens
cggaccccagctgt

SEQ ID NO: 169184 - DNA, 22 bp, Homo sapiens
cggaccccagctgtgagccttg

SEQ ID NO: 169185 - DNA, 24 bp, Homo sapiens
cggagaagagctgttcacagccag

SEQ ID NO: 169186 - DNA, 23 bp, Homo sapiens
cggagagcgcctgcccctcccag

SEQ ID NO: 169187 - DNA, 16 bp, Homo sapiens
cggagcaaactctgct

SEQ ID NO: 169188 - DNA, 13 bp, Homo sapiens
cggagccactcct

SEQ ID NO: 169189 - DNA, 18 bp, Homo sapiens
cggagccactcctctgac

SEQ ID NO: 169190 - DNA, 14 bp, Homo sapiens
cggagccccaggcc

SEQ ID NO: 169191 - DNA, 16 bp, Homo sapiens
cggcaatttccggcca

SEQ ID NO: 169192 - DNA, 20 bp, Homo sapiens
cggcagttctgggtgctccc

SEQ ID NO: 169193 - DNA, 22 bp, Homo sapiens
cgattcacctgagcaggacctc

SEQ ID NO: 169194 - DNA, 13 bp, Homo sapiens
cgattggctttaa

SEQ ID NO: 169195 - DNA, 14 bp, Homo sapiens
cgcaagtctgcagc

SEQ ID NO: 169196 - DNA, 19 bp, Homo sapiens
cgcacctaccatcagggac

SEQ ID NO: 169197 - DNA, 18 bp, Homo sapiens
cgcacgtgggtcttcagg

SEQ ID NO: 169198 - DNA, 23 bp, Homo sapiens
cttcagggggccaggtgcacaga

SEQ ID NO: 169199 - DNA, 18 bp, Homo sapiens
cttcagggttctcctctc

SEQ ID NO: 169200 - DNA, 21 bp, Homo sapiens
cttcagggttctcctctcccc

SEQ ID NO: 169201 - DNA, 23 bp, Homo sapiens
cttcagggttctcctctcccctc

SEQ ID NO: 169202 - DNA, 16 bp, Homo sapiens
cttcagtaagccgtga

SEQ ID NO: 169203 - DNA, 14 bp, Homo sapiens
cttcagtatgttgt

SEQ ID NO: 169204 - DNA, 15 bp, Homo sapiens
cttcagtatgttgtc

SEQ ID NO: 169205 - DNA, 19 bp, Homo sapiens
cttcagtgcatctgggaag

SEQ ID NO: 169206 - DNA, 15 bp, Homo sapiens
cttcagtgcccacca

SEQ ID NO: 169207 - DNA, 17 bp, Homo sapiens
cttcagtgcccaccaac

SEQ ID NO: 169208 - DNA, 18 bp, Homo sapiens
cttcagtgggagaaaaca

SEQ ID NO: 169209 - DNA, 17 bp, Homo sapiens
cttcagtttcctggtct

SEQ ID NO: 169210 - DNA, 21 bp, Homo sapiens
cttcatactttttttcacagt

SEQ ID NO: 169211 - DNA, 20 bp, Homo sapiens
cttcattcttgaaagctgtg

SEQ ID NO: 169212 - DNA, 14 bp, Homo sapiens
cttcatttttccta

SEQ ID NO: 169213 - DNA, 17 bp, Homo sapiens
cttccaccagcctgcac

SEQ ID NO: 169214 - DNA, 21 bp, Homo sapiens
cttccaccagcctgcactact

SEQ ID NO: 169215 - DNA, 14 bp, Homo sapiens
cttccagcaccctg

SEQ ID NO: 169216 - DNA, 15 bp, Homo sapiens
cttccagcaccctgc

SEQ ID NO: 169217 - DNA, 14 bp, Homo sapiens
cttccatatgacct

SEQ ID NO: 169218 - DNA, 13 bp, Homo sapiens
cttccatcatgtc

SEQ ID NO: 169219 - DNA, 14 bp, Homo sapiens
cttccatcatgtcc

SEQ ID NO: 169220 - DNA, 15 bp, Homo sapiens
cttccatgtcgcctc

SEQ ID NO: 169221 - DNA, 16 bp, Homo sapiens
cttccatgtcgcctct

SEQ ID NO: 169222 - DNA, 19 bp, Homo sapiens
cttccatgtcgcctctgca

SEQ ID NO: 169223 - DNA, 12 bp, Homo sapiens
cttccatttata

SEQ ID NO: 169224 - DNA, 14 bp, Homo sapiens
cttccatttgcaag

SEQ ID NO: 169225 - DNA, 14 bp, Homo sapiens
cttcccaaaggact

SEQ ID NO: 169226 - DNA, 18 bp, Homo sapiens
cttcccaaaggactccac

SEQ ID NO: 169227 - DNA, 19 bp, Homo sapiens
cttcccaaaggactccacc

SEQ ID NO: 169228 - DNA, 11 bp, Homo sapiens
cttcccatcac

SEQ ID NO: 169229 - DNA, 18 bp, Homo sapiens
cttcccatcactggagca

SEQ ID NO: 169230 - DNA, 14 bp, Homo sapiens
cttccccagcctct

SEQ ID NO: 169231 - DNA, 16 bp, Homo sapiens
cttcccccatagccac

SEQ ID NO: 169232 - DNA, 20 bp, Homo sapiens
cttcccctctctcctcctgc

SEQ ID NO: 169233 - DNA, 16 bp, Homo sapiens
cttccccttgcccagg

SEQ ID NO: 169234 - DNA, 19 bp, Homo sapiens
cttccccttgcccagggct

SEQ ID NO: 169235 - DNA, 15 bp, Homo sapiens
cttcccgctcagccc

SEQ ID NO: 169236 - DNA, 23 bp, Homo sapiens
cttcccgctcagccctccctgcc

SEQ ID NO: 169237 - DNA, 13 bp, Homo sapiens
cttccctgactca

SEQ ID NO: 169238 - DNA, 20 bp, Homo sapiens
cttccctgactcattctgaa

SEQ ID NO: 169239 - DNA, 23 bp, Homo sapiens
cttccgtaacccaactctcctgg

SEQ ID NO: 169240 - DNA, 12 bp, Homo sapiens
cttcctcctggg

SEQ ID NO: 169241 - DNA, 13 bp, Homo sapiens
cttcctctccact

SEQ ID NO: 169242 - DNA, 15 bp, Homo sapiens
cttcctctccactgc

SEQ ID NO: 169243 - DNA, 11 bp, Homo sapiens
cttcctctgct

SEQ ID NO: 169244 - DNA, 20 bp, Homo sapiens
cttcctgcattcacccagac

SEQ ID NO: 169245 - DNA, 21 bp, Homo sapiens
cttcctgcattcacccagaca

SEQ ID NO: 169246 - DNA, 14 bp, Homo sapiens
cttcctggagactg

SEQ ID NO: 169247 - DNA, 13 bp, Homo sapiens
cttcctgtgactt

SEQ ID NO: 169248 - DNA, 20 bp, Homo sapiens
cttcgaaagcatcattattt

SEQ ID NO: 169249 - DNA, 17 bp, Homo sapiens
cttcgagcactgtccag

SEQ ID NO: 169250 - DNA, 19 bp, Homo sapiens
cttcgggaggtcgaggcag

SEQ ID NO: 169251 - DNA, 18 bp, Homo sapiens
cttcggggaactcctgga

SEQ ID NO: 169252 - DNA, 21 bp, Homo sapiens
cttcgtttactatgcctgtgt

SEQ ID NO: 169253 - DNA, 13 bp, Homo sapiens
cttctaagtaaaa

SEQ ID NO: 169254 - DNA, 14 bp, Homo sapiens
cttctaatatattt

SEQ ID NO: 169255 - DNA, 20 bp, Homo sapiens
cttctaatatatttttatat

SEQ ID NO: 169256 - DNA, 13 bp, Homo sapiens
cttctacttttaa

SEQ ID NO: 169257 - DNA, 23 bp, Homo sapiens
cttctatggactggttgttgcca

SEQ ID NO: 169258 - DNA, 21 bp, Homo sapiens
cttctcactgccatgccagct

SEQ ID NO: 169259 - DNA, 13 bp, Homo sapiens
cttctcagaatct

SEQ ID NO: 169260 - DNA, 22 bp, Homo sapiens
cttctcaggctctgccctgccc

SEQ ID NO: 169261 - DNA, 20 bp, Homo sapiens
cttctcattccaacagtgag

SEQ ID NO: 169262 - DNA, 17 bp, Homo sapiens
cttctccactggatgga

SEQ ID NO: 169263 - DNA, 20 bp, Homo sapiens
cttctccaggtctcacgggc

SEQ ID NO: 169264 - DNA, 16 bp, Homo sapiens
cttctccatccacatg

SEQ ID NO: 169265 - DNA, 14 bp, Homo sapiens
cttctcctatgtgt

SEQ ID NO: 169266 - DNA, 22 bp, Homo sapiens
cttctcctatgtgtaaggtgaa

SEQ ID NO: 169267 - DNA, 20 bp, Homo sapiens
cttctcctttcacaaccttc

SEQ ID NO: 169268 - DNA, 22 bp, Homo sapiens
cttctctgtgaacgatttagaa

SEQ ID NO: 169269 - DNA, 12 bp, Homo sapiens
cttctcttaatt

SEQ ID NO: 169270 - DNA, 16 bp, Homo sapiens
cttctcttaatttaat

SEQ ID NO: 169271 - DNA, 15 bp, Homo sapiens
cttctgcccttgcca

SEQ ID NO: 169272 - DNA, 15 bp, Homo sapiens
cttctgtccctcaca

SEQ ID NO: 169273 - DNA, 14 bp, Homo sapiens
cttctgtgaaagta

SEQ ID NO: 169274 - DNA, 20 bp, Homo sapiens
cttcttattctcactccacc

SEQ ID NO: 169275 - DNA, 13 bp, Homo sapiens
cttcttcaccatt

SEQ ID NO: 169276 - DNA, 20 bp, Homo sapiens
cttcttccatcccaggacac

SEQ ID NO: 169277 - DNA, 17 bp, Homo sapiens
cttcttcggggaactcc

SEQ ID NO: 169278 - DNA, 19 bp, Homo sapiens
cttcttctcctatgtgtaa

SEQ ID NO: 169279 - DNA, 20 bp, Homo sapiens
cttcttggtcttatttatta

SEQ ID NO: 169280 - DNA, 22 bp, Homo sapiens
cttctttataattctactttga

SEQ ID NO: 169281 - DNA, 15 bp, Homo sapiens
cttctttttattttc

SEQ ID NO: 169282 - DNA, 13 bp, Homo sapiens
cttgaacactggg

SEQ ID NO: 169283 - DNA, 22 bp, Homo sapiens
cttgaatatcccctcccagtca

SEQ ID NO: 169284 - DNA, 17 bp, Homo sapiens
cttgaattgtaactgtt

SEQ ID NO: 169285 - DNA, 22 bp, Homo sapiens
cttgaattgtaactgttcttga

SEQ ID NO: 169286 - DNA, 15 bp, Homo sapiens
cttgacacctgctga

SEQ ID NO: 169287 - DNA, 22 bp, Homo sapiens
cttgacacctgctgagaaaaca

SEQ ID NO: 169288 - DNA, 19 bp, Homo sapiens
cttgacataatttcactga

SEQ ID NO: 169289 - DNA, 12 bp, Homo sapiens
cttgaccaagca

SEQ ID NO: 169290 - DNA, 11 bp, Homo sapiens
cttgaccagca

SEQ ID NO: 169291 - DNA, 20 bp, Homo sapiens
cttgaccagcagatcccagc

SEQ ID NO: 169292 - DNA, 21 bp, Homo sapiens
cttgaccagcagatcccagct

SEQ ID NO: 169293 - DNA, 20 bp, Homo sapiens
cttgactttagtctgcaaaa

SEQ ID NO: 169294 - DNA, 14 bp, Homo sapiens
cttgagacctcagc

SEQ ID NO: 169295 - DNA, 22 bp, Homo sapiens
cttgagactgttttgaatttgg

SEQ ID NO: 169296 - DNA, 22 bp, Homo sapiens
cttgagagtatcaggtctccca

SEQ ID NO: 169297 - DNA, 14 bp, Homo sapiens
cttgagcagtggct

SEQ ID NO: 169298 - DNA, 16 bp, Homo sapiens
cttgagcagtggctgg

SEQ ID NO: 169299 - DNA, 14 bp, Homo sapiens
cttgaggagtgtga

SEQ ID NO: 169300 - DNA, 22 bp, Homo sapiens
cttgaggagtgtgagaatcaaa

SEQ ID NO: 169301 - DNA, 22 bp, Homo sapiens
cttgatctgtatatacaataac

SEQ ID NO: 169302 - DNA, 21 bp, Homo sapiens
cttgatggctccgaacaccct

SEQ ID NO: 169303 - DNA, 18 bp, Homo sapiens
cttgattcacaatgaaat

SEQ ID NO: 169304 - DNA, 19 bp, Homo sapiens
cttgcacactcccctgcac

SEQ ID NO: 169305 - DNA, 14 bp, Homo sapiens
cttgccactgcctc

SEQ ID NO: 169306 - DNA, 21 bp, Homo sapiens
cttgcccagagatgcctccac

SEQ ID NO: 169307 - DNA, 22 bp, Homo sapiens
cttgcccagagatgcctccacc

SEQ ID NO: 169308 - DNA, 15 bp, Homo sapiens
cttgcccagggctca

SEQ ID NO: 169309 - DNA, 16 bp, Homo sapiens
cttgcccagggctcag

SEQ ID NO: 169310 - DNA, 18 bp, Homo sapiens
cttgcccagggctcagcc

SEQ ID NO: 169311 - DNA, 19 bp, Homo sapiens
cttgcccagggctcagcct

SEQ ID NO: 169312 - DNA, 18 bp, Homo sapiens
cttgccctggtgcctcac

SEQ ID NO: 169313 - DNA, 18 bp, Homo sapiens
cttgccttattagagtgt

SEQ ID NO: 169314 - DNA, 21 bp, Homo sapiens
cttgccttattagagtgtctt

SEQ ID NO: 169315 - DNA, 20 bp, Homo sapiens
cttgctctcccctgccctgc

SEQ ID NO: 169316 - DNA, 19 bp, Homo sapiens
cttgctcttcagtgggaga

SEQ ID NO: 169317 - DNA, 16 bp, Homo sapiens
cttgctgccctaggct

SEQ ID NO: 169318 - DNA, 23 bp, Homo sapiens
cttgctgccctaggctccgtcag

SEQ ID NO: 169319 - DNA, 22 bp, Homo sapiens
cttgctggacggggactgggga

SEQ ID NO: 169320 - DNA, 13 bp, Homo sapiens
cttgcttgctttt

SEQ ID NO: 169321 - DNA, 14 bp, Homo sapiens
cttggactattata

SEQ ID NO: 169322 - DNA, 13 bp, Homo sapiens
cttggagccccag

SEQ ID NO: 169323 - DNA, 15 bp, Homo sapiens
cttggaggctgtctt

SEQ ID NO: 169324 - DNA, 18 bp, Homo sapiens
cttggatgtacctgcccc

SEQ ID NO: 169325 - DNA, 15 bp, Homo sapiens
cttggcaacagaagc

SEQ ID NO: 169326 - DNA, 19 bp, Homo sapiens
cttggcagcacctgtctcc

SEQ ID NO: 169327 - DNA, 22 bp, Homo sapiens
cttggctgtagaaggagacaga

SEQ ID NO: 169328 - DNA, 13 bp, Homo sapiens
cttggctgtgagg

SEQ ID NO: 169329 - DNA, 23 bp, Homo sapiens
cttggcttctcatacgtccacca

SEQ ID NO: 169330 - DNA, 21 bp, Homo sapiens
cttgggaggccccactgggga

SEQ ID NO: 169331 - DNA, 21 bp, Homo sapiens
cttgggctccctgtaacctct

SEQ ID NO: 169332 - DNA, 21 bp, Homo sapiens
cttgggtgtaacaggtctcct

SEQ ID NO: 169333 - DNA, 22 bp, Homo sapiens
cttgggtgtaacaggtctcctc

SEQ ID NO: 169334 - DNA, 23 bp, Homo sapiens
cttggtctcagtgtcaatgcagc

SEQ ID NO: 169335 - DNA, 17 bp, Homo sapiens
cttggtgtccacctggc

SEQ ID NO: 169336 - DNA, 14 bp, Homo sapiens
cttggtgtcctttc

SEQ ID NO: 169337 - DNA, 19 bp, Homo sapiens
cttggttcccccactgatc

SEQ ID NO: 169338 - DNA, 16 bp, Homo sapiens
cttggttgaggaaaca

SEQ ID NO: 169339 - DNA, 17 bp, Homo sapiens
cttggttgggtcctcac

SEQ ID NO: 169340 - DNA, 21 bp, Homo sapiens
cttgtaactccaccaacccat

SEQ ID NO: 169341 - DNA, 13 bp, Homo sapiens
cttgtaattctaa

SEQ ID NO: 169342 - DNA, 16 bp, Homo sapiens
cttgtatagtgtaaaa

SEQ ID NO: 169343 - DNA, 19 bp, Homo sapiens
cttgtcccactcaagccaa

SEQ ID NO: 169344 - DNA, 17 bp, Homo sapiens
cttgtgccacaccctcc

SEQ ID NO: 169345 - DNA, 15 bp, Homo sapiens
cttgtgtctacagag

SEQ ID NO: 169346 - DNA, 19 bp, Homo sapiens
cttgtgttaagtatgtgta

SEQ ID NO: 169347 - DNA, 13 bp, Homo sapiens
cttgttatttata

SEQ ID NO: 169348 - DNA, 15 bp, Homo sapiens
cttgttatttataac

SEQ ID NO: 169349 - DNA, 15 bp, Homo sapiens
cttgtttccaatgtt

SEQ ID NO: 169350 - DNA, 22 bp, Homo sapiens
cttgtttgattttagctgcaga

SEQ ID NO: 169351 - DNA, 14 bp, Homo sapiens
cttgttttcagttt

SEQ ID NO: 169352 - DNA, 19 bp, Homo sapiens
cttgttttttttttccact

SEQ ID NO: 169353 - DNA, 23 bp, Homo sapiens
ctttaatttttttaaccaaaggt

SEQ ID NO: 169354 - DNA, 19 bp, Homo sapiens
ctttacaatgttcatccca

SEQ ID NO: 169355 - DNA, 14 bp, Homo sapiens
ctttacatgcaatt

SEQ ID NO: 169356 - DNA, 17 bp, Homo sapiens
ctttacatgcaatttat

SEQ ID NO: 169357 - DNA, 15 bp, Homo sapiens
ctttagtctgcaaaa

SEQ ID NO: 169358 - DNA, 12 bp, Homo sapiens
ctttatatttag

SEQ ID NO: 169359 - DNA, 13 bp, Homo sapiens
ctttatatttagt

SEQ ID NO: 169360 - DNA, 15 bp, Homo sapiens
ctttatgcacaaaat

SEQ ID NO: 169361 - DNA, 19 bp, Homo sapiens
ctttcaaaaccttttgaaa

SEQ ID NO: 169362 - DNA, 21 bp, Homo sapiens
ctttcacacttccaccagcct

SEQ ID NO: 169363 - DNA, 16 bp, Homo sapiens
ctttcaccccagggcc

SEQ ID NO: 169364 - DNA, 23 bp, Homo sapiens
ctttcaccccagggcctgagcct

SEQ ID NO: 169365 - DNA, 17 bp, Homo sapiens
ctttcatccactagtgc

SEQ ID NO: 169366 - DNA, 17 bp, Homo sapiens
ctttcatgtaaactgtg

SEQ ID NO: 169367 - DNA, 18 bp, Homo sapiens
ctttccaaatgcccagct

SEQ ID NO: 169368 - DNA, 19 bp, Homo sapiens
ctttccaaatgcccagctt

SEQ ID NO: 169369 - DNA, 22 bp, Homo sapiens
ctttccaaatgcccagcttaaa

SEQ ID NO: 169370 - DNA, 21 bp, Homo sapiens
ctttccacacctggcactgct

SEQ ID NO: 169371 - DNA, 13 bp, Homo sapiens
ctttccccagccc

SEQ ID NO: 169372 - DNA, 16 bp, Homo sapiens
ctttccccagcccagg

SEQ ID NO: 169373 - DNA, 17 bp, Homo sapiens
ctttccccagcccaggg

SEQ ID NO: 169374 - DNA, 19 bp, Homo sapiens
ctttcctcaaaacttcaga

SEQ ID NO: 169375 - DNA, 13 bp, Homo sapiens
ctttcctcgcctg

SEQ ID NO: 169376 - DNA, 10 bp, Homo sapiens
ctttcctgcc

SEQ ID NO: 169377 - DNA, 18 bp, Homo sapiens
ctttcctgccccaggcct

SEQ ID NO: 169378 - DNA, 19 bp, Homo sapiens
ctttcctgccccaggcctg

SEQ ID NO: 169379 - DNA, 22 bp, Homo sapiens
ctttcggggagaggctgaggac

SEQ ID NO: 169380 - DNA, 14 bp, Homo sapiens
ctttctagctgttg

SEQ ID NO: 169381 - DNA, 14 bp, Homo sapiens
ctttctctgccagt

SEQ ID NO: 169382 - DNA, 15 bp, Homo sapiens
ctttctgtgtgcacc

SEQ ID NO: 169383 - DNA, 13 bp, Homo sapiens
ctttcttcctctg

SEQ ID NO: 169384 - DNA, 16 bp, Homo sapiens
ctttcttcctctgctg

SEQ ID NO: 169385 - DNA, 15 bp, Homo sapiens
ctttcttctatttta

SEQ ID NO: 169386 - DNA, 16 bp, Homo sapiens
ctttgaaatgaatata

SEQ ID NO: 169387 - DNA, 15 bp, Homo sapiens
ctttgaaattgttta

SEQ ID NO: 169388 - DNA, 18 bp, Homo sapiens
ctttgaagaggaaaatga

SEQ ID NO: 169389 - DNA, 15 bp, Homo sapiens
ctttgaatgacaaag

SEQ ID NO: 169390 - DNA, 16 bp, Homo sapiens
ctttgactgagcagac

SEQ ID NO: 169391 - DNA, 16 bp, Homo sapiens
ctttgagtttcctcag

SEQ ID NO: 169392 - DNA, 17 bp, Homo sapiens
ctttgctgtgaggctgt

SEQ ID NO: 169393 - DNA, 13 bp, Homo sapiens
ctttggctctgga

SEQ ID NO: 169394 - DNA, 15 bp, Homo sapiens
ctttggctctggaga

SEQ ID NO: 169395 - DNA, 13 bp, Homo sapiens
ctttgggaatgtt

SEQ ID NO: 169396 - DNA, 23 bp, Homo sapiens
ctttgggaggccaaggtgggagg

SEQ ID NO: 169397 - DNA, 19 bp, Homo sapiens
ctttgggctgccctggtgc

SEQ ID NO: 169398 - DNA, 20 bp, Homo sapiens
ctttgggctgccctggtgct

SEQ ID NO: 169399 - DNA, 17 bp, Homo sapiens
ctttgtaatgtcaccac

SEQ ID NO: 169400 - DNA, 22 bp, Homo sapiens
ctttgtaatgtcaccaccttcc

SEQ ID NO: 169401 - DNA, 14 bp, Homo sapiens
ctttgtcccatttc

SEQ ID NO: 169402 - DNA, 21 bp, Homo sapiens
ctttgttgcaagtactgctgt

SEQ ID NO: 169403 - DNA, 17 bp, Homo sapiens
ctttgtttcaaccaagt

SEQ ID NO: 169404 - DNA, 20 bp, Homo sapiens
ctttgtttgttgtcagctga

SEQ ID NO: 169405 - DNA, 21 bp, Homo sapiens
ctttgtttgttgtcagctgaa

SEQ ID NO: 169406 - DNA, 19 bp, Homo sapiens
ctttgttttgcacactttg

SEQ ID NO: 169407 - DNA, 23 bp, Homo sapiens
ctttgttttgcacactttgccat

SEQ ID NO: 169408 - DNA, 23 bp, Homo sapiens
ctttgtttttttttcctgtcctt

SEQ ID NO: 169409 - DNA, 14 bp, Homo sapiens
cttttaatcagaca

SEQ ID NO: 169410 - DNA, 12 bp, Homo sapiens
cttttatagcta

SEQ ID NO: 169411 - DNA, 17 bp, Homo sapiens
cttttatagctattact

SEQ ID NO: 169412 - DNA, 16 bp, Homo sapiens
cttttattgtataaac

SEQ ID NO: 169413 - DNA, 21 bp, Homo sapiens
cttttattgtataaactatca

SEQ ID NO: 169414 - DNA, 12 bp, Homo sapiens
cttttcactgct

SEQ ID NO: 169415 - DNA, 20 bp, Homo sapiens
cttttcactgctggctgcct

SEQ ID NO: 169416 - DNA, 13 bp, Homo sapiens
cttttccttgggg

SEQ ID NO: 169417 - DNA, 16 bp, Homo sapiens
cttttcgccgtggctg

SEQ ID NO: 169418 - DNA, 13 bp, Homo sapiens
cttttctcagctg

SEQ ID NO: 169419 - DNA, 19 bp, Homo sapiens
cttttctggaatgtaatca

SEQ ID NO: 169420 - DNA, 20 bp, Homo sapiens
cttttgaagtagtttgtata

SEQ ID NO: 169421 - DNA, 17 bp, Homo sapiens
cttttgacaaaggcaag

SEQ ID NO: 169422 - DNA, 20 bp, Homo sapiens
cttttgcccttcacagtgtt

SEQ ID NO: 169423 - DNA, 15 bp, Homo sapiens
cttttgccctttgat

SEQ ID NO: 169424 - DNA, 23 bp, Homo sapiens
cttttgtatgtaaatgtgcattc

SEQ ID NO: 169425 - DNA, 15 bp, Homo sapiens
ctttttaataaaaag

SEQ ID NO: 169426 - DNA, 22 bp, Homo sapiens
ctttttaatattgatatgctta

SEQ ID NO: 169427 - DNA, 19 bp, Homo sapiens
ctttttagggccaggcagg

SEQ ID NO: 169428 - DNA, 17 bp, Homo sapiens
ctttttccccaaagtct

SEQ ID NO: 169429 - DNA, 11 bp, Homo sapiens
ctttttgaatg

SEQ ID NO: 169430 - DNA, 18 bp, Homo sapiens
cttttttatgtgccgtgt

SEQ ID NO: 169431 - DNA, 18 bp, Homo sapiens
gaaaaaaagtttgccaga

SEQ ID NO: 169432 - DNA, 20 bp, Homo sapiens
gaaaaaaagtttgccagaag

SEQ ID NO: 169433 - DNA, 11 bp, Homo sapiens
gaaaaagaaaa

SEQ ID NO: 169434 - DNA, 12 bp, Homo sapiens
gaaaaaggagga

SEQ ID NO: 169435 - DNA, 21 bp, Homo sapiens
gaaaaagtcatccaatctaac

SEQ ID NO: 169436 - DNA, 19 bp, Homo sapiens
gaaaaataacttcaagcaa

SEQ ID NO: 169437 - DNA, 20 bp, Homo sapiens
gaaaaatctaagtgatataa

SEQ ID NO: 169438 - DNA, 14 bp, Homo sapiens
gaaaaatgtgtaat

SEQ ID NO: 169439 - DNA, 12 bp, Homo sapiens
gaaaacaaggaa

SEQ ID NO: 169440 - DNA, 14 bp, Homo sapiens
gaaaacaaggaagt

SEQ ID NO: 169441 - DNA, 14 bp, Homo sapiens
gaaaacactgtgca

SEQ ID NO: 169442 - DNA, 12 bp, Homo sapiens
gaaaacccagag

SEQ ID NO: 169443 - DNA, 21 bp, Homo sapiens
gaaaactttatgctaagtgaa

SEQ ID NO: 169444 - DNA, 16 bp, Homo sapiens
gaaaagactccaaaga

SEQ ID NO: 169445 - DNA, 18 bp, Homo sapiens
gaaaagactccaaagaaa

SEQ ID NO: 169446 - DNA, 21 bp, Homo sapiens
gaaaagactccaaagaaatgt

SEQ ID NO: 169447 - DNA, 14 bp, Homo sapiens
gaaaagagatggcc

SEQ ID NO: 169448 - DNA, 14 bp, Homo sapiens
gaaaagcacctgcc

SEQ ID NO: 169449 - DNA, 16 bp, Homo sapiens
gaaaagcacctgccga

SEQ ID NO: 169450 - DNA, 18 bp, Homo sapiens
gaaaatatttgtatcaca

SEQ ID NO: 169451 - DNA, 20 bp, Homo sapiens
gaaaatcagcctgctccagc

SEQ ID NO: 169452 - DNA, 22 bp, Homo sapiens
gaaaatcagcctgctccagctg

SEQ ID NO: 169453 - DNA, 14 bp, Homo sapiens
gaaaatcatattgc

SEQ ID NO: 169454 - DNA, 13 bp, Homo sapiens
gaaaatcctctgg

SEQ ID NO: 169455 - DNA, 14 bp, Homo sapiens
gaaaatctaatatt

SEQ ID NO: 169456 - DNA, 21 bp, Homo sapiens
gaaaatctaatattaaaaata

SEQ ID NO: 169457 - DNA, 22 bp, Homo sapiens
gaaaatctacactccagtgaga

SEQ ID NO: 169458 - DNA, 12 bp, Homo sapiens
gaaaatgaataa

SEQ ID NO: 169459 - DNA, 20 bp, Homo sapiens
gaaaatgatacgcaacataa

SEQ ID NO: 169460 - DNA, 23 bp, Homo sapiens
gaaaatgctgtattagtcacaga

SEQ ID NO: 169461 - DNA, 18 bp, Homo sapiens
gaaaatggtccaggagaa

SEQ ID NO: 169462 - DNA, 16 bp, Homo sapiens
gaaaattatttgcata

SEQ ID NO: 169463 - DNA, 17 bp, Homo sapiens
gaaaattattttaaaca

SEQ ID NO: 169464 - DNA, 17 bp, Homo sapiens
gaaaatttgttattttg

SEQ ID NO: 169465 - DNA, 21 bp, Homo sapiens
gaaaatttgttattttgcaac

SEQ ID NO: 169466 - DNA, 20 bp, Homo sapiens
gaaacaactctttgagaaac

SEQ ID NO: 169467 - DNA, 15 bp, Homo sapiens
gaaacacaatatttt

SEQ ID NO: 169468 - DNA, 22 bp, Homo sapiens
gaaacactgggcttctagaacc

SEQ ID NO: 169469 - DNA, 13 bp, Homo sapiens
gaaacaggagaga

SEQ ID NO: 169470 - DNA, 17 bp, Homo sapiens
gaaaccttattgtacct

SEQ ID NO: 169471 - DNA, 18 bp, Homo sapiens
gaaactccgtcttagaag

SEQ ID NO: 169472 - DNA, 21 bp, Homo sapiens
gaaactgttgccagagatgga

SEQ ID NO: 169473 - DNA, 16 bp, Homo sapiens
gaaagaccatttttcc

SEQ ID NO: 169474 - DNA, 14 bp, Homo sapiens
gaaagactattcaa

SEQ ID NO: 169475 - DNA, 17 bp, Homo sapiens
gaaagcagaacagtgat

SEQ ID NO: 169476 - DNA, 19 bp, Homo sapiens
gaaagcagctcaaaggcac

SEQ ID NO: 169477 - DNA, 13 bp, Homo sapiens
gaaagcaggggct

SEQ ID NO: 169478 - DNA, 14 bp, Homo sapiens
gaaagcaggggcta

SEQ ID NO: 169479 - DNA, 19 bp, Homo sapiens
gaaagcaggggctacaaga

SEQ ID NO: 169480 - DNA, 11 bp, Homo sapiens
gaaagccaggc

SEQ ID NO: 169481 - DNA, 23 bp, Homo sapiens
gaaagccaggcaggtagccaggg

SEQ ID NO: 169482 - DNA, 17 bp, Homo sapiens
gaaagccctgagctttc

SEQ ID NO: 169483 - DNA, 21 bp, Homo sapiens
gaaagccctgagctttctgct

SEQ ID NO: 169484 - DNA, 22 bp, Homo sapiens
gaaaggaagctccactgtcacc

SEQ ID NO: 169485 - DNA, 17 bp, Homo sapiens
gaaaggagaggaaagaa

SEQ ID NO: 169486 - DNA, 22 bp, Homo sapiens
gaaaggatgtaaacagtgcctg

SEQ ID NO: 169487 - DNA, 12 bp, Homo sapiens
gaaaggccagct

SEQ ID NO: 169488 - DNA, 16 bp, Homo sapiens
gaaaggccagctggca

SEQ ID NO: 169489 - DNA, 22 bp, Homo sapiens
gaaaggccagctggcagcagag

SEQ ID NO: 169490 - DNA, 14 bp, Homo sapiens
gaaaggtttacatt

SEQ ID NO: 169491 - DNA, 22 bp, Homo sapiens
gaaagtcgaattaatagctttt

SEQ ID NO: 169492 - DNA, 21 bp, Homo sapiens
gaaagtgggtgagatgctgga

SEQ ID NO: 169493 - DNA, 18 bp, Homo sapiens
gaagatgtagaggagaaa

SEQ ID NO: 169494 - DNA, 14 bp, Homo sapiens
gaagattctttccc

SEQ ID NO: 169495 - DNA, 19 bp, Homo sapiens
gaagcagatgcaaagaggc

SEQ ID NO: 169496 - DNA, 16 bp, Homo sapiens
gaagcatgtaggagaa

SEQ ID NO: 169497 - DNA, 15 bp, Homo sapiens
gaagcattcagagag

SEQ ID NO: 169498 - DNA, 16 bp, Homo sapiens
gaagcattcagagagc

SEQ ID NO: 169499 - DNA, 12 bp, Homo sapiens
gaagccctcctt

SEQ ID NO: 169500 - DNA, 15 bp, Homo sapiens
gaagccctccttcca

SEQ ID NO: 169501 - DNA, 17 bp, Homo sapiens
gaagccgtgccctgccc

SEQ ID NO: 169502 - DNA, 22 bp, Homo sapiens
gaagcgcgccactcgcttcccc

SEQ ID NO: 169503 - DNA, 14 bp, Homo sapiens
gaagctcagactgg

SEQ ID NO: 169504 - DNA, 14 bp, Homo sapiens
gaagctgagcacca

SEQ ID NO: 169505 - DNA, 24 bp, Homo sapiens
gaagctgtgtccttgcacctgcat

SEQ ID NO: 169506 - DNA, 23 bp, Homo sapiens
gaagcttcttaaatgagaaggaa

SEQ ID NO: 169507 - DNA, 23 bp, Homo sapiens
gaaggaaggagactcacctctgc

SEQ ID NO: 169508 - DNA, 22 bp, Homo sapiens
gaaggacccggaggggcctggc

SEQ ID NO: 169509 - DNA, 23 bp, Homo sapiens
gaaggacccggaggggcctggca

SEQ ID NO: 169510 - DNA, 17 bp, Homo sapiens
gaaggagaaggaaggag

SEQ ID NO: 169511 - DNA, 15 bp, Homo sapiens
gaaggagactcacct

SEQ ID NO: 169512 - DNA, 23 bp, Homo sapiens
gaaggagactcacctctgcctca

SEQ ID NO: 169513 - DNA, 20 bp, Homo sapiens
gaaggagagaaagtgggtga

SEQ ID NO: 169514 - DNA, 18 bp, Homo sapiens
gaaggagagaaggggagg

SEQ ID NO: 169515 - DNA, 18 bp, Homo sapiens
gaaggaggaggaggaggt

SEQ ID NO: 169516 - DNA, 14 bp, Homo sapiens
gaaggaggctggct

SEQ ID NO: 169517 - DNA, 22 bp, Homo sapiens
gaaggccgagaagcaagaaaga

SEQ ID NO: 169518 - DNA, 16 bp, Homo sapiens
gaaggcttctctctgt

SEQ ID NO: 169519 - DNA, 12 bp, Homo sapiens
gaaggtgctgga

SEQ ID NO: 169520 - DNA, 21 bp, Homo sapiens
gaaggtgctggaggtgggagc

SEQ ID NO: 169521 - DNA, 23 bp, Homo sapiens
gaaggtgctggaggtgggagcag

SEQ ID NO: 169522 - DNA, 13 bp, Homo sapiens
gaagtaggaagta

SEQ ID NO: 169523 - DNA, 14 bp, Homo sapiens
gaagtatccttcag

SEQ ID NO: 169524 - DNA, 16 bp, Homo sapiens
gaagtatccttcagcc

SEQ ID NO: 169525 - DNA, 15 bp, Homo sapiens
gaagtcaaagcaagg

SEQ ID NO: 169526 - DNA, 22 bp, Homo sapiens
gaagtggaccaggacaggacca

SEQ ID NO: 169527 - DNA, 16 bp, Homo sapiens
gaagtgggccaggaca

SEQ ID NO: 169528 - DNA, 21 bp, Homo sapiens
gaagtgggccaggacaggccc

SEQ ID NO: 169529 - DNA, 16 bp, Homo sapiens
gaagtgtaggcagaca

SEQ ID NO: 169530 - DNA, 18 bp, Homo sapiens
gaagtgtaggcagacaca

SEQ ID NO: 169531 - DNA, 15 bp, Homo sapiens
gaagtgtgtttcctt

SEQ ID NO: 169532 - DNA, 20 bp, Homo sapiens
gaagttgtgccttttatagc

SEQ ID NO: 169533 - DNA, 11 bp, Homo sapiens
gaagttttcaa

SEQ ID NO: 169534 - DNA, 13 bp, Homo sapiens
gaataaagttctg

SEQ ID NO: 169535 - DNA, 22 bp, Homo sapiens
gaataaataaatgtatcttatt

SEQ ID NO: 169536 - DNA, 16 bp, Homo sapiens
gaataatacattgaat

SEQ ID NO: 169537 - DNA, 14 bp, Homo sapiens
gaatacagaaagat

SEQ ID NO: 169538 - DNA, 13 bp, Homo sapiens
gaatacagtgtta

SEQ ID NO: 169539 - DNA, 22 bp, Homo sapiens
gaatatatggcagagttgtaaa

SEQ ID NO: 169540 - DNA, 22 bp, Homo sapiens
gaatatcccctcccagtcacct

SEQ ID NO: 169541 - DNA, 22 bp, Homo sapiens
gaatatgaacggtgagcattgt

SEQ ID NO: 169542 - DNA, 18 bp, Homo sapiens
gaatatgattagtaaaga

SEQ ID NO: 169543 - DNA, 19 bp, Homo sapiens
gaatatgattagtaaagaa

SEQ ID NO: 169544 - DNA, 22 bp, Homo sapiens
gaatattgctttggtcatatga

SEQ ID NO: 169545 - DNA, 13 bp, Homo sapiens
gaatattgtccat

SEQ ID NO: 169546 - DNA, 21 bp, Homo sapiens
gaatatttattacctctgata

SEQ ID NO: 169547 - DNA, 14 bp, Homo sapiens
gaatcaaaactctc

SEQ ID NO: 169548 - DNA, 18 bp, Homo sapiens
gaatcagaccctacccca

SEQ ID NO: 169549 - DNA, 23 bp, Homo sapiens
gaatcagaccctaccccaccacg

SEQ ID NO: 169550 - DNA, 21 bp, Homo sapiens
gaatcatgtcaggcctgtgtg

SEQ ID NO: 169551 - DNA, 13 bp, Homo sapiens
gaatccatgcttg

SEQ ID NO: 169552 - DNA, 22 bp, Homo sapiens
gaatcctgtcctcagcttctta

SEQ ID NO: 169553 - DNA, 18 bp, Homo sapiens
gaatctttattgagaaag

SEQ ID NO: 169554 - DNA, 15 bp, Homo sapiens
gaatgaaaaaacagt

SEQ ID NO: 169555 - DNA, 14 bp, Homo sapiens
gaatgaatggctaa

SEQ ID NO: 169556 - DNA, 20 bp, Homo sapiens
gaatgaatggctaagcaaaa

SEQ ID NO: 169557 - DNA, 14 bp, Homo sapiens
gaatgagagtgtga

SEQ ID NO: 169558 - DNA, 14 bp, Homo sapiens
gaatgaggaggaag

SEQ ID NO: 169559 - DNA, 20 bp, Homo sapiens
gaatgatgatcctaggcatt

SEQ ID NO: 169560 - DNA, 22 bp, Homo sapiens
gaatgatttccaaagagaaaaa

SEQ ID NO: 169561 - DNA, 14 bp, Homo sapiens
gaatgatttttaga

SEQ ID NO: 169562 - DNA, 16 bp, Homo sapiens
gaatgatttttagatg

SEQ ID NO: 169563 - DNA, 22 bp, Homo sapiens
gaatgcccacaggcaaatgcat

SEQ ID NO: 169564 - DNA, 22 bp, Homo sapiens
gaatgctcaagtttttcagaaa

SEQ ID NO: 169565 - DNA, 15 bp, Homo sapiens
gaatgctgtatatgt

SEQ ID NO: 169566 - DNA, 14 bp, Homo sapiens
gaatgctgtgttaa

SEQ ID NO: 169567 - DNA, 18 bp, Homo sapiens
gaatgctttttgaatgtt

SEQ ID NO: 169568 - DNA, 16 bp, Homo sapiens
gaatgtaatcaatgtt

SEQ ID NO: 169569 - DNA, 14 bp, Homo sapiens
gaatgtactctgtt

SEQ ID NO: 169570 - DNA, 14 bp, Homo sapiens
gaatgttaagcaga

SEQ ID NO: 169571 - DNA, 17 bp, Homo sapiens
gaatgttacattgtttg

SEQ ID NO: 169572 - DNA, 22 bp, Homo sapiens
gaattacatgtaaaacattatc

SEQ ID NO: 169573 - DNA, 24 bp, Homo sapiens
gactgctccccagccctggctctg

SEQ ID NO: 169574 - DNA, 14 bp, Homo sapiens
gactggcacagttt

SEQ ID NO: 169575 - DNA, 18 bp, Homo sapiens
gactggcacagttttctg

SEQ ID NO: 169576 - DNA, 21 bp, Homo sapiens
gactgtctcaagagggcactg

SEQ ID NO: 169577 - DNA, 16 bp, Homo sapiens
gactgttttctcttga

SEQ ID NO: 169578 - DNA, 18 bp, Homo sapiens
gactgttttctcttgaga

SEQ ID NO: 169579 - DNA, 14 bp, Homo sapiens
gacttagaaagcag

SEQ ID NO: 169580 - DNA, 18 bp, Homo sapiens
gacttagaaagcaggggc

SEQ ID NO: 169581 - DNA, 20 bp, Homo sapiens
gacttcagtatgttgtcaaa

SEQ ID NO: 169582 - DNA, 21 bp, Homo sapiens
gacttcagtatgttgtcaaag

SEQ ID NO: 169583 - DNA, 21 bp, Homo sapiens
gacttcatagatttccttccc

SEQ ID NO: 169584 - DNA, 19 bp, Homo sapiens
gacttctaagtaaaaccac

SEQ ID NO: 169585 - DNA, 14 bp, Homo sapiens
gacttctccaggtc

SEQ ID NO: 169586 - DNA, 22 bp, Homo sapiens
gacttctccaggtctcacgggc

SEQ ID NO: 169587 - DNA, 17 bp, Homo sapiens
gacttctgctttccaca

SEQ ID NO: 169588 - DNA, 23 bp, Homo sapiens
gacttctgtcttcacaacagatt

SEQ ID NO: 169589 - DNA, 18 bp, Homo sapiens
gacttgttttatgctcag

SEQ ID NO: 169590 - DNA, 17 bp, Homo sapiens
gactttagtctgcaaaa

SEQ ID NO: 169591 - DNA, 12 bp, Homo sapiens
gactttcctgca

SEQ ID NO: 169592 - DNA, 19 bp, Homo sapiens
gacttttcgaccaattcaa

SEQ ID NO: 169593 - DNA, 22 bp, Homo sapiens
gacttttcgaccaattcaaccc

SEQ ID NO: 169594 - DNA, 12 bp, Homo sapiens
gagaaaccctgt

SEQ ID NO: 169595 - DNA, 21 bp, Homo sapiens
gagaaaccttattgtacctct

SEQ ID NO: 169596 - DNA, 17 bp, Homo sapiens
gagaaagactattcaaa

SEQ ID NO: 169597 - DNA, 18 bp, Homo sapiens
gagaaagagcacttaaga

SEQ ID NO: 169598 - DNA, 22 bp, Homo sapiens
gagaacctcacgcacctcccat

SEQ ID NO: 169599 - DNA, 15 bp, Homo sapiens
gagaactcctagggt

SEQ ID NO: 169600 - DNA, 19 bp, Homo sapiens
gagaagagagaaatagcct

SEQ ID NO: 169601 - DNA, 14 bp, Homo sapiens
gagaagcagtgagc

SEQ ID NO: 169602 - DNA, 15 bp, Homo sapiens
gagaagcggctggca

SEQ ID NO: 169603 - DNA, 17 bp, Homo sapiens
gagaagcggctggcagc

SEQ ID NO: 169604 - DNA, 12 bp, Homo sapiens
gagaaggaagcc

SEQ ID NO: 169605 - DNA, 21 bp, Homo sapiens
gagaaggaaggagactcacct

SEQ ID NO: 169606 - DNA, 12 bp, Homo sapiens
gagaaggcagga

SEQ ID NO: 169607 - DNA, 18 bp, Homo sapiens
gagaataggcagccccca

SEQ ID NO: 169608 - DNA, 19 bp, Homo sapiens
gagaatattttaagtattg

SEQ ID NO: 169609 - DNA, 20 bp, Homo sapiens
gagaatcccactttctatag

SEQ ID NO: 169610 - DNA, 13 bp, Homo sapiens
gagaatctttatt

SEQ ID NO: 169611 - DNA, 15 bp, Homo sapiens
gagaattttaaatta

SEQ ID NO: 169612 - DNA, 16 bp, Homo sapiens
gagaattttaaattat

SEQ ID NO: 169613 - DNA, 18 bp, Homo sapiens
gagacaaatctatgccac

SEQ ID NO: 169614 - DNA, 19 bp, Homo sapiens
gagacacctgcacctcccc

SEQ ID NO: 169615 - DNA, 22 bp, Homo sapiens
gagacagagaggacgtgggcgg

SEQ ID NO: 169616 - DNA, 14 bp, Homo sapiens
gagacagagctggt

SEQ ID NO: 169617 - DNA, 14 bp, Homo sapiens
gagacagccccaga

SEQ ID NO: 169618 - DNA, 15 bp, Homo sapiens
gagacagccccagag

SEQ ID NO: 169619 - DNA, 19 bp, Homo sapiens
gagacagccccagagcagg

SEQ ID NO: 169620 - DNA, 13 bp, Homo sapiens
gagacagctctgc

SEQ ID NO: 169621 - DNA, 15 bp, Homo sapiens
gagacagctctgcat

SEQ ID NO: 169622 - DNA, 16 bp, Homo sapiens
gagacaggacctgact

SEQ ID NO: 169623 - DNA, 14 bp, Homo sapiens
gagaccaacctgac

SEQ ID NO: 169624 - DNA, 15 bp, Homo sapiens
gagaccaacctgacc

SEQ ID NO: 169625 - DNA, 21 bp, Homo sapiens
gagaccctgtctcaaaaaaag

SEQ ID NO: 169626 - DNA, 22 bp, Homo sapiens
gagaccgtcctcacccctgtcc

SEQ ID NO: 169627 - DNA, 21 bp, Homo sapiens
gagactagatttatgaataca

SEQ ID NO: 169628 - DNA, 16 bp, Homo sapiens
gagactcacctctgcc

SEQ ID NO: 169629 - DNA, 17 bp, Homo sapiens
gagactcacctctgcct

SEQ ID NO: 169630 - DNA, 23 bp, Homo sapiens
gagactcacctctgcctcaatgt

SEQ ID NO: 169631 - DNA, 13 bp, Homo sapiens
gagactcagacag

SEQ ID NO: 169632 - DNA, 21 bp, Homo sapiens
gagactcagggccccagcact

SEQ ID NO: 169633 - DNA, 16 bp, Homo sapiens
gagactccatgagaag

SEQ ID NO: 169634 - DNA, 15 bp, Homo sapiens
gagactgcccagcta

SEQ ID NO: 169635 - DNA, 17 bp, Homo sapiens
gagactgttttgaattt

SEQ ID NO: 169636 - DNA, 18 bp, Homo sapiens
gagagaaagccaggcagg

SEQ ID NO: 169637 - DNA, 18 bp, Homo sapiens
gagagaaagtgggtgaga

SEQ ID NO: 169638 - DNA, 20 bp, Homo sapiens
gagagaaagtgggtgagatg

SEQ ID NO: 169639 - DNA, 22 bp, Homo sapiens
gagagaaagtgggtgagatgct

SEQ ID NO: 169640 - DNA, 19 bp, Homo sapiens
gagagacccaaggaggaaa

SEQ ID NO: 169641 - DNA, 16 bp, Homo sapiens
gagagaggcagagagc

SEQ ID NO: 169642 - DNA, 13 bp, Homo sapiens
gagagcaactctg

SEQ ID NO: 169643 - DNA, 21 bp, Homo sapiens
gacactcccttgggctccctg

SEQ ID NO: 169644 - DNA, 21 bp, Homo sapiens
gacagaaagcagaacagtgat

SEQ ID NO: 169645 - DNA, 23 bp, Homo sapiens
gacagacacttctaaatgaagtg

SEQ ID NO: 169646 - DNA, 21 bp, Homo sapiens
gacagacaggctcttagcagc

SEQ ID NO: 169647 - DNA, 16 bp, Homo sapiens
gacagagacacctgca

SEQ ID NO: 169648 - DNA, 21 bp, Homo sapiens
gacagagcaagtgagaccctg

SEQ ID NO: 169649 - DNA, 19 bp, Homo sapiens
gacagagccatgctgggaa

SEQ ID NO: 169650 - DNA, 19 bp, Homo sapiens
gacagagggaagaaaagag

SEQ ID NO: 169651 - DNA, 13 bp, Homo sapiens
gacagataactct

SEQ ID NO: 169652 - DNA, 21 bp, Homo sapiens
gacagatctctgctttggaaa

SEQ ID NO: 169653 - DNA, 15 bp, Homo sapiens
gacagcagctcaggc

SEQ ID NO: 169654 - DNA, 18 bp, Homo sapiens
gacagcagctcaggcaca

SEQ ID NO: 169655 - DNA, 19 bp, Homo sapiens
gacagccccagagcagggt

SEQ ID NO: 169656 - DNA, 20 bp, Homo sapiens
gacagcctgtggcggtgcct

SEQ ID NO: 169657 - DNA, 23 bp, Homo sapiens
gacagcctgtggcggtgcctggg

SEQ ID NO: 169658 - DNA, 24 bp, Homo sapiens
gacaggagaaatgcatccattcct

SEQ ID NO: 169659 - DNA, 13 bp, Homo sapiens
gacaggctcttag

SEQ ID NO: 169660 - DNA, 15 bp, Homo sapiens
gacagggaagagcag

SEQ ID NO: 169661 - DNA, 16 bp, Homo sapiens
gacagggaagagcaga

SEQ ID NO: 169662 - DNA, 14 bp, Homo sapiens
gacagggcatggcc

SEQ ID NO: 169663 - DNA, 20 bp, Homo sapiens
gacagtatggcagctttcct

SEQ ID NO: 169664 - DNA, 17 bp, Homo sapiens
gacagtcaaggagtggc

SEQ ID NO: 169665 - DNA, 18 bp, Homo sapiens
gacatagcccatccctgc

SEQ ID NO: 169666 - DNA, 22 bp, Homo sapiens
gacatagcccatccctgcctgg

SEQ ID NO: 169667 - DNA, 20 bp, Homo sapiens
gacatattcatttggaaata

SEQ ID NO: 169668 - DNA, 17 bp, Homo sapiens
gacatccaagcttcctt

SEQ ID NO: 169669 - DNA, 16 bp, Homo sapiens
gacatctcaggggcca

SEQ ID NO: 169670 - DNA, 16 bp, Homo sapiens
gacatcttagtatttg

SEQ ID NO: 169671 - DNA, 12 bp, Homo sapiens
gacatgaatatg

SEQ ID NO: 169672 - DNA, 18 bp, Homo sapiens
gacatgcgggctgggcag

SEQ ID NO: 169673 - DNA, 20 bp, Homo sapiens
gacatgcgggctgggcagct

SEQ ID NO: 169674 - DNA, 22 bp, Homo sapiens
gacatgcgggctgggcagctgt

SEQ ID NO: 169675 - DNA, 15 bp, Homo sapiens
gacatggggaggaag

SEQ ID NO: 169676 - DNA, 16 bp, Homo sapiens
gacatgtggtgggaca

SEQ ID NO: 169677 - DNA, 14 bp, Homo sapiens
gacattctgccagg

SEQ ID NO: 169678 - DNA, 19 bp, Homo sapiens
gacattgtagagcttctgg

SEQ ID NO: 169679 - DNA, 13 bp, Homo sapiens
gacatttctctaa

SEQ ID NO: 169680 - DNA, 21 bp, Homo sapiens
gacatttctcttactgcaaat

SEQ ID NO: 169681 - DNA, 17 bp, Homo sapiens
gaccaacatggagaaac

SEQ ID NO: 169682 - DNA, 14 bp, Homo sapiens
gaccaacctgacca

SEQ ID NO: 169683 - DNA, 14 bp, Homo sapiens
gaccaagcaggaag

SEQ ID NO: 169684 - DNA, 15 bp, Homo sapiens
gaccaagcaggaagc

SEQ ID NO: 169685 - DNA, 16 bp, Homo sapiens
gaccaagcaggaagct

SEQ ID NO: 169686 - DNA, 19 bp, Homo sapiens
gaccaagcaggaagctcag

SEQ ID NO: 169687 - DNA, 13 bp, Homo sapiens
gaccacctgccca

SEQ ID NO: 169688 - DNA, 21 bp, Homo sapiens
gaccacggacgtttccatcag

SEQ ID NO: 169689 - DNA, 14 bp, Homo sapiens
gaccactgttatca

SEQ ID NO: 169690 - DNA, 21 bp, Homo sapiens
gaccagcctccatgctgcctc

SEQ ID NO: 169691 - DNA, 14 bp, Homo sapiens
gaccagtggtctca

SEQ ID NO: 169692 - DNA, 15 bp, Homo sapiens
gaccagttgcacttg

SEQ ID NO: 169693 - DNA, 18 bp, Homo sapiens
gacccaaaaggcagaagc

SEQ ID NO: 169694 - DNA, 13 bp, Homo sapiens
gacccaaggagga

SEQ ID NO: 169695 - DNA, 22 bp, Homo sapiens
gacccacctggtggcctctgcc

SEQ ID NO: 169696 - DNA, 22 bp, Homo sapiens
gacccagtgagattacagagga

SEQ ID NO: 169697 - DNA, 18 bp, Homo sapiens
gaccccagcggctgagtc

SEQ ID NO: 169698 - DNA, 19 bp, Homo sapiens
gaccccagcggctgagtca

SEQ ID NO: 169699 - DNA, 21 bp, Homo sapiens
gaccccagctgtgagccttgg

SEQ ID NO: 169700 - DNA, 12 bp, Homo sapiens
gacccctcctca

SEQ ID NO: 169701 - DNA, 15 bp, Homo sapiens
gacccctcctcactg

SEQ ID NO: 169702 - DNA, 13 bp, Homo sapiens
gacccctggcttt

SEQ ID NO: 169703 - DNA, 21 bp, Homo sapiens
gacccctggcttttcactgct

SEQ ID NO: 169704 - DNA, 17 bp, Homo sapiens
gacccggaggggcctgg

SEQ ID NO: 169705 - DNA, 19 bp, Homo sapiens
gacccggaggggcctggca

SEQ ID NO: 169706 - DNA, 11 bp, Homo sapiens
gaccctacccc

SEQ ID NO: 169707 - DNA, 15 bp, Homo sapiens
gaccctcgtggcctt

SEQ ID NO: 169708 - DNA, 15 bp, Homo sapiens
gaccctctccacccc

SEQ ID NO: 169709 - DNA, 20 bp, Homo sapiens
gacccttacagcctctgact

SEQ ID NO: 169710 - DNA, 20 bp, Homo sapiens
gaccctttccttccttccct

SEQ ID NO: 169711 - DNA, 21 bp, Homo sapiens
gaccctttccttccttccctg

SEQ ID NO: 169712 - DNA, 22 bp, Homo sapiens
gaccctttccttccttccctgg

SEQ ID NO: 169713 - DNA, 13 bp, Homo sapiens
gaccgtcctcacc

SEQ ID NO: 169714 - DNA, 23 bp, Homo sapiens
gacctagggatgttctggccctc

SEQ ID NO: 169715 - DNA, 13 bp, Homo sapiens
gacctcagcctgt

SEQ ID NO: 169716 - DNA, 16 bp, Homo sapiens
gacctcagcctgtgct

SEQ ID NO: 169717 - DNA, 19 bp, Homo sapiens
gacctcagcctgtgctgcc

SEQ ID NO: 169718 - DNA, 20 bp, Homo sapiens
gacctcagccttccccttgc

SEQ ID NO: 169719 - DNA, 18 bp, Homo sapiens
gacctcaggtgagaagca

SEQ ID NO: 169720 - DNA, 19 bp, Homo sapiens
gacctcaggtgagaagcag

SEQ ID NO: 169721 - DNA, 21 bp, Homo sapiens
gacctcaggtgagaagcagag

SEQ ID NO: 169722 - DNA, 20 bp, Homo sapiens
gacctcagttttatcatttt

SEQ ID NO: 169723 - DNA, 18 bp, Homo sapiens
gacctcgtcctccccctg

SEQ ID NO: 169724 - DNA, 21 bp, Homo sapiens
gacctcgtcctccccctgcca

SEQ ID NO: 169725 - DNA, 16 bp, Homo sapiens
gacctgagctccccac

SEQ ID NO: 169726 - DNA, 17 bp, Homo sapiens
gacctggataacttagg

SEQ ID NO: 169727 - DNA, 14 bp, Homo sapiens
gaccttgttgcatg

SEQ ID NO: 169728 - DNA, 17 bp, Homo sapiens
gacgcctgagctcactc

SEQ ID NO: 169729 - DNA, 19 bp, Homo sapiens
gacgcctgggggtgccagg

SEQ ID NO: 169730 - DNA, 15 bp, Homo sapiens
gacgcgtctcctgtt

SEQ ID NO: 169731 - DNA, 20 bp, Homo sapiens
gacgctggtagagatggagg

SEQ ID NO: 169732 - DNA, 17 bp, Homo sapiens
gacggttcaccagcctc

SEQ ID NO: 169733 - DNA, 22 bp, Homo sapiens
gacgtccctccacgttcacccc

SEQ ID NO: 169734 - DNA, 13 bp, Homo sapiens
gacgtcctgccac

SEQ ID NO: 169735 - DNA, 14 bp, Homo sapiens
gacgtcctgccacc

SEQ ID NO: 169736 - DNA, 13 bp, Homo sapiens
gacgtttccatca

SEQ ID NO: 169737 - DNA, 18 bp, Homo sapiens
gactaatttaaaaaataa

SEQ ID NO: 169738 - DNA, 18 bp, Homo sapiens
gactacagtcaggaaagg

SEQ ID NO: 169739 - DNA, 23 bp, Homo sapiens
gactagcccctgtggagactggg

SEQ ID NO: 169740 - DNA, 22 bp, Homo sapiens
gactatcaaactgaagccagaa

SEQ ID NO: 169741 - DNA, 16 bp, Homo sapiens
gactcagaagcctctg

SEQ ID NO: 169742 - DNA, 17 bp, Homo sapiens
gactcagacaggaaagg

SEQ ID NO: 169743 - DNA, 15 bp, Homo sapiens
gactcaggatgccca

SEQ ID NO: 169744 - DNA, 14 bp, Homo sapiens
gactcagggctcct

SEQ ID NO: 169745 - DNA, 16 bp, Homo sapiens
gactcagggctcctgg

SEQ ID NO: 169746 - DNA, 19 bp, Homo sapiens
gactcagggctcctgggtt

SEQ ID NO: 169747 - DNA, 12 bp, Homo sapiens
gactcagtgttc

SEQ ID NO: 169748 - DNA, 16 bp, Homo sapiens
gactcattctgaagga

SEQ ID NO: 169749 - DNA, 12 bp, Homo sapiens
gactccaaagaa

SEQ ID NO: 169750 - DNA, 15 bp, Homo sapiens
gactccaaagaaatg

SEQ ID NO: 169751 - DNA, 16 bp, Homo sapiens
gactccaaagaaatgt

SEQ ID NO: 169752 - DNA, 23 bp, Homo sapiens
gactccatgagaagccgtgggtg

SEQ ID NO: 169753 - DNA, 16 bp, Homo sapiens
gactcctgtgcaactt

SEQ ID NO: 169754 - DNA, 14 bp, Homo sapiens
gactctaccagact

SEQ ID NO: 169755 - DNA, 19 bp, Homo sapiens
gactgagcagactggtgag

SEQ ID NO: 169756 - DNA, 13 bp, Homo sapiens
gactgagctcaag

SEQ ID NO: 169757 - DNA, 20 bp, Homo sapiens
gactgccagtccccctgccc

SEQ ID NO: 169758 - DNA, 19 bp, Homo sapiens
gactgccccgtgcagactg

SEQ ID NO: 169759 - DNA, 21 bp, Homo sapiens
gactgccccgtgcagactgga

SEQ ID NO: 169760 - DNA, 20 bp, Homo sapiens
gagagcaactctgagatcta

SEQ ID NO: 169761 - DNA, 13 bp, Homo sapiens
gagagccagccct

SEQ ID NO: 169762 - DNA, 17 bp, Homo sapiens
gagagcctgctccccca

SEQ ID NO: 169763 - DNA, 16 bp, Homo sapiens
gagagcgcctgcccct

SEQ ID NO: 169764 - DNA, 22 bp, Homo sapiens
gagagcgcctgcccctcccaga

SEQ ID NO: 169765 - DNA, 14 bp, Homo sapiens
gagagctggggaag

SEQ ID NO: 169766 - DNA, 23 bp, Homo sapiens
gagagctggggaagcttcttaaa

SEQ ID NO: 169767 - DNA, 17 bp, Homo sapiens
gagaggacgtgggcggc

SEQ ID NO: 169768 - DNA, 12 bp, Homo sapiens
gagaggagagag

SEQ ID NO: 169769 - DNA, 18 bp, Homo sapiens
gagaggagagaggcagag

SEQ ID NO: 169770 - DNA, 15 bp, Homo sapiens
gagaggcaatggcca

SEQ ID NO: 169771 - DNA, 22 bp, Homo sapiens
gagaggcagacttccctgaatg

SEQ ID NO: 169772 - DNA, 13 bp, Homo sapiens
gagaggcagagag

SEQ ID NO: 169773 - DNA, 14 bp, Homo sapiens
gagaggcagagagc

SEQ ID NO: 169774 - DNA, 13 bp, Homo sapiens
gagagggtctgga

SEQ ID NO: 169775 - DNA, 15 bp, Homo sapiens
gagagtagaacagat

SEQ ID NO: 169776 - DNA, 20 bp, Homo sapiens
gagagtagccgagagcctgc

SEQ ID NO: 169777 - DNA, 16 bp, Homo sapiens
gagatatggcagcgaa

SEQ ID NO: 169778 - DNA, 11 bp, Homo sapiens
gagatatttac

SEQ ID NO: 169779 - DNA, 17 bp, Homo sapiens
gagatcaaatggaaagg

SEQ ID NO: 169780 - DNA, 20 bp, Homo sapiens
gagatcatcctttccagcat

SEQ ID NO: 169781 - DNA, 21 bp, Homo sapiens
gagatcgtgccgttactctcc

SEQ ID NO: 169782 - DNA, 14 bp, Homo sapiens
gagatgcctccacc

SEQ ID NO: 169783 - DNA, 16 bp, Homo sapiens
gagatgctggagaaga

SEQ ID NO: 169784 - DNA, 20 bp, Homo sapiens
gagatgctggagaagagagg

SEQ ID NO: 169785 - DNA, 13 bp, Homo sapiens
gagatggaggagg

SEQ ID NO: 169786 - DNA, 15 bp, Homo sapiens
gagatggaggaggag

SEQ ID NO: 169787 - DNA, 15 bp, Homo sapiens
gagattacctcctga

SEQ ID NO: 169788 - DNA, 18 bp, Homo sapiens
gagattgagaaggagaga

SEQ ID NO: 169789 - DNA, 18 bp, Homo sapiens
gagattgcaccactgcac

SEQ ID NO: 169790 - DNA, 14 bp, Homo sapiens
gagcaagactctgt

SEQ ID NO: 169791 - DNA, 20 bp, Homo sapiens
gagcaagcatttatgtttat

SEQ ID NO: 169792 - DNA, 23 bp, Homo sapiens
gagcaccaggcacgaacccacct

SEQ ID NO: 169793 - DNA, 15 bp, Homo sapiens
gagcacttaagagaa

SEQ ID NO: 169794 - DNA, 15 bp, Homo sapiens
gagcagacaggagga

SEQ ID NO: 169795 - DNA, 23 bp, Homo sapiens
gagcagactggtgagcagactgg

SEQ ID NO: 169796 - DNA, 15 bp, Homo sapiens
gagcagaggggctga

SEQ ID NO: 169797 - DNA, 16 bp, Homo sapiens
gagcagaggggctgaa

SEQ ID NO: 169798 - DNA, 21 bp, Homo sapiens
gagcagctttaaactcaggga

SEQ ID NO: 169799 - DNA, 23 bp, Homo sapiens
gagcagctttaaactcagggaca

SEQ ID NO: 169800 - DNA, 21 bp, Homo sapiens
gagcagggattaacctctgca

SEQ ID NO: 169801 - DNA, 21 bp, Homo sapiens
gagcagtgaatgattcagtgt

SEQ ID NO: 169802 - DNA, 22 bp, Homo sapiens
gagcatgtactgagccttgtaa

SEQ ID NO: 169803 - DNA, 19 bp, Homo sapiens
gagccaccatgcccagctc

SEQ ID NO: 169804 - DNA, 16 bp, Homo sapiens
gagccagccctccctg

SEQ ID NO: 169805 - DNA, 21 bp, Homo sapiens
gagcccagctctgaaaccagt

SEQ ID NO: 169806 - DNA, 13 bp, Homo sapiens
gagccccgcagac

SEQ ID NO: 169807 - DNA, 20 bp, Homo sapiens
gagcccctggtcctgagggt

SEQ ID NO: 169808 - DNA, 13 bp, Homo sapiens
gagccctcagaac

SEQ ID NO: 169809 - DNA, 19 bp, Homo sapiens
gagcccttatctgtgctca

SEQ ID NO: 169810 - DNA, 19 bp, Homo sapiens
gagccgctgtgagcccctg

SEQ ID NO: 169811 - DNA, 13 bp, Homo sapiens
gagccgtggtcct

SEQ ID NO: 169812 - DNA, 17 bp, Homo sapiens
gagcctcatccgaggca

SEQ ID NO: 169813 - DNA, 12 bp, Homo sapiens
gagcctgaggga

SEQ ID NO: 169814 - DNA, 13 bp, Homo sapiens
gagcctgggaggt

SEQ ID NO: 169815 - DNA, 21 bp, Homo sapiens
gagcctgggaggtcaaggctg

SEQ ID NO: 169816 - DNA, 20 bp, Homo sapiens
gagccttggtgtccacctgg

SEQ ID NO: 169817 - DNA, 13 bp, Homo sapiens
gagcgcctgcccc

SEQ ID NO: 169818 - DNA, 13 bp, Homo sapiens
gagcggaaagcag

SEQ ID NO: 169819 - DNA, 14 bp, Homo sapiens
gagcggaaagcagc

SEQ ID NO: 169820 - DNA, 17 bp, Homo sapiens
gagcggtctcaggctgg

SEQ ID NO: 169821 - DNA, 15 bp, Homo sapiens
gagctagcagcaggg

SEQ ID NO: 169822 - DNA, 18 bp, Homo sapiens
gagctagcgctgccgcac

SEQ ID NO: 169823 - DNA, 19 bp, Homo sapiens
gagctagcgctgccgcacc

SEQ ID NO: 169824 - DNA, 23 bp, Homo sapiens
gagctagcgctgccgcaccccag

SEQ ID NO: 169825 - DNA, 18 bp, Homo sapiens
gagctatttccattccag

SEQ ID NO: 169826 - DNA, 20 bp, Homo sapiens
gagctatttccattccagaa

SEQ ID NO: 169827 - DNA, 18 bp, Homo sapiens
gagctcagacccccactc

SEQ ID NO: 169828 - DNA, 21 bp, Homo sapiens
gagctcagacccccactctca

SEQ ID NO: 169829 - DNA, 22 bp, Homo sapiens
gagctccccaccaccccagctg

SEQ ID NO: 169830 - DNA, 15 bp, Homo sapiens
gagctcggtggaccc

SEQ ID NO: 169831 - DNA, 14 bp, Homo sapiens
gagctctacccagg

SEQ ID NO: 169832 - DNA, 16 bp, Homo sapiens
gagctctgcagagcag

SEQ ID NO: 169833 - DNA, 13 bp, Homo sapiens
gagctgagatcgt

SEQ ID NO: 169834 - DNA, 13 bp, Homo sapiens
gagctgagcaggg

SEQ ID NO: 169835 - DNA, 17 bp, Homo sapiens
gagctgggaggcatggc

SEQ ID NO: 169836 - DNA, 18 bp, Homo sapiens
gagctgggaggcatggcc

SEQ ID NO: 169837 - DNA, 16 bp, Homo sapiens
gagctgggatcctaag

SEQ ID NO: 169838 - DNA, 18 bp, Homo sapiens
cttactacatgtgggagc

SEQ ID NO: 169839 - DNA, 19 bp, Homo sapiens
cttactagtttcccttgca

SEQ ID NO: 169840 - DNA, 21 bp, Homo sapiens
cttactgatttttaagttatt

SEQ ID NO: 169841 - DNA, 12 bp, Homo sapiens
cttactgcaaat

SEQ ID NO: 169842 - DNA, 23 bp, Homo sapiens
cttactttcctttccccagccca

SEQ ID NO: 169843 - DNA, 14 bp, Homo sapiens
cttagaaagcaggg

SEQ ID NO: 169844 - DNA, 16 bp, Homo sapiens
cttagaaattgcattt

SEQ ID NO: 169845 - DNA, 15 bp, Homo sapiens
cttagaacctttctt

SEQ ID NO: 169846 - DNA, 18 bp, Homo sapiens
cttagaagtggaccagga

SEQ ID NO: 169847 - DNA, 22 bp, Homo sapiens
cttagaagtggaccaggacagg

SEQ ID NO: 169848 - DNA, 12 bp, Homo sapiens
cttagacctcag

SEQ ID NO: 169849 - DNA, 15 bp, Homo sapiens
cttagacctcagcct

SEQ ID NO: 169850 - DNA, 17 bp, Homo sapiens
cttagacctcagcctgt

SEQ ID NO: 169851 - DNA, 18 bp, Homo sapiens
cttagacctcagcctgtg

SEQ ID NO: 169852 - DNA, 20 bp, Homo sapiens
cttagacctcagcctgtgct

SEQ ID NO: 169853 - DNA, 18 bp, Homo sapiens
cttagatgttctaagtct

SEQ ID NO: 169854 - DNA, 18 bp, Homo sapiens
cttagcagcttccagatt

SEQ ID NO: 169855 - DNA, 16 bp, Homo sapiens
cttagcttagacctca

SEQ ID NO: 169856 - DNA, 21 bp, Homo sapiens
cttagcttagacctcagcctg

SEQ ID NO: 169857 - DNA, 17 bp, Homo sapiens
cttaggaagagaaacca

SEQ ID NO: 169858 - DNA, 15 bp, Homo sapiens
cttaggcagggaagt

SEQ ID NO: 169859 - DNA, 18 bp, Homo sapiens
cttaggtacttattccag

SEQ ID NO: 169860 - DNA, 21 bp, Homo sapiens
cttatatcatcagcatacctt

SEQ ID NO: 169861 - DNA, 14 bp, Homo sapiens
cttattgtacctct

SEQ ID NO: 169862 - DNA, 13 bp, Homo sapiens
cttatttattatt

SEQ ID NO: 169863 - DNA, 14 bp, Homo sapiens
cttatttcatttct

SEQ ID NO: 169864 - DNA, 15 bp, Homo sapiens
cttatttcatttctt

SEQ ID NO: 169865 - DNA, 22 bp, Homo sapiens
cttcaagtgcatgctctctgca

SEQ ID NO: 169866 - DNA, 14 bp, Homo sapiens
cttcacaacagatt

SEQ ID NO: 169867 - DNA, 12 bp, Homo sapiens
cttcacactgca

SEQ ID NO: 169868 - DNA, 15 bp, Homo sapiens
cttcacactgcaaga

SEQ ID NO: 169869 - DNA, 20 bp, Homo sapiens
cttcacactgcaagagcctt

SEQ ID NO: 169870 - DNA, 21 bp, Homo sapiens
cttcacactgcaagagccttg

SEQ ID NO: 169871 - DNA, 13 bp, Homo sapiens
cttcacagtgttt

SEQ ID NO: 169872 - DNA, 14 bp, Homo sapiens
cttcacagtgtttc

SEQ ID NO: 169873 - DNA, 17 bp, Homo sapiens
cttcacggcaggacaac

SEQ ID NO: 169874 - DNA, 15 bp, Homo sapiens
cttcactctctgaag

SEQ ID NO: 169875 - DNA, 15 bp, Homo sapiens
cttcactttaattct

SEQ ID NO: 169876 - DNA, 16 bp, Homo sapiens
cttcactttaattctc

SEQ ID NO: 169877 - DNA, 15 bp, Homo sapiens
cttcagatcagtgct

SEQ ID NO: 169878 - DNA, 17 bp, Homo sapiens
cttcagatcagtgcttg

SEQ ID NO: 169879 - DNA, 20 bp, Homo sapiens
cttcagatcagtgcttgagt

SEQ ID NO: 169880 - DNA, 17 bp, Homo sapiens
cttcaggctcttctcct

SEQ ID NO: 169881 - DNA, 18 bp, Homo sapiens
cttcaggctcttctcctt

SEQ ID NO: 169882 - DNA, 19 bp, Homo sapiens
cttcaggctcttctccttt

SEQ ID NO: 169883 - DNA, 22 bp, Homo sapiens
cttcaggctcttctcctttcac

SEQ ID NO: 169884 - DNA, 14 bp, Homo sapiens
cttcagggggccag

SEQ ID NO: 169885 - DNA, 20 bp, Homo sapiens
gagctgttcacagccagact

SEQ ID NO: 169886 - DNA, 16 bp, Homo sapiens
gagcttcatggcagaa

SEQ ID NO: 169887 - DNA, 17 bp, Homo sapiens
gagcttccctgactcat

SEQ ID NO: 169888 - DNA, 10 bp, Homo sapiens
gagcttctct

SEQ ID NO: 169889 - DNA, 22 bp, Homo sapiens
gagctttctgctatcaaagagg

SEQ ID NO: 169890 - DNA, 14 bp, Homo sapiens
gaggaaactcagag

SEQ ID NO: 169891 - DNA, 20 bp, Homo sapiens
gaggaactagccaccaactc

SEQ ID NO: 169892 - DNA, 17 bp, Homo sapiens
gaggaactgtccagaga

SEQ ID NO: 169893 - DNA, 21 bp, Homo sapiens
gaggaactgtccagagagcaa

SEQ ID NO: 169894 - DNA, 20 bp, Homo sapiens
gaggaagcgtgaaggccgag

SEQ ID NO: 169895 - DNA, 21 bp, Homo sapiens
gaggaatcatgtcaggcctgt

SEQ ID NO: 169896 - DNA, 18 bp, Homo sapiens
gaggacgtgggcggcaga

SEQ ID NO: 169897 - DNA, 20 bp, Homo sapiens
gaggacgtgggcggcagaga

SEQ ID NO: 169898 - DNA, 12 bp, Homo sapiens
gaggagaaactg

SEQ ID NO: 169899 - DNA, 13 bp, Homo sapiens
gaggagagaggca

SEQ ID NO: 169900 - DNA, 16 bp, Homo sapiens
gaggagagaggcagag

SEQ ID NO: 169901 - DNA, 17 bp, Homo sapiens
gaggagatgctccttgg

SEQ ID NO: 169902 - DNA, 14 bp, Homo sapiens
gaggaggaggaggt

SEQ ID NO: 169903 - DNA, 18 bp, Homo sapiens
gaggaggctccagagggc

SEQ ID NO: 169904 - DNA, 20 bp, Homo sapiens
gaggagggcgtgactcaccc

SEQ ID NO: 169905 - DNA, 16 bp, Homo sapiens
gaggatctcttgagcc

SEQ ID NO: 169906 - DNA, 16 bp, Homo sapiens
gaggattctatgaggc

SEQ ID NO: 169907 - DNA, 16 bp, Homo sapiens
gaggattgcttgagct

SEQ ID NO: 169908 - DNA, 20 bp, Homo sapiens
gaggcacacagctgcagaga

SEQ ID NO: 169909 - DNA, 24 bp, Homo sapiens
gaggcacacagctgcagagacaga

SEQ ID NO: 169910 - DNA, 15 bp, Homo sapiens
gaggcagacagcagc

SEQ ID NO: 169911 - DNA, 20 bp, Homo sapiens
gaggcagacagcagctcagg

SEQ ID NO: 169912 - DNA, 22 bp, Homo sapiens
gaggcagacttccctgaatgta

SEQ ID NO: 169913 - DNA, 15 bp, Homo sapiens
gaggcagagagcggt

SEQ ID NO: 169914 - DNA, 13 bp, Homo sapiens
gaggcagcagtgt

SEQ ID NO: 169915 - DNA, 14 bp, Homo sapiens
gaggcaggggcgga

SEQ ID NO: 169916 - DNA, 13 bp, Homo sapiens
gaggcagggtcag

SEQ ID NO: 169917 - DNA, 14 bp, Homo sapiens
gaggcatggccctg

SEQ ID NO: 169918 - DNA, 18 bp, Homo sapiens
gaggcatggccctggggt

SEQ ID NO: 169919 - DNA, 13 bp, Homo sapiens
gaggccagcctgg

SEQ ID NO: 169920 - DNA, 19 bp, Homo sapiens
gaggccagggcagagtgag

SEQ ID NO: 169921 - DNA, 18 bp, Homo sapiens
gaggcctggactttcctg

SEQ ID NO: 169922 - DNA, 19 bp, Homo sapiens
gaggcctggactttcctgc

SEQ ID NO: 169923 - DNA, 14 bp, Homo sapiens
gaggctccagaggg

SEQ ID NO: 169924 - DNA, 17 bp, Homo sapiens
gaggctccagagggcac

SEQ ID NO: 169925 - DNA, 18 bp, Homo sapiens
gatggttcccctgttcac

SEQ ID NO: 169926 - DNA, 21 bp, Homo sapiens
gatggttcccctgttcactct

SEQ ID NO: 169927 - DNA, 18 bp, Homo sapiens
gatgtagaggagaaactg

SEQ ID NO: 169928 - DNA, 20 bp, Homo sapiens
gatgtagggtaaggtgcctt

SEQ ID NO: 169929 - DNA, 13 bp, Homo sapiens
gatgtcacagggc

SEQ ID NO: 169930 - DNA, 17 bp, Homo sapiens
gatgtccacagatgcct

SEQ ID NO: 169931 - DNA, 20 bp, Homo sapiens
gatgtccacagatgcctcca

SEQ ID NO: 169932 - DNA, 17 bp, Homo sapiens
gatgtcccaacttgtaa

SEQ ID NO: 169933 - DNA, 18 bp, Homo sapiens
gatgtcccaacttgtaaa

SEQ ID NO: 169934 - DNA, 18 bp, Homo sapiens
gatgtgatatataagtgt

SEQ ID NO: 169935 - DNA, 20 bp, Homo sapiens
gatgtggccctggcctgctg

SEQ ID NO: 169936 - DNA, 23 bp, Homo sapiens
gatgtgggagggagcagacagga

SEQ ID NO: 169937 - DNA, 17 bp, Homo sapiens
gatgttcagcactgtcc

SEQ ID NO: 169938 - DNA, 19 bp, Homo sapiens
gatgtttcttttgtatgta

SEQ ID NO: 169939 - DNA, 20 bp, Homo sapiens
gatgtttcttttgtatgtaa

SEQ ID NO: 169940 - DNA, 13 bp, Homo sapiens
gattacagaggaa

SEQ ID NO: 169941 - DNA, 14 bp, Homo sapiens
gattattcagtgtc

SEQ ID NO: 169942 - DNA, 15 bp, Homo sapiens
gattattcatttaaa

SEQ ID NO: 169943 - DNA, 20 bp, Homo sapiens
gattattcatttaaaatgat

SEQ ID NO: 169944 - DNA, 21 bp, Homo sapiens
gattattcatttaaaatgatt

SEQ ID NO: 169945 - DNA, 17 bp, Homo sapiens
gattattctgattccac

SEQ ID NO: 169946 - DNA, 19 bp, Homo sapiens
gattcatatttacttctta

SEQ ID NO: 169947 - DNA, 19 bp, Homo sapiens
gattccagagagtggctcc

SEQ ID NO: 169948 - DNA, 19 bp, Homo sapiens
gattcccagagacaggaaa

SEQ ID NO: 169949 - DNA, 22 bp, Homo sapiens
gattccccattgcctcctcctt

SEQ ID NO: 169950 - DNA, 21 bp, Homo sapiens
gattcctttgaagaggaaaat

SEQ ID NO: 169951 - DNA, 19 bp, Homo sapiens
gattctaatttttaagcaa

SEQ ID NO: 169952 - DNA, 14 bp, Homo sapiens
gattctactttaag

SEQ ID NO: 169953 - DNA, 16 bp, Homo sapiens
gattgagtctgtgcca

SEQ ID NO: 169954 - DNA, 15 bp, Homo sapiens
gattgcacgtggcct

SEQ ID NO: 169955 - DNA, 16 bp, Homo sapiens
gattgcacgtggcctc

SEQ ID NO: 169956 - DNA, 17 bp, Homo sapiens
gattgcacgtggcctct

SEQ ID NO: 169957 - DNA, 23 bp, Homo sapiens
gattgcacgtggcctcttgagca

SEQ ID NO: 169958 - DNA, 14 bp, Homo sapiens
gattgcttaaaata

SEQ ID NO: 169959 - DNA, 18 bp, Homo sapiens
gattgcttgagctcagga

SEQ ID NO: 169960 - DNA, 11 bp, Homo sapiens
gattggattat

SEQ ID NO: 169961 - DNA, 14 bp, Homo sapiens
gattggattattca

SEQ ID NO: 169962 - DNA, 17 bp, Homo sapiens
gattggattattcattt

SEQ ID NO: 169963 - DNA, 20 bp, Homo sapiens
gattggggaagactgtggct

SEQ ID NO: 169964 - DNA, 12 bp, Homo sapiens
gattgtaaaata

SEQ ID NO: 169965 - DNA, 20 bp, Homo sapiens
gattgtaaaatagcttgtat

SEQ ID NO: 169966 - DNA, 23 bp, Homo sapiens
gattgtaaaatagcttgtatagt

SEQ ID NO: 169967 - DNA, 14 bp, Homo sapiens
gattgttaaaataa

SEQ ID NO: 169968 - DNA, 17 bp, Homo sapiens
gattgtttgctctgaga

SEQ ID NO: 169969 - DNA, 17 bp, Homo sapiens
gatttatagtttgtaca

SEQ ID NO: 169970 - DNA, 20 bp, Homo sapiens
gatttatagtttgtacatgc

SEQ ID NO: 169971 - DNA, 15 bp, Homo sapiens
gattttatttgacaa

SEQ ID NO: 169972 - DNA, 21 bp, Homo sapiens
gattttgaaatttttattaaa

SEQ ID NO: 169973 - DNA, 20 bp, Homo sapiens
gcaaaaggttcactaaagca

SEQ ID NO: 169974 - DNA, 19 bp, Homo sapiens
gcaaaagttctgacttgac

SEQ ID NO: 169975 - DNA, 16 bp, Homo sapiens
gcaaaattcccaggga

SEQ ID NO: 169976 - DNA, 17 bp, Homo sapiens
gcaaacacacaaaggta

SEQ ID NO: 169977 - DNA, 19 bp, Homo sapiens
gcaaacccatcaacaaaaa

SEQ ID NO: 169978 - DNA, 15 bp, Homo sapiens
gcaaacgctgcctgc

SEQ ID NO: 169979 - DNA, 15 bp, Homo sapiens
gcaaagacagaagcc

SEQ ID NO: 169980 - DNA, 17 bp, Homo sapiens
gcaaagacagaagcctc

SEQ ID NO: 169981 - DNA, 13 bp, Homo sapiens
gcaaagaggcaag

SEQ ID NO: 169982 - DNA, 17 bp, Homo sapiens
gcaacagtagcatagga

SEQ ID NO: 169983 - DNA, 20 bp, Homo sapiens
gcaaccacaggcagcattta

SEQ ID NO: 169984 - DNA, 14 bp, Homo sapiens
gcaactcatcttag

SEQ ID NO: 169985 - DNA, 17 bp, Homo sapiens
gcaagaaagaaacccga

SEQ ID NO: 169986 - DNA, 13 bp, Homo sapiens
gcaagagccttgg

SEQ ID NO: 169987 - DNA, 21 bp, Homo sapiens
gcaagcactgcatgggcaagc

SEQ ID NO: 169988 - DNA, 20 bp, Homo sapiens
gcaagcatttatgtttattt

SEQ ID NO: 169989 - DNA, 22 bp, Homo sapiens
gcaagcttggctgtagaaggag

SEQ ID NO: 169990 - DNA, 18 bp, Homo sapiens
gcaagtatgtgagtgtgt

SEQ ID NO: 169991 - DNA, 13 bp, Homo sapiens
gcaagtgaagaaa

SEQ ID NO: 169992 - DNA, 15 bp, Homo sapiens
gcaagtgtctgtgtg

SEQ ID NO: 169993 - DNA, 17 bp, Homo sapiens
gcaagtgtctgtgtgca

SEQ ID NO: 169994 - DNA, 23 bp, Homo sapiens
gcaagtgtgtgcacatgtgtgcg

SEQ ID NO: 169995 - DNA, 15 bp, Homo sapiens
gcaatgaaaaattct

SEQ ID NO: 169996 - DNA, 21 bp, Homo sapiens
gcaatgacatctcaggggcca

SEQ ID NO: 169997 - DNA, 18 bp, Homo sapiens
gcaatgccatcatctcct

SEQ ID NO: 169998 - DNA, 15 bp, Homo sapiens
gcaattccgcattta

SEQ ID NO: 169999 - DNA, 19 bp, Homo sapiens
gcaatttatacaatatcat

SEQ ID NO: 170000 - DNA, 19 bp, Homo sapiens
gcaattttaattgattatt

SEQ ID NO: 170001 - DNA, 18 bp, Homo sapiens
gcaattttgcatttgaat

SEQ ID NO: 170002 - DNA, 23 bp, Homo sapiens
gcacaagcaaaagggtgtctgag

SEQ ID NO: 170003 - DNA, 15 bp, Homo sapiens
gcacactcccctgca

SEQ ID NO: 170004 - DNA, 20 bp, Homo sapiens
gcacagaaacacaatatttt

SEQ ID NO: 170005 - DNA, 18 bp, Homo sapiens
gcacagacgtccctccac

SEQ ID NO: 170006 - DNA, 17 bp, Homo sapiens
gcacagagagggggcca

SEQ ID NO: 170007 - DNA, 23 bp, Homo sapiens
gcacagagagggggccacctccc

SEQ ID NO: 170008 - DNA, 17 bp, Homo sapiens
gcacagggtctgctctt

SEQ ID NO: 170009 - DNA, 15 bp, Homo sapiens
gcacagtgcatctca

SEQ ID NO: 170010 - DNA, 17 bp, Homo sapiens
gcacatctgtgtcttgt

SEQ ID NO: 170011 - DNA, 22 bp, Homo sapiens
gcaccactgcactccagcctgg

SEQ ID NO: 170012 - DNA, 18 bp, Homo sapiens
gcaccactgtgtatttaa

SEQ ID NO: 170013 - DNA, 14 bp, Homo sapiens
gcaccagcagcctg

SEQ ID NO: 170014 - DNA, 15 bp, Homo sapiens
gcaccagcagcctgg

SEQ ID NO: 170015 - DNA, 16 bp, Homo sapiens
gcaccagcagcctgga

SEQ ID NO: 170016 - DNA, 22 bp, Homo sapiens
gcaccatccctttttgaagtgt

SEQ ID NO: 170017 - DNA, 14 bp, Homo sapiens
gcacccactctgct

SEQ ID NO: 170018 - DNA, 20 bp, Homo sapiens
gcaccccaaagctttcctgc

SEQ ID NO: 170019 - DNA, 15 bp, Homo sapiens
gcaccctcaggcagg

SEQ ID NO: 170020 - DNA, 17 bp, Homo sapiens
gcaccgtcatggcttaa

SEQ ID NO: 170021 - DNA, 17 bp, Homo sapiens
gcacctaccatcaggga

SEQ ID NO: 170022 - DNA, 23 bp, Homo sapiens
gcacctaccatcagggacaggat

SEQ ID NO: 170023 - DNA, 23 bp, Homo sapiens
gcacctactacatcgccctccac

SEQ ID NO: 170024 - DNA, 17 bp, Homo sapiens
gcacctcccatcctaat

SEQ ID NO: 170025 - DNA, 13 bp, Homo sapiens
gcacctcccccca

SEQ ID NO: 170026 - DNA, 19 bp, Homo sapiens
gcacctccccccactgcag

SEQ ID NO: 170027 - DNA, 22 bp, Homo sapiens
gcacctgcatccgtagttccct

SEQ ID NO: 170028 - DNA, 21 bp, Homo sapiens
gcacctgtaatcccagctact

SEQ ID NO: 170029 - DNA, 20 bp, Homo sapiens
gcaccttaccaactttctgt

SEQ ID NO: 170030 - DNA, 21 bp, Homo sapiens
gcaccttaccaactttctgta

SEQ ID NO: 170031 - DNA, 15 bp, Homo sapiens
gcacgaaatgttatt

SEQ ID NO: 170032 - DNA, 23 bp, Homo sapiens
gcacgaacccacctgctgagaga

SEQ ID NO: 170033 - DNA, 22 bp, Homo sapiens
gcacgcccatgtgtgagtgtgt

SEQ ID NO: 170034 - DNA, 12 bp, Homo sapiens
gcacgctgtggg

SEQ ID NO: 170035 - DNA, 21 bp, Homo sapiens
gcacgtagtagggtcaggcca

SEQ ID NO: 170036 - DNA, 13 bp, Homo sapiens
gcacgtggcctct

SEQ ID NO: 170037 - DNA, 14 bp, Homo sapiens
gcacgtggcctctt

SEQ ID NO: 170038 - DNA, 14 bp, Homo sapiens
gcactacataaact

SEQ ID NO: 170039 - DNA, 15 bp, Homo sapiens
gcactacataaactg

SEQ ID NO: 170040 - DNA, 16 bp, Homo sapiens
gcactacataaactga

SEQ ID NO: 170041 - DNA, 21 bp, Homo sapiens
gcactactccctcaaagcaca

SEQ ID NO: 170042 - DNA, 17 bp, Homo sapiens
gcactactgacatgtgg

SEQ ID NO: 170043 - DNA, 18 bp, Homo sapiens
gcactactgacatgtggg

SEQ ID NO: 170044 - DNA, 16 bp, Homo sapiens
gcactagcctttggct

SEQ ID NO: 170045 - DNA, 20 bp, Homo sapiens
gcactagcctttggctctgg

SEQ ID NO: 170046 - DNA, 21 bp, Homo sapiens
gccaccagagaccgtcctcac

SEQ ID NO: 170047 - DNA, 12 bp, Homo sapiens
gccaccatcctg

SEQ ID NO: 170048 - DNA, 15 bp, Homo sapiens
gccacctccccaggc

SEQ ID NO: 170049 - DNA, 12 bp, Homo sapiens
gccacctcccct

SEQ ID NO: 170050 - DNA, 21 bp, Homo sapiens
gccacctcccctatccaccca

SEQ ID NO: 170051 - DNA, 14 bp, Homo sapiens
gccacctctgcgga

SEQ ID NO: 170052 - DNA, 23 bp, Homo sapiens
gccacctctgcggaccccagctg

SEQ ID NO: 170053 - DNA, 21 bp, Homo sapiens
gccacgttccttactgcagaa

SEQ ID NO: 170054 - DNA, 22 bp, Homo sapiens
gccacgttccttactgcagaat

SEQ ID NO: 170055 - DNA, 16 bp, Homo sapiens
gccactccagacccct

SEQ ID NO: 170056 - DNA, 22 bp, Homo sapiens
gccactccagacccctggcttt

SEQ ID NO: 170057 - DNA, 17 bp, Homo sapiens
gccactcctctgactca

SEQ ID NO: 170058 - DNA, 15 bp, Homo sapiens
gccactcctgaaccc

SEQ ID NO: 170059 - DNA, 14 bp, Homo sapiens
gccactcgcttccc

SEQ ID NO: 170060 - DNA, 18 bp, Homo sapiens
gccactcgcttcccccat

SEQ ID NO: 170061 - DNA, 15 bp, Homo sapiens
gccactctgcctctg

SEQ ID NO: 170062 - DNA, 17 bp, Homo sapiens
gccactgcctcttcctc

SEQ ID NO: 170063 - DNA, 18 bp, Homo sapiens
gccacttaaaatgttcac

SEQ ID NO: 170064 - DNA, 20 bp, Homo sapiens
gccagaacgtggctctgctg

SEQ ID NO: 170065 - DNA, 12 bp, Homo sapiens
gccagaagctga

SEQ ID NO: 170066 - DNA, 15 bp, Homo sapiens
gccagagctgggagg

SEQ ID NO: 170067 - DNA, 18 bp, Homo sapiens
gccagaggaactgtccag

SEQ ID NO: 170068 - DNA, 24 bp, Homo sapiens
gccagaggaactgtccagagagca

SEQ ID NO: 170069 - DNA, 23 bp, Homo sapiens
gccagcaatgacatctcaggggc

SEQ ID NO: 170070 - DNA, 18 bp, Homo sapiens
gccagcagccagctctca

SEQ ID NO: 170071 - DNA, 21 bp, Homo sapiens
gccagcagccagctctcagcc

SEQ ID NO: 170072 - DNA, 16 bp, Homo sapiens
gccagccagcagccag

SEQ ID NO: 170073 - DNA, 19 bp, Homo sapiens
gccagccagtgacctgagg

SEQ ID NO: 170074 - DNA, 15 bp, Homo sapiens
gccagccctccctgt

SEQ ID NO: 170075 - DNA, 21 bp, Homo sapiens
gccagccctccctgtcctcct

SEQ ID NO: 170076 - DNA, 23 bp, Homo sapiens
gccagccctccctgtcctcctcg

SEQ ID NO: 170077 - DNA, 12 bp, Homo sapiens
gccagccttctt

SEQ ID NO: 170078 - DNA, 15 bp, Homo sapiens
gccagctctcagcca

SEQ ID NO: 170079 - DNA, 18 bp, Homo sapiens
gccagctggcagcagagt

SEQ ID NO: 170080 - DNA, 18 bp, Homo sapiens
gccagcttgttatttata

SEQ ID NO: 170081 - DNA, 14 bp, Homo sapiens
gccaggacaggccc

SEQ ID NO: 170082 - DNA, 19 bp, Homo sapiens
gccaggactgagccccgca

SEQ ID NO: 170083 - DNA, 17 bp, Homo sapiens
gccaggcccggggctgg

SEQ ID NO: 170084 - DNA, 15 bp, Homo sapiens
gccagggcagagtga

SEQ ID NO: 170085 - DNA, 19 bp, Homo sapiens
gccagggggactagcccct

SEQ ID NO: 170086 - DNA, 18 bp, Homo sapiens
gccagtgacctgaggaag

SEQ ID NO: 170087 - DNA, 15 bp, Homo sapiens
gccagtgccttacct

SEQ ID NO: 170088 - DNA, 19 bp, Homo sapiens
gccagtgccttacctcctg

SEQ ID NO: 170089 - DNA, 20 bp, Homo sapiens
gccagtgccttacctcctgc

SEQ ID NO: 170090 - DNA, 13 bp, Homo sapiens
gccataaaacatt

SEQ ID NO: 170091 - DNA, 22 bp, Homo sapiens
gccataaaacattaagaaaatc

SEQ ID NO: 170092 - DNA, 12 bp, Homo sapiens
gccatctgtggg

SEQ ID NO: 170093 - DNA, 18 bp, Homo sapiens
gccatgccagcttatctc

SEQ ID NO: 170094 - DNA, 15 bp, Homo sapiens
gccattgcactccag

SEQ ID NO: 170095 - DNA, 18 bp, Homo sapiens
gccattgcactccagcct

SEQ ID NO: 170096 - DNA, 24 bp, Homo sapiens
gcccaacctgctctcctcttgcca

SEQ ID NO: 170097 - DNA, 21 bp, Homo sapiens
gcccaagaatagatgctgact

SEQ ID NO: 170098 - DNA, 12 bp, Homo sapiens
gcccaatattat

SEQ ID NO: 170099 - DNA, 14 bp, Homo sapiens
gcccacagctccca

SEQ ID NO: 170100 - DNA, 10 bp, Homo sapiens
gcccacctcc

SEQ ID NO: 170101 - DNA, 17 bp, Homo sapiens
gcccacctccccacgcc

SEQ ID NO: 170102 - DNA, 21 bp, Homo sapiens
gcccacctccccacgccctcc

SEQ ID NO: 170103 - DNA, 13 bp, Homo sapiens
gcccacttcaggg

SEQ ID NO: 170104 - DNA, 16 bp, Homo sapiens
gcccagagcaggaagc

SEQ ID NO: 170105 - DNA, 17 bp, Homo sapiens
gcccagccaaaccctgt

SEQ ID NO: 170106 - DNA, 20 bp, Homo sapiens
gcccagccaaaccctgtctg

SEQ ID NO: 170107 - DNA, 13 bp, Homo sapiens
gcccagctctgaa

SEQ ID NO: 170108 - DNA, 13 bp, Homo sapiens
gcccaggagagag

SEQ ID NO: 170109 - DNA, 20 bp, Homo sapiens
gcccaggagagccagccctc

SEQ ID NO: 170110 - DNA, 21 bp, Homo sapiens
gcccaggagagccagccctcc

SEQ ID NO: 170111 - DNA, 17 bp, Homo sapiens
gcccaggcctgcctgtt

SEQ ID NO: 170112 - DNA, 12 bp, Homo sapiens
gcccaggcggga

SEQ ID NO: 170113 - DNA, 13 bp, Homo sapiens
gcccagggccact

SEQ ID NO: 170114 - DNA, 15 bp, Homo sapiens
gcccagggccactct

SEQ ID NO: 170115 - DNA, 12 bp, Homo sapiens
gcccagggctca

SEQ ID NO: 170116 - DNA, 14 bp, Homo sapiens
gcccagggctcagc

SEQ ID NO: 170117 - DNA, 15 bp, Homo sapiens
gcccagggctcagcc

SEQ ID NO: 170118 - DNA, 14 bp, Homo sapiens
gcccagggtggact

SEQ ID NO: 170119 - DNA, 13 bp, Homo sapiens
gcccatgtgtgag

SEQ ID NO: 170120 - DNA, 15 bp, Homo sapiens
gcccattctctctcc

SEQ ID NO: 170121 - DNA, 21 bp, Homo sapiens
gcccattctctctcctgtcca

SEQ ID NO: 170122 - DNA, 17 bp, Homo sapiens
gccccaaacaaatatgc

SEQ ID NO: 170123 - DNA, 15 bp, Homo sapiens
gccccaactcctgga

SEQ ID NO: 170124 - DNA, 13 bp, Homo sapiens
gccccaccaccta

SEQ ID NO: 170125 - DNA, 15 bp, Homo sapiens
gccccaccacctagg

SEQ ID NO: 170126 - DNA, 18 bp, Homo sapiens
gccccaccacctaggcca

SEQ ID NO: 170127 - DNA, 20 bp, Homo sapiens
gccccaccacctaggccact

SEQ ID NO: 170128 - DNA, 23 bp, Homo sapiens
gccccaccacctaggccactcct

SEQ ID NO: 170129 - DNA, 15 bp, Homo sapiens
gccccacctttatta

SEQ ID NO: 170130 - DNA, 21 bp, Homo sapiens
gccccacctttattaaaatct

SEQ ID NO: 170131 - DNA, 13 bp, Homo sapiens
gccccactgggga

SEQ ID NO: 170132 - DNA, 15 bp, Homo sapiens
gccccactggggaaa

SEQ ID NO: 170133 - DNA, 17 bp, Homo sapiens
gccccagcactaaagca

SEQ ID NO: 170134 - DNA, 14 bp, Homo sapiens
gccccaggcctctg

SEQ ID NO: 170135 - DNA, 12 bp, Homo sapiens
gccccaggcctg

SEQ ID NO: 170136 - DNA, 15 bp, Homo sapiens
gccccattcctggga

SEQ ID NO: 170137 - DNA, 23 bp, Homo sapiens
gcccccacagaaagactgagctc

SEQ ID NO: 170138 - DNA, 12 bp, Homo sapiens
gcccccagacgc

SEQ ID NO: 170139 - DNA, 17 bp, Homo sapiens
gcccccaggctgctgga

SEQ ID NO: 170140 - DNA, 14 bp, Homo sapiens
gccccgcctccccg

SEQ ID NO: 170141 - DNA, 18 bp, Homo sapiens
gccccgcttgtccagcgc

SEQ ID NO: 170142 - DNA, 17 bp, Homo sapiens
gccccggccacctctgc

SEQ ID NO: 170143 - DNA, 15 bp, Homo sapiens
gccccgtgcagactg

SEQ ID NO: 170144 - DNA, 22 bp, Homo sapiens
gccccgtgcagactggagggga

SEQ ID NO: 170145 - DNA, 20 bp, Homo sapiens
gcccctagcccaggagagag

SEQ ID NO: 170146 - DNA, 21 bp, Homo sapiens
gcccctagcccaggagagaga

SEQ ID NO: 170147 - DNA, 18 bp, Homo sapiens
gcccctcaccctgcctta

SEQ ID NO: 170148 - DNA, 13 bp, Homo sapiens
gcccctcctctgc

SEQ ID NO: 170149 - DNA, 22 bp, Homo sapiens
gcccctcctctgccacctcccc

SEQ ID NO: 170150 - DNA, 23 bp, Homo sapiens
gcccctcctctgccacctcccct

SEQ ID NO: 170151 - DNA, 20 bp, Homo sapiens
gcccctgcatccccttggct

SEQ ID NO: 170152 - DNA, 17 bp, Homo sapiens
gcccgacagcctggcac

SEQ ID NO: 170153 - DNA, 16 bp, Homo sapiens
gcccgtcttcagccta

SEQ ID NO: 170154 - DNA, 20 bp, Homo sapiens
gcccgtgacatccccaccct

SEQ ID NO: 170155 - DNA, 12 bp, Homo sapiens
gccctaggctcc

SEQ ID NO: 170156 - DNA, 20 bp, Homo sapiens
gccctcccctcccctgctgc

SEQ ID NO: 170157 - DNA, 15 bp, Homo sapiens
gccctccctgcccct

SEQ ID NO: 170158 - DNA, 21 bp, Homo sapiens
gccctccctgtcctcctcgga

SEQ ID NO: 170159 - DNA, 17 bp, Homo sapiens
gccctcgctgccagctc

SEQ ID NO: 170160 - DNA, 13 bp, Homo sapiens
gccctgagctcgg

SEQ ID NO: 170161 - DNA, 16 bp, Homo sapiens
gccctgagctttctgc

SEQ ID NO: 170162 - DNA, 21 bp, Homo sapiens
gccctgcaaaaggactctcag

SEQ ID NO: 170163 - DNA, 15 bp, Homo sapiens
gccctgccctagctc

SEQ ID NO: 170164 - DNA, 16 bp, Homo sapiens
gccctgccctagctcc

SEQ ID NO: 170165 - DNA, 17 bp, Homo sapiens
gccctgccctagctcca

SEQ ID NO: 170166 - DNA, 23 bp, Homo sapiens
gccctgctgccgcctcccagcct

SEQ ID NO: 170167 - DNA, 18 bp, Homo sapiens
gccctggatttcagaaag

SEQ ID NO: 170168 - DNA, 16 bp, Homo sapiens
gccctggccagaggct

SEQ ID NO: 170169 - DNA, 15 bp, Homo sapiens
gccctggcctgctgg

SEQ ID NO: 170170 - DNA, 19 bp, Homo sapiens
gccctggctcccacaggcc

SEQ ID NO: 170171 - DNA, 20 bp, Homo sapiens
gccctggctcccacaggccc

SEQ ID NO: 170172 - DNA, 21 bp, Homo sapiens
gccctgggtctaaggggttgg

SEQ ID NO: 170173 - DNA, 16 bp, Homo sapiens
gccctggtgctgccac

SEQ ID NO: 170174 - DNA, 21 bp, Homo sapiens
gccctggtgctgccacacttc

SEQ ID NO: 170175 - DNA, 20 bp, Homo sapiens
gccctgtccctcccacctct

SEQ ID NO: 170176 - DNA, 21 bp, Homo sapiens
gccctgtccctcccacctctg

SEQ ID NO: 170177 - DNA, 22 bp, Homo sapiens
gccctgtccctcccacctctgt

SEQ ID NO: 170178 - DNA, 22 bp, Homo sapiens
gccctgtggatgagccctcaga

SEQ ID NO: 170179 - DNA, 16 bp, Homo sapiens
gcccttatctgtgctc

SEQ ID NO: 170180 - DNA, 14 bp, Homo sapiens
gcccttcctctcca

SEQ ID NO: 170181 - DNA, 15 bp, Homo sapiens
gcccttcctctccac

SEQ ID NO: 170182 - DNA, 16 bp, Homo sapiens
gcccttcctctccact

SEQ ID NO: 170183 - DNA, 18 bp, Homo sapiens
gcccttcctctccactgc

SEQ ID NO: 170184 - DNA, 20 bp, Homo sapiens
gcccttcctctccactgcct

SEQ ID NO: 170185 - DNA, 12 bp, Homo sapiens
gcccttgtccca

SEQ ID NO: 170186 - DNA, 21 bp, Homo sapiens
gcccttgtcccactcaagcca

SEQ ID NO: 170187 - DNA, 24 bp, Homo sapiens
gcccttgtcccactcaagccaagc

SEQ ID NO: 170188 - DNA, 13 bp, Homo sapiens
gccgacctcagcc

SEQ ID NO: 170189 - DNA, 17 bp, Homo sapiens
gccgagagcctgctccc

SEQ ID NO: 170190 - DNA, 22 bp, Homo sapiens
gccgagagcctgctcccccacc

SEQ ID NO: 170191 - DNA, 16 bp, Homo sapiens
gccgcaccccagagtg

SEQ ID NO: 170192 - DNA, 18 bp, Homo sapiens
gccgcatcttctccatct

SEQ ID NO: 170193 - DNA, 15 bp, Homo sapiens
gccgcattccctgag

SEQ ID NO: 170194 - DNA, 15 bp, Homo sapiens
ggacctgcctgtagc

SEQ ID NO: 170195 - DNA, 22 bp, Homo sapiens
ggacgcagcaggaggccaggcc

SEQ ID NO: 170196 - DNA, 23 bp, Homo sapiens
ggacgcagcaggaggccaggccg

SEQ ID NO: 170197 - DNA, 14 bp, Homo sapiens
ggacgcctgggggt

SEQ ID NO: 170198 - DNA, 20 bp, Homo sapiens
ggacgcctgggggtgccagg

SEQ ID NO: 170199 - DNA, 22 bp, Homo sapiens
ggactagcccctgtggagactg

SEQ ID NO: 170200 - DNA, 14 bp, Homo sapiens
ggactcctctgtcc

SEQ ID NO: 170201 - DNA, 18 bp, Homo sapiens
ggactctcagtctctgag

SEQ ID NO: 170202 - DNA, 11 bp, Homo sapiens
ggactctgcct

SEQ ID NO: 170203 - DNA, 19 bp, Homo sapiens
ggactgaattgtccccagt

SEQ ID NO: 170204 - DNA, 12 bp, Homo sapiens
ggactgagcccc

SEQ ID NO: 170205 - DNA, 20 bp, Homo sapiens
ggactgccttgaatatcccc

SEQ ID NO: 170206 - DNA, 12 bp, Homo sapiens
ggactgggaggt

SEQ ID NO: 170207 - DNA, 23 bp, Homo sapiens
ggactggggatgtgggagggagc

SEQ ID NO: 170208 - DNA, 17 bp, Homo sapiens
ggacttagaaagcaggg

SEQ ID NO: 170209 - DNA, 18 bp, Homo sapiens
ggacttagaaagcagggg

SEQ ID NO: 170210 - DNA, 23 bp, Homo sapiens
ggagaaatgcatccattcctcag

SEQ ID NO: 170211 - DNA, 13 bp, Homo sapiens
ggagaagagagga

SEQ ID NO: 170212 - DNA, 15 bp, Homo sapiens
ggagaagagctgttc

SEQ ID NO: 170213 - DNA, 16 bp, Homo sapiens
ggagaagcagtgagcc

SEQ ID NO: 170214 - DNA, 17 bp, Homo sapiens
ggagaagcggctggcag

SEQ ID NO: 170215 - DNA, 18 bp, Homo sapiens
ggagaagcggctggcagc

SEQ ID NO: 170216 - DNA, 17 bp, Homo sapiens
ggagaaggaaggagact

SEQ ID NO: 170217 - DNA, 22 bp, Homo sapiens
ggagaaggaaggagactcacct

SEQ ID NO: 170218 - DNA, 15 bp, Homo sapiens
ggagacagccccaga

SEQ ID NO: 170219 - DNA, 20 bp, Homo sapiens
ggagacagccccagagcagg

SEQ ID NO: 170220 - DNA, 21 bp, Homo sapiens
ggagacagccccagagcaggg

SEQ ID NO: 170221 - DNA, 15 bp, Homo sapiens
ggagacatgtgacat

SEQ ID NO: 170222 - DNA, 22 bp, Homo sapiens
ggagactagatttatgaataca

SEQ ID NO: 170223 - DNA, 16 bp, Homo sapiens
ggagactcacctctgc

SEQ ID NO: 170224 - DNA, 17 bp, Homo sapiens
ggagactcacctctgcc

SEQ ID NO: 170225 - DNA, 18 bp, Homo sapiens
ggagactcacctctgcct

SEQ ID NO: 170226 - DNA, 15 bp, Homo sapiens
ggagactgcccagct

SEQ ID NO: 170227 - DNA, 22 bp, Homo sapiens
ggagactgctgagtcaacccaa

SEQ ID NO: 170228 - DNA, 20 bp, Homo sapiens
ggagactgggctgagggagc

SEQ ID NO: 170229 - DNA, 23 bp, Homo sapiens
ggagactgggctgagggagcctg

SEQ ID NO: 170230 - DNA, 15 bp, Homo sapiens
ggagactggggggct

SEQ ID NO: 170231 - DNA, 18 bp, Homo sapiens
ggagagaaggggaggagg

SEQ ID NO: 170232 - DNA, 20 bp, Homo sapiens
ggagagaaggggaggagggc

SEQ ID NO: 170233 - DNA, 20 bp, Homo sapiens
ggagagagaaagccaggcag

SEQ ID NO: 170234 - DNA, 10 bp, Homo sapiens
ggagagaggc

SEQ ID NO: 170235 - DNA, 13 bp, Homo sapiens
ggagagaggcaga

SEQ ID NO: 170236 - DNA, 18 bp, Homo sapiens
ggagagaggcagagagcg

SEQ ID NO: 170237 - DNA, 12 bp, Homo sapiens
ggagagccagcc

SEQ ID NO: 170238 - DNA, 12 bp, Homo sapiens
ggagaggaaaga

SEQ ID NO: 170239 - DNA, 12 bp, Homo sapiens
ggagaggagaga

SEQ ID NO: 170240 - DNA, 21 bp, Homo sapiens
ggagagggatgaggtgctggg

SEQ ID NO: 170241 - DNA, 24 bp, Homo sapiens
ggagagggatgaggtgctgggagg

SEQ ID NO: 170242 - DNA, 14 bp, Homo sapiens
ggagaggggcagaa

SEQ ID NO: 170243 - DNA, 17 bp, Homo sapiens
ggagagggtctggagaa

SEQ ID NO: 170244 - DNA, 18 bp, Homo sapiens
ggagagggtctggagaag

SEQ ID NO: 170245 - DNA, 20 bp, Homo sapiens
ggagagggtctggagaagca

SEQ ID NO: 170246 - DNA, 18 bp, Homo sapiens
ggagaggtcttttttaaa

SEQ ID NO: 170247 - DNA, 15 bp, Homo sapiens
ggagatgctccttgg

SEQ ID NO: 170248 - DNA, 17 bp, Homo sapiens
ggagattgagaaggaga

SEQ ID NO: 170249 - DNA, 20 bp, Homo sapiens
ggagattgagaaggagagaa

SEQ ID NO: 170250 - DNA, 23 bp, Homo sapiens
ggagcaggagattgagaaggaga

SEQ ID NO: 170251 - DNA, 20 bp, Homo sapiens
ggagccaacagaagcttcca

SEQ ID NO: 170252 - DNA, 23 bp, Homo sapiens
ggagccaagggttcagagactca

SEQ ID NO: 170253 - DNA, 22 bp, Homo sapiens
ggagcccaggcgggagcggtgg

SEQ ID NO: 170254 - DNA, 20 bp, Homo sapiens
ggagccccaggcctctgtgt

SEQ ID NO: 170255 - DNA, 22 bp, Homo sapiens
ggagccccaggcctctgtgtcc

SEQ ID NO: 170256 - DNA, 14 bp, Homo sapiens
ggagccccagtgcc

SEQ ID NO: 170257 - DNA, 16 bp, Homo sapiens
ggagccccattcctgg

SEQ ID NO: 170258 - DNA, 17 bp, Homo sapiens
ggagccccattcctggg

SEQ ID NO: 170259 - DNA, 20 bp, Homo sapiens
ggagcccttatctgtgctca

SEQ ID NO: 170260 - DNA, 17 bp, Homo sapiens
ggagccgggtctgcctc

SEQ ID NO: 170261 - DNA, 14 bp, Homo sapiens
ggagcggaaagcag

SEQ ID NO: 170262 - DNA, 15 bp, Homo sapiens
ggagcggaaagcagc

SEQ ID NO: 170263 - DNA, 16 bp, Homo sapiens
ggagcggaaagcagct

SEQ ID NO: 170264 - DNA, 15 bp, Homo sapiens
ggagcggtggccctg

SEQ ID NO: 170265 - DNA, 22 bp, Homo sapiens
ggagcggtggccctgtccctcc

SEQ ID NO: 170266 - DNA, 20 bp, Homo sapiens
tactcagcagccctcctcac

SEQ ID NO: 170267 - DNA, 23 bp, Homo sapiens
tactcagcagccctcctcacccc

SEQ ID NO: 170268 - DNA, 14 bp, Homo sapiens
tactcagccctggg

SEQ ID NO: 170269 - DNA, 16 bp, Homo sapiens
tactcagccctgggcc

SEQ ID NO: 170270 - DNA, 22 bp, Homo sapiens
tactcccactcccggcctgtca

SEQ ID NO: 170271 - DNA, 17 bp, Homo sapiens
tactcctctttacactg

SEQ ID NO: 170272 - DNA, 16 bp, Homo sapiens
tactctaccctcttag

SEQ ID NO: 170273 - DNA, 19 bp, Homo sapiens
tactctcctcggccccctc

SEQ ID NO: 170274 - DNA, 20 bp, Homo sapiens
tactgaaaggttaccctgta

SEQ ID NO: 170275 - DNA, 22 bp, Homo sapiens
tactgaagatgcagcaaaatgt

SEQ ID NO: 170276 - DNA, 18 bp, Homo sapiens
tactgcaaatgtcatcag

SEQ ID NO: 170277 - DNA, 20 bp, Homo sapiens
tactgcagcctttgcctccc

SEQ ID NO: 170278 - DNA, 22 bp, Homo sapiens
tactgcagcctttgcctccccg

SEQ ID NO: 170279 - DNA, 19 bp, Homo sapiens
tactgcagctttacatgca

SEQ ID NO: 170280 - DNA, 22 bp, Homo sapiens
tactgcagctttacatgcaatt

SEQ ID NO: 170281 - DNA, 10 bp, Homo sapiens
tactgcaggg

SEQ ID NO: 170282 - DNA, 16 bp, Homo sapiens
tactgtctggttttaa

SEQ ID NO: 170283 - DNA, 19 bp, Homo sapiens
tactgtctggttttaacaa

SEQ ID NO: 170284 - DNA, 20 bp, Homo sapiens
tactgtctggttttaacaat

SEQ ID NO: 170285 - DNA, 15 bp, Homo sapiens
tacttcactttaatt

SEQ ID NO: 170286 - DNA, 23 bp, Homo sapiens
tacttgccttattagagtgtctt

SEQ ID NO: 170287 - DNA, 19 bp, Homo sapiens
tactttcctttccccagcc

SEQ ID NO: 170288 - DNA, 23 bp, Homo sapiens
tactttgatattttcaacgcagc

SEQ ID NO: 170289 - DNA, 15 bp, Homo sapiens
tacttttgccctttg

SEQ ID NO: 170290 - DNA, 14 bp, Homo sapiens
tactttttttcaca

SEQ ID NO: 170291 - DNA, 22 bp, Homo sapiens
tagaaaaaccctgcccccaaat

SEQ ID NO: 170292 - DNA, 20 bp, Homo sapiens
tagaaaactgaaaatctaat

SEQ ID NO: 170293 - DNA, 21 bp, Homo sapiens
tagaaaactgaaaatctaata

SEQ ID NO: 170294 - DNA, 14 bp, Homo sapiens
tagaaaccttaata

SEQ ID NO: 170295 - DNA, 15 bp, Homo sapiens
tagaaacttccaaat

SEQ ID NO: 170296 - DNA, 14 bp, Homo sapiens
tagaaagaagccca

SEQ ID NO: 170297 - DNA, 15 bp, Homo sapiens
tagaaagcaggggct

SEQ ID NO: 170298 - DNA, 23 bp, Homo sapiens
tagaaccaggcaacttgggaact

SEQ ID NO: 170299 - DNA, 19 bp, Homo sapiens
tagaactcagttttaacta

SEQ ID NO: 170300 - DNA, 19 bp, Homo sapiens
tagaactgtatgtcagaca

SEQ ID NO: 170301 - DNA, 16 bp, Homo sapiens
tagaagctgtagtagc

SEQ ID NO: 170302 - DNA, 16 bp, Homo sapiens
tagaagtggaccagga

SEQ ID NO: 170303 - DNA, 20 bp, Homo sapiens
tagaagtggaccaggacagg

SEQ ID NO: 170304 - DNA, 20 bp, Homo sapiens
tagaatatttattacctctg

SEQ ID NO: 170305 - DNA, 12 bp, Homo sapiens
tagaatgaaaat

SEQ ID NO: 170306 - DNA, 20 bp, Homo sapiens
tagaatgaaaattgtatgtt

SEQ ID NO: 170307 - DNA, 16 bp, Homo sapiens
tagaattaacacatga

SEQ ID NO: 170308 - DNA, 20 bp, Homo sapiens
tagaattccctctctctgac

SEQ ID NO: 170309 - DNA, 22 bp, Homo sapiens
tagaatttattcaattcctctg

SEQ ID NO: 170310 - DNA, 21 bp, Homo sapiens
tagacatttctcttactgcaa

SEQ ID NO: 170311 - DNA, 12 bp, Homo sapiens
tagacctcagcc

SEQ ID NO: 170312 - DNA, 13 bp, Homo sapiens
tagacctcagcct

SEQ ID NO: 170313 - DNA, 15 bp, Homo sapiens
tagacctcagcctgt

SEQ ID NO: 170314 - DNA, 22 bp, Homo sapiens
tagagaaggacccggaggggcc

SEQ ID NO: 170315 - DNA, 20 bp, Homo sapiens
tagagatcatcctttccagc

SEQ ID NO: 170316 - DNA, 19 bp, Homo sapiens
tagagattacctcctgaga

SEQ ID NO: 170317 - DNA, 21 bp, Homo sapiens
tagagattacctcctgagaaa

SEQ ID NO: 170318 - DNA, 16 bp, Homo sapiens
tagagcacactgtagc

SEQ ID NO: 170319 - DNA, 14 bp, Homo sapiens
tagagcctgaggga

SEQ ID NO: 170320 - DNA, 16 bp, Homo sapiens
tagaggttttgttgtt

SEQ ID NO: 170321 - DNA, 19 bp, Homo sapiens
tagaggttttgttgtttta

SEQ ID NO: 170322 - DNA, 22 bp, Homo sapiens
tagagtccaacgtggggcagca

SEQ ID NO: 170323 - DNA, 14 bp, Homo sapiens
tagatcatgaagaa

SEQ ID NO: 170324 - DNA, 15 bp, Homo sapiens
tagatgaactcaact

SEQ ID NO: 170325 - DNA, 21 bp, Homo sapiens
tagattaccccctcattgttt

SEQ ID NO: 170326 - DNA, 16 bp, Homo sapiens
tagattgttaaaataa

SEQ ID NO: 170327 - DNA, 24 bp, Homo sapiens
tagcaagattgcttaaaatagcaa

SEQ ID NO: 170328 - DNA, 16 bp, Homo sapiens
tagcaaggcatgatgt

SEQ ID NO: 170329 - DNA, 20 bp, Homo sapiens
tagcactaccactcctgcca

SEQ ID NO: 170330 - DNA, 14 bp, Homo sapiens
tagcagattttaat

SEQ ID NO: 170331 - DNA, 18 bp, Homo sapiens
tagcagattttaattttg

SEQ ID NO: 170332 - DNA, 22 bp, Homo sapiens
tagcaggactgaattgtcccca

SEQ ID NO: 170333 - DNA, 17 bp, Homo sapiens
tagcaggtaccactgat

SEQ ID NO: 170334 - DNA, 22 bp, Homo sapiens
tagcattttgctaaatgtgaat

SEQ ID NO: 170335 - DNA, 14 bp, Homo sapiens
tagccaccaactct

SEQ ID NO: 170336 - DNA, 22 bp, Homo sapiens
tagccagggggactagcccctg

SEQ ID NO: 170337 - DNA, 12 bp, Homo sapiens
tagcccaggaga

SEQ ID NO: 170338 - DNA, 15 bp, Homo sapiens
tagcccaggagagag

SEQ ID NO: 170339 - DNA, 17 bp, Homo sapiens
tagcccaggagagagaa

SEQ ID NO: 170340 - DNA, 18 bp, Homo sapiens
tagcccaggagagagaaa

SEQ ID NO: 170341 - DNA, 14 bp, Homo sapiens
tagcccatccctgc

SEQ ID NO: 170342 - DNA, 16 bp, Homo sapiens
tagcccatccctgcct

SEQ ID NO: 170343 - DNA, 21 bp, Homo sapiens
tagcccatccctgcctggtca

SEQ ID NO: 170344 - DNA, 18 bp, Homo sapiens
tagccctggccagaggct

SEQ ID NO: 170345 - DNA, 14 bp, Homo sapiens
tagccctttctgtg

SEQ ID NO: 170346 - DNA, 15 bp, Homo sapiens
tagccctttctgtgt

SEQ ID NO: 170347 - DNA, 14 bp, Homo sapiens
tagccgagagcctg

SEQ ID NO: 170348 - DNA, 20 bp, Homo sapiens
tagcctcgccgtctgtgaat

SEQ ID NO: 170349 - DNA, 20 bp, Homo sapiens
tagccttccgtaacccaact

SEQ ID NO: 170350 - DNA, 22 bp, Homo sapiens
tagccttccgtaacccaactct

SEQ ID NO: 170351 - DNA, 21 bp, Homo sapiens
tagctgacccagccccttgag

SEQ ID NO: 170352 - DNA, 18 bp, Homo sapiens
tagctgtacaaatataag

SEQ ID NO: 170353 - DNA, 14 bp, Homo sapiens
tagctgtggtgagg

SEQ ID NO: 170354 - DNA, 18 bp, Homo sapiens
tagctgtggtgaggtggg

SEQ ID NO: 170355 - DNA, 14 bp, Homo sapiens
tagctgtgtgaaat

SEQ ID NO: 170356 - DNA, 18 bp, Homo sapiens
tagcttagacctcagcct

SEQ ID NO: 170357 - DNA, 13 bp, Homo sapiens
tagcttgtatagt

SEQ ID NO: 170358 - DNA, 19 bp, Homo sapiens
tagcttgtatagtgtaaaa

SEQ ID NO: 170359 - DNA, 19 bp, Homo sapiens
tagctttcccaaataaact

SEQ ID NO: 170360 - DNA, 19 bp, Homo sapiens
taggaagagaaaccaggga

SEQ ID NO: 170361 - DNA, 12 bp, Homo sapiens
taggaattgacc

SEQ ID NO: 170362 - DNA, 22 bp, Homo sapiens
taggagaattgcttgaacctgg

SEQ ID NO: 170363 - DNA, 18 bp, Homo sapiens
taggagctgggaggaaaa

SEQ ID NO: 170364 - DNA, 12 bp, Homo sapiens
taggatttaaca

SEQ ID NO: 170365 - DNA, 22 bp, Homo sapiens
taggatttaacagtcatttaaa

SEQ ID NO: 170366 - DNA, 18 bp, Homo sapiens
taggcaacctttattttt

SEQ ID NO: 170367 - DNA, 15 bp, Homo sapiens
taggcagacacaggg

SEQ ID NO: 170368 - DNA, 22 bp, Homo sapiens
taggcagacacagggacttgaa

SEQ ID NO: 170369 - DNA, 22 bp, Homo sapiens
taggctccgtcagtatcaggcc

SEQ ID NO: 170370 - DNA, 16 bp, Homo sapiens
taggctggagcccagg

SEQ ID NO: 170371 - DNA, 11 bp, Homo sapiens
tagggaaaaac

SEQ ID NO: 170372 - DNA, 21 bp, Homo sapiens
tagggaaaaaccagcgtgtga

SEQ ID NO: 170373 - DNA, 13 bp, Homo sapiens
tagggaagataat

SEQ ID NO: 170374 - DNA, 14 bp, Homo sapiens
tagggaagggcctg

SEQ ID NO: 170375 - DNA, 14 bp, Homo sapiens
tagggagagaagat

SEQ ID NO: 170376 - DNA, 15 bp, Homo sapiens
tagggagagaagata

SEQ ID NO: 170377 - DNA, 18 bp, Homo sapiens
tagggatgttctggccct

SEQ ID NO: 170378 - DNA, 23 bp, Homo sapiens
tagggccaagcccagcactgctt

SEQ ID NO: 170379 - DNA, 21 bp, Homo sapiens
tagggccaggcaggtgcctgg

SEQ ID NO: 170380 - DNA, 15 bp, Homo sapiens
tagggttataataat

SEQ ID NO: 170381 - DNA, 22 bp, Homo sapiens
tatgttttgacatttttagttt

SEQ ID NO: 170382 - DNA, 15 bp, Homo sapiens
tattaaaaatataaa

SEQ ID NO: 170383 - DNA, 22 bp, Homo sapiens
tattaaaaatataaaactgcgt

SEQ ID NO: 170384 - DNA, 20 bp, Homo sapiens
tattaaaaatatggaacttc

SEQ ID NO: 170385 - DNA, 16 bp, Homo sapiens
tattaaaactcatttt

SEQ ID NO: 170386 - DNA, 22 bp, Homo sapiens
tattaaaatatggctataaata

SEQ ID NO: 170387 - DNA, 18 bp, Homo sapiens
tattaaaatgattgtaaa

SEQ ID NO: 170388 - DNA, 19 bp, Homo sapiens
tattaaaatgattgtaaaa

SEQ ID NO: 170389 - DNA, 12 bp, Homo sapiens
tattaaattatg

SEQ ID NO: 170390 - DNA, 13 bp, Homo sapiens
tattacctctgat

SEQ ID NO: 170391 - DNA, 14 bp, Homo sapiens
tattacctctgata

SEQ ID NO: 170392 - DNA, 19 bp, Homo sapiens
tattacctctgatacctca

SEQ ID NO: 170393 - DNA, 22 bp, Homo sapiens
tattactatgactgctccccag

SEQ ID NO: 170394 - DNA, 15 bp, Homo sapiens
tattagagtgtcttt

SEQ ID NO: 170395 - DNA, 18 bp, Homo sapiens
tattagagtgtctttcca

SEQ ID NO: 170396 - DNA, 13 bp, Homo sapiens
tattagttaatat

SEQ ID NO: 170397 - DNA, 15 bp, Homo sapiens
tattataacttaaaa

SEQ ID NO: 170398 - DNA, 19 bp, Homo sapiens
tattataatttttttcaat

SEQ ID NO: 170399 - DNA, 15 bp, Homo sapiens
tattatcaacaatag

SEQ ID NO: 170400 - DNA, 12 bp, Homo sapiens
tattatgtgttt

SEQ ID NO: 170401 - DNA, 16 bp, Homo sapiens
tattattcccattcta

SEQ ID NO: 170402 - DNA, 13 bp, Homo sapiens
tattatttatata

SEQ ID NO: 170403 - DNA, 18 bp, Homo sapiens
tattcaattcctctggga

SEQ ID NO: 170404 - DNA, 21 bp, Homo sapiens
tattcatattttctttcaaaa

SEQ ID NO: 170405 - DNA, 12 bp, Homo sapiens
tattcatttaaa

SEQ ID NO: 170406 - DNA, 15 bp, Homo sapiens
tattcatttaaaatg

SEQ ID NO: 170407 - DNA, 17 bp, Homo sapiens
tattccatatttattca

SEQ ID NO: 170408 - DNA, 20 bp, Homo sapiens
tattcctgcatttgtgaaat

SEQ ID NO: 170409 - DNA, 21 bp, Homo sapiens
tattcctgcatttgtgaaatg

SEQ ID NO: 170410 - DNA, 10 bp, Homo sapiens
tattctagtc

SEQ ID NO: 170411 - DNA, 16 bp, Homo sapiens
tattctcactccacca

SEQ ID NO: 170412 - DNA, 19 bp, Homo sapiens
tattctcactccaccaccc

SEQ ID NO: 170413 - DNA, 22 bp, Homo sapiens
tattctcactccaccacccaaa

SEQ ID NO: 170414 - DNA, 14 bp, Homo sapiens
tattgacaaactct

SEQ ID NO: 170415 - DNA, 15 bp, Homo sapiens
tattgagaaagagca

SEQ ID NO: 170416 - DNA, 13 bp, Homo sapiens
tattgcacattgt

SEQ ID NO: 170417 - DNA, 18 bp, Homo sapiens
tattggtaacatcctttc

SEQ ID NO: 170418 - DNA, 21 bp, Homo sapiens
tattgtataaactatcagttt

SEQ ID NO: 170419 - DNA, 21 bp, Homo sapiens
tattgtgatctatcaatagtc

SEQ ID NO: 170420 - DNA, 14 bp, Homo sapiens
tattgtgttgtgaa

SEQ ID NO: 170421 - DNA, 24 bp, Homo sapiens
tattgtttattctttttaaagtat

SEQ ID NO: 170422 - DNA, 18 bp, Homo sapiens
tattgtttcaattgcatc

SEQ ID NO: 170423 - DNA, 15 bp, Homo sapiens
gctgagagaaaataa

SEQ ID NO: 170424 - DNA, 14 bp, Homo sapiens
gctgagagacccaa

SEQ ID NO: 170425 - DNA, 20 bp, Homo sapiens
gctgagagacccaaggagga

SEQ ID NO: 170426 - DNA, 16 bp, Homo sapiens
gctgagaggagagaga

SEQ ID NO: 170427 - DNA, 17 bp, Homo sapiens
gctgagcaccaggggat

SEQ ID NO: 170428 - DNA, 12 bp, Homo sapiens
gctgaggaaagg

SEQ ID NO: 170429 - DNA, 15 bp, Homo sapiens
gctgaggaaaggcca

SEQ ID NO: 170430 - DNA, 16 bp, Homo sapiens
gctgaggaaaggccag

SEQ ID NO: 170431 - DNA, 15 bp, Homo sapiens
gctgaggcagaagaa

SEQ ID NO: 170432 - DNA, 23 bp, Homo sapiens
gctgaggcagcagtgtgaggcca

SEQ ID NO: 170433 - DNA, 12 bp, Homo sapiens
gctgaggcctgg

SEQ ID NO: 170434 - DNA, 14 bp, Homo sapiens
gctgaggcctggac

SEQ ID NO: 170435 - DNA, 23 bp, Homo sapiens
gctgaggctctgacccagtgaga

SEQ ID NO: 170436 - DNA, 15 bp, Homo sapiens
gctgagggaccagcc

SEQ ID NO: 170437 - DNA, 23 bp, Homo sapiens
gctgatggataacctatatgatt

SEQ ID NO: 170438 - DNA, 15 bp, Homo sapiens
gctgcaccctcaggc

SEQ ID NO: 170439 - DNA, 18 bp, Homo sapiens
gctgcagagacagagagg

SEQ ID NO: 170440 - DNA, 12 bp, Homo sapiens
gctgcaggggct

SEQ ID NO: 170441 - DNA, 16 bp, Homo sapiens
gctgcaggggctctgg

SEQ ID NO: 170442 - DNA, 18 bp, Homo sapiens
gctgccacacttcaggct

SEQ ID NO: 170443 - DNA, 18 bp, Homo sapiens
gctgccagctctgtatca

SEQ ID NO: 170444 - DNA, 19 bp, Homo sapiens
gctgccccacaggtgtgtt

SEQ ID NO: 170445 - DNA, 19 bp, Homo sapiens
gctgcccgtcttcagccta

SEQ ID NO: 170446 - DNA, 13 bp, Homo sapiens
gctgccctggtgc

SEQ ID NO: 170447 - DNA, 14 bp, Homo sapiens
gctgccctggtgct

SEQ ID NO: 170448 - DNA, 15 bp, Homo sapiens
gctgccctggtgctg

SEQ ID NO: 170449 - DNA, 17 bp, Homo sapiens
gctgccctggtgctgcc

SEQ ID NO: 170450 - DNA, 23 bp, Homo sapiens
gctgccctggtgctgccacactt

SEQ ID NO: 170451 - DNA, 14 bp, Homo sapiens
gctgccgcacccca

SEQ ID NO: 170452 - DNA, 18 bp, Homo sapiens
gctgccgcaccccagagt

SEQ ID NO: 170453 - DNA, 22 bp, Homo sapiens
gctgccgcaccccagagtgtgg

SEQ ID NO: 170454 - DNA, 16 bp, Homo sapiens
gctgccgcctcccagc

SEQ ID NO: 170455 - DNA, 16 bp, Homo sapiens
gctgcctaagtggctg

SEQ ID NO: 170456 - DNA, 14 bp, Homo sapiens
gctgcctgcccaca

SEQ ID NO: 170457 - DNA, 13 bp, Homo sapiens
gctgcctgcccgt

SEQ ID NO: 170458 - DNA, 22 bp, Homo sapiens
gctgcctgccggtaaacacgcc

SEQ ID NO: 170459 - DNA, 19 bp, Homo sapiens
gctgcctggcccccagctg

SEQ ID NO: 170460 - DNA, 15 bp, Homo sapiens
gctgcctgtagttag

SEQ ID NO: 170461 - DNA, 19 bp, Homo sapiens
gctgcctgtagttaggaaa

SEQ ID NO: 170462 - DNA, 15 bp, Homo sapiens
gctgctaatcttcag

SEQ ID NO: 170463 - DNA, 14 bp, Homo sapiens
gctgctcctccagg

SEQ ID NO: 170464 - DNA, 18 bp, Homo sapiens
gctgctcctccagggcca

SEQ ID NO: 170465 - DNA, 18 bp, Homo sapiens
gctgctgacctccacagc

SEQ ID NO: 170466 - DNA, 14 bp, Homo sapiens
gctgctgctgctgc

SEQ ID NO: 170467 - DNA, 12 bp, Homo sapiens
gctgctggagga

SEQ ID NO: 170468 - DNA, 21 bp, Homo sapiens
gctggactctcagtctctgag

SEQ ID NO: 170469 - DNA, 12 bp, Homo sapiens
gctggagaagag

SEQ ID NO: 170470 - DNA, 18 bp, Homo sapiens
gctggagaagagaggaga

SEQ ID NO: 170471 - DNA, 13 bp, Homo sapiens
gcctttggctctg

SEQ ID NO: 170472 - DNA, 14 bp, Homo sapiens
gccttttatagcta

SEQ ID NO: 170473 - DNA, 19 bp, Homo sapiens
gccttttttcacggaagtt

SEQ ID NO: 170474 - DNA, 23 bp, Homo sapiens
gcgaaaggatgtaaacagtgcct

SEQ ID NO: 170475 - DNA, 17 bp, Homo sapiens
gcgacatagcccatccc

SEQ ID NO: 170476 - DNA, 23 bp, Homo sapiens
gcgagatggggtggggtggagaa

SEQ ID NO: 170477 - DNA, 20 bp, Homo sapiens
gcgaggagatgctccttggg

SEQ ID NO: 170478 - DNA, 15 bp, Homo sapiens
gcgaggaggctccag

SEQ ID NO: 170479 - DNA, 18 bp, Homo sapiens
gcgaggaggctccagagg

SEQ ID NO: 170480 - DNA, 16 bp, Homo sapiens
gcgaggtcaacagaga

SEQ ID NO: 170481 - DNA, 17 bp, Homo sapiens
gcgaggtcaacagagaa

SEQ ID NO: 170482 - DNA, 17 bp, Homo sapiens
gcgatccacctgtctca

SEQ ID NO: 170483 - DNA, 21 bp, Homo sapiens
gcgatccacctgtctcagcct

SEQ ID NO: 170484 - DNA, 15 bp, Homo sapiens
gcgatggtctcagaa

SEQ ID NO: 170485 - DNA, 12 bp, Homo sapiens
gcgcaagcctgt

SEQ ID NO: 170486 - DNA, 22 bp, Homo sapiens
gcgcaagcctgtaatcccagct

SEQ ID NO: 170487 - DNA, 23 bp, Homo sapiens
gcgcaagcctgtaatcccagcta

SEQ ID NO: 170488 - DNA, 20 bp, Homo sapiens
gcgccattgcactccagcct

SEQ ID NO: 170489 - DNA, 13 bp, Homo sapiens
gcgcccacctccc

SEQ ID NO: 170490 - DNA, 16 bp, Homo sapiens
gcgctgccgcacccca

SEQ ID NO: 170491 - DNA, 17 bp, Homo sapiens
gcgcttttgctggtcac

SEQ ID NO: 170492 - DNA, 14 bp, Homo sapiens
gcggaccccagctg

SEQ ID NO: 170493 - DNA, 20 bp, Homo sapiens
gcggaccccagctgtgagcc

SEQ ID NO: 170494 - DNA, 12 bp, Homo sapiens
gcggcagagagg

SEQ ID NO: 170495 - DNA, 17 bp, Homo sapiens
gcggccgcattccctga

SEQ ID NO: 170496 - DNA, 18 bp, Homo sapiens
gcggccgcattccctgag

SEQ ID NO: 170497 - DNA, 21 bp, Homo sapiens
gcggctactcagcagccctcc

SEQ ID NO: 170498 - DNA, 13 bp, Homo sapiens
gcgggaaggaggg

SEQ ID NO: 170499 - DNA, 18 bp, Homo sapiens
gcgggagcggtggccctg

SEQ ID NO: 170500 - DNA, 14 bp, Homo sapiens
gcggtggccctgtc

SEQ ID NO: 170501 - DNA, 15 bp, Homo sapiens
gcgtcctcctctgtg

SEQ ID NO: 170502 - DNA, 16 bp, Homo sapiens
gcgtgaaggccgagaa

SEQ ID NO: 170503 - DNA, 13 bp, Homo sapiens
gcgtgactcaccc

SEQ ID NO: 170504 - DNA, 16 bp, Homo sapiens
gcgtgactcacccaag

SEQ ID NO: 170505 - DNA, 17 bp, Homo sapiens
gcgtgtcacctgtgctt

SEQ ID NO: 170506 - DNA, 18 bp, Homo sapiens
gcgtgtgcgtgcatgtgc

SEQ ID NO: 170507 - DNA, 14 bp, Homo sapiens
gcgtgtggctcacg

SEQ ID NO: 170508 - DNA, 19 bp, Homo sapiens
gcgtgtggctcacgtgtgt

SEQ ID NO: 170509 - DNA, 22 bp, Homo sapiens
gcttttgctggtcactgccatg

SEQ ID NO: 170510 - DNA, 16 bp, Homo sapiens
gctttttgtcttttct

SEQ ID NO: 170511 - DNA, 13 bp, Homo sapiens
ggaaaaatagcct

SEQ ID NO: 170512 - DNA, 15 bp, Homo sapiens
ggaaaaatagcctgc

SEQ ID NO: 170513 - DNA, 21 bp, Homo sapiens
ggaaaactgagactcagacag

SEQ ID NO: 170514 - DNA, 15 bp, Homo sapiens
ggaaaatcagcctgc

SEQ ID NO: 170515 - DNA, 23 bp, Homo sapiens
ggaaaatcagcctgctccagctg

SEQ ID NO: 170516 - DNA, 17 bp, Homo sapiens
ggaaactgttgccagag

SEQ ID NO: 170517 - DNA, 19 bp, Homo sapiens
ggaaagcagctcaaaggca

SEQ ID NO: 170518 - DNA, 22 bp, Homo sapiens
ggaaagcagctcaaaggcacag

SEQ ID NO: 170519 - DNA, 15 bp, Homo sapiens
ggaaaggccagctgg

SEQ ID NO: 170520 - DNA, 16 bp, Homo sapiens
ggaaataaaacctttc

SEQ ID NO: 170521 - DNA, 16 bp, Homo sapiens
ggaaatatcagttact

SEQ ID NO: 170522 - DNA, 18 bp, Homo sapiens
ggaaatctcaccccatcc

SEQ ID NO: 170523 - DNA, 17 bp, Homo sapiens
ggaacagacaggagaaa

SEQ ID NO: 170524 - DNA, 18 bp, Homo sapiens
ggaaccatgaagacagga

SEQ ID NO: 170525 - DNA, 24 bp, Homo sapiens
ggaacccttacagtaggagcccag

SEQ ID NO: 170526 - DNA, 18 bp, Homo sapiens
ggaaccgcaggaagctgc

SEQ ID NO: 170527 - DNA, 22 bp, Homo sapiens
ggaactcattcctgcctgtctc

SEQ ID NO: 170528 - DNA, 15 bp, Homo sapiens
ggaactcctggaaat

SEQ ID NO: 170529 - DNA, 16 bp, Homo sapiens
ggaactgtccagagag

SEQ ID NO: 170530 - DNA, 15 bp, Homo sapiens
ggaagacgcctgagc

SEQ ID NO: 170531 - DNA, 15 bp, Homo sapiens
ggaagagaaaaaata

SEQ ID NO: 170532 - DNA, 13 bp, Homo sapiens
ggaagagaaacca

SEQ ID NO: 170533 - DNA, 17 bp, Homo sapiens
ggaagcatgtaggagaa

SEQ ID NO: 170534 - DNA, 20 bp, Homo sapiens
ggaagcatgtaggagaatcc

SEQ ID NO: 170535 - DNA, 20 bp, Homo sapiens
ggaagcattcagagagcagc

SEQ ID NO: 170536 - DNA, 11 bp, Homo sapiens
ggaagccctcc

SEQ ID NO: 170537 - DNA, 15 bp, Homo sapiens
ggaagccctccttcc

SEQ ID NO: 170538 - DNA, 11 bp, Homo sapiens
ggaagccctgg

SEQ ID NO: 170539 - DNA, 13 bp, Homo sapiens
ggaagctgctccg

SEQ ID NO: 170540 - DNA, 15 bp, Homo sapiens
ggaagctgctccgtg

SEQ ID NO: 170541 - DNA, 23 bp, Homo sapiens
ggaagctgtgtccttgcacctgc

SEQ ID NO: 170542 - DNA, 13 bp, Homo sapiens
ggaagcttccagt

SEQ ID NO: 170543 - DNA, 15 bp, Homo sapiens
ggaaggagactcacc

SEQ ID NO: 170544 - DNA, 21 bp, Homo sapiens
ggaaggagactcacctctgcc

SEQ ID NO: 170545 - DNA, 17 bp, Homo sapiens
ggaaggggccagaggct

SEQ ID NO: 170546 - DNA, 16 bp, Homo sapiens
ggaagtaggaagtaaa

SEQ ID NO: 170547 - DNA, 18 bp, Homo sapiens
ggaagtccccaggcccca

SEQ ID NO: 170548 - DNA, 20 bp, Homo sapiens
ggaagtgacggtttaatggg

SEQ ID NO: 170549 - DNA, 14 bp, Homo sapiens
ggaagttttcaatg

SEQ ID NO: 170550 - DNA, 23 bp, Homo sapiens
ggaatcagacttcacactgcaag

SEQ ID NO: 170551 - DNA, 13 bp, Homo sapiens
ggaatcagcttct

SEQ ID NO: 170552 - DNA, 14 bp, Homo sapiens
ggaatcctgtcctc

SEQ ID NO: 170553 - DNA, 14 bp, Homo sapiens
ggaatgctgtgtta

SEQ ID NO: 170554 - DNA, 19 bp, Homo sapiens
ggaattacatgtaaaacat

SEQ ID NO: 170555 - DNA, 13 bp, Homo sapiens
ggacaagcagagg

SEQ ID NO: 170556 - DNA, 22 bp, Homo sapiens
ggacaaggctagatcatgaaga

SEQ ID NO: 170557 - DNA, 20 bp, Homo sapiens
ggacaccacacccagcctca

SEQ ID NO: 170558 - DNA, 16 bp, Homo sapiens
ggacacctgccctgcc

SEQ ID NO: 170559 - DNA, 22 bp, Homo sapiens
ggacactcaaaagctgggcagg

SEQ ID NO: 170560 - DNA, 19 bp, Homo sapiens
ggacagagacacctgcacc

SEQ ID NO: 170561 - DNA, 20 bp, Homo sapiens
ggacagagacacctgcacct

SEQ ID NO: 170562 - DNA, 22 bp, Homo sapiens
ggacagcctgtggcggtgcctg

SEQ ID NO: 170563 - DNA, 15 bp, Homo sapiens
ggacagggcatggcc

SEQ ID NO: 170564 - DNA, 22 bp, Homo sapiens
ggacagggcatggccaggtggc

SEQ ID NO: 170565 - DNA, 17 bp, Homo sapiens
ggaccaggacaggacca

SEQ ID NO: 170566 - DNA, 21 bp, Homo sapiens
ggacccagaggaaggggccag

SEQ ID NO: 170567 - DNA, 14 bp, Homo sapiens
ggacccagggatga

SEQ ID NO: 170568 - DNA, 20 bp, Homo sapiens
ggacccggaggggcctggca

SEQ ID NO: 170569 - DNA, 21 bp, Homo sapiens
ggacccggaggggcctggcag

SEQ ID NO: 170570 - DNA, 23 bp, Homo sapiens
ggacccttgagagtatcaggtct

SEQ ID NO: 170571 - DNA, 16 bp, Homo sapiens
ggaccctttccttcct

SEQ ID NO: 170572 - DNA, 14 bp, Homo sapiens
ggacctcctgagcg

SEQ ID NO: 170573 - DNA, 14 bp, Homo sapiens
ggacctgcctgtag

SEQ ID NO: 170574 - DNA, 13 bp, Homo sapiens
taagagaaagaaa

SEQ ID NO: 170575 - DNA, 18 bp, Homo sapiens
taagagctagcgctgccg

SEQ ID NO: 170576 - DNA, 23 bp, Homo sapiens
taagagggattagggagagaaga

SEQ ID NO: 170577 - DNA, 13 bp, Homo sapiens
taagataattata

SEQ ID NO: 170578 - DNA, 19 bp, Homo sapiens
taagatatgggacattttt

SEQ ID NO: 170579 - DNA, 14 bp, Homo sapiens
taagatatttttca

SEQ ID NO: 170580 - DNA, 17 bp, Homo sapiens
taagatatttttcatga

SEQ ID NO: 170581 - DNA, 17 bp, Homo sapiens
taagatggaagcttcca

SEQ ID NO: 170582 - DNA, 19 bp, Homo sapiens
taagatggaagcttccagt

SEQ ID NO: 170583 - DNA, 18 bp, Homo sapiens
taagattagaatgaaaat

SEQ ID NO: 170584 - DNA, 14 bp, Homo sapiens
taagattccagaga

SEQ ID NO: 170585 - DNA, 21 bp, Homo sapiens
taagcaaaatgtgatatgtac

SEQ ID NO: 170586 - DNA, 20 bp, Homo sapiens
taagcagaccactgataaaa

SEQ ID NO: 170587 - DNA, 15 bp, Homo sapiens
taagcatcaaactct

SEQ ID NO: 170588 - DNA, 16 bp, Homo sapiens
taagcatcaaactctt

SEQ ID NO: 170589 - DNA, 17 bp, Homo sapiens
taagccacttaaaatgt

SEQ ID NO: 170590 - DNA, 20 bp, Homo sapiens
taagccagacatcaacagat

SEQ ID NO: 170591 - DNA, 16 bp, Homo sapiens
taagcctcatatttaa

SEQ ID NO: 170592 - DNA, 13 bp, Homo sapiens
taagctgaaaata

SEQ ID NO: 170593 - DNA, 16 bp, Homo sapiens
taagcttatgtcagac

SEQ ID NO: 170594 - DNA, 20 bp, Homo sapiens
taaggatggagccagctctg

SEQ ID NO: 170595 - DNA, 12 bp, Homo sapiens
taaggatgggaa

SEQ ID NO: 170596 - DNA, 17 bp, Homo sapiens
taaggatgtcacagggc

SEQ ID NO: 170597 - DNA, 19 bp, Homo sapiens
taaggatgtcacagggcca

SEQ ID NO: 170598 - DNA, 15 bp, Homo sapiens
taaggattgtgatat

SEQ ID NO: 170599 - DNA, 18 bp, Homo sapiens
taaggttacctttgttcc

SEQ ID NO: 170600 - DNA, 16 bp, Homo sapiens
taaggttctcatagga

SEQ ID NO: 170601 - DNA, 17 bp, Homo sapiens
taagtaaaaccacagca

SEQ ID NO: 170602 - DNA, 18 bp, Homo sapiens
taagtaaaaccacagcag

SEQ ID NO: 170603 - DNA, 19 bp, Homo sapiens
taagtaaaaccacagcagt

SEQ ID NO: 170604 - DNA, 12 bp, Homo sapiens
taagtaagaaaa

SEQ ID NO: 170605 - DNA, 19 bp, Homo sapiens
taagtaagaaaatattttg

SEQ ID NO: 170606 - DNA, 19 bp, Homo sapiens
taagtattgcatctgtata

SEQ ID NO: 170607 - DNA, 14 bp, Homo sapiens
taagtatttatata

SEQ ID NO: 170608 - DNA, 15 bp, Homo sapiens
taagtatttatatat

SEQ ID NO: 170609 - DNA, 19 bp, Homo sapiens
taagtatttatatatttat

SEQ ID NO: 170610 - DNA, 19 bp, Homo sapiens
taagtcatgttccttcaag

SEQ ID NO: 170611 - DNA, 14 bp, Homo sapiens
taagtgttgtaaat

SEQ ID NO: 170612 - DNA, 14 bp, Homo sapiens
taagtttctgggac

SEQ ID NO: 170613 - DNA, 14 bp, Homo sapiens
taataaaaaatgga

SEQ ID NO: 170614 - DNA, 15 bp, Homo sapiens
taataaatctggtag

SEQ ID NO: 170615 - DNA, 15 bp, Homo sapiens
taataactgtgaagt

SEQ ID NO: 170616 - DNA, 23 bp, Homo sapiens
taatacagcagtgtcatcagaag

SEQ ID NO: 170617 - DNA, 12 bp, Homo sapiens
taatagagcaaa

SEQ ID NO: 170618 - DNA, 19 bp, Homo sapiens
taatagcgggttactttca

SEQ ID NO: 170619 - DNA, 21 bp, Homo sapiens
taatagcttttattgtataaa

SEQ ID NO: 170620 - DNA, 18 bp, Homo sapiens
taatatggcaaaaatggc

SEQ ID NO: 170621 - DNA, 18 bp, Homo sapiens
taatcaatgtttcttcta

SEQ ID NO: 170622 - DNA, 13 bp, Homo sapiens
taatcagcctctt

SEQ ID NO: 170623 - DNA, 17 bp, Homo sapiens
taatcatccaatgctca

SEQ ID NO: 170624 - DNA, 19 bp, Homo sapiens
taatcccagcactttggga

SEQ ID NO: 170625 - DNA, 19 bp, Homo sapiens
taatcccagctacttggga

SEQ ID NO: 170626 - DNA, 13 bp, Homo sapiens
taatctccacagt

SEQ ID NO: 170627 - DNA, 21 bp, Homo sapiens
taatctggactcctctgtcca

SEQ ID NO: 170628 - DNA, 17 bp, Homo sapiens
taatctgggaagggaag

SEQ ID NO: 170629 - DNA, 16 bp, Homo sapiens
taatcttgaattgtaa

SEQ ID NO: 170630 - DNA, 17 bp, Homo sapiens
taatgaagaaagtggaa

SEQ ID NO: 170631 - DNA, 22 bp, Homo sapiens
taatgaagggaaaggatatttt

SEQ ID NO: 170632 - DNA, 20 bp, Homo sapiens
taatgacatcaccacagttt

SEQ ID NO: 170633 - DNA, 19 bp, Homo sapiens
taatgataagtaaatgcta

SEQ ID NO: 170634 - DNA, 16 bp, Homo sapiens
taatgcatgttaggaa

SEQ ID NO: 170635 - DNA, 21 bp, Homo sapiens
taatgcatgttaggaaaattt

SEQ ID NO: 170636 - DNA, 19 bp, Homo sapiens
taatgccactaaattgaca

SEQ ID NO: 170637 - DNA, 17 bp, Homo sapiens
taatgtaataactgtga

SEQ ID NO: 170638 - DNA, 13 bp, Homo sapiens
taatgtactgcat

SEQ ID NO: 170639 - DNA, 15 bp, Homo sapiens
taatgttaattcagc

SEQ ID NO: 170640 - DNA, 18 bp, Homo sapiens
taatgttgttatttaaag

SEQ ID NO: 170641 - DNA, 14 bp, Homo sapiens
taattattatttat

SEQ ID NO: 170642 - DNA, 22 bp, Homo sapiens
taattcaaagctctattaagat

SEQ ID NO: 170643 - DNA, 22 bp, Homo sapiens
taattcctctcactaaacttta

SEQ ID NO: 170644 - DNA, 20 bp, Homo sapiens
taattctcatgtgatccttt

SEQ ID NO: 170645 - DNA, 15 bp, Homo sapiens
taattcttgtatatt

SEQ ID NO: 170646 - DNA, 16 bp, Homo sapiens
taattgcttacatttt

SEQ ID NO: 170647 - DNA, 21 bp, Homo sapiens
taatttaatgcatgttaggaa

SEQ ID NO: 170648 - DNA, 20 bp, Homo sapiens
taatttatgagtttttgata

SEQ ID NO: 170649 - DNA, 15 bp, Homo sapiens
taattttgaataaat

SEQ ID NO: 170650 - DNA, 16 bp, Homo sapiens
taatttttcctatatt

SEQ ID NO: 170651 - DNA, 17 bp, Homo sapiens
taattttttattcaagt

SEQ ID NO: 170652 - DNA, 17 bp, Homo sapiens
taatttttttaaccaaa

SEQ ID NO: 170653 - DNA, 21 bp, Homo sapiens
taatttttttaaccaaaggtg

SEQ ID NO: 170654 - DNA, 22 bp, Homo sapiens
taatttttttcaatatttatta

SEQ ID NO: 170655 - DNA, 14 bp, Homo sapiens
tacaaaaacacagc

SEQ ID NO: 170656 - DNA, 16 bp, Homo sapiens
tacaaaaacacagcaa

SEQ ID NO: 170657 - DNA, 18 bp, Homo sapiens
tacaaaaacacagcaagg

SEQ ID NO: 170658 - DNA, 17 bp, Homo sapiens
tacaaatactcttagga

SEQ ID NO: 170659 - DNA, 14 bp, Homo sapiens
tacaacttcagcag

SEQ ID NO: 170660 - DNA, 21 bp, Homo sapiens
tacaagccattctaaggaaat

SEQ ID NO: 170661 - DNA, 15 bp, Homo sapiens
tacaagtgtatatca

SEQ ID NO: 170662 - DNA, 21 bp, Homo sapiens
tacaataaaactttgctgcca

SEQ ID NO: 170663 - DNA, 16 bp, Homo sapiens
tacaataaataatctg

SEQ ID NO: 170664 - DNA, 17 bp, Homo sapiens
tacaattccctgctgtc

SEQ ID NO: 170665 - DNA, 15 bp, Homo sapiens
tacaatttacaaagt

SEQ ID NO: 170666 - DNA, 16 bp, Homo sapiens
tacaatttacaaagtg

SEQ ID NO: 170667 - DNA, 23 bp, Homo sapiens
tacacaaaacaaatgccacacat

SEQ ID NO: 170668 - DNA, 16 bp, Homo sapiens
tacacactcaaatcaa

SEQ ID NO: 170669 - DNA, 19 bp, Homo sapiens
tacaccatgtttgagctca

SEQ ID NO: 170670 - DNA, 24 bp, Homo sapiens
tacaccatgtttgagctcagaccc

SEQ ID NO: 170671 - DNA, 15 bp, Homo sapiens
tacaccgggcctgga

SEQ ID NO: 170672 - DNA, 20 bp, Homo sapiens
tacactgaagttaacagaga

SEQ ID NO: 170673 - DNA, 13 bp, Homo sapiens
tacactttatgca

SEQ ID NO: 170674 - DNA, 17 bp, Homo sapiens
tacagagacagaaagca

SEQ ID NO: 170675 - DNA, 16 bp, Homo sapiens
tacagagtgatagcct

SEQ ID NO: 170676 - DNA, 20 bp, Homo sapiens
tacagtaggagcccagctct

SEQ ID NO: 170677 - DNA, 18 bp, Homo sapiens
tacagtatctcagggcct

SEQ ID NO: 170678 - DNA, 19 bp, Homo sapiens
tacagtgttattttctttg

SEQ ID NO: 170679 - DNA, 19 bp, Homo sapiens
tacagttgaaaaacagctg

SEQ ID NO: 170680 - DNA, 17 bp, Homo sapiens
tacataaactgacttta

SEQ ID NO: 170681 - DNA, 15 bp, Homo sapiens
tacataagtaattca

SEQ ID NO: 170682 - DNA, 15 bp, Homo sapiens
tacataagtttagga

SEQ ID NO: 170683 - DNA, 19 bp, Homo sapiens
tacataattttttattcaa

SEQ ID NO: 170684 - DNA, 14 bp, Homo sapiens
tacatcgccctcca

SEQ ID NO: 170685 - DNA, 21 bp, Homo sapiens
tacatgaggtactgagagtga

SEQ ID NO: 170686 - DNA, 19 bp, Homo sapiens
tacatgcaatttattaaaa

SEQ ID NO: 170687 - DNA, 22 bp, Homo sapiens
tacatgcaatttattaaaatga

SEQ ID NO: 170688 - DNA, 19 bp, Homo sapiens
tacatgtattgcacattgt

SEQ ID NO: 170689 - DNA, 22 bp, Homo sapiens
tacattaattattattgctgtt

SEQ ID NO: 170690 - DNA, 20 bp, Homo sapiens
tacattagcagtttgctttg

SEQ ID NO: 170691 - DNA, 16 bp, Homo sapiens
tacattgtgaaacttc

SEQ ID NO: 170692 - DNA, 20 bp, Homo sapiens
tacatttatagttgtaacta

SEQ ID NO: 170693 - DNA, 15 bp, Homo sapiens
tacatttccaaatga

SEQ ID NO: 170694 - DNA, 14 bp, Homo sapiens
tacatttttacaat

SEQ ID NO: 170695 - DNA, 16 bp, Homo sapiens
tacatttttacaataa

SEQ ID NO: 170696 - DNA, 17 bp, Homo sapiens
tacatttttacaataaa

SEQ ID NO: 170697 - DNA, 21 bp, Homo sapiens
tacatttttacaataaataat

SEQ ID NO: 170698 - DNA, 23 bp, Homo sapiens
taccaaaattatttcagaaatgt

SEQ ID NO: 170699 - DNA, 16 bp, Homo sapiens
taccaagtttcaggta

SEQ ID NO: 170700 - DNA, 15 bp, Homo sapiens
taccaatcattttaa

SEQ ID NO: 170701 - DNA, 19 bp, Homo sapiens
taccaatcattttaattat

SEQ ID NO: 170702 - DNA, 14 bp, Homo sapiens
tcacttgagacaaa

SEQ ID NO: 170703 - DNA, 22 bp, Homo sapiens
tcacttgaggtcaggagttcct

SEQ ID NO: 170704 - DNA, 16 bp, Homo sapiens
tcactttaattctcat

SEQ ID NO: 170705 - DNA, 17 bp, Homo sapiens
tcagaaaatattatgtg

SEQ ID NO: 170706 - DNA, 20 bp, Homo sapiens
tcagaaaatattatgtgttt

SEQ ID NO: 170707 - DNA, 14 bp, Homo sapiens
tcagaaagagcaag

SEQ ID NO: 170708 - DNA, 18 bp, Homo sapiens
tcagaacccttggcttgc

SEQ ID NO: 170709 - DNA, 16 bp, Homo sapiens
tcagaagcctctgggt

SEQ ID NO: 170710 - DNA, 19 bp, Homo sapiens
tcagaatctacccaaagga

SEQ ID NO: 170711 - DNA, 20 bp, Homo sapiens
tcagaatctacccaaaggat

SEQ ID NO: 170712 - DNA, 19 bp, Homo sapiens
tcagacatagaattaacac

SEQ ID NO: 170713 - DNA, 21 bp, Homo sapiens
tcagacatccatgtttgtaaa

SEQ ID NO: 170714 - DNA, 22 bp, Homo sapiens
tcagacatccatgtttgtaaaa

SEQ ID NO: 170715 - DNA, 12 bp, Homo sapiens
tcagacccccac

SEQ ID NO: 170716 - DNA, 18 bp, Homo sapiens
tcagacccccactctcat

SEQ ID NO: 170717 - DNA, 14 bp, Homo sapiens
tcagaccctacccc

SEQ ID NO: 170718 - DNA, 16 bp, Homo sapiens
tcagaccctaccccac

SEQ ID NO: 170719 - DNA, 16 bp, Homo sapiens
tcagacgcctgaggaa

SEQ ID NO: 170720 - DNA, 20 bp, Homo sapiens
tcagagaggagtcagagaga

SEQ ID NO: 170721 - DNA, 22 bp, Homo sapiens
tcagatattttttcagaaatat

SEQ ID NO: 170722 - DNA, 16 bp, Homo sapiens
tcagcaaaaagcaaaa

SEQ ID NO: 170723 - DNA, 15 bp, Homo sapiens
tcagcaaaagatgct

SEQ ID NO: 170724 - DNA, 21 bp, Homo sapiens
tcagcactgtcccttgcctca

SEQ ID NO: 170725 - DNA, 14 bp, Homo sapiens
tcagcagccctcct

SEQ ID NO: 170726 - DNA, 14 bp, Homo sapiens
tcagcaggaagcaa

SEQ ID NO: 170727 - DNA, 14 bp, Homo sapiens
tcagccatgtattt

SEQ ID NO: 170728 - DNA, 16 bp, Homo sapiens
tcagccattcactgcc

SEQ ID NO: 170729 - DNA, 15 bp, Homo sapiens
tcagcccctcctctg

SEQ ID NO: 170730 - DNA, 16 bp, Homo sapiens
tcagcccctcctctgc

SEQ ID NO: 170731 - DNA, 19 bp, Homo sapiens
tcagcccctcctctgccac

SEQ ID NO: 170732 - DNA, 19 bp, Homo sapiens
tccaaatgaatgaccttgt

SEQ ID NO: 170733 - DNA, 17 bp, Homo sapiens
tccaacaggagctggga

SEQ ID NO: 170734 - DNA, 15 bp, Homo sapiens
tccaaccccaactcc

SEQ ID NO: 170735 - DNA, 18 bp, Homo sapiens
tccaaccccaactccagt

SEQ ID NO: 170736 - DNA, 23 bp, Homo sapiens
tccaacctaacccctttcctgcg

SEQ ID NO: 170737 - DNA, 14 bp, Homo sapiens
tccaacctggacaa

SEQ ID NO: 170738 - DNA, 23 bp, Homo sapiens
tccaagcataccaacacgagcag

SEQ ID NO: 170739 - DNA, 21 bp, Homo sapiens
tccaagcgaggtcaacagaga

SEQ ID NO: 170740 - DNA, 22 bp, Homo sapiens
tccaagcgaggtcaacagagaa

SEQ ID NO: 170741 - DNA, 15 bp, Homo sapiens
tccaatctcatggag

SEQ ID NO: 170742 - DNA, 20 bp, Homo sapiens
tccacaagattcccagagac

SEQ ID NO: 170743 - DNA, 21 bp, Homo sapiens
tccacaagattcccagagaca

SEQ ID NO: 170744 - DNA, 17 bp, Homo sapiens
tccacaagttaaataaa

SEQ ID NO: 170745 - DNA, 19 bp, Homo sapiens
tccacaccctctcccagga

SEQ ID NO: 170746 - DNA, 20 bp, Homo sapiens
tccacaccctctcccaggac

SEQ ID NO: 170747 - DNA, 21 bp, Homo sapiens
tccacaccctctcccaggacc

SEQ ID NO: 170748 - DNA, 16 bp, Homo sapiens
tccaccaacccatcag

SEQ ID NO: 170749 - DNA, 18 bp, Homo sapiens
tccaccaacccatcagaa

SEQ ID NO: 170750 - DNA, 17 bp, Homo sapiens
tccaccaagaaagcagg

SEQ ID NO: 170751 - DNA, 17 bp, Homo sapiens
tccaccacccaaaagtc

SEQ ID NO: 170752 - DNA, 14 bp, Homo sapiens
tccaccacctccct

SEQ ID NO: 170753 - DNA, 17 bp, Homo sapiens
tccaccacctccctcac

SEQ ID NO: 170754 - DNA, 17 bp, Homo sapiens
tccacccaccttggcct

SEQ ID NO: 170755 - DNA, 17 bp, Homo sapiens
tccacccagcccattct

SEQ ID NO: 170756 - DNA, 14 bp, Homo sapiens
tccacctacatgag

SEQ ID NO: 170757 - DNA, 12 bp, Homo sapiens
tccacctcagcc

SEQ ID NO: 170758 - DNA, 13 bp, Homo sapiens
tccacctcagcct

SEQ ID NO: 170759 - DNA, 14 bp, Homo sapiens
tccacctgagctgc

SEQ ID NO: 170760 - DNA, 17 bp, Homo sapiens
tccacctggccccatgt

SEQ ID NO: 170761 - DNA, 13 bp, Homo sapiens
tccacctgtctca

SEQ ID NO: 170762 - DNA, 20 bp, Homo sapiens
tccacctgtctcagcctccc

SEQ ID NO: 170763 - DNA, 16 bp, Homo sapiens
tccacgactgtctcca

SEQ ID NO: 170764 - DNA, 17 bp, Homo sapiens
tccacgactgtctccat

SEQ ID NO: 170765 - DNA, 18 bp, Homo sapiens
tccacgactgtctccatg

SEQ ID NO: 170766 - DNA, 15 bp, Homo sapiens
tccacggagccactc

SEQ ID NO: 170767 - DNA, 18 bp, Homo sapiens
tccacgtccccctggggc

SEQ ID NO: 170768 - DNA, 20 bp, Homo sapiens
tccacgttctgctcatcatt

SEQ ID NO: 170769 - DNA, 21 bp, Homo sapiens
tccacgttctgctcatcattc

SEQ ID NO: 170770 - DNA, 15 bp, Homo sapiens
tccactagtgcaaat

SEQ ID NO: 170771 - DNA, 17 bp, Homo sapiens
tccactagtgcaaatca

SEQ ID NO: 170772 - DNA, 18 bp, Homo sapiens
tccactagtgcaaatcat

SEQ ID NO: 170773 - DNA, 13 bp, Homo sapiens
tccactgccttcg

SEQ ID NO: 170774 - DNA, 15 bp, Homo sapiens
tccactgccttcgat

SEQ ID NO: 170775 - DNA, 17 bp, Homo sapiens
tccactgtcaccctcca

SEQ ID NO: 170776 - DNA, 14 bp, Homo sapiens
tccagaatatctgg

SEQ ID NO: 170777 - DNA, 19 bp, Homo sapiens
tccagacaaaccagaagca

SEQ ID NO: 170778 - DNA, 24 bp, Homo sapiens
tccagacaaaccagaagcaacaga

SEQ ID NO: 170779 - DNA, 16 bp, Homo sapiens
tccagacccctggctt

SEQ ID NO: 170780 - DNA, 19 bp, Homo sapiens
tccagagagtggctcctcc

SEQ ID NO: 170781 - DNA, 15 bp, Homo sapiens
tccagcctctcccct

SEQ ID NO: 170782 - DNA, 21 bp, Homo sapiens
tccagcctgagcgacagtgag

SEQ ID NO: 170783 - DNA, 24 bp, Homo sapiens
tccagcctgggtgacagagcaagt

SEQ ID NO: 170784 - DNA, 16 bp, Homo sapiens
tccagcttgctcttca

SEQ ID NO: 170785 - DNA, 17 bp, Homo sapiens
tccagcttgctcttcag

SEQ ID NO: 170786 - DNA, 19 bp, Homo sapiens
tccagcttgctcttcagtg

SEQ ID NO: 170787 - DNA, 23 bp, Homo sapiens
tccaggagaaggccaattcctat

SEQ ID NO: 170788 - DNA, 19 bp, Homo sapiens
tccaggatgctaacatcta

SEQ ID NO: 170789 - DNA, 20 bp, Homo sapiens
tccaggctgtctttcactga

SEQ ID NO: 170790 - DNA, 23 bp, Homo sapiens
tccagggccacgtgccaggcccg

SEQ ID NO: 170791 - DNA, 13 bp, Homo sapiens
tccagggccctga

SEQ ID NO: 170792 - DNA, 16 bp, Homo sapiens
tccagggccctgagct

SEQ ID NO: 170793 - DNA, 13 bp, Homo sapiens
tccaggtgcccag

SEQ ID NO: 170794 - DNA, 20 bp, Homo sapiens
tccaggtttaagctgttact

SEQ ID NO: 170795 - DNA, 17 bp, Homo sapiens
tccagtccaatctcatg

SEQ ID NO: 170796 - DNA, 18 bp, Homo sapiens
tccagtgagacagctctg

SEQ ID NO: 170797 - DNA, 16 bp, Homo sapiens
tccagtgtctcggagg

SEQ ID NO: 170798 - DNA, 19 bp, Homo sapiens
tccagttaaaaaaaatttt

SEQ ID NO: 170799 - DNA, 18 bp, Homo sapiens
tccatcaggttccatccc

SEQ ID NO: 170800 - DNA, 13 bp, Homo sapiens
tccatcatgtccc

SEQ ID NO: 170801 - DNA, 14 bp, Homo sapiens
tccatcatgtcccc

SEQ ID NO: 170802 - DNA, 15 bp, Homo sapiens
tccatcatgtcccca

SEQ ID NO: 170803 - DNA, 15 bp, Homo sapiens
tccatccacatggga

SEQ ID NO: 170804 - DNA, 21 bp, Homo sapiens
tccatcccaggacaccacacc

SEQ ID NO: 170805 - DNA, 22 bp, Homo sapiens
tccatcccaggacaccacaccc

SEQ ID NO: 170806 - DNA, 16 bp, Homo sapiens
tccatctcgccacccc

SEQ ID NO: 170807 - DNA, 23 bp, Homo sapiens
tccatctcgccacccctccttcc

SEQ ID NO: 170808 - DNA, 22 bp, Homo sapiens
tccatgaagatgtagaggagaa

SEQ ID NO: 170809 - DNA, 20 bp, Homo sapiens
tccatggccctgcaaaagga

SEQ ID NO: 170810 - DNA, 16 bp, Homo sapiens
tccatgggcagagccc

SEQ ID NO: 170811 - DNA, 23 bp, Homo sapiens
tccatgggcagagcccaagggaa

SEQ ID NO: 170812 - DNA, 15 bp, Homo sapiens
tccatgggggcaggg

SEQ ID NO: 170813 - DNA, 17 bp, Homo sapiens
tccatgggggcagggca

SEQ ID NO: 170814 - DNA, 13 bp, Homo sapiens
tccatgtgtgtgc

SEQ ID NO: 170815 - DNA, 14 bp, Homo sapiens
tccatgtgtgtgca

SEQ ID NO: 170816 - DNA, 12 bp, Homo sapiens
tccattcctcag

SEQ ID NO: 170817 - DNA, 13 bp, Homo sapiens
tccattcctcagg

SEQ ID NO: 170818 - DNA, 14 bp, Homo sapiens
tccattcctcaggg

SEQ ID NO: 170819 - DNA, 12 bp, Homo sapiens
tccatttgcaag

SEQ ID NO: 170820 - DNA, 15 bp, Homo sapiens
tccatttgcaaggga

SEQ ID NO: 170821 - DNA, 16 bp, Homo sapiens
tcccaaatttcatacc

SEQ ID NO: 170822 - DNA, 22 bp, Homo sapiens
tcccaaggctctgagcaaatgt

SEQ ID NO: 170823 - DNA, 14 bp, Homo sapiens
tcccaagtctacag

SEQ ID NO: 170824 - DNA, 16 bp, Homo sapiens
tcccacaaaggagagc

SEQ ID NO: 170825 - DNA, 15 bp, Homo sapiens
tcccacaggcccttc

SEQ ID NO: 170826 - DNA, 22 bp, Homo sapiens
tcccacaggcccttcctctcca

SEQ ID NO: 170827 - DNA, 19 bp, Homo sapiens
tcccaccaaccctcagagc

SEQ ID NO: 170828 - DNA, 20 bp, Homo sapiens
tcccacccccatctctccct

SEQ ID NO: 170829 - DNA, 11 bp, Homo sapiens
tcccacctctg

SEQ ID NO: 170830 - DNA, 18 bp, Homo sapiens
tcccactcaagccaagca

SEQ ID NO: 170831 - DNA, 19 bp, Homo sapiens
tcccagaacacactccatc

SEQ ID NO: 170832 - DNA, 20 bp, Homo sapiens
tcccagaaggacctcctgag

SEQ ID NO: 170833 - DNA, 18 bp, Homo sapiens
tcccagagacaggaaaat

SEQ ID NO: 170834 - DNA, 16 bp, Homo sapiens
tcccagataatgtgaa

SEQ ID NO: 170835 - DNA, 21 bp, Homo sapiens
tcccagcactttgggaggcca

SEQ ID NO: 170836 - DNA, 13 bp, Homo sapiens
tcccagctactca

SEQ ID NO: 170837 - DNA, 16 bp, Homo sapiens
tcccagctacttggga

SEQ ID NO: 170838 - DNA, 17 bp, Homo sapiens
tcccagctcacgtcaca

SEQ ID NO: 170839 - DNA, 18 bp, Homo sapiens
tcccagctctccctctgg

SEQ ID NO: 170840 - DNA, 19 bp, Homo sapiens
tcccagctctccctctggc

SEQ ID NO: 170841 - DNA, 23 bp, Homo sapiens
tcccagctctccctctggccctg

SEQ ID NO: 170842 - DNA, 17 bp, Homo sapiens
tcccagctgaaatactg

SEQ ID NO: 170843 - DNA, 15 bp, Homo sapiens
tcccaggacaccaca

SEQ ID NO: 170844 - DNA, 18 bp, Homo sapiens
tcccaggacaccacaccc

SEQ ID NO: 170845 - DNA, 19 bp, Homo sapiens
tcccaggacaccacaccca

SEQ ID NO: 170846 - DNA, 22 bp, Homo sapiens
tcccaggacaccacacccagcc

SEQ ID NO: 170847 - DNA, 18 bp, Homo sapiens
tcccaggccagtaaggga

SEQ ID NO: 170848 - DNA, 20 bp, Homo sapiens
tcccaggcgccccttccccc

SEQ ID NO: 170849 - DNA, 17 bp, Homo sapiens
tcccatagccaggaaac

SEQ ID NO: 170850 - DNA, 22 bp, Homo sapiens
tcccatcactggagcaccaggc

SEQ ID NO: 170851 - DNA, 18 bp, Homo sapiens
tcccatcccactgctccc

SEQ ID NO: 170852 - DNA, 15 bp, Homo sapiens
tcccatcccctggac

SEQ ID NO: 170853 - DNA, 12 bp, Homo sapiens
tcccatgccctg

SEQ ID NO: 170854 - DNA, 15 bp, Homo sapiens
tcccatggacactcc

SEQ ID NO: 170855 - DNA, 23 bp, Homo sapiens
tccccaacagcgacatagcccat

SEQ ID NO: 170856 - DNA, 14 bp, Homo sapiens
tccccacctgggac

SEQ ID NO: 170857 - DNA, 14 bp, Homo sapiens
tccccacgccctcc

SEQ ID NO: 170858 - DNA, 18 bp, Homo sapiens
tccccacgccctcccctc

SEQ ID NO: 170859 - DNA, 15 bp, Homo sapiens
tccccactgcctact

SEQ ID NO: 170860 - DNA, 18 bp, Homo sapiens
tccccactgcctactgca

SEQ ID NO: 170861 - DNA, 16 bp, Homo sapiens
tccccagacctgagct

SEQ ID NO: 170862 - DNA, 13 bp, Homo sapiens
tccccagcccagg

SEQ ID NO: 170863 - DNA, 11 bp, Homo sapiens
tccccagcccc

SEQ ID NO: 170864 - DNA, 15 bp, Homo sapiens
tccccagcccctagc

SEQ ID NO: 170865 - DNA, 19 bp, Homo sapiens
tccccagcccctagcccag

SEQ ID NO: 170866 - DNA, 15 bp, Homo sapiens
tccccagccctggct

SEQ ID NO: 170867 - DNA, 19 bp, Homo sapiens
tccccaggccccaggaagc

SEQ ID NO: 170868 - DNA, 19 bp, Homo sapiens
tccccaggccgtggctgcc

SEQ ID NO: 170869 - DNA, 10 bp, Homo sapiens
tccccagggg

SEQ ID NO: 170870 - DNA, 18 bp, Homo sapiens
tccccaggggaaaatgaa

SEQ ID NO: 170871 - DNA, 17 bp, Homo sapiens
tccccagtttgcagaaa

SEQ ID NO: 170872 - DNA, 13 bp, Homo sapiens
tccccccactgca

SEQ ID NO: 170873 - DNA, 14 bp, Homo sapiens
tcccccgccactcc

SEQ ID NO: 170874 - DNA, 18 bp, Homo sapiens
tccccctgccagtgcctt

SEQ ID NO: 170875 - DNA, 20 bp, Homo sapiens
tccccgtgccccgcctcccc

SEQ ID NO: 170876 - DNA, 13 bp, Homo sapiens
tccccgtggtctc

SEQ ID NO: 170877 - DNA, 14 bp, Homo sapiens
tcccctaacctcat

SEQ ID NO: 170878 - DNA, 13 bp, Homo sapiens
tcccctaatgcct

SEQ ID NO: 170879 - DNA, 17 bp, Homo sapiens
tcccctatccacccagc

SEQ ID NO: 170880 - DNA, 21 bp, Homo sapiens
ttgaagttgttactaactaaa

SEQ ID NO: 170881 - DNA, 17 bp, Homo sapiens
ttgaatatcccctccca

SEQ ID NO: 170882 - DNA, 17 bp, Homo sapiens
ttgaatccatgcttggg

SEQ ID NO: 170883 - DNA, 18 bp, Homo sapiens
ttgaatgacaacagaagc

SEQ ID NO: 170884 - DNA, 20 bp, Homo sapiens
ttgaatgacaacagaagctt

SEQ ID NO: 170885 - DNA, 20 bp, Homo sapiens
ttgaatgctttttgaatgtt

SEQ ID NO: 170886 - DNA, 14 bp, Homo sapiens
ttgaatgttaagca

SEQ ID NO: 170887 - DNA, 20 bp, Homo sapiens
ttgaccaagcaggaagctca

SEQ ID NO: 170888 - DNA, 22 bp, Homo sapiens
ttgaccaagcaggaagctcaga

SEQ ID NO: 170889 - DNA, 22 bp, Homo sapiens
ttgaccagcagatcccagctca

SEQ ID NO: 170890 - DNA, 13 bp, Homo sapiens
ttgactttcaggt

SEQ ID NO: 170891 - DNA, 15 bp, Homo sapiens
ttgactttcaggtac

SEQ ID NO: 170892 - DNA, 13 bp, Homo sapiens
ttgagaattttaa

SEQ ID NO: 170893 - DNA, 17 bp, Homo sapiens
ttgagacctcagccatg

SEQ ID NO: 170894 - DNA, 12 bp, Homo sapiens
ttgagctgtttt

SEQ ID NO: 170895 - DNA, 23 bp, Homo sapiens
ttgaggaaaacaagcattcacaa

SEQ ID NO: 170896 - DNA, 14 bp, Homo sapiens
ttgagggcccagag

SEQ ID NO: 170897 - DNA, 16 bp, Homo sapiens
ttgagggcccagagca

SEQ ID NO: 170898 - DNA, 23 bp, Homo sapiens
ttgagggcccagagcaggaagca

SEQ ID NO: 170899 - DNA, 17 bp, Homo sapiens
ttgatgacccccaacca

SEQ ID NO: 170900 - DNA, 14 bp, Homo sapiens
ttgatggagatatt

SEQ ID NO: 170901 - DNA, 14 bp, Homo sapiens
ttgatggggaagga

SEQ ID NO: 170902 - DNA, 23 bp, Homo sapiens
ttgatggtgatgaaatgtaaata

SEQ ID NO: 170903 - DNA, 12 bp, Homo sapiens
ttgattattctg

SEQ ID NO: 170904 - DNA, 16 bp, Homo sapiens
ttgattcagctctgca

SEQ ID NO: 170905 - DNA, 17 bp, Homo sapiens
ttgcaaggccgctgttc

SEQ ID NO: 170906 - DNA, 22 bp, Homo sapiens
ttgcaagggaaaagtctcttgt

SEQ ID NO: 170907 - DNA, 15 bp, Homo sapiens
ttgcaagtgaaggtt

SEQ ID NO: 170908 - DNA, 22 bp, Homo sapiens
ttgcacactcccctgcactgga

SEQ ID NO: 170909 - DNA, 15 bp, Homo sapiens
ttgcaccactgcact

SEQ ID NO: 170910 - DNA, 17 bp, Homo sapiens
ttgcacctacctcacag

SEQ ID NO: 170911 - DNA, 20 bp, Homo sapiens
ttgcagaaaagcacctgccg

SEQ ID NO: 170912 - DNA, 20 bp, Homo sapiens
ttgcagccggcacagggtct

SEQ ID NO: 170913 - DNA, 13 bp, Homo sapiens
ttgcatcaatttt

SEQ ID NO: 170914 - DNA, 13 bp, Homo sapiens
ttgcatctgtata

SEQ ID NO: 170915 - DNA, 14 bp, Homo sapiens
ttgcatctgtataa

SEQ ID NO: 170916 - DNA, 14 bp, Homo sapiens
ttgccactgcctct

SEQ ID NO: 170917 - DNA, 15 bp, Homo sapiens
ttgccactgcctctt

SEQ ID NO: 170918 - DNA, 16 bp, Homo sapiens
ttgcccagagatgcct

SEQ ID NO: 170919 - DNA, 17 bp, Homo sapiens
ttgcccagagatgcctc

SEQ ID NO: 170920 - DNA, 18 bp, Homo sapiens
ttgcccagagatgcctcc

SEQ ID NO: 170921 - DNA, 15 bp, Homo sapiens
ttgcccatccatctg

SEQ ID NO: 170922 - DNA, 19 bp, Homo sapiens
ttgcgttagaatgaggagg

SEQ ID NO: 170923 - DNA, 13 bp, Homo sapiens
ttgctccgcctct

SEQ ID NO: 170924 - DNA, 12 bp, Homo sapiens
ttgctccttgac

SEQ ID NO: 170925 - DNA, 21 bp, Homo sapiens
ttgctctcccctgccctgctg

SEQ ID NO: 170926 - DNA, 15 bp, Homo sapiens
ttgctgattcttgag

SEQ ID NO: 170927 - DNA, 19 bp, Homo sapiens
ttgctgccccatcagtgct

SEQ ID NO: 170928 - DNA, 16 bp, Homo sapiens
tctgccggccctgggg

SEQ ID NO: 170929 - DNA, 17 bp, Homo sapiens
tctgccggccctggggc

SEQ ID NO: 170930 - DNA, 16 bp, Homo sapiens
tctgcctcaatgtgaa

SEQ ID NO: 170931 - DNA, 16 bp, Homo sapiens
tctgcctctgcctgca

SEQ ID NO: 170932 - DNA, 14 bp, Homo sapiens
tctgcctcttctgg

SEQ ID NO: 170933 - DNA, 18 bp, Homo sapiens
tctgcctcttctgggagg

SEQ ID NO: 170934 - DNA, 19 bp, Homo sapiens
tctgcctcttctgggaggg

SEQ ID NO: 170935 - DNA, 15 bp, Homo sapiens
tctgcggaccccagc

SEQ ID NO: 170936 - DNA, 17 bp, Homo sapiens
tctgcgtcatgcttgtg

SEQ ID NO: 170937 - DNA, 15 bp, Homo sapiens
tctgcgtgtcacctg

SEQ ID NO: 170938 - DNA, 20 bp, Homo sapiens
tctgcgtgtcacctgtgctt

SEQ ID NO: 170939 - DNA, 21 bp, Homo sapiens
tctgctaacttggagccccag

SEQ ID NO: 170940 - DNA, 17 bp, Homo sapiens
tctgctacctcactggg

SEQ ID NO: 170941 - DNA, 14 bp, Homo sapiens
tctgctcatcattc

SEQ ID NO: 170942 - DNA, 15 bp, Homo sapiens
tctgctcatcattct

SEQ ID NO: 170943 - DNA, 23 bp, Homo sapiens
tctgctcatcattctctgtctca

SEQ ID NO: 170944 - DNA, 19 bp, Homo sapiens
tctgcttacaattccctgc

SEQ ID NO: 170945 - DNA, 18 bp, Homo sapiens
tctgctttgactgagcag

SEQ ID NO: 170946 - DNA, 16 bp, Homo sapiens
tctggactcctctgtc

SEQ ID NO: 170947 - DNA, 11 bp, Homo sapiens
tctggagaagc

SEQ ID NO: 170948 - DNA, 16 bp, Homo sapiens
tctggagacagcccca

SEQ ID NO: 170949 - DNA, 12 bp, Homo sapiens
tctggagagaaa

SEQ ID NO: 170950 - DNA, 21 bp, Homo sapiens
tctggagtctcacttgtctca

SEQ ID NO: 170951 - DNA, 19 bp, Homo sapiens
tctggcagggtgggatgga

SEQ ID NO: 170952 - DNA, 19 bp, Homo sapiens
tctggccctcacccctgcc

SEQ ID NO: 170953 - DNA, 15 bp, Homo sapiens
tctggccctgccttc

SEQ ID NO: 170954 - DNA, 16 bp, Homo sapiens
tctggccctgccttct

SEQ ID NO: 170955 - DNA, 18 bp, Homo sapiens
tctggggttcagcccctc

SEQ ID NO: 170956 - DNA, 18 bp, Homo sapiens
tctgggtgctccctacca

SEQ ID NO: 170957 - DNA, 20 bp, Homo sapiens
tctggtagatttttaacgaa

SEQ ID NO: 170958 - DNA, 15 bp, Homo sapiens
tctggttttaacaat

SEQ ID NO: 170959 - DNA, 17 bp, Homo sapiens
tctgtataagtaagaaa

SEQ ID NO: 170960 - DNA, 15 bp, Homo sapiens
tctgtatatacaata

SEQ ID NO: 170961 - DNA, 19 bp, Homo sapiens
tctgtcaccaattggttaa

SEQ ID NO: 170962 - DNA, 19 bp, Homo sapiens
tctgtccagggccctgagc

SEQ ID NO: 170963 - DNA, 20 bp, Homo sapiens
tctgtccagggccctgagct

SEQ ID NO: 170964 - DNA, 17 bp, Homo sapiens
tctgtgaacgatttaga

SEQ ID NO: 170965 - DNA, 15 bp, Homo sapiens
tctgtgaattcagat

SEQ ID NO: 170966 - DNA, 18 bp, Homo sapiens
tctgtgaccaatgtcttg

SEQ ID NO: 170967 - DNA, 13 bp, Homo sapiens
tctgtgtgaaaat

SEQ ID NO: 170968 - DNA, 18 bp, Homo sapiens
tcttaaaaaataaaaact

SEQ ID NO: 170969 - DNA, 20 bp, Homo sapiens
tcttaaagctgcctgtagtt

SEQ ID NO: 170970 - DNA, 21 bp, Homo sapiens
tcttaaagctgcctgtagtta

SEQ ID NO: 170971 - DNA, 15 bp, Homo sapiens
tcttaagacttttgg

SEQ ID NO: 170972 - DNA, 19 bp, Homo sapiens
tcttaatataactgcctta

SEQ ID NO: 170973 - DNA, 19 bp, Homo sapiens
tcttacaggcacaaaatga

SEQ ID NO: 170974 - DNA, 18 bp, Homo sapiens
tcttagacttctgctttc

SEQ ID NO: 170975 - DNA, 15 bp, Homo sapiens
tcttatacatttgat

SEQ ID NO: 170976 - DNA, 19 bp, Homo sapiens
tcttatagaatatttatta

SEQ ID NO: 170977 - DNA, 20 bp, Homo sapiens
tcttatagaatatttattac

SEQ ID NO: 170978 - DNA, 18 bp, Homo sapiens
tcttatgtatgtgaaagt

SEQ ID NO: 170979 - DNA, 15 bp, Homo sapiens
tcttcacaacagatt

SEQ ID NO: 170980 - DNA, 22 bp, Homo sapiens
tcttcatactttttttcacagt

SEQ ID NO: 170981 - DNA, 19 bp, Homo sapiens
tcttcatccggcagcctgg

SEQ ID NO: 170982 - DNA, 21 bp, Homo sapiens
tcttcattaagccctcttcca

SEQ ID NO: 170983 - DNA, 15 bp, Homo sapiens
tcttccaggtgccca

SEQ ID NO: 170984 - DNA, 16 bp, Homo sapiens
tcttccatcccaggac

SEQ ID NO: 170985 - DNA, 19 bp, Homo sapiens
tcttcccgaaccccaagga

SEQ ID NO: 170986 - DNA, 19 bp, Homo sapiens
tcttccctacagttgaaaa

SEQ ID NO: 170987 - DNA, 19 bp, Homo sapiens
tcttcggggaactcctgga

SEQ ID NO: 170988 - DNA, 17 bp, Homo sapiens
tcttctaggttctaaaa

SEQ ID NO: 170989 - DNA, 16 bp, Homo sapiens
tcttctattttattcc

SEQ ID NO: 170990 - DNA, 12 bp, Homo sapiens
tcttctccactg

SEQ ID NO: 170991 - DNA, 16 bp, Homo sapiens
tcttctccactggatg

SEQ ID NO: 170992 - DNA, 16 bp, Homo sapiens
tcttctcctatgtgta

SEQ ID NO: 170993 - DNA, 13 bp, Homo sapiens
tcttctcctttca

SEQ ID NO: 170994 - DNA, 14 bp, Homo sapiens
tcttctcctttcac

SEQ ID NO: 170995 - DNA, 20 bp, Homo sapiens
tcttctctctcaattttatc

SEQ ID NO: 170996 - DNA, 20 bp, Homo sapiens
tcttctgggagggcagcagg

SEQ ID NO: 170997 - DNA, 15 bp, Homo sapiens
tcttcttttgtgaag

SEQ ID NO: 170998 - DNA, 18 bp, Homo sapiens
tcttctttttttgtgatg

SEQ ID NO: 170999 - DNA, 19 bp, Homo sapiens
tcttgaaggaaaatgatac

SEQ ID NO: 171000 - DNA, 16 bp, Homo sapiens
tcttgagcctgggagg

SEQ ID NO: 171001 - DNA, 13 bp, Homo sapiens
tcttgatgcatgc

SEQ ID NO: 171002 - DNA, 14 bp, Homo sapiens
tcttgcaggtctca

SEQ ID NO: 171003 - DNA, 20 bp, Homo sapiens
tcttgcaggtctcaaccctt

SEQ ID NO: 171004 - DNA, 23 bp, Homo sapiens
tcttgcatggcaaggactgcagg

SEQ ID NO: 171005 - DNA, 16 bp, Homo sapiens
tcttgccactgcctct

SEQ ID NO: 171006 - DNA, 19 bp, Homo sapiens
tcttggcttactgcagcct

SEQ ID NO: 171007 - DNA, 15 bp, Homo sapiens
tcttggtttccttcc

SEQ ID NO: 171008 - DNA, 19 bp, Homo sapiens
tcttgtaatccgaatctct

SEQ ID NO: 171009 - DNA, 22 bp, Homo sapiens
tcttgtgtttccacagcctgca

SEQ ID NO: 171010 - DNA, 15 bp, Homo sapiens
tctttaactcataaa

SEQ ID NO: 171011 - DNA, 11 bp, Homo sapiens
tctttcaaaac

SEQ ID NO: 171012 - DNA, 20 bp, Homo sapiens
tctttcacacttccaccagc

SEQ ID NO: 171013 - DNA, 23 bp, Homo sapiens
tctttcacacttccaccagcctg

SEQ ID NO: 171014 - DNA, 23 bp, Homo sapiens
tctttccacggagccactcctct

SEQ ID NO: 171015 - DNA, 18 bp, Homo sapiens
tctttctaatgtgtgaat

SEQ ID NO: 171016 - DNA, 16 bp, Homo sapiens
tctttgaatgacaaag

SEQ ID NO: 171017 - DNA, 14 bp, Homo sapiens
tctttgaatgcttt

SEQ ID NO: 171018 - DNA, 14 bp, Homo sapiens
tctttgggaatgtt

SEQ ID NO: 171019 - DNA, 18 bp, Homo sapiens
tctttgggaatgtttgtc

SEQ ID NO: 171020 - DNA, 14 bp, Homo sapiens
tcttttaaaagaca

SEQ ID NO: 171021 - DNA, 22 bp, Homo sapiens
tcttttataactagtcctttac

SEQ ID NO: 171022 - DNA, 22 bp, Homo sapiens
tcttttcgccgtggctgcggca

SEQ ID NO: 171023 - DNA, 19 bp, Homo sapiens
tcttttgaatccatgcttg

SEQ ID NO: 171024 - DNA, 20 bp, Homo sapiens
tcttttgaatccatgcttgg

SEQ ID NO: 171025 - DNA, 21 bp, Homo sapiens
tcttttgcccttcacagtgtt

SEQ ID NO: 171026 - DNA, 11 bp, Homo sapiens
tcttttgtatg

SEQ ID NO: 171027 - DNA, 12 bp, Homo sapiens
tctttttcagtt

SEQ ID NO: 171028 - DNA, 16 bp, Homo sapiens
tctttttttgtgatgt

SEQ ID NO: 171029 - DNA, 16 bp, Homo sapiens
tgaaaaaaagtttaca

SEQ ID NO: 171030 - DNA, 22 bp, Homo sapiens
tgaaaaaatagagcctgaggga

SEQ ID NO: 171031 - DNA, 16 bp, Homo sapiens
tgaaaaaggaggaaga

SEQ ID NO: 171032 - DNA, 20 bp, Homo sapiens
tgatttttagatgagattgt

SEQ ID NO: 171033 - DNA, 13 bp, Homo sapiens
tgatttttttcca

SEQ ID NO: 171034 - DNA, 23 bp, Homo sapiens
tgcaaaaggttcactaaagcagt

SEQ ID NO: 171035 - DNA, 21 bp, Homo sapiens
tgcaaaatgaggaatgtatat

SEQ ID NO: 171036 - DNA, 21 bp, Homo sapiens
tgcaaaatttgatgccaggac

SEQ ID NO: 171037 - DNA, 22 bp, Homo sapiens
tgctggagaagagaggagagga

SEQ ID NO: 171038 - DNA, 14 bp, Homo sapiens
tgctggaggtggga

SEQ ID NO: 171039 - DNA, 16 bp, Homo sapiens
tgctggaggtgggagc

SEQ ID NO: 171040 - DNA, 19 bp, Homo sapiens
tgctggatggagcccaggc

SEQ ID NO: 171041 - DNA, 18 bp, Homo sapiens
tgctggcacatttcccca

SEQ ID NO: 171042 - DNA, 15 bp, Homo sapiens
tgctggctgccttag

SEQ ID NO: 171043 - DNA, 15 bp, Homo sapiens
tgctgggctctccac

SEQ ID NO: 171044 - DNA, 20 bp, Homo sapiens
tgctgggctctccacctcag

SEQ ID NO: 171045 - DNA, 22 bp, Homo sapiens
tgctgggctctccacctcagcc

SEQ ID NO: 171046 - DNA, 23 bp, Homo sapiens
tgctgggctctccacctcagcct

SEQ ID NO: 171047 - DNA, 14 bp, Homo sapiens
tggctgtgtctaaa

SEQ ID NO: 171048 - DNA, 15 bp, Homo sapiens
tggctgtgtctaaac

SEQ ID NO: 171049 - DNA, 18 bp, Homo sapiens
tggctgttggcagtgagt

SEQ ID NO: 171050 - DNA, 23 bp, Homo sapiens
tggcttactacatgtgggagctt

SEQ ID NO: 171051 - DNA, 14 bp, Homo sapiens
tggcttcacggaag

SEQ ID NO: 171052 - DNA, 17 bp, Homo sapiens
tggcttcacggaagagc

SEQ ID NO: 171053 - DNA, 22 bp, Homo sapiens
tggcttcacggaagagccttgc

SEQ ID NO: 171054 - DNA, 15 bp, Homo sapiens
tggcttcccgctcag

SEQ ID NO: 171055 - DNA, 21 bp, Homo sapiens
tggcttctcatacgtccacca

SEQ ID NO: 171056 - DNA, 22 bp, Homo sapiens
tggcttctcatacgtccaccat

SEQ ID NO: 171057 - DNA, 14 bp, Homo sapiens
tggcttttcactgc

SEQ ID NO: 171058 - DNA, 15 bp, Homo sapiens
tggcttttcactgct

SEQ ID NO: 171059 - DNA, 16 bp, Homo sapiens
tggcttttcactgctg

SEQ ID NO: 171060 - DNA, 22 bp, Homo sapiens
tggcttttcactgctggctgcc

SEQ ID NO: 171061 - DNA, 22 bp, Homo sapiens
tgggaaccccttcatcctctga

SEQ ID NO: 171062 - DNA, 16 bp, Homo sapiens
tgggaacgtgactgcc

SEQ ID NO: 171063 - DNA, 21 bp, Homo sapiens
tgggaagggagagcggggcag

SEQ ID NO: 171064 - DNA, 18 bp, Homo sapiens
tgggactgctgcttctta

SEQ ID NO: 171065 - DNA, 21 bp, Homo sapiens
tgggaggattgcttgagctca

SEQ ID NO: 171066 - DNA, 16 bp, Homo sapiens
tgggaggcatggccct

SEQ ID NO: 171067 - DNA, 20 bp, Homo sapiens
tgggaggccccactggggaa

SEQ ID NO: 171068 - DNA, 18 bp, Homo sapiens
tgggagggatagaggggg

SEQ ID NO: 171069 - DNA, 14 bp, Homo sapiens
tgggagggcagcag

SEQ ID NO: 171070 - DNA, 19 bp, Homo sapiens
tgggagggcagcagggcta

SEQ ID NO: 171071 - DNA, 20 bp, Homo sapiens
tgggaggggcgcccacctcc

SEQ ID NO: 171072 - DNA, 17 bp, Homo sapiens
tgggaggtcaaggctgc

SEQ ID NO: 171073 - DNA, 23 bp, Homo sapiens
tgggaggtcaaggctgcagtgag

SEQ ID NO: 171074 - DNA, 14 bp, Homo sapiens
tgggatggaggaga

SEQ ID NO: 171075 - DNA, 16 bp, Homo sapiens
tgggatggtggagggc

SEQ ID NO: 171076 - DNA, 18 bp, Homo sapiens
tgggatggtggagggcca

SEQ ID NO: 171077 - DNA, 17 bp, Homo sapiens
tgggattctactttaag

SEQ ID NO: 171078 - DNA, 16 bp, Homo sapiens
tgggcactgggatgag

SEQ ID NO: 171079 - DNA, 23 bp, Homo sapiens
tgggcaggaagtgaagagatcct

SEQ ID NO: 171080 - DNA, 16 bp, Homo sapiens
tgggcatactaataaa

SEQ ID NO: 171081 - DNA, 17 bp, Homo sapiens
tgggcattgatggggaa

SEQ ID NO: 171082 - DNA, 20 bp, Homo sapiens
tgggccaagtcaaagacatt

SEQ ID NO: 171083 - DNA, 17 bp, Homo sapiens
tgggccccaccacctag

SEQ ID NO: 171084 - DNA, 23 bp, Homo sapiens
tgggccccaccacctaggccact

SEQ ID NO: 171085 - DNA, 13 bp, Homo sapiens
tgggcggcagaga

SEQ ID NO: 171086 - DNA, 17 bp, Homo sapiens
tgggctaattaaataaa

SEQ ID NO: 171087 - DNA, 11 bp, Homo sapiens
tgggctccctg

SEQ ID NO: 171088 - DNA, 15 bp, Homo sapiens
tgggctccctgactg

SEQ ID NO: 171089 - DNA, 17 bp, Homo sapiens
tgggctcccttgtgcgt

SEQ ID NO: 171090 - DNA, 14 bp, Homo sapiens
tgggctctccacct

SEQ ID NO: 171091 - DNA, 19 bp, Homo sapiens
tgggctctccacctcagcc

SEQ ID NO: 171092 - DNA, 21 bp, Homo sapiens
tgggctctccacctcagcctt

SEQ ID NO: 171093 - DNA, 23 bp, Homo sapiens
tgggctctccacctcagccttgg

SEQ ID NO: 171094 - DNA, 16 bp, Homo sapiens
tgggctgccctggtgc

SEQ ID NO: 171095 - DNA, 17 bp, Homo sapiens
tggggaagactgtggct

SEQ ID NO: 171096 - DNA, 24 bp, Homo sapiens
tggggaagactgtggctgctagca

SEQ ID NO: 171097 - DNA, 17 bp, Homo sapiens
tggggacagagcagaac

SEQ ID NO: 171098 - DNA, 13 bp, Homo sapiens
tggggcagcacag

SEQ ID NO: 171099 - DNA, 12 bp, Homo sapiens
tggggcaggcag

SEQ ID NO: 171100 - DNA, 14 bp, Homo sapiens
tggggcaggcagtg

SEQ ID NO: 171101 - DNA, 14 bp, Homo sapiens
tggggccttggcct

SEQ ID NO: 171102 - DNA, 16 bp, Homo sapiens
tggggctgctcctcca

SEQ ID NO: 171103 - DNA, 21 bp, Homo sapiens
tggggctgctcctccagggcc

SEQ ID NO: 171104 - DNA, 15 bp, Homo sapiens
tggggcttctcctga

SEQ ID NO: 171105 - DNA, 16 bp, Homo sapiens
tggggcttctcctgac

SEQ ID NO: 171106 - DNA, 16 bp, Homo sapiens
tgggggaagccctgga

SEQ ID NO: 171107 - DNA, 21 bp, Homo sapiens
tgggggatcacagcctctgaa

SEQ ID NO: 171108 - DNA, 16 bp, Homo sapiens
tgggggcagagggcag

SEQ ID NO: 171109 - DNA, 17 bp, Homo sapiens
tgggggcagagggcaga

SEQ ID NO: 171110 - DNA, 14 bp, Homo sapiens
tgggggctggcctc

SEQ ID NO: 171111 - DNA, 19 bp, Homo sapiens
tgggggttctttcttcctc

SEQ ID NO: 171112 - DNA, 18 bp, Homo sapiens
tggggtagctagaggaac

SEQ ID NO: 171113 - DNA, 15 bp, Homo sapiens
tgggtatattcattt

SEQ ID NO: 171114 - DNA, 14 bp, Homo sapiens
tgggtgacagagca

SEQ ID NO: 171115 - DNA, 18 bp, Homo sapiens
tgggtgagatgctggaga

SEQ ID NO: 171116 - DNA, 19 bp, Homo sapiens
tgggtgagatgctggagaa

SEQ ID NO: 171117 - DNA, 17 bp, Homo sapiens
tgggtggcaccagcagc

SEQ ID NO: 171118 - DNA, 21 bp, Homo sapiens
tgggtggcaccagcagcctgg

SEQ ID NO: 171119 - DNA, 23 bp, Homo sapiens
tgggtgtaacaggtctcctctta

SEQ ID NO: 171120 - DNA, 16 bp, Homo sapiens
tgggttggtgcttcta

SEQ ID NO: 171121 - DNA, 17 bp, Homo sapiens
tggtagcttttcccttc

SEQ ID NO: 171122 - DNA, 20 bp, Homo sapiens
tggtagcttttcccttcttt

SEQ ID NO: 171123 - DNA, 17 bp, Homo sapiens
tggtagggacttaaaaa

SEQ ID NO: 171124 - DNA, 21 bp, Homo sapiens
tggtatgtgacatgcgggctg

SEQ ID NO: 171125 - DNA, 19 bp, Homo sapiens
tggtattcaggattacatg

SEQ ID NO: 171126 - DNA, 22 bp, Homo sapiens
tggtcacaggactctgcctcct

SEQ ID NO: 171127 - DNA, 22 bp, Homo sapiens
tggtcagccctagggtggagag

SEQ ID NO: 171128 - DNA, 15 bp, Homo sapiens
tggtccagcttgctc

SEQ ID NO: 171129 - DNA, 21 bp, Homo sapiens
tggtccagggctagtgacttg

SEQ ID NO: 171130 - DNA, 20 bp, Homo sapiens
tggtcctgagggtccccacc

SEQ ID NO: 171131 - DNA, 15 bp, Homo sapiens
tggtctgcaggcagg

SEQ ID NO: 171132 - DNA, 20 bp, Homo sapiens
tggtcttggcagcacctgtc

SEQ ID NO: 171133 - DNA, 18 bp, Homo sapiens
tggtgaaatttattagtt

SEQ ID NO: 171134 - DNA, 19 bp, Homo sapiens
tggtgaaatttattagtta

SEQ ID NO: 171135 - DNA, 21 bp, Homo sapiens
tggtggcctctgccccgtctc

SEQ ID NO: 171136 - DNA, 21 bp, Homo sapiens
tggtgggaagcgtctgtccgt

SEQ ID NO: 171137 - DNA, 18 bp, Homo sapiens
tggtgggggcctcggtgt

SEQ ID NO: 171138 - DNA, 17 bp, Homo sapiens
tggtgggtccatgggca

SEQ ID NO: 171139 - DNA, 18 bp, Homo sapiens
tggtgggtccatgggcag

SEQ ID NO: 171140 - DNA, 23 bp, Homo sapiens
tggtgtatcccccccctgtatag

SEQ ID NO: 171141 - DNA, 17 bp, Homo sapiens
tggtgtccacctggccc

SEQ ID NO: 171142 - DNA, 18 bp, Homo sapiens
tggtgtgatcgtctgact

SEQ ID NO: 171143 - DNA, 13 bp, Homo sapiens
tggtgttgcagaa

SEQ ID NO: 171144 - DNA, 11 bp, Homo sapiens
tggttcccctg

SEQ ID NO: 171145 - DNA, 18 bp, Homo sapiens
tggttcccctgttcactc

SEQ ID NO: 171146 - DNA, 12 bp, Homo sapiens
tggttgaggaaa

SEQ ID NO: 171147 - DNA, 22 bp, Homo sapiens
tggttgaggtggaagccctcct

SEQ ID NO: 171148 - DNA, 11 bp, Homo sapiens
tggtttatgtc

SEQ ID NO: 171149 - DNA, 14 bp, Homo sapiens
tggtttgcagatga

SEQ ID NO: 171150 - DNA, 17 bp, Homo sapiens
tggtttgcagatgacaa

SEQ ID NO: 171151 - DNA, 18 bp, Homo sapiens
tggttttaacaatttcct

SEQ ID NO: 171152 - DNA, 23 bp, Homo sapiens
tggtttttaaaaaactgctgact

SEQ ID NO: 171153 - DNA, 23 bp, Homo sapiens
tgtaaaacaaaaatgtaatgatc

SEQ ID NO: 171154 - DNA, 18 bp, Homo sapiens
tgtaaaataagaatgatt

SEQ ID NO: 171155 - DNA, 14 bp, Homo sapiens
tgtaaaatagcttg

SEQ ID NO: 171156 - DNA, 11 bp, Homo sapiens
tgtaaaatata

SEQ ID NO: 171157 - DNA, 19 bp, Homo sapiens
tgtaaaatatagctgtaca

SEQ ID NO: 171158 - DNA, 21 bp, Homo sapiens
tgtaaaatcttggcacagaaa

SEQ ID NO: 171159 - DNA, 17 bp, Homo sapiens
tgtaaacagtgcctgct

SEQ ID NO: 171160 - DNA, 13 bp, Homo sapiens
tttagttatagtt

SEQ ID NO: 171161 - DNA, 23 bp, Homo sapiens
tttataaaagaataaaattgcac

SEQ ID NO: 171162 - DNA, 19 bp, Homo sapiens
tttataactcatcataaaa

SEQ ID NO: 171163 - DNA, 22 bp, Homo sapiens
tttataactcatcataaaataa

SEQ ID NO: 171164 - DNA, 12 bp, Homo sapiens
tttatatattta

SEQ ID NO: 171165 - DNA, 13 bp, Homo sapiens
tttatatatttat

SEQ ID NO: 171166 - DNA, 16 bp, Homo sapiens
tttatatatttataac

SEQ ID NO: 171167 - DNA, 17 bp, Homo sapiens
tttatatcccattttta

SEQ ID NO: 171168 - DNA, 13 bp, Homo sapiens
tttatctctattt

SEQ ID NO: 171169 - DNA, 18 bp, Homo sapiens
tttatgtctatttaagcc

SEQ ID NO: 171170 - DNA, 13 bp, Homo sapiens
tttatgttattta

SEQ ID NO: 171171 - DNA, 16 bp, Homo sapiens
tttattaaaatcttaa

SEQ ID NO: 171172 - DNA, 21 bp, Homo sapiens
tttattaaaatgattgtaaaa

SEQ ID NO: 171173 - DNA, 16 bp, Homo sapiens
tttattaataaacatt

SEQ ID NO: 171174 - DNA, 17 bp, Homo sapiens
tttattcaattcctctg

SEQ ID NO: 171175 - DNA, 16 bp, Homo sapiens
tttattctttttaaag

SEQ ID NO: 171176 - DNA, 14 bp, Homo sapiens
tttattgagaattt

SEQ ID NO: 171177 - DNA, 21 bp, Homo sapiens
tttattttcttttgtaaatgt

SEQ ID NO: 171178 - DNA, 12 bp, Homo sapiens
tttatttttcat

SEQ ID NO: 171179 - DNA, 14 bp, Homo sapiens
tttattttttaagt

SEQ ID NO: 171180 - DNA, 15 bp, Homo sapiens
tttattttttacatt

SEQ ID NO: 171181 - DNA, 20 bp, Homo sapiens
tttcaaaataaaaaccaaga

SEQ ID NO: 171182 - DNA, 17 bp, Homo sapiens
tttcaaagggagagaga

SEQ ID NO: 171183 - DNA, 21 bp, Homo sapiens
tttcaaattggagcttcatgg

SEQ ID NO: 171184 - DNA, 20 bp, Homo sapiens
tttcaacgcagccctgcttt

SEQ ID NO: 171185 - DNA, 21 bp, Homo sapiens
tttcaacgcagccctgctttg

SEQ ID NO: 171186 - DNA, 20 bp, Homo sapiens
tttcagaaatatgtggtttc

SEQ ID NO: 171187 - DNA, 10 bp, Homo sapiens
tttcagaccc

SEQ ID NO: 171188 - DNA, 16 bp, Homo sapiens
tttcaggaccttttga

SEQ ID NO: 171189 - DNA, 21 bp, Homo sapiens
tttcagttgatcactggcaat

SEQ ID NO: 171190 - DNA, 14 bp, Homo sapiens
tttcataagtattt

SEQ ID NO: 171191 - DNA, 19 bp, Homo sapiens
tttcataagtatttcaaat

SEQ ID NO: 171192 - DNA, 15 bp, Homo sapiens
tttcatatgctgtat

SEQ ID NO: 171193 - DNA, 16 bp, Homo sapiens
tttcatctcttgtata

SEQ ID NO: 171194 - DNA, 15 bp, Homo sapiens
tttccaaataaaatg

SEQ ID NO: 171195 - DNA, 22 bp, Homo sapiens
tttccacaagattcccagagac

SEQ ID NO: 171196 - DNA, 21 bp, Homo sapiens
tttccccaaagtcttaaaata

SEQ ID NO: 171197 - DNA, 20 bp, Homo sapiens
tttcccctgcccccagacct

SEQ ID NO: 171198 - DNA, 20 bp, Homo sapiens
tttccctaagccaagggcct

SEQ ID NO: 171199 - DNA, 19 bp, Homo sapiens
tttccctccactccttcct

SEQ ID NO: 171200 - DNA, 13 bp, Homo sapiens
tttccctgacctc

SEQ ID NO: 171201 - DNA, 22 bp, Homo sapiens
tttcctcaaaacttcagacata

SEQ ID NO: 171202 - DNA, 18 bp, Homo sapiens
tttccttggggcaggcag

SEQ ID NO: 171203 - DNA, 16 bp, Homo sapiens
tttcctttccccagcc

SEQ ID NO: 171204 - DNA, 17 bp, Homo sapiens
tttcctttccccagccc

SEQ ID NO: 171205 - DNA, 21 bp, Homo sapiens
tttccttttaaaacacttcca

SEQ ID NO: 171206 - DNA, 21 bp, Homo sapiens
tttcgtctgtttataaacatt

SEQ ID NO: 171207 - DNA, 15 bp, Homo sapiens
tttctagactttctg

SEQ ID NO: 171208 - DNA, 17 bp, Homo sapiens
tttctcccagtcattta

SEQ ID NO: 171209 - DNA, 18 bp, Homo sapiens
tttctcccagtcatttaa

SEQ ID NO: 171210 - DNA, 14 bp, Homo sapiens
tttctcctccatgg

SEQ ID NO: 171211 - DNA, 22 bp, Homo sapiens
tttctctaacttcaaggcccat

SEQ ID NO: 171212 - DNA, 19 bp, Homo sapiens
tttctgggctgtctattct

SEQ ID NO: 171213 - DNA, 11 bp, Homo sapiens
tttctgtgtgc

SEQ ID NO: 171214 - DNA, 15 bp, Homo sapiens
tttctgttggtgtat

SEQ ID NO: 171215 - DNA, 22 bp, Homo sapiens
tttcttacaggcacaaaatgat

SEQ ID NO: 171216 - DNA, 20 bp, Homo sapiens
tttcttactgatttttaagt

SEQ ID NO: 171217 - DNA, 11 bp, Homo sapiens
tttcttcctct

SEQ ID NO: 171218 - DNA, 14 bp, Homo sapiens
tttcttcctctgct

SEQ ID NO: 171219 - DNA, 16 bp, Homo sapiens
tttcttttctctggta

SEQ ID NO: 171220 - DNA, 22 bp, Homo sapiens
tttcttttctggaatgtaatca

SEQ ID NO: 171221 - DNA, 18 bp, Homo sapiens
tttgaaattaacctctca

SEQ ID NO: 171222 - DNA, 11 bp, Homo sapiens
tttgaagtgta

SEQ ID NO: 171223 - DNA, 17 bp, Homo sapiens
tttgaatccatgcttgg

SEQ ID NO: 171224 - DNA, 20 bp, Homo sapiens
tttgaatgttatttgttatt

SEQ ID NO: 171225 - DNA, 14 bp, Homo sapiens
tttgagagttctaa

SEQ ID NO: 171226 - DNA, 16 bp, Homo sapiens
tttgagatcagcctgg

SEQ ID NO: 171227 - DNA, 19 bp, Homo sapiens
tttgagttattttaattat

SEQ ID NO: 171228 - DNA, 12 bp, Homo sapiens
tttgagttctac

SEQ ID NO: 171229 - DNA, 20 bp, Homo sapiens
tttgcaagggaaaagtctct

SEQ ID NO: 171230 - DNA, 18 bp, Homo sapiens
tttgcactgatatatcat

SEQ ID NO: 171231 - DNA, 20 bp, Homo sapiens
tttgcagaaaagcacctgcc

SEQ ID NO: 171232 - DNA, 16 bp, Homo sapiens
tttgcataacaattcc

SEQ ID NO: 171233 - DNA, 20 bp, Homo sapiens
tttgcataacaattcctcta

SEQ ID NO: 171234 - DNA, 21 bp, Homo sapiens
tttgcatagattccctgagca

SEQ ID NO: 171235 - DNA, 23 bp, Homo sapiens
tttgcatagtaccaatcatttta

SEQ ID NO: 171236 - DNA, 14 bp, Homo sapiens
tttgcattcctaca

SEQ ID NO: 171237 - DNA, 20 bp, Homo sapiens
tttgcctcttttctctgtgc

SEQ ID NO: 171238 - DNA, 13 bp, Homo sapiens
tttgctagttttt

SEQ ID NO: 171239 - DNA, 16 bp, Homo sapiens
tttgctcacctggggt

SEQ ID NO: 171240 - DNA, 10 bp, Homo sapiens
tttgctgcca

SEQ ID NO: 171241 - DNA, 21 bp, Homo sapiens
tttgctgtgaggctgtcctgt

SEQ ID NO: 171242 - DNA, 13 bp, Homo sapiens
tttggctgtgtct

SEQ ID NO: 171243 - DNA, 15 bp, Homo sapiens
tttggctgtgtctaa

SEQ ID NO: 171244 - DNA, 14 bp, Homo sapiens
tttgggctgccctg

SEQ ID NO: 171245 - DNA, 19 bp, Homo sapiens
tttgtaggggtcaaagaaa

SEQ ID NO: 171246 - DNA, 23 bp, Homo sapiens
tttgtaggggtcaaagaaatgct

SEQ ID NO: 171247 - DNA, 18 bp, Homo sapiens
tttgtataacttcttaaa

SEQ ID NO: 171248 - DNA, 16 bp, Homo sapiens
tttgtatgcactttgt

SEQ ID NO: 171249 - DNA, 17 bp, Homo sapiens
tttgtatgtaaatgtgc

SEQ ID NO: 171250 - DNA, 17 bp, Homo sapiens
tttgtatttttttgcaa

SEQ ID NO: 171251 - DNA, 15 bp, Homo sapiens
tttgtctaaaatgcc

SEQ ID NO: 171252 - DNA, 19 bp, Homo sapiens
tttgtctcatcccattctg

SEQ ID NO: 171253 - DNA, 23 bp, Homo sapiens
tttgtcttaaaaagtggaaaaat

SEQ ID NO: 171254 - DNA, 22 bp, Homo sapiens
tttgtggtacgacctttagatt

SEQ ID NO: 171255 - DNA, 19 bp, Homo sapiens
tttgtgtaatagaaaactg

SEQ ID NO: 171256 - DNA, 21 bp, Homo sapiens
tttgtgtcatgtttaagaaat

SEQ ID NO: 171257 - DNA, 15 bp, Homo sapiens
tttgttattttgcaa

SEQ ID NO: 171258 - DNA, 16 bp, Homo sapiens
tttgttattttgcaac

SEQ ID NO: 171259 - DNA, 16 bp, Homo sapiens
tttgttctagttttca

SEQ ID NO: 171260 - DNA, 10 bp, Homo sapiens
tttgttgtta

SEQ ID NO: 171261 - DNA, 18 bp, Homo sapiens
ttttaaaaaactgctgac

SEQ ID NO: 171262 - DNA, 13 bp, Homo sapiens
ttttaaaacccag

SEQ ID NO: 171263 - DNA, 14 bp, Homo sapiens
ttttaaaagacaag

SEQ ID NO: 171264 - DNA, 22 bp, Homo sapiens
ttttaaagtatgttattgcata

SEQ ID NO: 171265 - DNA, 22 bp, Homo sapiens
ttttaagataaattataagtta

SEQ ID NO: 171266 - DNA, 12 bp, Homo sapiens
ttttaagctgtt

SEQ ID NO: 171267 - DNA, 23 bp, Homo sapiens
ttttaagggtttgtggaaaatga

SEQ ID NO: 171268 - DNA, 18 bp, Homo sapiens
ttttaagtatttatatat

SEQ ID NO: 171269 - DNA, 23 bp, Homo sapiens
ttttaatttatgagtttttgata

SEQ ID NO: 171270 - DNA, 12 bp, Homo sapiens
ttttacaataaa

SEQ ID NO: 171271 - DNA, 18 bp, Homo sapiens
ttttacaataaataatct

SEQ ID NO: 171272 - DNA, 19 bp, Homo sapiens
ttttagatgagattgtttt

SEQ ID NO: 171273 - DNA, 21 bp, Homo sapiens
ttttagcaatttatacaatat

SEQ ID NO: 171274 - DNA, 18 bp, Homo sapiens
ttttagtgattttaataa

SEQ ID NO: 171275 - DNA, 20 bp, Homo sapiens
ttttataactagtcctttac

SEQ ID NO: 171276 - DNA, 17 bp, Homo sapiens
ttttatcatgacatgtt

SEQ ID NO: 171277 - DNA, 19 bp, Homo sapiens
ttttatcatgacatgttat

SEQ ID NO: 171278 - DNA, 23 bp, Homo sapiens
ttttatctccccttcacatgcat

SEQ ID NO: 171279 - DNA, 12 bp, Homo sapiens
ttttattaataa

SEQ ID NO: 171280 - DNA, 19 bp, Homo sapiens
ttttattaataaacattct

SEQ ID NO: 171281 - DNA, 14 bp, Homo sapiens
ttttcaaaatggag

SEQ ID NO: 171282 - DNA, 14 bp, Homo sapiens
ttttcaatatttat

SEQ ID NO: 171283 - DNA, 17 bp, Homo sapiens
ttttcacggaagttttc

SEQ ID NO: 171284 - DNA, 16 bp, Homo sapiens
ttttcagaaaatatta

SEQ ID NO: 171285 - DNA, 12 bp, Homo sapiens
ttttcataataa

SEQ ID NO: 171286 - DNA, 18 bp, Homo sapiens
ttttcatacttttacctt

SEQ ID NO: 171287 - DNA, 22 bp, Homo sapiens
ttttccacaagattcccagaga

SEQ ID NO: 171288 - DNA, 18 bp, Homo sapiens
ttttccctattagagaag

SEQ ID NO: 171289 - DNA, 22 bp, Homo sapiens
ttttccctattagagaagagat

SEQ ID NO: 171290 - DNA, 20 bp, Homo sapiens
ttttcctaagtgattgtatg

SEQ ID NO: 171291 - DNA, 13 bp, Homo sapiens
ttttctagacttt

SEQ ID NO: 171292 - DNA, 12 bp, Homo sapiens
ttttctcagctg

SEQ ID NO: 171293 - DNA, 14 bp, Homo sapiens
ttttctctggtaat

SEQ ID NO: 171294 - DNA, 15 bp, Homo sapiens
ttttctgagaaagac

SEQ ID NO: 171295 - DNA, 18 bp, Homo sapiens
ttttctgagaaagactat

SEQ ID NO: 171296 - DNA, 13 bp, Homo sapiens
ttttcttacataa

SEQ ID NO: 171297 - DNA, 14 bp, Homo sapiens
ttttctttgaaatt

SEQ ID NO: 171298 - DNA, 13 bp, Homo sapiens
ttttcttttctat

SEQ ID NO: 171299 - DNA, 17 bp, Homo sapiens
ttattcatttaaaatga

SEQ ID NO: 171300 - DNA, 22 bp, Homo sapiens
ttattcctatatagtttattga

SEQ ID NO: 171301 - DNA, 21 bp, Homo sapiens
ttattcctgataataattgat

SEQ ID NO: 171302 - DNA, 22 bp, Homo sapiens
ttattgacaataatttcaggtt

SEQ ID NO: 171303 - DNA, 16 bp, Homo sapiens
ttattgagaaagagca

SEQ ID NO: 171304 - DNA, 13 bp, Homo sapiens
ttattgagaattt

SEQ ID NO: 171305 - DNA, 12 bp, Homo sapiens
ttattgctgttg

SEQ ID NO: 171306 - DNA, 12 bp, Homo sapiens
ttattgtacctc

SEQ ID NO: 171307 - DNA, 14 bp, Homo sapiens
ttattgtacctctc

SEQ ID NO: 171308 - DNA, 22 bp, Homo sapiens
ttattgtataaactatcagttt

SEQ ID NO: 171309 - DNA, 17 bp, Homo sapiens
ttattgtttaaaatcat

SEQ ID NO: 171310 - DNA, 16 bp, Homo sapiens
ttatttagttccttga

SEQ ID NO: 171311 - DNA, 14 bp, Homo sapiens
ttatttatgcctct

SEQ ID NO: 171312 - DNA, 15 bp, Homo sapiens
ttatttcatgaaaat

SEQ ID NO: 171313 - DNA, 18 bp, Homo sapiens
ttatttgttattttcagt

SEQ ID NO: 171314 - DNA, 14 bp, Homo sapiens
ttattttcacctgt

SEQ ID NO: 171315 - DNA, 14 bp, Homo sapiens
ttattttcagtatt

SEQ ID NO: 171316 - DNA, 22 bp, Homo sapiens
ttatttttctaaggttctcata

SEQ ID NO: 171317 - DNA, 14 bp, Homo sapiens
ttattttttaatta

SEQ ID NO: 171318 - DNA, 13 bp, Homo sapiens
ttattttttattg

SEQ ID NO: 171319 - DNA, 21 bp, Homo sapiens
ttcaaaaagtctacgctctcc

SEQ ID NO: 171320 - DNA, 17 bp, Homo sapiens
ttcaaaaccttttgaaa

SEQ ID NO: 171321 - DNA, 16 bp, Homo sapiens
ttcaaaatggagggaa

SEQ ID NO: 171322 - DNA, 14 bp, Homo sapiens
ttcaacgcagccct

SEQ ID NO: 171323 - DNA, 16 bp, Homo sapiens
ttcaactcagactagt

SEQ ID NO: 171324 - DNA, 22 bp, Homo sapiens
ttcaaggtggccaaattatttg

SEQ ID NO: 171325 - DNA, 20 bp, Homo sapiens
ttcaataagcatcaaactct

SEQ ID NO: 171326 - DNA, 15 bp, Homo sapiens
ttcaattgcatctcc

SEQ ID NO: 171327 - DNA, 17 bp, Homo sapiens
ttcaattgcatctccca

SEQ ID NO: 171328 - DNA, 19 bp, Homo sapiens
ttcaattgcatctcccaga

SEQ ID NO: 171329 - DNA, 13 bp, Homo sapiens
ttcacaatagaaa

SEQ ID NO: 171330 - DNA, 20 bp, Homo sapiens
ttcacaatgaaatgctctcc

SEQ ID NO: 171331 - DNA, 12 bp, Homo sapiens
ttcacagtgttt

SEQ ID NO: 171332 - DNA, 15 bp, Homo sapiens
ttcacataccctccc

SEQ ID NO: 171333 - DNA, 23 bp, Homo sapiens
ttcaccccccactcaccagtgtc

SEQ ID NO: 171334 - DNA, 21 bp, Homo sapiens
ttcacctgtttttaagctgtt

SEQ ID NO: 171335 - DNA, 22 bp, Homo sapiens
ttcacctgtttttaagctgttt

SEQ ID NO: 171336 - DNA, 23 bp, Homo sapiens
ttcaccttcgtttactatgcctg

SEQ ID NO: 171337 - DNA, 16 bp, Homo sapiens
ttcaccttgggatgat

SEQ ID NO: 171338 - DNA, 13 bp, Homo sapiens
ttcacggaagttt

SEQ ID NO: 171339 - DNA, 14 bp, Homo sapiens
ttcactaaagcagt

SEQ ID NO: 171340 - DNA, 13 bp, Homo sapiens
ttcactgctggct

SEQ ID NO: 171341 - DNA, 17 bp, Homo sapiens
ttcacttttgacaaagg

SEQ ID NO: 171342 - DNA, 20 bp, Homo sapiens
ttcacttttgacaaaggcaa

SEQ ID NO: 171343 - DNA, 20 bp, Homo sapiens
ttcagaagtttggcaatagt

SEQ ID NO: 171344 - DNA, 23 bp, Homo sapiens
ttcagaagtttggcaatagtttg

SEQ ID NO: 171345 - DNA, 20 bp, Homo sapiens
ttcagagactcagggcccca

SEQ ID NO: 171346 - DNA, 13 bp, Homo sapiens
ttcagcccctcct

SEQ ID NO: 171347 - DNA, 14 bp, Homo sapiens
ttcagcccctcctc

SEQ ID NO: 171348 - DNA, 15 bp, Homo sapiens
ttcagcccctcctct

SEQ ID NO: 171349 - DNA, 18 bp, Homo sapiens
ttcagcccctcctctgcc

SEQ ID NO: 171350 - DNA, 23 bp, Homo sapiens
ttcagcccctcctctgccacctc

SEQ ID NO: 171351 - DNA, 21 bp, Homo sapiens
ttcagcctagccgacctcagc

SEQ ID NO: 171352 - DNA, 18 bp, Homo sapiens
ttcagctcacacatgaga

SEQ ID NO: 171353 - DNA, 17 bp, Homo sapiens
ttcagctgacttttctg

SEQ ID NO: 171354 - DNA, 15 bp, Homo sapiens
ttcaggctcttctcc

SEQ ID NO: 171355 - DNA, 15 bp, Homo sapiens
ttcaggttttgtaaa

SEQ ID NO: 171356 - DNA, 19 bp, Homo sapiens
ttcaggttttgtaaagatg

SEQ ID NO: 171357 - DNA, 10 bp, Homo sapiens
ttcagtgccc

SEQ ID NO: 171358 - DNA, 14 bp, Homo sapiens
ttcagtgcccacca

SEQ ID NO: 171359 - DNA, 18 bp, Homo sapiens
ttcagtgttaaatgtgat

SEQ ID NO: 171360 - DNA, 19 bp, Homo sapiens
ttcagttggctgacttcca

SEQ ID NO: 171361 - DNA, 16 bp, Homo sapiens
ttcatatttacttctt

SEQ ID NO: 171362 - DNA, 21 bp, Homo sapiens
ttcatatttacttcttataca

SEQ ID NO: 171363 - DNA, 18 bp, Homo sapiens
ttcatcccatgatgtagt

SEQ ID NO: 171364 - DNA, 17 bp, Homo sapiens
ttcatctatttctgaga

SEQ ID NO: 171365 - DNA, 18 bp, Homo sapiens
ttcatctgttgttttgtt

SEQ ID NO: 171366 - DNA, 15 bp, Homo sapiens
ttcatgattttgaaa

SEQ ID NO: 171367 - DNA, 19 bp, Homo sapiens
ttcattaagccctcttcca

SEQ ID NO: 171368 - DNA, 22 bp, Homo sapiens
ttcattcatgtcatgtgtacaa

SEQ ID NO: 171369 - DNA, 13 bp, Homo sapiens
ttcattctcctgc

SEQ ID NO: 171370 - DNA, 13 bp, Homo sapiens
ttcatttaaaatg

SEQ ID NO: 171371 - DNA, 15 bp, Homo sapiens
aggcatggtggccca

SEQ ID NO: 171372 - DNA, 12 bp, Homo sapiens
aggcattcaagt

SEQ ID NO: 171373 - DNA, 18 bp, Homo sapiens
aggcattgccaagggctt

SEQ ID NO: 171374 - DNA, 20 bp, Homo sapiens
aggcattgccaagggctttg

SEQ ID NO: 171375 - DNA, 16 bp, Homo sapiens
aggccaaggtgggagg

SEQ ID NO: 171376 - DNA, 19 bp, Homo sapiens
aggccactcctccaaagga

SEQ ID NO: 171377 - DNA, 13 bp, Homo sapiens
aggccagccagtg

SEQ ID NO: 171378 - DNA, 17 bp, Homo sapiens
aggccagctggcagcag

SEQ ID NO: 171379 - DNA, 17 bp, Homo sapiens
aggccaggctccttcct

SEQ ID NO: 171380 - DNA, 13 bp, Homo sapiens
aggccattattgt

SEQ ID NO: 171381 - DNA, 14 bp, Homo sapiens
aggccccaggaagc

SEQ ID NO: 171382 - DNA, 15 bp, Homo sapiens
aggccccaggaagcc

SEQ ID NO: 171383 - DNA, 13 bp, Homo sapiens
aggcccggggctg

SEQ ID NO: 171384 - DNA, 14 bp, Homo sapiens
aggccctgtctgta

SEQ ID NO: 171385 - DNA, 18 bp, Homo sapiens
aggccgccccagcctctg

SEQ ID NO: 171386 - DNA, 19 bp, Homo sapiens
aggccgccccagcctctga

SEQ ID NO: 171387 - DNA, 17 bp, Homo sapiens
aggccgctgttcaccca

SEQ ID NO: 171388 - DNA, 20 bp, Homo sapiens
aggccgggtgctcagggctg

SEQ ID NO: 171389 - DNA, 13 bp, Homo sapiens
aggcctccctcaa

SEQ ID NO: 171390 - DNA, 15 bp, Homo sapiens
aggcctctgtgtcct

SEQ ID NO: 171391 - DNA, 20 bp, Homo sapiens
aggcctctgtgtccttccct

SEQ ID NO: 171392 - DNA, 17 bp, Homo sapiens
aggcctggactttcctg

SEQ ID NO: 171393 - DNA, 16 bp, Homo sapiens
agctggcagcagagtg

SEQ ID NO: 171394 - DNA, 18 bp, Homo sapiens
agctgggaggaaaagaaa

SEQ ID NO: 171395 - DNA, 16 bp, Homo sapiens
agctgggaggcatggc

SEQ ID NO: 171396 - DNA, 20 bp, Homo sapiens
agctggggaagcttcttaaa

SEQ ID NO: 171397 - DNA, 13 bp, Homo sapiens
agctgtacaaata

SEQ ID NO: 171398 - DNA, 22 bp, Homo sapiens
agctgtacaaatataagaataa

SEQ ID NO: 171399 - DNA, 20 bp, Homo sapiens
agctgtagtagccctttctg

SEQ ID NO: 171400 - DNA, 23 bp, Homo sapiens
agctgtagtagccctttctgtgt

SEQ ID NO: 171401 - DNA, 20 bp, Homo sapiens
agctgtccctgtcaccaagc

SEQ ID NO: 171402 - DNA, 18 bp, Homo sapiens
agctgtgacttctccagg

SEQ ID NO: 171403 - DNA, 15 bp, Homo sapiens
agctgtgagccttgg

SEQ ID NO: 171404 - DNA, 16 bp, Homo sapiens
agctgtgagccttggc

SEQ ID NO: 171405 - DNA, 10 bp, Homo sapiens
agctgtgcag

SEQ ID NO: 171406 - DNA, 21 bp, Homo sapiens
agctgtgggtacagagaggtc

SEQ ID NO: 171407 - DNA, 15 bp, Homo sapiens
agctgtgtccttgca

SEQ ID NO: 171408 - DNA, 14 bp, Homo sapiens
agctgtgtgaaata

SEQ ID NO: 171409 - DNA, 14 bp, Homo sapiens
agctgttactgtct

SEQ ID NO: 171410 - DNA, 13 bp, Homo sapiens
agctgttcagctg

SEQ ID NO: 171411 - DNA, 14 bp, Homo sapiens
agcttagacctcag

SEQ ID NO: 171412 - DNA, 19 bp, Homo sapiens
agcttagacctcagcctgt

SEQ ID NO: 171413 - DNA, 20 bp, Homo sapiens
agcttagacctcagcctgtg

SEQ ID NO: 171414 - DNA, 16 bp, Homo sapiens
agcttcagaagtttgg

SEQ ID NO: 171415 - DNA, 21 bp, Homo sapiens
agcttcagaagtttggcaata

SEQ ID NO: 171416 - DNA, 23 bp, Homo sapiens
agcttccattccaagcctgacca

SEQ ID NO: 171417 - DNA, 13 bp, Homo sapiens
agcttctctgtga

SEQ ID NO: 171418 - DNA, 16 bp, Homo sapiens
agcttgccctgttaaa

SEQ ID NO: 171419 - DNA, 19 bp, Homo sapiens
agcttgccctgttaaaaga

SEQ ID NO: 171420 - DNA, 22 bp, Homo sapiens
agcttgctcttcagtgggagaa

SEQ ID NO: 171421 - DNA, 16 bp, Homo sapiens
agcttggaagagcctg

SEQ ID NO: 171422 - DNA, 16 bp, Homo sapiens
agcttggctgtagaag

SEQ ID NO: 171423 - DNA, 23 bp, Homo sapiens
agcttggctgtagaaggagacag

SEQ ID NO: 171424 - DNA, 12 bp, Homo sapiens
aggtgctgggag

SEQ ID NO: 171425 - DNA, 13 bp, Homo sapiens
aggtgctgggagg

SEQ ID NO: 171426 - DNA, 14 bp, Homo sapiens
aggtggaagccctc

SEQ ID NO: 171427 - DNA, 15 bp, Homo sapiens
aggtggaagccctcc

SEQ ID NO: 171428 - DNA, 17 bp, Homo sapiens
aggtggatcacctgagg

SEQ ID NO: 171429 - DNA, 14 bp, Homo sapiens
aggtggccactcca

SEQ ID NO: 171430 - DNA, 20 bp, Homo sapiens
aggtggctgacccagtccct

SEQ ID NO: 171431 - DNA, 21 bp, Homo sapiens
aggtggctgacccagtccctg

SEQ ID NO: 171432 - DNA, 22 bp, Homo sapiens
aggtggctgacccagtccctgg

SEQ ID NO: 171433 - DNA, 20 bp, Homo sapiens
aggtgggagcaggagattga

SEQ ID NO: 171434 - DNA, 13 bp, Homo sapiens
aggtgggagcttg

SEQ ID NO: 171435 - DNA, 22 bp, Homo sapiens
aggtgggttttcttcccatcac

SEQ ID NO: 171436 - DNA, 23 bp, Homo sapiens
aggtgggttttcttcccatcact

SEQ ID NO: 171437 - DNA, 15 bp, Homo sapiens
aggtgtcatttccat

SEQ ID NO: 171438 - DNA, 12 bp, Homo sapiens
aggtgtttatac

SEQ ID NO: 171439 - DNA, 22 bp, Homo sapiens
aggttaattccaattatatgag

SEQ ID NO: 171440 - DNA, 21 bp, Homo sapiens
aggttccgcttggagcagagg

SEQ ID NO: 171441 - DNA, 17 bp, Homo sapiens
aggttgcagtgagctga

SEQ ID NO: 171442 - DNA, 14 bp, Homo sapiens
aggttggtgggggc

SEQ ID NO: 171443 - DNA, 16 bp, Homo sapiens
aggtttacaatttaca

SEQ ID NO: 171444 - DNA, 18 bp, Homo sapiens
aggtttacaatttacaaa

SEQ ID NO: 171445 - DNA, 13 bp, Homo sapiens
aggttttgtaaag

SEQ ID NO: 171446 - DNA, 15 bp, Homo sapiens
agtaaaaccacagca

SEQ ID NO: 171447 - DNA, 19 bp, Homo sapiens
agtaaaaccacagcagttg

SEQ ID NO: 171448 - DNA, 20 bp, Homo sapiens
agtaaaaccacagcagttga

SEQ ID NO: 171449 - DNA, 13 bp, Homo sapiens
agtaaagaaatga

SEQ ID NO: 171450 - DNA, 17 bp, Homo sapiens
agtaaagctaaaatgat

SEQ ID NO: 171451 - DNA, 23 bp, Homo sapiens
agtaaatgctaggttaattccaa

SEQ ID NO: 171452 - DNA, 17 bp, Homo sapiens
agtaacgcgtcttcctg

SEQ ID NO: 171453 - DNA, 19 bp, Homo sapiens
agtaactgccatcaagatg

SEQ ID NO: 171454 - DNA, 13 bp, Homo sapiens
agtaagaaaatat

SEQ ID NO: 171455 - DNA, 14 bp, Homo sapiens
agtaagaaaatatt

SEQ ID NO: 171456 - DNA, 18 bp, Homo sapiens
agtaatatttatatattt

SEQ ID NO: 171457 - DNA, 19 bp, Homo sapiens
agtaattcaagaaaacaac

SEQ ID NO: 171458 - DNA, 13 bp, Homo sapiens
agtaatttattgt

SEQ ID NO: 171459 - DNA, 22 bp, Homo sapiens
agtaatttattgtttttccttg

SEQ ID NO: 171460 - DNA, 18 bp, Homo sapiens
agtacaggcagcacagag

SEQ ID NO: 171461 - DNA, 21 bp, Homo sapiens
agtacatttaatacagcagtg

SEQ ID NO: 171462 - DNA, 16 bp, Homo sapiens
agtacatttggagaca

SEQ ID NO: 171463 - DNA, 15 bp, Homo sapiens
agtaccaatcatttt

SEQ ID NO: 171464 - DNA, 23 bp, Homo sapiens
agtacttgggagacctgtaatca

SEQ ID NO: 171465 - DNA, 18 bp, Homo sapiens
agtagaaataatatgcat

SEQ ID NO: 171466 - DNA, 22 bp, Homo sapiens
agtagacatttctcttactgca

SEQ ID NO: 171467 - DNA, 18 bp, Homo sapiens
agtagcaccctggattga

SEQ ID NO: 171468 - DNA, 17 bp, Homo sapiens
agtagccctttctgtgt

SEQ ID NO: 171469 - DNA, 15 bp, Homo sapiens
agtagccgagagcct

SEQ ID NO: 171470 - DNA, 17 bp, Homo sapiens
agtagccgagagcctgc

SEQ ID NO: 171471 - DNA, 19 bp, Homo sapiens
agtagccgagagcctgctc

SEQ ID NO: 171472 - DNA, 13 bp, Homo sapiens
agtaggagcccag

SEQ ID NO: 171473 - DNA, 15 bp, Homo sapiens
agtatcaggtctccc

SEQ ID NO: 171474 - DNA, 13 bp, Homo sapiens
agtatgaaaataa

SEQ ID NO: 171475 - DNA, 23 bp, Homo sapiens
agtatgcttgaaaagataaatta

SEQ ID NO: 171476 - DNA, 21 bp, Homo sapiens
agtatgtaaagtatgtaaaca

SEQ ID NO: 171477 - DNA, 19 bp, Homo sapiens
agtattccattgtgtgagt

SEQ ID NO: 171478 - DNA, 20 bp, Homo sapiens
agtattgcatctgtataagt

SEQ ID NO: 171479 - DNA, 13 bp, Homo sapiens
agtatttatatat

SEQ ID NO: 171480 - DNA, 15 bp, Homo sapiens
agtatttatatattt

SEQ ID NO: 171481 - DNA, 17 bp, Homo sapiens
agtatttatatatttat

SEQ ID NO: 171482 - DNA, 14 bp, Homo sapiens
agtcaaaacagaga

SEQ ID NO: 171483 - DNA, 16 bp, Homo sapiens
agtcaaaaggtgcctg

SEQ ID NO: 171484 - DNA, 13 bp, Homo sapiens
agtcaaaccataa

SEQ ID NO: 171485 - DNA, 15 bp, Homo sapiens
agtcaacctgcctga

SEQ ID NO: 171486 - DNA, 20 bp, Homo sapiens
agtcaagtgaaaaaggagga

SEQ ID NO: 171487 - DNA, 20 bp, Homo sapiens
agtcacattccaagcctcat

SEQ ID NO: 171488 - DNA, 19 bp, Homo sapiens
agtcaccaggaatgttaaa

SEQ ID NO: 171489 - DNA, 14 bp, Homo sapiens
agtcactgcctctc

SEQ ID NO: 171490 - DNA, 20 bp, Homo sapiens
agtcactgcctctccctggc

SEQ ID NO: 171491 - DNA, 16 bp, Homo sapiens
agtcagggacccctgc

SEQ ID NO: 171492 - DNA, 16 bp, Homo sapiens
agtcagttgaaattct

SEQ ID NO: 171493 - DNA, 14 bp, Homo sapiens
agtcataccaatga

SEQ ID NO: 171494 - DNA, 15 bp, Homo sapiens
agtcatctcaaccat

SEQ ID NO: 171495 - DNA, 20 bp, Homo sapiens
agtcatcttgaccaagcagg

SEQ ID NO: 171496 - DNA, 14 bp, Homo sapiens
agtcatgagctgag

SEQ ID NO: 171497 - DNA, 22 bp, Homo sapiens
agtcatgagctgagcagggaga

SEQ ID NO: 171498 - DNA, 19 bp, Homo sapiens
agtcatgcgtttaatcaca

SEQ ID NO: 171499 - DNA, 20 bp, Homo sapiens
agtcatgtaagctgaaaata

SEQ ID NO: 171500 - DNA, 12 bp, Homo sapiens
agtcatgtgacc

SEQ ID NO: 171501 - DNA, 15 bp, Homo sapiens
agtcatgttccttca

SEQ ID NO: 171502 - DNA, 20 bp, Homo sapiens
agtcattatagatcccccag

SEQ ID NO: 171503 - DNA, 13 bp, Homo sapiens
agtcatttaataa

SEQ ID NO: 171504 - DNA, 22 bp, Homo sapiens
agtcatttgctgagcatgtact

SEQ ID NO: 171505 - DNA, 12 bp, Homo sapiens
agtccacctgag

SEQ ID NO: 171506 - DNA, 18 bp, Homo sapiens
agtcccagctactcagga

SEQ ID NO: 171507 - DNA, 17 bp, Homo sapiens
agtccccaggccccagg

SEQ ID NO: 171508 - DNA, 21 bp, Homo sapiens
agtccccaggccccaggaagc

SEQ ID NO: 171509 - DNA, 18 bp, Homo sapiens
agtccccgtgccccgcct

SEQ ID NO: 171510 - DNA, 20 bp, Homo sapiens
agtccccgtgccccgcctcc

SEQ ID NO: 171511 - DNA, 17 bp, Homo sapiens
agtccctgggggaagcc

SEQ ID NO: 171512 - DNA, 20 bp, Homo sapiens
agtccctgggggaagccctg

SEQ ID NO: 171513 - DNA, 21 bp, Homo sapiens
agtccctgggggaagccctgg

SEQ ID NO: 171514 - DNA, 20 bp, Homo sapiens
agtcctacaagctaaaatta

SEQ ID NO: 171515 - DNA, 18 bp, Homo sapiens
agtcctcccctcacagcc

SEQ ID NO: 171516 - DNA, 20 bp, Homo sapiens
agtcctcccctcacagcctc

SEQ ID NO: 171517 - DNA, 23 bp, Homo sapiens
agtcctcccctcacagcctctga

SEQ ID NO: 171518 - DNA, 20 bp, Homo sapiens
agtcctgatcagagccgtgg

SEQ ID NO: 171519 - DNA, 13 bp, Homo sapiens
agtcctgtgaatt

SEQ ID NO: 171520 - DNA, 23 bp, Homo sapiens
agtcctgtgaatttcttcactgt

SEQ ID NO: 171521 - DNA, 18 bp, Homo sapiens
agtcgaattaatagcttt

SEQ ID NO: 171522 - DNA, 21 bp, Homo sapiens
agtcgaattaatagcttttat

SEQ ID NO: 171523 - DNA, 19 bp, Homo sapiens
agtcgatagagctgtatta

SEQ ID NO: 171524 - DNA, 16 bp, Homo sapiens
agtcgctgaggaaaaa

SEQ ID NO: 171525 - DNA, 19 bp, Homo sapiens
agtcgctgtggttgtttta

SEQ ID NO: 171526 - DNA, 18 bp, Homo sapiens
agtctaggagctgggagg

SEQ ID NO: 171527 - DNA, 16 bp, Homo sapiens
agtctcaggaaatcaa

SEQ ID NO: 171528 - DNA, 13 bp, Homo sapiens
agtctctgagcag

SEQ ID NO: 171529 - DNA, 16 bp, Homo sapiens
agtctctgctggccca

SEQ ID NO: 171530 - DNA, 17 bp, Homo sapiens
agtctctgctggcccag

SEQ ID NO: 171531 - DNA, 13 bp, Homo sapiens
agtctcttctcca

SEQ ID NO: 171532 - DNA, 16 bp, Homo sapiens
agtctcttctccactg

SEQ ID NO: 171533 - DNA, 18 bp, Homo sapiens
agtctcttctccactgga

SEQ ID NO: 171534 - DNA, 21 bp, Homo sapiens
agtctcttctccactggatgg

SEQ ID NO: 171535 - DNA, 15 bp, Homo sapiens
agtctgaacagctgt

SEQ ID NO: 171536 - DNA, 16 bp, Homo sapiens
agtctgaacagctgta

SEQ ID NO: 171537 - DNA, 14 bp, Homo sapiens
agtctgaagcagat

SEQ ID NO: 171538 - DNA, 15 bp, Homo sapiens
agtctggatctggga

SEQ ID NO: 171539 - DNA, 21 bp, Homo sapiens
agtctgtgtgatgaactttct

SEQ ID NO: 171540 - DNA, 13 bp, Homo sapiens
agtcttaaaataa

SEQ ID NO: 171541 - DNA, 16 bp, Homo sapiens
agtcttacgaatactt

SEQ ID NO: 171542 - DNA, 15 bp, Homo sapiens
agtcttccatttgca

SEQ ID NO: 171543 - DNA, 16 bp, Homo sapiens
agtcttccatttgcaa

SEQ ID NO: 171544 - DNA, 17 bp, Homo sapiens
agtcttccatttgcaag

SEQ ID NO: 171545 - DNA, 11 bp, Homo sapiens
agtgaaaaagg

SEQ ID NO: 171546 - DNA, 16 bp, Homo sapiens
agtgaaagaggcagct

SEQ ID NO: 171547 - DNA, 16 bp, Homo sapiens
agtgaaagctagagat

SEQ ID NO: 171548 - DNA, 20 bp, Homo sapiens
agtgaacaaatttacagaga

SEQ ID NO: 171549 - DNA, 23 bp, Homo sapiens
agtgaacaaatttacagagacag

SEQ ID NO: 171550 - DNA, 15 bp, Homo sapiens
agtgaaggcttctct

SEQ ID NO: 171551 - DNA, 23 bp, Homo sapiens
agtgaaggtttacaatttacaaa

SEQ ID NO: 171552 - DNA, 17 bp, Homo sapiens
agtgaataaatgtcttg

SEQ ID NO: 171553 - DNA, 16 bp, Homo sapiens
agtgacagacaggctc

SEQ ID NO: 171554 - DNA, 16 bp, Homo sapiens
agtgacctgaggaagc

SEQ ID NO: 171555 - DNA, 18 bp, Homo sapiens
agtgactcatcctcttga

SEQ ID NO: 171556 - DNA, 21 bp, Homo sapiens
agtgactgatggctaatgtac

SEQ ID NO: 171557 - DNA, 16 bp, Homo sapiens
agtgacttgtgtccca

SEQ ID NO: 171558 - DNA, 18 bp, Homo sapiens
agtgagaaaaagctcctg

SEQ ID NO: 171559 - DNA, 15 bp, Homo sapiens
agtgagcactcccaa

SEQ ID NO: 171560 - DNA, 16 bp, Homo sapiens
agtgagccgagattgt

SEQ ID NO: 171561 - DNA, 15 bp, Homo sapiens
agtgagcctggctct

SEQ ID NO: 171562 - DNA, 14 bp, Homo sapiens
agtgagtgagcctg

SEQ ID NO: 171563 - DNA, 16 bp, Homo sapiens
agtgagtgagcctggc

SEQ ID NO: 171564 - DNA, 17 bp, Homo sapiens
agtgatacaacttcaag

SEQ ID NO: 171565 - DNA, 23 bp, Homo sapiens
agtgatacaacttcaagtgcatg

SEQ ID NO: 171566 - DNA, 14 bp, Homo sapiens
agtgatataaatca

SEQ ID NO: 171567 - DNA, 13 bp, Homo sapiens
agtgattaccagg

SEQ ID NO: 171568 - DNA, 15 bp, Homo sapiens
agtgattaccaggga

SEQ ID NO: 171569 - DNA, 15 bp, Homo sapiens
agtgcaacagtagca

SEQ ID NO: 171570 - DNA, 19 bp, Homo sapiens
agtgcccaccaacatccca

SEQ ID NO: 171571 - DNA, 20 bp, Homo sapiens
agtgcccaccaacatcccat

SEQ ID NO: 171572 - DNA, 21 bp, Homo sapiens
agtgcctgtaatcacagctac

SEQ ID NO: 171573 - DNA, 20 bp, Homo sapiens
agtgccttacctcctgccca

SEQ ID NO: 171574 - DNA, 18 bp, Homo sapiens
agtgctcgctttctatgt

SEQ ID NO: 171575 - DNA, 18 bp, Homo sapiens
agtggaaaaatagcctgc

SEQ ID NO: 171576 - DNA, 20 bp, Homo sapiens
agtggacaccaggagtccct

SEQ ID NO: 171577 - DNA, 14 bp, Homo sapiens
agtggaccaggaca

SEQ ID NO: 171578 - DNA, 23 bp, Homo sapiens
agtggaggttaaggctgaggaaa

SEQ ID NO: 171579 - DNA, 14 bp, Homo sapiens
agtggattgcattt

SEQ ID NO: 171580 - DNA, 16 bp, Homo sapiens
agtggcccccacagaa

SEQ ID NO: 171581 - DNA, 13 bp, Homo sapiens
agtggctcctccc

SEQ ID NO: 171582 - DNA, 11 bp, Homo sapiens
agtggctgctg

SEQ ID NO: 171583 - DNA, 14 bp, Homo sapiens
agtggctgctgact

SEQ ID NO: 171584 - DNA, 17 bp, Homo sapiens
agtggctggtccagggc

SEQ ID NO: 171585 - DNA, 19 bp, Homo sapiens
agtgggacagggcatggcc

SEQ ID NO: 171586 - DNA, 13 bp, Homo sapiens
agtgggagaaaac

SEQ ID NO: 171587 - DNA, 17 bp, Homo sapiens
agtgggagaaaacactt

SEQ ID NO: 171588 - DNA, 15 bp, Homo sapiens
agtgggccaggacag

SEQ ID NO: 171589 - DNA, 16 bp, Homo sapiens
agtgggccaggacagg

SEQ ID NO: 171590 - DNA, 18 bp, Homo sapiens
agtgggggatcacagcct

SEQ ID NO: 171591 - DNA, 18 bp, Homo sapiens
agtgggtgagatgctgga

SEQ ID NO: 171592 - DNA, 19 bp, Homo sapiens
agtgggtgagatgctggag

SEQ ID NO: 171593 - DNA, 11 bp, Homo sapiens
agtgtaaaata

SEQ ID NO: 171594 - DNA, 13 bp, Homo sapiens
agtgtaggcagac

SEQ ID NO: 171595 - DNA, 22 bp, Homo sapiens
agtgtaggcagacacagggact

SEQ ID NO: 171596 - DNA, 14 bp, Homo sapiens
agtgtatatcagaa

SEQ ID NO: 171597 - DNA, 16 bp, Homo sapiens
agtgtcatcagaagat

SEQ ID NO: 171598 - DNA, 22 bp, Homo sapiens
agtgtctcagtccacctgagct

SEQ ID NO: 171599 - DNA, 15 bp, Homo sapiens
agtgtcttaattaaa

SEQ ID NO: 171600 - DNA, 18 bp, Homo sapiens
agtgtcttaattaaaaga

SEQ ID NO: 171601 - DNA, 21 bp, Homo sapiens
agtgtcttaattaaaagaata

SEQ ID NO: 171602 - DNA, 19 bp, Homo sapiens
agtgtcttcacggcaggac

SEQ ID NO: 171603 - DNA, 13 bp, Homo sapiens
agtgtctttccac

SEQ ID NO: 171604 - DNA, 23 bp, Homo sapiens
agtgtctttccacggagccactc

SEQ ID NO: 171605 - DNA, 15 bp, Homo sapiens
agtgtgaggccaggg

SEQ ID NO: 171606 - DNA, 15 bp, Homo sapiens
agtgtgggaagggag

SEQ ID NO: 171607 - DNA, 17 bp, Homo sapiens
agtgtgggaagggagag

SEQ ID NO: 171608 - DNA, 21 bp, Homo sapiens
agtgtggtagggacttaaaaa

SEQ ID NO: 171609 - DNA, 16 bp, Homo sapiens
agtgtgtatgtgcgtg

SEQ ID NO: 171610 - DNA, 11 bp, Homo sapiens
agtgtgtatta

SEQ ID NO: 171611 - DNA, 23 bp, Homo sapiens
agtgtgtattaaaaaaaacaaaa

SEQ ID NO: 171612 - DNA, 18 bp, Homo sapiens
agtgtgtgcacatgtgtg

SEQ ID NO: 171613 - DNA, 22 bp, Homo sapiens
agtgtgtgcacatgtgtgcgtg

SEQ ID NO: 171614 - DNA, 17 bp, Homo sapiens
agtgtgtgcatgtgtgc

SEQ ID NO: 171615 - DNA, 15 bp, Homo sapiens
agtgttaaatgtgat

SEQ ID NO: 171616 - DNA, 15 bp, Homo sapiens
agtgttagggaaggg

SEQ ID NO: 171617 - DNA, 18 bp, Homo sapiens
agtgttagggaagggcct

SEQ ID NO: 171618 - DNA, 19 bp, Homo sapiens
agtgttagggaagggcctg

SEQ ID NO: 171619 - DNA, 23 bp, Homo sapiens
agtgttatcagtcataactaaat

SEQ ID NO: 171620 - DNA, 16 bp, Homo sapiens
agtgttccccttccac

SEQ ID NO: 171621 - DNA, 18 bp, Homo sapiens
agtgttccctttcctact

SEQ ID NO: 171622 - DNA, 21 bp, Homo sapiens
agtgtttgggtatattcattt

SEQ ID NO: 171623 - DNA, 12 bp, Homo sapiens
agttaaataaat

SEQ ID NO: 171624 - DNA, 23 bp, Homo sapiens
agttaaatagagtatatgcactt

SEQ ID NO: 171625 - DNA, 15 bp, Homo sapiens
agttaatattgtgaa

SEQ ID NO: 171626 - DNA, 23 bp, Homo sapiens
agttactatcatgtcaaacgtga

SEQ ID NO: 171627 - DNA, 14 bp, Homo sapiens
agttactcagccct

SEQ ID NO: 171628 - DNA, 17 bp, Homo sapiens
agttactcagccctggg

SEQ ID NO: 171629 - DNA, 18 bp, Homo sapiens
agttactcagccctgggc

SEQ ID NO: 171630 - DNA, 17 bp, Homo sapiens
agttactgttatagagg

SEQ ID NO: 171631 - DNA, 13 bp, Homo sapiens
agttaggaaataa

SEQ ID NO: 171632 - DNA, 17 bp, Homo sapiens
agttaggaaataaaacc

SEQ ID NO: 171633 - DNA, 20 bp, Homo sapiens
agttaggaaataaaaccttt

SEQ ID NO: 171634 - DNA, 21 bp, Homo sapiens
agttaggaaataaaacctttc

SEQ ID NO: 171635 - DNA, 18 bp, Homo sapiens
agttatagtttcagatat

SEQ ID NO: 171636 - DNA, 18 bp, Homo sapiens
agttatggcctatacact

SEQ ID NO: 171637 - DNA, 17 bp, Homo sapiens
agttattgacaaactct

SEQ ID NO: 171638 - DNA, 21 bp, Homo sapiens
agttatttttatttatttaaa

SEQ ID NO: 171639 - DNA, 15 bp, Homo sapiens
agttccctacttcct

SEQ ID NO: 171640 - DNA, 14 bp, Homo sapiens
agttccctgaaaac

SEQ ID NO: 171641 - DNA, 12 bp, Homo sapiens
agttcctcgccc

SEQ ID NO: 171642 - DNA, 13 bp, Homo sapiens
agttcctcgccct

SEQ ID NO: 171643 - DNA, 15 bp, Homo sapiens
agttcctcgccctgg

SEQ ID NO: 171644 - DNA, 19 bp, Homo sapiens
agttcctgaacctgatgct

SEQ ID NO: 171645 - DNA, 23 bp, Homo sapiens
agttcctgctacaacttcagcag

SEQ ID NO: 171646 - DNA, 20 bp, Homo sapiens
agttcctgtcccttctctta

SEQ ID NO: 171647 - DNA, 15 bp, Homo sapiens
agttctaaattttgt

SEQ ID NO: 171648 - DNA, 15 bp, Homo sapiens
agttctacataagta

SEQ ID NO: 171649 - DNA, 22 bp, Homo sapiens
agttctgagtgtttttactaca

SEQ ID NO: 171650 - DNA, 23 bp, Homo sapiens
agttctgtactcaaatgtagcca

SEQ ID NO: 171651 - DNA, 14 bp, Homo sapiens
agttgaaaagactc

SEQ ID NO: 171652 - DNA, 18 bp, Homo sapiens
agttgaaaagactccaaa

SEQ ID NO: 171653 - DNA, 21 bp, Homo sapiens
agttgaaaagactccaaagaa

SEQ ID NO: 171654 - DNA, 22 bp, Homo sapiens
agttgaaaagactccaaagaaa

SEQ ID NO: 171655 - DNA, 21 bp, Homo sapiens
agttgatcgcctttcccaggt

SEQ ID NO: 171656 - DNA, 17 bp, Homo sapiens
agttgattcagctctgc

SEQ ID NO: 171657 - DNA, 18 bp, Homo sapiens
agttgattcagctctgca

SEQ ID NO: 171658 - DNA, 19 bp, Homo sapiens
agttgcaatcgtaatgtac

SEQ ID NO: 171659 - DNA, 20 bp, Homo sapiens
agttgcacttggcctctgga

SEQ ID NO: 171660 - DNA, 14 bp, Homo sapiens
agttgtaaatatat

SEQ ID NO: 171661 - DNA, 16 bp, Homo sapiens
agttgtaaatatataa

SEQ ID NO: 171662 - DNA, 17 bp, Homo sapiens
agttgtaaatatataaa

SEQ ID NO: 171663 - DNA, 14 bp, Homo sapiens
agttgtatctcttt

SEQ ID NO: 171664 - DNA, 22 bp, Homo sapiens
agttgtgagtttaccttgtata

SEQ ID NO: 171665 - DNA, 20 bp, Homo sapiens
agttgtggagagtgcaacag

SEQ ID NO: 171666 - DNA, 18 bp, Homo sapiens
agttgttactaactaaac

SEQ ID NO: 171667 - DNA, 15 bp, Homo sapiens
agttgtttcattgac

SEQ ID NO: 171668 - DNA, 16 bp, Homo sapiens
agttgtttcattgact

SEQ ID NO: 171669 - DNA, 19 bp, Homo sapiens
agttgttttcagactcaga

SEQ ID NO: 171670 - DNA, 21 bp, Homo sapiens
agtttacaagtgtatatcaga

SEQ ID NO: 171671 - DNA, 14 bp, Homo sapiens
agtttagaggaaaa

SEQ ID NO: 171672 - DNA, 16 bp, Homo sapiens
agtttaggataaaata

SEQ ID NO: 171673 - DNA, 22 bp, Homo sapiens
agtttattgacaataatttcag

SEQ ID NO: 171674 - DNA, 22 bp, Homo sapiens
agtttatttccaaataaaatga

SEQ ID NO: 171675 - DNA, 12 bp, Homo sapiens
agtttcagagaa

SEQ ID NO: 171676 - DNA, 14 bp, Homo sapiens
agtttcagatatat

SEQ ID NO: 171677 - DNA, 17 bp, Homo sapiens
agtttcagatatatatc

SEQ ID NO: 171678 - DNA, 17 bp, Homo sapiens
agtttcctcaggctgct

SEQ ID NO: 171679 - DNA, 18 bp, Homo sapiens
agtttcctcaggctgctg

SEQ ID NO: 171680 - DNA, 20 bp, Homo sapiens
agtttcctcaggctgctgga

SEQ ID NO: 171681 - DNA, 23 bp, Homo sapiens
agtttcctcaggctgctggagga

SEQ ID NO: 171682 - DNA, 16 bp, Homo sapiens
agtttctagctagaaa

SEQ ID NO: 171683 - DNA, 17 bp, Homo sapiens
agtttgattattcagtg

SEQ ID NO: 171684 - DNA, 21 bp, Homo sapiens
agtttgcagaaaagcacctgc

SEQ ID NO: 171685 - DNA, 13 bp, Homo sapiens
agtttgccagaag

SEQ ID NO: 171686 - DNA, 16 bp, Homo sapiens
agtttggcaatagttt

SEQ ID NO: 171687 - DNA, 18 bp, Homo sapiens
agtttgtacatgcattca

SEQ ID NO: 171688 - DNA, 12 bp, Homo sapiens
agttttatcatt

SEQ ID NO: 171689 - DNA, 19 bp, Homo sapiens
ataacttcttaaaagttgt

SEQ ID NO: 171690 - DNA, 20 bp, Homo sapiens
ataagaagggatggattcca

SEQ ID NO: 171691 - DNA, 21 bp, Homo sapiens
ataagaataaaatgttgaaaa

SEQ ID NO: 171692 - DNA, 21 bp, Homo sapiens
ataagacggatttatttttcc

SEQ ID NO: 171693 - DNA, 13 bp, Homo sapiens
ataagattagaat

SEQ ID NO: 171694 - DNA, 17 bp, Homo sapiens
ataagattagaatgaaa

SEQ ID NO: 171695 - DNA, 23 bp, Homo sapiens
ataagcaaagggagcactgggtt

SEQ ID NO: 171696 - DNA, 20 bp, Homo sapiens
ataaggatcagaacagcaga

SEQ ID NO: 171697 - DNA, 22 bp, Homo sapiens
ataaggatcagaacagcagagg

SEQ ID NO: 171698 - DNA, 14 bp, Homo sapiens
ataagtaagaaaat

SEQ ID NO: 171699 - DNA, 15 bp, Homo sapiens
ataagtaagaaaata

SEQ ID NO: 171700 - DNA, 19 bp, Homo sapiens
ataagtaagaaaatatttt

SEQ ID NO: 171701 - DNA, 13 bp, Homo sapiens
ataagtactgtgt

SEQ ID NO: 171702 - DNA, 18 bp, Homo sapiens
ataagtactgtgtacaga

SEQ ID NO: 171703 - DNA, 16 bp, Homo sapiens
ataagtatttcaaatt

SEQ ID NO: 171704 - DNA, 19 bp, Homo sapiens
ataagtatttcaaattgga

SEQ ID NO: 171705 - DNA, 17 bp, Homo sapiens
ataagttaacttccaat

SEQ ID NO: 171706 - DNA, 22 bp, Homo sapiens
ataagttaacttccaatttaca

SEQ ID NO: 171707 - DNA, 14 bp, Homo sapiens
ataagtttatttct

SEQ ID NO: 171708 - DNA, 18 bp, Homo sapiens
ataagtttatttcttaaa

SEQ ID NO: 171709 - DNA, 20 bp, Homo sapiens
ataagtttcactgacttaga

SEQ ID NO: 171710 - DNA, 22 bp, Homo sapiens
ataatacactaattcctttcta

SEQ ID NO: 171711 - DNA, 19 bp, Homo sapiens
ataatacagtatctcaggg

SEQ ID NO: 171712 - DNA, 13 bp, Homo sapiens
ataatcagcctct

SEQ ID NO: 171713 - DNA, 13 bp, Homo sapiens
ataatctgatttg

SEQ ID NO: 171714 - DNA, 12 bp, Homo sapiens
ataatgttaaca

SEQ ID NO: 171715 - DNA, 14 bp, Homo sapiens
ataatgttgttatt

SEQ ID NO: 171716 - DNA, 17 bp, Homo sapiens
ataattatccagagttt

SEQ ID NO: 171717 - DNA, 19 bp, Homo sapiens
ataattgagttttcagtgg

SEQ ID NO: 171718 - DNA, 15 bp, Homo sapiens
ataattgatcaaatt

SEQ ID NO: 171719 - DNA, 15 bp, Homo sapiens
ataattttaagaaat

SEQ ID NO: 171720 - DNA, 21 bp, Homo sapiens
ataatttttaaagtatatatt

SEQ ID NO: 171721 - DNA, 15 bp, Homo sapiens
ataattttttattca

SEQ ID NO: 171722 - DNA, 20 bp, Homo sapiens
ataatttttttcaatattta

SEQ ID NO: 171723 - DNA, 21 bp, Homo sapiens
ataatttttttcaatatttat

SEQ ID NO: 171724 - DNA, 14 bp, Homo sapiens
atacaccgggcctg

SEQ ID NO: 171725 - DNA, 17 bp, Homo sapiens
atacacgaggtatgagg

SEQ ID NO: 171726 - DNA, 18 bp, Homo sapiens
atacagaactctttcaaa

SEQ ID NO: 171727 - DNA, 20 bp, Homo sapiens
atacagaactctttcaaaac

SEQ ID NO: 171728 - DNA, 23 bp, Homo sapiens
atacagaactctttcaaaacctt

SEQ ID NO: 171729 - DNA, 17 bp, Homo sapiens
atacagaggcaactgca

SEQ ID NO: 171730 - DNA, 15 bp, Homo sapiens
atacagtacaggcag

SEQ ID NO: 171731 - DNA, 16 bp, Homo sapiens
atacagtacaggcagc

SEQ ID NO: 171732 - DNA, 14 bp, Homo sapiens
atacagtgttattt

SEQ ID NO: 171733 - DNA, 20 bp, Homo sapiens
ataccaaaattatttcagaa

SEQ ID NO: 171734 - DNA, 17 bp, Homo sapiens
ataccaagtatttatta

SEQ ID NO: 171735 - DNA, 22 bp, Homo sapiens
ataccagcgaggaggctccaga

SEQ ID NO: 171736 - DNA, 16 bp, Homo sapiens
atacctgtgcctcggc

SEQ ID NO: 171737 - DNA, 15 bp, Homo sapiens
atactatattttagg

SEQ ID NO: 171738 - DNA, 17 bp, Homo sapiens
atactgcagggccagga

SEQ ID NO: 171739 - DNA, 13 bp, Homo sapiens
atacttgagactg

SEQ ID NO: 171740 - DNA, 17 bp, Homo sapiens
atacttgtcttgttcac

SEQ ID NO: 171741 - DNA, 16 bp, Homo sapiens
atacttttgccctttg

SEQ ID NO: 171742 - DNA, 15 bp, Homo sapiens
atactttttttcaca

SEQ ID NO: 171743 - DNA, 17 bp, Homo sapiens
atagaaaactgaaaatc

SEQ ID NO: 171744 - DNA, 13 bp, Homo sapiens
atagaagctgtag

SEQ ID NO: 171745 - DNA, 14 bp, Homo sapiens
atagaagctgtagt

SEQ ID NO: 171746 - DNA, 12 bp, Homo sapiens
atagaatattta

SEQ ID NO: 171747 - DNA, 19 bp, Homo sapiens
atagaatatttattacctc

SEQ ID NO: 171748 - DNA, 14 bp, Homo sapiens
atagagatcatcct

SEQ ID NO: 171749 - DNA, 15 bp, Homo sapiens
atagagcctgaggga

SEQ ID NO: 171750 - DNA, 14 bp, Homo sapiens
atagagggccaaga

SEQ ID NO: 171751 - DNA, 14 bp, Homo sapiens
atagagtatatgca

SEQ ID NO: 171752 - DNA, 14 bp, Homo sapiens
atagagtgtactta

SEQ ID NO: 171753 - DNA, 19 bp, Homo sapiens
atagagtgtacttaactat

SEQ ID NO: 171754 - DNA, 20 bp, Homo sapiens
atagataagagtagaaactg

SEQ ID NO: 171755 - DNA, 15 bp, Homo sapiens
atagatcccccagac

SEQ ID NO: 171756 - DNA, 16 bp, Homo sapiens
atagatcccccagact

SEQ ID NO: 171757 - DNA, 17 bp, Homo sapiens
atagcaagattgcttaa

SEQ ID NO: 171758 - DNA, 15 bp, Homo sapiens
atagcagcttattca

SEQ ID NO: 171759 - DNA, 18 bp, Homo sapiens
atagcatttttgatttat

SEQ ID NO: 171760 - DNA, 16 bp, Homo sapiens
atagccaccccagaaa

SEQ ID NO: 171761 - DNA, 13 bp, Homo sapiens
atagcccagacac

SEQ ID NO: 171762 - DNA, 16 bp, Homo sapiens
atagcccatccctgcc

SEQ ID NO: 171763 - DNA, 18 bp, Homo sapiens
atagccgggcatggtggc

SEQ ID NO: 171764 - DNA, 20 bp, Homo sapiens
atagcgggttactttcacat

SEQ ID NO: 171765 - DNA, 20 bp, Homo sapiens
atagctctttggcagtctat

SEQ ID NO: 171766 - DNA, 18 bp, Homo sapiens
atagctgtacaaatataa

SEQ ID NO: 171767 - DNA, 10 bp, Homo sapiens
atagctttat

SEQ ID NO: 171768 - DNA, 14 bp, Homo sapiens
atagcttttattgt

SEQ ID NO: 171769 - DNA, 18 bp, Homo sapiens
ataggaaaagtacattta

SEQ ID NO: 171770 - DNA, 19 bp, Homo sapiens
ataggaaaagtacatttaa

SEQ ID NO: 171771 - DNA, 21 bp, Homo sapiens
ataggaattgacccacaagaa

SEQ ID NO: 171772 - DNA, 22 bp, Homo sapiens
ataggaattgacccacaagaaa

SEQ ID NO: 171773 - DNA, 22 bp, Homo sapiens
atagtattccattgtgtgagtg

SEQ ID NO: 171774 - DNA, 20 bp, Homo sapiens
atagtatttgagagttctaa

SEQ ID NO: 171775 - DNA, 23 bp, Homo sapiens
atagtatttgagagttctaaatt

SEQ ID NO: 171776 - DNA, 19 bp, Homo sapiens
atagtcaatgtttctttta

SEQ ID NO: 171777 - DNA, 23 bp, Homo sapiens
atagttaggatagcatttttgat

SEQ ID NO: 171778 - DNA, 19 bp, Homo sapiens
atagttgctccgcctctgc

SEQ ID NO: 171779 - DNA, 13 bp, Homo sapiens
atagtttattgac

SEQ ID NO: 171780 - DNA, 16 bp, Homo sapiens
atagttttattaataa

SEQ ID NO: 171781 - DNA, 21 bp, Homo sapiens
atataaaataaatatatataa

SEQ ID NO: 171782 - DNA, 24 bp, Homo sapiens
atataaaataaatatatataaacc

SEQ ID NO: 171783 - DNA, 19 bp, Homo sapiens
atataaacctaaaaaagat

SEQ ID NO: 171784 - DNA, 16 bp, Homo sapiens
atataaatattagaaa

SEQ ID NO: 171785 - DNA, 15 bp, Homo sapiens
atataagtgtacata

SEQ ID NO: 171786 - DNA, 18 bp, Homo sapiens
atataagtgtacatatgt

SEQ ID NO: 171787 - DNA, 21 bp, Homo sapiens
atataatgttgttatttaaag

SEQ ID NO: 171788 - DNA, 22 bp, Homo sapiens
atataatgttgttatttaaaga

SEQ ID NO: 171789 - DNA, 18 bp, Homo sapiens
atatacaataacataatt

SEQ ID NO: 171790 - DNA, 14 bp, Homo sapiens
atatagctgtacaa

SEQ ID NO: 171791 - DNA, 19 bp, Homo sapiens
atatagctgtacaaatata

SEQ ID NO: 171792 - DNA, 21 bp, Homo sapiens
atatataaaaagaaaagataa

SEQ ID NO: 171793 - DNA, 14 bp, Homo sapiens
atatataaaataaa

SEQ ID NO: 171794 - DNA, 13 bp, Homo sapiens
atatataaatata

SEQ ID NO: 171795 - DNA, 13 bp, Homo sapiens
atatatataaacc

SEQ ID NO: 171796 - DNA, 16 bp, Homo sapiens
atatatcccagaaatt

SEQ ID NO: 171797 - DNA, 16 bp, Homo sapiens
atatattaaaaatata

SEQ ID NO: 171798 - DNA, 22 bp, Homo sapiens
atatattaaaaatataaaactg

SEQ ID NO: 171799 - DNA, 13 bp, Homo sapiens
atatattgaatta

SEQ ID NO: 171800 - DNA, 14 bp, Homo sapiens
atatattgaattaa

SEQ ID NO: 171801 - DNA, 15 bp, Homo sapiens
atatatttataactc

SEQ ID NO: 171802 - DNA, 21 bp, Homo sapiens
atatatttataactcatcata

SEQ ID NO: 171803 - DNA, 23 bp, Homo sapiens
acagatagtcaaaccataaactt

SEQ ID NO: 171804 - DNA, 12 bp, Homo sapiens
acagatgttgaa

SEQ ID NO: 171805 - DNA, 18 bp, Homo sapiens
acagcaagggtgatggga

SEQ ID NO: 171806 - DNA, 15 bp, Homo sapiens
acagcagaggttctt

SEQ ID NO: 171807 - DNA, 17 bp, Homo sapiens
acagcagcccctgcaca

SEQ ID NO: 171808 - DNA, 18 bp, Homo sapiens
acagcagcccctgcacaa

SEQ ID NO: 171809 - DNA, 16 bp, Homo sapiens
acagccagactggcac

SEQ ID NO: 171810 - DNA, 13 bp, Homo sapiens
acagccccagagc

SEQ ID NO: 171811 - DNA, 14 bp, Homo sapiens
acagccccagagca

SEQ ID NO: 171812 - DNA, 16 bp, Homo sapiens
acagccccagagcagg

SEQ ID NO: 171813 - DNA, 14 bp, Homo sapiens
acagccgctcctgt

SEQ ID NO: 171814 - DNA, 23 bp, Homo sapiens
acagccgctcctgtctgccagcc

SEQ ID NO: 171815 - DNA, 14 bp, Homo sapiens
acagcctcacagaa

SEQ ID NO: 171816 - DNA, 18 bp, Homo sapiens
acagcctcccctgccagg

SEQ ID NO: 171817 - DNA, 21 bp, Homo sapiens
acagcctcccctgccagggca

SEQ ID NO: 171818 - DNA, 22 bp, Homo sapiens
acagcctcccctgccagggcag

SEQ ID NO: 171819 - DNA, 17 bp, Homo sapiens
acagcgagactccgtct

SEQ ID NO: 171820 - DNA, 12 bp, Homo sapiens
acagcgctgggt

SEQ ID NO: 171821 - DNA, 13 bp, Homo sapiens
acagcggcccctg

SEQ ID NO: 171822 - DNA, 16 bp, Homo sapiens
acagcggcccctgcat

SEQ ID NO: 171823 - DNA, 22 bp, Homo sapiens
acagctaatcagcattctcact

SEQ ID NO: 171824 - DNA, 14 bp, Homo sapiens
acagctcccacccc

SEQ ID NO: 171825 - DNA, 16 bp, Homo sapiens
acagctcccaccccac

SEQ ID NO: 171826 - DNA, 18 bp, Homo sapiens
acagctcccaccccaccc

SEQ ID NO: 171827 - DNA, 22 bp, Homo sapiens
acagctcccaccccaccccctt

SEQ ID NO: 171828 - DNA, 17 bp, Homo sapiens
acagctccctctgcctg

SEQ ID NO: 171829 - DNA, 12 bp, Homo sapiens
acagctgcctgc

SEQ ID NO: 171830 - DNA, 16 bp, Homo sapiens
acagctgtccctgtca

SEQ ID NO: 171831 - DNA, 15 bp, Homo sapiens
acagctgtttaagat

SEQ ID NO: 171832 - DNA, 22 bp, Homo sapiens
acagcttcccctctctcctcct

SEQ ID NO: 171833 - DNA, 17 bp, Homo sapiens
acaggaaaatcctctgg

SEQ ID NO: 171834 - DNA, 18 bp, Homo sapiens
acaggaaaatcctctggc

SEQ ID NO: 171835 - DNA, 19 bp, Homo sapiens
acaggaaagggaaggcccc

SEQ ID NO: 171836 - DNA, 20 bp, Homo sapiens
acaggaaggtggtgcttaca

SEQ ID NO: 171837 - DNA, 17 bp, Homo sapiens
acaggaagtagaggagg

SEQ ID NO: 171838 - DNA, 15 bp, Homo sapiens
acaggagagaaaggg

SEQ ID NO: 171839 - DNA, 19 bp, Homo sapiens
acaggatgggggctggcct

SEQ ID NO: 171840 - DNA, 14 bp, Homo sapiens
acaggcaaatgcat

SEQ ID NO: 171841 - DNA, 13 bp, Homo sapiens
acaggcagcacag

SEQ ID NO: 171842 - DNA, 18 bp, Homo sapiens
acaggctactctcctcgg

SEQ ID NO: 171843 - DNA, 15 bp, Homo sapiens
acaggctcttagcag

SEQ ID NO: 171844 - DNA, 23 bp, Homo sapiens
acagggcatgccccggccacctc

SEQ ID NO: 171845 - DNA, 22 bp, Homo sapiens
acagggctaagagctagcgctg

SEQ ID NO: 171846 - DNA, 17 bp, Homo sapiens
acagggtagcaggtacc

SEQ ID NO: 171847 - DNA, 22 bp, Homo sapiens
acaggtcaatacagtacaggca

SEQ ID NO: 171848 - DNA, 18 bp, Homo sapiens
acaggtctcctcttaaaa

SEQ ID NO: 171849 - DNA, 20 bp, Homo sapiens
acagtacaggcagcacagag

SEQ ID NO: 171850 - DNA, 22 bp, Homo sapiens
acagtaggagcccagctctgaa

SEQ ID NO: 171851 - DNA, 21 bp, Homo sapiens
acagtatggcagctttcctca

SEQ ID NO: 171852 - DNA, 20 bp, Homo sapiens
agaacccttggcttgcccac

SEQ ID NO: 171853 - DNA, 21 bp, Homo sapiens
agaacctcacgcacctcccat

SEQ ID NO: 171854 - DNA, 22 bp, Homo sapiens
agaacctcacgcacctcccatc

SEQ ID NO: 171855 - DNA, 18 bp, Homo sapiens
agaacctggagttcctga

SEQ ID NO: 171856 - DNA, 12 bp, Homo sapiens
agaacctgtcct

SEQ ID NO: 171857 - DNA, 14 bp, Homo sapiens
agaacctgtccttg

SEQ ID NO: 171858 - DNA, 21 bp, Homo sapiens
agaacctgtccttgcacactc

SEQ ID NO: 171859 - DNA, 16 bp, Homo sapiens
agaactggactcagga

SEQ ID NO: 171860 - DNA, 20 bp, Homo sapiens
agaactggactcaggatgcc

SEQ ID NO: 171861 - DNA, 22 bp, Homo sapiens
agaactggactcaggatgccca

SEQ ID NO: 171862 - DNA, 18 bp, Homo sapiens
agaacttggatgtacctg

SEQ ID NO: 171863 - DNA, 23 bp, Homo sapiens
agaagaattttcagaccccagcg

SEQ ID NO: 171864 - DNA, 20 bp, Homo sapiens
agaagactctaccagactgt

SEQ ID NO: 171865 - DNA, 18 bp, Homo sapiens
agaagagactctttgcat

SEQ ID NO: 171866 - DNA, 15 bp, Homo sapiens
agaagagagatcaaa

SEQ ID NO: 171867 - DNA, 20 bp, Homo sapiens
agaagagctgttcacagcca

SEQ ID NO: 171868 - DNA, 15 bp, Homo sapiens
agaagcagaaataca

SEQ ID NO: 171869 - DNA, 14 bp, Homo sapiens
agaagcagtgagcc

SEQ ID NO: 171870 - DNA, 15 bp, Homo sapiens
agaagcggctggcag

SEQ ID NO: 171871 - DNA, 16 bp, Homo sapiens
agaagcggctggcagc

SEQ ID NO: 171872 - DNA, 23 bp, Homo sapiens
agaagctccctgaagtaagcaaa

SEQ ID NO: 171873 - DNA, 15 bp, Homo sapiens
agaagctgagcacca

SEQ ID NO: 171874 - DNA, 20 bp, Homo sapiens
agaagctgagcaccagggga

SEQ ID NO: 171875 - DNA, 17 bp, Homo sapiens
agaagcttcagaagttt

SEQ ID NO: 171876 - DNA, 18 bp, Homo sapiens
agaaggaaaaatgtgtaa

SEQ ID NO: 171877 - DNA, 15 bp, Homo sapiens
agaaggaatttgagt

SEQ ID NO: 171878 - DNA, 14 bp, Homo sapiens
agaaggagacagag

SEQ ID NO: 171879 - DNA, 20 bp, Homo sapiens
agaaggagacagagctggtt

SEQ ID NO: 171880 - DNA, 21 bp, Homo sapiens
agaagggatggattccaaccc

SEQ ID NO: 171881 - DNA, 21 bp, Homo sapiens
agaaggtccttaatgatccgt

SEQ ID NO: 171882 - DNA, 14 bp, Homo sapiens
agaagtcaaagtaa

SEQ ID NO: 171883 - DNA, 17 bp, Homo sapiens
agaagtcaaagtaaaac

SEQ ID NO: 171884 - DNA, 18 bp, Homo sapiens
agaagtgagaataggcag

SEQ ID NO: 171885 - DNA, 21 bp, Homo sapiens
agaagtgagaataggcagccc

SEQ ID NO: 171886 - DNA, 15 bp, Homo sapiens
agaagtggaccagga

SEQ ID NO: 171887 - DNA, 13 bp, Homo sapiens
agaataaaatgtt

SEQ ID NO: 171888 - DNA, 21 bp, Homo sapiens
agaataaagttctgagtgttt

SEQ ID NO: 171889 - DNA, 21 bp, Homo sapiens
agaataagtcatgttccttca

SEQ ID NO: 171890 - DNA, 15 bp, Homo sapiens
agaataatgaatgga

SEQ ID NO: 171891 - DNA, 11 bp, Homo sapiens
agaatatctgg

SEQ ID NO: 171892 - DNA, 19 bp, Homo sapiens
agaatattttaagtattgc

SEQ ID NO: 171893 - DNA, 18 bp, Homo sapiens
agaatcccactttctata

SEQ ID NO: 171894 - DNA, 16 bp, Homo sapiens
agaatctttattgaga

SEQ ID NO: 171895 - DNA, 19 bp, Homo sapiens
agaatctttattgagaaag

SEQ ID NO: 171896 - DNA, 16 bp, Homo sapiens
agaatgatttttagat

SEQ ID NO: 171897 - DNA, 15 bp, Homo sapiens
agaattaacacatga

SEQ ID NO: 171898 - DNA, 13 bp, Homo sapiens
agaattatatagg

SEQ ID NO: 171899 - DNA, 20 bp, Homo sapiens
agaattccctctctctgact

SEQ ID NO: 171900 - DNA, 22 bp, Homo sapiens
agaattccctctctctgactct

SEQ ID NO: 171901 - DNA, 20 bp, Homo sapiens
agaattctgctacctcactg

SEQ ID NO: 171902 - DNA, 19 bp, Homo sapiens
agaattgaacccaggaggt

SEQ ID NO: 171903 - DNA, 13 bp, Homo sapiens
agaatttattcaa

SEQ ID NO: 171904 - DNA, 15 bp, Homo sapiens
agaattttaaattat

SEQ ID NO: 171905 - DNA, 17 bp, Homo sapiens
agacaaaccagaagcaa

SEQ ID NO: 171906 - DNA, 17 bp, Homo sapiens
agacaagaaatccctgt

SEQ ID NO: 171907 - DNA, 19 bp, Homo sapiens
agacaagacttcagtatgt

SEQ ID NO: 171908 - DNA, 21 bp, Homo sapiens
agacaagacttcagtatgttg

SEQ ID NO: 171909 - DNA, 20 bp, Homo sapiens
agacacaactatttttccaa

SEQ ID NO: 171910 - DNA, 18 bp, Homo sapiens
agacacagaagaggctgg

SEQ ID NO: 171911 - DNA, 15 bp, Homo sapiens
agacacagggacttg

SEQ ID NO: 171912 - DNA, 16 bp, Homo sapiens
agacacagggacttga

SEQ ID NO: 171913 - DNA, 19 bp, Homo sapiens
agacacagggacttgaagt

SEQ ID NO: 171914 - DNA, 22 bp, Homo sapiens
agacacagggacttgaagttgt

SEQ ID NO: 171915 - DNA, 16 bp, Homo sapiens
agacacctgcacctcc

SEQ ID NO: 171916 - DNA, 21 bp, Homo sapiens
agacacctgcacctcccccca

SEQ ID NO: 171917 - DNA, 21 bp, Homo sapiens
agacacggatctgagaatctt

SEQ ID NO: 171918 - DNA, 19 bp, Homo sapiens
agacagagaccctctgcca

SEQ ID NO: 171919 - DNA, 12 bp, Homo sapiens
agacagcagctc

SEQ ID NO: 171920 - DNA, 14 bp, Homo sapiens
agacagcagctcag

SEQ ID NO: 171921 - DNA, 12 bp, Homo sapiens
agacagccccag

SEQ ID NO: 171922 - DNA, 19 bp, Homo sapiens
agacagccccagagcaggg

SEQ ID NO: 171923 - DNA, 18 bp, Homo sapiens
agacagctccctctgcct

SEQ ID NO: 171924 - DNA, 20 bp, Homo sapiens
agacagctccctctgcctga

SEQ ID NO: 171925 - DNA, 18 bp, Homo sapiens
agacaggaaaatcctctg

SEQ ID NO: 171926 - DNA, 18 bp, Homo sapiens
agacaggacctgactatt

SEQ ID NO: 171927 - DNA, 14 bp, Homo sapiens
agacaggagaaatg

SEQ ID NO: 171928 - DNA, 15 bp, Homo sapiens
agacaggctcttagc

SEQ ID NO: 171929 - DNA, 20 bp, Homo sapiens
agacaggctcttagcagctt

SEQ ID NO: 171930 - DNA, 21 bp, Homo sapiens
agacagggtttggctgtgtct

SEQ ID NO: 171931 - DNA, 20 bp, Homo sapiens
agacagtcaaggagtggctt

SEQ ID NO: 171932 - DNA, 21 bp, Homo sapiens
agacatccatgtttgtaaaac

SEQ ID NO: 171933 - DNA, 14 bp, Homo sapiens
agacatgaatatga

SEQ ID NO: 171934 - DNA, 12 bp, Homo sapiens
agacatggggag

SEQ ID NO: 171935 - DNA, 18 bp, Homo sapiens
agacatggggaggaagga

SEQ ID NO: 171936 - DNA, 15 bp, Homo sapiens
agacatgtgacattt

SEQ ID NO: 171937 - DNA, 16 bp, Homo sapiens
agacatgtgacattta

SEQ ID NO: 171938 - DNA, 17 bp, Homo sapiens
agacatgtgacatttat

SEQ ID NO: 171939 - DNA, 14 bp, Homo sapiens
agaccaacctgacc

SEQ ID NO: 171940 - DNA, 16 bp, Homo sapiens
agaccacaaaaattga

SEQ ID NO: 171941 - DNA, 14 bp, Homo sapiens
agaccacaaatagt

SEQ ID NO: 171942 - DNA, 19 bp, Homo sapiens
agacccaaaaggcagaagc

SEQ ID NO: 171943 - DNA, 14 bp, Homo sapiens
agacccaaggagga

SEQ ID NO: 171944 - DNA, 19 bp, Homo sapiens
agacccagccctcatcccg

SEQ ID NO: 171945 - DNA, 12 bp, Homo sapiens
agacccccactc

SEQ ID NO: 171946 - DNA, 19 bp, Homo sapiens
agacccccggaacaagcct

SEQ ID NO: 171947 - DNA, 15 bp, Homo sapiens
agaccctctgccacc

SEQ ID NO: 171948 - DNA, 16 bp, Homo sapiens
agaccctctgccacca

SEQ ID NO: 171949 - DNA, 13 bp, Homo sapiens
agaccgtcctcac

SEQ ID NO: 171950 - DNA, 14 bp, Homo sapiens
agaccgtcctcacc

SEQ ID NO: 171951 - DNA, 19 bp, Homo sapiens
agaccgtcctcacccctgt

SEQ ID NO: 171952 - DNA, 16 bp, Homo sapiens
agacctatttgacata

SEQ ID NO: 171953 - DNA, 12 bp, Homo sapiens
agacctcagcct

SEQ ID NO: 171954 - DNA, 16 bp, Homo sapiens
agacctcagcctgtgc

SEQ ID NO: 171955 - DNA, 17 bp, Homo sapiens
agacctccccagcccct

SEQ ID NO: 171956 - DNA, 20 bp, Homo sapiens
agacctccccagcccctagc

SEQ ID NO: 171957 - DNA, 16 bp, Homo sapiens
agacctgagctcccca

SEQ ID NO: 171958 - DNA, 19 bp, Homo sapiens
agacggttcaccagcctct

SEQ ID NO: 171959 - DNA, 14 bp, Homo sapiens
agacgtccctccac

SEQ ID NO: 171960 - DNA, 14 bp, Homo sapiens
agactaatttaaaa

SEQ ID NO: 171961 - DNA, 16 bp, Homo sapiens
agactcacctctgcct

SEQ ID NO: 171962 - DNA, 17 bp, Homo sapiens
agactcacctctgcctc

SEQ ID NO: 171963 - DNA, 12 bp, Homo sapiens
agactcagggcc

SEQ ID NO: 171964 - DNA, 17 bp, Homo sapiens
agactcagggccccagc

SEQ ID NO: 171965 - DNA, 20 bp, Homo sapiens
agactcagggccccagcact

SEQ ID NO: 171966 - DNA, 13 bp, Homo sapiens
agactcagtgttc

SEQ ID NO: 171967 - DNA, 23 bp, Homo sapiens
agagaccctctgccaccagagac

SEQ ID NO: 171968 - DNA, 16 bp, Homo sapiens
agagactccagctggg

SEQ ID NO: 171969 - DNA, 16 bp, Homo sapiens
agagacttttaatcag

SEQ ID NO: 171970 - DNA, 14 bp, Homo sapiens
agagagaaagccag

SEQ ID NO: 171971 - DNA, 22 bp, Homo sapiens
agagagaaagccaggcaggtag

SEQ ID NO: 171972 - DNA, 15 bp, Homo sapiens
agagaggagaggaga

SEQ ID NO: 171973 - DNA, 20 bp, Homo sapiens
agagaggagtcagagagaat

SEQ ID NO: 171974 - DNA, 15 bp, Homo sapiens
agagagggctttaat

SEQ ID NO: 171975 - DNA, 16 bp, Homo sapiens
agagagggggccacct

SEQ ID NO: 171976 - DNA, 22 bp, Homo sapiens
agagaggtcaagcccaggagga

SEQ ID NO: 171977 - DNA, 14 bp, Homo sapiens
agagagtggctcct

SEQ ID NO: 171978 - DNA, 19 bp, Homo sapiens
agagatcaaatggaaagga

SEQ ID NO: 171979 - DNA, 14 bp, Homo sapiens
agagatgcctccac

SEQ ID NO: 171980 - DNA, 21 bp, Homo sapiens
agagatgcctccaccgctgcc

SEQ ID NO: 171981 - DNA, 13 bp, Homo sapiens
agagatggaggag

SEQ ID NO: 171982 - DNA, 16 bp, Homo sapiens
agagatgggactggga

SEQ ID NO: 171983 - DNA, 16 bp, Homo sapiens
agagattacctcctga

SEQ ID NO: 171984 - DNA, 14 bp, Homo sapiens
agagcacactgtag

SEQ ID NO: 171985 - DNA, 22 bp, Homo sapiens
agagcacttaagagaatatttt

SEQ ID NO: 171986 - DNA, 23 bp, Homo sapiens
agagcagaacggagccccaggcc

SEQ ID NO: 171987 - DNA, 18 bp, Homo sapiens
agagcagctttaaactca

SEQ ID NO: 171988 - DNA, 21 bp, Homo sapiens
agagcagctttaaactcaggg

SEQ ID NO: 171989 - DNA, 18 bp, Homo sapiens
agagcaggaagcattcag

SEQ ID NO: 171990 - DNA, 15 bp, Homo sapiens
agagccaccaagagg

SEQ ID NO: 171991 - DNA, 13 bp, Homo sapiens
agagccagccctc

SEQ ID NO: 171992 - DNA, 16 bp, Homo sapiens
agagccagccctccct

SEQ ID NO: 171993 - DNA, 13 bp, Homo sapiens
agagcctgaggga

SEQ ID NO: 171994 - DNA, 14 bp, Homo sapiens
agagcctgagggat

SEQ ID NO: 171995 - DNA, 17 bp, Homo sapiens
agagcctgcaggtgctg

SEQ ID NO: 171996 - DNA, 18 bp, Homo sapiens
agagcctgcaggtgctgc

SEQ ID NO: 171997 - DNA, 21 bp, Homo sapiens
agagccttgcggaaggttcta

SEQ ID NO: 171998 - DNA, 22 bp, Homo sapiens
agagccttggtgtccacctggc

SEQ ID NO: 171999 - DNA, 15 bp, Homo sapiens
agagcgcctgcccct

SEQ ID NO: 172000 - DNA, 21 bp, Homo sapiens
agagcgcctgcccctcccaga

SEQ ID NO: 172001 - DNA, 20 bp, Homo sapiens
agagctagcagcagggaggg

SEQ ID NO: 172002 - DNA, 13 bp, Homo sapiens
agagctagcgctg

SEQ ID NO: 172003 - DNA, 14 bp, Homo sapiens
agagctgcctctcg

SEQ ID NO: 172004 - DNA, 12 bp, Homo sapiens
agagctgggagg

SEQ ID NO: 172005 - DNA, 23 bp, Homo sapiens
agagctgggaggcatggccctgg

SEQ ID NO: 172006 - DNA, 22 bp, Homo sapiens
agagctggttgggaagacatgg

SEQ ID NO: 172007 - DNA, 18 bp, Homo sapiens
agagctgttcacagccag

SEQ ID NO: 172008 - DNA, 13 bp, Homo sapiens
agagcttccctga

SEQ ID NO: 172009 - DNA, 17 bp, Homo sapiens
agagcttccctgactca

SEQ ID NO: 172010 - DNA, 22 bp, Homo sapiens
agagcttcttccaggtgcccag

SEQ ID NO: 172011 - DNA, 23 bp, Homo sapiens
agagcttcttccaggtgcccagc

SEQ ID NO: 172012 - DNA, 22 bp, Homo sapiens
agagctttcttcccgaacccca

SEQ ID NO: 172013 - DNA, 16 bp, Homo sapiens
agaggaaaaaaatgac

SEQ ID NO: 172014 - DNA, 17 bp, Homo sapiens
agaggaaaatgaataat

SEQ ID NO: 172015 - DNA, 14 bp, Homo sapiens
agaggaaccaaccc

SEQ ID NO: 172016 - DNA, 17 bp, Homo sapiens
agaggaactgtccagag

SEQ ID NO: 172017 - DNA, 21 bp, Homo sapiens
agaggaactgtccagagagca

SEQ ID NO: 172018 - DNA, 16 bp, Homo sapiens
agaggaaggagaggag

SEQ ID NO: 172019 - DNA, 18 bp, Homo sapiens
agaggaaggggccagagg

SEQ ID NO: 172020 - DNA, 23 bp, Homo sapiens
agaggaaggggccagaggctcgt

SEQ ID NO: 172021 - DNA, 14 bp, Homo sapiens
agaggacgtgggcg

SEQ ID NO: 172022 - DNA, 15 bp, Homo sapiens
agaggagagaggcag

SEQ ID NO: 172023 - DNA, 12 bp, Homo sapiens
agaggagaggag

SEQ ID NO: 172024 - DNA, 21 bp, Homo sapiens
agaggagggcgtgactcaccc

SEQ ID NO: 172025 - DNA, 14 bp, Homo sapiens
agaggagtcagaga

SEQ ID NO: 172026 - DNA, 18 bp, Homo sapiens
agaggcaactgcattggc

SEQ ID NO: 172027 - DNA, 23 bp, Homo sapiens
agaggcagagagcggtctcaggc

SEQ ID NO: 172028 - DNA, 19 bp, Homo sapiens
agaggccctcgctgccagc

SEQ ID NO: 172029 - DNA, 19 bp, Homo sapiens
agaggctgaggcctggact

SEQ ID NO: 172030 - DNA, 19 bp, Homo sapiens
agaggctggaggcagggcc

SEQ ID NO: 172031 - DNA, 22 bp, Homo sapiens
agaggctggaggcagggccttg

SEQ ID NO: 172032 - DNA, 15 bp, Homo sapiens
agagggacgcctggg

SEQ ID NO: 172033 - DNA, 14 bp, Homo sapiens
agagggcagaggct

SEQ ID NO: 172034 - DNA, 17 bp, Homo sapiens
agagggctttaattttt

SEQ ID NO: 172035 - DNA, 21 bp, Homo sapiens
agaggggctgaatagcagaag

SEQ ID NO: 172036 - DNA, 12 bp, Homo sapiens
agaggttttgtt

SEQ ID NO: 172037 - DNA, 17 bp, Homo sapiens
agagtagccgagagcct

SEQ ID NO: 172038 - DNA, 18 bp, Homo sapiens
agagtagccgagagcctg

SEQ ID NO: 172039 - DNA, 22 bp, Homo sapiens
agagtgaacaaatttacagaga

SEQ ID NO: 172040 - DNA, 17 bp, Homo sapiens
agagtgataatacaagt

SEQ ID NO: 172041 - DNA, 14 bp, Homo sapiens
agagtggctcctcc

SEQ ID NO: 172042 - DNA, 19 bp, Homo sapiens
agagtggggatatgattta

SEQ ID NO: 172043 - DNA, 20 bp, Homo sapiens
agagtgtcttcacggcagga

SEQ ID NO: 172044 - DNA, 20 bp, Homo sapiens
agagtgtgggaagggagagc

SEQ ID NO: 172045 - DNA, 21 bp, Homo sapiens
agagttgtaaatatataaata

SEQ ID NO: 172046 - DNA, 19 bp, Homo sapiens
agagttgtgcacatggctt

SEQ ID NO: 172047 - DNA, 15 bp, Homo sapiens
agagtttaacacaag

SEQ ID NO: 172048 - DNA, 14 bp, Homo sapiens
agataatcagcctc

SEQ ID NO: 172049 - DNA, 15 bp, Homo sapiens
agataatcagcctct

SEQ ID NO: 172050 - DNA, 16 bp, Homo sapiens
agataatcagcctctt

SEQ ID NO: 172051 - DNA, 12 bp, Homo sapiens
agataatgtgaa

SEQ ID NO: 172052 - DNA, 18 bp, Homo sapiens
agataattctagctttga

SEQ ID NO: 172053 - DNA, 20 bp, Homo sapiens
agatacagaactctttcaaa

SEQ ID NO: 172054 - DNA, 22 bp, Homo sapiens
agatacttggggggctgaggtg

SEQ ID NO: 172055 - DNA, 17 bp, Homo sapiens
agatatgggacattttt

SEQ ID NO: 172056 - DNA, 19 bp, Homo sapiens
agatatttttcatgatttt

SEQ ID NO: 172057 - DNA, 22 bp, Homo sapiens
agatattttttcagaaatatgt

SEQ ID NO: 172058 - DNA, 15 bp, Homo sapiens
agatcagcctgggca

SEQ ID NO: 172059 - DNA, 13 bp, Homo sapiens
agatcatcctttc

SEQ ID NO: 172060 - DNA, 15 bp, Homo sapiens
agatcatcctttcca

SEQ ID NO: 172061 - DNA, 18 bp, Homo sapiens
agatcatcctttccagca

SEQ ID NO: 172062 - DNA, 22 bp, Homo sapiens
agatcccagaaggacctcctga

SEQ ID NO: 172063 - DNA, 22 bp, Homo sapiens
agatctaaggatgtcacagggc

SEQ ID NO: 172064 - DNA, 14 bp, Homo sapiens
agatgacccctccc

SEQ ID NO: 172065 - DNA, 16 bp, Homo sapiens
agatgatctactcaga

SEQ ID NO: 172066 - DNA, 14 bp, Homo sapiens
agatgcaaagaggc

SEQ ID NO: 172067 - DNA, 14 bp, Homo sapiens
agatgcagcaaaat

SEQ ID NO: 172068 - DNA, 18 bp, Homo sapiens
agatgctgaaacaggaga

SEQ ID NO: 172069 - DNA, 21 bp, Homo sapiens
agatgctgaaacaggagagaa

SEQ ID NO: 172070 - DNA, 17 bp, Homo sapiens
agatgctggagaagaga

SEQ ID NO: 172071 - DNA, 16 bp, Homo sapiens
agatgcttctcactgc

SEQ ID NO: 172072 - DNA, 18 bp, Homo sapiens
agatggaaccgcaggaag

SEQ ID NO: 172073 - DNA, 20 bp, Homo sapiens
agatggaaccgcaggaagct

SEQ ID NO: 172074 - DNA, 23 bp, Homo sapiens
agatggaagttgcagtgagctga

SEQ ID NO: 172075 - DNA, 16 bp, Homo sapiens
agatggcaaatgacca

SEQ ID NO: 172076 - DNA, 14 bp, Homo sapiens
agatggctgtgcct

SEQ ID NO: 172077 - DNA, 20 bp, Homo sapiens
agatggctgtgcctctgcct

SEQ ID NO: 172078 - DNA, 23 bp, Homo sapiens
agatggctgtgcctctgcctgtc

SEQ ID NO: 172079 - DNA, 22 bp, Homo sapiens
agatggttttataatctgattt

SEQ ID NO: 172080 - DNA, 16 bp, Homo sapiens
agatgtagaggagaaa

SEQ ID NO: 172081 - DNA, 19 bp, Homo sapiens
agatgtagaggagaaactg

SEQ ID NO: 172082 - DNA, 18 bp, Homo sapiens
agatgtctaatagttatt

SEQ ID NO: 172083 - DNA, 22 bp, Homo sapiens
agatgtctctggcgtgtgggta

SEQ ID NO: 172084 - DNA, 21 bp, Homo sapiens
agatgtggccttccatttata

SEQ ID NO: 172085 - DNA, 21 bp, Homo sapiens
agatgttctaagtctttccat

SEQ ID NO: 172086 - DNA, 18 bp, Homo sapiens
agatgtttcttttgtatg

SEQ ID NO: 172087 - DNA, 21 bp, Homo sapiens
agattaccccctcattgttta

SEQ ID NO: 172088 - DNA, 14 bp, Homo sapiens
agccctcctcaccc

SEQ ID NO: 172089 - DNA, 11 bp, Homo sapiens
agccctccttc

SEQ ID NO: 172090 - DNA, 13 bp, Homo sapiens
agccctccttcca

SEQ ID NO: 172091 - DNA, 12 bp, Homo sapiens
agccctcttcca

SEQ ID NO: 172092 - DNA, 15 bp, Homo sapiens
agccctcttccatca

SEQ ID NO: 172093 - DNA, 17 bp, Homo sapiens
agccctgctttgggctg

SEQ ID NO: 172094 - DNA, 19 bp, Homo sapiens
agccctgctttgggctgcc

SEQ ID NO: 172095 - DNA, 23 bp, Homo sapiens
agccctggatttcagaaagagca

SEQ ID NO: 172096 - DNA, 19 bp, Homo sapiens
agccctgggccccaccacc

SEQ ID NO: 172097 - DNA, 18 bp, Homo sapiens
agccctgtggatgagccc

SEQ ID NO: 172098 - DNA, 19 bp, Homo sapiens
agccctgtggatgagccct

SEQ ID NO: 172099 - DNA, 22 bp, Homo sapiens
agcccttccatgtcgcctctgc

SEQ ID NO: 172100 - DNA, 17 bp, Homo sapiens
agccctttctgtgtgca

SEQ ID NO: 172101 - DNA, 18 bp, Homo sapiens
agccctttctgtgtgcac

SEQ ID NO: 172102 - DNA, 12 bp, Homo sapiens
agccgacctcag

SEQ ID NO: 172103 - DNA, 14 bp, Homo sapiens
agccgacctcagcc

SEQ ID NO: 172104 - DNA, 15 bp, Homo sapiens
agccgagagcctgct

SEQ ID NO: 172105 - DNA, 16 bp, Homo sapiens
agccgcatcttctcca

SEQ ID NO: 172106 - DNA, 21 bp, Homo sapiens
agccgccatgctcctggccca

SEQ ID NO: 172107 - DNA, 14 bp, Homo sapiens
agccgctcctgtct

SEQ ID NO: 172108 - DNA, 17 bp, Homo sapiens
agccgctcctgtctgcc

SEQ ID NO: 172109 - DNA, 21 bp, Homo sapiens
agccgggcgtggtggtgagtg

SEQ ID NO: 172110 - DNA, 16 bp, Homo sapiens
agccgggtctgcctct

SEQ ID NO: 172111 - DNA, 16 bp, Homo sapiens
agccgtgccttcagct

SEQ ID NO: 172112 - DNA, 17 bp, Homo sapiens
agccgtgccttcagctc

SEQ ID NO: 172113 - DNA, 22 bp, Homo sapiens
agccgtggcttcccgctcagcc

SEQ ID NO: 172114 - DNA, 22 bp, Homo sapiens
agcctaccggcaatttccggcc

SEQ ID NO: 172115 - DNA, 17 bp, Homo sapiens
agcctagccgacctcag

SEQ ID NO: 172116 - DNA, 23 bp, Homo sapiens
agcctagtgaaggcttctctctg

SEQ ID NO: 172117 - DNA, 14 bp, Homo sapiens
atgtacattaatta

SEQ ID NO: 172118 - DNA, 18 bp, Homo sapiens
atgtaccatgaaacaaag

SEQ ID NO: 172119 - DNA, 12 bp, Homo sapiens
atgtagaaagct

SEQ ID NO: 172120 - DNA, 14 bp, Homo sapiens
atgtagtgcctctt

SEQ ID NO: 172121 - DNA, 16 bp, Homo sapiens
atgtagtgcctctttc

SEQ ID NO: 172122 - DNA, 20 bp, Homo sapiens
atgtatccatgggggcaggg

SEQ ID NO: 172123 - DNA, 21 bp, Homo sapiens
atgtatggaatacagtgttat

SEQ ID NO: 172124 - DNA, 20 bp, Homo sapiens
atgtattctagctaatgtaa

SEQ ID NO: 172125 - DNA, 17 bp, Homo sapiens
atgtatttataaatata

SEQ ID NO: 172126 - DNA, 17 bp, Homo sapiens
atgtatttttgtaccct

SEQ ID NO: 172127 - DNA, 13 bp, Homo sapiens
atgtcacagggcc

SEQ ID NO: 172128 - DNA, 14 bp, Homo sapiens
atgtcacagggcca

SEQ ID NO: 172129 - DNA, 15 bp, Homo sapiens
atgtcaccaccttcc

SEQ ID NO: 172130 - DNA, 23 bp, Homo sapiens
atgtcaccaccttcccagctctc

SEQ ID NO: 172131 - DNA, 15 bp, Homo sapiens
atgtcagcaaaaagc

SEQ ID NO: 172132 - DNA, 16 bp, Homo sapiens
atgtcaggcctgtgtg

SEQ ID NO: 172133 - DNA, 15 bp, Homo sapiens
atgtcatcatacatg

SEQ ID NO: 172134 - DNA, 16 bp, Homo sapiens
atgtccccaaacctgc

SEQ ID NO: 172135 - DNA, 21 bp, Homo sapiens
atgtccctacacccctcccct

SEQ ID NO: 172136 - DNA, 24 bp, Homo sapiens
atgtccctaccgagtctcttctcc

SEQ ID NO: 172137 - DNA, 14 bp, Homo sapiens
atgtcccttgctgt

SEQ ID NO: 172138 - DNA, 13 bp, Homo sapiens
atgtcgcctctgc

SEQ ID NO: 172139 - DNA, 14 bp, Homo sapiens
atgtctatttaagc

SEQ ID NO: 172140 - DNA, 17 bp, Homo sapiens
atgtctctcagaattct

SEQ ID NO: 172141 - DNA, 10 bp, Homo sapiens
atgtcttgtg

SEQ ID NO: 172142 - DNA, 23 bp, Homo sapiens
atgtctttgttggaaaagaatac

SEQ ID NO: 172143 - DNA, 15 bp, Homo sapiens
atgtgaatcagaccc

SEQ ID NO: 172144 - DNA, 16 bp, Homo sapiens
atgtgaatcagaccct

SEQ ID NO: 172145 - DNA, 14 bp, Homo sapiens
atgtgacatttata

SEQ ID NO: 172146 - DNA, 17 bp, Homo sapiens
atgtgatatataagtgt

SEQ ID NO: 172147 - DNA, 23 bp, Homo sapiens
atgtgatccttttatgttattta

SEQ ID NO: 172148 - DNA, 20 bp, Homo sapiens
atgtgattcctttgaagagg

SEQ ID NO: 172149 - DNA, 14 bp, Homo sapiens
atgtgcaaatgcaa

SEQ ID NO: 172150 - DNA, 21 bp, Homo sapiens
atgtgccgtgttattgtatta

SEQ ID NO: 172151 - DNA, 14 bp, Homo sapiens
atgtgcgtgtgtgc

SEQ ID NO: 172152 - DNA, 13 bp, Homo sapiens
atgtggccctggc

SEQ ID NO: 172153 - DNA, 14 bp, Homo sapiens
atgtggccctggcc

SEQ ID NO: 172154 - DNA, 16 bp, Homo sapiens
atgtggggccaggtca

SEQ ID NO: 172155 - DNA, 15 bp, Homo sapiens
atgtgtaaaatgtga

SEQ ID NO: 172156 - DNA, 15 bp, Homo sapiens
atgtgtaaggtgaac

SEQ ID NO: 172157 - DNA, 18 bp, Homo sapiens
atgtgtattacaaatatt

SEQ ID NO: 172158 - DNA, 20 bp, Homo sapiens
atgtgtgccatagagtttaa

SEQ ID NO: 172159 - DNA, 22 bp, Homo sapiens
atgtgtgccatagagtttaaca

SEQ ID NO: 172160 - DNA, 21 bp, Homo sapiens
atgtgtgtccacgactgtctc

SEQ ID NO: 172161 - DNA, 22 bp, Homo sapiens
atgtgtgtccacgactgtctcc

SEQ ID NO: 172162 - DNA, 12 bp, Homo sapiens
atgtgtttccat

SEQ ID NO: 172163 - DNA, 22 bp, Homo sapiens
atgttaattcagcactgatttc

SEQ ID NO: 172164 - DNA, 14 bp, Homo sapiens
atgttacattgttt

SEQ ID NO: 172165 - DNA, 13 bp, Homo sapiens
atgttatatattt

SEQ ID NO: 172166 - DNA, 22 bp, Homo sapiens
atgttatttgttattttcagta

SEQ ID NO: 172167 - DNA, 19 bp, Homo sapiens
atgttattttttaattatt

SEQ ID NO: 172168 - DNA, 18 bp, Homo sapiens
atgttcacttttgacaaa

SEQ ID NO: 172169 - DNA, 18 bp, Homo sapiens
atgttctaagtctttcca

SEQ ID NO: 172170 - DNA, 21 bp, Homo sapiens
atgttctgtgcctgtaaacat

SEQ ID NO: 172171 - DNA, 21 bp, Homo sapiens
atgttgcacacccactcagct

SEQ ID NO: 172172 - DNA, 22 bp, Homo sapiens
atgttgtgtttctgttcacctt

SEQ ID NO: 172173 - DNA, 15 bp, Homo sapiens
atgttgttatttaaa

SEQ ID NO: 172174 - DNA, 18 bp, Homo sapiens
atgtttacactctttgta

SEQ ID NO: 172175 - DNA, 14 bp, Homo sapiens
atgtttattcctga

SEQ ID NO: 172176 - DNA, 19 bp, Homo sapiens
atgtttctctggccccaag

SEQ ID NO: 172177 - DNA, 21 bp, Homo sapiens
atgtttcttttgtatgtaaat

SEQ ID NO: 172178 - DNA, 20 bp, Homo sapiens
atgttttaccgtaataatta

SEQ ID NO: 172179 - DNA, 16 bp, Homo sapiens
atgttttgacattttt

SEQ ID NO: 172180 - DNA, 18 bp, Homo sapiens
atgttttgtgggaacaga

SEQ ID NO: 172181 - DNA, 23 bp, Homo sapiens
attaaaaaaaacaaaaagaacaa

SEQ ID NO: 172182 - DNA, 13 bp, Homo sapiens
attaaaaatataa

SEQ ID NO: 172183 - DNA, 16 bp, Homo sapiens
attaaaaatataaaac

SEQ ID NO: 172184 - DNA, 21 bp, Homo sapiens
attaaaaatatggaacttcta

SEQ ID NO: 172185 - DNA, 22 bp, Homo sapiens
attaaaatatggctataaatat

SEQ ID NO: 172186 - DNA, 16 bp, Homo sapiens
attaaaatcctcaatc

SEQ ID NO: 172187 - DNA, 13 bp, Homo sapiens
attaaaatcttaa

SEQ ID NO: 172188 - DNA, 19 bp, Homo sapiens
attaaaatgattgtaaaat

SEQ ID NO: 172189 - DNA, 20 bp, Homo sapiens
attaaaatgattgtaaaata

SEQ ID NO: 172190 - DNA, 11 bp, Homo sapiens
attaaattatg

SEQ ID NO: 172191 - DNA, 20 bp, Homo sapiens
attaacaaattatgttacat

SEQ ID NO: 172192 - DNA, 20 bp, Homo sapiens
attaaccacttcagctgact

SEQ ID NO: 172193 - DNA, 12 bp, Homo sapiens
attaagaaaatc

SEQ ID NO: 172194 - DNA, 14 bp, Homo sapiens
attaagaaaatcat

SEQ ID NO: 172195 - DNA, 21 bp, Homo sapiens
attaagatatgggacattttt

SEQ ID NO: 172196 - DNA, 17 bp, Homo sapiens
attaagccacttaaaat

SEQ ID NO: 172197 - DNA, 20 bp, Homo sapiens
attaagccacttaaaatgtt

SEQ ID NO: 172198 - DNA, 16 bp, Homo sapiens
attaagccctcttcca

SEQ ID NO: 172199 - DNA, 13 bp, Homo sapiens
attaatagctttt

SEQ ID NO: 172200 - DNA, 23 bp, Homo sapiens
attaatagcttttattgtataaa

SEQ ID NO: 172201 - DNA, 20 bp, Homo sapiens
attaatatccctacatgtat

SEQ ID NO: 172202 - DNA, 17 bp, Homo sapiens
attaatattcctcagtt

SEQ ID NO: 172203 - DNA, 18 bp, Homo sapiens
attaatgttaattcagca

SEQ ID NO: 172204 - DNA, 21 bp, Homo sapiens
attacagatgggcaaattaag

SEQ ID NO: 172205 - DNA, 19 bp, Homo sapiens
attacatgtaaaacattat

SEQ ID NO: 172206 - DNA, 15 bp, Homo sapiens
attacatttccaaat

SEQ ID NO: 172207 - DNA, 17 bp, Homo sapiens
attacatttccaaatga

SEQ ID NO: 172208 - DNA, 20 bp, Homo sapiens
attaccagacggttcaccag

SEQ ID NO: 172209 - DNA, 17 bp, Homo sapiens
attacctcctgagaaaa

SEQ ID NO: 172210 - DNA, 13 bp, Homo sapiens
attacctctgata

SEQ ID NO: 172211 - DNA, 15 bp, Homo sapiens
attagaaattagctg

SEQ ID NO: 172212 - DNA, 20 bp, Homo sapiens
attagaaattagctgtgtga

SEQ ID NO: 172213 - DNA, 17 bp, Homo sapiens
attagcagtttgctttg

SEQ ID NO: 172214 - DNA, 14 bp, Homo sapiens
attaggatttcatg

SEQ ID NO: 172215 - DNA, 14 bp, Homo sapiens
attagtaaagaaat

SEQ ID NO: 172216 - DNA, 22 bp, Homo sapiens
attataatatactatatttatg

SEQ ID NO: 172217 - DNA, 23 bp, Homo sapiens
attataatttttttcaatattta

SEQ ID NO: 172218 - DNA, 13 bp, Homo sapiens
attatataggttg

SEQ ID NO: 172219 - DNA, 20 bp, Homo sapiens
attatataggttgtgcaaat

SEQ ID NO: 172220 - DNA, 19 bp, Homo sapiens
attatatcaatttcctcat

SEQ ID NO: 172221 - DNA, 16 bp, Homo sapiens
attatatctaattatt

SEQ ID NO: 172222 - DNA, 16 bp, Homo sapiens
attatggaagatttta

SEQ ID NO: 172223 - DNA, 20 bp, Homo sapiens
attattaccttacagaagtt

SEQ ID NO: 172224 - DNA, 21 bp, Homo sapiens
attattagtaagaaaacatca

SEQ ID NO: 172225 - DNA, 16 bp, Homo sapiens
attattattcttcata

SEQ ID NO: 172226 - DNA, 14 bp, Homo sapiens
attattcagtgtca

SEQ ID NO: 172227 - DNA, 18 bp, Homo sapiens
attattcatttaaaatga

SEQ ID NO: 172228 - DNA, 16 bp, Homo sapiens
attattctgattccac

SEQ ID NO: 172229 - DNA, 12 bp, Homo sapiens
attattgcatta

SEQ ID NO: 172230 - DNA, 13 bp, Homo sapiens
attattgctgttg

SEQ ID NO: 172231 - DNA, 11 bp, Homo sapiens
attatttgcat

SEQ ID NO: 172232 - DNA, 15 bp, Homo sapiens
attatttgtgtaata

SEQ ID NO: 172233 - DNA, 17 bp, Homo sapiens
attcctatatagtttat

SEQ ID NO: 172234 - DNA, 20 bp, Homo sapiens
attcctctactaacaatcag

SEQ ID NO: 172235 - DNA, 17 bp, Homo sapiens
attcctgggaaatattc

SEQ ID NO: 172236 - DNA, 23 bp, Homo sapiens
attccttagcttagacctcagcc

SEQ ID NO: 172237 - DNA, 24 bp, Homo sapiens
attccttagcttagacctcagcct

SEQ ID NO: 172238 - DNA, 20 bp, Homo sapiens
attccttggcatgccttcca

SEQ ID NO: 172239 - DNA, 21 bp, Homo sapiens
attcgtgcagcatatgaggat

SEQ ID NO: 172240 - DNA, 13 bp, Homo sapiens
attctactttgag

SEQ ID NO: 172241 - DNA, 16 bp, Homo sapiens
attctactttgagtgc

SEQ ID NO: 172242 - DNA, 22 bp, Homo sapiens
attctcctgcctgtagcagtga

SEQ ID NO: 172243 - DNA, 10 bp, Homo sapiens
attctctctc

SEQ ID NO: 172244 - DNA, 15 bp, Homo sapiens
attctctctcctgtc

SEQ ID NO: 172245 - DNA, 13 bp, Homo sapiens
attctctgagctg

SEQ ID NO: 172246 - DNA, 17 bp, Homo sapiens
attctctgagctgtgca

SEQ ID NO: 172247 - DNA, 18 bp, Homo sapiens
attctctgagctgtgcag

SEQ ID NO: 172248 - DNA, 16 bp, Homo sapiens
attctctgtctcatcc

SEQ ID NO: 172249 - DNA, 15 bp, Homo sapiens
attctgaaggagccc

SEQ ID NO: 172250 - DNA, 22 bp, Homo sapiens
attctgcaagcacatctgcatt

SEQ ID NO: 172251 - DNA, 22 bp, Homo sapiens
attctgccgtgtgccctcgggc

SEQ ID NO: 172252 - DNA, 15 bp, Homo sapiens
attctgctacctcac

SEQ ID NO: 172253 - DNA, 22 bp, Homo sapiens
attctgtgtgttttcataataa

SEQ ID NO: 172254 - DNA, 14 bp, Homo sapiens
attcttgtcaaaaa

SEQ ID NO: 172255 - DNA, 19 bp, Homo sapiens
attgaaaaaatagagcctg

SEQ ID NO: 172256 - DNA, 23 bp, Homo sapiens
attgaactctttgaatgacaaag

SEQ ID NO: 172257 - DNA, 18 bp, Homo sapiens
attgaagtcagatgtggt

SEQ ID NO: 172258 - DNA, 23 bp, Homo sapiens
attgaattcttggttgaggaaac

SEQ ID NO: 172259 - DNA, 13 bp, Homo sapiens
attgacaaactct

SEQ ID NO: 172260 - DNA, 14 bp, Homo sapiens
attgacaaactctc

SEQ ID NO: 172261 - DNA, 21 bp, Homo sapiens
attgacccacaagaaatgaaa

SEQ ID NO: 172262 - DNA, 18 bp, Homo sapiens
attgactatcaaactgaa

SEQ ID NO: 172263 - DNA, 12 bp, Homo sapiens
attgagaaagag

SEQ ID NO: 172264 - DNA, 18 bp, Homo sapiens
attgagaaagagcactta

SEQ ID NO: 172265 - DNA, 15 bp, Homo sapiens
attgagaaggagaga

SEQ ID NO: 172266 - DNA, 13 bp, Homo sapiens
attgagaatttta

SEQ ID NO: 172267 - DNA, 17 bp, Homo sapiens
attgagaattttaaatt

SEQ ID NO: 172268 - DNA, 17 bp, Homo sapiens
attgatatgcttataca

SEQ ID NO: 172269 - DNA, 13 bp, Homo sapiens
attgatggggaag

SEQ ID NO: 172270 - DNA, 16 bp, Homo sapiens
attgatggggaaggag

SEQ ID NO: 172271 - DNA, 12 bp, Homo sapiens
attgatgtgttt

SEQ ID NO: 172272 - DNA, 16 bp, Homo sapiens
attgcacgtggcctct

SEQ ID NO: 172273 - DNA, 19 bp, Homo sapiens
attgcacgtggcctcttga

SEQ ID NO: 172274 - DNA, 18 bp, Homo sapiens
attgcactccagcctggg

SEQ ID NO: 172275 - DNA, 19 bp, Homo sapiens
attgcatctgtataagtaa

SEQ ID NO: 172276 - DNA, 17 bp, Homo sapiens
attgcatttcctgacag

SEQ ID NO: 172277 - DNA, 13 bp, Homo sapiens
attgcctcctcct

SEQ ID NO: 172278 - DNA, 12 bp, Homo sapiens
attgctgcttga

SEQ ID NO: 172279 - DNA, 22 bp, Homo sapiens
attgctggcaaagacagaagcc

SEQ ID NO: 172280 - DNA, 17 bp, Homo sapiens
attgcttaaaatagcaa

SEQ ID NO: 172281 - DNA, 21 bp, Homo sapiens
attgcttacatttttacaata

SEQ ID NO: 172282 - DNA, 22 bp, Homo sapiens
attgcttacatttttacaataa

SEQ ID NO: 172283 - DNA, 18 bp, Homo sapiens
attggagagtaaaaactg

SEQ ID NO: 172284 - DNA, 17 bp, Homo sapiens
attggagccaccatgcc

SEQ ID NO: 172285 - DNA, 18 bp, Homo sapiens
attggtaaagaatggaag

SEQ ID NO: 172286 - DNA, 16 bp, Homo sapiens
attggtaacatccttt

SEQ ID NO: 172287 - DNA, 18 bp, Homo sapiens
attgtacctctcttatag

SEQ ID NO: 172288 - DNA, 19 bp, Homo sapiens
attgtacctctcttataga

SEQ ID NO: 172289 - DNA, 18 bp, Homo sapiens
attgtccaatcctatgtt

SEQ ID NO: 172290 - DNA, 21 bp, Homo sapiens
attgtgatctatcaatagtca

SEQ ID NO: 172291 - DNA, 13 bp, Homo sapiens
attgtgcccctgc

SEQ ID NO: 172292 - DNA, 18 bp, Homo sapiens
attgtggctgtcagcagg

SEQ ID NO: 172293 - DNA, 19 bp, Homo sapiens
attgtggctgtcagcagga

SEQ ID NO: 172294 - DNA, 17 bp, Homo sapiens
attgtgttgtgaatgtt

SEQ ID NO: 172295 - DNA, 13 bp, Homo sapiens
attgttaaaataa

SEQ ID NO: 172296 - DNA, 21 bp, Homo sapiens
attgttgtacacagaaataca

SEQ ID NO: 172297 - DNA, 20 bp, Homo sapiens
attgtttgtctgtcttcata

SEQ ID NO: 172298 - DNA, 18 bp, Homo sapiens
attgttttatcatgacat

SEQ ID NO: 172299 - DNA, 10 bp, Homo sapiens
attgttttca

SEQ ID NO: 172300 - DNA, 13 bp, Homo sapiens
atttaaaaaataa

SEQ ID NO: 172301 - DNA, 15 bp, Homo sapiens
atttaaaaaataact

SEQ ID NO: 172302 - DNA, 21 bp, Homo sapiens
atttaaagacagggaagagca

SEQ ID NO: 172303 - DNA, 17 bp, Homo sapiens
atttaacagtcatttaa

SEQ ID NO: 172304 - DNA, 15 bp, Homo sapiens
atttaagacactgaa

SEQ ID NO: 172305 - DNA, 19 bp, Homo sapiens
atttaagttcatattccat

SEQ ID NO: 172306 - DNA, 13 bp, Homo sapiens
atttaatatttat

SEQ ID NO: 172307 - DNA, 17 bp, Homo sapiens
atttacaaagtgtgtat

SEQ ID NO: 172308 - DNA, 18 bp, Homo sapiens
atttacatgaattgcatt

SEQ ID NO: 172309 - DNA, 21 bp, Homo sapiens
atttacatgaattgcatttta

SEQ ID NO: 172310 - DNA, 15 bp, Homo sapiens
atttactaagccaca

SEQ ID NO: 172311 - DNA, 13 bp, Homo sapiens
atttactgagctt

SEQ ID NO: 172312 - DNA, 21 bp, Homo sapiens
atttactgagcttctctgtga

SEQ ID NO: 172313 - DNA, 20 bp, Homo sapiens
atttacttcttatacatttg

SEQ ID NO: 172314 - DNA, 15 bp, Homo sapiens
atttagggcaaggag

SEQ ID NO: 172315 - DNA, 16 bp, Homo sapiens
atttagtcatgtgacc

SEQ ID NO: 172316 - DNA, 15 bp, Homo sapiens
atttagtgaactacg

SEQ ID NO: 172317 - DNA, 22 bp, Homo sapiens
atttagtttgattattcagtgt

SEQ ID NO: 172318 - DNA, 19 bp, Homo sapiens
atttagtttttgtaattta

SEQ ID NO: 172319 - DNA, 20 bp, Homo sapiens
atttagtttttgtaatttat

SEQ ID NO: 172320 - DNA, 15 bp, Homo sapiens
atttataactcatca

SEQ ID NO: 172321 - DNA, 12 bp, Homo sapiens
atttatagtttg

SEQ ID NO: 172322 - DNA, 16 bp, Homo sapiens
atttatagtttgtaca

SEQ ID NO: 172323 - DNA, 14 bp, Homo sapiens
atttatatatgtat

SEQ ID NO: 172324 - DNA, 14 bp, Homo sapiens
atttatatattgaa

SEQ ID NO: 172325 - DNA, 20 bp, Homo sapiens
atttatatatttataactca

SEQ ID NO: 172326 - DNA, 14 bp, Homo sapiens
atttatctctattt

SEQ ID NO: 172327 - DNA, 19 bp, Homo sapiens
atttatgagtttttgatag

SEQ ID NO: 172328 - DNA, 22 bp, Homo sapiens
atttatgtctatttaagcctca

SEQ ID NO: 172329 - DNA, 14 bp, Homo sapiens
atttattattttca

SEQ ID NO: 172330 - DNA, 14 bp, Homo sapiens
atttatttaaattt

SEQ ID NO: 172331 - DNA, 14 bp, Homo sapiens
atttatttatttat

SEQ ID NO: 172332 - DNA, 14 bp, Homo sapiens
atttatttcaaaaa

SEQ ID NO: 172333 - DNA, 15 bp, Homo sapiens
atttcacaacagatc

SEQ ID NO: 172334 - DNA, 20 bp, Homo sapiens
atttcacaacagatcaattt

SEQ ID NO: 172335 - DNA, 22 bp, Homo sapiens
atttcacattaatatttgctga

SEQ ID NO: 172336 - DNA, 20 bp, Homo sapiens
atttcacgtcgtcttctgta

SEQ ID NO: 172337 - DNA, 14 bp, Homo sapiens
atttcatctatttc

SEQ ID NO: 172338 - DNA, 15 bp, Homo sapiens
atttcatctatttct

SEQ ID NO: 172339 - DNA, 18 bp, Homo sapiens
atttcatttcaactgttt

SEQ ID NO: 172340 - DNA, 17 bp, Homo sapiens
atttccaaatgaatgac

SEQ ID NO: 172341 - DNA, 17 bp, Homo sapiens
atttccagccaaagcct

SEQ ID NO: 172342 - DNA, 15 bp, Homo sapiens
atttccccagacctg

SEQ ID NO: 172343 - DNA, 18 bp, Homo sapiens
atttctactttgaagtca

SEQ ID NO: 172344 - DNA, 13 bp, Homo sapiens
atttctatttatt

SEQ ID NO: 172345 - DNA, 16 bp, Homo sapiens
atttctatttatttac

SEQ ID NO: 172346 - DNA, 15 bp, Homo sapiens
atttctatttctcct

SEQ ID NO: 172347 - DNA, 11 bp, Homo sapiens
atttctgagaa

SEQ ID NO: 172348 - DNA, 17 bp, Homo sapiens
atttctgagaaggtcct

SEQ ID NO: 172349 - DNA, 23 bp, Homo sapiens
atttctgagaaggtccttaatga

SEQ ID NO: 172350 - DNA, 15 bp, Homo sapiens
atttgcaagggaaaa

SEQ ID NO: 172351 - DNA, 20 bp, Homo sapiens
atttgcaagggaaaagtctc

SEQ ID NO: 172352 - DNA, 21 bp, Homo sapiens
atttgcagctgagagaaaata

SEQ ID NO: 172353 - DNA, 21 bp, Homo sapiens
atttgcataacaattcctcta

SEQ ID NO: 172354 - DNA, 13 bp, Homo sapiens
atttgctggggaa

SEQ ID NO: 172355 - DNA, 12 bp, Homo sapiens
atttggaaaata

SEQ ID NO: 172356 - DNA, 13 bp, Homo sapiens
atttggaaaataa

SEQ ID NO: 172357 - DNA, 21 bp, Homo sapiens
atttggagacacaactatttt

SEQ ID NO: 172358 - DNA, 19 bp, Homo sapiens
atttggcaatgccatcatc

SEQ ID NO: 172359 - DNA, 21 bp, Homo sapiens
atttggggtagctagaggaac

SEQ ID NO: 172360 - DNA, 23 bp, Homo sapiens
atttggggtagctagaggaacca

SEQ ID NO: 172361 - DNA, 16 bp, Homo sapiens
atttgtacatatgtaa

SEQ ID NO: 172362 - DNA, 18 bp, Homo sapiens
atttgtacatatgtaaaa

SEQ ID NO: 172363 - DNA, 19 bp, Homo sapiens
atttgtacatatgtaaaat

SEQ ID NO: 172364 - DNA, 15 bp, Homo sapiens
atttgtctttcagga

SEQ ID NO: 172365 - DNA, 21 bp, Homo sapiens
atttgtgtaatagaaaactga

SEQ ID NO: 172366 - DNA, 14 bp, Homo sapiens
atttgttgaaatta

SEQ ID NO: 172367 - DNA, 18 bp, Homo sapiens
atttgttttgacggatga

SEQ ID NO: 172368 - DNA, 20 bp, Homo sapiens
attttaagtattgcatctgt

SEQ ID NO: 172369 - DNA, 22 bp, Homo sapiens
attttaagtattgcatctgtat

SEQ ID NO: 172370 - DNA, 23 bp, Homo sapiens
attttaattattattcttcataa

SEQ ID NO: 172371 - DNA, 19 bp, Homo sapiens
attttagaagactctacca

SEQ ID NO: 172372 - DNA, 15 bp, Homo sapiens
attttagctgcagaa

SEQ ID NO: 172373 - DNA, 20 bp, Homo sapiens
attttatccctcacctgtag

SEQ ID NO: 172374 - DNA, 15 bp, Homo sapiens
attttatctgtgaat

SEQ ID NO: 172375 - DNA, 18 bp, Homo sapiens
attttcaacgcagccctg

SEQ ID NO: 172376 - DNA, 16 bp, Homo sapiens
attttcaccccaccct

SEQ ID NO: 172377 - DNA, 21 bp, Homo sapiens
attttcacctgtttttaagct

SEQ ID NO: 172378 - DNA, 12 bp, Homo sapiens
attttcagaccc

SEQ ID NO: 172379 - DNA, 21 bp, Homo sapiens
attttcataagtatttcaaat

SEQ ID NO: 172380 - DNA, 22 bp, Homo sapiens
attttcataagtatttcaaatt

SEQ ID NO: 172381 - DNA, 15 bp, Homo sapiens
attttcattattcct

SEQ ID NO: 172382 - DNA, 20 bp, Homo sapiens
attttccacaagattcccag

SEQ ID NO: 172383 - DNA, 18 bp, Homo sapiens
attttctagactttctgt

SEQ ID NO: 172384 - DNA, 21 bp, Homo sapiens
attttcttccaagcaaaggtg

SEQ ID NO: 172385 - DNA, 17 bp, Homo sapiens
attttcttttgtaaatg

SEQ ID NO: 172386 - DNA, 20 bp, Homo sapiens
attttgaataaataaatgta

SEQ ID NO: 172387 - DNA, 16 bp, Homo sapiens
attttgcatttgaata

SEQ ID NO: 172388 - DNA, 19 bp, Homo sapiens
attttggaaaataaattat

SEQ ID NO: 172389 - DNA, 20 bp, Homo sapiens
attttggaaaataaattatt

SEQ ID NO: 172390 - DNA, 19 bp, Homo sapiens
attttgggttttgggtctt

SEQ ID NO: 172391 - DNA, 14 bp, Homo sapiens
attttgtatctgca

SEQ ID NO: 172392 - DNA, 15 bp, Homo sapiens
attttgtatctgcag

SEQ ID NO: 172393 - DNA, 19 bp, Homo sapiens
attttgtattgtttcaatt

SEQ ID NO: 172394 - DNA, 12 bp, Homo sapiens
attttgtctaaa

SEQ ID NO: 172395 - DNA, 16 bp, Homo sapiens
atttttaaaatattta

SEQ ID NO: 172396 - DNA, 17 bp, Homo sapiens
atttttaaagtatatat

SEQ ID NO: 172397 - DNA, 18 bp, Homo sapiens
atttttaatatatactat

SEQ ID NO: 172398 - DNA, 15 bp, Homo sapiens
atttttatatttagt

SEQ ID NO: 172399 - DNA, 10 bp, Homo sapiens
atttttccta

SEQ ID NO: 172400 - DNA, 15 bp, Homo sapiens
atttttcttatttca

SEQ ID NO: 172401 - DNA, 20 bp, Homo sapiens
atttttcttatttcatttct

SEQ ID NO: 172402 - DNA, 13 bp, Homo sapiens
atttttgatttat

SEQ ID NO: 172403 - DNA, 11 bp, Homo sapiens
attttttaagt

SEQ ID NO: 172404 - DNA, 20 bp, Homo sapiens
attttttaattattatttat

SEQ ID NO: 172405 - DNA, 13 bp, Homo sapiens
attttttattgtt

SEQ ID NO: 172406 - DNA, 13 bp, Homo sapiens
attttttcagaaa

SEQ ID NO: 172407 - DNA, 16 bp, Homo sapiens
atttttttaaccaaag

SEQ ID NO: 172408 - DNA, 15 bp, Homo sapiens
atttttttcaatatt

SEQ ID NO: 172409 - DNA, 19 bp, Homo sapiens
attttttttttaaattatt

SEQ ID NO: 172410 - DNA, 16 bp, Homo sapiens
caaaaaaatctgcaga

SEQ ID NO: 172411 - DNA, 17 bp, Homo sapiens
caaaaaaatctgcagaa

SEQ ID NO: 172412 - DNA, 21 bp, Homo sapiens
caaaaaaatctgcagaaggaa

SEQ ID NO: 172413 - DNA, 16 bp, Homo sapiens
caaaaacagcctcaca

SEQ ID NO: 172414 - DNA, 13 bp, Homo sapiens
caaaaagaacaaa

SEQ ID NO: 172415 - DNA, 16 bp, Homo sapiens
caaaaagcaaaatcat

SEQ ID NO: 172416 - DNA, 16 bp, Homo sapiens
caaaagggtgtctgag

SEQ ID NO: 172417 - DNA, 21 bp, Homo sapiens
caaaaggtattttaatcacca

SEQ ID NO: 172418 - DNA, 15 bp, Homo sapiens
caaaaggtgcctgtg

SEQ ID NO: 172419 - DNA, 17 bp, Homo sapiens
caaaagttctgacttga

SEQ ID NO: 172420 - DNA, 11 bp, Homo sapiens
caaaataaaaa

SEQ ID NO: 172421 - DNA, 15 bp, Homo sapiens
caaaataaaaaccaa

SEQ ID NO: 172422 - DNA, 13 bp, Homo sapiens
caaaatagaagct

SEQ ID NO: 172423 - DNA, 23 bp, Homo sapiens
caaaatcattttatatgtcaaag

SEQ ID NO: 172424 - DNA, 22 bp, Homo sapiens
caaaatgaggaatgtatatgtt

SEQ ID NO: 172425 - DNA, 20 bp, Homo sapiens
caaaatgatggacccaatgc

SEQ ID NO: 172426 - DNA, 15 bp, Homo sapiens
caaaattgatgtgtt

SEQ ID NO: 172427 - DNA, 16 bp, Homo sapiens
caaacaaaaaggttct

SEQ ID NO: 172428 - DNA, 20 bp, Homo sapiens
caaacaaaaaggttctcagg

SEQ ID NO: 172429 - DNA, 21 bp, Homo sapiens
caaacaaaaaggttctcaggt

SEQ ID NO: 172430 - DNA, 16 bp, Homo sapiens
caaacagtctcaggaa

SEQ ID NO: 172431 - DNA, 21 bp, Homo sapiens
caaacatgaccctaaatcttg

SEQ ID NO: 172432 - DNA, 15 bp, Homo sapiens
caaaccaaataaaaa

SEQ ID NO: 172433 - DNA, 18 bp, Homo sapiens
caaaccccgaccacctgc

SEQ ID NO: 172434 - DNA, 18 bp, Homo sapiens
caaacgctgcctgcccac

SEQ ID NO: 172435 - DNA, 14 bp, Homo sapiens
caaactgaagccag

SEQ ID NO: 172436 - DNA, 15 bp, Homo sapiens
caaactgaagccaga

SEQ ID NO: 172437 - DNA, 14 bp, Homo sapiens
caaagacagaagcc

SEQ ID NO: 172438 - DNA, 18 bp, Homo sapiens
caaagaccaaattccttg

SEQ ID NO: 172439 - DNA, 19 bp, Homo sapiens
caaagagagaaaataaaga

SEQ ID NO: 172440 - DNA, 20 bp, Homo sapiens
caaagaggcaagaggctgga

SEQ ID NO: 172441 - DNA, 16 bp, Homo sapiens
caaagagttaatatat

SEQ ID NO: 172442 - DNA, 20 bp, Homo sapiens
caaagcactgacttctaagt

SEQ ID NO: 172443 - DNA, 22 bp, Homo sapiens
caaagcactgacttctaagtaa

SEQ ID NO: 172444 - DNA, 20 bp, Homo sapiens
caaagccagcgtcctcctct

SEQ ID NO: 172445 - DNA, 21 bp, Homo sapiens
caaagccagcgtcctcctctg

SEQ ID NO: 172446 - DNA, 17 bp, Homo sapiens
caaagcctcctccagcc

SEQ ID NO: 172447 - DNA, 23 bp, Homo sapiens
caaagccttgtgtctacagagaa

SEQ ID NO: 172448 - DNA, 19 bp, Homo sapiens
caaagcttggaagagcctg

SEQ ID NO: 172449 - DNA, 23 bp, Homo sapiens
caaagctttcctgccccaggcct

SEQ ID NO: 172450 - DNA, 16 bp, Homo sapiens
caaaggaagtctagga

SEQ ID NO: 172451 - DNA, 17 bp, Homo sapiens
caaagggaaatatcatt

SEQ ID NO: 172452 - DNA, 14 bp, Homo sapiens
caaaggtataattt

SEQ ID NO: 172453 - DNA, 16 bp, Homo sapiens
caaaggtgaaggaata

SEQ ID NO: 172454 - DNA, 21 bp, Homo sapiens
caaagtaaaacttgctgcctg

SEQ ID NO: 172455 - DNA, 14 bp, Homo sapiens
caaagtctgtgtga

SEQ ID NO: 172456 - DNA, 20 bp, Homo sapiens
caaagtcttaaaataactta

SEQ ID NO: 172457 - DNA, 18 bp, Homo sapiens
caaataaaaatattgtgt

SEQ ID NO: 172458 - DNA, 17 bp, Homo sapiens
caaataaactctaaaca

SEQ ID NO: 172459 - DNA, 18 bp, Homo sapiens
caaatataagaataaaat

SEQ ID NO: 172460 - DNA, 12 bp, Homo sapiens
caaatatgcaaa

SEQ ID NO: 172461 - DNA, 13 bp, Homo sapiens
caaatatgcaaag

SEQ ID NO: 172462 - DNA, 14 bp, Homo sapiens
caaatatgcaaagc

SEQ ID NO: 172463 - DNA, 16 bp, Homo sapiens
caaatatgcaaagcac

SEQ ID NO: 172464 - DNA, 19 bp, Homo sapiens
caaatatgcaaagcactga

SEQ ID NO: 172465 - DNA, 17 bp, Homo sapiens
caaatatgtcctggggt

SEQ ID NO: 172466 - DNA, 13 bp, Homo sapiens
caaatcatagctg

SEQ ID NO: 172467 - DNA, 19 bp, Homo sapiens
caaatcttttagtcattat

SEQ ID NO: 172468 - DNA, 21 bp, Homo sapiens
caaatgctgcgcccttcccca

SEQ ID NO: 172469 - DNA, 14 bp, Homo sapiens
caaatggaaaggag

SEQ ID NO: 172470 - DNA, 17 bp, Homo sapiens
caaatgtgacctgtgtc

SEQ ID NO: 172471 - DNA, 18 bp, Homo sapiens
caaatgttcatcaatgaa

SEQ ID NO: 172472 - DNA, 21 bp, Homo sapiens
caaatgttcatcaatgaatga

SEQ ID NO: 172473 - DNA, 14 bp, Homo sapiens
caaattatttgtgt

SEQ ID NO: 172474 - DNA, 16 bp, Homo sapiens
caaattatttgtgtaa

SEQ ID NO: 172475 - DNA, 17 bp, Homo sapiens
caaattatttgtgtaat

SEQ ID NO: 172476 - DNA, 19 bp, Homo sapiens
caaattgcttgaaagaaaa

SEQ ID NO: 172477 - DNA, 15 bp, Homo sapiens
caaatttacagagac

SEQ ID NO: 172478 - DNA, 17 bp, Homo sapiens
caaatttacagagacag

SEQ ID NO: 172479 - DNA, 22 bp, Homo sapiens
caacaatacatgctgctaattc

SEQ ID NO: 172480 - DNA, 17 bp, Homo sapiens
caacagaagcttcagaa

SEQ ID NO: 172481 - DNA, 15 bp, Homo sapiens
caacagaagcttcca

SEQ ID NO: 172482 - DNA, 17 bp, Homo sapiens
caacagagaaggcagga

SEQ ID NO: 172483 - DNA, 15 bp, Homo sapiens
caacaggagctggga

SEQ ID NO: 172484 - DNA, 22 bp, Homo sapiens
caacaggagctgggatcctaag

SEQ ID NO: 172485 - DNA, 18 bp, Homo sapiens
caacatcccattgccctg

SEQ ID NO: 172486 - DNA, 19 bp, Homo sapiens
caacatcccattgccctgg

SEQ ID NO: 172487 - DNA, 20 bp, Homo sapiens
caacatcccattgccctggt

SEQ ID NO: 172488 - DNA, 13 bp, Homo sapiens
caacatggagaaa

SEQ ID NO: 172489 - DNA, 22 bp, Homo sapiens
caacatggagaaaccctgtctc

SEQ ID NO: 172490 - DNA, 18 bp, Homo sapiens
caaccaagtcatgtgcat

SEQ ID NO: 172491 - DNA, 14 bp, Homo sapiens
caaccactggtctg

SEQ ID NO: 172492 - DNA, 23 bp, Homo sapiens
cacctgtgcagcgaagcttagcg

SEQ ID NO: 172493 - DNA, 19 bp, Homo sapiens
caccttaccaactttctgt

SEQ ID NO: 172494 - DNA, 13 bp, Homo sapiens
caccttaggcagg

SEQ ID NO: 172495 - DNA, 19 bp, Homo sapiens
caccttcccagctctccct

SEQ ID NO: 172496 - DNA, 21 bp, Homo sapiens
caccttcccagctctccctct

SEQ ID NO: 172497 - DNA, 13 bp, Homo sapiens
caccttcccatgc

SEQ ID NO: 172498 - DNA, 14 bp, Homo sapiens
caccttcccatgcc

SEQ ID NO: 172499 - DNA, 16 bp, Homo sapiens
cacgaaatgttatttt

SEQ ID NO: 172500 - DNA, 18 bp, Homo sapiens
cacgaacccacctgctga

SEQ ID NO: 172501 - DNA, 22 bp, Homo sapiens
cacgaacccacctgctgagaga

SEQ ID NO: 172502 - DNA, 18 bp, Homo sapiens
cacgaatttgctggggaa

SEQ ID NO: 172503 - DNA, 16 bp, Homo sapiens
cacgactgcccggcag

SEQ ID NO: 172504 - DNA, 23 bp, Homo sapiens
cacgagcaaagtgaagacactgg

SEQ ID NO: 172505 - DNA, 22 bp, Homo sapiens
cacgagcaggctactgtcagct

SEQ ID NO: 172506 - DNA, 20 bp, Homo sapiens
cacgataaataatcggccca

SEQ ID NO: 172507 - DNA, 14 bp, Homo sapiens
cacgatgtggccct

SEQ ID NO: 172508 - DNA, 21 bp, Homo sapiens
cacgatgtggccctggcctgc

SEQ ID NO: 172509 - DNA, 12 bp, Homo sapiens
cacgcacctccc

SEQ ID NO: 172510 - DNA, 19 bp, Homo sapiens
cacgcacctcccatcctaa

SEQ ID NO: 172511 - DNA, 15 bp, Homo sapiens
cacgcccatgtgtga

SEQ ID NO: 172512 - DNA, 21 bp, Homo sapiens
cacgccctcccctcccctgct

SEQ ID NO: 172513 - DNA, 24 bp, Homo sapiens
cacgccctcccctcccctgctgca

SEQ ID NO: 172514 - DNA, 23 bp, Homo sapiens
cacgcctgcaaacgctgcctgcc

SEQ ID NO: 172515 - DNA, 18 bp, Homo sapiens
cacgcctgtaatcccagc

SEQ ID NO: 172516 - DNA, 19 bp, Homo sapiens
cacgcctgtaatcccagca

SEQ ID NO: 172517 - DNA, 20 bp, Homo sapiens
cacgcctgtaatcccagcac

SEQ ID NO: 172518 - DNA, 19 bp, Homo sapiens
cacgcctgtaatcctagca

SEQ ID NO: 172519 - DNA, 12 bp, Homo sapiens
cacgcctgtgca

SEQ ID NO: 172520 - DNA, 17 bp, Homo sapiens
cacgctttctagctgtt

SEQ ID NO: 172521 - DNA, 22 bp, Homo sapiens
cacggaagagccttgcggaagg

SEQ ID NO: 172522 - DNA, 16 bp, Homo sapiens
cacggagccactcctc

SEQ ID NO: 172523 - DNA, 19 bp, Homo sapiens
cacggagccactcctctga

SEQ ID NO: 172524 - DNA, 23 bp, Homo sapiens
cacggagccactcctctgactca

SEQ ID NO: 172525 - DNA, 20 bp, Homo sapiens
cacggcaggacaacgaggaa

SEQ ID NO: 172526 - DNA, 23 bp, Homo sapiens
cacgtagcccccaggctgctgga

SEQ ID NO: 172527 - DNA, 19 bp, Homo sapiens
cacgtagtagggtcaggcc

SEQ ID NO: 172528 - DNA, 21 bp, Homo sapiens
cacgtagtagggtcaggccac

SEQ ID NO: 172529 - DNA, 17 bp, Homo sapiens
cacgtcatgtttcttca

SEQ ID NO: 172530 - DNA, 12 bp, Homo sapiens
cacgtggcctct

SEQ ID NO: 172531 - DNA, 17 bp, Homo sapiens
cacgtggcctcttgagc

SEQ ID NO: 172532 - DNA, 18 bp, Homo sapiens
cacgtggcctcttgagca

SEQ ID NO: 172533 - DNA, 13 bp, Homo sapiens
cacgttcacccct

SEQ ID NO: 172534 - DNA, 15 bp, Homo sapiens
cactaaagtatgtaa

SEQ ID NO: 172535 - DNA, 19 bp, Homo sapiens
cactacataaactgacttt

SEQ ID NO: 172536 - DNA, 21 bp, Homo sapiens
cactaccacgccaagctaatt

SEQ ID NO: 172537 - DNA, 15 bp, Homo sapiens
cactactgacatgtg

SEQ ID NO: 172538 - DNA, 21 bp, Homo sapiens
cactagcctttggctctggag

SEQ ID NO: 172539 - DNA, 22 bp, Homo sapiens
cactagcctttggctctggaga

SEQ ID NO: 172540 - DNA, 15 bp, Homo sapiens
cactagtgcaaatca

SEQ ID NO: 172541 - DNA, 16 bp, Homo sapiens
cactcaagccaagcag

SEQ ID NO: 172542 - DNA, 21 bp, Homo sapiens
cactcaccagtgtcccctcca

SEQ ID NO: 172543 - DNA, 16 bp, Homo sapiens
cactccagacccctgg

SEQ ID NO: 172544 - DNA, 12 bp, Homo sapiens
cactccagcctg

SEQ ID NO: 172545 - DNA, 14 bp, Homo sapiens
cactccagcctggg

SEQ ID NO: 172546 - DNA, 16 bp, Homo sapiens
cactccagtgagacag

SEQ ID NO: 172547 - DNA, 17 bp, Homo sapiens
cactcccctgcactgga

SEQ ID NO: 172548 - DNA, 19 bp, Homo sapiens
cactcccttcccataagct

SEQ ID NO: 172549 - DNA, 13 bp, Homo sapiens
cactcccttgggc

SEQ ID NO: 172550 - DNA, 16 bp, Homo sapiens
cactcccttgggctcc

SEQ ID NO: 172551 - DNA, 20 bp, Homo sapiens
cactcccttgggctccctgt

SEQ ID NO: 172552 - DNA, 14 bp, Homo sapiens
cactcctacctggt

SEQ ID NO: 172553 - DNA, 15 bp, Homo sapiens
cactcctccaaagga

SEQ ID NO: 172554 - DNA, 12 bp, Homo sapiens
cactcctctgac

SEQ ID NO: 172555 - DNA, 13 bp, Homo sapiens
cactcctctgact

SEQ ID NO: 172556 - DNA, 23 bp, Homo sapiens
cactcctctgactcagggctcct

SEQ ID NO: 172557 - DNA, 14 bp, Homo sapiens
cactcctgccaagg

SEQ ID NO: 172558 - DNA, 11 bp, Homo sapiens
cactccttcct

SEQ ID NO: 172559 - DNA, 17 bp, Homo sapiens
cactccttcctgccacc

SEQ ID NO: 172560 - DNA, 20 bp, Homo sapiens
cactctctgaagatgatcat

SEQ ID NO: 172561 - DNA, 19 bp, Homo sapiens
cactctgcctctgcctgca

SEQ ID NO: 172562 - DNA, 16 bp, Homo sapiens
cactctgcttgttatt

SEQ ID NO: 172563 - DNA, 21 bp, Homo sapiens
cactctgctttgactgagcag

SEQ ID NO: 172564 - DNA, 19 bp, Homo sapiens
cactgaagttaacagagac

SEQ ID NO: 172565 - DNA, 14 bp, Homo sapiens
cactgagcaaagca

SEQ ID NO: 172566 - DNA, 17 bp, Homo sapiens
cactgaggcagggaagt

SEQ ID NO: 172567 - DNA, 22 bp, Homo sapiens
cactgcacagtgcatctcagcc

SEQ ID NO: 172568 - DNA, 19 bp, Homo sapiens
cactgcactccagcctggg

SEQ ID NO: 172569 - DNA, 20 bp, Homo sapiens
cactgcactccagcctgggt

SEQ ID NO: 172570 - DNA, 21 bp, Homo sapiens
cactgcccccagctcttctcc

SEQ ID NO: 172571 - DNA, 16 bp, Homo sapiens
cactgcctactgcatc

SEQ ID NO: 172572 - DNA, 16 bp, Homo sapiens
cactgcctctccctgg

SEQ ID NO: 172573 - DNA, 18 bp, Homo sapiens
cactgcctctccctggcc

SEQ ID NO: 172574 - DNA, 16 bp, Homo sapiens
cactgcctcttcctcc

SEQ ID NO: 172575 - DNA, 14 bp, Homo sapiens
cactgctccctgaa

SEQ ID NO: 172576 - DNA, 20 bp, Homo sapiens
cactgctccctgaagccagc

SEQ ID NO: 172577 - DNA, 21 bp, Homo sapiens
cactgctccctgaagccagcc

SEQ ID NO: 172578 - DNA, 17 bp, Homo sapiens
cactgctgcccagcctc

SEQ ID NO: 172579 - DNA, 13 bp, Homo sapiens
cactgctggctgc

SEQ ID NO: 172580 - DNA, 15 bp, Homo sapiens
cactgctggctgcct

SEQ ID NO: 172581 - DNA, 16 bp, Homo sapiens
cactgctggctgcctt

SEQ ID NO: 172582 - DNA, 17 bp, Homo sapiens
cactgctgtgctgtgcc

SEQ ID NO: 172583 - DNA, 20 bp, Homo sapiens
cactgggatgagccgctgtg

SEQ ID NO: 172584 - DNA, 13 bp, Homo sapiens
cactgggcttcta

SEQ ID NO: 172585 - DNA, 18 bp, Homo sapiens
cactgggggaggggacat

SEQ ID NO: 172586 - DNA, 15 bp, Homo sapiens
cactggggtcctggg

SEQ ID NO: 172587 - DNA, 23 bp, Homo sapiens
cactggtggcccgacagcctggc

SEQ ID NO: 172588 - DNA, 14 bp, Homo sapiens
cactgtcaagatga

SEQ ID NO: 172589 - DNA, 16 bp, Homo sapiens
cactgtcaccctccac

SEQ ID NO: 172590 - DNA, 19 bp, Homo sapiens
cactgtcactgtttctctg

SEQ ID NO: 172591 - DNA, 12 bp, Homo sapiens
cactgtcccttg

SEQ ID NO: 172592 - DNA, 17 bp, Homo sapiens
cactgttgaaaattatt

SEQ ID NO: 172593 - DNA, 21 bp, Homo sapiens
cactgttgaaaattattttaa

SEQ ID NO: 172594 - DNA, 15 bp, Homo sapiens
cacttaaaaatggtt

SEQ ID NO: 172595 - DNA, 13 bp, Homo sapiens
cacttaagagaat

SEQ ID NO: 172596 - DNA, 17 bp, Homo sapiens
cacttaagagaatattt

SEQ ID NO: 172597 - DNA, 20 bp, Homo sapiens
cacttaagagaatattttaa

SEQ ID NO: 172598 - DNA, 19 bp, Homo sapiens
cacttagaaattgcatttc

SEQ ID NO: 172599 - DNA, 24 bp, Homo sapiens
cacttagaaattgcatttcctgac

SEQ ID NO: 172600 - DNA, 21 bp, Homo sapiens
cacttcagctgacttttctgt

SEQ ID NO: 172601 - DNA, 14 bp, Homo sapiens
cacttccaccagcc

SEQ ID NO: 172602 - DNA, 17 bp, Homo sapiens
cacttccaccagcctgc

SEQ ID NO: 172603 - DNA, 20 bp, Homo sapiens
cacttccataatctggactc

SEQ ID NO: 172604 - DNA, 18 bp, Homo sapiens
cacttctaaatgaagtgc

SEQ ID NO: 172605 - DNA, 18 bp, Homo sapiens
cacttcttgttccccact

SEQ ID NO: 172606 - DNA, 20 bp, Homo sapiens
cacttgaacccgggaggcag

SEQ ID NO: 172607 - DNA, 19 bp, Homo sapiens
cacttgatgacccccaacc

SEQ ID NO: 172608 - DNA, 18 bp, Homo sapiens
cacttgcccctgttacct

SEQ ID NO: 172609 - DNA, 22 bp, Homo sapiens
cactttaattctcatgtgatcc

SEQ ID NO: 172610 - DNA, 16 bp, Homo sapiens
cactttctatagcaga

SEQ ID NO: 172611 - DNA, 19 bp, Homo sapiens
cactttgcactgatatatc

SEQ ID NO: 172612 - DNA, 12 bp, Homo sapiens
cactttgggagg

SEQ ID NO: 172613 - DNA, 19 bp, Homo sapiens
cactttgggaggccaagga

SEQ ID NO: 172614 - DNA, 13 bp, Homo sapiens
cacttttcagtga

SEQ ID NO: 172615 - DNA, 17 bp, Homo sapiens
cacttttgacaaaggca

SEQ ID NO: 172616 - DNA, 16 bp, Homo sapiens
cagaaaaactctggga

SEQ ID NO: 172617 - DNA, 19 bp, Homo sapiens
cagaaaaactctgggaaat

SEQ ID NO: 172618 - DNA, 21 bp, Homo sapiens
cagaaaaataacttcaagcaa

SEQ ID NO: 172619 - DNA, 19 bp, Homo sapiens
cagaaaacggttaaaactg

SEQ ID NO: 172620 - DNA, 19 bp, Homo sapiens
cagaaaatattatgtgttt

SEQ ID NO: 172621 - DNA, 22 bp, Homo sapiens
cagaaacaggtgcatctgggga

SEQ ID NO: 172622 - DNA, 20 bp, Homo sapiens
cagaaagactgagctcaagg

SEQ ID NO: 172623 - DNA, 16 bp, Homo sapiens
cagaaatacatatttc

SEQ ID NO: 172624 - DNA, 15 bp, Homo sapiens
cagaaatttttattt

SEQ ID NO: 172625 - DNA, 14 bp, Homo sapiens
cagaacagcagagg

SEQ ID NO: 172626 - DNA, 17 bp, Homo sapiens
cagaacagccgctcctg

SEQ ID NO: 172627 - DNA, 11 bp, Homo sapiens
cagaacagtga

SEQ ID NO: 172628 - DNA, 18 bp, Homo sapiens
cagaacagtgattaccag

SEQ ID NO: 172629 - DNA, 15 bp, Homo sapiens
cagaacgtggctctg

SEQ ID NO: 172630 - DNA, 18 bp, Homo sapiens
cagaacgtggctctgctg

SEQ ID NO: 172631 - DNA, 19 bp, Homo sapiens
cagaacgtggctctgctgg

SEQ ID NO: 172632 - DNA, 14 bp, Homo sapiens
cagaactctttcaa

SEQ ID NO: 172633 - DNA, 13 bp, Homo sapiens
cagaactggactc

SEQ ID NO: 172634 - DNA, 18 bp, Homo sapiens
cagaactggactcaggat

SEQ ID NO: 172635 - DNA, 20 bp, Homo sapiens
cagaagaattgaacccagga

SEQ ID NO: 172636 - DNA, 22 bp, Homo sapiens
cagaagaattgaacccaggagg

SEQ ID NO: 172637 - DNA, 21 bp, Homo sapiens
cagaagaccacaaaaattgac

SEQ ID NO: 172638 - DNA, 15 bp, Homo sapiens
cagaagataacttga

SEQ ID NO: 172639 - DNA, 19 bp, Homo sapiens
cagaagcaacccaaatgtt

SEQ ID NO: 172640 - DNA, 12 bp, Homo sapiens
cagaagcttcca

SEQ ID NO: 172641 - DNA, 17 bp, Homo sapiens
cagaaggaaaaatgtgt

SEQ ID NO: 172642 - DNA, 22 bp, Homo sapiens
cagccctgggccccaccaccta

SEQ ID NO: 172643 - DNA, 23 bp, Homo sapiens
cagccctgggccccaccacctag

SEQ ID NO: 172644 - DNA, 18 bp, Homo sapiens
cagccgattcacctgagc

SEQ ID NO: 172645 - DNA, 23 bp, Homo sapiens
cagccgccatgctcctggcccac

SEQ ID NO: 172646 - DNA, 16 bp, Homo sapiens
cagccgctcctgtctg

SEQ ID NO: 172647 - DNA, 17 bp, Homo sapiens
cagccgctcctgtctgc

SEQ ID NO: 172648 - DNA, 18 bp, Homo sapiens
cagccgctcctgtctgcc

SEQ ID NO: 172649 - DNA, 21 bp, Homo sapiens
cagccgctcctgtctgccagc

SEQ ID NO: 172650 - DNA, 23 bp, Homo sapiens
cagccggcacagggtctgctctt

SEQ ID NO: 172651 - DNA, 14 bp, Homo sapiens
cagccgtgccttca

SEQ ID NO: 172652 - DNA, 21 bp, Homo sapiens
cagccgtgtaaccatggaccc

SEQ ID NO: 172653 - DNA, 15 bp, Homo sapiens
cagcctaccatgaga

SEQ ID NO: 172654 - DNA, 15 bp, Homo sapiens
cagcctagccgacct

SEQ ID NO: 172655 - DNA, 20 bp, Homo sapiens
cagcctagccgacctcagcc

SEQ ID NO: 172656 - DNA, 12 bp, Homo sapiens
cagcctcacaga

SEQ ID NO: 172657 - DNA, 14 bp, Homo sapiens
cagcctcacagaag

SEQ ID NO: 172658 - DNA, 14 bp, Homo sapiens
cagcctccatgctg

SEQ ID NO: 172659 - DNA, 15 bp, Homo sapiens
cagcctccatgctgc

SEQ ID NO: 172660 - DNA, 20 bp, Homo sapiens
cagcctccatgctgcctcca

SEQ ID NO: 172661 - DNA, 19 bp, Homo sapiens
cagcctcccacccccatct

SEQ ID NO: 172662 - DNA, 19 bp, Homo sapiens
cagcctcccctgccagggc

SEQ ID NO: 172663 - DNA, 22 bp, Homo sapiens
cagcctcccctgccagggcagg

SEQ ID NO: 172664 - DNA, 22 bp, Homo sapiens
cagcctctcttggtttccttcc

SEQ ID NO: 172665 - DNA, 18 bp, Homo sapiens
cagcctctgagcccctgg

SEQ ID NO: 172666 - DNA, 22 bp, Homo sapiens
cagcctgagcgacagtgagact

SEQ ID NO: 172667 - DNA, 23 bp, Homo sapiens
cagcctgagcgacagtgagactc

SEQ ID NO: 172668 - DNA, 12 bp, Homo sapiens
cagcctgctcca

SEQ ID NO: 172669 - DNA, 16 bp, Homo sapiens
cagcctgctccagctg

SEQ ID NO: 172670 - DNA, 15 bp, Homo sapiens
cagcctggaccctgt

SEQ ID NO: 172671 - DNA, 19 bp, Homo sapiens
cagcctggaccctgtggat

SEQ ID NO: 172672 - DNA, 13 bp, Homo sapiens
cagcctggaggcc

SEQ ID NO: 172673 - DNA, 23 bp, Homo sapiens
cagcctggcgaaaccccatctct

SEQ ID NO: 172674 - DNA, 20 bp, Homo sapiens
cagcctgggcaacacagcga

SEQ ID NO: 172675 - DNA, 16 bp, Homo sapiens
cagcctgggcaatgtg

SEQ ID NO: 172676 - DNA, 23 bp, Homo sapiens
cagcctggtgggcctcctctgtc

SEQ ID NO: 172677 - DNA, 21 bp, Homo sapiens
cagcctgtcccatggacactc

SEQ ID NO: 172678 - DNA, 22 bp, Homo sapiens
cagcctgtcccatggacactcc

SEQ ID NO: 172679 - DNA, 16 bp, Homo sapiens
cagcctgtctcttcca

SEQ ID NO: 172680 - DNA, 17 bp, Homo sapiens
cagcctgtctcttccat

SEQ ID NO: 172681 - DNA, 19 bp, Homo sapiens
cagcctgtctcttccatat

SEQ ID NO: 172682 - DNA, 18 bp, Homo sapiens
cagcctgtggcggtgcct

SEQ ID NO: 172683 - DNA, 19 bp, Homo sapiens
cagcctgtggcggtgcctg

SEQ ID NO: 172684 - DNA, 16 bp, Homo sapiens
atcaaactgaagccag

SEQ ID NO: 172685 - DNA, 23 bp, Homo sapiens
atcaaagaggttttaaaaaaatc

SEQ ID NO: 172686 - DNA, 16 bp, Homo sapiens
atcaaatatgcaaagc

SEQ ID NO: 172687 - DNA, 22 bp, Homo sapiens
atcaaatttcacgtcgtcttct

SEQ ID NO: 172688 - DNA, 16 bp, Homo sapiens
atcaacaaaaattgtc

SEQ ID NO: 172689 - DNA, 15 bp, Homo sapiens
atcaagaaagtgttg

SEQ ID NO: 172690 - DNA, 22 bp, Homo sapiens
atcaagatgagagaactggagg

SEQ ID NO: 172691 - DNA, 13 bp, Homo sapiens
atcaagcccttta

SEQ ID NO: 172692 - DNA, 20 bp, Homo sapiens
atcaatattgtcattcctgt

SEQ ID NO: 172693 - DNA, 13 bp, Homo sapiens
atcaatcaactta

SEQ ID NO: 172694 - DNA, 22 bp, Homo sapiens
atcaatcatctgtgtgaaaatg

SEQ ID NO: 172695 - DNA, 14 bp, Homo sapiens
atcaatttttctta

SEQ ID NO: 172696 - DNA, 12 bp, Homo sapiens
atcaccagagag

SEQ ID NO: 172697 - DNA, 23 bp, Homo sapiens
atcaccagagagggactgacacc

SEQ ID NO: 172698 - DNA, 20 bp, Homo sapiens
atcaccgacgcgtctcctgt

SEQ ID NO: 172699 - DNA, 18 bp, Homo sapiens
atcaccttaggcagggaa

SEQ ID NO: 172700 - DNA, 16 bp, Homo sapiens
atcactggcaatgaaa

SEQ ID NO: 172701 - DNA, 22 bp, Homo sapiens
atcactggcaatgaaaaattct

SEQ ID NO: 172702 - DNA, 13 bp, Homo sapiens
atcacttttcagt

SEQ ID NO: 172703 - DNA, 23 bp, Homo sapiens
atcagaagaccacaaaaattgac

SEQ ID NO: 172704 - DNA, 13 bp, Homo sapiens
atcagaagataac

SEQ ID NO: 172705 - DNA, 20 bp, Homo sapiens
atcagaccataatgttacat

SEQ ID NO: 172706 - DNA, 15 bp, Homo sapiens
atcagaccctacccc

SEQ ID NO: 172707 - DNA, 18 bp, Homo sapiens
atcagaccctaccccacc

SEQ ID NO: 172708 - DNA, 15 bp, Homo sapiens
atcagccacattcta

SEQ ID NO: 172709 - DNA, 13 bp, Homo sapiens
atcagcctcttaa

SEQ ID NO: 172710 - DNA, 18 bp, Homo sapiens
atcagcctgctccagctg

SEQ ID NO: 172711 - DNA, 18 bp, Homo sapiens
atcagcctgtctcttcca

SEQ ID NO: 172712 - DNA, 19 bp, Homo sapiens
atcagcctgtctcttccat

SEQ ID NO: 172713 - DNA, 17 bp, Homo sapiens
atcagctccttcctgga

SEQ ID NO: 172714 - DNA, 22 bp, Homo sapiens
atcagctgctgaaacaacaaat

SEQ ID NO: 172715 - DNA, 22 bp, Homo sapiens
atcagcttgccctgttaaaaga

SEQ ID NO: 172716 - DNA, 16 bp, Homo sapiens
atcaggacccagagga

SEQ ID NO: 172717 - DNA, 15 bp, Homo sapiens
atcagtaatatttat

SEQ ID NO: 172718 - DNA, 15 bp, Homo sapiens
atcagtgctccctca

SEQ ID NO: 172719 - DNA, 20 bp, Homo sapiens
atcagtgtgtctaaatttga

SEQ ID NO: 172720 - DNA, 16 bp, Homo sapiens
atcagttactcagccc

SEQ ID NO: 172721 - DNA, 18 bp, Homo sapiens
atcagttactcagccctg

SEQ ID NO: 172722 - DNA, 21 bp, Homo sapiens
atcagttactcagccctgggc

SEQ ID NO: 172723 - DNA, 12 bp, Homo sapiens
atcataaaataa

SEQ ID NO: 172724 - DNA, 12 bp, Homo sapiens
atcatagtacag

SEQ ID NO: 172725 - DNA, 16 bp, Homo sapiens
atcatcctttccagca

SEQ ID NO: 172726 - DNA, 18 bp, Homo sapiens
atcatgaaatatgcatct

SEQ ID NO: 172727 - DNA, 18 bp, Homo sapiens
atcatgaagatatttttc

SEQ ID NO: 172728 - DNA, 23 bp, Homo sapiens
atcatgagtgaataaatgtcttg

SEQ ID NO: 172729 - DNA, 12 bp, Homo sapiens
atcatgtcccca

SEQ ID NO: 172730 - DNA, 14 bp, Homo sapiens
atcatgtccccaaa

SEQ ID NO: 172731 - DNA, 14 bp, Homo sapiens
atcattctctgtct

SEQ ID NO: 172732 - DNA, 20 bp, Homo sapiens
atcattcttatttcatgaaa

SEQ ID NO: 172733 - DNA, 23 bp, Homo sapiens
atcattcttatttcatgaaaatt

SEQ ID NO: 172734 - DNA, 15 bp, Homo sapiens
atcatttctatttct

SEQ ID NO: 172735 - DNA, 20 bp, Homo sapiens
atcatttctgcatcagctgc

SEQ ID NO: 172736 - DNA, 17 bp, Homo sapiens
atcattttatatgtcaa

SEQ ID NO: 172737 - DNA, 19 bp, Homo sapiens
atcattttatatgtcaaag

SEQ ID NO: 172738 - DNA, 22 bp, Homo sapiens
atccaagacagaataatgaatg

SEQ ID NO: 172739 - DNA, 20 bp, Homo sapiens
atccaatctaaccacatcaa

SEQ ID NO: 172740 - DNA, 17 bp, Homo sapiens
atccaccacctccctca

SEQ ID NO: 172741 - DNA, 13 bp, Homo sapiens
atccacccagccc

SEQ ID NO: 172742 - DNA, 18 bp, Homo sapiens
atccagggatgccatctg

SEQ ID NO: 172743 - DNA, 18 bp, Homo sapiens
atccatcatcatgtgtgt

SEQ ID NO: 172744 - DNA, 14 bp, Homo sapiens
atccattcctcagg

SEQ ID NO: 172745 - DNA, 22 bp, Homo sapiens
atccattcctcagggacagaga

SEQ ID NO: 172746 - DNA, 21 bp, Homo sapiens
atccatttcatctatttctga

SEQ ID NO: 172747 - DNA, 19 bp, Homo sapiens
atcccagcactttgggagg

SEQ ID NO: 172748 - DNA, 15 bp, Homo sapiens
atcccatgtatttat

SEQ ID NO: 172749 - DNA, 12 bp, Homo sapiens
atcccccagcct

SEQ ID NO: 172750 - DNA, 19 bp, Homo sapiens
atcccgagcacctccacat

SEQ ID NO: 172751 - DNA, 14 bp, Homo sapiens
atccctacatgtat

SEQ ID NO: 172752 - DNA, 15 bp, Homo sapiens
atccctacatgtatt

SEQ ID NO: 172753 - DNA, 21 bp, Homo sapiens
atccctagtcttcaagcagat

SEQ ID NO: 172754 - DNA, 14 bp, Homo sapiens
atccctcacctgta

SEQ ID NO: 172755 - DNA, 13 bp, Homo sapiens
atccctcatctgt

SEQ ID NO: 172756 - DNA, 14 bp, Homo sapiens
atccctgcctggtc

SEQ ID NO: 172757 - DNA, 18 bp, Homo sapiens
atccctgtgttgtctcta

SEQ ID NO: 172758 - DNA, 23 bp, Homo sapiens
atccctgtttaatatttaaacag

SEQ ID NO: 172759 - DNA, 18 bp, Homo sapiens
atccctttttgaagtgta

SEQ ID NO: 172760 - DNA, 16 bp, Homo sapiens
atcctaggcatttgct

SEQ ID NO: 172761 - DNA, 23 bp, Homo sapiens
atcctatcagcctgtctcttcca

SEQ ID NO: 172762 - DNA, 16 bp, Homo sapiens
atcctgcagcctcctc

SEQ ID NO: 172763 - DNA, 17 bp, Homo sapiens
atcctgcagcctcctcc

SEQ ID NO: 172764 - DNA, 22 bp, Homo sapiens
atcctggttggtgttgcagaag

SEQ ID NO: 172765 - DNA, 13 bp, Homo sapiens
atccttttatgtt

SEQ ID NO: 172766 - DNA, 23 bp, Homo sapiens
atcgatgggggagtctgaagcag

SEQ ID NO: 172767 - DNA, 11 bp, Homo sapiens
atcgattggct

SEQ ID NO: 172768 - DNA, 20 bp, Homo sapiens
atcgcaccactgtgtattta

SEQ ID NO: 172769 - DNA, 23 bp, Homo sapiens
atcggcccacagctcccacccca

SEQ ID NO: 172770 - DNA, 18 bp, Homo sapiens
atcgtgccgttactctcc

SEQ ID NO: 172771 - DNA, 19 bp, Homo sapiens
atcgtgccgttactctcca

SEQ ID NO: 172772 - DNA, 23 bp, Homo sapiens
atctaaaaatagacttaaatctc

SEQ ID NO: 172773 - DNA, 22 bp, Homo sapiens
atctaaactggattcacagctc

SEQ ID NO: 172774 - DNA, 14 bp, Homo sapiens
atctaaccacatca

SEQ ID NO: 172775 - DNA, 18 bp, Homo sapiens
atctaacctcatcttctt

SEQ ID NO: 172776 - DNA, 18 bp, Homo sapiens
atctaaggatgtcacagg

SEQ ID NO: 172777 - DNA, 14 bp, Homo sapiens
atctaagtgatata

SEQ ID NO: 172778 - DNA, 21 bp, Homo sapiens
atctaatagcgggttactttc

SEQ ID NO: 172779 - DNA, 22 bp, Homo sapiens
atctaatagcgggttactttca

SEQ ID NO: 172780 - DNA, 16 bp, Homo sapiens
atctaattattttgca

SEQ ID NO: 172781 - DNA, 19 bp, Homo sapiens
atctacactccagtgagac

SEQ ID NO: 172782 - DNA, 22 bp, Homo sapiens
atctatcaatagtcaagaaaaa

SEQ ID NO: 172783 - DNA, 11 bp, Homo sapiens
atctcagccca

SEQ ID NO: 172784 - DNA, 16 bp, Homo sapiens
atctcaggggccagag

SEQ ID NO: 172785 - DNA, 23 bp, Homo sapiens
atctcataggttgccaataatac

SEQ ID NO: 172786 - DNA, 24 bp, Homo sapiens
atctcatggagaagcagaaataca

SEQ ID NO: 172787 - DNA, 16 bp, Homo sapiens
atctcattgcttacaa

SEQ ID NO: 172788 - DNA, 15 bp, Homo sapiens
atctcattggaccct

SEQ ID NO: 172789 - DNA, 19 bp, Homo sapiens
atctcattggacccttcca

SEQ ID NO: 172790 - DNA, 19 bp, Homo sapiens
atctccacagtcaaagaag

SEQ ID NO: 172791 - DNA, 20 bp, Homo sapiens
atctcccagataatgtgaaa

SEQ ID NO: 172792 - DNA, 23 bp, Homo sapiens
atctcgtttttcttcttaagact

SEQ ID NO: 172793 - DNA, 15 bp, Homo sapiens
atctctccctcccct

SEQ ID NO: 172794 - DNA, 19 bp, Homo sapiens
atctctttttgctttcgaa

SEQ ID NO: 172795 - DNA, 18 bp, Homo sapiens
caggcccccaagcctgca

SEQ ID NO: 172796 - DNA, 14 bp, Homo sapiens
caggcccccaggtg

SEQ ID NO: 172797 - DNA, 19 bp, Homo sapiens
caggcccccaggtgccagt

SEQ ID NO: 172798 - DNA, 19 bp, Homo sapiens
caggccccgcttgtccagc

SEQ ID NO: 172799 - DNA, 18 bp, Homo sapiens
caggcccggcgcggtggc

SEQ ID NO: 172800 - DNA, 15 bp, Homo sapiens
caggcccttcctctc

SEQ ID NO: 172801 - DNA, 19 bp, Homo sapiens
caggcccttcctctccact

SEQ ID NO: 172802 - DNA, 21 bp, Homo sapiens
caggcccttcctctccactgc

SEQ ID NO: 172803 - DNA, 16 bp, Homo sapiens
caggccgccccagcct

SEQ ID NO: 172804 - DNA, 23 bp, Homo sapiens
caggccgccccagcctctgagcc

SEQ ID NO: 172805 - DNA, 15 bp, Homo sapiens
caggccgtggctgcc

SEQ ID NO: 172806 - DNA, 17 bp, Homo sapiens
caggccgtggctgccca

SEQ ID NO: 172807 - DNA, 15 bp, Homo sapiens
caggcctctgtgtcc

SEQ ID NO: 172808 - DNA, 22 bp, Homo sapiens
caggcctgaaagaggctgaggc

SEQ ID NO: 172809 - DNA, 17 bp, Homo sapiens
caggcctggcaagtggg

SEQ ID NO: 172810 - DNA, 20 bp, Homo sapiens
caggcctggcaagtgggtga

SEQ ID NO: 172811 - DNA, 21 bp, Homo sapiens
caggcgggagcggtggccctg

SEQ ID NO: 172812 - DNA, 22 bp, Homo sapiens
caggctcatagggaagacctgc

SEQ ID NO: 172813 - DNA, 13 bp, Homo sapiens
caggctccttcct

SEQ ID NO: 172814 - DNA, 17 bp, Homo sapiens
caggctccttcctgtct

SEQ ID NO: 172815 - DNA, 21 bp, Homo sapiens
caggctctgccctgccctagc

SEQ ID NO: 172816 - DNA, 12 bp, Homo sapiens
caggctcttagc

SEQ ID NO: 172817 - DNA, 22 bp, Homo sapiens
caggctcttagcagcttccaga

SEQ ID NO: 172818 - DNA, 12 bp, Homo sapiens
caggctcttctc

SEQ ID NO: 172819 - DNA, 14 bp, Homo sapiens
caggctcttctcct

SEQ ID NO: 172820 - DNA, 16 bp, Homo sapiens
caggctgctggaggaa

SEQ ID NO: 172821 - DNA, 15 bp, Homo sapiens
caggctggtgggagg

SEQ ID NO: 172822 - DNA, 18 bp, Homo sapiens
caggctggtgggaggggc

SEQ ID NO: 172823 - DNA, 14 bp, Homo sapiens
cagggaagtcccca

SEQ ID NO: 172824 - DNA, 16 bp, Homo sapiens
cagggaagtccccagg

SEQ ID NO: 172825 - DNA, 17 bp, Homo sapiens
cagggaagtccccaggc

SEQ ID NO: 172826 - DNA, 14 bp, Homo sapiens
cagggacagagaca

SEQ ID NO: 172827 - DNA, 17 bp, Homo sapiens
cagggacagagacacct

SEQ ID NO: 172828 - DNA, 20 bp, Homo sapiens
cagggacagagacacctgca

SEQ ID NO: 172829 - DNA, 14 bp, Homo sapiens
cagggacagagcca

SEQ ID NO: 172830 - DNA, 16 bp, Homo sapiens
cagggagggcttctgc

SEQ ID NO: 172831 - DNA, 20 bp, Homo sapiens
cagggattaacctctgcact

SEQ ID NO: 172832 - DNA, 11 bp, Homo sapiens
cagggcactgc

SEQ ID NO: 172833 - DNA, 15 bp, Homo sapiens
cagggcactgctgct

SEQ ID NO: 172834 - DNA, 13 bp, Homo sapiens
cagggcagagtga

SEQ ID NO: 172835 - DNA, 22 bp, Homo sapiens
cagggcatgccccggccacctc

SEQ ID NO: 172836 - DNA, 23 bp, Homo sapiens
cagggcatgccccggccacctct

SEQ ID NO: 172837 - DNA, 20 bp, Homo sapiens
cagggcatggccaggtggcc

SEQ ID NO: 172838 - DNA, 19 bp, Homo sapiens
cagggccaacttgagggcc

SEQ ID NO: 172839 - DNA, 21 bp, Homo sapiens
cagggccacgtgccaggcccg

SEQ ID NO: 172840 - DNA, 20 bp, Homo sapiens
cagggccaggactgagcccc

SEQ ID NO: 172841 - DNA, 22 bp, Homo sapiens
cagggccccagcactaaagcag

SEQ ID NO: 172842 - DNA, 20 bp, Homo sapiens
cagggccccaggcattgcca

SEQ ID NO: 172843 - DNA, 15 bp, Homo sapiens
cagggccctgagctc

SEQ ID NO: 172844 - DNA, 21 bp, Homo sapiens
cagggccctgagctcggtgga

SEQ ID NO: 172845 - DNA, 16 bp, Homo sapiens
cagggcctgagcctgg

SEQ ID NO: 172846 - DNA, 15 bp, Homo sapiens
cagggccttgcccag

SEQ ID NO: 172847 - DNA, 18 bp, Homo sapiens
cagggccttgcccagaga

SEQ ID NO: 172848 - DNA, 15 bp, Homo sapiens
cagggctaccctccc

SEQ ID NO: 172849 - DNA, 17 bp, Homo sapiens
cagggctaccctccccc

SEQ ID NO: 172850 - DNA, 19 bp, Homo sapiens
cagggctaccctgagctga

SEQ ID NO: 172851 - DNA, 24 bp, Homo sapiens
cagggctaccctgagctgaggcag

SEQ ID NO: 172852 - DNA, 14 bp, Homo sapiens
cagggctagtgact

SEQ ID NO: 172853 - DNA, 14 bp, Homo sapiens
cagggctcagcctg

SEQ ID NO: 172854 - DNA, 15 bp, Homo sapiens
cagggctcagcctgg

SEQ ID NO: 172855 - DNA, 12 bp, Homo sapiens
cagggctcctgg

SEQ ID NO: 172856 - DNA, 17 bp, Homo sapiens
caggggaaaatcagcct

SEQ ID NO: 172857 - DNA, 16 bp, Homo sapiens
caggggaaaatgaagg

SEQ ID NO: 172858 - DNA, 17 bp, Homo sapiens
caggggagagggtctgg

SEQ ID NO: 172859 - DNA, 15 bp, Homo sapiens
caggggccagaggaa

SEQ ID NO: 172860 - DNA, 17 bp, Homo sapiens
caggggctacaagaggg

SEQ ID NO: 172861 - DNA, 18 bp, Homo sapiens
caggggctacaagaggga

SEQ ID NO: 172862 - DNA, 15 bp, Homo sapiens
caggggctctggaga

SEQ ID NO: 172863 - DNA, 16 bp, Homo sapiens
caggggctctggagag

SEQ ID NO: 172864 - DNA, 18 bp, Homo sapiens
caggggctctggagagaa

SEQ ID NO: 172865 - DNA, 16 bp, Homo sapiens
cagggtagcaggtacc

SEQ ID NO: 172866 - DNA, 14 bp, Homo sapiens
cagggtcaggagag

SEQ ID NO: 172867 - DNA, 17 bp, Homo sapiens
cagggtctgctctttct

SEQ ID NO: 172868 - DNA, 17 bp, Homo sapiens
cagggtgggatggagga

SEQ ID NO: 172869 - DNA, 20 bp, Homo sapiens
cagggttgaccccagaggat

SEQ ID NO: 172870 - DNA, 22 bp, Homo sapiens
cagggtttggctgtgtctaaac

SEQ ID NO: 172871 - DNA, 12 bp, Homo sapiens
caggtagccagg

SEQ ID NO: 172872 - DNA, 15 bp, Homo sapiens
caggtagctgcccct

SEQ ID NO: 172873 - DNA, 21 bp, Homo sapiens
caggtagctgcccctggctct

SEQ ID NO: 172874 - DNA, 22 bp, Homo sapiens
caggtagctgcccctggctctg

SEQ ID NO: 172875 - DNA, 16 bp, Homo sapiens
caggtcagggtgagga

SEQ ID NO: 172876 - DNA, 14 bp, Homo sapiens
caggtctcacgggc

SEQ ID NO: 172877 - DNA, 20 bp, Homo sapiens
caggtctcccacgtgggaga

SEQ ID NO: 172878 - DNA, 17 bp, Homo sapiens
caggtctcctcttaaaa

SEQ ID NO: 172879 - DNA, 19 bp, Homo sapiens
caggtgccagttatggcta

SEQ ID NO: 172880 - DNA, 12 bp, Homo sapiens
caggtgcctgga

SEQ ID NO: 172881 - DNA, 15 bp, Homo sapiens
caggtgcctggacat

SEQ ID NO: 172882 - DNA, 13 bp, Homo sapiens
caggtgctgctgc

SEQ ID NO: 172883 - DNA, 19 bp, Homo sapiens
caggtggctgacccagtcc

SEQ ID NO: 172884 - DNA, 20 bp, Homo sapiens
caggtggctgacccagtccc

SEQ ID NO: 172885 - DNA, 19 bp, Homo sapiens
caggtggggagactgggct

SEQ ID NO: 172886 - DNA, 21 bp, Homo sapiens
caggttggtgggggcctcggt

SEQ ID NO: 172887 - DNA, 18 bp, Homo sapiens
caggtttaagctgttact

SEQ ID NO: 172888 - DNA, 20 bp, Homo sapiens
cagtaatatttatatattta

SEQ ID NO: 172889 - DNA, 16 bp, Homo sapiens
cagtacaggcagcaca

SEQ ID NO: 172890 - DNA, 20 bp, Homo sapiens
cagtacctataaagtaaagc

SEQ ID NO: 172891 - DNA, 18 bp, Homo sapiens
cagtagaaataatatgca

SEQ ID NO: 172892 - DNA, 12 bp, Homo sapiens
cagtaggagccc

SEQ ID NO: 172893 - DNA, 23 bp, Homo sapiens
cagtataattgagttttcagtgg

SEQ ID NO: 172894 - DNA, 13 bp, Homo sapiens
cagtatgaaaata

SEQ ID NO: 172895 - DNA, 15 bp, Homo sapiens
cagtatgttgtcaaa

SEQ ID NO: 172896 - DNA, 21 bp, Homo sapiens
cagtattctaggtagtgccct

SEQ ID NO: 172897 - DNA, 19 bp, Homo sapiens
cagtattcttgtcaaaaaa

SEQ ID NO: 172898 - DNA, 14 bp, Homo sapiens
cagtattttggaga

SEQ ID NO: 172899 - DNA, 18 bp, Homo sapiens
cagtattttggagaaatt

SEQ ID NO: 172900 - DNA, 15 bp, Homo sapiens
cagtcaaaacagaga

SEQ ID NO: 172901 - DNA, 21 bp, Homo sapiens
cagtcaggaaaggaatcattt

SEQ ID NO: 172902 - DNA, 16 bp, Homo sapiens
cagtcagtaattgcca

SEQ ID NO: 172903 - DNA, 16 bp, Homo sapiens
cagtccacctgagctg

SEQ ID NO: 172904 - DNA, 20 bp, Homo sapiens
cagtccacctgagctgccat

SEQ ID NO: 172905 - DNA, 21 bp, Homo sapiens
cagtccctgggggaagccctg

SEQ ID NO: 172906 - DNA, 12 bp, Homo sapiens
cagtcctcccct

SEQ ID NO: 172907 - DNA, 13 bp, Homo sapiens
cagtcctcccctc

SEQ ID NO: 172908 - DNA, 14 bp, Homo sapiens
cagtcctcccctca

SEQ ID NO: 172909 - DNA, 21 bp, Homo sapiens
cagtcctcccctcacagcctc

SEQ ID NO: 172910 - DNA, 23 bp, Homo sapiens
cagtcctcccctcacagcctctg

SEQ ID NO: 172911 - DNA, 17 bp, Homo sapiens
cagtcctgcctcagcct

SEQ ID NO: 172912 - DNA, 21 bp, Homo sapiens
cagtctacccacctcagcctc

SEQ ID NO: 172913 - DNA, 22 bp, Homo sapiens
cagtctcgggtggctagtcaga

SEQ ID NO: 172914 - DNA, 12 bp, Homo sapiens
cagtctgaccct

SEQ ID NO: 172915 - DNA, 17 bp, Homo sapiens
cagtgaatgattcagtg

SEQ ID NO: 172916 - DNA, 18 bp, Homo sapiens
cagtgacctgaggaagcg

SEQ ID NO: 172917 - DNA, 22 bp, Homo sapiens
cagtgagaaaaagctcctgtcc

SEQ ID NO: 172918 - DNA, 18 bp, Homo sapiens
cagtgagattacagagga

SEQ ID NO: 172919 - DNA, 20 bp, Homo sapiens
cagtgagattacagaggaag

SEQ ID NO: 172920 - DNA, 16 bp, Homo sapiens
cagtgagcactcccaa

SEQ ID NO: 172921 - DNA, 24 bp, Homo sapiens
cagtgagccgagattgcaccactg

SEQ ID NO: 172922 - DNA, 19 bp, Homo sapiens
cagtgagccgcatcttctc

SEQ ID NO: 172923 - DNA, 14 bp, Homo sapiens
cagtgagtgagcct

SEQ ID NO: 172924 - DNA, 16 bp, Homo sapiens
cagtgagtgagcctgg

SEQ ID NO: 172925 - DNA, 20 bp, Homo sapiens
cagtgatgctggatgctcct

SEQ ID NO: 172926 - DNA, 15 bp, Homo sapiens
cagtgccaagcacag

SEQ ID NO: 172927 - DNA, 15 bp, Homo sapiens
cagtgccagcaatga

SEQ ID NO: 172928 - DNA, 16 bp, Homo sapiens
cagtgcccaccaacat

SEQ ID NO: 172929 - DNA, 10 bp, Homo sapiens
cagtgcctgc

SEQ ID NO: 172930 - DNA, 17 bp, Homo sapiens
cagtgccttacctcctg

SEQ ID NO: 172931 - DNA, 20 bp, Homo sapiens
cagtgccttacctcctgccc

SEQ ID NO: 172932 - DNA, 21 bp, Homo sapiens
cagtgccttacctcctgccca

SEQ ID NO: 172933 - DNA, 20 bp, Homo sapiens
cagtgcttgagtttggggaa

SEQ ID NO: 172934 - DNA, 20 bp, Homo sapiens
cagtggaggaagagggacag

SEQ ID NO: 172935 - DNA, 19 bp, Homo sapiens
cagtgggaacgtgactgcc

SEQ ID NO: 172936 - DNA, 11 bp, Homo sapiens
cagtgggaact

SEQ ID NO: 172937 - DNA, 14 bp, Homo sapiens
cagtgggagaaaac

SEQ ID NO: 172938 - DNA, 15 bp, Homo sapiens
cagtggggcagtcat

SEQ ID NO: 172939 - DNA, 23 bp, Homo sapiens
cagtgtatttgtatttttttgca

SEQ ID NO: 172940 - DNA, 16 bp, Homo sapiens
cagtgtgaggccaggg

SEQ ID NO: 172941 - DNA, 17 bp, Homo sapiens
cagtgtgaggccagggc

SEQ ID NO: 172942 - DNA, 14 bp, Homo sapiens
ccaactttctgtaa

SEQ ID NO: 172943 - DNA, 13 bp, Homo sapiens
ccaagaaagcagg

SEQ ID NO: 172944 - DNA, 13 bp, Homo sapiens
ccaagaagttgga

SEQ ID NO: 172945 - DNA, 22 bp, Homo sapiens
ccaagacttggcaacagaagca

SEQ ID NO: 172946 - DNA, 19 bp, Homo sapiens
ccaagacttggtgtccttt

SEQ ID NO: 172947 - DNA, 20 bp, Homo sapiens
ccaagcaaaggtgaagagac

SEQ ID NO: 172948 - DNA, 18 bp, Homo sapiens
ccaagcagccaagctcct

SEQ ID NO: 172949 - DNA, 18 bp, Homo sapiens
ccaagcaggaaatgaaaa

SEQ ID NO: 172950 - DNA, 13 bp, Homo sapiens
ccaagcaggaagc

SEQ ID NO: 172951 - DNA, 13 bp, Homo sapiens
ccaagcctgacca

SEQ ID NO: 172952 - DNA, 13 bp, Homo sapiens
ccaagctcacagt

SEQ ID NO: 172953 - DNA, 19 bp, Homo sapiens
ccaaggctgattaaaccaa

SEQ ID NO: 172954 - DNA, 14 bp, Homo sapiens
ccaaggctggggga

SEQ ID NO: 172955 - DNA, 18 bp, Homo sapiens
ccaagggcaaaattccca

SEQ ID NO: 172956 - DNA, 16 bp, Homo sapiens
ccaagtgggggcagag

SEQ ID NO: 172957 - DNA, 18 bp, Homo sapiens
ccaagtgggggcagaggg

SEQ ID NO: 172958 - DNA, 13 bp, Homo sapiens
ccaagtgtgtgtg

SEQ ID NO: 172959 - DNA, 17 bp, Homo sapiens
ccaagtgtgtgtgcgtg

SEQ ID NO: 172960 - DNA, 22 bp, Homo sapiens
ccaataaatgtgaaattctgtc

SEQ ID NO: 172961 - DNA, 13 bp, Homo sapiens
ccaatattataat

SEQ ID NO: 172962 - DNA, 17 bp, Homo sapiens
ccaatatttaccagacc

SEQ ID NO: 172963 - DNA, 18 bp, Homo sapiens
ccaatctaaccacatcaa

SEQ ID NO: 172964 - DNA, 12 bp, Homo sapiens
ccaatgtcttga

SEQ ID NO: 172965 - DNA, 22 bp, Homo sapiens
ccaattatatgagacgtttttg

SEQ ID NO: 172966 - DNA, 19 bp, Homo sapiens
ccaattcgaactttttcca

SEQ ID NO: 172967 - DNA, 16 bp, Homo sapiens
ccacaagaaatgaaag

SEQ ID NO: 172968 - DNA, 21 bp, Homo sapiens
ccacaagattcccagagacag

SEQ ID NO: 172969 - DNA, 15 bp, Homo sapiens
ccacaagttaaataa

SEQ ID NO: 172970 - DNA, 20 bp, Homo sapiens
ccacaagttaaataaatcat

SEQ ID NO: 172971 - DNA, 19 bp, Homo sapiens
ccacacccagcctcagtcc

SEQ ID NO: 172972 - DNA, 19 bp, Homo sapiens
ccacacctggcactgctgt

SEQ ID NO: 172973 - DNA, 20 bp, Homo sapiens
ccacacttcaggctcttctc

SEQ ID NO: 172974 - DNA, 22 bp, Homo sapiens
ccacacttcaggctcttctcct

SEQ ID NO: 172975 - DNA, 16 bp, Homo sapiens
ccacagcctcccctgc

SEQ ID NO: 172976 - DNA, 20 bp, Homo sapiens
ccacagcctcccctgccagg

SEQ ID NO: 172977 - DNA, 15 bp, Homo sapiens
ccacagctcccaccc

SEQ ID NO: 172978 - DNA, 16 bp, Homo sapiens
ccacagctcccacccc

SEQ ID NO: 172979 - DNA, 17 bp, Homo sapiens
ccacagctcccacccca

SEQ ID NO: 172980 - DNA, 17 bp, Homo sapiens
ccacagcttcccctctc

SEQ ID NO: 172981 - DNA, 16 bp, Homo sapiens
ccacaggcccacagta

SEQ ID NO: 172982 - DNA, 14 bp, Homo sapiens
ccacagggctaaga

SEQ ID NO: 172983 - DNA, 19 bp, Homo sapiens
ccacatagtgatggttccc

SEQ ID NO: 172984 - DNA, 20 bp, Homo sapiens
ccacatcccgggacgcagca

SEQ ID NO: 172985 - DNA, 13 bp, Homo sapiens
ccacatcctccac

SEQ ID NO: 172986 - DNA, 14 bp, Homo sapiens
ccaccaactcttgc

SEQ ID NO: 172987 - DNA, 17 bp, Homo sapiens
ccaccaagacttgtttt

SEQ ID NO: 172988 - DNA, 21 bp, Homo sapiens
ccaccaagagggacgcctggg

SEQ ID NO: 172989 - DNA, 21 bp, Homo sapiens
ccaccacctaggccactcctc

SEQ ID NO: 172990 - DNA, 21 bp, Homo sapiens
ccaccacgatgtggccctggc

SEQ ID NO: 172991 - DNA, 23 bp, Homo sapiens
ccaccagactgacaaatgtgtat

SEQ ID NO: 172992 - DNA, 15 bp, Homo sapiens
ccaccatcctgcagc

SEQ ID NO: 172993 - DNA, 14 bp, Homo sapiens
ccaccccaccccct

SEQ ID NO: 172994 - DNA, 17 bp, Homo sapiens
ccaccccacccccttca

SEQ ID NO: 172995 - DNA, 21 bp, Homo sapiens
ccaccccccagaacctgtcct

SEQ ID NO: 172996 - DNA, 13 bp, Homo sapiens
actctgcttgtta

SEQ ID NO: 172997 - DNA, 14 bp, Homo sapiens
actctgctttgact

SEQ ID NO: 172998 - DNA, 23 bp, Homo sapiens
actctgctttgactgagcagact

SEQ ID NO: 172999 - DNA, 15 bp, Homo sapiens
actctgtcttgtgtt

SEQ ID NO: 173000 - DNA, 17 bp, Homo sapiens
actcttaggaagagaaa

SEQ ID NO: 173001 - DNA, 19 bp, Homo sapiens
actcttaggaagagaaacc

SEQ ID NO: 173002 - DNA, 20 bp, Homo sapiens
actcttaggaagagaaacca

SEQ ID NO: 173003 - DNA, 15 bp, Homo sapiens
actcttagttactca

SEQ ID NO: 173004 - DNA, 20 bp, Homo sapiens
actcttcttaacttaaattt

SEQ ID NO: 173005 - DNA, 18 bp, Homo sapiens
actctttgaatgacaaag

SEQ ID NO: 173006 - DNA, 13 bp, Homo sapiens
actctttgagaaa

SEQ ID NO: 173007 - DNA, 18 bp, Homo sapiens
actctttgagaaacaaca

SEQ ID NO: 173008 - DNA, 13 bp, Homo sapiens
actctttgtaaga

SEQ ID NO: 173009 - DNA, 13 bp, Homo sapiens
actgaaggagaag

SEQ ID NO: 173010 - DNA, 14 bp, Homo sapiens
actgaaggagaagg

SEQ ID NO: 173011 - DNA, 19 bp, Homo sapiens
actgaagtttcacatgagc

SEQ ID NO: 173012 - DNA, 18 bp, Homo sapiens
actgacagcctcccaccc

SEQ ID NO: 173013 - DNA, 15 bp, Homo sapiens
actgaccagcctcca

SEQ ID NO: 173014 - DNA, 13 bp, Homo sapiens
actgacttctaag

SEQ ID NO: 173015 - DNA, 22 bp, Homo sapiens
actgacttctaagtaaaaccac

SEQ ID NO: 173016 - DNA, 14 bp, Homo sapiens
actgactttatcct

SEQ ID NO: 173017 - DNA, 18 bp, Homo sapiens
actgagataccagcgagg

SEQ ID NO: 173018 - DNA, 15 bp, Homo sapiens
actgaggcacgagca

SEQ ID NO: 173019 - DNA, 17 bp, Homo sapiens
actgatttcacaacaga

SEQ ID NO: 173020 - DNA, 15 bp, Homo sapiens
actgatttttgtgat

SEQ ID NO: 173021 - DNA, 22 bp, Homo sapiens
actgcaaatgtcatcagaactt

SEQ ID NO: 173022 - DNA, 16 bp, Homo sapiens
actgcaagagccttgg

SEQ ID NO: 173023 - DNA, 17 bp, Homo sapiens
actgcagggactgccag

SEQ ID NO: 173024 - DNA, 18 bp, Homo sapiens
actgcagggactgccagt

SEQ ID NO: 173025 - DNA, 23 bp, Homo sapiens
actgcattaccgcgttgtaaaat

SEQ ID NO: 173026 - DNA, 19 bp, Homo sapiens
actgccagtccccctgccc

SEQ ID NO: 173027 - DNA, 22 bp, Homo sapiens
actgccataaaacattaagaaa

SEQ ID NO: 173028 - DNA, 21 bp, Homo sapiens
actgccccaactcctggaagc

SEQ ID NO: 173029 - DNA, 14 bp, Homo sapiens
accctcgtggcctt

SEQ ID NO: 173030 - DNA, 14 bp, Homo sapiens
accctctccacccc

SEQ ID NO: 173031 - DNA, 16 bp, Homo sapiens
accctctccaccccat

SEQ ID NO: 173032 - DNA, 14 bp, Homo sapiens
accctctgccacca

SEQ ID NO: 173033 - DNA, 19 bp, Homo sapiens
accctctgccaccagagac

SEQ ID NO: 173034 - DNA, 14 bp, Homo sapiens
accctcttagaaaa

SEQ ID NO: 173035 - DNA, 22 bp, Homo sapiens
accctgagctgaggcagcagtg

SEQ ID NO: 173036 - DNA, 17 bp, Homo sapiens
accctggaccagtggtc

SEQ ID NO: 173037 - DNA, 19 bp, Homo sapiens
acccttacagtaggagccc

SEQ ID NO: 173038 - DNA, 18 bp, Homo sapiens
acccttaccatgtgcctg

SEQ ID NO: 173039 - DNA, 13 bp, Homo sapiens
acccttgaaaaga

SEQ ID NO: 173040 - DNA, 16 bp, Homo sapiens
acccttgaaaagacat

SEQ ID NO: 173041 - DNA, 21 bp, Homo sapiens
accctttccttccttccctgg

SEQ ID NO: 173042 - DNA, 12 bp, Homo sapiens
acccttttccag

SEQ ID NO: 173043 - DNA, 14 bp, Homo sapiens
acccttttgtctgc

SEQ ID NO: 173044 - DNA, 18 bp, Homo sapiens
accgacgcgtctcctgtt

SEQ ID NO: 173045 - DNA, 17 bp, Homo sapiens
accgagagtagccgaga

SEQ ID NO: 173046 - DNA, 17 bp, Homo sapiens
accgagtctcttctcca

SEQ ID NO: 173047 - DNA, 18 bp, Homo sapiens
accgagtctcttctccac

SEQ ID NO: 173048 - DNA, 13 bp, Homo sapiens
accggatcctggg

SEQ ID NO: 173049 - DNA, 17 bp, Homo sapiens
accggcaatttccggcc

SEQ ID NO: 173050 - DNA, 13 bp, Homo sapiens
accggtacagaaa

SEQ ID NO: 173051 - DNA, 22 bp, Homo sapiens
accgtcatggcttaatgtttat

SEQ ID NO: 173052 - DNA, 17 bp, Homo sapiens
accgtcctcacccctgt

SEQ ID NO: 173053 - DNA, 18 bp, Homo sapiens
accgtcctcacccctgtc

SEQ ID NO: 173054 - DNA, 21 bp, Homo sapiens
accgtcctcacccctgtcctc

SEQ ID NO: 173055 - DNA, 14 bp, Homo sapiens
accgtgggctccct

SEQ ID NO: 173056 - DNA, 18 bp, Homo sapiens
accgttggggattgggga

SEQ ID NO: 173057 - DNA, 19 bp, Homo sapiens
acctaaaaaagatatatta

SEQ ID NO: 173058 - DNA, 22 bp, Homo sapiens
acctaaaaggaaatctcacccc

SEQ ID NO: 173059 - DNA, 19 bp, Homo sapiens
acctaattagagcagatga

SEQ ID NO: 173060 - DNA, 19 bp, Homo sapiens
acctataaagtaaagctaa

SEQ ID NO: 173061 - DNA, 22 bp, Homo sapiens
acctatggtataatggttgact

SEQ ID NO: 173062 - DNA, 22 bp, Homo sapiens
acctcaacccccatttctattt

SEQ ID NO: 173063 - DNA, 15 bp, Homo sapiens
acctcacgcacctcc

SEQ ID NO: 173064 - DNA, 16 bp, Homo sapiens
acctcacgcacctccc

SEQ ID NO: 173065 - DNA, 22 bp, Homo sapiens
acctcagccatgaggagttgct

SEQ ID NO: 173066 - DNA, 23 bp, Homo sapiens
acctcagccatgaggagttgctg

SEQ ID NO: 173067 - DNA, 12 bp, Homo sapiens
acctcagcctgt

SEQ ID NO: 173068 - DNA, 20 bp, Homo sapiens
acctcagccttccccttgcc

SEQ ID NO: 173069 - DNA, 17 bp, Homo sapiens
acctcagttttatcatt

SEQ ID NO: 173070 - DNA, 18 bp, Homo sapiens
acctcatgcatctccacc

SEQ ID NO: 173071 - DNA, 20 bp, Homo sapiens
acctcatgcatctccacctg

SEQ ID NO: 173072 - DNA, 13 bp, Homo sapiens
acctccacagctt

SEQ ID NO: 173073 - DNA, 14 bp, Homo sapiens
acctccacagcttc

SEQ ID NO: 173074 - DNA, 16 bp, Homo sapiens
acctccacatcctcca

SEQ ID NO: 173075 - DNA, 19 bp, Homo sapiens
acctccccacgccctcccc

SEQ ID NO: 173076 - DNA, 22 bp, Homo sapiens
acctccccacgccctcccctcc

SEQ ID NO: 173077 - DNA, 13 bp, Homo sapiens
acctccccagccc

SEQ ID NO: 173078 - DNA, 13 bp, Homo sapiens
acctccccccact

SEQ ID NO: 173079 - DNA, 18 bp, Homo sapiens
acctccccccactgcagg

SEQ ID NO: 173080 - DNA, 21 bp, Homo sapiens
acctcccctatccacccagcc

SEQ ID NO: 173081 - DNA, 14 bp, Homo sapiens
acctcctgcccagg

SEQ ID NO: 173082 - DNA, 16 bp, Homo sapiens
acctcctgcccaggag

SEQ ID NO: 173083 - DNA, 19 bp, Homo sapiens
acctcctgcccaggagagc

SEQ ID NO: 173084 - DNA, 14 bp, Homo sapiens
acctctctttttca

SEQ ID NO: 173085 - DNA, 21 bp, Homo sapiens
acctctgcacaagctgcaccc

SEQ ID NO: 173086 - DNA, 21 bp, Homo sapiens
acctctgcactactgacatgt

SEQ ID NO: 173087 - DNA, 14 bp, Homo sapiens
acctctgcctcaat

SEQ ID NO: 173088 - DNA, 14 bp, Homo sapiens
acctctgcggaccc

SEQ ID NO: 173089 - DNA, 14 bp, Homo sapiens
acctctgtgacctc

SEQ ID NO: 173090 - DNA, 15 bp, Homo sapiens
acctctgtgacctca

SEQ ID NO: 173091 - DNA, 16 bp, Homo sapiens
acctctgtgacctcag

SEQ ID NO: 173092 - DNA, 15 bp, Homo sapiens
acctcttcacccccc

SEQ ID NO: 173093 - DNA, 15 bp, Homo sapiens
acctgaaaaaaagtt

SEQ ID NO: 173094 - DNA, 18 bp, Homo sapiens
acctgaaaaaaagtttac

SEQ ID NO: 173095 - DNA, 11 bp, Homo sapiens
acctgaaaaca

SEQ ID NO: 173096 - DNA, 19 bp, Homo sapiens
acctgaaaacactgtgcac

SEQ ID NO: 173097 - DNA, 21 bp, Homo sapiens
acctgaaaacactgtgcacat

SEQ ID NO: 173098 - DNA, 17 bp, Homo sapiens
acctgacactcccttgg

SEQ ID NO: 173099 - DNA, 17 bp, Homo sapiens
acctgaccaacatggag

SEQ ID NO: 173100 - DNA, 18 bp, Homo sapiens
acctgagcaggacctctg

SEQ ID NO: 173101 - DNA, 12 bp, Homo sapiens
acctgagcccca

SEQ ID NO: 173102 - DNA, 21 bp, Homo sapiens
acctgagcccggatgcttctc

SEQ ID NO: 173103 - DNA, 12 bp, Homo sapiens
acctgagctgcc

SEQ ID NO: 173104 - DNA, 15 bp, Homo sapiens
acctgcacctccccc

SEQ ID NO: 173105 - DNA, 16 bp, Homo sapiens
acctgcacctcccccc

SEQ ID NO: 173106 - DNA, 22 bp, Homo sapiens
acctgcacctccccccactgca

SEQ ID NO: 173107 - DNA, 16 bp, Homo sapiens
acctgcccccaatcca

SEQ ID NO: 173108 - DNA, 12 bp, Homo sapiens
acctgccctgcc

SEQ ID NO: 173109 - DNA, 17 bp, Homo sapiens
acctgccctgcccccac

SEQ ID NO: 173110 - DNA, 13 bp, Homo sapiens
acctgccgacctc

SEQ ID NO: 173111 - DNA, 20 bp, Homo sapiens
acctgccgacctcgtcctcc

SEQ ID NO: 173112 - DNA, 11 bp, Homo sapiens
acctgcctgta

SEQ ID NO: 173113 - DNA, 17 bp, Homo sapiens
acctgctcccaggccag

SEQ ID NO: 173114 - DNA, 18 bp, Homo sapiens
acctgctctcctcttgcc

SEQ ID NO: 173115 - DNA, 19 bp, Homo sapiens
acctgctctcctcttgcca

SEQ ID NO: 173116 - DNA, 16 bp, Homo sapiens
acctgctgagagaccc

SEQ ID NO: 173117 - DNA, 22 bp, Homo sapiens
acctgctgagagacccaaggag

SEQ ID NO: 173118 - DNA, 23 bp, Homo sapiens
acctgctgagggaccagccaaga

SEQ ID NO: 173119 - DNA, 19 bp, Homo sapiens
acctggggcagtcacctgc

SEQ ID NO: 173120 - DNA, 23 bp, Homo sapiens
acctggtcacaggactctgcctc

SEQ ID NO: 173121 - DNA, 15 bp, Homo sapiens
acctgtaatcccagc

SEQ ID NO: 173122 - DNA, 17 bp, Homo sapiens
acctgtagtcccagcta

SEQ ID NO: 173123 - DNA, 14 bp, Homo sapiens
acctgtgcctcggc

SEQ ID NO: 173124 - DNA, 18 bp, Homo sapiens
acctgttttcgcacctac

SEQ ID NO: 173125 - DNA, 16 bp, Homo sapiens
accttaccaactttct

SEQ ID NO: 173126 - DNA, 19 bp, Homo sapiens
accttaccaactttctgta

SEQ ID NO: 173127 - DNA, 22 bp, Homo sapiens
accttagatgttctaagtcttt

SEQ ID NO: 173128 - DNA, 16 bp, Homo sapiens
accttaggcagggaag

SEQ ID NO: 173129 - DNA, 14 bp, Homo sapiens
accttattgtacct

SEQ ID NO: 173130 - DNA, 17 bp, Homo sapiens
accttattgtacctctc

SEQ ID NO: 173131 - DNA, 12 bp, Homo sapiens
accttcccagct

SEQ ID NO: 173132 - DNA, 17 bp, Homo sapiens
accttcccagctctccc

SEQ ID NO: 173133 - DNA, 19 bp, Homo sapiens
accttcccagctctccctc

SEQ ID NO: 173134 - DNA, 22 bp, Homo sapiens
accttcgtttactatgcctgtg

SEQ ID NO: 173135 - DNA, 12 bp, Homo sapiens
accttctgtggc

SEQ ID NO: 173136 - DNA, 16 bp, Homo sapiens
accttctgtggctcac

SEQ ID NO: 173137 - DNA, 19 bp, Homo sapiens
accttcttcagccacctct

SEQ ID NO: 173138 - DNA, 20 bp, Homo sapiens
accttgtggcaagcccctgc

SEQ ID NO: 173139 - DNA, 14 bp, Homo sapiens
accttgttcacact

SEQ ID NO: 173140 - DNA, 14 bp, Homo sapiens
acctttattaaaat

SEQ ID NO: 173141 - DNA, 15 bp, Homo sapiens
acctttcacatagag

SEQ ID NO: 173142 - DNA, 14 bp, Homo sapiens
accttttattacat

SEQ ID NO: 173143 - DNA, 14 bp, Homo sapiens
acgaacccacctgc

SEQ ID NO: 173144 - DNA, 15 bp, Homo sapiens
acgactgcccggcag

SEQ ID NO: 173145 - DNA, 20 bp, Homo sapiens
acgagcaggctactgtcagc

SEQ ID NO: 173146 - DNA, 19 bp, Homo sapiens
acgagctgtttactaggga

SEQ ID NO: 173147 - DNA, 12 bp, Homo sapiens
acgaggaagccc

SEQ ID NO: 173148 - DNA, 14 bp, Homo sapiens
acgaggtatgaggt

SEQ ID NO: 173149 - DNA, 16 bp, Homo sapiens
acgatgtggccctggc

SEQ ID NO: 173150 - DNA, 18 bp, Homo sapiens
acgatgtggccctggcct

SEQ ID NO: 173151 - DNA, 19 bp, Homo sapiens
acgatgtggccctggcctg

SEQ ID NO: 173152 - DNA, 18 bp, Homo sapiens
acgatttagaaagaagcc

SEQ ID NO: 173153 - DNA, 20 bp, Homo sapiens
aaaggtattttaatcaccaa

SEQ ID NO: 173154 - DNA, 15 bp, Homo sapiens
aaaggtgaaggaata

SEQ ID NO: 173155 - DNA, 16 bp, Homo sapiens
aaaggtgaaggaatat

SEQ ID NO: 173156 - DNA, 17 bp, Homo sapiens
aaaggttcactaaagca

SEQ ID NO: 173157 - DNA, 13 bp, Homo sapiens
aaagtacatttaa

SEQ ID NO: 173158 - DNA, 15 bp, Homo sapiens
aaagtacatttaata

SEQ ID NO: 173159 - DNA, 23 bp, Homo sapiens
aaagtatatatttatttaagctt

SEQ ID NO: 173160 - DNA, 19 bp, Homo sapiens
aaagtatggtattgaaact

SEQ ID NO: 173161 - DNA, 15 bp, Homo sapiens
aaagtgtgtattaaa

SEQ ID NO: 173162 - DNA, 21 bp, Homo sapiens
aaagttccctacttcctgtga

SEQ ID NO: 173163 - DNA, 23 bp, Homo sapiens
aaagttctgcagataaacagtag

SEQ ID NO: 173164 - DNA, 13 bp, Homo sapiens
aaagtttgccaga

SEQ ID NO: 173165 - DNA, 14 bp, Homo sapiens
aaataaaaatattg

SEQ ID NO: 173166 - DNA, 17 bp, Homo sapiens
aaataaaacctttcaaa

SEQ ID NO: 173167 - DNA, 14 bp, Homo sapiens
aaataaaataaagc

SEQ ID NO: 173168 - DNA, 14 bp, Homo sapiens
aaataaaatgacca

SEQ ID NO: 173169 - DNA, 19 bp, Homo sapiens
aaataaacctcaaaatgtc

SEQ ID NO: 173170 - DNA, 14 bp, Homo sapiens
aaataaactctaaa

SEQ ID NO: 173171 - DNA, 18 bp, Homo sapiens
aaataaagttggtgacag

SEQ ID NO: 173172 - DNA, 11 bp, Homo sapiens
aaataaatata

SEQ ID NO: 173173 - DNA, 19 bp, Homo sapiens
aaataaatttggttctaat

SEQ ID NO: 173174 - DNA, 13 bp, Homo sapiens
aaataacacacat

SEQ ID NO: 173175 - DNA, 15 bp, Homo sapiens
aaataacttcaagca

SEQ ID NO: 173176 - DNA, 23 bp, Homo sapiens
aaataagacggatttatttttcc

SEQ ID NO: 173177 - DNA, 12 bp, Homo sapiens
aaataagagaga

SEQ ID NO: 173178 - DNA, 19 bp, Homo sapiens
aaataataaagatgctctt

SEQ ID NO: 173179 - DNA, 13 bp, Homo sapiens
aaataatatgcat

SEQ ID NO: 173180 - DNA, 15 bp, Homo sapiens
aaataatcggcccac

SEQ ID NO: 173181 - DNA, 19 bp, Homo sapiens
aaatacacactcaaatcaa

SEQ ID NO: 173182 - DNA, 22 bp, Homo sapiens
aaatacagtcttccatttgcaa

SEQ ID NO: 173183 - DNA, 16 bp, Homo sapiens
aaatacatatttccaa

SEQ ID NO: 173184 - DNA, 21 bp, Homo sapiens
aaataccaaaattatttcaga

SEQ ID NO: 173185 - DNA, 23 bp, Homo sapiens
aaataccaaaattatttcagaaa

SEQ ID NO: 173186 - DNA, 19 bp, Homo sapiens
aaataccccatcattcatg

SEQ ID NO: 173187 - DNA, 17 bp, Homo sapiens
aaatagagtatatgcac

SEQ ID NO: 173188 - DNA, 15 bp, Homo sapiens
aaatagcttgtatag

SEQ ID NO: 173189 - DNA, 14 bp, Homo sapiens
aaatataagaataa

SEQ ID NO: 173190 - DNA, 14 bp, Homo sapiens
aaatatatataaac

SEQ ID NO: 173191 - DNA, 19 bp, Homo sapiens
aaatatatatatatataaa

SEQ ID NO: 173192 - DNA, 22 bp, Homo sapiens
aaatatatttaagataattata

SEQ ID NO: 173193 - DNA, 14 bp, Homo sapiens
aaatatatttaatg

SEQ ID NO: 173194 - DNA, 18 bp, Homo sapiens
aaatatcatttatttttt

SEQ ID NO: 173195 - DNA, 15 bp, Homo sapiens
aaatatgcaaagcac

SEQ ID NO: 173196 - DNA, 12 bp, Homo sapiens
aaatatgcatct

SEQ ID NO: 173197 - DNA, 20 bp, Homo sapiens
aaatatggaacttctaatat

SEQ ID NO: 173198 - DNA, 20 bp, Homo sapiens
aaatatgttagcaaagagtt

SEQ ID NO: 173199 - DNA, 14 bp, Homo sapiens
aaatattatgtgtt

SEQ ID NO: 173200 - DNA, 15 bp, Homo sapiens
aaatattcctgcatt

SEQ ID NO: 173201 - DNA, 10 bp, Homo sapiens
aaatatttat

SEQ ID NO: 173202 - DNA, 16 bp, Homo sapiens
aaatattttgctagtt

SEQ ID NO: 173203 - DNA, 22 bp, Homo sapiens
aaatattttgtctaaaatgcct

SEQ ID NO: 173204 - DNA, 21 bp, Homo sapiens
aaatattttttcttttctatt

SEQ ID NO: 173205 - DNA, 14 bp, Homo sapiens
aaatcaaatatgca

SEQ ID NO: 173206 - DNA, 18 bp, Homo sapiens
aaatcaaatatgcaaagc

SEQ ID NO: 173207 - DNA, 22 bp, Homo sapiens
aaatcaccacaccaaacctctc

SEQ ID NO: 173208 - DNA, 18 bp, Homo sapiens
aaatcagcctgctccagc

SEQ ID NO: 173209 - DNA, 23 bp, Homo sapiens
aaatcagcctgctccagctgttc

SEQ ID NO: 173210 - DNA, 22 bp, Homo sapiens
aaatcataggaaagtatttttt

SEQ ID NO: 173211 - DNA, 19 bp, Homo sapiens
aaatcattaatactcttct

SEQ ID NO: 173212 - DNA, 11 bp, Homo sapiens
aaatcatttct

SEQ ID NO: 173213 - DNA, 12 bp, Homo sapiens
aaatcatttctg

SEQ ID NO: 173214 - DNA, 23 bp, Homo sapiens
aaatcatttctgcatcagctgct

SEQ ID NO: 173215 - DNA, 16 bp, Homo sapiens
aaatcattttatatgt

SEQ ID NO: 173216 - DNA, 21 bp, Homo sapiens
aaatcattttatatgtcaaag

SEQ ID NO: 173217 - DNA, 12 bp, Homo sapiens
aaatcctctggc

SEQ ID NO: 173218 - DNA, 16 bp, Homo sapiens
aaatcctttactgtta

SEQ ID NO: 173219 - DNA, 17 bp, Homo sapiens
aaatctaatattaaaaa

SEQ ID NO: 173220 - DNA, 18 bp, Homo sapiens
aaatctaatattaaaaat

SEQ ID NO: 173221 - DNA, 19 bp, Homo sapiens
aaatctaatattaaaaata

SEQ ID NO: 173222 - DNA, 13 bp, Homo sapiens
aaatctatgccac

SEQ ID NO: 173223 - DNA, 22 bp, Homo sapiens
aaatctcagaattccttttcta

SEQ ID NO: 173224 - DNA, 13 bp, Homo sapiens
aaatctctaatat

SEQ ID NO: 173225 - DNA, 15 bp, Homo sapiens
aaatgaaaatgtctt

SEQ ID NO: 173226 - DNA, 11 bp, Homo sapiens
aaatgaaaatt

SEQ ID NO: 173227 - DNA, 19 bp, Homo sapiens
aaatgaaggttaggattta

SEQ ID NO: 173228 - DNA, 14 bp, Homo sapiens
aaatgaggaatgta

SEQ ID NO: 173229 - DNA, 18 bp, Homo sapiens
aaatgaggaatgtatatg

SEQ ID NO: 173230 - DNA, 16 bp, Homo sapiens
aaatgaggacatgttt

SEQ ID NO: 173231 - DNA, 22 bp, Homo sapiens
aaatgagtttttatggggctga

SEQ ID NO: 173232 - DNA, 21 bp, Homo sapiens
aaatgattttatctgtgaatt

SEQ ID NO: 173233 - DNA, 21 bp, Homo sapiens
aaatgcaaacacacaaaggta

SEQ ID NO: 173234 - DNA, 14 bp, Homo sapiens
aaatgcaagatttt

SEQ ID NO: 173235 - DNA, 23 bp, Homo sapiens
aaatgcatccattcctcagggac

SEQ ID NO: 173236 - DNA, 21 bp, Homo sapiens
aaatgcctcagtgtatttgta

SEQ ID NO: 173237 - DNA, 20 bp, Homo sapiens
aaatgctaggttaattccaa

SEQ ID NO: 173238 - DNA, 21 bp, Homo sapiens
aaatgctgcgcccttccccag

SEQ ID NO: 173239 - DNA, 16 bp, Homo sapiens
aaatgtaagggaaact

SEQ ID NO: 173240 - DNA, 14 bp, Homo sapiens
aaatgtatcttatt

SEQ ID NO: 173241 - DNA, 17 bp, Homo sapiens
aaatgtatcttattcac

SEQ ID NO: 173242 - DNA, 24 bp, Homo sapiens
aaatgtctagttgtaacaccatga

SEQ ID NO: 173243 - DNA, 12 bp, Homo sapiens
aaatgtcttgtg

SEQ ID NO: 173244 - DNA, 22 bp, Homo sapiens
aaatgtgcattcttttaaaaga

SEQ ID NO: 173245 - DNA, 23 bp, Homo sapiens
aaatgtgcattcttttaaaagac

SEQ ID NO: 173246 - DNA, 13 bp, Homo sapiens
aaatgttcacttt

SEQ ID NO: 173247 - DNA, 13 bp, Homo sapiens
aaatgttcatcaa

SEQ ID NO: 173248 - DNA, 17 bp, Homo sapiens
aaatgttcatcaatgaa

SEQ ID NO: 173249 - DNA, 17 bp, Homo sapiens
aaattaacagtcctaac

SEQ ID NO: 173250 - DNA, 19 bp, Homo sapiens
aaattagctgtgtgaaata

SEQ ID NO: 173251 - DNA, 19 bp, Homo sapiens
aaattaggatttcatgatt

SEQ ID NO: 173252 - DNA, 21 bp, Homo sapiens
aaattagttagccaatatttt

SEQ ID NO: 173253 - DNA, 15 bp, Homo sapiens
aaattatatcaattt

SEQ ID NO: 173254 - DNA, 13 bp, Homo sapiens
aaattatttgcat

SEQ ID NO: 173255 - DNA, 22 bp, Homo sapiens
aaattcatttttttcactggag

SEQ ID NO: 173256 - DNA, 23 bp, Homo sapiens
aaattccttagcttagacctcag

SEQ ID NO: 173257 - DNA, 22 bp, Homo sapiens
aaattgtttaagtgttgtaaat

SEQ ID NO: 173258 - DNA, 16 bp, Homo sapiens
aaatttgaagaatgaa

SEQ ID NO: 173259 - DNA, 18 bp, Homo sapiens
aaatttgttgaaattatg

SEQ ID NO: 173260 - DNA, 13 bp, Homo sapiens
aaattttattcct

SEQ ID NO: 173261 - DNA, 19 bp, Homo sapiens
ccagccagcagccagctct

SEQ ID NO: 173262 - DNA, 19 bp, Homo sapiens
ccagccagtgacctgagga

SEQ ID NO: 173263 - DNA, 14 bp, Homo sapiens
ccagcccagcccag

SEQ ID NO: 173264 - DNA, 21 bp, Homo sapiens
ccagcccattctctctcctgt

SEQ ID NO: 173265 - DNA, 23 bp, Homo sapiens
ccagcccctagcccaggagagag

SEQ ID NO: 173266 - DNA, 21 bp, Homo sapiens
ccagccccttctcagaatcta

SEQ ID NO: 173267 - DNA, 14 bp, Homo sapiens
ccagccctcatccc

SEQ ID NO: 173268 - DNA, 14 bp, Homo sapiens
ccagccctccctgt

SEQ ID NO: 173269 - DNA, 15 bp, Homo sapiens
ccagccctccctgtc

SEQ ID NO: 173270 - DNA, 20 bp, Homo sapiens
ccagccctccctgtcctcct

SEQ ID NO: 173271 - DNA, 14 bp, Homo sapiens
ccagccgccatgct

SEQ ID NO: 173272 - DNA, 12 bp, Homo sapiens
ccagcctcagtc

SEQ ID NO: 173273 - DNA, 15 bp, Homo sapiens
ccagcctcagtcctc

SEQ ID NO: 173274 - DNA, 16 bp, Homo sapiens
ccagcctccatgctgc

SEQ ID NO: 173275 - DNA, 16 bp, Homo sapiens
ccagcctcgtcttcat

SEQ ID NO: 173276 - DNA, 15 bp, Homo sapiens
ccagcctctcccctg

SEQ ID NO: 173277 - DNA, 22 bp, Homo sapiens
ccagcctctcttggtttccttc

SEQ ID NO: 173278 - DNA, 20 bp, Homo sapiens
ccagcctttgatcaggtggg

SEQ ID NO: 173279 - DNA, 13 bp, Homo sapiens
ccagcgtcctcct

SEQ ID NO: 173280 - DNA, 17 bp, Homo sapiens
ccagcgtcctcctctgt

SEQ ID NO: 173281 - DNA, 15 bp, Homo sapiens
ccagctactcaggag

SEQ ID NO: 173282 - DNA, 19 bp, Homo sapiens
ccagctactcaggaggctg

SEQ ID NO: 173283 - DNA, 20 bp, Homo sapiens
ccagctactcaggaggctga

SEQ ID NO: 173284 - DNA, 14 bp, Homo sapiens
ccagctatacctgt

SEQ ID NO: 173285 - DNA, 15 bp, Homo sapiens
ccagctatacctgtg

SEQ ID NO: 173286 - DNA, 19 bp, Homo sapiens
ccagctatacctgtgcctc

SEQ ID NO: 173287 - DNA, 22 bp, Homo sapiens
ccagctatgttatattgaaaaa

SEQ ID NO: 173288 - DNA, 23 bp, Homo sapiens
ccagctccccaagaaagcctcag

SEQ ID NO: 173289 - DNA, 14 bp, Homo sapiens
ccagctccttcgct

SEQ ID NO: 173290 - DNA, 14 bp, Homo sapiens
ccagctctcagcca

SEQ ID NO: 173291 - DNA, 20 bp, Homo sapiens
ccagctctccctctggccct

SEQ ID NO: 173292 - DNA, 23 bp, Homo sapiens
ccagctctccctctggccctgcc

SEQ ID NO: 173293 - DNA, 20 bp, Homo sapiens
ccagctctgaaaccagtgtt

SEQ ID NO: 173294 - DNA, 18 bp, Homo sapiens
ccagctctgtatcaggac

SEQ ID NO: 173295 - DNA, 19 bp, Homo sapiens
ccagctcttctccccaggt

SEQ ID NO: 173296 - DNA, 14 bp, Homo sapiens
ccagctgctcccct

SEQ ID NO: 173297 - DNA, 20 bp, Homo sapiens
ccagctggcagcagagtgtg

SEQ ID NO: 173298 - DNA, 16 bp, Homo sapiens
ccagctgggttggaaa

SEQ ID NO: 173299 - DNA, 18 bp, Homo sapiens
ccagctgtgagccttggc

SEQ ID NO: 173300 - DNA, 19 bp, Homo sapiens
ccagctgtgagccttggct

SEQ ID NO: 173301 - DNA, 16 bp, Homo sapiens
ccagcttatctcaggg

SEQ ID NO: 173302 - DNA, 14 bp, Homo sapiens
ccagcttgctcttc

SEQ ID NO: 173303 - DNA, 16 bp, Homo sapiens
ccagcttgctcttcag

SEQ ID NO: 173304 - DNA, 13 bp, Homo sapiens
ccaggacaggacc

SEQ ID NO: 173305 - DNA, 17 bp, Homo sapiens
ccaggacaggcccggcg

SEQ ID NO: 173306 - DNA, 23 bp, Homo sapiens
ccaggaccagtcaacctgggcaa

SEQ ID NO: 173307 - DNA, 14 bp, Homo sapiens
ccaggactgagccc

SEQ ID NO: 173308 - DNA, 20 bp, Homo sapiens
ccaggagaaggccaattcct

SEQ ID NO: 173309 - DNA, 12 bp, Homo sapiens
ccaggagagaga

SEQ ID NO: 173310 - DNA, 15 bp, Homo sapiens
ccaggagagagaaag

SEQ ID NO: 173311 - DNA, 16 bp, Homo sapiens
ccaggagagagaaagc

SEQ ID NO: 173312 - DNA, 20 bp, Homo sapiens
ccaggagagccagccctccc

SEQ ID NO: 173313 - DNA, 23 bp, Homo sapiens
ccaggagagccagccctccctgt

SEQ ID NO: 173314 - DNA, 19 bp, Homo sapiens
aggtagctgcccctggctc

SEQ ID NO: 173315 - DNA, 16 bp, Homo sapiens
aggtatgaggtctagg

SEQ ID NO: 173316 - DNA, 18 bp, Homo sapiens
aggtcaatacagtacagg

SEQ ID NO: 173317 - DNA, 21 bp, Homo sapiens
aggtcaatgccagagacggaa

SEQ ID NO: 173318 - DNA, 15 bp, Homo sapiens
aggtcaccctttgct

SEQ ID NO: 173319 - DNA, 21 bp, Homo sapiens
aggtcgaccccaaagcccctt

SEQ ID NO: 173320 - DNA, 22 bp, Homo sapiens
aggtctcaacccttttgtctgc

SEQ ID NO: 173321 - DNA, 13 bp, Homo sapiens
aggtctcacgggc

SEQ ID NO: 173322 - DNA, 17 bp, Homo sapiens
aggtctcccacgtggga

SEQ ID NO: 173323 - DNA, 17 bp, Homo sapiens
aggtgaaggaatatatg

SEQ ID NO: 173324 - DNA, 21 bp, Homo sapiens
aggtgagaagcagaggaagga

SEQ ID NO: 173325 - DNA, 23 bp, Homo sapiens
aggtgagaagcagaggaaggaga

SEQ ID NO: 173326 - DNA, 22 bp, Homo sapiens
aggtgcacagacgtccctccac

SEQ ID NO: 173327 - DNA, 21 bp, Homo sapiens
aggtgcccttggaggccagcc

SEQ ID NO: 173328 - DNA, 22 bp, Homo sapiens
aggtgcccttggaggccagcca

SEQ ID NO: 173329 - DNA, 18 bp, Homo sapiens
aggtgcctgtgaggcagg

SEQ ID NO: 173330 - DNA, 20 bp, Homo sapiens
aggtgcctgtgaggcagggg

SEQ ID NO: 173331 - DNA, 13 bp, Homo sapiens
aggtgccttctta

SEQ ID NO: 173332 - DNA, 16 bp, Homo sapiens
aggtgctacaaaaaca

SEQ ID NO: 173333 - DNA, 23 bp, Homo sapiens
aggtgctacaaaaacacagcaag

SEQ ID NO: 173334 - DNA, 14 bp, Homo sapiens
aggtgctggaggtg

SEQ ID NO: 173335 - DNA, 17 bp, Homo sapiens
aggtgctggaggtggga

SEQ ID NO: 173336 - DNA, 19 bp, Homo sapiens
aggtgctggaggtgggagc

SEQ ID NO: 173337 - DNA, 22 bp, Homo sapiens
ttttattaataaacattctatc

SEQ ID NO: 173338 - DNA, 19 bp, Homo sapiens
ttttattgagaattttaaa

SEQ ID NO: 173339 - DNA, 20 bp, Homo sapiens
ttttattgtataaactatca

SEQ ID NO: 173340 - DNA, 12 bp, Homo sapiens
ttttattgtttt

SEQ ID NO: 173341 - DNA, 17 bp, Homo sapiens
ttttcaacgcagccctg

SEQ ID NO: 173342 - DNA, 20 bp, Homo sapiens
ttttcaccccacccttcccc

SEQ ID NO: 173343 - DNA, 23 bp, Homo sapiens
ttttcacctgtttttaagctgtt

SEQ ID NO: 173344 - DNA, 20 bp, Homo sapiens
ttttcacggaagttttcaat

SEQ ID NO: 173345 - DNA, 14 bp, Homo sapiens
ttttcagactcaga

SEQ ID NO: 173346 - DNA, 20 bp, Homo sapiens
ttttcagtttcaattcagtg

SEQ ID NO: 173347 - DNA, 14 bp, Homo sapiens
ttttctagactttc

SEQ ID NO: 173348 - DNA, 16 bp, Homo sapiens
ttttctctggtaatat

SEQ ID NO: 173349 - DNA, 21 bp, Homo sapiens
ttttctctggtaatattgact

SEQ ID NO: 173350 - DNA, 13 bp, Homo sapiens
ttttcttatttca

SEQ ID NO: 173351 - DNA, 20 bp, Homo sapiens
ttttgaactaataaaagcat

SEQ ID NO: 173352 - DNA, 21 bp, Homo sapiens
ttttgaactaataaaagcata

SEQ ID NO: 173353 - DNA, 11 bp, Homo sapiens
ttttgaagtgt

SEQ ID NO: 173354 - DNA, 16 bp, Homo sapiens
ttttgaatccatgctt

SEQ ID NO: 173355 - DNA, 15 bp, Homo sapiens
ttttgacggatgatt

SEQ ID NO: 173356 - DNA, 15 bp, Homo sapiens
ttttgatttatgcat

SEQ ID NO: 173357 - DNA, 17 bp, Homo sapiens
ttttgcaacctcgctgg

SEQ ID NO: 173358 - DNA, 17 bp, Homo sapiens
ttttgcaatggctatat

SEQ ID NO: 173359 - DNA, 21 bp, Homo sapiens
ttttgctttcgaactgctagt

SEQ ID NO: 173360 - DNA, 20 bp, Homo sapiens
ttttgtatgtaaatgtgcat

SEQ ID NO: 173361 - DNA, 17 bp, Homo sapiens
ttttgtattctctgagc

SEQ ID NO: 173362 - DNA, 16 bp, Homo sapiens
ttttgtgatttagaac

SEQ ID NO: 173363 - DNA, 19 bp, Homo sapiens
ttttgtgatttagaactgt

SEQ ID NO: 173364 - DNA, 16 bp, Homo sapiens
ttttgtttttgtctta

SEQ ID NO: 173365 - DNA, 12 bp, Homo sapiens
tttttaaccaaa

SEQ ID NO: 173366 - DNA, 12 bp, Homo sapiens
tttttaattatt

SEQ ID NO: 173367 - DNA, 22 bp, Homo sapiens
tttttcacggaagttttcaatg

SEQ ID NO: 173368 - DNA, 14 bp, Homo sapiens
tttttcagaaatat

SEQ ID NO: 173369 - DNA, 15 bp, Homo sapiens
tttttccccaaagtc

SEQ ID NO: 173370 - DNA, 14 bp, Homo sapiens
tttttcctgtcctt

SEQ ID NO: 173371 - DNA, 11 bp, Homo sapiens
tttttcctttt

SEQ ID NO: 173372 - DNA, 13 bp, Homo sapiens
tttttgaaaacat

SEQ ID NO: 173373 - DNA, 12 bp, Homo sapiens
tttttgaagtgt

SEQ ID NO: 173374 - DNA, 24 bp, Homo sapiens
tttttgaagtgtaggcagacacag

SEQ ID NO: 173375 - DNA, 13 bp, Homo sapiens
tttttgtaattta

SEQ ID NO: 173376 - DNA, 13 bp, Homo sapiens
ttttttccactta

SEQ ID NO: 173377 - DNA, 15 bp, Homo sapiens
ttttttgcaagtgaa

SEQ ID NO: 173378 - DNA, 20 bp, Homo sapiens
actggaagcatgtaggagaa

SEQ ID NO: 173379 - DNA, 14 bp, Homo sapiens
actggactcaggat

SEQ ID NO: 173380 - DNA, 15 bp, Homo sapiens
actggagcaccaggc

SEQ ID NO: 173381 - DNA, 17 bp, Homo sapiens
actggagttacattaat

SEQ ID NO: 173382 - DNA, 13 bp, Homo sapiens
actggcacagttt

SEQ ID NO: 173383 - DNA, 19 bp, Homo sapiens
actggcacagttttctgag

SEQ ID NO: 173384 - DNA, 21 bp, Homo sapiens
actggcacagttttctgagaa

SEQ ID NO: 173385 - DNA, 19 bp, Homo sapiens
actggcgacacgtagcagc

SEQ ID NO: 173386 - DNA, 16 bp, Homo sapiens
actggggatgtgggag

SEQ ID NO: 173387 - DNA, 13 bp, Homo sapiens
actgggttgactt

SEQ ID NO: 173388 - DNA, 20 bp, Homo sapiens
actgggtttctctgtatagt

SEQ ID NO: 173389 - DNA, 15 bp, Homo sapiens
actggtcctgtgtgc

SEQ ID NO: 173390 - DNA, 15 bp, Homo sapiens
actggtctgtaggga

SEQ ID NO: 173391 - DNA, 14 bp, Homo sapiens
actggtgagcagac

SEQ ID NO: 173392 - DNA, 15 bp, Homo sapiens
actgtaggcacactt

SEQ ID NO: 173393 - DNA, 15 bp, Homo sapiens
actgtagtctcagga

SEQ ID NO: 173394 - DNA, 16 bp, Homo sapiens
actgtagtctcaggac

SEQ ID NO: 173395 - DNA, 17 bp, Homo sapiens
actgtcaccctccacct

SEQ ID NO: 173396 - DNA, 19 bp, Homo sapiens
aggggttggttgaggtgga

SEQ ID NO: 173397 - DNA, 14 bp, Homo sapiens
agggtaaggtgcct

SEQ ID NO: 173398 - DNA, 13 bp, Homo sapiens
agggtattccaga

SEQ ID NO: 173399 - DNA, 19 bp, Homo sapiens
agggtcagacgcctgagga

SEQ ID NO: 173400 - DNA, 15 bp, Homo sapiens
agggtccccacctgg

SEQ ID NO: 173401 - DNA, 16 bp, Homo sapiens
agggtccttccctctc

SEQ ID NO: 173402 - DNA, 15 bp, Homo sapiens
agggtctagggagag

SEQ ID NO: 173403 - DNA, 23 bp, Homo sapiens
agggtctagggagagacccttgt

SEQ ID NO: 173404 - DNA, 13 bp, Homo sapiens
agggtctgctctt

SEQ ID NO: 173405 - DNA, 22 bp, Homo sapiens
agggtctgctctttctctgcca

SEQ ID NO: 173406 - DNA, 23 bp, Homo sapiens
agggtctgctctttctctgccag

SEQ ID NO: 173407 - DNA, 13 bp, Homo sapiens
agggtctggagaa

SEQ ID NO: 173408 - DNA, 22 bp, Homo sapiens
agggtgatgggaaagcattgta

SEQ ID NO: 173409 - DNA, 16 bp, Homo sapiens
agggtggacttagaaa

SEQ ID NO: 173410 - DNA, 23 bp, Homo sapiens
agggtggacttagaaagcagggg

SEQ ID NO: 173411 - DNA, 18 bp, Homo sapiens
agggtgggatggaggaga

SEQ ID NO: 173412 - DNA, 18 bp, Homo sapiens
agggttactatgcacaat

SEQ ID NO: 173413 - DNA, 15 bp, Homo sapiens
agggttagggagggg

SEQ ID NO: 173414 - DNA, 23 bp, Homo sapiens
agggtttggctgtgtctaaactg

SEQ ID NO: 173415 - DNA, 14 bp, Homo sapiens
aggtagctgcccct

SEQ ID NO: 173416 - DNA, 15 bp, Homo sapiens
aggtataattttatg

SEQ ID NO: 173417 - DNA, 21 bp, Homo sapiens
aggtatcattttctgcattta

SEQ ID NO: 173418 - DNA, 14 bp, Homo sapiens
aggtcaacagagaa

SEQ ID NO: 173419 - DNA, 17 bp, Homo sapiens
aggtcaacagagaaggc

SEQ ID NO: 173420 - DNA, 19 bp, Homo sapiens
aggtcaacagagaaggcag

SEQ ID NO: 173421 - DNA, 21 bp, Homo sapiens
aggtcaacagagaaggcagga

SEQ ID NO: 173422 - DNA, 16 bp, Homo sapiens
aggtcagcttgctgcc

SEQ ID NO: 173423 - DNA, 19 bp, Homo sapiens
aggtcaggagttagaggcc

SEQ ID NO: 173424 - DNA, 15 bp, Homo sapiens
aggtcaggagttcct

SEQ ID NO: 173425 - DNA, 11 bp, Homo sapiens
aggtctcctct

SEQ ID NO: 173426 - DNA, 12 bp, Homo sapiens
aggtctcctctt

SEQ ID NO: 173427 - DNA, 13 bp, Homo sapiens
aggtctcctctta

SEQ ID NO: 173428 - DNA, 14 bp, Homo sapiens
aggtgaaggaatat

SEQ ID NO: 173429 - DNA, 16 bp, Homo sapiens
aggtgaaggaatatat

SEQ ID NO: 173430 - DNA, 23 bp, Homo sapiens
aggtgaaggaatatatggcagag

SEQ ID NO: 173431 - DNA, 16 bp, Homo sapiens
aggtgagaagcagagg

SEQ ID NO: 173432 - DNA, 19 bp, Homo sapiens
aggtgcagagtgcccagaa

SEQ ID NO: 173433 - DNA, 23 bp, Homo sapiens
aggtgcatctggggaactagagg

SEQ ID NO: 173434 - DNA, 17 bp, Homo sapiens
aggtgccccaaaatgca

SEQ ID NO: 173435 - DNA, 19 bp, Homo sapiens
aggtgcctgtgaggcaggg

SEQ ID NO: 173436 - DNA, 22 bp, Homo sapiens
aggtgcctgtgaggcaggggcg

SEQ ID NO: 173437 - DNA, 18 bp, Homo sapiens
aggtgctacaaaaacaca

SEQ ID NO: 173438 - DNA, 19 bp, Homo sapiens
aggtgctacaaaaacacag

SEQ ID NO: 173439 - DNA, 20 bp, Homo sapiens
aggtgctacaaaaacacagc

SEQ ID NO: 173440 - DNA, 22 bp, Homo sapiens
aggtgctacaaaaacacagcaa

SEQ ID NO: 173441 - DNA, 24 bp, Homo sapiens
aggtgctacaaaaacacagcaagg

SEQ ID NO: 173442 - DNA, 21 bp, Homo sapiens
aggtgctacacccttttccag

SEQ ID NO: 173443 - DNA, 17 bp, Homo sapiens
aggtggaagccctcctt

SEQ ID NO: 173444 - DNA, 21 bp, Homo sapiens
aggtggaagccctccttccac

SEQ ID NO: 173445 - DNA, 14 bp, Homo sapiens
aggtgggagcagga

SEQ ID NO: 173446 - DNA, 15 bp, Homo sapiens
aggtgggagcaggag

SEQ ID NO: 173447 - DNA, 12 bp, Homo sapiens
aggtgggaggat

SEQ ID NO: 173448 - DNA, 18 bp, Homo sapiens
aggtggggagactgggct

SEQ ID NO: 173449 - DNA, 19 bp, Homo sapiens
aggtggggagactgggctg

SEQ ID NO: 173450 - DNA, 22 bp, Homo sapiens
aggtggggtctttgtgagagtg

SEQ ID NO: 173451 - DNA, 19 bp, Homo sapiens
aggtgggttttcttcccat

SEQ ID NO: 173452 - DNA, 17 bp, Homo sapiens
aggtggttatggagagg

SEQ ID NO: 173453 - DNA, 13 bp, Homo sapiens
aggttaatattta

SEQ ID NO: 173454 - DNA, 16 bp, Homo sapiens
aggttaatatttaaga

SEQ ID NO: 173455 - DNA, 17 bp, Homo sapiens
aggttaccctgtaacat

SEQ ID NO: 173456 - DNA, 11 bp, Homo sapiens
aggttctaaaa

SEQ ID NO: 173457 - DNA, 21 bp, Homo sapiens
aggttgacaataaatgtgctt

SEQ ID NO: 173458 - DNA, 14 bp, Homo sapiens
aggttgcagtgagc

SEQ ID NO: 173459 - DNA, 16 bp, Homo sapiens
aggttgtctgaagtca

SEQ ID NO: 173460 - DNA, 17 bp, Homo sapiens
aggtttacaatttacaa

SEQ ID NO: 173461 - DNA, 12 bp, Homo sapiens
aggtttgtatat

SEQ ID NO: 173462 - DNA, 17 bp, Homo sapiens
aggttttgttgttttat

SEQ ID NO: 173463 - DNA, 23 bp, Homo sapiens
agtaagaaaatattttgtctaaa

SEQ ID NO: 173464 - DNA, 18 bp, Homo sapiens
agcttgccctgttaaaag

SEQ ID NO: 173465 - DNA, 23 bp, Homo sapiens
agcttgcgttagaatgaggagga

SEQ ID NO: 173466 - DNA, 17 bp, Homo sapiens
agcttggaagagcctgc

SEQ ID NO: 173467 - DNA, 18 bp, Homo sapiens
agcttgtatagtgtaaaa

SEQ ID NO: 173468 - DNA, 19 bp, Homo sapiens
agctttaaactcagggaca

SEQ ID NO: 173469 - DNA, 23 bp, Homo sapiens
agctttatcaccagagagggact

SEQ ID NO: 173470 - DNA, 13 bp, Homo sapiens
agctttcctgccc

SEQ ID NO: 173471 - DNA, 20 bp, Homo sapiens
agctttcctgccccaggcct

SEQ ID NO: 173472 - DNA, 23 bp, Homo sapiens
agctttcctgccccaggcctgaa

SEQ ID NO: 173473 - DNA, 18 bp, Homo sapiens
agctttgttcttcttaaa

SEQ ID NO: 173474 - DNA, 19 bp, Homo sapiens
agcttttattgtataaact

SEQ ID NO: 173475 - DNA, 18 bp, Homo sapiens
agcttttttacacaaatg

SEQ ID NO: 173476 - DNA, 13 bp, Homo sapiens
aggaaaagaaaag

SEQ ID NO: 173477 - DNA, 19 bp, Homo sapiens
aggaaaagtacatttaata

SEQ ID NO: 173478 - DNA, 14 bp, Homo sapiens
aggaaaatcctctg

SEQ ID NO: 173479 - DNA, 14 bp, Homo sapiens
aggaaaatgaataa

SEQ ID NO: 173480 - DNA, 14 bp, Homo sapiens
aggaaaggccagct

SEQ ID NO: 173481 - DNA, 22 bp, Homo sapiens
aggaaaggccagctggcagcag

SEQ ID NO: 173482 - DNA, 14 bp, Homo sapiens
aggaaataaaacct

SEQ ID NO: 173483 - DNA, 19 bp, Homo sapiens
aggaaataaaacctttcaa

SEQ ID NO: 173484 - DNA, 22 bp, Homo sapiens
aggaaataaaacctttcaaatt

SEQ ID NO: 173485 - DNA, 19 bp, Homo sapiens
aggaaatcaaatatgcaaa

SEQ ID NO: 173486 - DNA, 22 bp, Homo sapiens
aggaaatcaaatatgcaaagca

SEQ ID NO: 173487 - DNA, 14 bp, Homo sapiens
aggaaatctcaccc

SEQ ID NO: 173488 - DNA, 19 bp, Homo sapiens
aggaaatgaaaatgtcttg

SEQ ID NO: 173489 - DNA, 20 bp, Homo sapiens
aggaactgtccagagagcaa

SEQ ID NO: 173490 - DNA, 14 bp, Homo sapiens
aggaagagaaacca

SEQ ID NO: 173491 - DNA, 21 bp, Homo sapiens
aggaagccgtgccctgccccc

SEQ ID NO: 173492 - DNA, 16 bp, Homo sapiens
aggaagctcagactgg

SEQ ID NO: 173493 - DNA, 17 bp, Homo sapiens
aggaagctgctccgtgc

SEQ ID NO: 173494 - DNA, 23 bp, Homo sapiens
aggaaggagactcacctctgcct

SEQ ID NO: 173495 - DNA, 18 bp, Homo sapiens
aggaagtcaaagcaagga

SEQ ID NO: 173496 - DNA, 19 bp, Homo sapiens
aggaataaattgctccttg

SEQ ID NO: 173497 - DNA, 12 bp, Homo sapiens
aggaatatatgg

SEQ ID NO: 173498 - DNA, 21 bp, Homo sapiens
aggaatcatgtcaggcctgtg

SEQ ID NO: 173499 - DNA, 18 bp, Homo sapiens
aggacaacgaggaagccc

SEQ ID NO: 173500 - DNA, 14 bp, Homo sapiens
aggacaaggctaga

SEQ ID NO: 173501 - DNA, 19 bp, Homo sapiens
aggacaccacacccagcct

SEQ ID NO: 173502 - DNA, 23 bp, Homo sapiens
aggacatgtttttgttttctttg

SEQ ID NO: 173503 - DNA, 20 bp, Homo sapiens
aggaccagtcaacctgggca

SEQ ID NO: 173504 - DNA, 18 bp, Homo sapiens
aggacccggaggggcctg

SEQ ID NO: 173505 - DNA, 17 bp, Homo sapiens
aggactccacccatcct

SEQ ID NO: 173506 - DNA, 14 bp, Homo sapiens
aggactctgcctcc

SEQ ID NO: 173507 - DNA, 17 bp, Homo sapiens
aggactctgcctcctct

SEQ ID NO: 173508 - DNA, 24 bp, Homo sapiens
aggactgagccccgcagacctccc

SEQ ID NO: 173509 - DNA, 18 bp, Homo sapiens
aggactgccccgtgcaga

SEQ ID NO: 173510 - DNA, 11 bp, Homo sapiens
aggactttgca

SEQ ID NO: 173511 - DNA, 18 bp, Homo sapiens
aggagaaactggaactct

SEQ ID NO: 173512 - DNA, 20 bp, Homo sapiens
aggagaattgcttgaacctg

SEQ ID NO: 173513 - DNA, 11 bp, Homo sapiens
aggagactcac

SEQ ID NO: 173514 - DNA, 15 bp, Homo sapiens
aggagactcacctct

SEQ ID NO: 173515 - DNA, 17 bp, Homo sapiens
aggagactcacctctgc

SEQ ID NO: 173516 - DNA, 14 bp, Homo sapiens
aggagagagaaagc

SEQ ID NO: 173517 - DNA, 19 bp, Homo sapiens
aggagagagaaagccaggc

SEQ ID NO: 173518 - DNA, 22 bp, Homo sapiens
aggagagagaaagccaggcagg

SEQ ID NO: 173519 - DNA, 10 bp, Homo sapiens
aggagagagg

SEQ ID NO: 173520 - DNA, 13 bp, Homo sapiens
aggagagaggcag

SEQ ID NO: 173521 - DNA, 14 bp, Homo sapiens
aggagagaggcaga

SEQ ID NO: 173522 - DNA, 16 bp, Homo sapiens
aggagagccagccctc

SEQ ID NO: 173523 - DNA, 13 bp, Homo sapiens
aggagaggagaga

SEQ ID NO: 173524 - DNA, 14 bp, Homo sapiens
aggagaggagagag

SEQ ID NO: 173525 - DNA, 15 bp, Homo sapiens
aggagaggagagggg

SEQ ID NO: 173526 - DNA, 13 bp, Homo sapiens
aggagaggggcag

SEQ ID NO: 173527 - DNA, 17 bp, Homo sapiens
aggagagtagaacagat

SEQ ID NO: 173528 - DNA, 17 bp, Homo sapiens
aggagatgctccttggg

SEQ ID NO: 173529 - DNA, 18 bp, Homo sapiens
aggagatgctccttgggc

SEQ ID NO: 173530 - DNA, 13 bp, Homo sapiens
aggagattgagaa

SEQ ID NO: 173531 - DNA, 21 bp, Homo sapiens
aggagattgagaaggagagaa

SEQ ID NO: 173532 - DNA, 18 bp, Homo sapiens
aggagccccattcctggg

SEQ ID NO: 173533 - DNA, 16 bp, Homo sapiens
aggagctgggaggaaa

SEQ ID NO: 173534 - DNA, 17 bp, Homo sapiens
aggagctgggaggaaaa

SEQ ID NO: 173535 - DNA, 21 bp, Homo sapiens
aggaggaggtttaggtcaaga

SEQ ID NO: 173536 - DNA, 16 bp, Homo sapiens
aggaggctccagaggg

SEQ ID NO: 173537 - DNA, 19 bp, Homo sapiens
aggaggctccagagggcac

SEQ ID NO: 173538 - DNA, 13 bp, Homo sapiens
aggaggctggctt

SEQ ID NO: 173539 - DNA, 17 bp, Homo sapiens
aggagggtcaggaagga

SEQ ID NO: 173540 - DNA, 20 bp, Homo sapiens
aggagttccttgatctgtat

SEQ ID NO: 173541 - DNA, 14 bp, Homo sapiens
aggagttgctgttt

SEQ ID NO: 173542 - DNA, 14 bp, Homo sapiens
aggatagcattttt

SEQ ID NO: 173543 - DNA, 21 bp, Homo sapiens
aggatctcttgagcctgggag

SEQ ID NO: 173544 - DNA, 20 bp, Homo sapiens
aggatgacctggataactta

SEQ ID NO: 173545 - DNA, 18 bp, Homo sapiens
aggatgcagagtcagcag

SEQ ID NO: 173546 - DNA, 19 bp, Homo sapiens
aggatgcagagtcagcaga

SEQ ID NO: 173547 - DNA, 13 bp, Homo sapiens
aggatgcccaggg

SEQ ID NO: 173548 - DNA, 19 bp, Homo sapiens
aggatgctaacatctaaaa

SEQ ID NO: 173549 - DNA, 17 bp, Homo sapiens
cacgcctgcaaacgctg

SEQ ID NO: 173550 - DNA, 20 bp, Homo sapiens
cacgcctgtaatcccagcag

SEQ ID NO: 173551 - DNA, 21 bp, Homo sapiens
cacgcctgtaatcccagcagt

SEQ ID NO: 173552 - DNA, 18 bp, Homo sapiens
cacgctgtgggcaggtgg

SEQ ID NO: 173553 - DNA, 22 bp, Homo sapiens
cacgctgtgggcaggtgggagc

SEQ ID NO: 173554 - DNA, 15 bp, Homo sapiens
cacggaagttttcaa

SEQ ID NO: 173555 - DNA, 21 bp, Homo sapiens
cacggagccactcctctgact

SEQ ID NO: 173556 - DNA, 21 bp, Homo sapiens
cacggcaggacaacgaggaag

SEQ ID NO: 173557 - DNA, 22 bp, Homo sapiens
cacggcaggacaacgaggaagc

SEQ ID NO: 173558 - DNA, 15 bp, Homo sapiens
cacggtgcctttttt

SEQ ID NO: 173559 - DNA, 17 bp, Homo sapiens
cacgtccccctggggct

SEQ ID NO: 173560 - DNA, 20 bp, Homo sapiens
cacgtccccctggggcttct

SEQ ID NO: 173561 - DNA, 16 bp, Homo sapiens
cacgtctgaccctctc

SEQ ID NO: 173562 - DNA, 17 bp, Homo sapiens
cacgtctgaccctctcc

SEQ ID NO: 173563 - DNA, 16 bp, Homo sapiens
cacgtgcagctcaagg

SEQ ID NO: 173564 - DNA, 15 bp, Homo sapiens
cacgtgccaggcccg

SEQ ID NO: 173565 - DNA, 16 bp, Homo sapiens
cacgtgccaggcccgg

SEQ ID NO: 173566 - DNA, 20 bp, Homo sapiens
cacgtggcctcttgagcagt

SEQ ID NO: 173567 - DNA, 11 bp, Homo sapiens
cacgtgtgtga

SEQ ID NO: 173568 - DNA, 12 bp, Homo sapiens
cacgtgtgtgac

SEQ ID NO: 173569 - DNA, 16 bp, Homo sapiens
cacgtgtttgtgctgt

SEQ ID NO: 173570 - DNA, 20 bp, Homo sapiens
cacgttccttcccccgcaat

SEQ ID NO: 173571 - DNA, 22 bp, Homo sapiens
cacgttcttactagtttccctt

SEQ ID NO: 173572 - DNA, 14 bp, Homo sapiens
cactacataaactg

SEQ ID NO: 173573 - DNA, 19 bp, Homo sapiens
cactacatgtggtttatag

SEQ ID NO: 173574 - DNA, 20 bp, Homo sapiens
cactacatgtggtttataga

SEQ ID NO: 173575 - DNA, 17 bp, Homo sapiens
cactagcctttggctct

SEQ ID NO: 173576 - DNA, 18 bp, Homo sapiens
cactagcctttggctctg

SEQ ID NO: 173577 - DNA, 15 bp, Homo sapiens
cactcaaaagctggg

SEQ ID NO: 173578 - DNA, 17 bp, Homo sapiens
cactcaaaagctgggca

SEQ ID NO: 173579 - DNA, 23 bp, Homo sapiens
cactccagcctgagcgacagtga

SEQ ID NO: 173580 - DNA, 16 bp, Homo sapiens
cactccagcctgggtg

SEQ ID NO: 173581 - DNA, 16 bp, Homo sapiens
cactccagtgccagca

SEQ ID NO: 173582 - DNA, 17 bp, Homo sapiens
cactccagtgccagcaa

SEQ ID NO: 173583 - DNA, 13 bp, Homo sapiens
cactcccaagtct

SEQ ID NO: 173584 - DNA, 13 bp, Homo sapiens
cactcccctgcac

SEQ ID NO: 173585 - DNA, 18 bp, Homo sapiens
cactccttcctgccacct

SEQ ID NO: 173586 - DNA, 16 bp, Homo sapiens
cactcgcttcccccat

SEQ ID NO: 173587 - DNA, 17 bp, Homo sapiens
cactctcattccccagg

SEQ ID NO: 173588 - DNA, 13 bp, Homo sapiens
cactctctgaaga

SEQ ID NO: 173589 - DNA, 14 bp, Homo sapiens
cactctctgaagat

SEQ ID NO: 173590 - DNA, 15 bp, Homo sapiens
cactctgctcgcctt

SEQ ID NO: 173591 - DNA, 12 bp, Homo sapiens
cactctttgtaa

SEQ ID NO: 173592 - DNA, 13 bp, Homo sapiens
cactgacagcctc

SEQ ID NO: 173593 - DNA, 14 bp, Homo sapiens
cactgacagcctcc

SEQ ID NO: 173594 - DNA, 15 bp, Homo sapiens
cactgacagcctccc

SEQ ID NO: 173595 - DNA, 17 bp, Homo sapiens
cactgacagcctcccac

SEQ ID NO: 173596 - DNA, 20 bp, Homo sapiens
cactgacagcctcccacccc

SEQ ID NO: 173597 - DNA, 23 bp, Homo sapiens
cactgagataccagcgaggaggc

SEQ ID NO: 173598 - DNA, 14 bp, Homo sapiens
cactgaggcaggga

SEQ ID NO: 173599 - DNA, 13 bp, Homo sapiens
cactgatttcaca

SEQ ID NO: 173600 - DNA, 21 bp, Homo sapiens
cactgatttcacaacagatca

SEQ ID NO: 173601 - DNA, 16 bp, Homo sapiens
cactgcaagagccttg

SEQ ID NO: 173602 - DNA, 20 bp, Homo sapiens
cactgcaagagccttggtgt

SEQ ID NO: 173603 - DNA, 19 bp, Homo sapiens
cactgcacagtgcatctca

SEQ ID NO: 173604 - DNA, 13 bp, Homo sapiens
cactgcaggcccc

SEQ ID NO: 173605 - DNA, 17 bp, Homo sapiens
cactgccatggaggcac

SEQ ID NO: 173606 - DNA, 15 bp, Homo sapiens
cactgcctactgcat

SEQ ID NO: 173607 - DNA, 20 bp, Homo sapiens
cactgccttcgatacaccgg

SEQ ID NO: 173608 - DNA, 19 bp, Homo sapiens
cactgctccctgaagccag

SEQ ID NO: 173609 - DNA, 23 bp, Homo sapiens
cactgctccctgaagccagcctt

SEQ ID NO: 173610 - DNA, 15 bp, Homo sapiens
cactgctgcccagcc

SEQ ID NO: 173611 - DNA, 16 bp, Homo sapiens
cactgctgctgccttt

SEQ ID NO: 173612 - DNA, 14 bp, Homo sapiens
cactgctggctgcc

SEQ ID NO: 173613 - DNA, 20 bp, Homo sapiens
cactgcttgaggaaaacaag

SEQ ID NO: 173614 - DNA, 23 bp, Homo sapiens
cactggatgcaaagaaaatcaga

SEQ ID NO: 173615 - DNA, 14 bp, Homo sapiens
cactggccatccct

SEQ ID NO: 173616 - DNA, 22 bp, Homo sapiens
cactgggatgagccgctgtgag

SEQ ID NO: 173617 - DNA, 15 bp, Homo sapiens
cactgggggagggga

SEQ ID NO: 173618 - DNA, 13 bp, Homo sapiens
cactggtggcccg

SEQ ID NO: 173619 - DNA, 18 bp, Homo sapiens
cactgtcactgtttctct

SEQ ID NO: 173620 - DNA, 13 bp, Homo sapiens
cactgtgaagaga

SEQ ID NO: 173621 - DNA, 16 bp, Homo sapiens
cactgtgggactcttc

SEQ ID NO: 173622 - DNA, 16 bp, Homo sapiens
cactgttgaaaattat

SEQ ID NO: 173623 - DNA, 12 bp, Homo sapiens
cactgtttctct

SEQ ID NO: 173624 - DNA, 18 bp, Homo sapiens
cactgtttctctgctgtt

SEQ ID NO: 173625 - DNA, 17 bp, Homo sapiens
cacttagaaattgcatt

SEQ ID NO: 173626 - DNA, 20 bp, Homo sapiens
cacttagaaattgcatttcc

SEQ ID NO: 173627 - DNA, 15 bp, Homo sapiens
cacttagctatcaga

SEQ ID NO: 173628 - DNA, 16 bp, Homo sapiens
cacttcaggctcttct

SEQ ID NO: 173629 - DNA, 23 bp, Homo sapiens
cacttcaggctcttctcctttca

SEQ ID NO: 173630 - DNA, 22 bp, Homo sapiens
cacttcattcttgaaagctgtg

SEQ ID NO: 173631 - DNA, 18 bp, Homo sapiens
cacttccaccagcctgca

SEQ ID NO: 173632 - DNA, 21 bp, Homo sapiens
cacttcgggaggtcgaggcag

SEQ ID NO: 173633 - DNA, 17 bp, Homo sapiens
cacttctaaatgaagtg

SEQ ID NO: 173634 - DNA, 15 bp, Homo sapiens
cacttcttttataac

SEQ ID NO: 173635 - DNA, 23 bp, Homo sapiens
cacttgaacccgggaggcagagg

SEQ ID NO: 173636 - DNA, 18 bp, Homo sapiens
cacttgaggtcaggagtt

SEQ ID NO: 173637 - DNA, 12 bp, Homo sapiens
cacttgcatttc

SEQ ID NO: 173638 - DNA, 16 bp, Homo sapiens
cacttggcctctggat

SEQ ID NO: 173639 - DNA, 20 bp, Homo sapiens
cacttggttgggtcctcaca

SEQ ID NO: 173640 - DNA, 20 bp, Homo sapiens
cactttaattctcatgtgat

SEQ ID NO: 173641 - DNA, 22 bp, Homo sapiens
cactttgcactgatatatcatg

SEQ ID NO: 173642 - DNA, 20 bp, Homo sapiens
cagaaaacggttaaaactgt

SEQ ID NO: 173643 - DNA, 14 bp, Homo sapiens
cagaaaagcacctg

SEQ ID NO: 173644 - DNA, 15 bp, Homo sapiens
cagaaaagcacctgc

SEQ ID NO: 173645 - DNA, 17 bp, Homo sapiens
cagaaaagcacctgccg

SEQ ID NO: 173646 - DNA, 17 bp, Homo sapiens
cagaaaagggaagttgt

SEQ ID NO: 173647 - DNA, 24 bp, Homo sapiens
cagaaagaagtggggacagagcag

SEQ ID NO: 173648 - DNA, 15 bp, Homo sapiens
cagaaatatgtggtt

SEQ ID NO: 173649 - DNA, 23 bp, Homo sapiens
cagaaatgtacaactttttacct

SEQ ID NO: 173650 - DNA, 20 bp, Homo sapiens
acatctttcacacttccacc

SEQ ID NO: 173651 - DNA, 23 bp, Homo sapiens
acatgagctatttccattccaga

SEQ ID NO: 173652 - DNA, 15 bp, Homo sapiens
acatgatcttcttta

SEQ ID NO: 173653 - DNA, 17 bp, Homo sapiens
acatgatcttctttata

SEQ ID NO: 173654 - DNA, 21 bp, Homo sapiens
acatgcctgccccaaacaaat

SEQ ID NO: 173655 - DNA, 16 bp, Homo sapiens
acatgcgggctgggca

SEQ ID NO: 173656 - DNA, 22 bp, Homo sapiens
acatgcgggctgggcagctgtt

SEQ ID NO: 173657 - DNA, 23 bp, Homo sapiens
acatggtgctacgcctgcatgta

SEQ ID NO: 173658 - DNA, 19 bp, Homo sapiens
acatggtgggtccatgggc

SEQ ID NO: 173659 - DNA, 17 bp, Homo sapiens
acatgtaggaagtagga

SEQ ID NO: 173660 - DNA, 18 bp, Homo sapiens
acatgtcagtaccttcaa

SEQ ID NO: 173661 - DNA, 13 bp, Homo sapiens
acatgtgacattt

SEQ ID NO: 173662 - DNA, 16 bp, Homo sapiens
acatgtgacatttata

SEQ ID NO: 173663 - DNA, 15 bp, Homo sapiens
acatgtggtgggaca

SEQ ID NO: 173664 - DNA, 13 bp, Homo sapiens
acatgtggtttat

SEQ ID NO: 173665 - DNA, 20 bp, Homo sapiens
acatgtgttaagtattttca

SEQ ID NO: 173666 - DNA, 13 bp, Homo sapiens
acatgttacaaca

SEQ ID NO: 173667 - DNA, 20 bp, Homo sapiens
acatgtttagagttgcaatc

SEQ ID NO: 173668 - DNA, 12 bp, Homo sapiens
acattaagaaaa

SEQ ID NO: 173669 - DNA, 21 bp, Homo sapiens
acattaagaaaatcatattgc

SEQ ID NO: 173670 - DNA, 20 bp, Homo sapiens
acattctgacatcttagtat

SEQ ID NO: 173671 - DNA, 14 bp, Homo sapiens
acattgaattagaa

SEQ ID NO: 173672 - DNA, 22 bp, Homo sapiens
acattgaattagaaacataaat

SEQ ID NO: 173673 - DNA, 20 bp, Homo sapiens
acattgcttgtgccacaccc

SEQ ID NO: 173674 - DNA, 15 bp, Homo sapiens
acatttgccttgctg

SEQ ID NO: 173675 - DNA, 20 bp, Homo sapiens
acatttggagtgttcccctt

SEQ ID NO: 173676 - DNA, 21 bp, Homo sapiens
acatttgggagacatgtgaca

SEQ ID NO: 173677 - DNA, 12 bp, Homo sapiens
acatttttacaa

SEQ ID NO: 173678 - DNA, 14 bp, Homo sapiens
acatttttacaata

SEQ ID NO: 173679 - DNA, 18 bp, Homo sapiens
accaaaggtgaaggaata

SEQ ID NO: 173680 - DNA, 20 bp, Homo sapiens
accaaaggtgaaggaatata

SEQ ID NO: 173681 - DNA, 21 bp, Homo sapiens
accaacatcccattgccctgg

SEQ ID NO: 173682 - DNA, 15 bp, Homo sapiens
accaacatggagaaa

SEQ ID NO: 173683 - DNA, 22 bp, Homo sapiens
accaacccatcagaaggagaag

SEQ ID NO: 173684 - DNA, 14 bp, Homo sapiens
accaagcaggaagc

SEQ ID NO: 173685 - DNA, 13 bp, Homo sapiens
accaatagattcc

SEQ ID NO: 173686 - DNA, 17 bp, Homo sapiens
accaatgaaaaaatgta

SEQ ID NO: 173687 - DNA, 12 bp, Homo sapiens
accaatgtcttg

SEQ ID NO: 173688 - DNA, 16 bp, Homo sapiens
accaattggttaatct

SEQ ID NO: 173689 - DNA, 15 bp, Homo sapiens
accacaccaaacctc

SEQ ID NO: 173690 - DNA, 13 bp, Homo sapiens
accacacccagcc

SEQ ID NO: 173691 - DNA, 16 bp, Homo sapiens
cagacccccactctca

SEQ ID NO: 173692 - DNA, 18 bp, Homo sapiens
cagaccctaccccaccac

SEQ ID NO: 173693 - DNA, 14 bp, Homo sapiens
cagacctccccagc

SEQ ID NO: 173694 - DNA, 21 bp, Homo sapiens
cagacctccccagcccctagc

SEQ ID NO: 173695 - DNA, 17 bp, Homo sapiens
cagacgcacgtgggtct

SEQ ID NO: 173696 - DNA, 17 bp, Homo sapiens
cagacggcacccaccca

SEQ ID NO: 173697 - DNA, 19 bp, Homo sapiens
cagacggttcaccagcctc

SEQ ID NO: 173698 - DNA, 21 bp, Homo sapiens
cagactcctgtgcaactttcc

SEQ ID NO: 173699 - DNA, 17 bp, Homo sapiens
cagactggcacagtttt

SEQ ID NO: 173700 - DNA, 18 bp, Homo sapiens
cagactggcacagttttc

SEQ ID NO: 173701 - DNA, 15 bp, Homo sapiens
cagactggtgagcag

SEQ ID NO: 173702 - DNA, 23 bp, Homo sapiens
cagactggttgagttcaggtagc

SEQ ID NO: 173703 - DNA, 14 bp, Homo sapiens
cagactgtgtattc

SEQ ID NO: 173704 - DNA, 20 bp, Homo sapiens
cagactttttttaaatagta

SEQ ID NO: 173705 - DNA, 13 bp, Homo sapiens
cagagaaggcagg

SEQ ID NO: 173706 - DNA, 14 bp, Homo sapiens
cagagaaggcagga

SEQ ID NO: 173707 - DNA, 17 bp, Homo sapiens
cagagaaggcaggaatg

SEQ ID NO: 173708 - DNA, 15 bp, Homo sapiens
cagagaattctctta

SEQ ID NO: 173709 - DNA, 20 bp, Homo sapiens
cagagacacctgcacctccc

SEQ ID NO: 173710 - DNA, 21 bp, Homo sapiens
cagagacaggaaaatcctctg

SEQ ID NO: 173711 - DNA, 22 bp, Homo sapiens
cagagacaggaaaatcctctgg

SEQ ID NO: 173712 - DNA, 19 bp, Homo sapiens
cagagaccctctgccacca

SEQ ID NO: 173713 - DNA, 16 bp, Homo sapiens
cagagaccgtcctcac

SEQ ID NO: 173714 - DNA, 19 bp, Homo sapiens
cagagaccgtcctcacccc

SEQ ID NO: 173715 - DNA, 19 bp, Homo sapiens
cagagactcagggccccag

SEQ ID NO: 173716 - DNA, 12 bp, Homo sapiens
cagagagagtgt

SEQ ID NO: 173717 - DNA, 22 bp, Homo sapiens
cagagagcggtctcaggctggt

SEQ ID NO: 173718 - DNA, 18 bp, Homo sapiens
cagagaggacgtgggcgg

SEQ ID NO: 173719 - DNA, 22 bp, Homo sapiens
cagagagggggccacctcccca

SEQ ID NO: 173720 - DNA, 14 bp, Homo sapiens
cagagagtggctcc

SEQ ID NO: 173721 - DNA, 18 bp, Homo sapiens
cagagatgcctccaccgc

SEQ ID NO: 173722 - DNA, 19 bp, Homo sapiens
cagagatgcctccaccgct

SEQ ID NO: 173723 - DNA, 21 bp, Homo sapiens
cagagatgcctccaccgctgc

SEQ ID NO: 173724 - DNA, 23 bp, Homo sapiens
cagagatggaggttctctcggag

SEQ ID NO: 173725 - DNA, 20 bp, Homo sapiens
cagagcaagactctgtctca

SEQ ID NO: 173726 - DNA, 14 bp, Homo sapiens
cagagcaagtgaga

SEQ ID NO: 173727 - DNA, 21 bp, Homo sapiens
cagagcaggaagcattcagag

SEQ ID NO: 173728 - DNA, 13 bp, Homo sapiens
cagagcttccctg

SEQ ID NO: 173729 - DNA, 22 bp, Homo sapiens
cagaggaactgtccagagagca

SEQ ID NO: 173730 - DNA, 13 bp, Homo sapiens
cagaggaaggaga

SEQ ID NO: 173731 - DNA, 16 bp, Homo sapiens
cagaggaaggggccag

SEQ ID NO: 173732 - DNA, 21 bp, Homo sapiens
cagaggattgctgccccatca

SEQ ID NO: 173733 - DNA, 20 bp, Homo sapiens
cagaggccctcgctgccagc

SEQ ID NO: 173734 - DNA, 19 bp, Homo sapiens
cagaggctggaggcagggc

SEQ ID NO: 173735 - DNA, 15 bp, Homo sapiens
cagaggcttcttcag

SEQ ID NO: 173736 - DNA, 20 bp, Homo sapiens
cagaggcttcttcagatcag

SEQ ID NO: 173737 - DNA, 16 bp, Homo sapiens
cagaggttgcagtgag

SEQ ID NO: 173738 - DNA, 17 bp, Homo sapiens
cagaggttgcagtgagc

SEQ ID NO: 173739 - DNA, 20 bp, Homo sapiens
cagagtatttgaaaaatgta

SEQ ID NO: 173740 - DNA, 23 bp, Homo sapiens
cagagtcggaacggagaaaggtg

SEQ ID NO: 173741 - DNA, 17 bp, Homo sapiens
cagagtgagacccagcc

SEQ ID NO: 173742 - DNA, 12 bp, Homo sapiens
cagagttgtaaa

SEQ ID NO: 173743 - DNA, 14 bp, Homo sapiens
cagagttgtaaata

SEQ ID NO: 173744 - DNA, 16 bp, Homo sapiens
cagagttgtaaatata

SEQ ID NO: 173745 - DNA, 17 bp, Homo sapiens
cagagttgtaaatatat

SEQ ID NO: 173746 - DNA, 20 bp, Homo sapiens
cagagttgtaaatatataaa

SEQ ID NO: 173747 - DNA, 23 bp, Homo sapiens
cagagttgtgcacatggcttagt

SEQ ID NO: 173748 - DNA, 15 bp, Homo sapiens
cagataatcagcctc

SEQ ID NO: 173749 - DNA, 19 bp, Homo sapiens
cagataatcagcctcttaa

SEQ ID NO: 173750 - DNA, 14 bp, Homo sapiens
cagataatcagtgt

SEQ ID NO: 173751 - DNA, 13 bp, Homo sapiens
cagataatgtgaa

SEQ ID NO: 173752 - DNA, 20 bp, Homo sapiens
cagatatatatcatattggt

SEQ ID NO: 173753 - DNA, 15 bp, Homo sapiens
cagatattttttcag

SEQ ID NO: 173754 - DNA, 12 bp, Homo sapiens
cagatcccagct

SEQ ID NO: 173755 - DNA, 13 bp, Homo sapiens
cagatgacccctc

SEQ ID NO: 173756 - DNA, 18 bp, Homo sapiens
cagatgacccctccccta

SEQ ID NO: 173757 - DNA, 16 bp, Homo sapiens
cagatgcaaagaggca

SEQ ID NO: 173758 - DNA, 14 bp, Homo sapiens
cagatgcctccacc

SEQ ID NO: 173759 - DNA, 20 bp, Homo sapiens
cagatggaaccgcaggaagc

SEQ ID NO: 173760 - DNA, 16 bp, Homo sapiens
cagatggaatgctgtg

SEQ ID NO: 173761 - DNA, 21 bp, Homo sapiens
cagatggaatgctgtgttaaa

SEQ ID NO: 173762 - DNA, 14 bp, Homo sapiens
cagatgtttctttt

SEQ ID NO: 173763 - DNA, 19 bp, Homo sapiens
cagatgtttcttttgtatg

SEQ ID NO: 173764 - DNA, 22 bp, Homo sapiens
cagatgtttcttttgtatgtaa

SEQ ID NO: 173765 - DNA, 23 bp, Homo sapiens
cagattccaggcgatgtgcaagt

SEQ ID NO: 173766 - DNA, 18 bp, Homo sapiens
cagattggagaaaccctt

SEQ ID NO: 173767 - DNA, 19 bp, Homo sapiens
cagatttgaactcttcaat

SEQ ID NO: 173768 - DNA, 22 bp, Homo sapiens
cagattttaaaaagtcttcact

SEQ ID NO: 173769 - DNA, 23 bp, Homo sapiens
cagattttaattttgaataaata

SEQ ID NO: 173770 - DNA, 13 bp, Homo sapiens
cagcaaaaagcaa

SEQ ID NO: 173771 - DNA, 23 bp, Homo sapiens
cagcaacgcaggcccccaggtgc

SEQ ID NO: 173772 - DNA, 15 bp, Homo sapiens
cagcaatatgtaaat

SEQ ID NO: 173773 - DNA, 17 bp, Homo sapiens
cagcacagagagggggc

SEQ ID NO: 173774 - DNA, 20 bp, Homo sapiens
cagcacagagagggggccac

SEQ ID NO: 173775 - DNA, 18 bp, Homo sapiens
cagcacccagcaactcca

SEQ ID NO: 173776 - DNA, 12 bp, Homo sapiens
cagcaccctgca

SEQ ID NO: 173777 - DNA, 13 bp, Homo sapiens
cagcacctgtctc

SEQ ID NO: 173778 - DNA, 17 bp, Homo sapiens
cagcactaaagcagtgg

SEQ ID NO: 173779 - DNA, 20 bp, Homo sapiens
cagcactaaagcagtggaca

SEQ ID NO: 173780 - DNA, 18 bp, Homo sapiens
cagcactgcttgaggaaa

SEQ ID NO: 173781 - DNA, 20 bp, Homo sapiens
cagcactttgggaggccaag

SEQ ID NO: 173782 - DNA, 22 bp, Homo sapiens
cagcactttgggaggccaagga

SEQ ID NO: 173783 - DNA, 21 bp, Homo sapiens
cagcagccagctctcagccaa

SEQ ID NO: 173784 - DNA, 14 bp, Homo sapiens
cagcagcctggacc

SEQ ID NO: 173785 - DNA, 18 bp, Homo sapiens
cagcagcctggaccctgt

SEQ ID NO: 173786 - DNA, 12 bp, Homo sapiens
cagcagctcagg

SEQ ID NO: 173787 - DNA, 13 bp, Homo sapiens
cagcagctcaggc

SEQ ID NO: 173788 - DNA, 16 bp, Homo sapiens
cagcagctcaggcaca

SEQ ID NO: 173789 - DNA, 18 bp, Homo sapiens
cagcaggaggccaggccg

SEQ ID NO: 173790 - DNA, 21 bp, Homo sapiens
cagcagggctaccctgagctg

SEQ ID NO: 173791 - DNA, 19 bp, Homo sapiens
cagcagtacctataaagta

SEQ ID NO: 173792 - DNA, 17 bp, Homo sapiens
cagcagtgtgaggccag

SEQ ID NO: 173793 - DNA, 22 bp, Homo sapiens
cagcagtgtgaggccagggcag

SEQ ID NO: 173794 - DNA, 12 bp, Homo sapiens
cagcagtgttcc

SEQ ID NO: 173795 - DNA, 13 bp, Homo sapiens
cagcagtgttccc

SEQ ID NO: 173796 - DNA, 14 bp, Homo sapiens
cagcagtgttcccc

SEQ ID NO: 173797 - DNA, 17 bp, Homo sapiens
cagcagttgaaaagact

SEQ ID NO: 173798 - DNA, 23 bp, Homo sapiens
cagcagttgaatgacaacagaag

SEQ ID NO: 173799 - DNA, 17 bp, Homo sapiens
cagcatagaagtaactt

SEQ ID NO: 173800 - DNA, 15 bp, Homo sapiens
cagcattctcactcc

SEQ ID NO: 173801 - DNA, 15 bp, Homo sapiens
cagccaaaccctgtc

SEQ ID NO: 173802 - DNA, 16 bp, Homo sapiens
cagccacctctctttt

SEQ ID NO: 173803 - DNA, 14 bp, Homo sapiens
cagccagactggca

SEQ ID NO: 173804 - DNA, 13 bp, Homo sapiens
catcatctcctgc

SEQ ID NO: 173805 - DNA, 17 bp, Homo sapiens
catcattccttgagaaa

SEQ ID NO: 173806 - DNA, 12 bp, Homo sapiens
catcattctctg

SEQ ID NO: 173807 - DNA, 15 bp, Homo sapiens
catcattctctgtct

SEQ ID NO: 173808 - DNA, 16 bp, Homo sapiens
catcattctctgtctc

SEQ ID NO: 173809 - DNA, 19 bp, Homo sapiens
catccaatctaaccacatc

SEQ ID NO: 173810 - DNA, 21 bp, Homo sapiens
catccactagtgcaaatcata

SEQ ID NO: 173811 - DNA, 15 bp, Homo sapiens
catccatgtttgtaa

SEQ ID NO: 173812 - DNA, 18 bp, Homo sapiens
catccatgtttgtaaaac

SEQ ID NO: 173813 - DNA, 15 bp, Homo sapiens
catccattcctcagg

SEQ ID NO: 173814 - DNA, 17 bp, Homo sapiens
catccattcctcaggga

SEQ ID NO: 173815 - DNA, 20 bp, Homo sapiens
catccatttcatctatttct

SEQ ID NO: 173816 - DNA, 23 bp, Homo sapiens
catccatttcatctatttctgag

SEQ ID NO: 173817 - DNA, 12 bp, Homo sapiens
catcccattgcc

SEQ ID NO: 173818 - DNA, 13 bp, Homo sapiens
catcccattgccc

SEQ ID NO: 173819 - DNA, 16 bp, Homo sapiens
catccccacccttgga

SEQ ID NO: 173820 - DNA, 15 bp, Homo sapiens
catccctgccagctc

SEQ ID NO: 173821 - DNA, 20 bp, Homo sapiens
catccctttttgaagtgtag

SEQ ID NO: 173822 - DNA, 14 bp, Homo sapiens
catccgaggcaggg

SEQ ID NO: 173823 - DNA, 22 bp, Homo sapiens
catccgaggcagggtcaggaga

SEQ ID NO: 173824 - DNA, 18 bp, Homo sapiens
catcctccacgttctgct

SEQ ID NO: 173825 - DNA, 21 bp, Homo sapiens
catcctccacgttctgctcat

SEQ ID NO: 173826 - DNA, 20 bp, Homo sapiens
catcctgcagcctcctcctg

SEQ ID NO: 173827 - DNA, 23 bp, Homo sapiens
catctaaaaatagacttaaatct

SEQ ID NO: 173828 - DNA, 18 bp, Homo sapiens
catctaacctcatcttct

SEQ ID NO: 173829 - DNA, 14 bp, Homo sapiens
catctaataaaaaa

SEQ ID NO: 173830 - DNA, 19 bp, Homo sapiens
catctatgtcccttgctgt

SEQ ID NO: 173831 - DNA, 16 bp, Homo sapiens
catctatttctgagaa

SEQ ID NO: 173832 - DNA, 18 bp, Homo sapiens
catctcaggcctccctca

SEQ ID NO: 173833 - DNA, 20 bp, Homo sapiens
cagccctgggccccaccacc

SEQ ID NO: 173834 - DNA, 19 bp, Homo sapiens
cagccgctcctgtctgcca

SEQ ID NO: 173835 - DNA, 20 bp, Homo sapiens
cagccgctcctgtctgccag

SEQ ID NO: 173836 - DNA, 19 bp, Homo sapiens
cagccgctgagcgaggaga

SEQ ID NO: 173837 - DNA, 9 bp, Homo sapiens
cagccgtgc

SEQ ID NO: 173838 - DNA, 18 bp, Homo sapiens
cagccgtgccttcagctc

SEQ ID NO: 173839 - DNA, 20 bp, Homo sapiens
cagccgtgccttcagctcta

SEQ ID NO: 173840 - DNA, 13 bp, Homo sapiens
cagcctcacagaa

SEQ ID NO: 173841 - DNA, 20 bp, Homo sapiens
cagcctccaagctccatctc

SEQ ID NO: 173842 - DNA, 17 bp, Homo sapiens
cagcctccatgctgcct

SEQ ID NO: 173843 - DNA, 16 bp, Homo sapiens
cagcctcccaccccca

SEQ ID NO: 173844 - DNA, 18 bp, Homo sapiens
cagcctcccacccccatc

SEQ ID NO: 173845 - DNA, 15 bp, Homo sapiens
cagcctcctcctgac

SEQ ID NO: 173846 - DNA, 17 bp, Homo sapiens
cagcctctgaaaaccaa

SEQ ID NO: 173847 - DNA, 16 bp, Homo sapiens
cagcctctgacccctc

SEQ ID NO: 173848 - DNA, 18 bp, Homo sapiens
cagcctctgacccctcct

SEQ ID NO: 173849 - DNA, 19 bp, Homo sapiens
cagcctctgacccctcctc

SEQ ID NO: 173850 - DNA, 20 bp, Homo sapiens
cagcctctgacccctcctca

SEQ ID NO: 173851 - DNA, 23 bp, Homo sapiens
cagcctctgacttaagctgcctc

SEQ ID NO: 173852 - DNA, 21 bp, Homo sapiens
cagcctctgagcccctgggac

SEQ ID NO: 173853 - DNA, 15 bp, Homo sapiens
cagcctcttaaagct

SEQ ID NO: 173854 - DNA, 19 bp, Homo sapiens
cagcctcttaaagctgcct

SEQ ID NO: 173855 - DNA, 20 bp, Homo sapiens
cagcctcttaaagctgcctg

SEQ ID NO: 173856 - DNA, 19 bp, Homo sapiens
cagcctgagcgacagtgag

SEQ ID NO: 173857 - DNA, 17 bp, Homo sapiens
cagcctgctccagctgt

SEQ ID NO: 173858 - DNA, 10 bp, Homo sapiens
cagcctggca

SEQ ID NO: 173859 - DNA, 16 bp, Homo sapiens
cagcctggtgggcctc

SEQ ID NO: 173860 - DNA, 14 bp, Homo sapiens
cagcctgtgctgcc

SEQ ID NO: 173861 - DNA, 16 bp, Homo sapiens
cagcctgtgctgcccg

SEQ ID NO: 173862 - DNA, 21 bp, Homo sapiens
cagcctgtggcggtgcctggg

SEQ ID NO: 173863 - DNA, 22 bp, Homo sapiens
cagcctgtggcggtgcctgggt

SEQ ID NO: 173864 - DNA, 18 bp, Homo sapiens
cagccttcttccatccca

SEQ ID NO: 173865 - DNA, 18 bp, Homo sapiens
cagcctttctcccaggcc

SEQ ID NO: 173866 - DNA, 23 bp, Homo sapiens
cagcctttctcccaggccaggct

SEQ ID NO: 173867 - DNA, 16 bp, Homo sapiens
cagcgaggaggctcca

SEQ ID NO: 173868 - DNA, 18 bp, Homo sapiens
cagcgaggaggctccaga

SEQ ID NO: 173869 - DNA, 23 bp, Homo sapiens
cagcgcctagtggggtctccctc

SEQ ID NO: 173870 - DNA, 19 bp, Homo sapiens
cagcgctgggtccacccca

SEQ ID NO: 173871 - DNA, 15 bp, Homo sapiens
cagcggcccctgcat

SEQ ID NO: 173872 - DNA, 17 bp, Homo sapiens
cagcgtagcctctccgg

SEQ ID NO: 173873 - DNA, 19 bp, Homo sapiens
cagctaatcagcattctca

SEQ ID NO: 173874 - DNA, 12 bp, Homo sapiens
cagctactcagg

SEQ ID NO: 173875 - DNA, 18 bp, Homo sapiens
cagctactcaggaggctg

SEQ ID NO: 173876 - DNA, 19 bp, Homo sapiens
cagctactgatttttgtga

SEQ ID NO: 173877 - DNA, 19 bp, Homo sapiens
cagctacttgggaggctga

SEQ ID NO: 173878 - DNA, 16 bp, Homo sapiens
cagctatacctgtgcc

SEQ ID NO: 173879 - DNA, 22 bp, Homo sapiens
cagctatacctgtgcctcggct

SEQ ID NO: 173880 - DNA, 19 bp, Homo sapiens
cagctcaaaggcacagtga

SEQ ID NO: 173881 - DNA, 20 bp, Homo sapiens
cagctcaaggaaaggcctga

SEQ ID NO: 173882 - DNA, 18 bp, Homo sapiens
cagctcagcgccagcctg

SEQ ID NO: 173883 - DNA, 12 bp, Homo sapiens
cagctcccaccc

SEQ ID NO: 173884 - DNA, 14 bp, Homo sapiens
cagctcccacccca

SEQ ID NO: 173885 - DNA, 13 bp, Homo sapiens
cagctccccaaga

SEQ ID NO: 173886 - DNA, 17 bp, Homo sapiens
cagctcccctcggagaa

SEQ ID NO: 173887 - DNA, 21 bp, Homo sapiens
cagctcccctcggagaagagc

SEQ ID NO: 173888 - DNA, 14 bp, Homo sapiens
cagctccctctgcc

SEQ ID NO: 173889 - DNA, 15 bp, Homo sapiens
cagctccctctgcct

SEQ ID NO: 173890 - DNA, 13 bp, Homo sapiens
cagctctcagcca

SEQ ID NO: 173891 - DNA, 12 bp, Homo sapiens
cagctctccctc

SEQ ID NO: 173892 - DNA, 21 bp, Homo sapiens
cagctctccctctggccctgc

SEQ ID NO: 173893 - DNA, 19 bp, Homo sapiens
cagctctgaaaccagtgtt

SEQ ID NO: 173894 - DNA, 15 bp, Homo sapiens
cagctctgcaagaat

SEQ ID NO: 173895 - DNA, 21 bp, Homo sapiens
cagctctgcaagaattgaagc

SEQ ID NO: 173896 - DNA, 21 bp, Homo sapiens
cagctgacttttctgtccgag

SEQ ID NO: 173897 - DNA, 21 bp, Homo sapiens
cagctgagagacttttaatca

SEQ ID NO: 173898 - DNA, 16 bp, Homo sapiens
cagctgcagagacaga

SEQ ID NO: 173899 - DNA, 21 bp, Homo sapiens
cagctgctgaaacaacaaata

SEQ ID NO: 173900 - DNA, 14 bp, Homo sapiens
cagctggcagcaga

SEQ ID NO: 173901 - DNA, 16 bp, Homo sapiens
cagctgggttggaaaa

SEQ ID NO: 173902 - DNA, 22 bp, Homo sapiens
cagctggtgggaagcgtctgtc

SEQ ID NO: 173903 - DNA, 20 bp, Homo sapiens
cagctgtaacacagctgaga

SEQ ID NO: 173904 - DNA, 13 bp, Homo sapiens
cagctgtccctgt

SEQ ID NO: 173905 - DNA, 15 bp, Homo sapiens
cagctgtccctgtca

SEQ ID NO: 173906 - DNA, 22 bp, Homo sapiens
cagctgtccctgtcaccaagct

SEQ ID NO: 173907 - DNA, 15 bp, Homo sapiens
cagctgttcagctgg

SEQ ID NO: 173908 - DNA, 16 bp, Homo sapiens
cagctgttcagctggt

SEQ ID NO: 173909 - DNA, 17 bp, Homo sapiens
cagcttaggggctgctg

SEQ ID NO: 173910 - DNA, 22 bp, Homo sapiens
cagcttcccctctctcctcctg

SEQ ID NO: 173911 - DNA, 22 bp, Homo sapiens
cagcttgcgttagaatgaggag

SEQ ID NO: 173912 - DNA, 19 bp, Homo sapiens
cagcttgctgccctaggct

SEQ ID NO: 173913 - DNA, 17 bp, Homo sapiens
cagcttgttatttataa

SEQ ID NO: 173914 - DNA, 18 bp, Homo sapiens
cagctttaaactcaggga

SEQ ID NO: 173915 - DNA, 20 bp, Homo sapiens
cagctttaaactcagggaca

SEQ ID NO: 173916 - DNA, 23 bp, Homo sapiens
cagctttcctcaaaacttcagac

SEQ ID NO: 173917 - DNA, 22 bp, Homo sapiens
cagctttgtttgttgtcagctg

SEQ ID NO: 173918 - DNA, 13 bp, Homo sapiens
cagctttttgtct

SEQ ID NO: 173919 - DNA, 19 bp, Homo sapiens
cagcttttttttcccccct

SEQ ID NO: 173920 - DNA, 17 bp, Homo sapiens
caggaaaatcctctggc

SEQ ID NO: 173921 - DNA, 23 bp, Homo sapiens
caggaaatcaaatatgcaaagca

SEQ ID NO: 173922 - DNA, 13 bp, Homo sapiens
caggaaatgaaaa

SEQ ID NO: 173923 - DNA, 19 bp, Homo sapiens
caggaagcattcagagagc

SEQ ID NO: 173924 - DNA, 22 bp, Homo sapiens
caggaagcattcagagagcagc

SEQ ID NO: 173925 - DNA, 19 bp, Homo sapiens
caggaaggctgagaggaga

SEQ ID NO: 173926 - DNA, 16 bp, Homo sapiens
caggaagtagaggagg

SEQ ID NO: 173927 - DNA, 17 bp, Homo sapiens
caggaatgtgtggcaga

SEQ ID NO: 173928 - DNA, 15 bp, Homo sapiens
caggacaacgaggaa

SEQ ID NO: 173929 - DNA, 21 bp, Homo sapiens
caggacaccacacccagcctc

SEQ ID NO: 173930 - DNA, 23 bp, Homo sapiens
caggacaccacacccagcctcag

SEQ ID NO: 173931 - DNA, 13 bp, Homo sapiens
caggacaggcccg

SEQ ID NO: 173932 - DNA, 14 bp, Homo sapiens
caggacccagagga

SEQ ID NO: 173933 - DNA, 21 bp, Homo sapiens
caggacccatcacgcctgtgc

SEQ ID NO: 173934 - DNA, 16 bp, Homo sapiens
caggacctcaggtgag

SEQ ID NO: 173935 - DNA, 13 bp, Homo sapiens
caggaccttttga

SEQ ID NO: 173936 - DNA, 20 bp, Homo sapiens
caggaccttttgaagtagtt

SEQ ID NO: 173937 - DNA, 19 bp, Homo sapiens
caggactcagaagcctctg

SEQ ID NO: 173938 - DNA, 20 bp, Homo sapiens
caggactcagaagcctctgg

SEQ ID NO: 173939 - DNA, 21 bp, Homo sapiens
caggactcagaagcctctggg

SEQ ID NO: 173940 - DNA, 20 bp, Homo sapiens
caggactgagccccgcagac

SEQ ID NO: 173941 - DNA, 23 bp, Homo sapiens
caggagaaatgcatccattcctc

SEQ ID NO: 173942 - DNA, 22 bp, Homo sapiens
caggagaaggccaattcctata

SEQ ID NO: 173943 - DNA, 14 bp, Homo sapiens
caggagacaggaag

SEQ ID NO: 173944 - DNA, 15 bp, Homo sapiens
caggagacaggaagg

SEQ ID NO: 173945 - DNA, 13 bp, Homo sapiens
caggagagagaaa

SEQ ID NO: 173946 - DNA, 19 bp, Homo sapiens
caggagagagaaagccagg

SEQ ID NO: 173947 - DNA, 13 bp, Homo sapiens
caggagagccagc

SEQ ID NO: 173948 - DNA, 17 bp, Homo sapiens
caggagagccagccctc

SEQ ID NO: 173949 - DNA, 18 bp, Homo sapiens
caggagagccagccctcc

SEQ ID NO: 173950 - DNA, 19 bp, Homo sapiens
caggagagccagccctccc

SEQ ID NO: 173951 - DNA, 21 bp, Homo sapiens
caggagagccagccctccctg

SEQ ID NO: 173952 - DNA, 12 bp, Homo sapiens
caggagagtaga

SEQ ID NO: 173953 - DNA, 16 bp, Homo sapiens
caggagattgagaagg

SEQ ID NO: 173954 - DNA, 17 bp, Homo sapiens
caggagattgagaagga

SEQ ID NO: 173955 - DNA, 23 bp, Homo sapiens
caggagattgagaaggagagaaa

SEQ ID NO: 173956 - DNA, 23 bp, Homo sapiens
caggaggaatcatgtcaggcctg

SEQ ID NO: 173957 - DNA, 14 bp, Homo sapiens
cattctattgttaa

SEQ ID NO: 173958 - DNA, 16 bp, Homo sapiens
cattctcactcctacc

SEQ ID NO: 173959 - DNA, 11 bp, Homo sapiens
cattctcctgc

SEQ ID NO: 173960 - DNA, 15 bp, Homo sapiens
cattctcctgcctgt

SEQ ID NO: 173961 - DNA, 15 bp, Homo sapiens
cattctctctcctgt

SEQ ID NO: 173962 - DNA, 19 bp, Homo sapiens
cattgatggggaaggaggc

SEQ ID NO: 173963 - DNA, 22 bp, Homo sapiens
cattgcttgtgccacaccctcc

SEQ ID NO: 173964 - DNA, 16 bp, Homo sapiens
cattggacccttccat

SEQ ID NO: 173965 - DNA, 19 bp, Homo sapiens
cattgtaaatagtatttga

SEQ ID NO: 173966 - DNA, 21 bp, Homo sapiens
cattgtagagcttctggcact

SEQ ID NO: 173967 - DNA, 19 bp, Homo sapiens
cattgtccaatcctatgtt

SEQ ID NO: 173968 - DNA, 21 bp, Homo sapiens
cattgtccaatcctatgtttt

SEQ ID NO: 173969 - DNA, 21 bp, Homo sapiens
cattgtggctgtcagcaggaa

SEQ ID NO: 173970 - DNA, 21 bp, Homo sapiens
cattgtgggatgttcagcact

SEQ ID NO: 173971 - DNA, 15 bp, Homo sapiens
catttaaaaaaaatc

SEQ ID NO: 173972 - DNA, 13 bp, Homo sapiens
catttaaaatgat

SEQ ID NO: 173973 - DNA, 14 bp, Homo sapiens
catttaaaatgatt

SEQ ID NO: 173974 - DNA, 23 bp, Homo sapiens
caggatgctaacatctaaaaata

SEQ ID NO: 173975 - DNA, 21 bp, Homo sapiens
caggatgggggctggcctctg

SEQ ID NO: 173976 - DNA, 15 bp, Homo sapiens
caggcaactgaggca

SEQ ID NO: 173977 - DNA, 17 bp, Homo sapiens
caggcaactgaggcaga

SEQ ID NO: 173978 - DNA, 22 bp, Homo sapiens
caggcaactgaggcagacagca

SEQ ID NO: 173979 - DNA, 18 bp, Homo sapiens
caggcaagtgaagaaaag

SEQ ID NO: 173980 - DNA, 17 bp, Homo sapiens
caggcacgaacccacct

SEQ ID NO: 173981 - DNA, 19 bp, Homo sapiens
caggcacgaacccacctgc

SEQ ID NO: 173982 - DNA, 22 bp, Homo sapiens
caggcactagcctttggctctg

SEQ ID NO: 173983 - DNA, 12 bp, Homo sapiens
caggcagacacg

SEQ ID NO: 173984 - DNA, 14 bp, Homo sapiens
caggcagacacgga

SEQ ID NO: 173985 - DNA, 16 bp, Homo sapiens
caggcagacacggatc

SEQ ID NO: 173986 - DNA, 22 bp, Homo sapiens
caggcagacacggatctgagaa

SEQ ID NO: 173987 - DNA, 15 bp, Homo sapiens
caggcagcacagaga

SEQ ID NO: 173988 - DNA, 21 bp, Homo sapiens
caggcagcgatggtctcagaa

SEQ ID NO: 173989 - DNA, 17 bp, Homo sapiens
caggcagggctgactct

SEQ ID NO: 173990 - DNA, 15 bp, Homo sapiens
caggcaggtgggatg

SEQ ID NO: 173991 - DNA, 21 bp, Homo sapiens
caggccaggctccttcctgtc

SEQ ID NO: 173992 - DNA, 21 bp, Homo sapiens
caggccagtaagggaaataga

SEQ ID NO: 173993 - DNA, 22 bp, Homo sapiens
caggccagtaagggaaatagaa

SEQ ID NO: 173994 - DNA, 23 bp, Homo sapiens
caggccagtaagggaaatagaaa

SEQ ID NO: 173995 - DNA, 13 bp, Homo sapiens
caggcccacagta

SEQ ID NO: 173996 - DNA, 14 bp, Homo sapiens
caggccccaggaag

SEQ ID NO: 173997 - DNA, 15 bp, Homo sapiens
caggcccggggctgg

SEQ ID NO: 173998 - DNA, 16 bp, Homo sapiens
caggcccttcctctcc

SEQ ID NO: 173999 - DNA, 18 bp, Homo sapiens
caggccgccccagcctct

SEQ ID NO: 174000 - DNA, 20 bp, Homo sapiens
caggccggcgagccctgtgg

SEQ ID NO: 174001 - DNA, 12 bp, Homo sapiens
caggcctctgtg

SEQ ID NO: 174002 - DNA, 14 bp, Homo sapiens
caggcctctgtgtc

SEQ ID NO: 174003 - DNA, 17 bp, Homo sapiens
caggcctctgtgtcctt

SEQ ID NO: 174004 - DNA, 12 bp, Homo sapiens
caggcctgccag

SEQ ID NO: 174005 - DNA, 19 bp, Homo sapiens
caggcgatccacctgtctc

SEQ ID NO: 174006 - DNA, 17 bp, Homo sapiens
caggcgccccttccccc

SEQ ID NO: 174007 - DNA, 23 bp, Homo sapiens
caggcgggagcggtggccctgtc

SEQ ID NO: 174008 - DNA, 20 bp, Homo sapiens
caggctccttcctgtcttcc

SEQ ID NO: 174009 - DNA, 21 bp, Homo sapiens
caggctccttcctgtcttcct

SEQ ID NO: 174010 - DNA, 13 bp, Homo sapiens
caggctctgccct

SEQ ID NO: 174011 - DNA, 22 bp, Homo sapiens
caggctctgccctgccctagct

SEQ ID NO: 174012 - DNA, 15 bp, Homo sapiens
caggctcttagcagc

SEQ ID NO: 174013 - DNA, 18 bp, Homo sapiens
caggctcttagcagcttc

SEQ ID NO: 174014 - DNA, 15 bp, Homo sapiens
caggctcttctcctt

SEQ ID NO: 174015 - DNA, 20 bp, Homo sapiens
cagggaaaattatttgcata

SEQ ID NO: 174016 - DNA, 15 bp, Homo sapiens
cagggaagagcagaa

SEQ ID NO: 174017 - DNA, 18 bp, Homo sapiens
cagggaagtccccaggcc

SEQ ID NO: 174018 - DNA, 23 bp, Homo sapiens
cagggaagtccccaggccccagg

SEQ ID NO: 174019 - DNA, 17 bp, Homo sapiens
cagggaagtgctctgat

SEQ ID NO: 174020 - DNA, 16 bp, Homo sapiens
cagggacagagccatg

SEQ ID NO: 174021 - DNA, 18 bp, Homo sapiens
cagggacaggataagagg

SEQ ID NO: 174022 - DNA, 22 bp, Homo sapiens
cagggacccacttcacacacag

SEQ ID NO: 174023 - DNA, 14 bp, Homo sapiens
cagggacccctgcc

SEQ ID NO: 174024 - DNA, 15 bp, Homo sapiens
cagggacttgaagtt

SEQ ID NO: 174025 - DNA, 13 bp, Homo sapiens
cagggagcggaaa

SEQ ID NO: 174026 - DNA, 16 bp, Homo sapiens
cagggagcggaaagca

SEQ ID NO: 174027 - DNA, 19 bp, Homo sapiens
cagggagcggaaagcagct

SEQ ID NO: 174028 - DNA, 22 bp, Homo sapiens
cagggagcggaaagcagctcaa

SEQ ID NO: 174029 - DNA, 23 bp, Homo sapiens
cagggatgccatctgtgggcacg

SEQ ID NO: 174030 - DNA, 17 bp, Homo sapiens
cagggattaacctctgc

SEQ ID NO: 174031 - DNA, 13 bp, Homo sapiens
cagggcagggccc

SEQ ID NO: 174032 - DNA, 22 bp, Homo sapiens
cagggccaacttgagggcccag

SEQ ID NO: 174033 - DNA, 15 bp, Homo sapiens
cagggccacgtgcca

SEQ ID NO: 174034 - DNA, 17 bp, Homo sapiens
cagggccacgtgccagg

SEQ ID NO: 174035 - DNA, 18 bp, Homo sapiens
cagggccacgtgccaggc

SEQ ID NO: 174036 - DNA, 16 bp, Homo sapiens
cagggccactctgcct

SEQ ID NO: 174037 - DNA, 20 bp, Homo sapiens
cagggccactctgcctctgc

SEQ ID NO: 174038 - DNA, 15 bp, Homo sapiens
cagggccaggactga

SEQ ID NO: 174039 - DNA, 15 bp, Homo sapiens
cagggccccagcact

SEQ ID NO: 174040 - DNA, 18 bp, Homo sapiens
cagggcccctcaccctgc

SEQ ID NO: 174041 - DNA, 20 bp, Homo sapiens
cagggcctgagcctggccag

SEQ ID NO: 174042 - DNA, 22 bp, Homo sapiens
cagggcctgagcctggccagcc

SEQ ID NO: 174043 - DNA, 22 bp, Homo sapiens
cagggcctgcaggacctgcctg

SEQ ID NO: 174044 - DNA, 14 bp, Homo sapiens
cagggccttgccca

SEQ ID NO: 174045 - DNA, 16 bp, Homo sapiens
cagggccttgcccaga

SEQ ID NO: 174046 - DNA, 14 bp, Homo sapiens
cagggctaccctga

SEQ ID NO: 174047 - DNA, 22 bp, Homo sapiens
cagggctaccctgagctgaggc

SEQ ID NO: 174048 - DNA, 18 bp, Homo sapiens
cagggctagtgacttgtg

SEQ ID NO: 174049 - DNA, 19 bp, Homo sapiens
caggggaaaatcagcctgc

SEQ ID NO: 174050 - DNA, 20 bp, Homo sapiens
caggggaaaatcagcctgct

SEQ ID NO: 174051 - DNA, 14 bp, Homo sapiens
caggggctctggag

SEQ ID NO: 174052 - DNA, 19 bp, Homo sapiens
caggggctctggagagaaa

SEQ ID NO: 174053 - DNA, 20 bp, Homo sapiens
caggggctctggagagaaac

SEQ ID NO: 174054 - DNA, 19 bp, Homo sapiens
cagggggccaggtgcacag

SEQ ID NO: 174055 - DNA, 13 bp, Homo sapiens
cagggtagcaggt

SEQ ID NO: 174056 - DNA, 13 bp, Homo sapiens
cagggtctgctct

SEQ ID NO: 174057 - DNA, 22 bp, Homo sapiens
cagggtctgctctttctctgcc

SEQ ID NO: 174058 - DNA, 22 bp, Homo sapiens
cagggtggacttagaaagcagg

SEQ ID NO: 174059 - DNA, 18 bp, Homo sapiens
cagggtgggatggaggag

SEQ ID NO: 174060 - DNA, 20 bp, Homo sapiens
cagggtgggatggaggagaa

SEQ ID NO: 174061 - DNA, 23 bp, Homo sapiens
cagggtgttgggatactgcaggg

SEQ ID NO: 174062 - DNA, 15 bp, Homo sapiens
cagggttctcctctc

SEQ ID NO: 174063 - DNA, 20 bp, Homo sapiens
cagggttctcctctcccctc

SEQ ID NO: 174064 - DNA, 21 bp, Homo sapiens
cagggttctcctctcccctct

SEQ ID NO: 174065 - DNA, 14 bp, Homo sapiens
caggtagctgcccc

SEQ ID NO: 174066 - DNA, 23 bp, Homo sapiens
caggtagctgcccctggctctga

SEQ ID NO: 174067 - DNA, 12 bp, Homo sapiens
caggtctcccac

SEQ ID NO: 174068 - DNA, 19 bp, Homo sapiens
caggtctcccacgtgggag

SEQ ID NO: 174069 - DNA, 22 bp, Homo sapiens
caggtctcctcttaaaaaataa

SEQ ID NO: 174070 - DNA, 13 bp, Homo sapiens
caggtgagaagca

SEQ ID NO: 174071 - DNA, 20 bp, Homo sapiens
caggtgagaagcagaggaag

SEQ ID NO: 174072 - DNA, 23 bp, Homo sapiens
caggtgcacagacgtccctccac

SEQ ID NO: 174073 - DNA, 17 bp, Homo sapiens
caggtgcccatccctgg

SEQ ID NO: 174074 - DNA, 20 bp, Homo sapiens
caggtgcccatccctggaag

SEQ ID NO: 174075 - DNA, 15 bp, Homo sapiens
caggtggccactcca

SEQ ID NO: 174076 - DNA, 21 bp, Homo sapiens
caggtggccactccagacccc

SEQ ID NO: 174077 - DNA, 15 bp, Homo sapiens
caggtggctgaccca

SEQ ID NO: 174078 - DNA, 22 bp, Homo sapiens
caggtggctgacccagtccctg

SEQ ID NO: 174079 - DNA, 23 bp, Homo sapiens
caggtggctgacccagtccctgg

SEQ ID NO: 174080 - DNA, 20 bp, Homo sapiens
caggtggggagactgggctg

SEQ ID NO: 174081 - DNA, 18 bp, Homo sapiens
caggtggttatggagagg

SEQ ID NO: 174082 - DNA, 20 bp, Homo sapiens
caggtggttatggagagggt

SEQ ID NO: 174083 - DNA, 13 bp, Homo sapiens
caggtgttgccaa

SEQ ID NO: 174084 - DNA, 14 bp, Homo sapiens
caggttggtggggg

SEQ ID NO: 174085 - DNA, 16 bp, Homo sapiens
caggtttaagctgtta

SEQ ID NO: 174086 - DNA, 15 bp, Homo sapiens
caggttttgtaaaga

SEQ ID NO: 174087 - DNA, 18 bp, Homo sapiens
cagtaacgcgtcttcctg

SEQ ID NO: 174088 - DNA, 15 bp, Homo sapiens
cagtaagccactgcc

SEQ ID NO: 174089 - DNA, 16 bp, Homo sapiens
cagtaattgtgaaaat

SEQ ID NO: 174090 - DNA, 22 bp, Homo sapiens
cagtacctataaagtaaagcta

SEQ ID NO: 174091 - DNA, 15 bp, Homo sapiens
cagtaggagcccagc

SEQ ID NO: 174092 - DNA, 22 bp, Homo sapiens
cagtaggagcccagctctgaaa

SEQ ID NO: 174093 - DNA, 12 bp, Homo sapiens
cagtagtgatag

SEQ ID NO: 174094 - DNA, 17 bp, Homo sapiens
cagtatcaggcctgcca

SEQ ID NO: 174095 - DNA, 15 bp, Homo sapiens
cagtattctaggtag

SEQ ID NO: 174096 - DNA, 14 bp, Homo sapiens
cagtcaacctgggc

SEQ ID NO: 174097 - DNA, 22 bp, Homo sapiens
cagtcaacctgggcaaagccta

SEQ ID NO: 174098 - DNA, 17 bp, Homo sapiens
cagtcaaggagtggctt

SEQ ID NO: 174099 - DNA, 24 bp, Homo sapiens
cagtcatggcaccaaagccaccag

SEQ ID NO: 174100 - DNA, 11 bp, Homo sapiens
cagtcatttaa

SEQ ID NO: 174101 - DNA, 13 bp, Homo sapiens
cagtccacaaaat

SEQ ID NO: 174102 - DNA, 15 bp, Homo sapiens
cagtccacctgagct

SEQ ID NO: 174103 - DNA, 23 bp, Homo sapiens
cagtccaggatgctaacatctaa

SEQ ID NO: 174104 - DNA, 16 bp, Homo sapiens
cagtccccctgcccca

SEQ ID NO: 174105 - DNA, 17 bp, Homo sapiens
cagtccccctgccccag

SEQ ID NO: 174106 - DNA, 23 bp, Homo sapiens
cagtccccgtgaaggagagccct

SEQ ID NO: 174107 - DNA, 12 bp, Homo sapiens
cagtccctgggg

SEQ ID NO: 174108 - DNA, 20 bp, Homo sapiens
cagtccctgggggaagccct

SEQ ID NO: 174109 - DNA, 15 bp, Homo sapiens
ccacgtccccctggg

SEQ ID NO: 174110 - DNA, 17 bp, Homo sapiens
ccactcaagccaagcag

SEQ ID NO: 174111 - DNA, 16 bp, Homo sapiens
ccactcaccagtgtcc

SEQ ID NO: 174112 - DNA, 21 bp, Homo sapiens
ccactccagacccctggcttt

SEQ ID NO: 174113 - DNA, 12 bp, Homo sapiens
ccactcctccaa

SEQ ID NO: 174114 - DNA, 12 bp, Homo sapiens
ccactccttcct

SEQ ID NO: 174115 - DNA, 21 bp, Homo sapiens
ccagtgacagacaggctctta

SEQ ID NO: 174116 - DNA, 15 bp, Homo sapiens
ccagtgacctgagga

SEQ ID NO: 174117 - DNA, 17 bp, Homo sapiens
ccagtgacctgaggaag

SEQ ID NO: 174118 - DNA, 18 bp, Homo sapiens
ccagtgacctgaggaagc

SEQ ID NO: 174119 - DNA, 19 bp, Homo sapiens
ccagtgagcactcccaagt

SEQ ID NO: 174120 - DNA, 17 bp, Homo sapiens
ccagtgccttacctcct

SEQ ID NO: 174121 - DNA, 22 bp, Homo sapiens
ccagtgtcccctccactgtcac

SEQ ID NO: 174122 - DNA, 20 bp, Homo sapiens
ccagtgttagggaagggcct

SEQ ID NO: 174123 - DNA, 17 bp, Homo sapiens
ccagttaaaaaaaattt

SEQ ID NO: 174124 - DNA, 21 bp, Homo sapiens
ccagttgcacttggcctctgg

SEQ ID NO: 174125 - DNA, 14 bp, Homo sapiens
ccagtttgcagaaa

SEQ ID NO: 174126 - DNA, 17 bp, Homo sapiens
ccatagagtttaacaca

SEQ ID NO: 174127 - DNA, 21 bp, Homo sapiens
ccatagcaagattgcttaaaa

SEQ ID NO: 174128 - DNA, 16 bp, Homo sapiens
ccatcacgcctgtgca

SEQ ID NO: 174129 - DNA, 21 bp, Homo sapiens
ccatcagcttaggggctgctg

SEQ ID NO: 174130 - DNA, 12 bp, Homo sapiens
ccatcccacacc

SEQ ID NO: 174131 - DNA, 13 bp, Homo sapiens
ccatcccctggac

SEQ ID NO: 174132 - DNA, 22 bp, Homo sapiens
ccatcccctgtagagtgggagc

SEQ ID NO: 174133 - DNA, 15 bp, Homo sapiens
ccatccctgcctggt

SEQ ID NO: 174134 - DNA, 17 bp, Homo sapiens
ccatccctgcctggtca

SEQ ID NO: 174135 - DNA, 21 bp, Homo sapiens
ccatcctgcagcctcctcctg

SEQ ID NO: 174136 - DNA, 16 bp, Homo sapiens
ccatcgctgtcatctc

SEQ ID NO: 174137 - DNA, 17 bp, Homo sapiens
ccatctctccctcccct

SEQ ID NO: 174138 - DNA, 14 bp, Homo sapiens
ccatctggcagggt

SEQ ID NO: 174139 - DNA, 16 bp, Homo sapiens
ccatctggcagggtgg

SEQ ID NO: 174140 - DNA, 22 bp, Homo sapiens
ccatctgggtccttgcacccct

SEQ ID NO: 174141 - DNA, 22 bp, Homo sapiens
ccatctgtgggcacgctgtggg

SEQ ID NO: 174142 - DNA, 13 bp, Homo sapiens
ccatgaagacagg

SEQ ID NO: 174143 - DNA, 22 bp, Homo sapiens
ccatgaagagatttttcatgat

SEQ ID NO: 174144 - DNA, 20 bp, Homo sapiens
ccatgaggagttgctgtttg

SEQ ID NO: 174145 - DNA, 19 bp, Homo sapiens
ccatgattaaccacttcag

SEQ ID NO: 174146 - DNA, 15 bp, Homo sapiens
ccatgctcctggccc

SEQ ID NO: 174147 - DNA, 18 bp, Homo sapiens
ccatgctcctggcccact

SEQ ID NO: 174148 - DNA, 16 bp, Homo sapiens
ccatgctgggaagacg

SEQ ID NO: 174149 - DNA, 15 bp, Homo sapiens
ccatggacactccag

SEQ ID NO: 174150 - DNA, 19 bp, Homo sapiens
ccatggacactccagtgcc

SEQ ID NO: 174151 - DNA, 23 bp, Homo sapiens
ccatggcactctatgttctaaga

SEQ ID NO: 174152 - DNA, 11 bp, Homo sapiens
ccatggggaag

SEQ ID NO: 174153 - DNA, 16 bp, Homo sapiens
ccatgtacatgaagaa

SEQ ID NO: 174154 - DNA, 16 bp, Homo sapiens
ccatgtagcaggactg

SEQ ID NO: 174155 - DNA, 16 bp, Homo sapiens
ccatgtatttatctct

SEQ ID NO: 174156 - DNA, 22 bp, Homo sapiens
ccatgtatttatctctatttaa

SEQ ID NO: 174157 - DNA, 19 bp, Homo sapiens
ccatgtcgcctctgcattc

SEQ ID NO: 174158 - DNA, 12 bp, Homo sapiens
ccatgtgtgtgc

SEQ ID NO: 174159 - DNA, 14 bp, Homo sapiens
ccatgtttctctgg

SEQ ID NO: 174160 - DNA, 15 bp, Homo sapiens
ccatgtttctctggc

SEQ ID NO: 174161 - DNA, 21 bp, Homo sapiens
ccatgtttctctggccccaag

SEQ ID NO: 174162 - DNA, 16 bp, Homo sapiens
ccatgtttgagctcag

SEQ ID NO: 174163 - DNA, 22 bp, Homo sapiens
ccattcctgggaaatattccct

SEQ ID NO: 174164 - DNA, 14 bp, Homo sapiens
ccattctctctcct

SEQ ID NO: 174165 - DNA, 16 bp, Homo sapiens
ccattctctctcctgt

SEQ ID NO: 174166 - DNA, 19 bp, Homo sapiens
ccattctctctcctgtcca

SEQ ID NO: 174167 - DNA, 22 bp, Homo sapiens
ccattgaattcttggttgagga

SEQ ID NO: 174168 - DNA, 13 bp, Homo sapiens
ccatttaaagctt

SEQ ID NO: 174169 - DNA, 16 bp, Homo sapiens
ccatttcatctatttc

SEQ ID NO: 174170 - DNA, 13 bp, Homo sapiens
ccatttctattta

SEQ ID NO: 174171 - DNA, 13 bp, Homo sapiens
cccaaaaggcaga

SEQ ID NO: 174172 - DNA, 14 bp, Homo sapiens
cccaaagctttcct

SEQ ID NO: 174173 - DNA, 16 bp, Homo sapiens
cccaaagctttcctgc

SEQ ID NO: 174174 - DNA, 23 bp, Homo sapiens
cccaaaggatactgtaacacttt

SEQ ID NO: 174175 - DNA, 16 bp, Homo sapiens
cccaaagtctgtgtga

SEQ ID NO: 174176 - DNA, 13 bp, Homo sapiens
cccaacctgctct

SEQ ID NO: 174177 - DNA, 21 bp, Homo sapiens
cccaacctgctctcctcttgc

SEQ ID NO: 174178 - DNA, 12 bp, Homo sapiens
cccaactcctgg

SEQ ID NO: 174179 - DNA, 15 bp, Homo sapiens
cccaactcctggaag

SEQ ID NO: 174180 - DNA, 14 bp, Homo sapiens
cccaaggaggaaaa

SEQ ID NO: 174181 - DNA, 22 bp, Homo sapiens
cccaaggaggaaaaacagacaa

SEQ ID NO: 174182 - DNA, 21 bp, Homo sapiens
cccaaggggcagtctggaggg

SEQ ID NO: 174183 - DNA, 14 bp, Homo sapiens
cccaagtgggggca

SEQ ID NO: 174184 - DNA, 19 bp, Homo sapiens
cccacagctcccaccccac

SEQ ID NO: 174185 - DNA, 16 bp, Homo sapiens
cccacaggcccttcct

SEQ ID NO: 174186 - DNA, 15 bp, Homo sapiens
cccaccaccccagct

SEQ ID NO: 174187 - DNA, 19 bp, Homo sapiens
cccaccacctaggccactc

SEQ ID NO: 174188 - DNA, 21 bp, Homo sapiens
cccaccacctaggccactcct

SEQ ID NO: 174189 - DNA, 19 bp, Homo sapiens
cccaccacgatgtggccct

SEQ ID NO: 174190 - DNA, 15 bp, Homo sapiens
cccaccccaccccct

SEQ ID NO: 174191 - DNA, 19 bp, Homo sapiens
cccacccccttcagtgccc

SEQ ID NO: 174192 - DNA, 23 bp, Homo sapiens
cccacccccttcagtgcccacca

SEQ ID NO: 174193 - DNA, 23 bp, Homo sapiens
cccaccgggctgggagctctgca

SEQ ID NO: 174194 - DNA, 10 bp, Homo sapiens
cccacctccc

SEQ ID NO: 174195 - DNA, 14 bp, Homo sapiens
cccacctccccacg

SEQ ID NO: 174196 - DNA, 18 bp, Homo sapiens
cccacctctgtgacctca

SEQ ID NO: 174197 - DNA, 12 bp, Homo sapiens
cccacctgctga

SEQ ID NO: 174198 - DNA, 19 bp, Homo sapiens
cccacctgctgagagaccc

SEQ ID NO: 174199 - DNA, 20 bp, Homo sapiens
cccacctggtggcctctgcc

SEQ ID NO: 174200 - DNA, 22 bp, Homo sapiens
cccacctgtcaaacaaagccag

SEQ ID NO: 174201 - DNA, 20 bp, Homo sapiens
cccacgactgcccggcaggg

SEQ ID NO: 174202 - DNA, 21 bp, Homo sapiens
cccacgactgcccggcagggt

SEQ ID NO: 174203 - DNA, 17 bp, Homo sapiens
cccacgccctcccctcc

SEQ ID NO: 174204 - DNA, 12 bp, Homo sapiens
cccacgtgggag

SEQ ID NO: 174205 - DNA, 19 bp, Homo sapiens
cccactcaagccaagcagc

SEQ ID NO: 174206 - DNA, 13 bp, Homo sapiens
cccactctcattc

SEQ ID NO: 174207 - DNA, 21 bp, Homo sapiens
cccactctcattccccaggtg

SEQ ID NO: 174208 - DNA, 21 bp, Homo sapiens
cccactctgctttgactgagc

SEQ ID NO: 174209 - DNA, 15 bp, Homo sapiens
cccactgcaggcccc

SEQ ID NO: 174210 - DNA, 19 bp, Homo sapiens
cccagaactggactcagga

SEQ ID NO: 174211 - DNA, 20 bp, Homo sapiens
cccagaactggactcaggat

SEQ ID NO: 174212 - DNA, 19 bp, Homo sapiens
cccagaaggacctcctgag

SEQ ID NO: 174213 - DNA, 15 bp, Homo sapiens
cccagacacagaaga

SEQ ID NO: 174214 - DNA, 13 bp, Homo sapiens
cccagacagctcc

SEQ ID NO: 174215 - DNA, 17 bp, Homo sapiens
cccagagacaggaaaat

SEQ ID NO: 174216 - DNA, 15 bp, Homo sapiens
cccagagaggaatca

SEQ ID NO: 174217 - DNA, 19 bp, Homo sapiens
cccagagatgcctccaccg

SEQ ID NO: 174218 - DNA, 23 bp, Homo sapiens
cccagaggaaggggccagaggct

SEQ ID NO: 174219 - DNA, 16 bp, Homo sapiens
cccagaggattgctgc

SEQ ID NO: 174220 - DNA, 16 bp, Homo sapiens
cccagagtgtgggaag

SEQ ID NO: 174221 - DNA, 16 bp, Homo sapiens
cccagatcccagaagg

SEQ ID NO: 174222 - DNA, 21 bp, Homo sapiens
cccagcactgcttgaggaaaa

SEQ ID NO: 174223 - DNA, 17 bp, Homo sapiens
cccagcccctagcccag

SEQ ID NO: 174224 - DNA, 19 bp, Homo sapiens
cccagcccctagcccagga

SEQ ID NO: 174225 - DNA, 14 bp, Homo sapiens
cccagccctcatcc

SEQ ID NO: 174226 - DNA, 15 bp, Homo sapiens
cccagccctcatccc

SEQ ID NO: 174227 - DNA, 19 bp, Homo sapiens
cccagccctcatcccgagc

SEQ ID NO: 174228 - DNA, 14 bp, Homo sapiens
cccagccctggctc

SEQ ID NO: 174229 - DNA, 16 bp, Homo sapiens
cccagccctggctctg

SEQ ID NO: 174230 - DNA, 18 bp, Homo sapiens
cccagccctggctctgca

SEQ ID NO: 174231 - DNA, 11 bp, Homo sapiens
cccagcctcag

SEQ ID NO: 174232 - DNA, 20 bp, Homo sapiens
cccagcctccaagctccatc

SEQ ID NO: 174233 - DNA, 15 bp, Homo sapiens
cccagctactcagga

SEQ ID NO: 174234 - DNA, 20 bp, Homo sapiens
cccagctactcaggaggctg

SEQ ID NO: 174235 - DNA, 17 bp, Homo sapiens
cccagctctccctctgg

SEQ ID NO: 174236 - DNA, 18 bp, Homo sapiens
cccagctctccctctggc

SEQ ID NO: 174237 - DNA, 19 bp, Homo sapiens
cccagctctccctctggcc

SEQ ID NO: 174238 - DNA, 14 bp, Homo sapiens
cccagctctgaaac

SEQ ID NO: 174239 - DNA, 20 bp, Homo sapiens
cccagctcttctccccaggt

SEQ ID NO: 174240 - DNA, 18 bp, Homo sapiens
cccagctgtgagccttgg

SEQ ID NO: 174241 - DNA, 14 bp, Homo sapiens
cccaggagagagaa

SEQ ID NO: 174242 - DNA, 18 bp, Homo sapiens
cccaggagagccagccct

SEQ ID NO: 174243 - DNA, 19 bp, Homo sapiens
cccaggagagccagccctc

SEQ ID NO: 174244 - DNA, 19 bp, Homo sapiens
cccaggccaggctccttcc

SEQ ID NO: 174245 - DNA, 23 bp, Homo sapiens
cccaggccaggctccttcctgtc

SEQ ID NO: 174246 - DNA, 14 bp, Homo sapiens
cccaggccagtaag

SEQ ID NO: 174247 - DNA, 18 bp, Homo sapiens
cccaggccccaggaagcc

SEQ ID NO: 174248 - DNA, 23 bp, Homo sapiens
cccaggcgggagcggtggccctg

SEQ ID NO: 174249 - DNA, 13 bp, Homo sapiens
cccagggcctgag

SEQ ID NO: 174250 - DNA, 19 bp, Homo sapiens
cccagggcctgcaggacct

SEQ ID NO: 174251 - DNA, 16 bp, Homo sapiens
cccagggctcagcctg

SEQ ID NO: 174252 - DNA, 17 bp, Homo sapiens
cccagggctcagcctgg

SEQ ID NO: 174253 - DNA, 17 bp, Homo sapiens
cccaggggaaaatgaag

SEQ ID NO: 174254 - DNA, 22 bp, Homo sapiens
cccagggtggacttagaaagca

SEQ ID NO: 174255 - DNA, 13 bp, Homo sapiens
cccagtccccgtg

SEQ ID NO: 174256 - DNA, 14 bp, Homo sapiens
cccagtccctgggg

SEQ ID NO: 174257 - DNA, 14 bp, Homo sapiens
ccaacacgagcagg

SEQ ID NO: 174258 - DNA, 15 bp, Homo sapiens
ccaacaggagctggg

SEQ ID NO: 174259 - DNA, 20 bp, Homo sapiens
ccaacagtgagtctgtcagc

SEQ ID NO: 174260 - DNA, 17 bp, Homo sapiens
ccaacatcccattgccc

SEQ ID NO: 174261 - DNA, 20 bp, Homo sapiens
ccaacatcccattgccctgg

SEQ ID NO: 174262 - DNA, 12 bp, Homo sapiens
ccaacccatcag

SEQ ID NO: 174263 - DNA, 14 bp, Homo sapiens
ccaaccctcagagc

SEQ ID NO: 174264 - DNA, 12 bp, Homo sapiens
ccaacctgacca

SEQ ID NO: 174265 - DNA, 16 bp, Homo sapiens
ccaacctgaccaacat

SEQ ID NO: 174266 - DNA, 13 bp, Homo sapiens
ccaacctggacaa

SEQ ID NO: 174267 - DNA, 23 bp, Homo sapiens
ccaaccttagatgttctaagtct

SEQ ID NO: 174268 - DNA, 21 bp, Homo sapiens
ccaacggagagcgcctgcccc

SEQ ID NO: 174269 - DNA, 20 bp, Homo sapiens
ccaacgtggggcagcacaga

SEQ ID NO: 174270 - DNA, 12 bp, Homo sapiens
ccaactctcctg

SEQ ID NO: 174271 - DNA, 17 bp, Homo sapiens
ccaactttctgtaaact

SEQ ID NO: 174272 - DNA, 20 bp, Homo sapiens
ccaagaatagatgctgactg

SEQ ID NO: 174273 - DNA, 18 bp, Homo sapiens
ccaagacttggcaacaga

SEQ ID NO: 174274 - DNA, 21 bp, Homo sapiens
ccaagacttggtgtcctttcc

SEQ ID NO: 174275 - DNA, 22 bp, Homo sapiens
ccaagacttggtgtcctttccc

SEQ ID NO: 174276 - DNA, 12 bp, Homo sapiens
ccaagcagccaa

SEQ ID NO: 174277 - DNA, 16 bp, Homo sapiens
ccaagcagccaagctc

SEQ ID NO: 174278 - DNA, 14 bp, Homo sapiens
ccaagcaggaagct

SEQ ID NO: 174279 - DNA, 17 bp, Homo sapiens
ccaagcaggaagctcag

SEQ ID NO: 174280 - DNA, 22 bp, Homo sapiens
ccaagcataccaacacgagcag

SEQ ID NO: 174281 - DNA, 15 bp, Homo sapiens
ccaagctagaattcc

SEQ ID NO: 174282 - DNA, 22 bp, Homo sapiens
ccctgcactggagtccagtctc

SEQ ID NO: 174283 - DNA, 23 bp, Homo sapiens
ccctgcactggagtccagtctct

SEQ ID NO: 174284 - DNA, 13 bp, Homo sapiens
ccctgccagctct

SEQ ID NO: 174285 - DNA, 12 bp, Homo sapiens
ccctgccagggc

SEQ ID NO: 174286 - DNA, 20 bp, Homo sapiens
ccctgcccccaaataagaag

SEQ ID NO: 174287 - DNA, 18 bp, Homo sapiens
ccctgcccctcccttcaa

SEQ ID NO: 174288 - DNA, 19 bp, Homo sapiens
ccctgcccctcccttcaac

SEQ ID NO: 174289 - DNA, 13 bp, Homo sapiens
ccctgccgcctca

SEQ ID NO: 174290 - DNA, 13 bp, Homo sapiens
ccctgctgcaggg

SEQ ID NO: 174291 - DNA, 15 bp, Homo sapiens
ccctgctgcaggggc

SEQ ID NO: 174292 - DNA, 19 bp, Homo sapiens
ccctgctgcaggggctctg

SEQ ID NO: 174293 - DNA, 23 bp, Homo sapiens
ccctgctgccgcctcccagcctg

SEQ ID NO: 174294 - DNA, 19 bp, Homo sapiens
ccctgctttgggctgccct

SEQ ID NO: 174295 - DNA, 20 bp, Homo sapiens
ccctgctttgggctgccctg

SEQ ID NO: 174296 - DNA, 22 bp, Homo sapiens
ccctgctttgggctgccctggt

SEQ ID NO: 174297 - DNA, 23 bp, Homo sapiens
ccctgctttgggctgccctggtg

SEQ ID NO: 174298 - DNA, 16 bp, Homo sapiens
ccctggaccagtggtc

SEQ ID NO: 174299 - DNA, 14 bp, Homo sapiens
ccctggactgggag

SEQ ID NO: 174300 - DNA, 19 bp, Homo sapiens
ccctggatccatcaggcca

SEQ ID NO: 174301 - DNA, 17 bp, Homo sapiens
ccctggctcccacaggc

SEQ ID NO: 174302 - DNA, 19 bp, Homo sapiens
ccctggcttgtaactccac

SEQ ID NO: 174303 - DNA, 17 bp, Homo sapiens
ccctggcttttcactgc

SEQ ID NO: 174304 - DNA, 19 bp, Homo sapiens
ccctggcttttcactgctg

SEQ ID NO: 174305 - DNA, 22 bp, Homo sapiens
ccctggcttttcactgctggct

SEQ ID NO: 174306 - DNA, 18 bp, Homo sapiens
ccctgggccccaccacct

SEQ ID NO: 174307 - DNA, 20 bp, Homo sapiens
ccctgggccccaccacctag

SEQ ID NO: 174308 - DNA, 18 bp, Homo sapiens
ccctggggcttctcctga

SEQ ID NO: 174309 - DNA, 17 bp, Homo sapiens
ccctgggggaagccctg

SEQ ID NO: 174310 - DNA, 18 bp, Homo sapiens
ccctgggggaagccctgg

SEQ ID NO: 174311 - DNA, 19 bp, Homo sapiens
ccctgggggaagccctgga

SEQ ID NO: 174312 - DNA, 20 bp, Homo sapiens
ccctgggggaagccctggat

SEQ ID NO: 174313 - DNA, 15 bp, Homo sapiens
ccctggtgctgccac

SEQ ID NO: 174314 - DNA, 21 bp, Homo sapiens
ccctggtgctgccacacttca

SEQ ID NO: 174315 - DNA, 19 bp, Homo sapiens
ccctggttatattctcacg

SEQ ID NO: 174316 - DNA, 14 bp, Homo sapiens
ccctgtcaccaagc

SEQ ID NO: 174317 - DNA, 13 bp, Homo sapiens
ccctgtccctccc

SEQ ID NO: 174318 - DNA, 16 bp, Homo sapiens
ccctgtccctcccacc

SEQ ID NO: 174319 - DNA, 20 bp, Homo sapiens
ccctgtccctcccacctctg

SEQ ID NO: 174320 - DNA, 24 bp, Homo sapiens
ccctgtccctcccacctctgtgac

SEQ ID NO: 174321 - DNA, 13 bp, Homo sapiens
ccctgtcctcact

SEQ ID NO: 174322 - DNA, 22 bp, Homo sapiens
ccctgtgcagccgctgagcgag

SEQ ID NO: 174323 - DNA, 15 bp, Homo sapiens
ccctgtgttgtctct

SEQ ID NO: 174324 - DNA, 17 bp, Homo sapiens
ccctgtgttgtctctag

SEQ ID NO: 174325 - DNA, 13 bp, Homo sapiens
ccctgttcactct

SEQ ID NO: 174326 - DNA, 19 bp, Homo sapiens
ccctgttcagctactccca

SEQ ID NO: 174327 - DNA, 14 bp, Homo sapiens
ccctgtttaatatt

SEQ ID NO: 174328 - DNA, 16 bp, Homo sapiens
ccctgtttaatattta

SEQ ID NO: 174329 - DNA, 15 bp, Homo sapiens
cccttacagcctctg

SEQ ID NO: 174330 - DNA, 19 bp, Homo sapiens
cccttacagcctctgactt

SEQ ID NO: 174331 - DNA, 12 bp, Homo sapiens
cccttatttcct

SEQ ID NO: 174332 - DNA, 18 bp, Homo sapiens
cccttcaaccattcccca

SEQ ID NO: 174333 - DNA, 16 bp, Homo sapiens
cccttcacagtgtttc

SEQ ID NO: 174334 - DNA, 13 bp, Homo sapiens
cccttcagtgccc

SEQ ID NO: 174335 - DNA, 23 bp, Homo sapiens
cccttcccacaggacatttctct

SEQ ID NO: 174336 - DNA, 20 bp, Homo sapiens
cccttcctctccactgcctt

SEQ ID NO: 174337 - DNA, 21 bp, Homo sapiens
cccttcctctccactgccttc

SEQ ID NO: 174338 - DNA, 16 bp, Homo sapiens
cccttctgtccctcac

SEQ ID NO: 174339 - DNA, 11 bp, Homo sapiens
cccttcttttt

SEQ ID NO: 174340 - DNA, 19 bp, Homo sapiens
cccttctttttcttctttt

SEQ ID NO: 174341 - DNA, 13 bp, Homo sapiens
cccttgagacctc

SEQ ID NO: 174342 - DNA, 14 bp, Homo sapiens
cccttgagacctca

SEQ ID NO: 174343 - DNA, 15 bp, Homo sapiens
cccttgagacctcag

SEQ ID NO: 174344 - DNA, 16 bp, Homo sapiens
cccttgagacctcagc

SEQ ID NO: 174345 - DNA, 14 bp, Homo sapiens
cccttgcccagggc

SEQ ID NO: 174346 - DNA, 21 bp, Homo sapiens
cccttgcccagggctcagcct

SEQ ID NO: 174347 - DNA, 17 bp, Homo sapiens
cccttggaggccagcca

SEQ ID NO: 174348 - DNA, 18 bp, Homo sapiens
cccttggaggccagccag

SEQ ID NO: 174349 - DNA, 17 bp, Homo sapiens
cccttggaggctgtctt

SEQ ID NO: 174350 - DNA, 14 bp, Homo sapiens
cccttggctgtgag

SEQ ID NO: 174351 - DNA, 15 bp, Homo sapiens
cccttgtcccactca

SEQ ID NO: 174352 - DNA, 17 bp, Homo sapiens
cccttgtgcgtgggtga

SEQ ID NO: 174353 - DNA, 23 bp, Homo sapiens
ccgaaggtgctggaggtgggagc

SEQ ID NO: 174354 - DNA, 13 bp, Homo sapiens
ccgacagcctggc

SEQ ID NO: 174355 - DNA, 15 bp, Homo sapiens
ccgacagcctggcac

SEQ ID NO: 174356 - DNA, 13 bp, Homo sapiens
ccgacctcgtcct

SEQ ID NO: 174357 - DNA, 23 bp, Homo sapiens
ccgacctcgtcctccccctgcca

SEQ ID NO: 174358 - DNA, 17 bp, Homo sapiens
ccgacgcgtctcctgtt

SEQ ID NO: 174359 - DNA, 17 bp, Homo sapiens
ccgagaaggaagcctcc

SEQ ID NO: 174360 - DNA, 20 bp, Homo sapiens
ccgagagcctgctcccccac

SEQ ID NO: 174361 - DNA, 16 bp, Homo sapiens
ccgagagtagccgaga

SEQ ID NO: 174362 - DNA, 19 bp, Homo sapiens
ccgagattgcaccactgca

SEQ ID NO: 174363 - DNA, 14 bp, Homo sapiens
ccgaggaaactcag

SEQ ID NO: 174364 - DNA, 16 bp, Homo sapiens
ccgagtctcttctcca

SEQ ID NO: 174365 - DNA, 19 bp, Homo sapiens
ccgagtctcttctccactg

SEQ ID NO: 174366 - DNA, 16 bp, Homo sapiens
ccgattcacctgagca

SEQ ID NO: 174367 - DNA, 11 bp, Homo sapiens
ccgcaccccag

SEQ ID NO: 174368 - DNA, 13 bp, Homo sapiens
ccgcaccccagag

SEQ ID NO: 174369 - DNA, 19 bp, Homo sapiens
ccgcagacctccccagccc

SEQ ID NO: 174370 - DNA, 21 bp, Homo sapiens
ccgcagacctccccagcccct

SEQ ID NO: 174371 - DNA, 14 bp, Homo sapiens
ccgcagcagctccc

SEQ ID NO: 174372 - DNA, 12 bp, Homo sapiens
ccgcatcttctc

SEQ ID NO: 174373 - DNA, 23 bp, Homo sapiens
ccgcattccctgagtcaccagga

SEQ ID NO: 174374 - DNA, 23 bp, Homo sapiens
ccgcctcaatgtggttgcaaggc

SEQ ID NO: 174375 - DNA, 13 bp, Homo sapiens
ccgcgttgtaaaa

SEQ ID NO: 174376 - DNA, 17 bp, Homo sapiens
ccgcgttgtaaaatata

SEQ ID NO: 174377 - DNA, 11 bp, Homo sapiens
ccgctcagccc

SEQ ID NO: 174378 - DNA, 17 bp, Homo sapiens
ccgctcctgtctgccag

SEQ ID NO: 174379 - DNA, 23 bp, Homo sapiens
ccgctgagcgaggagatgctcct

SEQ ID NO: 174380 - DNA, 14 bp, Homo sapiens
ccgctgttcaccca

SEQ ID NO: 174381 - DNA, 21 bp, Homo sapiens
ccgctgttcacccacagggct

SEQ ID NO: 174382 - DNA, 15 bp, Homo sapiens
ccgcttggagcagag

SEQ ID NO: 174383 - DNA, 17 bp, Homo sapiens
ccgcttggagcagaggg

SEQ ID NO: 174384 - DNA, 18 bp, Homo sapiens
ccgcttggagcagagggg

SEQ ID NO: 174385 - DNA, 16 bp, Homo sapiens
ccgcttgtccagcgcc

SEQ ID NO: 174386 - DNA, 20 bp, Homo sapiens
ccggaatcctgtcctcagct

SEQ ID NO: 174387 - DNA, 22 bp, Homo sapiens
ccggaatcctgtcctcagcttc

SEQ ID NO: 174388 - DNA, 18 bp, Homo sapiens
ccggagcaaactctgctg

SEQ ID NO: 174389 - DNA, 18 bp, Homo sapiens
ccggcagggtcctagaaa

SEQ ID NO: 174390 - DNA, 22 bp, Homo sapiens
ccggcagttctgggtgctccct

SEQ ID NO: 174391 - DNA, 12 bp, Homo sapiens
ccggccctgggg

SEQ ID NO: 174392 - DNA, 17 bp, Homo sapiens
ccggcgagccctgtgga

SEQ ID NO: 174393 - DNA, 17 bp, Homo sapiens
ccggctatgggggcact

SEQ ID NO: 174394 - DNA, 12 bp, Homo sapiens
ccgggagagggg

SEQ ID NO: 174395 - DNA, 20 bp, Homo sapiens
ccgggcgcggtggctcacgc

SEQ ID NO: 174396 - DNA, 13 bp, Homo sapiens
ccgggctgggagc

SEQ ID NO: 174397 - DNA, 19 bp, Homo sapiens
ccgggctgggagctctgca

SEQ ID NO: 174398 - DNA, 17 bp, Homo sapiens
ccgtaataattattatt

SEQ ID NO: 174399 - DNA, 20 bp, Homo sapiens
ccagtgccttacctcctgcc

SEQ ID NO: 174400 - DNA, 21 bp, Homo sapiens
ccagtgccttacctcctgccc

SEQ ID NO: 174401 - DNA, 22 bp, Homo sapiens
ccagtgccttacctcctgccca

SEQ ID NO: 174402 - DNA, 13 bp, Homo sapiens
ccagtggtctcac

SEQ ID NO: 174403 - DNA, 14 bp, Homo sapiens
ccagtgtcccctcc

SEQ ID NO: 174404 - DNA, 16 bp, Homo sapiens
ccagtgtcccctccac

SEQ ID NO: 174405 - DNA, 17 bp, Homo sapiens
ccagtgttagggaaggg

SEQ ID NO: 174406 - DNA, 14 bp, Homo sapiens
ccagttatggctat

SEQ ID NO: 174407 - DNA, 20 bp, Homo sapiens
ccagttgcacttggcctctg

SEQ ID NO: 174408 - DNA, 23 bp, Homo sapiens
ccagtttgcagaaaagcacctgc

SEQ ID NO: 174409 - DNA, 19 bp, Homo sapiens
ccataaaacattaagaaaa

SEQ ID NO: 174410 - DNA, 13 bp, Homo sapiens
ccatagagtttaa

SEQ ID NO: 174411 - DNA, 18 bp, Homo sapiens
ccatagcaagattgctta

SEQ ID NO: 174412 - DNA, 18 bp, Homo sapiens
ccatagccaccccagaaa

SEQ ID NO: 174413 - DNA, 18 bp, Homo sapiens
ccatatgacctcatgcat

SEQ ID NO: 174414 - DNA, 17 bp, Homo sapiens
ccatcaacaaaaattgt

SEQ ID NO: 174415 - DNA, 18 bp, Homo sapiens
ccatcactggagcaccag

SEQ ID NO: 174416 - DNA, 21 bp, Homo sapiens
ccatccagggatgccatctgt

SEQ ID NO: 174417 - DNA, 14 bp, Homo sapiens
ccatcccacaccct

SEQ ID NO: 174418 - DNA, 22 bp, Homo sapiens
ccatcccaggacaccacaccca

SEQ ID NO: 174419 - DNA, 23 bp, Homo sapiens
ccatcccaggacaccacacccag

SEQ ID NO: 174420 - DNA, 19 bp, Homo sapiens
ccatcccgaaaatctctcg

SEQ ID NO: 174421 - DNA, 12 bp, Homo sapiens
ccatccctgcct

SEQ ID NO: 174422 - DNA, 14 bp, Homo sapiens
ccatccctgcctgg

SEQ ID NO: 174423 - DNA, 19 bp, Homo sapiens
ccatctgcacccccctggg

SEQ ID NO: 174424 - DNA, 20 bp, Homo sapiens
ccatctgcacccccctgggc

SEQ ID NO: 174425 - DNA, 18 bp, Homo sapiens
ccatgcccagctcagagg

SEQ ID NO: 174426 - DNA, 21 bp, Homo sapiens
ccatgctgggaagacgcctga

SEQ ID NO: 174427 - DNA, 15 bp, Homo sapiens
ccatgcttgggtgta

SEQ ID NO: 174428 - DNA, 17 bp, Homo sapiens
ccatggacactccagtg

SEQ ID NO: 174429 - DNA, 13 bp, Homo sapiens
ccatggaggcaca

SEQ ID NO: 174430 - DNA, 17 bp, Homo sapiens
ccatggaggcacacagc

SEQ ID NO: 174431 - DNA, 14 bp, Homo sapiens
ccatgggcagagcc

SEQ ID NO: 174432 - DNA, 16 bp, Homo sapiens
ccatgggcagagccca

SEQ ID NO: 174433 - DNA, 13 bp, Homo sapiens
ccatgggggcagg

SEQ ID NO: 174434 - DNA, 14 bp, Homo sapiens
ccatgggggcaggg

SEQ ID NO: 174435 - DNA, 19 bp, Homo sapiens
ccatggtgtgatcgtctga

SEQ ID NO: 174436 - DNA, 23 bp, Homo sapiens
ccatgtatttatctctatttaat

SEQ ID NO: 174437 - DNA, 16 bp, Homo sapiens
ccatgtgcctgatcca

SEQ ID NO: 174438 - DNA, 10 bp, Homo sapiens
ccatgtgtgt

SEQ ID NO: 174439 - DNA, 21 bp, Homo sapiens
ccatgtttgagctcagacccc

SEQ ID NO: 174440 - DNA, 16 bp, Homo sapiens
ccattccagaatatct

SEQ ID NO: 174441 - DNA, 20 bp, Homo sapiens
ccattctctctcctgtccaa

SEQ ID NO: 174442 - DNA, 13 bp, Homo sapiens
ccattgcctcctc

SEQ ID NO: 174443 - DNA, 15 bp, Homo sapiens
ccattgcctcctcct

SEQ ID NO: 174444 - DNA, 22 bp, Homo sapiens
ccatttaaagcttattaaaact

SEQ ID NO: 174445 - DNA, 19 bp, Homo sapiens
ccatttctaaaggcctctt

SEQ ID NO: 174446 - DNA, 12 bp, Homo sapiens
ccatttctattt

SEQ ID NO: 174447 - DNA, 23 bp, Homo sapiens
accgagagtagccgagagcctgc

SEQ ID NO: 174448 - DNA, 24 bp, Homo sapiens
accgagtctcttctccactggatg

SEQ ID NO: 174449 - DNA, 16 bp, Homo sapiens
accgcaggaagctgct

SEQ ID NO: 174450 - DNA, 19 bp, Homo sapiens
accgcaggaagctgctccg

SEQ ID NO: 174451 - DNA, 17 bp, Homo sapiens
accgccaaggctggggg

SEQ ID NO: 174452 - DNA, 18 bp, Homo sapiens
accgcgttgtaaaatata

SEQ ID NO: 174453 - DNA, 19 bp, Homo sapiens
accgctgcctaagtggctg

SEQ ID NO: 174454 - DNA, 16 bp, Homo sapiens
accggatcctgggtgg

SEQ ID NO: 174455 - DNA, 21 bp, Homo sapiens
accgggctgggagctctgcag

SEQ ID NO: 174456 - DNA, 23 bp, Homo sapiens
accgggctgggagctctgcagag

SEQ ID NO: 174457 - DNA, 23 bp, Homo sapiens
accgtcatggcttaatgtttatt

SEQ ID NO: 174458 - DNA, 13 bp, Homo sapiens
accgtcctcaccc

SEQ ID NO: 174459 - DNA, 15 bp, Homo sapiens
accgtcctcacccct

SEQ ID NO: 174460 - DNA, 16 bp, Homo sapiens
accgtgggctccctga

SEQ ID NO: 174461 - DNA, 16 bp, Homo sapiens
acctaaaaaagatata

SEQ ID NO: 174462 - DNA, 17 bp, Homo sapiens
acctaacccctttcctg

SEQ ID NO: 174463 - DNA, 15 bp, Homo sapiens
acctagtagtcattt

SEQ ID NO: 174464 - DNA, 18 bp, Homo sapiens
acctataaagtaaagcta

SEQ ID NO: 174465 - DNA, 16 bp, Homo sapiens
acctcaaaatgtctaa

SEQ ID NO: 174466 - DNA, 19 bp, Homo sapiens
acctcaacccccatttcta

SEQ ID NO: 174467 - DNA, 21 bp, Homo sapiens
acctcaacccccatttctatt

SEQ ID NO: 174468 - DNA, 18 bp, Homo sapiens
acctcacgcacctcccat

SEQ ID NO: 174469 - DNA, 19 bp, Homo sapiens
acctcacgcacctcccatc

SEQ ID NO: 174470 - DNA, 11 bp, Homo sapiens
acctcagcctg

SEQ ID NO: 174471 - DNA, 17 bp, Homo sapiens
acctcaggcactagcct

SEQ ID NO: 174472 - DNA, 18 bp, Homo sapiens
acctcaggtgagaagcag

SEQ ID NO: 174473 - DNA, 16 bp, Homo sapiens
acctcatgcatctcca

SEQ ID NO: 174474 - DNA, 19 bp, Homo sapiens
acctcatgcatctccacct

SEQ ID NO: 174475 - DNA, 21 bp, Homo sapiens
acctcatgcatctccacctgc

SEQ ID NO: 174476 - DNA, 11 bp, Homo sapiens
acctccacagc

SEQ ID NO: 174477 - DNA, 15 bp, Homo sapiens
acctccacagcttcc

SEQ ID NO: 174478 - DNA, 11 bp, Homo sapiens
acctccccacg

SEQ ID NO: 174479 - DNA, 20 bp, Homo sapiens
acctccccacgccctcccct

SEQ ID NO: 174480 - DNA, 12 bp, Homo sapiens
acctccccagcc

SEQ ID NO: 174481 - DNA, 20 bp, Homo sapiens
acctccccaggccgtggctg

SEQ ID NO: 174482 - DNA, 14 bp, Homo sapiens
acctccccccactg

SEQ ID NO: 174483 - DNA, 19 bp, Homo sapiens
acctcccctatccacccag

SEQ ID NO: 174484 - DNA, 23 bp, Homo sapiens
acctcccctatccacccagccca

SEQ ID NO: 174485 - DNA, 13 bp, Homo sapiens
acctcctgagaaa

SEQ ID NO: 174486 - DNA, 17 bp, Homo sapiens
acctcctgcccaggaga

SEQ ID NO: 174487 - DNA, 20 bp, Homo sapiens
acctcctgcccaggagagcc

SEQ ID NO: 174488 - DNA, 18 bp, Homo sapiens
acctcgctggactctcag

SEQ ID NO: 174489 - DNA, 15 bp, Homo sapiens
acctcgtcctccccc

SEQ ID NO: 174490 - DNA, 18 bp, Homo sapiens
acctcgtcctccccctgc

SEQ ID NO: 174491 - DNA, 20 bp, Homo sapiens
acctcgtcctccccctgcca

SEQ ID NO: 174492 - DNA, 22 bp, Homo sapiens
acctcgtcctccccctgccagt

SEQ ID NO: 174493 - DNA, 23 bp, Homo sapiens
acctctcttatagaatatttatt

SEQ ID NO: 174494 - DNA, 12 bp, Homo sapiens
acctctgcacaa

SEQ ID NO: 174495 - DNA, 16 bp, Homo sapiens
acctctgcacaagctg

SEQ ID NO: 174496 - DNA, 18 bp, Homo sapiens
acctctgcacaagctgca

SEQ ID NO: 174497 - DNA, 18 bp, Homo sapiens
acctctgcggaccccagc

SEQ ID NO: 174498 - DNA, 20 bp, Homo sapiens
acctctgcggaccccagctg

SEQ ID NO: 174499 - DNA, 17 bp, Homo sapiens
acctctgtgacctcagg

SEQ ID NO: 174500 - DNA, 18 bp, Homo sapiens
acctctgtgacctcaggc

SEQ ID NO: 174501 - DNA, 15 bp, Homo sapiens
acctcttcagaggcc

SEQ ID NO: 174502 - DNA, 17 bp, Homo sapiens
acctcttcagaggccct

SEQ ID NO: 174503 - DNA, 21 bp, Homo sapiens
acctgaaaaaaagtttacaag

SEQ ID NO: 174504 - DNA, 19 bp, Homo sapiens
acctgacactcccttgggc

SEQ ID NO: 174505 - DNA, 19 bp, Homo sapiens
acctgaccaacatggagaa

SEQ ID NO: 174506 - DNA, 17 bp, Homo sapiens
acctgcacctcccccca

SEQ ID NO: 174507 - DNA, 18 bp, Homo sapiens
acctgcacctccccccac

SEQ ID NO: 174508 - DNA, 19 bp, Homo sapiens
acctgcacctccccccact

SEQ ID NO: 174509 - DNA, 21 bp, Homo sapiens
acctgcacctccccccactgc

SEQ ID NO: 174510 - DNA, 19 bp, Homo sapiens
acctgcatccgtagttccc

SEQ ID NO: 174511 - DNA, 21 bp, Homo sapiens
acctgcatccgtagttccctg

SEQ ID NO: 174512 - DNA, 22 bp, Homo sapiens
acctgcatccgtagttccctga

SEQ ID NO: 174513 - DNA, 13 bp, Homo sapiens
acctgcccaacct

SEQ ID NO: 174514 - DNA, 22 bp, Homo sapiens
acctgcccagatcccagaagga

SEQ ID NO: 174515 - DNA, 12 bp, Homo sapiens
acctgccgacct

SEQ ID NO: 174516 - DNA, 21 bp, Homo sapiens
acctgcctgacatttggagtg

SEQ ID NO: 174517 - DNA, 14 bp, Homo sapiens
acctgcctgtagcc

SEQ ID NO: 174518 - DNA, 19 bp, Homo sapiens
acctggagttcctgaacct

SEQ ID NO: 174519 - DNA, 14 bp, Homo sapiens
acctggcactgctg

SEQ ID NO: 174520 - DNA, 18 bp, Homo sapiens
acctggcactgctgtgct

SEQ ID NO: 174521 - DNA, 23 bp, Homo sapiens
acctggccccatgtctctcagaa

SEQ ID NO: 174522 - DNA, 21 bp, Homo sapiens
acctgggcatactaataaagt

SEQ ID NO: 174523 - DNA, 21 bp, Homo sapiens
acctggtcacaggactctgcc

SEQ ID NO: 174524 - DNA, 15 bp, Homo sapiens
acctggtggcctctg

SEQ ID NO: 174525 - DNA, 19 bp, Homo sapiens
acctgtaatcccagctact

SEQ ID NO: 174526 - DNA, 14 bp, Homo sapiens
acctgtagtcccag

SEQ ID NO: 174527 - DNA, 20 bp, Homo sapiens
acctgtcaaacaaagccaga

SEQ ID NO: 174528 - DNA, 15 bp, Homo sapiens
acctgtgcctcggct

SEQ ID NO: 174529 - DNA, 22 bp, Homo sapiens
acctgtgcttcgggcccttccc

SEQ ID NO: 174530 - DNA, 13 bp, Homo sapiens
acctgtgtcacta

SEQ ID NO: 174531 - DNA, 18 bp, Homo sapiens
acctgtttttaagctgtt

SEQ ID NO: 174532 - DNA, 19 bp, Homo sapiens
acctgtttttaagctgttt

SEQ ID NO: 174533 - DNA, 15 bp, Homo sapiens
accttaccaactttc

SEQ ID NO: 174534 - DNA, 18 bp, Homo sapiens
accttaccaactttctgt

SEQ ID NO: 174535 - DNA, 13 bp, Homo sapiens
accttaggcaggg

SEQ ID NO: 174536 - DNA, 15 bp, Homo sapiens
accttaggcagggaa

SEQ ID NO: 174537 - DNA, 18 bp, Homo sapiens
accttattgtacctctct

SEQ ID NO: 174538 - DNA, 19 bp, Homo sapiens
accttcaaactagggccaa

SEQ ID NO: 174539 - DNA, 18 bp, Homo sapiens
accttcccagctctccct

SEQ ID NO: 174540 - DNA, 17 bp, Homo sapiens
actctcattccccaggt

SEQ ID NO: 174541 - DNA, 14 bp, Homo sapiens
actctgcctctgcc

SEQ ID NO: 174542 - DNA, 18 bp, Homo sapiens
actctgctcgccttagca

SEQ ID NO: 174543 - DNA, 22 bp, Homo sapiens
actctgctttgactgagcagac

SEQ ID NO: 174544 - DNA, 11 bp, Homo sapiens
actctggcctc

SEQ ID NO: 174545 - DNA, 20 bp, Homo sapiens
actctgtctcagtccatgaa

SEQ ID NO: 174546 - DNA, 15 bp, Homo sapiens
actctgtggccaaag

SEQ ID NO: 174547 - DNA, 11 bp, Homo sapiens
actcttaaaac

SEQ ID NO: 174548 - DNA, 14 bp, Homo sapiens
actcttaatcaaat

SEQ ID NO: 174549 - DNA, 13 bp, Homo sapiens
actctttcaaaac

SEQ ID NO: 174550 - DNA, 16 bp, Homo sapiens
actctttgagaaacaa

SEQ ID NO: 174551 - DNA, 14 bp, Homo sapiens
actctttttagggc

SEQ ID NO: 174552 - DNA, 19 bp, Homo sapiens
actgaaaagactcagtgtt

SEQ ID NO: 174553 - DNA, 13 bp, Homo sapiens
actgaaacttccc

SEQ ID NO: 174554 - DNA, 13 bp, Homo sapiens
actgaaaggttac

SEQ ID NO: 174555 - DNA, 18 bp, Homo sapiens
actgaagccagaaataaa

SEQ ID NO: 174556 - DNA, 21 bp, Homo sapiens
actgaagttaacagagacaga

SEQ ID NO: 174557 - DNA, 15 bp, Homo sapiens
actgaagtttcacat

SEQ ID NO: 174558 - DNA, 17 bp, Homo sapiens
actgaattgtccccagt

SEQ ID NO: 174559 - DNA, 21 bp, Homo sapiens
actgacacccatgtttctctg

SEQ ID NO: 174560 - DNA, 22 bp, Homo sapiens
actgacacccatgtttctctgg

SEQ ID NO: 174561 - DNA, 23 bp, Homo sapiens
actgaccagcctccatgctgcct

SEQ ID NO: 174562 - DNA, 12 bp, Homo sapiens
actgagcagact

SEQ ID NO: 174563 - DNA, 23 bp, Homo sapiens
actgagcagactggtgagcagac

SEQ ID NO: 174564 - DNA, 14 bp, Homo sapiens
actgagccccgcag

SEQ ID NO: 174565 - DNA, 21 bp, Homo sapiens
actgagccccgcagacctccc

SEQ ID NO: 174566 - DNA, 23 bp, Homo sapiens
actgagccccgcagacctcccca

SEQ ID NO: 174567 - DNA, 14 bp, Homo sapiens
actgagccttgtaa

SEQ ID NO: 174568 - DNA, 18 bp, Homo sapiens
actgagcttctctgtgaa

SEQ ID NO: 174569 - DNA, 15 bp, Homo sapiens
actgaggaccagcca

SEQ ID NO: 174570 - DNA, 13 bp, Homo sapiens
actgaggcagaca

SEQ ID NO: 174571 - DNA, 19 bp, Homo sapiens
actgaggcagacagcagct

SEQ ID NO: 174572 - DNA, 23 bp, Homo sapiens
actgaggcagacagcagctcagg

SEQ ID NO: 174573 - DNA, 12 bp, Homo sapiens
actgaggcaggg

SEQ ID NO: 174574 - DNA, 17 bp, Homo sapiens
actgaggggaggggagc

SEQ ID NO: 174575 - DNA, 18 bp, Homo sapiens
actgaggggtctccagga

SEQ ID NO: 174576 - DNA, 22 bp, Homo sapiens
actgatggctaatgtactgcat

SEQ ID NO: 174577 - DNA, 20 bp, Homo sapiens
actgcaacttgtaaatgtgg

SEQ ID NO: 174578 - DNA, 15 bp, Homo sapiens
actgcaagagccttg

SEQ ID NO: 174579 - DNA, 17 bp, Homo sapiens
actgcaagagccttggt

SEQ ID NO: 174580 - DNA, 18 bp, Homo sapiens
actgcaagagccttggtg

SEQ ID NO: 174581 - DNA, 20 bp, Homo sapiens
actgcacagcggcccctgca

SEQ ID NO: 174582 - DNA, 22 bp, Homo sapiens
actgcacagtgcatctcagccc

SEQ ID NO: 174583 - DNA, 14 bp, Homo sapiens
actgcactccagcc

SEQ ID NO: 174584 - DNA, 12 bp, Homo sapiens
actgcaggcccc

SEQ ID NO: 174585 - DNA, 10 bp, Homo sapiens
actgcaggga

SEQ ID NO: 174586 - DNA, 16 bp, Homo sapiens
actgcagggactgcca

SEQ ID NO: 174587 - DNA, 16 bp, Homo sapiens
actgcagggccaggac

SEQ ID NO: 174588 - DNA, 22 bp, Homo sapiens
actgcagggccaggactgagcc

SEQ ID NO: 174589 - DNA, 16 bp, Homo sapiens
actgcattagaaatta

SEQ ID NO: 174590 - DNA, 22 bp, Homo sapiens
actgccacacgtctgaccctct

SEQ ID NO: 174591 - DNA, 14 bp, Homo sapiens
actgccataaaaca

SEQ ID NO: 174592 - DNA, 23 bp, Homo sapiens
actgccataaaacattaagaaaa

SEQ ID NO: 174593 - DNA, 18 bp, Homo sapiens
actgccatggaggcacac

SEQ ID NO: 174594 - DNA, 18 bp, Homo sapiens
actgccccaactcctgga

SEQ ID NO: 174595 - DNA, 18 bp, Homo sapiens
actgccccgtgcagactg

SEQ ID NO: 174596 - DNA, 23 bp, Homo sapiens
actgccccgtgcagactggaggg

SEQ ID NO: 174597 - DNA, 16 bp, Homo sapiens
actgcctctccctggc

SEQ ID NO: 174598 - DNA, 14 bp, Homo sapiens
actgccttaaaact

SEQ ID NO: 174599 - DNA, 21 bp, Homo sapiens
actgccttgaatatcccctcc

SEQ ID NO: 174600 - DNA, 22 bp, Homo sapiens
actgccttgaatatcccctccc

SEQ ID NO: 174601 - DNA, 20 bp, Homo sapiens
actgctccccagccctggct

SEQ ID NO: 174602 - DNA, 16 bp, Homo sapiens
actgctccctgaagcc

SEQ ID NO: 174603 - DNA, 17 bp, Homo sapiens
actgctccctgaagcca

SEQ ID NO: 174604 - DNA, 19 bp, Homo sapiens
actgctccctgaagccagc

SEQ ID NO: 174605 - DNA, 23 bp, Homo sapiens
actgctccctgaagccagccttc

SEQ ID NO: 174606 - DNA, 12 bp, Homo sapiens
actgctggctgc

SEQ ID NO: 174607 - DNA, 13 bp, Homo sapiens
actgctggctgcc

SEQ ID NO: 174608 - DNA, 14 bp, Homo sapiens
actgctggctgcct

SEQ ID NO: 174609 - DNA, 20 bp, Homo sapiens
actggactcaggatgcccag

SEQ ID NO: 174610 - DNA, 21 bp, Homo sapiens
actggactcaggatgcccagg

SEQ ID NO: 174611 - DNA, 16 bp, Homo sapiens
ccgctgttcacccaca

SEQ ID NO: 174612 - DNA, 18 bp, Homo sapiens
ccgctgttcacccacagg

SEQ ID NO: 174613 - DNA, 19 bp, Homo sapiens
ccgcttgtccagcgcctag

SEQ ID NO: 174614 - DNA, 17 bp, Homo sapiens
ccggaggggcctggcag

SEQ ID NO: 174615 - DNA, 15 bp, Homo sapiens
ccggatcctgggtgg

SEQ ID NO: 174616 - DNA, 19 bp, Homo sapiens
ccggcacagggtctgctct

SEQ ID NO: 174617 - DNA, 20 bp, Homo sapiens
ccggcacagggtctgctctt

SEQ ID NO: 174618 - DNA, 17 bp, Homo sapiens
ccggcagttctgggtgc

SEQ ID NO: 174619 - DNA, 13 bp, Homo sapiens
ccggccacctctg

SEQ ID NO: 174620 - DNA, 22 bp, Homo sapiens
ccggctatgggggcactgagga

SEQ ID NO: 174621 - DNA, 23 bp, Homo sapiens
ccggctcgagcagtcctgcctca

SEQ ID NO: 174622 - DNA, 22 bp, Homo sapiens
ccgggaggcagaggttgcagtg

SEQ ID NO: 174623 - DNA, 14 bp, Homo sapiens
ccgggtctgcctct

SEQ ID NO: 174624 - DNA, 18 bp, Homo sapiens
ccggtcccttgagacctc

SEQ ID NO: 174625 - DNA, 14 bp, Homo sapiens
ccgtagttccctga

SEQ ID NO: 174626 - DNA, 16 bp, Homo sapiens
ccgtagttccctgaaa

SEQ ID NO: 174627 - DNA, 16 bp, Homo sapiens
ccgtctcatgaggggc

SEQ ID NO: 174628 - DNA, 22 bp, Homo sapiens
ccgtctggggttcagcccctcc

SEQ ID NO: 174629 - DNA, 23 bp, Homo sapiens
ccgtctggggttcagcccctcct

SEQ ID NO: 174630 - DNA, 15 bp, Homo sapiens
ccgtcttcagcctag

SEQ ID NO: 174631 - DNA, 23 bp, Homo sapiens
ccgtggattgcacgtggcctctt

SEQ ID NO: 174632 - DNA, 23 bp, Homo sapiens
ccgtggcttcccgctcagccctc

SEQ ID NO: 174633 - DNA, 12 bp, Homo sapiens
cctaaaaaagat

SEQ ID NO: 174634 - DNA, 12 bp, Homo sapiens
cctaaaacaaat

SEQ ID NO: 174635 - DNA, 22 bp, Homo sapiens
cctaaaaggaaatctcacccca

SEQ ID NO: 174636 - DNA, 23 bp, Homo sapiens
cctaaaaggaaatctcaccccat

SEQ ID NO: 174637 - DNA, 19 bp, Homo sapiens
cctaagggctcaccgtggc

SEQ ID NO: 174638 - DNA, 16 bp, Homo sapiens
cctaataaagttctgt

SEQ ID NO: 174639 - DNA, 23 bp, Homo sapiens
cctaattagagcagatgacccct

SEQ ID NO: 174640 - DNA, 16 bp, Homo sapiens
cctacagatagtcaaa

SEQ ID NO: 174641 - DNA, 22 bp, Homo sapiens
cctacagttgaaaaacagctga

SEQ ID NO: 174642 - DNA, 19 bp, Homo sapiens
cctaccaatagattcccca

SEQ ID NO: 174643 - DNA, 16 bp, Homo sapiens
cctaccatcagggaca

SEQ ID NO: 174644 - DNA, 11 bp, Homo sapiens
cctaccccacc

SEQ ID NO: 174645 - DNA, 16 bp, Homo sapiens
cctaccgagtctcttc

SEQ ID NO: 174646 - DNA, 20 bp, Homo sapiens
cctaccggcaatttccggcc

SEQ ID NO: 174647 - DNA, 18 bp, Homo sapiens
cctactacatcgccctcc

SEQ ID NO: 174648 - DNA, 22 bp, Homo sapiens
cctagaaacgtttggaacaatc

SEQ ID NO: 174649 - DNA, 21 bp, Homo sapiens
cctagaaattccccaccctga

SEQ ID NO: 174650 - DNA, 17 bp, Homo sapiens
cctagcactttgggagg

SEQ ID NO: 174651 - DNA, 19 bp, Homo sapiens
cctagcccaggagagagaa

SEQ ID NO: 174652 - DNA, 23 bp, Homo sapiens
cctaggcatttgctgaatacaga

SEQ ID NO: 174653 - DNA, 17 bp, Homo sapiens
cctaggccactcctcca

SEQ ID NO: 174654 - DNA, 19 bp, Homo sapiens
cctaggccactcctccaaa

SEQ ID NO: 174655 - DNA, 17 bp, Homo sapiens
cctaggctgaccttgaa

SEQ ID NO: 174656 - DNA, 20 bp, Homo sapiens
cctagggatgttctggccct

SEQ ID NO: 174657 - DNA, 16 bp, Homo sapiens
cctagtccagtgacct

SEQ ID NO: 174658 - DNA, 19 bp, Homo sapiens
cctagtgaaggcttctctc

SEQ ID NO: 174659 - DNA, 21 bp, Homo sapiens
cctagtgaaggcttctctctg

SEQ ID NO: 174660 - DNA, 17 bp, Homo sapiens
cctagtggggtctccct

SEQ ID NO: 174661 - DNA, 20 bp, Homo sapiens
cctagtggggtctccctctc

SEQ ID NO: 174662 - DNA, 21 bp, Homo sapiens
cctagtggggtctccctctcc

SEQ ID NO: 174663 - DNA, 23 bp, Homo sapiens
cctataaaacaggtcaatacagt

SEQ ID NO: 174664 - DNA, 22 bp, Homo sapiens
cctatacgcagcgtgctttaaa

SEQ ID NO: 174665 - DNA, 13 bp, Homo sapiens
cctatccacccag

SEQ ID NO: 174666 - DNA, 22 bp, Homo sapiens
cctatgtttttgttcaaagcca

SEQ ID NO: 174667 - DNA, 17 bp, Homo sapiens
cctattagagaagagat

SEQ ID NO: 174668 - DNA, 19 bp, Homo sapiens
cctcaacgttgctccccat

SEQ ID NO: 174669 - DNA, 17 bp, Homo sapiens
cctcaagatgaaggcaa

SEQ ID NO: 174670 - DNA, 12 bp, Homo sapiens
cctcacagcctc

SEQ ID NO: 174671 - DNA, 16 bp, Homo sapiens
cctcacagcctctgac

SEQ ID NO: 174672 - DNA, 22 bp, Homo sapiens
cctcacagcctctgacccctcc

SEQ ID NO: 174673 - DNA, 23 bp, Homo sapiens
cctcacagcctctgacccctcct

SEQ ID NO: 174674 - DNA, 16 bp, Homo sapiens
cctcaccccgtctggg

SEQ ID NO: 174675 - DNA, 17 bp, Homo sapiens
cctcaccccgtctgggg

SEQ ID NO: 174676 - DNA, 18 bp, Homo sapiens
cctcacccctgccctggg

SEQ ID NO: 174677 - DNA, 14 bp, Homo sapiens
cctcaccctgcctt

SEQ ID NO: 174678 - DNA, 15 bp, Homo sapiens
cctcacctgtagcag

SEQ ID NO: 174679 - DNA, 15 bp, Homo sapiens
cctcactggccatcc

SEQ ID NO: 174680 - DNA, 22 bp, Homo sapiens
cctcactggccatccctcgtgg

SEQ ID NO: 174681 - DNA, 16 bp, Homo sapiens
acttccaccagcctgc

SEQ ID NO: 174682 - DNA, 18 bp, Homo sapiens
acttccaccagcctgcac

SEQ ID NO: 174683 - DNA, 17 bp, Homo sapiens
acttccatgaggccaaa

SEQ ID NO: 174684 - DNA, 15 bp, Homo sapiens
acttcctgtgacttc

SEQ ID NO: 174685 - DNA, 17 bp, Homo sapiens
acttcgggaggtcgagg

SEQ ID NO: 174686 - DNA, 15 bp, Homo sapiens
acttctaaatgaagt

SEQ ID NO: 174687 - DNA, 16 bp, Homo sapiens
acttctgctttccaca

SEQ ID NO: 174688 - DNA, 22 bp, Homo sapiens
acttctgtcttcacaacagatt

SEQ ID NO: 174689 - DNA, 20 bp, Homo sapiens
acttgaacccgggaggcaga

SEQ ID NO: 174690 - DNA, 23 bp, Homo sapiens
acttgaacccgggaggcagaggt

SEQ ID NO: 174691 - DNA, 13 bp, Homo sapiens
acttgaagttgtt

SEQ ID NO: 174692 - DNA, 20 bp, Homo sapiens
acttgagcaccgtcatggct

SEQ ID NO: 174693 - DNA, 15 bp, Homo sapiens
acttgagggcccaga

SEQ ID NO: 174694 - DNA, 20 bp, Homo sapiens
acttgagggcccagagcagg

SEQ ID NO: 174695 - DNA, 21 bp, Homo sapiens
acttgctgcagtatgaaaata

SEQ ID NO: 174696 - DNA, 19 bp, Homo sapiens
acttggagccaagggttca

SEQ ID NO: 174697 - DNA, 14 bp, Homo sapiens
acttggcctctgga

SEQ ID NO: 174698 - DNA, 14 bp, Homo sapiens
acttgggccactgt

SEQ ID NO: 174699 - DNA, 14 bp, Homo sapiens
acttgtaagttgct

SEQ ID NO: 174700 - DNA, 23 bp, Homo sapiens
acttgtgtcccatgatccctgtg

SEQ ID NO: 174701 - DNA, 15 bp, Homo sapiens
actttaaaataaaat

SEQ ID NO: 174702 - DNA, 19 bp, Homo sapiens
actttaattctcatgtgat

SEQ ID NO: 174703 - DNA, 20 bp, Homo sapiens
actttacaatgttcatccca

SEQ ID NO: 174704 - DNA, 15 bp, Homo sapiens
actttacatgacaca

SEQ ID NO: 174705 - DNA, 17 bp, Homo sapiens
actttacatgacacagc

SEQ ID NO: 174706 - DNA, 17 bp, Homo sapiens
actttacccaaaaacta

SEQ ID NO: 174707 - DNA, 15 bp, Homo sapiens
actttagtctgcaaa

SEQ ID NO: 174708 - DNA, 17 bp, Homo sapiens
actttagtctgcaaaat

SEQ ID NO: 174709 - DNA, 21 bp, Homo sapiens
actttcctcttagtcgagcca

SEQ ID NO: 174710 - DNA, 18 bp, Homo sapiens
actttcctttccccagcc

SEQ ID NO: 174711 - DNA, 18 bp, Homo sapiens
actttctgtaaactcaaa

SEQ ID NO: 174712 - DNA, 19 bp, Homo sapiens
actttctgtaaactcaaaa

SEQ ID NO: 174713 - DNA, 20 bp, Homo sapiens
actttcttttcgccgtggct

SEQ ID NO: 174714 - DNA, 12 bp, Homo sapiens
acttttgacaaa

SEQ ID NO: 174715 - DNA, 18 bp, Homo sapiens
actttttggtttgcagat

SEQ ID NO: 174716 - DNA, 21 bp, Homo sapiens
agaaaaaaagtttgccagaag

SEQ ID NO: 174717 - DNA, 19 bp, Homo sapiens
agaaaaaatattttcccta

SEQ ID NO: 174718 - DNA, 20 bp, Homo sapiens
agaaaaagctcctgtcctcc

SEQ ID NO: 174719 - DNA, 17 bp, Homo sapiens
agaaaacacttgtaagt

SEQ ID NO: 174720 - DNA, 15 bp, Homo sapiens
agaaaacatgcctct

SEQ ID NO: 174721 - DNA, 17 bp, Homo sapiens
agaaaagacatgaatat

SEQ ID NO: 174722 - DNA, 16 bp, Homo sapiens
agaaaagataaagatg

SEQ ID NO: 174723 - DNA, 17 bp, Homo sapiens
agaaaagataaagatga

SEQ ID NO: 174724 - DNA, 16 bp, Homo sapiens
agaaaagcacctgccg

SEQ ID NO: 174725 - DNA, 23 bp, Homo sapiens
agaaaagggaagttgtgcctttt

SEQ ID NO: 174726 - DNA, 18 bp, Homo sapiens
agaaaatattttgtctaa

SEQ ID NO: 174727 - DNA, 22 bp, Homo sapiens
agaaaatattttgtctaaaatg

SEQ ID NO: 174728 - DNA, 17 bp, Homo sapiens
agaaacaataaagagat

SEQ ID NO: 174729 - DNA, 17 bp, Homo sapiens
agaaacataaataaaat

SEQ ID NO: 174730 - DNA, 18 bp, Homo sapiens
agaaacccgacagaggga

SEQ ID NO: 174731 - DNA, 18 bp, Homo sapiens
agaaaccttattgtacct

SEQ ID NO: 174732 - DNA, 19 bp, Homo sapiens
agaaacgtttggaacaatc

SEQ ID NO: 174733 - DNA, 20 bp, Homo sapiens
agaaacgtttggaacaatct

SEQ ID NO: 174734 - DNA, 15 bp, Homo sapiens
agaaactcaccccca

SEQ ID NO: 174735 - DNA, 14 bp, Homo sapiens
agaaactgtagtct

SEQ ID NO: 174736 - DNA, 16 bp, Homo sapiens
agaaagactattcaaa

SEQ ID NO: 174737 - DNA, 22 bp, Homo sapiens
agaaagagcacttaagagaata

SEQ ID NO: 174738 - DNA, 17 bp, Homo sapiens
agaaagcagaacagtga

SEQ ID NO: 174739 - DNA, 21 bp, Homo sapiens
agaaagccaaatcaaaatatg

SEQ ID NO: 174740 - DNA, 21 bp, Homo sapiens
agaaagcctcagagaattgct

SEQ ID NO: 174741 - DNA, 19 bp, Homo sapiens
agaaagcctgggtgacatt

SEQ ID NO: 174742 - DNA, 16 bp, Homo sapiens
agaaagctggtaaact

SEQ ID NO: 174743 - DNA, 20 bp, Homo sapiens
agaaagctggtaaactattt

SEQ ID NO: 174744 - DNA, 20 bp, Homo sapiens
agaaaggtggactggaaggg

SEQ ID NO: 174745 - DNA, 20 bp, Homo sapiens
agaaagtcgaattaatagct

SEQ ID NO: 174746 - DNA, 19 bp, Homo sapiens
agaaataaagttggtgaca

SEQ ID NO: 174747 - DNA, 15 bp, Homo sapiens
agaaataatatgcat

SEQ ID NO: 174748 - DNA, 19 bp, Homo sapiens
agaaatacaattctacatt

SEQ ID NO: 174749 - DNA, 13 bp, Homo sapiens
agaaatatgattt

SEQ ID NO: 174750 - DNA, 15 bp, Homo sapiens
agaaatatgatttta

SEQ ID NO: 174751 - DNA, 19 bp, Homo sapiens
agaaatccctgtttaatat

SEQ ID NO: 174752 - DNA, 17 bp, Homo sapiens
agaaattagaaacctta

SEQ ID NO: 174753 - DNA, 15 bp, Homo sapiens
agaaattagctgtgt

SEQ ID NO: 174754 - DNA, 20 bp, Homo sapiens
agaaattgcatttcctgaca

SEQ ID NO: 174755 - DNA, 15 bp, Homo sapiens
agaaatttgatttct

SEQ ID NO: 174756 - DNA, 13 bp, Homo sapiens
agaaatttttatt

SEQ ID NO: 174757 - DNA, 22 bp, Homo sapiens
agaaatttttatttttctaagg

SEQ ID NO: 174758 - DNA, 23 bp, Homo sapiens
agaacaaaaaaatctgcagaagg

SEQ ID NO: 174759 - DNA, 13 bp, Homo sapiens
agaacagcagagg

SEQ ID NO: 174760 - DNA, 19 bp, Homo sapiens
agaacagccgctcctgtct

SEQ ID NO: 174761 - DNA, 20 bp, Homo sapiens
agaacagccgctcctgtctg

SEQ ID NO: 174762 - DNA, 22 bp, Homo sapiens
agaacagtgattaccagggact

SEQ ID NO: 174763 - DNA, 16 bp, Homo sapiens
agaacatccctgccag

SEQ ID NO: 174764 - DNA, 17 bp, Homo sapiens
agaacatccctgccagc

SEQ ID NO: 174765 - DNA, 18 bp, Homo sapiens
agaacatccctgccagct

SEQ ID NO: 174766 - DNA, 20 bp, Homo sapiens
agaacatctgtataccctct

SEQ ID NO: 174767 - DNA, 17 bp, Homo sapiens
agaaccaggcaacttgg

SEQ ID NO: 174768 - DNA, 18 bp, Homo sapiens
agaacctcacgcacctcc

SEQ ID NO: 174769 - DNA, 17 bp, Homo sapiens
agaacctggagttcctg

SEQ ID NO: 174770 - DNA, 21 bp, Homo sapiens
agaacggagccccaggcctct

SEQ ID NO: 174771 - DNA, 17 bp, Homo sapiens
agaacgtggctctgctg

SEQ ID NO: 174772 - DNA, 22 bp, Homo sapiens
agaactactcagggaatgaagg

SEQ ID NO: 174773 - DNA, 14 bp, Homo sapiens
agaactcctagggt

SEQ ID NO: 174774 - DNA, 14 bp, Homo sapiens
agaactctttcaaa

SEQ ID NO: 174775 - DNA, 14 bp, Homo sapiens
cctgggccccacca

SEQ ID NO: 174776 - DNA, 15 bp, Homo sapiens
cctgggccccaccac

SEQ ID NO: 174777 - DNA, 23 bp, Homo sapiens
cctgggccccaccacctaggcca

SEQ ID NO: 174778 - DNA, 15 bp, Homo sapiens
cctgggccctctctg

SEQ ID NO: 174779 - DNA, 14 bp, Homo sapiens
cctggggagccagg

SEQ ID NO: 174780 - DNA, 12 bp, Homo sapiens
cctggggcctcg

SEQ ID NO: 174781 - DNA, 22 bp, Homo sapiens
cctggggcctcggagcctcatc

SEQ ID NO: 174782 - DNA, 22 bp, Homo sapiens
cctggggctaggctggagccca

SEQ ID NO: 174783 - DNA, 21 bp, Homo sapiens
cctggggcttctcctgaccca

SEQ ID NO: 174784 - DNA, 17 bp, Homo sapiens
cctgggggaagccctgg

SEQ ID NO: 174785 - DNA, 18 bp, Homo sapiens
cctgggggaagccctgga

SEQ ID NO: 174786 - DNA, 21 bp, Homo sapiens
cctgggggttctttcttcctc

SEQ ID NO: 174787 - DNA, 23 bp, Homo sapiens
cctgggggttctttcttcctctg

SEQ ID NO: 174788 - DNA, 21 bp, Homo sapiens
cctggggtataaaactttcct

SEQ ID NO: 174789 - DNA, 20 bp, Homo sapiens
cctggggtgtgggaggcccg

SEQ ID NO: 174790 - DNA, 18 bp, Homo sapiens
cctgggtctaaggggttg

SEQ ID NO: 174791 - DNA, 14 bp, Homo sapiens
cctgggtgacattt

SEQ ID NO: 174792 - DNA, 19 bp, Homo sapiens
cctgggtggggctgctcct

SEQ ID NO: 174793 - DNA, 21 bp, Homo sapiens
cctgggtggtctgcaggcagg

SEQ ID NO: 174794 - DNA, 23 bp, Homo sapiens
cctggtcacaggactctgcctcc

SEQ ID NO: 174795 - DNA, 14 bp, Homo sapiens
cctggtctgtagaa

SEQ ID NO: 174796 - DNA, 15 bp, Homo sapiens
cctggtgctgccaca

SEQ ID NO: 174797 - DNA, 17 bp, Homo sapiens
cctggtggcctctgccc

SEQ ID NO: 174798 - DNA, 14 bp, Homo sapiens
cctggtgggcctcc

SEQ ID NO: 174799 - DNA, 16 bp, Homo sapiens
cctgtaacctcttcag

SEQ ID NO: 174800 - DNA, 21 bp, Homo sapiens
cctgtaacctcttcagaggcc

SEQ ID NO: 174801 - DNA, 14 bp, Homo sapiens
cctgtaatcccagc

SEQ ID NO: 174802 - DNA, 23 bp, Homo sapiens
cctgtaatcccagcactttggga

SEQ ID NO: 174803 - DNA, 16 bp, Homo sapiens
cctgtaatcccagcag

SEQ ID NO: 174804 - DNA, 23 bp, Homo sapiens
cctgtaatcccagctactcagga

SEQ ID NO: 174805 - DNA, 20 bp, Homo sapiens
cctgtaatcctagcactttg

SEQ ID NO: 174806 - DNA, 16 bp, Homo sapiens
cctgtacattgtggga

SEQ ID NO: 174807 - DNA, 13 bp, Homo sapiens
cctgtagcagtga

SEQ ID NO: 174808 - DNA, 13 bp, Homo sapiens
cctgtagtcccag

SEQ ID NO: 174809 - DNA, 14 bp, Homo sapiens
cctgtagtcccagc

SEQ ID NO: 174810 - DNA, 17 bp, Homo sapiens
cctgtagttaggaaata

SEQ ID NO: 174811 - DNA, 21 bp, Homo sapiens
cctgtagttaggaaataaaac

SEQ ID NO: 174812 - DNA, 12 bp, Homo sapiens
cctgtatagtta

SEQ ID NO: 174813 - DNA, 19 bp, Homo sapiens
cctgtcaaacaaagccaga

SEQ ID NO: 174814 - DNA, 22 bp, Homo sapiens
cctgtcaaacaaagccagaagc

SEQ ID NO: 174815 - DNA, 23 bp, Homo sapiens
cctgtcaaacaaagccagaagct

SEQ ID NO: 174816 - DNA, 14 bp, Homo sapiens
cctgtcaccaagct

SEQ ID NO: 174817 - DNA, 19 bp, Homo sapiens
cctgtccaacctaacccct

SEQ ID NO: 174818 - DNA, 23 bp, Homo sapiens
cctgtccaacctaacccctttcc

SEQ ID NO: 174819 - DNA, 23 bp, Homo sapiens
cctgtcccatggacactccagtg

SEQ ID NO: 174820 - DNA, 13 bp, Homo sapiens
cctgtcctcactg

SEQ ID NO: 174821 - DNA, 21 bp, Homo sapiens
cctgtcctcccatcccctgga

SEQ ID NO: 174822 - DNA, 19 bp, Homo sapiens
ctagtgaaagaggcagctt

SEQ ID NO: 174823 - DNA, 18 bp, Homo sapiens
ctagtgacttgtgtccca

SEQ ID NO: 174824 - DNA, 13 bp, Homo sapiens
ctagtgcaaatca

SEQ ID NO: 174825 - DNA, 14 bp, Homo sapiens
ctagtgttgcttgg

SEQ ID NO: 174826 - DNA, 20 bp, Homo sapiens
ctagttttcagtttgtatat

SEQ ID NO: 174827 - DNA, 20 bp, Homo sapiens
ctatacctgggcatactaat

SEQ ID NO: 174828 - DNA, 21 bp, Homo sapiens
ctatacctgggcatactaata

SEQ ID NO: 174829 - DNA, 19 bp, Homo sapiens
ctatagacccgaggaaact

SEQ ID NO: 174830 - DNA, 15 bp, Homo sapiens
ctataggtgctacaa

SEQ ID NO: 174831 - DNA, 13 bp, Homo sapiens
ctatatggcaaga

SEQ ID NO: 174832 - DNA, 19 bp, Homo sapiens
ctatatggcaagaaagctg

SEQ ID NO: 174833 - DNA, 19 bp, Homo sapiens
ctatatgtttgtataatga

SEQ ID NO: 174834 - DNA, 22 bp, Homo sapiens
ctatatttagattgttaaaata

SEQ ID NO: 174835 - DNA, 23 bp, Homo sapiens
ctatatttagattgttaaaataa

SEQ ID NO: 174836 - DNA, 20 bp, Homo sapiens
ctatcaaactgaagccagaa

SEQ ID NO: 174837 - DNA, 16 bp, Homo sapiens
ctatcaatagtcaaga

SEQ ID NO: 174838 - DNA, 21 bp, Homo sapiens
ctatcaatagtcaagaaaaat

SEQ ID NO: 174839 - DNA, 20 bp, Homo sapiens
ctatcagcctgtctcttcca

SEQ ID NO: 174840 - DNA, 18 bp, Homo sapiens
ctatcatgtcaaacgtga

SEQ ID NO: 174841 - DNA, 17 bp, Homo sapiens
ctatgaattctaagtga

SEQ ID NO: 174842 - DNA, 16 bp, Homo sapiens
ctatgactgctcccca

SEQ ID NO: 174843 - DNA, 17 bp, Homo sapiens
ctatgactgctccccag

SEQ ID NO: 174844 - DNA, 14 bp, Homo sapiens
ctatgcctgtgtct

SEQ ID NO: 174845 - DNA, 17 bp, Homo sapiens
ctatggggagaaaagac

SEQ ID NO: 174846 - DNA, 21 bp, Homo sapiens
ctatggggagaaaagacatga

SEQ ID NO: 174847 - DNA, 18 bp, Homo sapiens
ctatgttctaagaagtga

SEQ ID NO: 174848 - DNA, 19 bp, Homo sapiens
ctatgttttgacattttta

SEQ ID NO: 174849 - DNA, 22 bp, Homo sapiens
ctatgtttttgttcaaagccag

SEQ ID NO: 174850 - DNA, 17 bp, Homo sapiens
ctattaagatttccaag

SEQ ID NO: 174851 - DNA, 23 bp, Homo sapiens
ctattactgtctggttttaacaa

SEQ ID NO: 174852 - DNA, 21 bp, Homo sapiens
ctattataatttaatgcatgt

SEQ ID NO: 174853 - DNA, 16 bp, Homo sapiens
ctattcaaacagtctc

SEQ ID NO: 174854 - DNA, 23 bp, Homo sapiens
ctattcaaacagtctcaggaaat

SEQ ID NO: 174855 - DNA, 21 bp, Homo sapiens
ctattcaggagagtagaacag

SEQ ID NO: 174856 - DNA, 14 bp, Homo sapiens
ctattgtttattct

SEQ ID NO: 174857 - DNA, 22 bp, Homo sapiens
ctatttaactggcttcagcctc

SEQ ID NO: 174858 - DNA, 14 bp, Homo sapiens
ctatttaatattta

SEQ ID NO: 174859 - DNA, 15 bp, Homo sapiens
ctatttaatatttat

SEQ ID NO: 174860 - DNA, 23 bp, Homo sapiens
ctatttagtttttgtaatttatt

SEQ ID NO: 174861 - DNA, 18 bp, Homo sapiens
ctatttatttactgagct

SEQ ID NO: 174862 - DNA, 17 bp, Homo sapiens
ctatttccattccagaa

SEQ ID NO: 174863 - DNA, 23 bp, Homo sapiens
ctatttccccaggggaaaatgaa

SEQ ID NO: 174864 - DNA, 22 bp, Homo sapiens
ctatttgttgatgcttgtgtca

SEQ ID NO: 174865 - DNA, 12 bp, Homo sapiens
ctattttattcc

SEQ ID NO: 174866 - DNA, 18 bp, Homo sapiens
ctcaaaaaaagaaaaaga

SEQ ID NO: 174867 - DNA, 13 bp, Homo sapiens
ctcaaaactgcac

SEQ ID NO: 174868 - DNA, 20 bp, Homo sapiens
ctcaaaacttaacatattta

SEQ ID NO: 174869 - DNA, 18 bp, Homo sapiens
ctcaaaagctgggcaggt

SEQ ID NO: 174870 - DNA, 11 bp, Homo sapiens
ctcaaaggcac

SEQ ID NO: 174871 - DNA, 21 bp, Homo sapiens
ctcaacacctctgcacaagct

SEQ ID NO: 174872 - DNA, 20 bp, Homo sapiens
ctcaaccatcccctccgtgg

SEQ ID NO: 174873 - DNA, 18 bp, Homo sapiens
ctcaacgttgctccccat

SEQ ID NO: 174874 - DNA, 17 bp, Homo sapiens
ctcaagagggcactggt

SEQ ID NO: 174875 - DNA, 22 bp, Homo sapiens
ctcaaggactttgcagccggca

SEQ ID NO: 174876 - DNA, 15 bp, Homo sapiens
ctcaaggcgtgagga

SEQ ID NO: 174877 - DNA, 15 bp, Homo sapiens
ctcaatcaagaaaat

SEQ ID NO: 174878 - DNA, 23 bp, Homo sapiens
ctcacacggacactcaaaagctg

SEQ ID NO: 174879 - DNA, 18 bp, Homo sapiens
ctcacagttcctcgccct

SEQ ID NO: 174880 - DNA, 20 bp, Homo sapiens
ctcacagttcctcgccctgg

SEQ ID NO: 174881 - DNA, 22 bp, Homo sapiens
ctcacagttcctcgccctgggt

SEQ ID NO: 174882 - DNA, 23 bp, Homo sapiens
ctcacagttcctcgccctgggtc

SEQ ID NO: 174883 - DNA, 20 bp, Homo sapiens
ctcaccactacatcacttga

SEQ ID NO: 174884 - DNA, 23 bp, Homo sapiens
ctcaccagtgtcccctccactgt

SEQ ID NO: 174885 - DNA, 19 bp, Homo sapiens
ctcaccccatcccacaccc

SEQ ID NO: 174886 - DNA, 22 bp, Homo sapiens
ctcaccccatcccacaccctgg

SEQ ID NO: 174887 - DNA, 17 bp, Homo sapiens
ctcacccccaaggggca

SEQ ID NO: 174888 - DNA, 21 bp, Homo sapiens
ctcacccccaaggggcagtct

SEQ ID NO: 174889 - DNA, 15 bp, Homo sapiens
ctcacccctgtcctc

SEQ ID NO: 174890 - DNA, 19 bp, Homo sapiens
ctcacccctgtcctcactg

SEQ ID NO: 174891 - DNA, 16 bp, Homo sapiens
ctcacgcacctcccat

SEQ ID NO: 174892 - DNA, 23 bp, Homo sapiens
ctcacgcctgtaatcccagcagt

SEQ ID NO: 174893 - DNA, 17 bp, Homo sapiens
ctcacgggcatgggcac

SEQ ID NO: 174894 - DNA, 13 bp, Homo sapiens
ctcacgtgtgtga

SEQ ID NO: 174895 - DNA, 12 bp, Homo sapiens
ctcactccacca

SEQ ID NO: 174896 - DNA, 17 bp, Homo sapiens
ctcactccaccacccaa

SEQ ID NO: 174897 - DNA, 16 bp, Homo sapiens
ctcactcctacctggt

SEQ ID NO: 174898 - DNA, 17 bp, Homo sapiens
ctcactgctccctgaag

SEQ ID NO: 174899 - DNA, 23 bp, Homo sapiens
ctcactgctccctgaagccagcc

SEQ ID NO: 174900 - DNA, 14 bp, Homo sapiens
ctcactggccatcc

SEQ ID NO: 174901 - DNA, 21 bp, Homo sapiens
ctcactggccatccctcgtgg

SEQ ID NO: 174902 - DNA, 21 bp, Homo sapiens
ctcactgttgaattttctcta

SEQ ID NO: 174903 - DNA, 13 bp, Homo sapiens
ctcagacccccac

SEQ ID NO: 174904 - DNA, 14 bp, Homo sapiens
ctcagacccccact

SEQ ID NO: 174905 - DNA, 16 bp, Homo sapiens
ctcagacccccactct

SEQ ID NO: 174906 - DNA, 17 bp, Homo sapiens
ctcagagtcggaacgga

SEQ ID NO: 174907 - DNA, 23 bp, Homo sapiens
ctcagatggaaccgcaggaagct

SEQ ID NO: 174908 - DNA, 17 bp, Homo sapiens
ctcagattatttttcct

SEQ ID NO: 174909 - DNA, 19 bp, Homo sapiens
ctcagcaaaagatgcttct

SEQ ID NO: 174910 - DNA, 21 bp, Homo sapiens
ctcagcaaaagatgcttctca

SEQ ID NO: 174911 - DNA, 12 bp, Homo sapiens
ctcagcagccct

SEQ ID NO: 174912 - DNA, 13 bp, Homo sapiens
ctcagcagccctc

SEQ ID NO: 174913 - DNA, 15 bp, Homo sapiens
ctcagcagccctcct

SEQ ID NO: 174914 - DNA, 16 bp, Homo sapiens
ctcagcagccctcctc

SEQ ID NO: 174915 - DNA, 18 bp, Homo sapiens
ctcagcagccctcctcac

SEQ ID NO: 174916 - DNA, 21 bp, Homo sapiens
ctcagccctgggccccaccac

SEQ ID NO: 174917 - DNA, 20 bp, Homo sapiens
ctcagcctcccagagtgctg

SEQ ID NO: 174918 - DNA, 20 bp, Homo sapiens
ctcagcctccggagtagctg

SEQ ID NO: 174919 - DNA, 15 bp, Homo sapiens
ctcagcctcctgtgt

SEQ ID NO: 174920 - DNA, 12 bp, Homo sapiens
ctcagcctggtg

SEQ ID NO: 174921 - DNA, 13 bp, Homo sapiens
ctcagcctgtgct

SEQ ID NO: 174922 - DNA, 22 bp, Homo sapiens
ctcagccttccccttgcccagg

SEQ ID NO: 174923 - DNA, 11 bp, Homo sapiens
ctcagccttgg

SEQ ID NO: 174924 - DNA, 14 bp, Homo sapiens
ctcagcgaatgaat

SEQ ID NO: 174925 - DNA, 23 bp, Homo sapiens
ctcagcgtttttttgtttttaat

SEQ ID NO: 174926 - DNA, 20 bp, Homo sapiens
ctcaggaccaaagctttcat

SEQ ID NO: 174927 - DNA, 18 bp, Homo sapiens
ctcaggaggctgaggcag

SEQ ID NO: 174928 - DNA, 19 bp, Homo sapiens
ctcaggaggctgaggcaga

SEQ ID NO: 174929 - DNA, 19 bp, Homo sapiens
ctcaggatgcccagggcca

SEQ ID NO: 174930 - DNA, 15 bp, Homo sapiens
ctcaggcactagcct

SEQ ID NO: 174931 - DNA, 15 bp, Homo sapiens
ctcaggcaggtggga

SEQ ID NO: 174932 - DNA, 20 bp, Homo sapiens
ctcaggcgatccacctgtct

SEQ ID NO: 174933 - DNA, 16 bp, Homo sapiens
ctcaggctctgccctg

SEQ ID NO: 174934 - DNA, 14 bp, Homo sapiens
ctcagggacagaga

SEQ ID NO: 174935 - DNA, 19 bp, Homo sapiens
ctcagggacagagacacct

SEQ ID NO: 174936 - DNA, 21 bp, Homo sapiens
ctcagggacagagacacctgc

SEQ ID NO: 174937 - DNA, 22 bp, Homo sapiens
ctcagggacagagacacctgca

SEQ ID NO: 174938 - DNA, 16 bp, Homo sapiens
ctcagggacagagcca

SEQ ID NO: 174939 - DNA, 18 bp, Homo sapiens
ctcagggccccagcacta

SEQ ID NO: 174940 - DNA, 14 bp, Homo sapiens
ctcagggcctggtc

SEQ ID NO: 174941 - DNA, 13 bp, Homo sapiens
ctcagggctcctg

SEQ ID NO: 174942 - DNA, 14 bp, Homo sapiens
ctcagggctcctgg

SEQ ID NO: 174943 - DNA, 15 bp, Homo sapiens
ctcagggctcctggg

SEQ ID NO: 174944 - DNA, 16 bp, Homo sapiens
ctcagggctgacacgt

SEQ ID NO: 174945 - DNA, 17 bp, Homo sapiens
ctcaggtccctgcaggg

SEQ ID NO: 174946 - DNA, 15 bp, Homo sapiens
ctcaggtgttgccaa

SEQ ID NO: 174947 - DNA, 14 bp, Homo sapiens
ctcagtcctcccct

SEQ ID NO: 174948 - DNA, 16 bp, Homo sapiens
ctcagtcctcccctca

SEQ ID NO: 174949 - DNA, 18 bp, Homo sapiens
ctcagtcctcccctcaca

SEQ ID NO: 174950 - DNA, 17 bp, Homo sapiens
ctcagtgtatttgtatt

SEQ ID NO: 174951 - DNA, 21 bp, Homo sapiens
ctcaagagggcactggtggcc

SEQ ID NO: 174952 - DNA, 14 bp, Homo sapiens
ctcaagcagtctac

SEQ ID NO: 174953 - DNA, 18 bp, Homo sapiens
ctcaagccaagcagccaa

SEQ ID NO: 174954 - DNA, 22 bp, Homo sapiens
ctcaagccaagcagccaagctc

SEQ ID NO: 174955 - DNA, 16 bp, Homo sapiens
ctcaaggcgtgaggat

SEQ ID NO: 174956 - DNA, 12 bp, Homo sapiens
ctcacagcctct

SEQ ID NO: 174957 - DNA, 13 bp, Homo sapiens
ctcacagcctctg

SEQ ID NO: 174958 - DNA, 14 bp, Homo sapiens
ctcacagcctctga

SEQ ID NO: 174959 - DNA, 22 bp, Homo sapiens
ctcacagcctctgacccctcct

SEQ ID NO: 174960 - DNA, 13 bp, Homo sapiens
ctcacagttcctc

SEQ ID NO: 174961 - DNA, 17 bp, Homo sapiens
ctcacagttcctcgccc

SEQ ID NO: 174962 - DNA, 19 bp, Homo sapiens
ctcacagttcctcgccctg

SEQ ID NO: 174963 - DNA, 16 bp, Homo sapiens
ctcctggcccactgca

SEQ ID NO: 174964 - DNA, 19 bp, Homo sapiens
ctcctggcccactgcatcg

SEQ ID NO: 174965 - DNA, 17 bp, Homo sapiens
ctcctgggccctctctg

SEQ ID NO: 174966 - DNA, 19 bp, Homo sapiens
ctcctgggccctctctgct

SEQ ID NO: 174967 - DNA, 13 bp, Homo sapiens
ctcctgtcctccc

SEQ ID NO: 174968 - DNA, 15 bp, Homo sapiens
ctcctgtcctcccat

SEQ ID NO: 174969 - DNA, 19 bp, Homo sapiens
ctcctgtctgccagccagc

SEQ ID NO: 174970 - DNA, 23 bp, Homo sapiens
ctcctgtctgccagccagcagcc

SEQ ID NO: 174971 - DNA, 18 bp, Homo sapiens
ctcctgtgtagctgggat

SEQ ID NO: 174972 - DNA, 14 bp, Homo sapiens
ctccttccaacagg

SEQ ID NO: 174973 - DNA, 18 bp, Homo sapiens
ctccttccaacaggagct

SEQ ID NO: 174974 - DNA, 22 bp, Homo sapiens
ctccttcccaaaggactccacc

SEQ ID NO: 174975 - DNA, 16 bp, Homo sapiens
ctccttcctgccacct

SEQ ID NO: 174976 - DNA, 14 bp, Homo sapiens
ctccttcctggaga

SEQ ID NO: 174977 - DNA, 12 bp, Homo sapiens
ctccttcctgtc

SEQ ID NO: 174978 - DNA, 13 bp, Homo sapiens
ctccttcctgtct

SEQ ID NO: 174979 - DNA, 16 bp, Homo sapiens
ctccttcctgtcttcc

SEQ ID NO: 174980 - DNA, 17 bp, Homo sapiens
ctccttcctgtcttcct

SEQ ID NO: 174981 - DNA, 14 bp, Homo sapiens
ctccttccttgacc

SEQ ID NO: 174982 - DNA, 18 bp, Homo sapiens
ctccttccttgaccagca

SEQ ID NO: 174983 - DNA, 13 bp, Homo sapiens
ctccttctccctt

SEQ ID NO: 174984 - DNA, 13 bp, Homo sapiens
ctccttgggaggc

SEQ ID NO: 174985 - DNA, 16 bp, Homo sapiens
ctccttgggaggcccc

SEQ ID NO: 174986 - DNA, 17 bp, Homo sapiens
ctccttgggaggcccca

SEQ ID NO: 174987 - DNA, 22 bp, Homo sapiens
ctccttgggaggccccactggg

SEQ ID NO: 174988 - DNA, 12 bp, Homo sapiens
ctccttgggccc

SEQ ID NO: 174989 - DNA, 13 bp, Homo sapiens
ctccttgggccct

SEQ ID NO: 174990 - DNA, 20 bp, Homo sapiens
ctcctttcacaaccttctgt

SEQ ID NO: 174991 - DNA, 22 bp, Homo sapiens
ctcgaacatggaactcattcct

SEQ ID NO: 174992 - DNA, 13 bp, Homo sapiens
ctcgaagcgcgcc

SEQ ID NO: 174993 - DNA, 20 bp, Homo sapiens
ctcgattttgtatctgcagg

SEQ ID NO: 174994 - DNA, 14 bp, Homo sapiens
ctcgcaagctgggt

SEQ ID NO: 174995 - DNA, 12 bp, Homo sapiens
ctcgccctgggt

SEQ ID NO: 174996 - DNA, 13 bp, Homo sapiens
ctcgccctgggtc

SEQ ID NO: 174997 - DNA, 15 bp, Homo sapiens
ctcgccctgggtcta

SEQ ID NO: 174998 - DNA, 16 bp, Homo sapiens
ctcgccgtctgtgaat

SEQ ID NO: 174999 - DNA, 19 bp, Homo sapiens
ctcgctggactctcagtct

SEQ ID NO: 175000 - DNA, 18 bp, Homo sapiens
ctcgcttcccccatagcc

SEQ ID NO: 175001 - DNA, 13 bp, Homo sapiens
ctcggagaagagc

SEQ ID NO: 175002 - DNA, 20 bp, Homo sapiens
ctcggagaagagctgttcac

SEQ ID NO: 175003 - DNA, 12 bp, Homo sapiens
ctcggagcctca

SEQ ID NO: 175004 - DNA, 23 bp, Homo sapiens
ctcggagcctcatccgaggcagg

SEQ ID NO: 175005 - DNA, 21 bp, Homo sapiens
ctcggagtatctgggaactgt

SEQ ID NO: 175006 - DNA, 16 bp, Homo sapiens
ctcggccccctccatc

SEQ ID NO: 175007 - DNA, 17 bp, Homo sapiens
ctcggcttttctcagct

SEQ ID NO: 175008 - DNA, 22 bp, Homo sapiens
ctcgggcgagtcactgcctctc

SEQ ID NO: 175009 - DNA, 21 bp, Homo sapiens
ctcgggtggctagtcagagag

SEQ ID NO: 175010 - DNA, 11 bp, Homo sapiens
ctcggtgcctt

SEQ ID NO: 175011 - DNA, 18 bp, Homo sapiens
ctcggtggacccagggat

SEQ ID NO: 175012 - DNA, 12 bp, Homo sapiens
ctcgtcctcccc

SEQ ID NO: 175013 - DNA, 22 bp, Homo sapiens
ctcgtcctccccctgccagtgc

SEQ ID NO: 175014 - DNA, 23 bp, Homo sapiens
ctcgttgactggctgtgtgttgg

SEQ ID NO: 175015 - DNA, 22 bp, Homo sapiens
ctctacagagcttccctgactc

SEQ ID NO: 175016 - DNA, 18 bp, Homo sapiens
ctctaccagactgtgtat

SEQ ID NO: 175017 - DNA, 18 bp, Homo sapiens
ctctacccagggcctgca

SEQ ID NO: 175018 - DNA, 22 bp, Homo sapiens
ctctactaaaaatacaaaaatt

SEQ ID NO: 175019 - DNA, 22 bp, Homo sapiens
ctctcacatgtttagagttgca

SEQ ID NO: 175020 - DNA, 17 bp, Homo sapiens
ctctcagaattcttcag

SEQ ID NO: 175021 - DNA, 14 bp, Homo sapiens
ctctcaggatcaag

SEQ ID NO: 175022 - DNA, 15 bp, Homo sapiens
ctctcagtctctgag

SEQ ID NO: 175023 - DNA, 11 bp, Homo sapiens
ctctcattccc

SEQ ID NO: 175024 - DNA, 16 bp, Homo sapiens
ctctcattccccaggt

SEQ ID NO: 175025 - DNA, 21 bp, Homo sapiens
ctctcattccccaggtggctg

SEQ ID NO: 175026 - DNA, 16 bp, Homo sapiens
ctctccaacctggaca

SEQ ID NO: 175027 - DNA, 17 bp, Homo sapiens
ctctccacctcagcctt

SEQ ID NO: 175028 - DNA, 12 bp, Homo sapiens
ctctcccaggac

SEQ ID NO: 175029 - DNA, 15 bp, Homo sapiens
ctctcccctgccctg

SEQ ID NO: 175030 - DNA, 22 bp, Homo sapiens
ctctccctctggccctgccttc

SEQ ID NO: 175031 - DNA, 12 bp, Homo sapiens
ctctccctggcc

SEQ ID NO: 175032 - DNA, 12 bp, Homo sapiens
ctctccctgttg

SEQ ID NO: 175033 - DNA, 15 bp, Homo sapiens
ctctcctcctgccca

SEQ ID NO: 175034 - DNA, 19 bp, Homo sapiens
ctctcctcctgcccacctg

SEQ ID NO: 175035 - DNA, 20 bp, Homo sapiens
ctctcctcggccccctccat

SEQ ID NO: 175036 - DNA, 16 bp, Homo sapiens
ctctcctcttgccact

SEQ ID NO: 175037 - DNA, 19 bp, Homo sapiens
ctctcggagtatctgggaa

SEQ ID NO: 175038 - DNA, 20 bp, Homo sapiens
ctctcggagtatctgggaac

SEQ ID NO: 175039 - DNA, 14 bp, Homo sapiens
ctctctcctcctgc

SEQ ID NO: 175040 - DNA, 15 bp, Homo sapiens
ctctctcctgtccaa

SEQ ID NO: 175041 - DNA, 14 bp, Homo sapiens
ctctctgactctca

SEQ ID NO: 175042 - DNA, 19 bp, Homo sapiens
ctctctgcagccagcccag

SEQ ID NO: 175043 - DNA, 22 bp, Homo sapiens
ctctctgctctgcgtgtcacct

SEQ ID NO: 175044 - DNA, 15 bp, Homo sapiens
ctctctttgggaatg

SEQ ID NO: 175045 - DNA, 12 bp, Homo sapiens
ctctgaaaccag

SEQ ID NO: 175046 - DNA, 17 bp, Homo sapiens
ctctgaaaccagtgtta

SEQ ID NO: 175047 - DNA, 14 bp, Homo sapiens
ctctgacccctcct

SEQ ID NO: 175048 - DNA, 16 bp, Homo sapiens
ctctgacccctcctca

SEQ ID NO: 175049 - DNA, 18 bp, Homo sapiens
ctctgacccctcctcact

SEQ ID NO: 175050 - DNA, 17 bp, Homo sapiens
ctctgactcagggctcc

SEQ ID NO: 175051 - DNA, 13 bp, Homo sapiens
ctctgagcagtga

SEQ ID NO: 175052 - DNA, 16 bp, Homo sapiens
ctctgagctgtgcagg

SEQ ID NO: 175053 - DNA, 17 bp, Homo sapiens
ctctgagtatctcctcg

SEQ ID NO: 175054 - DNA, 22 bp, Homo sapiens
ctctgatccctctacagagctt

SEQ ID NO: 175055 - DNA, 17 bp, Homo sapiens
ctctgcaatgggcactg

SEQ ID NO: 175056 - DNA, 18 bp, Homo sapiens
ctctgcaatgggcactgg

SEQ ID NO: 175057 - DNA, 15 bp, Homo sapiens
ctctgcacaagctgc

SEQ ID NO: 175058 - DNA, 18 bp, Homo sapiens
ctctgcacaagctgcacc

SEQ ID NO: 175059 - DNA, 19 bp, Homo sapiens
ctctgcacaagctgcaccc

SEQ ID NO: 175060 - DNA, 18 bp, Homo sapiens
ctctgcactactgacatg

SEQ ID NO: 175061 - DNA, 13 bp, Homo sapiens
ctctgcagccagc

SEQ ID NO: 175062 - DNA, 14 bp, Homo sapiens
ctctgcagccagcc

SEQ ID NO: 175063 - DNA, 15 bp, Homo sapiens
ctctgcagccagccc

SEQ ID NO: 175064 - DNA, 18 bp, Homo sapiens
ctctgcagccagcccagc

SEQ ID NO: 175065 - DNA, 14 bp, Homo sapiens
ctctgccaaaggat

SEQ ID NO: 175066 - DNA, 21 bp, Homo sapiens
ctctgccaaaggatgtgatat

SEQ ID NO: 175067 - DNA, 12 bp, Homo sapiens
ctctgccacctc

SEQ ID NO: 175068 - DNA, 13 bp, Homo sapiens
ctctgccacctcc

SEQ ID NO: 175069 - DNA, 14 bp, Homo sapiens
ctctgccacctccc

SEQ ID NO: 175070 - DNA, 15 bp, Homo sapiens
ctctgccagtgacag

SEQ ID NO: 175071 - DNA, 23 bp, Homo sapiens
ctctgccctgccctagctccaca

SEQ ID NO: 175072 - DNA, 14 bp, Homo sapiens
ctctgcctcctctt

SEQ ID NO: 175073 - DNA, 16 bp, Homo sapiens
ctctgcctgcattctg

SEQ ID NO: 175074 - DNA, 19 bp, Homo sapiens
ctctgcggaccccagctgt

SEQ ID NO: 175075 - DNA, 22 bp, Homo sapiens
ctctgcgtgtcacctgtgcttc

SEQ ID NO: 175076 - DNA, 18 bp, Homo sapiens
ctctgctggcccagccaa

SEQ ID NO: 175077 - DNA, 21 bp, Homo sapiens
ctctggaagagaggaatgcct

SEQ ID NO: 175078 - DNA, 16 bp, Homo sapiens
ctctggagacagcccc

SEQ ID NO: 175079 - DNA, 17 bp, Homo sapiens
ctctggagacagcccca

SEQ ID NO: 175080 - DNA, 18 bp, Homo sapiens
ctctggagacagccccag

SEQ ID NO: 175081 - DNA, 19 bp, Homo sapiens
ctctggagacagccccaga

SEQ ID NO: 175082 - DNA, 20 bp, Homo sapiens
ctctggagacagccccagag

SEQ ID NO: 175083 - DNA, 14 bp, Homo sapiens
ctctggccccaagg

SEQ ID NO: 175084 - DNA, 13 bp, Homo sapiens
ctctggccctgcc

SEQ ID NO: 175085 - DNA, 18 bp, Homo sapiens
ctctggcctcagccgact

SEQ ID NO: 175086 - DNA, 14 bp, Homo sapiens
ctctggcgtgtggg

SEQ ID NO: 175087 - DNA, 16 bp, Homo sapiens
ctctggctctcatggg

SEQ ID NO: 175088 - DNA, 23 bp, Homo sapiens
ctctggctggctaactggaagca

SEQ ID NO: 175089 - DNA, 20 bp, Homo sapiens
ctctgtccagggccctgagc

SEQ ID NO: 175090 - DNA, 15 bp, Homo sapiens
ctctgtctcatccat

SEQ ID NO: 175091 - DNA, 15 bp, Homo sapiens
ctctgtgaccaatgt

SEQ ID NO: 175092 - DNA, 16 bp, Homo sapiens
ctctgtgacctcaggc

SEQ ID NO: 175093 - DNA, 19 bp, Homo sapiens
ctctgtgacctcaggcact

SEQ ID NO: 175094 - DNA, 24 bp, Homo sapiens
ctctgtgacctcaggcactagcct

SEQ ID NO: 175095 - DNA, 16 bp, Homo sapiens
ctctgtgtccttccct

SEQ ID NO: 175096 - DNA, 16 bp, Homo sapiens
ctcttaaaaaataaaa

SEQ ID NO: 175097 - DNA, 14 bp, Homo sapiens
ctcttactgcaaat

SEQ ID NO: 175098 - DNA, 23 bp, Homo sapiens
ctcttactttcctttccccagcc

SEQ ID NO: 175099 - DNA, 18 bp, Homo sapiens
ctcttagacttctgcttt

SEQ ID NO: 175100 - DNA, 18 bp, Homo sapiens
ctcttagcagcttccaga

SEQ ID NO: 175101 - DNA, 18 bp, Homo sapiens
ctcttcaccccccactca

SEQ ID NO: 175102 - DNA, 16 bp, Homo sapiens
ctcttccatcatgtcc

SEQ ID NO: 175103 - DNA, 18 bp, Homo sapiens
ctcttccttgctgtgtca

SEQ ID NO: 175104 - DNA, 12 bp, Homo sapiens
ctcttctccact

SEQ ID NO: 175105 - DNA, 13 bp, Homo sapiens
ctcttctccactg

SEQ ID NO: 175106 - DNA, 20 bp, Homo sapiens
ctgagcgacagtgagactct

SEQ ID NO: 175107 - DNA, 18 bp, Homo sapiens
ctgagctcggtggaccca

SEQ ID NO: 175108 - DNA, 22 bp, Homo sapiens
ctgagctcggtggacccaggga

SEQ ID NO: 175109 - DNA, 13 bp, Homo sapiens
ctgagctgtgcag

SEQ ID NO: 175110 - DNA, 15 bp, Homo sapiens
ctgagctgtgcaggt

SEQ ID NO: 175111 - DNA, 19 bp, Homo sapiens
ctgaggaaaggccagctgg

SEQ ID NO: 175112 - DNA, 20 bp, Homo sapiens
ctgaggaaaggccagctggc

SEQ ID NO: 175113 - DNA, 22 bp, Homo sapiens
ctgaggaacccttacagtagga

SEQ ID NO: 175114 - DNA, 14 bp, Homo sapiens
ctgaggaccagcca

SEQ ID NO: 175115 - DNA, 11 bp, Homo sapiens
ctgaggagaaa

SEQ ID NO: 175116 - DNA, 15 bp, Homo sapiens
ctgaggcagaagaat

SEQ ID NO: 175117 - DNA, 15 bp, Homo sapiens
ctgaggcagacagca

SEQ ID NO: 175118 - DNA, 15 bp, Homo sapiens
ctgaggcagcagtgt

SEQ ID NO: 175119 - DNA, 17 bp, Homo sapiens
ctgaggcagcagtgtga

SEQ ID NO: 175120 - DNA, 22 bp, Homo sapiens
ctgaggcagcagtgtgaggcca

SEQ ID NO: 175121 - DNA, 16 bp, Homo sapiens
ctgaggcagggaagtc

SEQ ID NO: 175122 - DNA, 15 bp, Homo sapiens
ctgaggcctggactt

SEQ ID NO: 175123 - DNA, 19 bp, Homo sapiens
ctgaggcctggactttcct

SEQ ID NO: 175124 - DNA, 20 bp, Homo sapiens
ctgaggcctggactttcctg

SEQ ID NO: 175125 - DNA, 13 bp, Homo sapiens
ctgagggaccagc

SEQ ID NO: 175126 - DNA, 18 bp, Homo sapiens
ctgagggtccccacctgg

SEQ ID NO: 175127 - DNA, 20 bp, Homo sapiens
ctgagggtccccacctggga

SEQ ID NO: 175128 - DNA, 12 bp, Homo sapiens
ctgaggtgggag

SEQ ID NO: 175129 - DNA, 18 bp, Homo sapiens
ctcttgagcagtggctgg

SEQ ID NO: 175130 - DNA, 13 bp, Homo sapiens
ctcttgagcctgg

SEQ ID NO: 175131 - DNA, 14 bp, Homo sapiens
ctcttgagcctggg

SEQ ID NO: 175132 - DNA, 15 bp, Homo sapiens
ctcttgagcctggga

SEQ ID NO: 175133 - DNA, 16 bp, Homo sapiens
ctcttgagcctgggag

SEQ ID NO: 175134 - DNA, 13 bp, Homo sapiens
ctcttgattttca

SEQ ID NO: 175135 - DNA, 18 bp, Homo sapiens
ctcttgccactgcctctt

SEQ ID NO: 175136 - DNA, 20 bp, Homo sapiens
ctcttgccactgcctcttcc

SEQ ID NO: 175137 - DNA, 17 bp, Homo sapiens
ctcttgcggtcccttct

SEQ ID NO: 175138 - DNA, 23 bp, Homo sapiens
ctcttgtgctggatggagcccag

SEQ ID NO: 175139 - DNA, 16 bp, Homo sapiens
ctcttgttttcagttt

SEQ ID NO: 175140 - DNA, 12 bp, Homo sapiens
ctctttcaaaac

SEQ ID NO: 175141 - DNA, 12 bp, Homo sapiens
ctctttctctgc

SEQ ID NO: 175142 - DNA, 18 bp, Homo sapiens
ctctttctctgccagtga

SEQ ID NO: 175143 - DNA, 19 bp, Homo sapiens
ctctttctgtcccttctgt

SEQ ID NO: 175144 - DNA, 14 bp, Homo sapiens
ctctttgaatgaca

SEQ ID NO: 175145 - DNA, 15 bp, Homo sapiens
ctctttgggaatgtt

SEQ ID NO: 175146 - DNA, 14 bp, Homo sapiens
ctcttttctctgtg

SEQ ID NO: 175147 - DNA, 11 bp, Homo sapiens
ctctttttaag

SEQ ID NO: 175148 - DNA, 20 bp, Homo sapiens
ctctttttagggccaggcag

SEQ ID NO: 175149 - DNA, 22 bp, Homo sapiens
ctctttttagggccaggcaggt

SEQ ID NO: 175150 - DNA, 17 bp, Homo sapiens
ctgaaaacactgtgcac

SEQ ID NO: 175151 - DNA, 16 bp, Homo sapiens
ctgaaaatctaatatt

SEQ ID NO: 175152 - DNA, 14 bp, Homo sapiens
ctgaaacaggagag

SEQ ID NO: 175153 - DNA, 16 bp, Homo sapiens
ctgaaaccctggacca

SEQ ID NO: 175154 - DNA, 13 bp, Homo sapiens
ctgaaacttccct

SEQ ID NO: 175155 - DNA, 14 bp, Homo sapiens
ctgaaagaggctga

SEQ ID NO: 175156 - DNA, 23 bp, Homo sapiens
ctgaaagccctgagctttctgct

SEQ ID NO: 175157 - DNA, 19 bp, Homo sapiens
ctgaaatctcagaattcct

SEQ ID NO: 175158 - DNA, 17 bp, Homo sapiens
ctgaagatgatcatttg

SEQ ID NO: 175159 - DNA, 22 bp, Homo sapiens
ctgaagatgcagcaaaatgtga

SEQ ID NO: 175160 - DNA, 14 bp, Homo sapiens
ctgaagcagatgca

SEQ ID NO: 175161 - DNA, 12 bp, Homo sapiens
ctgaaggagaag

SEQ ID NO: 175162 - DNA, 13 bp, Homo sapiens
ctgaaggagcccc

SEQ ID NO: 175163 - DNA, 15 bp, Homo sapiens
ctgaagtcactgcac

SEQ ID NO: 175164 - DNA, 16 bp, Homo sapiens
ctgaagtcactgcaca

SEQ ID NO: 175165 - DNA, 22 bp, Homo sapiens
ctgaagtcccagatacttgggg

SEQ ID NO: 175166 - DNA, 11 bp, Homo sapiens
ctgaataataa

SEQ ID NO: 175167 - DNA, 21 bp, Homo sapiens
ctgaatatgaacggtgagcat

SEQ ID NO: 175168 - DNA, 16 bp, Homo sapiens
ctgaattgtccccagt

SEQ ID NO: 175169 - DNA, 14 bp, Homo sapiens
ctgacacccatgtt

SEQ ID NO: 175170 - DNA, 12 bp, Homo sapiens
ctgacagcctcc

SEQ ID NO: 175171 - DNA, 19 bp, Homo sapiens
ctgacatgtggggccaggt

SEQ ID NO: 175172 - DNA, 18 bp, Homo sapiens
ctgacatttggagtgttc

SEQ ID NO: 175173 - DNA, 22 bp, Homo sapiens
ctgaccacgctttctagctgtt

SEQ ID NO: 175174 - DNA, 22 bp, Homo sapiens
ctgaccacggacgtttccatca

SEQ ID NO: 175175 - DNA, 11 bp, Homo sapiens
ctgacccagtc

SEQ ID NO: 175176 - DNA, 15 bp, Homo sapiens
ctgacccagtccctg

SEQ ID NO: 175177 - DNA, 16 bp, Homo sapiens
ctgacccagtccctgg

SEQ ID NO: 175178 - DNA, 17 bp, Homo sapiens
ctgacccagtccctggg

SEQ ID NO: 175179 - DNA, 18 bp, Homo sapiens
ctgacccagtccctgggg

SEQ ID NO: 175180 - DNA, 12 bp, Homo sapiens
ctgacccctcct

SEQ ID NO: 175181 - DNA, 16 bp, Homo sapiens
ctgacccctcctcact

SEQ ID NO: 175182 - DNA, 17 bp, Homo sapiens
ctgacccctcctcactg

SEQ ID NO: 175183 - DNA, 22 bp, Homo sapiens
ctgacccttacagcctctgact

SEQ ID NO: 175184 - DNA, 18 bp, Homo sapiens
ctgaccgaaacagcgctg

SEQ ID NO: 175185 - DNA, 13 bp, Homo sapiens
ctgacctccacag

SEQ ID NO: 175186 - DNA, 15 bp, Homo sapiens
ctgacctccacagct

SEQ ID NO: 175187 - DNA, 16 bp, Homo sapiens
ctgactcagggctcct

SEQ ID NO: 175188 - DNA, 18 bp, Homo sapiens
ctgactcagggctcctgg

SEQ ID NO: 175189 - DNA, 21 bp, Homo sapiens
ctgactctaggtgcccttgga

SEQ ID NO: 175190 - DNA, 17 bp, Homo sapiens
ctgactgtactcctccc

SEQ ID NO: 175191 - DNA, 15 bp, Homo sapiens
ctgactttgctcttt

SEQ ID NO: 175192 - DNA, 16 bp, Homo sapiens
ctgactttgctctttc

SEQ ID NO: 175193 - DNA, 15 bp, Homo sapiens
ctgagaaagactatt

SEQ ID NO: 175194 - DNA, 22 bp, Homo sapiens
ctgagaagagagatcaaatgga

SEQ ID NO: 175195 - DNA, 14 bp, Homo sapiens
ctgagactcagaca

SEQ ID NO: 175196 - DNA, 17 bp, Homo sapiens
ctgagactcagacagga

SEQ ID NO: 175197 - DNA, 20 bp, Homo sapiens
ctgagactcagacaggaaag

SEQ ID NO: 175198 - DNA, 21 bp, Homo sapiens
ctgagactcagacaggaaagg

SEQ ID NO: 175199 - DNA, 15 bp, Homo sapiens
ctgagagacccaagg

SEQ ID NO: 175200 - DNA, 17 bp, Homo sapiens
ctgagagacccaaggag

SEQ ID NO: 175201 - DNA, 13 bp, Homo sapiens
ctgagagactttt

SEQ ID NO: 175202 - DNA, 21 bp, Homo sapiens
ctgagatgtgaacacatcagc

SEQ ID NO: 175203 - DNA, 15 bp, Homo sapiens
ctgagcaaatgtggc

SEQ ID NO: 175204 - DNA, 16 bp, Homo sapiens
ctgagcaggacctctg

SEQ ID NO: 175205 - DNA, 13 bp, Homo sapiens
ctgagcagggaga

SEQ ID NO: 175206 - DNA, 22 bp, Homo sapiens
ctgagccaagctagaattccct

SEQ ID NO: 175207 - DNA, 23 bp, Homo sapiens
ctgagccccgcagacctccccag

SEQ ID NO: 175208 - DNA, 15 bp, Homo sapiens
ctgagccttgtaatt

SEQ ID NO: 175209 - DNA, 13 bp, Homo sapiens
ctgagctcactcg

SEQ ID NO: 175210 - DNA, 20 bp, Homo sapiens
ctgagctccccaccacccca

SEQ ID NO: 175211 - DNA, 17 bp, Homo sapiens
ctgagctcggtggaccc

SEQ ID NO: 175212 - DNA, 20 bp, Homo sapiens
ctgagctcggtggacccagg

SEQ ID NO: 175213 - DNA, 12 bp, Homo sapiens
ctgagctgaggc

SEQ ID NO: 175214 - DNA, 13 bp, Homo sapiens
ctgagctgaggca

SEQ ID NO: 175215 - DNA, 18 bp, Homo sapiens
ctgagctgaggcagcagt

SEQ ID NO: 175216 - DNA, 15 bp, Homo sapiens
ctgagctttctgcta

SEQ ID NO: 175217 - DNA, 15 bp, Homo sapiens
ctgaggaaaggccag

SEQ ID NO: 175218 - DNA, 16 bp, Homo sapiens
ctgaggaaaggccagc

SEQ ID NO: 175219 - DNA, 18 bp, Homo sapiens
ctgaggaaaggccagctg

SEQ ID NO: 175220 - DNA, 22 bp, Homo sapiens
ctgaggacttaaaatattcctg

SEQ ID NO: 175221 - DNA, 12 bp, Homo sapiens
ctgaggcaagag

SEQ ID NO: 175222 - DNA, 16 bp, Homo sapiens
ctgaggcagacagcag

SEQ ID NO: 175223 - DNA, 18 bp, Homo sapiens
ctgaggcagacagcagct

SEQ ID NO: 175224 - DNA, 22 bp, Homo sapiens
ctgaggcagacagcagctcagg

SEQ ID NO: 175225 - DNA, 21 bp, Homo sapiens
ctgaggcagggaagtccccag

SEQ ID NO: 175226 - DNA, 22 bp, Homo sapiens
ctgaggcagggaagtccccagg

SEQ ID NO: 175227 - DNA, 23 bp, Homo sapiens
ctgaggctctgacccagtgagat

SEQ ID NO: 175228 - DNA, 18 bp, Homo sapiens
ctgagggaccagccaaga

SEQ ID NO: 175229 - DNA, 17 bp, Homo sapiens
ctgagggagcctggccc

SEQ ID NO: 175230 - DNA, 15 bp, Homo sapiens
ctgagggatctttac

SEQ ID NO: 175231 - DNA, 16 bp, Homo sapiens
ctgagggcagtcgata

SEQ ID NO: 175232 - DNA, 21 bp, Homo sapiens
ctgagtatctcctcgcaagct

SEQ ID NO: 175233 - DNA, 18 bp, Homo sapiens
ctgagtcatgatctccct

SEQ ID NO: 175234 - DNA, 18 bp, Homo sapiens
ctgagtttcattctcctg

SEQ ID NO: 175235 - DNA, 15 bp, Homo sapiens
ctgatagctctttgg

SEQ ID NO: 175236 - DNA, 14 bp, Homo sapiens
ctgatcagagccgt

SEQ ID NO: 175237 - DNA, 20 bp, Homo sapiens
ctgatcagagccgtggtcct

SEQ ID NO: 175238 - DNA, 12 bp, Homo sapiens
ctgatccctcta

SEQ ID NO: 175239 - DNA, 16 bp, Homo sapiens
ctgattacacaaaaca

SEQ ID NO: 175240 - DNA, 13 bp, Homo sapiens
ctgatttcacaac

SEQ ID NO: 175241 - DNA, 14 bp, Homo sapiens
ctgcaaaatgagac

SEQ ID NO: 175242 - DNA, 23 bp, Homo sapiens
ctgcaaaatttgatgccaggaca

SEQ ID NO: 175243 - DNA, 13 bp, Homo sapiens
ctgcaaacgctgc

SEQ ID NO: 175244 - DNA, 17 bp, Homo sapiens
ctgcaaacgctgcctgc

SEQ ID NO: 175245 - DNA, 15 bp, Homo sapiens
ctgcaactcaaggac

SEQ ID NO: 175246 - DNA, 18 bp, Homo sapiens
ctgcaacttgtaaatgtg

SEQ ID NO: 175247 - DNA, 18 bp, Homo sapiens
ctgcaagaattgaagcag

SEQ ID NO: 175248 - DNA, 17 bp, Homo sapiens
ctgcaagagccttggtg

SEQ ID NO: 175249 - DNA, 23 bp, Homo sapiens
ctgggtggcctcgggacacctgc

SEQ ID NO: 175250 - DNA, 17 bp, Homo sapiens
ctgggtggggctgctcc

SEQ ID NO: 175251 - DNA, 22 bp, Homo sapiens
ctgggtggggctgctcctccag

SEQ ID NO: 175252 - DNA, 22 bp, Homo sapiens
ctgggttttgtattctctgagc

SEQ ID NO: 175253 - DNA, 19 bp, Homo sapiens
ctggtaatattgacttgta

SEQ ID NO: 175254 - DNA, 20 bp, Homo sapiens
ctggtcacaggactctgcct

SEQ ID NO: 175255 - DNA, 16 bp, Homo sapiens
ctggtgacaccagcct

SEQ ID NO: 175256 - DNA, 12 bp, Homo sapiens
ctggtgcctcac

SEQ ID NO: 175257 - DNA, 20 bp, Homo sapiens
ctggtgctgccacacttcag

SEQ ID NO: 175258 - DNA, 22 bp, Homo sapiens
ctggtgctgccacacttcaggc

SEQ ID NO: 175259 - DNA, 14 bp, Homo sapiens
ctggtgctgcctct

SEQ ID NO: 175260 - DNA, 19 bp, Homo sapiens
ctggtgctgcctctacctg

SEQ ID NO: 175261 - DNA, 20 bp, Homo sapiens
ctggtggcccgacagcctgg

SEQ ID NO: 175262 - DNA, 22 bp, Homo sapiens
ctggtggcccgacagcctggca

SEQ ID NO: 175263 - DNA, 22 bp, Homo sapiens
ctggtgggaggggcgcccacct

SEQ ID NO: 175264 - DNA, 17 bp, Homo sapiens
ctggtgggcctcctctg

SEQ ID NO: 175265 - DNA, 16 bp, Homo sapiens
ctgtaacactttacaa

SEQ ID NO: 175266 - DNA, 20 bp, Homo sapiens
ctgtaacctcttcagaggcc

SEQ ID NO: 175267 - DNA, 23 bp, Homo sapiens
ctgtaatcacagctacttgggag

SEQ ID NO: 175268 - DNA, 14 bp, Homo sapiens
ctgtaatcccagca

SEQ ID NO: 175269 - DNA, 20 bp, Homo sapiens
ctgtaatcctagcactttgg

SEQ ID NO: 175270 - DNA, 15 bp, Homo sapiens
ctgtactcctcccag

SEQ ID NO: 175271 - DNA, 17 bp, Homo sapiens
ctgtacttgatgacaga

SEQ ID NO: 175272 - DNA, 21 bp, Homo sapiens
ctgtagcagtgagaaaaagct

SEQ ID NO: 175273 - DNA, 21 bp, Homo sapiens
ctgtagtagccctttctgtgt

SEQ ID NO: 175274 - DNA, 12 bp, Homo sapiens
ctgtagtcccag

SEQ ID NO: 175275 - DNA, 20 bp, Homo sapiens
ctgtagtctcaggacctagg

SEQ ID NO: 175276 - DNA, 18 bp, Homo sapiens
ctgtagttaggaaataaa

SEQ ID NO: 175277 - DNA, 22 bp, Homo sapiens
ctgtagttaggaaataaaacct

SEQ ID NO: 175278 - DNA, 14 bp, Homo sapiens
ctgtataagtaaga

SEQ ID NO: 175279 - DNA, 15 bp, Homo sapiens
ctgtataagtaagaa

SEQ ID NO: 175280 - DNA, 16 bp, Homo sapiens
ctgtataagtaagaaa

SEQ ID NO: 175281 - DNA, 18 bp, Homo sapiens
ctgtataagtaagaaaat

SEQ ID NO: 175282 - DNA, 15 bp, Homo sapiens
ctgtatatacaataa

SEQ ID NO: 175283 - DNA, 23 bp, Homo sapiens
ctgtatcaggacccagaggaagg

SEQ ID NO: 175284 - DNA, 20 bp, Homo sapiens
ctgtattttgtttttgtctt

SEQ ID NO: 175285 - DNA, 17 bp, Homo sapiens
ctgtcaaacaaagccag

SEQ ID NO: 175286 - DNA, 18 bp, Homo sapiens
ctgtcaaacaaagccaga

SEQ ID NO: 175287 - DNA, 23 bp, Homo sapiens
ctgtcaccaagctcacagttcct

SEQ ID NO: 175288 - DNA, 16 bp, Homo sapiens
ctgtcaccctccacct

SEQ ID NO: 175289 - DNA, 14 bp, Homo sapiens
ctgtcactgtttct

SEQ ID NO: 175290 - DNA, 23 bp, Homo sapiens
ctgtcagctcccctcggagaaga

SEQ ID NO: 175291 - DNA, 19 bp, Homo sapiens
ctgtcataagaatgaataa

SEQ ID NO: 175292 - DNA, 19 bp, Homo sapiens
ctgtccaggcactgagata

SEQ ID NO: 175293 - DNA, 19 bp, Homo sapiens
ctgtccagggccctgagct

SEQ ID NO: 175294 - DNA, 15 bp, Homo sapiens
ctgtccctcccacct

SEQ ID NO: 175295 - DNA, 19 bp, Homo sapiens
ctgtccctcccacctctgt

SEQ ID NO: 175296 - DNA, 12 bp, Homo sapiens
ctgtccctccgg

SEQ ID NO: 175297 - DNA, 17 bp, Homo sapiens
ctgtccctgtcaccaag

SEQ ID NO: 175298 - DNA, 14 bp, Homo sapiens
ctgtccgagctttg

SEQ ID NO: 175299 - DNA, 15 bp, Homo sapiens
ctgtccgagctttga

SEQ ID NO: 175300 - DNA, 14 bp, Homo sapiens
ctgtcctcactgct

SEQ ID NO: 175301 - DNA, 16 bp, Homo sapiens
ctgtcctcactgctcc

SEQ ID NO: 175302 - DNA, 21 bp, Homo sapiens
ctgtcctcactgctccctgaa

SEQ ID NO: 175303 - DNA, 15 bp, Homo sapiens
ctgtcctcagcttct

SEQ ID NO: 175304 - DNA, 16 bp, Homo sapiens
ctgtcctcccatcccc

SEQ ID NO: 175305 - DNA, 19 bp, Homo sapiens
ctgtcctcccatcccctgg

SEQ ID NO: 175306 - DNA, 12 bp, Homo sapiens
ctgtcctcctcg

SEQ ID NO: 175307 - DNA, 23 bp, Homo sapiens
ctgtcctcctcggatcaccgaga

SEQ ID NO: 175308 - DNA, 14 bp, Homo sapiens
ctgtcctgtacatt

SEQ ID NO: 175309 - DNA, 22 bp, Homo sapiens
ctgtcctgtacattgtgggatg

SEQ ID NO: 175310 - DNA, 15 bp, Homo sapiens
ctgtccttctctcac

SEQ ID NO: 175311 - DNA, 15 bp, Homo sapiens
ctgtctaacctgtga

SEQ ID NO: 175312 - DNA, 23 bp, Homo sapiens
ctgtctcaagagggcactggtgg

SEQ ID NO: 175313 - DNA, 16 bp, Homo sapiens
ctgtctcagcctccca

SEQ ID NO: 175314 - DNA, 16 bp, Homo sapiens
ctgtctcatccatcat

SEQ ID NO: 175315 - DNA, 20 bp, Homo sapiens
ctgtctcatccatcatcatg

SEQ ID NO: 175316 - DNA, 23 bp, Homo sapiens
ctgtctcctttcaccccagggcc

SEQ ID NO: 175317 - DNA, 15 bp, Homo sapiens
ctgtctcttccatat

SEQ ID NO: 175318 - DNA, 15 bp, Homo sapiens
ctgtctgccagccag

SEQ ID NO: 175319 - DNA, 16 bp, Homo sapiens
ctgtctgccagccagc

SEQ ID NO: 175320 - DNA, 17 bp, Homo sapiens
ctgtctgccagccagca

SEQ ID NO: 175321 - DNA, 16 bp, Homo sapiens
ctgtctggttttaaca

SEQ ID NO: 175322 - DNA, 17 bp, Homo sapiens
ctgtctggttttaacaa

SEQ ID NO: 175323 - DNA, 18 bp, Homo sapiens
ctgtctggttttaacaat

SEQ ID NO: 175324 - DNA, 18 bp, Homo sapiens
ctgtcttcagtaagccgt

SEQ ID NO: 175325 - DNA, 14 bp, Homo sapiens
ctgtcttcctgcat

SEQ ID NO: 175326 - DNA, 18 bp, Homo sapiens
ctgtcttcctgcattcac

SEQ ID NO: 175327 - DNA, 16 bp, Homo sapiens
ctgtgaacgatttaga

SEQ ID NO: 175328 - DNA, 16 bp, Homo sapiens
ctgtgaccaatgtctt

SEQ ID NO: 175329 - DNA, 14 bp, Homo sapiens
ctgtgacctcaggc

SEQ ID NO: 175330 - DNA, 17 bp, Homo sapiens
ctgtgacctcaggcact

SEQ ID NO: 175331 - DNA, 15 bp, Homo sapiens
ctgtgagccttggct

SEQ ID NO: 175332 - DNA, 14 bp, Homo sapiens
ctgtgaggcagggg

SEQ ID NO: 175333 - DNA, 18 bp, Homo sapiens
ctgtgaggcaggggcgga

SEQ ID NO: 175334 - DNA, 18 bp, Homo sapiens
ctgtgaggcccctggaca

SEQ ID NO: 175335 - DNA, 23 bp, Homo sapiens
ctgtgaggtgcagagtgcccaga

SEQ ID NO: 175336 - DNA, 16 bp, Homo sapiens
ctgtgcaaatccttga

SEQ ID NO: 175337 - DNA, 13 bp, Homo sapiens
ctgtgcctcggct

SEQ ID NO: 175338 - DNA, 11 bp, Homo sapiens
ctgtgcctctg

SEQ ID NO: 175339 - DNA, 14 bp, Homo sapiens
ctgtgcctctggga

SEQ ID NO: 175340 - DNA, 16 bp, Homo sapiens
ctgtgcctctgggact

SEQ ID NO: 175341 - DNA, 17 bp, Homo sapiens
ctgtgcctctgggactg

SEQ ID NO: 175342 - DNA, 18 bp, Homo sapiens
ctgtgcctctgggactgg

SEQ ID NO: 175343 - DNA, 12 bp, Homo sapiens
ctgtgctcagga

SEQ ID NO: 175344 - DNA, 22 bp, Homo sapiens
ctgtgctgcccgtcttcagcct

SEQ ID NO: 175345 - DNA, 18 bp, Homo sapiens
ctgtgctgtgcccaagtt

SEQ ID NO: 175346 - DNA, 22 bp, Homo sapiens
ctgtggaggtacactcttatag

SEQ ID NO: 175347 - DNA, 15 bp, Homo sapiens
ctgtggcggtgcctg

SEQ ID NO: 175348 - DNA, 18 bp, Homo sapiens
ctgtggcggtgcctgggt

SEQ ID NO: 175349 - DNA, 14 bp, Homo sapiens
ctgtggtgtgtccc

SEQ ID NO: 175350 - DNA, 16 bp, Homo sapiens
ctgtgtattcattgaa

SEQ ID NO: 175351 - DNA, 14 bp, Homo sapiens
ctgtgtcactacgt

SEQ ID NO: 175352 - DNA, 15 bp, Homo sapiens
ctgtgtccttccctg

SEQ ID NO: 175353 - DNA, 16 bp, Homo sapiens
ctgtgtccttccctgc

SEQ ID NO: 175354 - DNA, 14 bp, Homo sapiens
ctgtgtccttgcac

SEQ ID NO: 175355 - DNA, 11 bp, Homo sapiens
ctgtgtctaaa

SEQ ID NO: 175356 - DNA, 16 bp, Homo sapiens
ctgtgtgatgaacttt

SEQ ID NO: 175357 - DNA, 19 bp, Homo sapiens
ctgtgtgatgaactttctc

SEQ ID NO: 175358 - DNA, 18 bp, Homo sapiens
ctgtgtgcaagtgtgtgc

SEQ ID NO: 175359 - DNA, 15 bp, Homo sapiens
ctgtgtgcagtgaag

SEQ ID NO: 175360 - DNA, 16 bp, Homo sapiens
ctgtgtgttttcataa

SEQ ID NO: 175361 - DNA, 16 bp, Homo sapiens
ctgttaaaagatgaaa

SEQ ID NO: 175362 - DNA, 21 bp, Homo sapiens
ctgttaaaagatgaaaatatt

SEQ ID NO: 175363 - DNA, 23 bp, Homo sapiens
ctgttaaaagatgaaaatatttg

SEQ ID NO: 175364 - DNA, 16 bp, Homo sapiens
ctgttaaattgctgtg

SEQ ID NO: 175365 - DNA, 22 bp, Homo sapiens
ctgttaaattgctgtgtatctg

SEQ ID NO: 175366 - DNA, 13 bp, Homo sapiens
ctgttagtcattt

SEQ ID NO: 175367 - DNA, 14 bp, Homo sapiens
ctgttagtcatttg

SEQ ID NO: 175368 - DNA, 15 bp, Homo sapiens
ctgttagtcatttgc

SEQ ID NO: 175369 - DNA, 18 bp, Homo sapiens
ctgttagtcatttgctga

SEQ ID NO: 175370 - DNA, 19 bp, Homo sapiens
ctgttatcaaaactttctt

SEQ ID NO: 175371 - DNA, 19 bp, Homo sapiens
ctgttcacagccagactgg

SEQ ID NO: 175372 - DNA, 18 bp, Homo sapiens
ctgttcacccacagggct

SEQ ID NO: 175373 - DNA, 13 bp, Homo sapiens
ctgttcactctac

SEQ ID NO: 175374 - DNA, 19 bp, Homo sapiens
ctgttcagctggttgaggt

SEQ ID NO: 175375 - DNA, 17 bp, Homo sapiens
ctgttccccctgtgcag

SEQ ID NO: 175376 - DNA, 14 bp, Homo sapiens
ctgttggcagtgag

SEQ ID NO: 175377 - DNA, 16 bp, Homo sapiens
ctgtttaatatttaaa

SEQ ID NO: 175378 - DNA, 15 bp, Homo sapiens
ctgtttccttttatg

SEQ ID NO: 175379 - DNA, 20 bp, Homo sapiens
ctgtttgtttgacaaagaaa

SEQ ID NO: 175380 - DNA, 12 bp, Homo sapiens
ctgttttaaatt

SEQ ID NO: 175381 - DNA, 17 bp, Homo sapiens
ctgtttttaagctgttt

SEQ ID NO: 175382 - DNA, 15 bp, Homo sapiens
ctgtttttctgggtg

SEQ ID NO: 175383 - DNA, 17 bp, Homo sapiens
cttaaaaagtggaaaaa

SEQ ID NO: 175384 - DNA, 20 bp, Homo sapiens
cttaaaaatggtttaaatgg

SEQ ID NO: 175385 - DNA, 19 bp, Homo sapiens
cttaaaataacttatatca

SEQ ID NO: 175386 - DNA, 18 bp, Homo sapiens
cttaaaatattcctgcat

SEQ ID NO: 175387 - DNA, 18 bp, Homo sapiens
cttaaagctgcctgtagt

SEQ ID NO: 175388 - DNA, 23 bp, Homo sapiens
cttaaagctgcctgtagttagga

SEQ ID NO: 175389 - DNA, 16 bp, Homo sapiens
cttaaatgagaaggaa

SEQ ID NO: 175390 - DNA, 13 bp, Homo sapiens
cttaacatattta

SEQ ID NO: 175391 - DNA, 23 bp, Homo sapiens
ctgggggttctttcttcctctgc

SEQ ID NO: 175392 - DNA, 18 bp, Homo sapiens
ctggggtcctggggcctc

SEQ ID NO: 175393 - DNA, 19 bp, Homo sapiens
ctggggtgtgggaggcccg

SEQ ID NO: 175394 - DNA, 15 bp, Homo sapiens
ctggggttcagcccc

SEQ ID NO: 175395 - DNA, 20 bp, Homo sapiens
ctggggttcagcccctcctc

SEQ ID NO: 175396 - DNA, 22 bp, Homo sapiens
ctggggttcagcccctcctctg

SEQ ID NO: 175397 - DNA, 18 bp, Homo sapiens
ctgggtccttgcacccct

SEQ ID NO: 175398 - DNA, 22 bp, Homo sapiens
ctgggtctcgctttgttgccca

SEQ ID NO: 175399 - DNA, 18 bp, Homo sapiens
ctgggtggcaccagcagc

SEQ ID NO: 175400 - DNA, 20 bp, Homo sapiens
ctgggtggcaccagcagcct

SEQ ID NO: 175401 - DNA, 21 bp, Homo sapiens
ctgggtggcaccagcagcctg

SEQ ID NO: 175402 - DNA, 16 bp, Homo sapiens
ctgggtggcctcggga

SEQ ID NO: 175403 - DNA, 19 bp, Homo sapiens
ctgggtggcctcgggacac

SEQ ID NO: 175404 - DNA, 18 bp, Homo sapiens
ctgggtggggctgctcct

SEQ ID NO: 175405 - DNA, 21 bp, Homo sapiens
ctgggtggggctgctcctcca

SEQ ID NO: 175406 - DNA, 13 bp, Homo sapiens
ctgggtggtctgc

SEQ ID NO: 175407 - DNA, 13 bp, Homo sapiens
ctgggttggaaaa

SEQ ID NO: 175408 - DNA, 20 bp, Homo sapiens
ctgggttttgtattctctga

SEQ ID NO: 175409 - DNA, 21 bp, Homo sapiens
ctggtcacaggactctgcctc

SEQ ID NO: 175410 - DNA, 22 bp, Homo sapiens
ctggtcacaggactctgcctcc

SEQ ID NO: 175411 - DNA, 14 bp, Homo sapiens
ctggtccagggcta

SEQ ID NO: 175412 - DNA, 19 bp, Homo sapiens
ctggtcctgagggtcccca

SEQ ID NO: 175413 - DNA, 22 bp, Homo sapiens
ctggtctgtagaagagggataa

SEQ ID NO: 175414 - DNA, 17 bp, Homo sapiens
ctggtgacaccagcctt

SEQ ID NO: 175415 - DNA, 12 bp, Homo sapiens
ctggtgctgcca

SEQ ID NO: 175416 - DNA, 21 bp, Homo sapiens
ctggtggcccgacagcctggc

SEQ ID NO: 175417 - DNA, 23 bp, Homo sapiens
ctggtgggaggggcgcccacctc

SEQ ID NO: 175418 - DNA, 23 bp, Homo sapiens
ctggtgggatctgtgcccagaga

SEQ ID NO: 175419 - DNA, 17 bp, Homo sapiens
ctggttccggaatcctg

SEQ ID NO: 175420 - DNA, 20 bp, Homo sapiens
ctggttggtgttgcagaagg

SEQ ID NO: 175421 - DNA, 13 bp, Homo sapiens
ctggttttaacaa

SEQ ID NO: 175422 - DNA, 15 bp, Homo sapiens
ctgtaacacagctga

SEQ ID NO: 175423 - DNA, 22 bp, Homo sapiens
ctgtaacctcttcagaggccct

SEQ ID NO: 175424 - DNA, 19 bp, Homo sapiens
ctgtaatcatataataaat

SEQ ID NO: 175425 - DNA, 13 bp, Homo sapiens
ctgtaatcccagc

SEQ ID NO: 175426 - DNA, 16 bp, Homo sapiens
ctgtaatcccagcact

SEQ ID NO: 175427 - DNA, 15 bp, Homo sapiens
ctgtaatcccagcag

SEQ ID NO: 175428 - DNA, 14 bp, Homo sapiens
ctgtaatcccagct

SEQ ID NO: 175429 - DNA, 19 bp, Homo sapiens
ctgtaatcctagcactttg

SEQ ID NO: 175430 - DNA, 15 bp, Homo sapiens
ctgtacaaatataag

SEQ ID NO: 175431 - DNA, 16 bp, Homo sapiens
ctgtacaaatataaga

SEQ ID NO: 175432 - DNA, 19 bp, Homo sapiens
ctgtacaaatataagaata

SEQ ID NO: 175433 - DNA, 20 bp, Homo sapiens
ctgtacaaatataagaataa

SEQ ID NO: 175434 - DNA, 15 bp, Homo sapiens
ctgtacattgtggga

SEQ ID NO: 175435 - DNA, 16 bp, Homo sapiens
ctgtactcctcccagg

SEQ ID NO: 175436 - DNA, 17 bp, Homo sapiens
ctgtagcattacagtgg

SEQ ID NO: 175437 - DNA, 15 bp, Homo sapiens
ctgtagtcccagcta

SEQ ID NO: 175438 - DNA, 23 bp, Homo sapiens
ctgtagtcccagctactcaggag

SEQ ID NO: 175439 - DNA, 15 bp, Homo sapiens
ctgtagttaggaaat

SEQ ID NO: 175440 - DNA, 21 bp, Homo sapiens
ctgtagttaggaaataaaacc

SEQ ID NO: 175441 - DNA, 13 bp, Homo sapiens
ctgtataagtaag

SEQ ID NO: 175442 - DNA, 17 bp, Homo sapiens
ctgtataagtaagaaaa

SEQ ID NO: 175443 - DNA, 19 bp, Homo sapiens
ctgtataagtaagaaaata

SEQ ID NO: 175444 - DNA, 19 bp, Homo sapiens
ctgtatatacaataacata

SEQ ID NO: 175445 - DNA, 23 bp, Homo sapiens
ctgtatatacaataacataattt

SEQ ID NO: 175446 - DNA, 16 bp, Homo sapiens
ctgtatcaggacccag

SEQ ID NO: 175447 - DNA, 22 bp, Homo sapiens
ctgtatcaggacccagaggaag

SEQ ID NO: 175448 - DNA, 12 bp, Homo sapiens
ctgtatgtcaga

SEQ ID NO: 175449 - DNA, 19 bp, Homo sapiens
ctgtattagtcacagagat

SEQ ID NO: 175450 - DNA, 18 bp, Homo sapiens
ctgtcaccctccacctct

SEQ ID NO: 175451 - DNA, 19 bp, Homo sapiens
ctgtcactgtttctctgct

SEQ ID NO: 175452 - DNA, 21 bp, Homo sapiens
ctgtcagctcccctcggagaa

SEQ ID NO: 175453 - DNA, 16 bp, Homo sapiens
ctgtccaacctaaccc

SEQ ID NO: 175454 - DNA, 11 bp, Homo sapiens
ctgtccagaga

SEQ ID NO: 175455 - DNA, 19 bp, Homo sapiens
ctgtccaggcactgctgcc

SEQ ID NO: 175456 - DNA, 23 bp, Homo sapiens
ctgtccaggcactgctgcccagc

SEQ ID NO: 175457 - DNA, 23 bp, Homo sapiens
ctgtccagggccctgagctcggt

SEQ ID NO: 175458 - DNA, 19 bp, Homo sapiens
ctgtcccatggacactcca

SEQ ID NO: 175459 - DNA, 12 bp, Homo sapiens
ctgtccctcaca

SEQ ID NO: 175460 - DNA, 13 bp, Homo sapiens
ctgtccctcactg

SEQ ID NO: 175461 - DNA, 18 bp, Homo sapiens
ctgtccctcccacctctg

SEQ ID NO: 175462 - DNA, 21 bp, Homo sapiens
ctgtccctcccacctctgtga

SEQ ID NO: 175463 - DNA, 17 bp, Homo sapiens
ctgtccctccgggacct

SEQ ID NO: 175464 - DNA, 21 bp, Homo sapiens
ctgtcccttctcttaatttaa

SEQ ID NO: 175465 - DNA, 13 bp, Homo sapiens
ctgtcccttgcct

SEQ ID NO: 175466 - DNA, 13 bp, Homo sapiens
ctgtcctcactgc

SEQ ID NO: 175467 - DNA, 17 bp, Homo sapiens
ctgtcctcagcttctta

SEQ ID NO: 175468 - DNA, 20 bp, Homo sapiens
gaacctgtccttgcacactc

SEQ ID NO: 175469 - DNA, 23 bp, Homo sapiens
gaacggagccccaggcctctgtg

SEQ ID NO: 175470 - DNA, 14 bp, Homo sapiens
gaacggggagaaaa

SEQ ID NO: 175471 - DNA, 14 bp, Homo sapiens
gaacgtgactgccc

SEQ ID NO: 175472 - DNA, 22 bp, Homo sapiens
gaactacgcttgctcatttttt

SEQ ID NO: 175473 - DNA, 15 bp, Homo sapiens
gaactataaagaagt

SEQ ID NO: 175474 - DNA, 14 bp, Homo sapiens
gaactcattcctgc

SEQ ID NO: 175475 - DNA, 16 bp, Homo sapiens
gaactcattcctgcct

SEQ ID NO: 175476 - DNA, 16 bp, Homo sapiens
gaactcctaaatcaag

SEQ ID NO: 175477 - DNA, 17 bp, Homo sapiens
gaactgaagtttcacat

SEQ ID NO: 175478 - DNA, 15 bp, Homo sapiens
gaacttctaatatat

SEQ ID NO: 175479 - DNA, 23 bp, Homo sapiens
gaactttctcttcatactttttt

SEQ ID NO: 175480 - DNA, 17 bp, Homo sapiens
gaagaattttcagaccc

SEQ ID NO: 175481 - DNA, 22 bp, Homo sapiens
gaagacatggggaggaaggaca

SEQ ID NO: 175482 - DNA, 20 bp, Homo sapiens
gaagaccagctttgcagtga

SEQ ID NO: 175483 - DNA, 22 bp, Homo sapiens
gaagacctgctgagggaccagc

SEQ ID NO: 175484 - DNA, 15 bp, Homo sapiens
gaagacgcctgagct

SEQ ID NO: 175485 - DNA, 11 bp, Homo sapiens
gaagactgtgg

SEQ ID NO: 175486 - DNA, 19 bp, Homo sapiens
gaagagagatcaaatggaa

SEQ ID NO: 175487 - DNA, 14 bp, Homo sapiens
gaagagaggagagg

SEQ ID NO: 175488 - DNA, 12 bp, Homo sapiens
gaagagccttgc

SEQ ID NO: 175489 - DNA, 20 bp, Homo sapiens
gaagagctgttcacagccag

SEQ ID NO: 175490 - DNA, 23 bp, Homo sapiens
gaagagctgttcacagccagact

SEQ ID NO: 175491 - DNA, 15 bp, Homo sapiens
gaagaggaaaatgaa

SEQ ID NO: 175492 - DNA, 15 bp, Homo sapiens
gaagaggctggttct

SEQ ID NO: 175493 - DNA, 23 bp, Homo sapiens
gaagagtaagtcaacctgcctga

SEQ ID NO: 175494 - DNA, 17 bp, Homo sapiens
gaagattctcctgtgct

SEQ ID NO: 175495 - DNA, 23 bp, Homo sapiens
gaagattttgaaatttttattaa

SEQ ID NO: 175496 - DNA, 16 bp, Homo sapiens
gaagcaccataacttt

SEQ ID NO: 175497 - DNA, 15 bp, Homo sapiens
gaagcagaggaagga

SEQ ID NO: 175498 - DNA, 20 bp, Homo sapiens
gaagcagatgcaaagaggca

SEQ ID NO: 175499 - DNA, 16 bp, Homo sapiens
gaagcagtgagccgca

SEQ ID NO: 175500 - DNA, 17 bp, Homo sapiens
gaagcattcagagagca

SEQ ID NO: 175501 - DNA, 11 bp, Homo sapiens
gaagccctcct

SEQ ID NO: 175502 - DNA, 15 bp, Homo sapiens
gaagctccactgtca

SEQ ID NO: 175503 - DNA, 16 bp, Homo sapiens
gaagctccactgtcac

SEQ ID NO: 175504 - DNA, 17 bp, Homo sapiens
gaagctgtgtccttgca

SEQ ID NO: 175505 - DNA, 15 bp, Homo sapiens
gaaggacctcctgag

SEQ ID NO: 175506 - DNA, 18 bp, Homo sapiens
gaaggagacagagctggt

SEQ ID NO: 175507 - DNA, 12 bp, Homo sapiens
gaaggagagaaa

SEQ ID NO: 175508 - DNA, 13 bp, Homo sapiens
gaaggagagaaag

SEQ ID NO: 175509 - DNA, 20 bp, Homo sapiens
gaaggagccccattcctggg

SEQ ID NO: 175510 - DNA, 15 bp, Homo sapiens
gaaggaggaggagga

SEQ ID NO: 175511 - DNA, 14 bp, Homo sapiens
gaaggatgagcatt

SEQ ID NO: 175512 - DNA, 16 bp, Homo sapiens
gaaggatgagcattta

SEQ ID NO: 175513 - DNA, 15 bp, Homo sapiens
gaaggcaaagcacga

SEQ ID NO: 175514 - DNA, 17 bp, Homo sapiens
gaaggccgagaagcaag

SEQ ID NO: 175515 - DNA, 18 bp, Homo sapiens
gaaggccgagaagcaaga

SEQ ID NO: 175516 - DNA, 12 bp, Homo sapiens
gaaggctgtcct

SEQ ID NO: 175517 - DNA, 17 bp, Homo sapiens
gaaggggaggagggcgg

SEQ ID NO: 175518 - DNA, 16 bp, Homo sapiens
gaaggggccagaggct

SEQ ID NO: 175519 - DNA, 17 bp, Homo sapiens
gaaggggccagaggctc

SEQ ID NO: 175520 - DNA, 17 bp, Homo sapiens
gaaggtcacctgagccc

SEQ ID NO: 175521 - DNA, 14 bp, Homo sapiens
gaaggtgctggagg

SEQ ID NO: 175522 - DNA, 16 bp, Homo sapiens
gaaggtgctggaggtg

SEQ ID NO: 175523 - DNA, 17 bp, Homo sapiens
gaaggtgctggaggtgg

SEQ ID NO: 175524 - DNA, 18 bp, Homo sapiens
gaaggtgctggaggtggg

SEQ ID NO: 175525 - DNA, 20 bp, Homo sapiens
gaaggtttactctgtggcca

SEQ ID NO: 175526 - DNA, 15 bp, Homo sapiens
gaaggtttgtatatt

SEQ ID NO: 175527 - DNA, 16 bp, Homo sapiens
gaaggtttgtatattg

SEQ ID NO: 175528 - DNA, 21 bp, Homo sapiens
gaagtacccgttcacattttt

SEQ ID NO: 175529 - DNA, 15 bp, Homo sapiens
gaagtcactgcacag

SEQ ID NO: 175530 - DNA, 16 bp, Homo sapiens
gaagtccccaggcccc

SEQ ID NO: 175531 - DNA, 15 bp, Homo sapiens
gaagtctaggagctg

SEQ ID NO: 175532 - DNA, 22 bp, Homo sapiens
gaagtctaggagctgggaggaa

SEQ ID NO: 175533 - DNA, 22 bp, Homo sapiens
gccagaggctcgttgactggct

SEQ ID NO: 175534 - DNA, 21 bp, Homo sapiens
gagaagaattttcagacccca

SEQ ID NO: 175535 - DNA, 16 bp, Homo sapiens
gagaagagaggagagg

SEQ ID NO: 175536 - DNA, 15 bp, Homo sapiens
gagaagagctgttca

SEQ ID NO: 175537 - DNA, 16 bp, Homo sapiens
gagaagcagaggaagg

SEQ ID NO: 175538 - DNA, 18 bp, Homo sapiens
gagaagcagtgagccgca

SEQ ID NO: 175539 - DNA, 13 bp, Homo sapiens
gagaagcggctgg

SEQ ID NO: 175540 - DNA, 14 bp, Homo sapiens
gagaaggaaggaga

SEQ ID NO: 175541 - DNA, 20 bp, Homo sapiens
gagaaggacccggaggggcc

SEQ ID NO: 175542 - DNA, 13 bp, Homo sapiens
gagaaggcaggaa

SEQ ID NO: 175543 - DNA, 15 bp, Homo sapiens
gagaaggggaggagg

SEQ ID NO: 175544 - DNA, 16 bp, Homo sapiens
gagaagtatacataag

SEQ ID NO: 175545 - DNA, 18 bp, Homo sapiens
gagaataagagaaagaaa

SEQ ID NO: 175546 - DNA, 18 bp, Homo sapiens
gagaattgcttgaaccca

SEQ ID NO: 175547 - DNA, 17 bp, Homo sapiens
gagacacctgcacctcc

SEQ ID NO: 175548 - DNA, 20 bp, Homo sapiens
gagacacctgcacctccccc

SEQ ID NO: 175549 - DNA, 20 bp, Homo sapiens
gagacaggaaaatcctctgg

SEQ ID NO: 175550 - DNA, 12 bp, Homo sapiens
gagacagggttt

SEQ ID NO: 175551 - DNA, 14 bp, Homo sapiens
gagacccaaggagg

SEQ ID NO: 175552 - DNA, 18 bp, Homo sapiens
gagacccagccctcatcc

SEQ ID NO: 175553 - DNA, 21 bp, Homo sapiens
gagaccctctgccaccagaga

SEQ ID NO: 175554 - DNA, 14 bp, Homo sapiens
gagaccgtcctcac

SEQ ID NO: 175555 - DNA, 15 bp, Homo sapiens
gagaccgtcctcacc

SEQ ID NO: 175556 - DNA, 11 bp, Homo sapiens
gagacctcagc

SEQ ID NO: 175557 - DNA, 14 bp, Homo sapiens
gagacctcagccat

SEQ ID NO: 175558 - DNA, 15 bp, Homo sapiens
gagacctcagccatg

SEQ ID NO: 175559 - DNA, 22 bp, Homo sapiens
gagacgtttttggaagagtagt

SEQ ID NO: 175560 - DNA, 15 bp, Homo sapiens
gagactcacctctgc

SEQ ID NO: 175561 - DNA, 19 bp, Homo sapiens
gagactcacctctgcctca

SEQ ID NO: 175562 - DNA, 20 bp, Homo sapiens
gagactcacctctgcctcaa

SEQ ID NO: 175563 - DNA, 15 bp, Homo sapiens
gagactgggctgagg

SEQ ID NO: 175564 - DNA, 21 bp, Homo sapiens
gagactgggctgagggagcct

SEQ ID NO: 175565 - DNA, 14 bp, Homo sapiens
gagactggggggct

SEQ ID NO: 175566 - DNA, 18 bp, Homo sapiens
gagactggggggcttgaa

SEQ ID NO: 175567 - DNA, 13 bp, Homo sapiens
gagacttgtatga

SEQ ID NO: 175568 - DNA, 16 bp, Homo sapiens
gagagaaagccaggca

SEQ ID NO: 175569 - DNA, 17 bp, Homo sapiens
gagagaaagtgggtgag

SEQ ID NO: 175570 - DNA, 15 bp, Homo sapiens
gagagaaggggagga

SEQ ID NO: 175571 - DNA, 17 bp, Homo sapiens
gagagaaggggaggagg

SEQ ID NO: 175572 - DNA, 15 bp, Homo sapiens
gagagacccaaggag

SEQ ID NO: 175573 - DNA, 20 bp, Homo sapiens
gagagacccaaggaggaaaa

SEQ ID NO: 175574 - DNA, 13 bp, Homo sapiens
gagagaggcagag

SEQ ID NO: 175575 - DNA, 17 bp, Homo sapiens
gagagaggcagagagcg

SEQ ID NO: 175576 - DNA, 21 bp, Homo sapiens
gagagcctgctcccccacccc

SEQ ID NO: 175577 - DNA, 23 bp, Homo sapiens
gagagcctgctcccccaccccct

SEQ ID NO: 175578 - DNA, 21 bp, Homo sapiens
gagagcggtctcaggctggtg

SEQ ID NO: 175579 - DNA, 15 bp, Homo sapiens
gagagctagcagcag

SEQ ID NO: 175580 - DNA, 21 bp, Homo sapiens
gagagctagcagcagggaggg

SEQ ID NO: 175581 - DNA, 19 bp, Homo sapiens
gagaggagagaggcagaga

SEQ ID NO: 175582 - DNA, 16 bp, Homo sapiens
gagaggcagagagcgg

SEQ ID NO: 175583 - DNA, 11 bp, Homo sapiens
gagagggcttt

SEQ ID NO: 175584 - DNA, 13 bp, Homo sapiens
gagaggggcacag

SEQ ID NO: 175585 - DNA, 18 bp, Homo sapiens
gagagggggccacctccc

SEQ ID NO: 175586 - DNA, 19 bp, Homo sapiens
gagaggtcaagcccaggag

SEQ ID NO: 175587 - DNA, 21 bp, Homo sapiens
gagagtagccgagagcctgct

SEQ ID NO: 175588 - DNA, 15 bp, Homo sapiens
gagagtgaacaaatt

SEQ ID NO: 175589 - DNA, 18 bp, Homo sapiens
gagagtgcaacagtagca

SEQ ID NO: 175590 - DNA, 13 bp, Homo sapiens
gagagtggctcct

SEQ ID NO: 175591 - DNA, 16 bp, Homo sapiens
gagagtggctcctccc

SEQ ID NO: 175592 - DNA, 21 bp, Homo sapiens
gagagtggctcctcccggtgc

SEQ ID NO: 175593 - DNA, 21 bp, Homo sapiens
gagagtgtcttcacggcagga

SEQ ID NO: 175594 - DNA, 17 bp, Homo sapiens
gagatatggcagcgaaa

SEQ ID NO: 175595 - DNA, 22 bp, Homo sapiens
gagatatttacatgaattgcat

SEQ ID NO: 175596 - DNA, 22 bp, Homo sapiens
gagatatttatggggggagaac

SEQ ID NO: 175597 - DNA, 18 bp, Homo sapiens
gagatcaaatggaaagga

SEQ ID NO: 175598 - DNA, 13 bp, Homo sapiens
gagatcagcctgg

SEQ ID NO: 175599 - DNA, 23 bp, Homo sapiens
gagatctaaggatgtcacagggc

SEQ ID NO: 175600 - DNA, 20 bp, Homo sapiens
gagatgcctccaccgctgcc

SEQ ID NO: 175601 - DNA, 22 bp, Homo sapiens
gagatgcctccaccgctgccta

SEQ ID NO: 175602 - DNA, 15 bp, Homo sapiens
gagatgctggagaag

SEQ ID NO: 175603 - DNA, 19 bp, Homo sapiens
gagatgctggagaagagag

SEQ ID NO: 175604 - DNA, 20 bp, Homo sapiens
gagatggaagttgcagtgag

SEQ ID NO: 175605 - DNA, 12 bp, Homo sapiens
gagatggaggag

SEQ ID NO: 175606 - DNA, 14 bp, Homo sapiens
gagatggaggagga

SEQ ID NO: 175607 - DNA, 16 bp, Homo sapiens
gagatggaggaggagg

SEQ ID NO: 175608 - DNA, 23 bp, Homo sapiens
gagatggatcaatcaaacccggc

SEQ ID NO: 175609 - DNA, 17 bp, Homo sapiens
gagatgggactgggagg

SEQ ID NO: 175610 - DNA, 13 bp, Homo sapiens
gagattgagaagg

SEQ ID NO: 175611 - DNA, 15 bp, Homo sapiens
gagcaaactctgctg

SEQ ID NO: 175612 - DNA, 22 bp, Homo sapiens
gagcaaaggggtcccatagagg

SEQ ID NO: 175613 - DNA, 13 bp, Homo sapiens
gagcaccaggcac

SEQ ID NO: 175614 - DNA, 16 bp, Homo sapiens
gagcacttaagagaat

SEQ ID NO: 175615 - DNA, 19 bp, Homo sapiens
gagcacttaagagaatatt

SEQ ID NO: 175616 - DNA, 14 bp, Homo sapiens
gagcagacaggagg

SEQ ID NO: 175617 - DNA, 21 bp, Homo sapiens
gagcagacaggaggaatcatg

SEQ ID NO: 175618 - DNA, 18 bp, Homo sapiens
gagcagactggtgagcag

SEQ ID NO: 175619 - DNA, 19 bp, Homo sapiens
gagcagactggtgagcaga

SEQ ID NO: 175620 - DNA, 20 bp, Homo sapiens
gagcagactggtgagcagac

SEQ ID NO: 175621 - DNA, 16 bp, Homo sapiens
gagcagagaattctct

SEQ ID NO: 175622 - DNA, 16 bp, Homo sapiens
gagcaggaagcattca

SEQ ID NO: 175623 - DNA, 22 bp, Homo sapiens
gagcaggagattgagaaggaga

SEQ ID NO: 175624 - DNA, 21 bp, Homo sapiens
gagcaggctactgtcagctcc

SEQ ID NO: 175625 - DNA, 22 bp, Homo sapiens
gagcagggattaacctctgcac

SEQ ID NO: 175626 - DNA, 17 bp, Homo sapiens
gagcatttagggcaagg

SEQ ID NO: 175627 - DNA, 20 bp, Homo sapiens
gagccaacagaagcttccat

SEQ ID NO: 175628 - DNA, 19 bp, Homo sapiens
gagccaagggttcagagac

SEQ ID NO: 175629 - DNA, 23 bp, Homo sapiens
gagccaagggttcagagactcag

SEQ ID NO: 175630 - DNA, 14 bp, Homo sapiens
gagccaccatgccc

SEQ ID NO: 175631 - DNA, 14 bp, Homo sapiens
gagccactcctctg

SEQ ID NO: 175632 - DNA, 14 bp, Homo sapiens
gagccatgctggga

SEQ ID NO: 175633 - DNA, 14 bp, Homo sapiens
gagcccaagggaat

SEQ ID NO: 175634 - DNA, 12 bp, Homo sapiens
gagcccagctct

SEQ ID NO: 175635 - DNA, 16 bp, Homo sapiens
gagccccaggcctctg

SEQ ID NO: 175636 - DNA, 17 bp, Homo sapiens
gagccccattcctggga

SEQ ID NO: 175637 - DNA, 18 bp, Homo sapiens
gagccccgcagacctccc

SEQ ID NO: 175638 - DNA, 21 bp, Homo sapiens
gagccctgtggatgagccctc

SEQ ID NO: 175639 - DNA, 21 bp, Homo sapiens
gagccgcatcttctccatctg

SEQ ID NO: 175640 - DNA, 17 bp, Homo sapiens
gagccgggtctgcctct

SEQ ID NO: 175641 - DNA, 20 bp, Homo sapiens
gagccgggtctgcctcttct

SEQ ID NO: 175642 - DNA, 22 bp, Homo sapiens
gagccgggtctgcctcttctgg

SEQ ID NO: 175643 - DNA, 14 bp, Homo sapiens
gagccgtgatgcct

SEQ ID NO: 175644 - DNA, 18 bp, Homo sapiens
gagcctcatccgaggcag

SEQ ID NO: 175645 - DNA, 19 bp, Homo sapiens
gagcctcatccgaggcagg

SEQ ID NO: 175646 - DNA, 20 bp, Homo sapiens
gagcctcatccgaggcaggg

SEQ ID NO: 175647 - DNA, 10 bp, Homo sapiens
gagcctgagg

SEQ ID NO: 175648 - DNA, 15 bp, Homo sapiens
gagcctgagggatct

SEQ ID NO: 175649 - DNA, 19 bp, Homo sapiens
gagcctgctcccccacccc

SEQ ID NO: 175650 - DNA, 15 bp, Homo sapiens
gagcctggccagcct

SEQ ID NO: 175651 - DNA, 21 bp, Homo sapiens
gagcctggctcttgtgctgga

SEQ ID NO: 175652 - DNA, 22 bp, Homo sapiens
gagccttggtgtccacctggcc

SEQ ID NO: 175653 - DNA, 13 bp, Homo sapiens
gagcgaaactccg

SEQ ID NO: 175654 - DNA, 13 bp, Homo sapiens
gagcgacagtgag

SEQ ID NO: 175655 - DNA, 15 bp, Homo sapiens
gagcgcctgcccctc

SEQ ID NO: 175656 - DNA, 18 bp, Homo sapiens
gagcgcctgcccctccca

SEQ ID NO: 175657 - DNA, 20 bp, Homo sapiens
gagcgcctgcccctcccaga

SEQ ID NO: 175658 - DNA, 17 bp, Homo sapiens
gagcggaaagcagctca

SEQ ID NO: 175659 - DNA, 14 bp, Homo sapiens
gagcggtggccctg

SEQ ID NO: 175660 - DNA, 19 bp, Homo sapiens
gagctatttccattccaga

SEQ ID NO: 175661 - DNA, 16 bp, Homo sapiens
gagctcactcggcacc

SEQ ID NO: 175662 - DNA, 14 bp, Homo sapiens
gagctcagaccccc

SEQ ID NO: 175663 - DNA, 20 bp, Homo sapiens
gagctctacccagggcctgc

SEQ ID NO: 175664 - DNA, 23 bp, Homo sapiens
gagctctacccagggcctgcagg

SEQ ID NO: 175665 - DNA, 16 bp, Homo sapiens
gagctgagcagggaga

SEQ ID NO: 175666 - DNA, 16 bp, Homo sapiens
gagctgaggcagcagt

SEQ ID NO: 175667 - DNA, 15 bp, Homo sapiens
gagctgagtggggga

SEQ ID NO: 175668 - DNA, 14 bp, Homo sapiens
gagctgggaggaaa

SEQ ID NO: 175669 - DNA, 16 bp, Homo sapiens
gagctgggaggaaaag

SEQ ID NO: 175670 - DNA, 18 bp, Homo sapiens
gagctggttgggaagaca

SEQ ID NO: 175671 - DNA, 18 bp, Homo sapiens
gagctgtgcaggtgggga

SEQ ID NO: 175672 - DNA, 14 bp, Homo sapiens
gagcttctctgtga

SEQ ID NO: 175673 - DNA, 16 bp, Homo sapiens
gagcttctctgtgaac

SEQ ID NO: 175674 - DNA, 20 bp, Homo sapiens
gaggaaaaccaagccgtggc

SEQ ID NO: 175675 - DNA, 16 bp, Homo sapiens
gctgaacggggagaaa

SEQ ID NO: 175676 - DNA, 19 bp, Homo sapiens
gctgacacgtccaccccag

SEQ ID NO: 175677 - DNA, 15 bp, Homo sapiens
gctgacctccacagc

SEQ ID NO: 175678 - DNA, 20 bp, Homo sapiens
gctgaccttgaactcctggg

SEQ ID NO: 175679 - DNA, 21 bp, Homo sapiens
gctgaccttgaactcctgggc

SEQ ID NO: 175680 - DNA, 23 bp, Homo sapiens
gctgaccttgaactcctgggctc

SEQ ID NO: 175681 - DNA, 19 bp, Homo sapiens
gctgactgtactcctccca

SEQ ID NO: 175682 - DNA, 21 bp, Homo sapiens
gctgactgtactcctcccagg

SEQ ID NO: 175683 - DNA, 22 bp, Homo sapiens
gctgactgttttctcttgagag

SEQ ID NO: 175684 - DNA, 15 bp, Homo sapiens
gctgagagacccaag

SEQ ID NO: 175685 - DNA, 14 bp, Homo sapiens
gctgagagactttt

SEQ ID NO: 175686 - DNA, 21 bp, Homo sapiens
gctgaggaaaggccagctggc

SEQ ID NO: 175687 - DNA, 22 bp, Homo sapiens
gctgaggaaaggccagctggca

SEQ ID NO: 175688 - DNA, 23 bp, Homo sapiens
gctgaggaaaggccagctggcag

SEQ ID NO: 175689 - DNA, 13 bp, Homo sapiens
gctgaggcagaag

SEQ ID NO: 175690 - DNA, 21 bp, Homo sapiens
gctgaggcctggactttcctg

SEQ ID NO: 175691 - DNA, 14 bp, Homo sapiens
gctgagggagcctg

SEQ ID NO: 175692 - DNA, 21 bp, Homo sapiens
gctgagtcatgatctccctgc

SEQ ID NO: 175693 - DNA, 13 bp, Homo sapiens
gctgcaccctcag

SEQ ID NO: 175694 - DNA, 18 bp, Homo sapiens
gctgcaccctcaggcagg

SEQ ID NO: 175695 - DNA, 17 bp, Homo sapiens
gctgcaggggctctgga

SEQ ID NO: 175696 - DNA, 20 bp, Homo sapiens
gctgcaggggctctggagag

SEQ ID NO: 175697 - DNA, 22 bp, Homo sapiens
gctgccacacttcaggctcttc

SEQ ID NO: 175698 - DNA, 23 bp, Homo sapiens
gctgccacacttcaggctcttct

SEQ ID NO: 175699 - DNA, 17 bp, Homo sapiens
gctgcccctggctctga

SEQ ID NO: 175700 - DNA, 20 bp, Homo sapiens
gctgcccgtcttcagcctag

SEQ ID NO: 175701 - DNA, 12 bp, Homo sapiens
gctgccctggtg

SEQ ID NO: 175702 - DNA, 19 bp, Homo sapiens
gctgccctggtgctgccac

SEQ ID NO: 175703 - DNA, 15 bp, Homo sapiens
gctgccgcctcccag

SEQ ID NO: 175704 - DNA, 18 bp, Homo sapiens
gctgccgcctcccagcct

SEQ ID NO: 175705 - DNA, 17 bp, Homo sapiens
gatgcccactgaggaat

SEQ ID NO: 175706 - DNA, 17 bp, Homo sapiens
gatgcctccaccgctgc

SEQ ID NO: 175707 - DNA, 21 bp, Homo sapiens
gatgctccttgggccctttga

SEQ ID NO: 175708 - DNA, 20 bp, Homo sapiens
gatgctgaaacaggagagaa

SEQ ID NO: 175709 - DNA, 21 bp, Homo sapiens
gatgctgaaacaggagagaaa

SEQ ID NO: 175710 - DNA, 19 bp, Homo sapiens
gatgctggagaagagagga

SEQ ID NO: 175711 - DNA, 21 bp, Homo sapiens
gatgctggagaagagaggaga

SEQ ID NO: 175712 - DNA, 16 bp, Homo sapiens
gatgctggatgctcct

SEQ ID NO: 175713 - DNA, 15 bp, Homo sapiens
gatggaagcttccag

SEQ ID NO: 175714 - DNA, 21 bp, Homo sapiens
gatggaagttgcagtgagctg

SEQ ID NO: 175715 - DNA, 22 bp, Homo sapiens
gatggagactccatgagaagcc

SEQ ID NO: 175716 - DNA, 22 bp, Homo sapiens
gatggattccaaccccaactcc

SEQ ID NO: 175717 - DNA, 22 bp, Homo sapiens
gatggatttccagccaaagcct

SEQ ID NO: 175718 - DNA, 22 bp, Homo sapiens
gatggccgggcgcggtggctca

SEQ ID NO: 175719 - DNA, 21 bp, Homo sapiens
gatggctaaaaccatcatagt

SEQ ID NO: 175720 - DNA, 21 bp, Homo sapiens
gatggctagtatcaaaagaaa

SEQ ID NO: 175721 - DNA, 17 bp, Homo sapiens
gatggctgtgcctctgc

SEQ ID NO: 175722 - DNA, 20 bp, Homo sapiens
gatggctgtgcctctgcctg

SEQ ID NO: 175723 - DNA, 16 bp, Homo sapiens
gatgggaaagcattgt

SEQ ID NO: 175724 - DNA, 18 bp, Homo sapiens
gatgggaaggagggaggt

SEQ ID NO: 175725 - DNA, 15 bp, Homo sapiens
gatgggactgggagg

SEQ ID NO: 175726 - DNA, 23 bp, Homo sapiens
gatggggtctcacagtgttgccc

SEQ ID NO: 175727 - DNA, 22 bp, Homo sapiens
gatggggtggggtggagaactc

SEQ ID NO: 175728 - DNA, 22 bp, Homo sapiens
gatgggtctggtttgcagagct

SEQ ID NO: 175729 - DNA, 13 bp, Homo sapiens
gatggttcccctg

SEQ ID NO: 175730 - DNA, 19 bp, Homo sapiens
gatgtagggtaaggtgcct

SEQ ID NO: 175731 - DNA, 21 bp, Homo sapiens
gatgtagggtaaggtgccttc

SEQ ID NO: 175732 - DNA, 18 bp, Homo sapiens
gatgtatccatgggggca

SEQ ID NO: 175733 - DNA, 14 bp, Homo sapiens
gatgtctaatagtt

SEQ ID NO: 175734 - DNA, 14 bp, Homo sapiens
gatgtgaacacatc

SEQ ID NO: 175735 - DNA, 16 bp, Homo sapiens
gatgtgaacacatcag

SEQ ID NO: 175736 - DNA, 21 bp, Homo sapiens
gatgtgctttgcattcctaca

SEQ ID NO: 175737 - DNA, 13 bp, Homo sapiens
gatgtggccctgg

SEQ ID NO: 175738 - DNA, 18 bp, Homo sapiens
gattaaccacttcagctg

SEQ ID NO: 175739 - DNA, 17 bp, Homo sapiens
gattagaatgaaaattg

SEQ ID NO: 175740 - DNA, 15 bp, Homo sapiens
gattagatcttttaa

SEQ ID NO: 175741 - DNA, 16 bp, Homo sapiens
gattattcatttaaaa

SEQ ID NO: 175742 - DNA, 19 bp, Homo sapiens
gattattcatttaaaatga

SEQ ID NO: 175743 - DNA, 22 bp, Homo sapiens
gattattcatttaaaatgatta

SEQ ID NO: 175744 - DNA, 14 bp, Homo sapiens
gattcacatctgca

SEQ ID NO: 175745 - DNA, 15 bp, Homo sapiens
gattcagctctgcaa

SEQ ID NO: 175746 - DNA, 11 bp, Homo sapiens
gattcatgtgg

SEQ ID NO: 175747 - DNA, 22 bp, Homo sapiens
gattccatttggcagagcttct

SEQ ID NO: 175748 - DNA, 18 bp, Homo sapiens
gattctactttaagcact

SEQ ID NO: 175749 - DNA, 22 bp, Homo sapiens
gattctactttaagcactacat

SEQ ID NO: 175750 - DNA, 23 bp, Homo sapiens
gattctactttaagcactacata

SEQ ID NO: 175751 - DNA, 19 bp, Homo sapiens
gattctgtgtgttttcata

SEQ ID NO: 175752 - DNA, 16 bp, Homo sapiens
gattgcaccactgcac

SEQ ID NO: 175753 - DNA, 20 bp, Homo sapiens
gattgctgccccatcagtgc

SEQ ID NO: 175754 - DNA, 18 bp, Homo sapiens
gattgcttaaaatagcaa

SEQ ID NO: 175755 - DNA, 20 bp, Homo sapiens
gattggattattcatttaaa

SEQ ID NO: 175756 - DNA, 23 bp, Homo sapiens
gattgtgggaattaaggaagtga

SEQ ID NO: 175757 - DNA, 12 bp, Homo sapiens
gatttaaatcag

SEQ ID NO: 175758 - DNA, 18 bp, Homo sapiens
gatttaacagtcatttaa

SEQ ID NO: 175759 - DNA, 13 bp, Homo sapiens
gattttaattttg

SEQ ID NO: 175760 - DNA, 21 bp, Homo sapiens
gattttgaaatcatgaagata

SEQ ID NO: 175761 - DNA, 13 bp, Homo sapiens
gcaaaaagcaaaa

SEQ ID NO: 175762 - DNA, 14 bp, Homo sapiens
gcaaaaaggcagga

SEQ ID NO: 175763 - DNA, 16 bp, Homo sapiens
gcaaaagatgcttctc

SEQ ID NO: 175764 - DNA, 23 bp, Homo sapiens
gcaaaatcattttatatgtcaaa

SEQ ID NO: 175765 - DNA, 13 bp, Homo sapiens
gcaaaatgtgaat

SEQ ID NO: 175766 - DNA, 17 bp, Homo sapiens
gcaaaattgatgtgttt

SEQ ID NO: 175767 - DNA, 22 bp, Homo sapiens
gcaaaatttgatgccaggacac

SEQ ID NO: 175768 - DNA, 17 bp, Homo sapiens
gcaaacgctgcctgccg

SEQ ID NO: 175769 - DNA, 14 bp, Homo sapiens
gcaaagaggcaaga

SEQ ID NO: 175770 - DNA, 21 bp, Homo sapiens
gcaaagctgatgacaacttcc

SEQ ID NO: 175771 - DNA, 16 bp, Homo sapiens
gcaaatgtgacctgtg

SEQ ID NO: 175772 - DNA, 14 bp, Homo sapiens
gcaactgaggcaga

SEQ ID NO: 175773 - DNA, 15 bp, Homo sapiens
gcaactgaggcagac

SEQ ID NO: 175774 - DNA, 19 bp, Homo sapiens
gcaactgaggcagacagca

SEQ ID NO: 175775 - DNA, 21 bp, Homo sapiens
gcaactgaggcagacagcagc

SEQ ID NO: 175776 - DNA, 22 bp, Homo sapiens
gcaactgaggcagacagcagct

SEQ ID NO: 175777 - DNA, 18 bp, Homo sapiens
gcaactgcattggctttg

SEQ ID NO: 175778 - DNA, 22 bp, Homo sapiens
gcaagattttccacaagattcc

SEQ ID NO: 175779 - DNA, 14 bp, Homo sapiens
gcaagcacatctgc

SEQ ID NO: 175780 - DNA, 20 bp, Homo sapiens
gcaagcctgtaatcccagct

SEQ ID NO: 175781 - DNA, 21 bp, Homo sapiens
gcaagcttggctgtagaagga

SEQ ID NO: 175782 - DNA, 14 bp, Homo sapiens
gcaagggtgatggg

SEQ ID NO: 175783 - DNA, 21 bp, Homo sapiens
gcaagtctgcagcccggcgcc

SEQ ID NO: 175784 - DNA, 16 bp, Homo sapiens
gcaagtgtctgtgtgc

SEQ ID NO: 175785 - DNA, 23 bp, Homo sapiens
gcaagtgtgtatgtgcgtgtgtg

SEQ ID NO: 175786 - DNA, 12 bp, Homo sapiens
gcaagtgtgtgc

SEQ ID NO: 175787 - DNA, 19 bp, Homo sapiens
gcaagtgtgtgcatgtgtg

SEQ ID NO: 175788 - DNA, 21 bp, Homo sapiens
gcaatcgtaatgtacagatgg

SEQ ID NO: 175789 - DNA, 16 bp, Homo sapiens
gcaatgacatctcagg

SEQ ID NO: 175790 - DNA, 15 bp, Homo sapiens
gcaatgccatcatct

SEQ ID NO: 175791 - DNA, 19 bp, Homo sapiens
gcaatgccatcatctcctg

SEQ ID NO: 175792 - DNA, 14 bp, Homo sapiens
gcaatgtgataaaa

SEQ ID NO: 175793 - DNA, 17 bp, Homo sapiens
gcaatttattaaaatga

SEQ ID NO: 175794 - DNA, 21 bp, Homo sapiens
gcacacacctgtagtcccagc

SEQ ID NO: 175795 - DNA, 12 bp, Homo sapiens
gcacactgtagc

SEQ ID NO: 175796 - DNA, 19 bp, Homo sapiens
gcacagagagggggccacc

SEQ ID NO: 175797 - DNA, 21 bp, Homo sapiens
gcacagcggggccccagggct

SEQ ID NO: 175798 - DNA, 23 bp, Homo sapiens
gcacagggtctgctctttctctg

SEQ ID NO: 175799 - DNA, 13 bp, Homo sapiens
gcacagtgcatct

SEQ ID NO: 175800 - DNA, 18 bp, Homo sapiens
gcacagtgcatctcagcc

SEQ ID NO: 175801 - DNA, 18 bp, Homo sapiens
gcacagttttctgagaaa

SEQ ID NO: 175802 - DNA, 21 bp, Homo sapiens
gcacatctgcattttcacccc

SEQ ID NO: 175803 - DNA, 22 bp, Homo sapiens
gcacatttccccagacctgagc

SEQ ID NO: 175804 - DNA, 20 bp, Homo sapiens
gcaccaggcacgaacccacc

SEQ ID NO: 175805 - DNA, 21 bp, Homo sapiens
gcaccaggcacgaacccacct

SEQ ID NO: 175806 - DNA, 23 bp, Homo sapiens
gcaccagggttgaccccagagga

SEQ ID NO: 175807 - DNA, 22 bp, Homo sapiens
gcacccacccagcacccagcaa

SEQ ID NO: 175808 - DNA, 17 bp, Homo sapiens
gcacccagtgagcactc

SEQ ID NO: 175809 - DNA, 23 bp, Homo sapiens
gcacccagtgagcactcccaagt

SEQ ID NO: 175810 - DNA, 17 bp, Homo sapiens
gcaccccaaagctttcc

SEQ ID NO: 175811 - DNA, 16 bp, Homo sapiens
gcaccctcaggcaggt

SEQ ID NO: 175812 - DNA, 21 bp, Homo sapiens
gcacctaaaccaccagtgccc

SEQ ID NO: 175813 - DNA, 15 bp, Homo sapiens
gcacctaccatcagg

SEQ ID NO: 175814 - DNA, 19 bp, Homo sapiens
gcacctaccatcagggaca

SEQ ID NO: 175815 - DNA, 13 bp, Homo sapiens
ggagggcagcagg

SEQ ID NO: 175816 - DNA, 19 bp, Homo sapiens
ggaggggagcatgggaagt

SEQ ID NO: 175817 - DNA, 18 bp, Homo sapiens
ggaggggcctggcagccg

SEQ ID NO: 175818 - DNA, 21 bp, Homo sapiens
ggaggggcctggcagccgtgc

SEQ ID NO: 175819 - DNA, 22 bp, Homo sapiens
ggaggtattcgtaaggatggga

SEQ ID NO: 175820 - DNA, 18 bp, Homo sapiens
ggaggtcgaggcaggagg

SEQ ID NO: 175821 - DNA, 19 bp, Homo sapiens
ggaggtggaggttgcagtg

SEQ ID NO: 175822 - DNA, 20 bp, Homo sapiens
ggaggtggaggttgcagtga

SEQ ID NO: 175823 - DNA, 17 bp, Homo sapiens
ggaggttaaggctgagg

SEQ ID NO: 175824 - DNA, 21 bp, Homo sapiens
ggaggttgcagtgagctgaga

SEQ ID NO: 175825 - DNA, 20 bp, Homo sapiens
ggaggtttaggtcaagaaga

SEQ ID NO: 175826 - DNA, 17 bp, Homo sapiens
ggagtcatctcaaccat

SEQ ID NO: 175827 - DNA, 21 bp, Homo sapiens
ggagttagaggccagcctggc

SEQ ID NO: 175828 - DNA, 20 bp, Homo sapiens
ggagttgatcgcctttccca

SEQ ID NO: 175829 - DNA, 23 bp, Homo sapiens
ggagttgatcgcctttcccaggt

SEQ ID NO: 175830 - DNA, 21 bp, Homo sapiens
ggataaggtacctttcacata

SEQ ID NO: 175831 - DNA, 20 bp, Homo sapiens
ggataatgctgttgcctcat

SEQ ID NO: 175832 - DNA, 13 bp, Homo sapiens
ggatagcattttt

SEQ ID NO: 175833 - DNA, 17 bp, Homo sapiens
ggatcagaacagcagag

SEQ ID NO: 175834 - DNA, 18 bp, Homo sapiens
ggatccctcatctgtccc

SEQ ID NO: 175835 - DNA, 15 bp, Homo sapiens
ggatctgagaatctt

SEQ ID NO: 175836 - DNA, 23 bp, Homo sapiens
ggatctgggaccctttccttcct

SEQ ID NO: 175837 - DNA, 18 bp, Homo sapiens
ggatgcagagtcagcaga

SEQ ID NO: 175838 - DNA, 18 bp, Homo sapiens
ggatgccatctgtgggca

SEQ ID NO: 175839 - DNA, 16 bp, Homo sapiens
ggatgctaacatctaa

SEQ ID NO: 175840 - DNA, 21 bp, Homo sapiens
ggatggagcccaggcgggagc

SEQ ID NO: 175841 - DNA, 18 bp, Homo sapiens
ggatggatttccagccaa

SEQ ID NO: 175842 - DNA, 22 bp, Homo sapiens
ggatgggggctggcctctggct

SEQ ID NO: 175843 - DNA, 20 bp, Homo sapiens
ggatgtaaacagtgcctgct

SEQ ID NO: 175844 - DNA, 16 bp, Homo sapiens
ggatgtcacagggcca

SEQ ID NO: 175845 - DNA, 18 bp, Homo sapiens
ggatgtcactcagatgga

SEQ ID NO: 175846 - DNA, 23 bp, Homo sapiens
ggatgttcagcactgtcccttgc

SEQ ID NO: 175847 - DNA, 17 bp, Homo sapiens
ggattagggagagaaga

SEQ ID NO: 175848 - DNA, 19 bp, Homo sapiens
ggattattcatttaaaatg

SEQ ID NO: 175849 - DNA, 21 bp, Homo sapiens
ggattattcatttaaaatgat

SEQ ID NO: 175850 - DNA, 18 bp, Homo sapiens
ggattgcacgtggcctct

SEQ ID NO: 175851 - DNA, 18 bp, Homo sapiens
ggattggggaagactgtg

SEQ ID NO: 175852 - DNA, 16 bp, Homo sapiens
ggcaaagacagaagcc

SEQ ID NO: 175853 - DNA, 13 bp, Homo sapiens
ggcaactgaggca

SEQ ID NO: 175854 - DNA, 23 bp, Homo sapiens
ggcaacttgggaactagactccc

SEQ ID NO: 175855 - DNA, 22 bp, Homo sapiens
ggcaagagcccccttgacaccg

SEQ ID NO: 175856 - DNA, 22 bp, Homo sapiens
ggcaagcttggctgtagaagga

SEQ ID NO: 175857 - DNA, 13 bp, Homo sapiens
ggcacacacctgt

SEQ ID NO: 175858 - DNA, 16 bp, Homo sapiens
ggcacagggcagtggg

SEQ ID NO: 175859 - DNA, 21 bp, Homo sapiens
ggcacatttccccagacctga

SEQ ID NO: 175860 - DNA, 16 bp, Homo sapiens
ggcaccaaagccacca

SEQ ID NO: 175861 - DNA, 16 bp, Homo sapiens
ggcacccacccagcac

SEQ ID NO: 175862 - DNA, 20 bp, Homo sapiens
ggcacccagtgagcactccc

SEQ ID NO: 175863 - DNA, 19 bp, Homo sapiens
ggcacgaacccacctgctg

SEQ ID NO: 175864 - DNA, 13 bp, Homo sapiens
ggcacgctgtggg

SEQ ID NO: 175865 - DNA, 15 bp, Homo sapiens
ggcacgggcccgtga

SEQ ID NO: 175866 - DNA, 14 bp, Homo sapiens
ggcactagcctttg

SEQ ID NO: 175867 - DNA, 21 bp, Homo sapiens
ggcactagcctttggctctgg

SEQ ID NO: 175868 - DNA, 19 bp, Homo sapiens
gccagccagcagccagctc

SEQ ID NO: 175869 - DNA, 10 bp, Homo sapiens
gccagccctc

SEQ ID NO: 175870 - DNA, 20 bp, Homo sapiens
gccagccctccctgtcctcc

SEQ ID NO: 175871 - DNA, 20 bp, Homo sapiens
gccagcctgtcccatggaca

SEQ ID NO: 175872 - DNA, 21 bp, Homo sapiens
gccagccttcttccatcccag

SEQ ID NO: 175873 - DNA, 12 bp, Homo sapiens
gccagcgtcctc

SEQ ID NO: 175874 - DNA, 19 bp, Homo sapiens
gccagcgtcctcctctgtg

SEQ ID NO: 175875 - DNA, 23 bp, Homo sapiens
gccagctctgtatcaggacccag

SEQ ID NO: 175876 - DNA, 15 bp, Homo sapiens
gccaggactgagccc

SEQ ID NO: 175877 - DNA, 18 bp, Homo sapiens
gccaggcccggggctggc

SEQ ID NO: 175878 - DNA, 19 bp, Homo sapiens
gccaggccggcgagccctg

SEQ ID NO: 175879 - DNA, 23 bp, Homo sapiens
gccaggccggcgagccctgtgga

SEQ ID NO: 175880 - DNA, 16 bp, Homo sapiens
gccaggcgagatgggg

SEQ ID NO: 175881 - DNA, 14 bp, Homo sapiens
gccaggctccttcc

SEQ ID NO: 175882 - DNA, 18 bp, Homo sapiens
gccaggctccttcctgtc

SEQ ID NO: 175883 - DNA, 21 bp, Homo sapiens
gccaggctccttcctgtcttc

SEQ ID NO: 175884 - DNA, 21 bp, Homo sapiens
gccagggcagagtgagaccca

SEQ ID NO: 175885 - DNA, 14 bp, Homo sapiens
gccagggcagggcc

SEQ ID NO: 175886 - DNA, 22 bp, Homo sapiens
gccaggggaaaatcagcctgct

SEQ ID NO: 175887 - DNA, 23 bp, Homo sapiens
gccaggggaaaatcagcctgctc

SEQ ID NO: 175888 - DNA, 22 bp, Homo sapiens
gccagtaacgcgtcttcctgag

SEQ ID NO: 175889 - DNA, 21 bp, Homo sapiens
gccagtaagggaaatagaaaa

SEQ ID NO: 175890 - DNA, 10 bp, Homo sapiens
gccagtgcct

SEQ ID NO: 175891 - DNA, 17 bp, Homo sapiens
gccagtgccttacctcc

SEQ ID NO: 175892 - DNA, 21 bp, Homo sapiens
gccagtgccttacctcctgcc

SEQ ID NO: 175893 - DNA, 22 bp, Homo sapiens
gccagtgccttacctcctgccc

SEQ ID NO: 175894 - DNA, 22 bp, Homo sapiens
gccagttatggctataggtgct

SEQ ID NO: 175895 - DNA, 14 bp, Homo sapiens
gccataaaacatta

SEQ ID NO: 175896 - DNA, 16 bp, Homo sapiens
gccatagagtttaaca

SEQ ID NO: 175897 - DNA, 17 bp, Homo sapiens
gccatattttcaccatt

SEQ ID NO: 175898 - DNA, 23 bp, Homo sapiens
gccatcatctcctgccttcctcc

SEQ ID NO: 175899 - DNA, 13 bp, Homo sapiens
gccatctgtgggc

SEQ ID NO: 175900 - DNA, 17 bp, Homo sapiens
gccatctgtgggcacgc

SEQ ID NO: 175901 - DNA, 20 bp, Homo sapiens
gccatgaggagttgctgttt

SEQ ID NO: 175902 - DNA, 13 bp, Homo sapiens
gccatgccagctt

SEQ ID NO: 175903 - DNA, 16 bp, Homo sapiens
gccatgctgggaagac

SEQ ID NO: 175904 - DNA, 21 bp, Homo sapiens
gccatggaggcacacagctgc

SEQ ID NO: 175905 - DNA, 22 bp, Homo sapiens
gccatttaaagcttattaaaac

SEQ ID NO: 175906 - DNA, 18 bp, Homo sapiens
gcccaagttgtggtgctg

SEQ ID NO: 175907 - DNA, 16 bp, Homo sapiens
gcccacagctcccacc

SEQ ID NO: 175908 - DNA, 12 bp, Homo sapiens
gcccacctcccc

SEQ ID NO: 175909 - DNA, 18 bp, Homo sapiens
gcccacctccccacgccc

SEQ ID NO: 175910 - DNA, 22 bp, Homo sapiens
gcccacctgtcaaacaaagcca

SEQ ID NO: 175911 - DNA, 23 bp, Homo sapiens
gcccacttcagggttctcctctc

SEQ ID NO: 175912 - DNA, 20 bp, Homo sapiens
gcccagagatgcctccaccg

SEQ ID NO: 175913 - DNA, 22 bp, Homo sapiens
gcccagagatgcctccaccgct

SEQ ID NO: 175914 - DNA, 14 bp, Homo sapiens
gcccagagcaggaa

SEQ ID NO: 175915 - DNA, 20 bp, Homo sapiens
gcccagcactgcttgaggaa

SEQ ID NO: 175916 - DNA, 21 bp, Homo sapiens
gcccagccaaaccctgtctga

SEQ ID NO: 175917 - DNA, 16 bp, Homo sapiens
gcccagcccagctggt

SEQ ID NO: 175918 - DNA, 18 bp, Homo sapiens
gcccagctatacctgtgc

SEQ ID NO: 175919 - DNA, 12 bp, Homo sapiens
gcccaggagaga

SEQ ID NO: 175920 - DNA, 14 bp, Homo sapiens
gcccaggagagaga

SEQ ID NO: 175921 - DNA, 22 bp, Homo sapiens
gcccaggagagagaaagccagg

SEQ ID NO: 175922 - DNA, 15 bp, Homo sapiens
gcccaggagagccag

SEQ ID NO: 175923 - DNA, 18 bp, Homo sapiens
gcccaggagagccagccc

SEQ ID NO: 175924 - DNA, 18 bp, Homo sapiens
gcccagggccactctgcc

SEQ ID NO: 175925 - DNA, 22 bp, Homo sapiens
gcccagggccactctgcctctg

SEQ ID NO: 175926 - DNA, 13 bp, Homo sapiens
gcccagggctcag

SEQ ID NO: 175927 - DNA, 17 bp, Homo sapiens
gcccagggctcagcctg

SEQ ID NO: 175928 - DNA, 18 bp, Homo sapiens
gcccagggctcagcctgg

SEQ ID NO: 175929 - DNA, 12 bp, Homo sapiens
gcccatccctgc

SEQ ID NO: 175930 - DNA, 14 bp, Homo sapiens
gcccatccctgcct

SEQ ID NO: 175931 - DNA, 16 bp, Homo sapiens
gcccatccctgcctgg

SEQ ID NO: 175932 - DNA, 21 bp, Homo sapiens
gcccatccctggaaggtgctg

SEQ ID NO: 175933 - DNA, 15 bp, Homo sapiens
gcccatgtgtgagtg

SEQ ID NO: 175934 - DNA, 19 bp, Homo sapiens
gcccattctctctcctgtc

SEQ ID NO: 175935 - DNA, 18 bp, Homo sapiens
gccccaactcctggaagc

SEQ ID NO: 175936 - DNA, 23 bp, Homo sapiens
gccccacctttattaaaatctta

SEQ ID NO: 175937 - DNA, 14 bp, Homo sapiens
gccccactggggaa

SEQ ID NO: 175938 - DNA, 22 bp, Homo sapiens
gccccagagcagggtgttggga

SEQ ID NO: 175939 - DNA, 12 bp, Homo sapiens
gccccagcacta

SEQ ID NO: 175940 - DNA, 14 bp, Homo sapiens
gccccaggaagccg

SEQ ID NO: 175941 - DNA, 15 bp, Homo sapiens
gccccaggcctgaaa

SEQ ID NO: 175942 - DNA, 18 bp, Homo sapiens
gccccagggctaccctcc

SEQ ID NO: 175943 - DNA, 15 bp, Homo sapiens
gccccatgtctctca

SEQ ID NO: 175944 - DNA, 18 bp, Homo sapiens
gccccatgtctctcagaa

SEQ ID NO: 175945 - DNA, 15 bp, Homo sapiens
gccccgcagacctcc

SEQ ID NO: 175946 - DNA, 21 bp, Homo sapiens
gccccgcagacctccccagcc

SEQ ID NO: 175947 - DNA, 16 bp, Homo sapiens
gccccgcttgtccagc

SEQ ID NO: 175948 - DNA, 19 bp, Homo sapiens
gccccgcttgtccagcgcc

SEQ ID NO: 175949 - DNA, 20 bp, Homo sapiens
gccccgcttgtccagcgcct

SEQ ID NO: 175950 - DNA, 16 bp, Homo sapiens
gccccggccacctctg

SEQ ID NO: 175951 - DNA, 13 bp, Homo sapiens
gcccctagcccag

SEQ ID NO: 175952 - DNA, 14 bp, Homo sapiens
gcccctagcccagg

SEQ ID NO: 175953 - DNA, 14 bp, Homo sapiens
gcccctcccttcaa

SEQ ID NO: 175954 - DNA, 15 bp, Homo sapiens
gcccctcccttcaac

SEQ ID NO: 175955 - DNA, 14 bp, Homo sapiens
gcccctcctctgcc

SEQ ID NO: 175956 - DNA, 21 bp, Homo sapiens
aaaagatatattaaaaatata

SEQ ID NO: 175957 - DNA, 21 bp, Homo sapiens
aaaagcctcaactagtcattt

SEQ ID NO: 175958 - DNA, 18 bp, Homo sapiens
aaaagctcatattttgta

SEQ ID NO: 175959 - DNA, 12 bp, Homo sapiens
aaaagctcctgt

SEQ ID NO: 175960 - DNA, 20 bp, Homo sapiens
aaaaggtgcctgtgaggcag

SEQ ID NO: 175961 - DNA, 13 bp, Homo sapiens
aaaagtacattta

SEQ ID NO: 175962 - DNA, 23 bp, Homo sapiens
aaaagtcttcactctctgaagat

SEQ ID NO: 175963 - DNA, 18 bp, Homo sapiens
aaaagttctgcagataaa

SEQ ID NO: 175964 - DNA, 16 bp, Homo sapiens
aaaagtttgccagaag

SEQ ID NO: 175965 - DNA, 21 bp, Homo sapiens
aaaataaaaagcgggcacggg

SEQ ID NO: 175966 - DNA, 15 bp, Homo sapiens
aaaataaatatatat

SEQ ID NO: 175967 - DNA, 14 bp, Homo sapiens
aaaatacacactca

SEQ ID NO: 175968 - DNA, 12 bp, Homo sapiens
aaaatagcttgt

SEQ ID NO: 175969 - DNA, 10 bp, Homo sapiens
aaaatataaa

SEQ ID NO: 175970 - DNA, 17 bp, Homo sapiens
aaaatataaaactgcgt

SEQ ID NO: 175971 - DNA, 22 bp, Homo sapiens
aaaatataaaactgcgttaaag

SEQ ID NO: 175972 - DNA, 14 bp, Homo sapiens
aaaatatatttaat

SEQ ID NO: 175973 - DNA, 20 bp, Homo sapiens
aaaatatggaacttctaata

SEQ ID NO: 175974 - DNA, 15 bp, Homo sapiens
aaaatattatgtgtt

SEQ ID NO: 175975 - DNA, 21 bp, Homo sapiens
aaaatattatgtgtttccata

SEQ ID NO: 175976 - DNA, 15 bp, Homo sapiens
aaaatattcctgcat

SEQ ID NO: 175977 - DNA, 18 bp, Homo sapiens
aaaatattttgtctaaaa

SEQ ID NO: 175978 - DNA, 10 bp, Homo sapiens
aaaatcattt

SEQ ID NO: 175979 - DNA, 11 bp, Homo sapiens
aaaatcatttc

SEQ ID NO: 175980 - DNA, 23 bp, Homo sapiens
aaaatctaatattaaaaatatgg

SEQ ID NO: 175981 - DNA, 17 bp, Homo sapiens
aaaatgacagatgttga

SEQ ID NO: 175982 - DNA, 21 bp, Homo sapiens
aaaatgagcctggcaagaatg

SEQ ID NO: 175983 - DNA, 23 bp, Homo sapiens
aaaatgagtttttatggggctga

SEQ ID NO: 175984 - DNA, 20 bp, Homo sapiens
aaaatgcctcagtgtatttg

SEQ ID NO: 175985 - DNA, 21 bp, Homo sapiens
aaaatgctgtattagtcacag

SEQ ID NO: 175986 - DNA, 17 bp, Homo sapiens
aaaattaaatcaacctt

SEQ ID NO: 175987 - DNA, 17 bp, Homo sapiens
aaaattattttaaacaa

SEQ ID NO: 175988 - DNA, 19 bp, Homo sapiens
aaaatttagaaatataatt

SEQ ID NO: 175989 - DNA, 16 bp, Homo sapiens
aaaatttgttttgacg

SEQ ID NO: 175990 - DNA, 12 bp, Homo sapiens
aaacaaaataga

SEQ ID NO: 175991 - DNA, 13 bp, Homo sapiens
aaacaaatatgca

SEQ ID NO: 175992 - DNA, 14 bp, Homo sapiens
aaacaataaagaga

SEQ ID NO: 175993 - DNA, 16 bp, Homo sapiens
aaacaataaatgtgca

SEQ ID NO: 175994 - DNA, 14 bp, Homo sapiens
aaacacaatatttt

SEQ ID NO: 175995 - DNA, 17 bp, Homo sapiens
aaacacactgaggcagg

SEQ ID NO: 175996 - DNA, 21 bp, Homo sapiens
aaacacagacattctgccagg

SEQ ID NO: 175997 - DNA, 18 bp, Homo sapiens
aaacaggagacaggaagg

SEQ ID NO: 175998 - DNA, 13 bp, Homo sapiens
aaacataaataaa

SEQ ID NO: 175999 - DNA, 21 bp, Homo sapiens
aaacatgaccctaaatcttga

SEQ ID NO: 176000 - DNA, 21 bp, Homo sapiens
aaacatggtagaattggagag

SEQ ID NO: 176001 - DNA, 18 bp, Homo sapiens
aaacattaagaaaatcat

SEQ ID NO: 176002 - DNA, 12 bp, Homo sapiens
aaaccaagaaga

SEQ ID NO: 176003 - DNA, 16 bp, Homo sapiens
aaaccacagcagttga

SEQ ID NO: 176004 - DNA, 23 bp, Homo sapiens
aaaccaccagtgcccaaagtctg

SEQ ID NO: 176005 - DNA, 12 bp, Homo sapiens
aaaccagggagc

SEQ ID NO: 176006 - DNA, 13 bp, Homo sapiens
aaaccataaactt

SEQ ID NO: 176007 - DNA, 16 bp, Homo sapiens
aaaccctattggtaaa

SEQ ID NO: 176008 - DNA, 21 bp, Homo sapiens
aaaccctgtctctactaaaaa

SEQ ID NO: 176009 - DNA, 16 bp, Homo sapiens
aaaccgccaaggctgg

SEQ ID NO: 176010 - DNA, 15 bp, Homo sapiens
aaacctaaaaaagat

SEQ ID NO: 176011 - DNA, 16 bp, Homo sapiens
aaacctgaaaaaaagt

SEQ ID NO: 176012 - DNA, 15 bp, Homo sapiens
aaacctggatgtcac

SEQ ID NO: 176013 - DNA, 16 bp, Homo sapiens
aaaccttattgtacct

SEQ ID NO: 176014 - DNA, 13 bp, Homo sapiens
aaaccttttgaaa

SEQ ID NO: 176015 - DNA, 15 bp, Homo sapiens
aaacgggctcagcaa

SEQ ID NO: 176016 - DNA, 17 bp, Homo sapiens
aaacggttaaaactgtc

SEQ ID NO: 176017 - DNA, 17 bp, Homo sapiens
aaactaaatctctaata

SEQ ID NO: 176018 - DNA, 18 bp, Homo sapiens
aaactaaatctctaatat

SEQ ID NO: 176019 - DNA, 18 bp, Homo sapiens
aaactagggccaagccca

SEQ ID NO: 176020 - DNA, 18 bp, Homo sapiens
aaactcagggacagagcc

SEQ ID NO: 176021 - DNA, 19 bp, Homo sapiens
aaactccgtcttagaagtg

SEQ ID NO: 176022 - DNA, 20 bp, Homo sapiens
aaactctaaacattaatcaa

SEQ ID NO: 176023 - DNA, 17 bp, Homo sapiens
aaactctctttgggaat

SEQ ID NO: 176024 - DNA, 12 bp, Homo sapiens
aaactctgctgt

SEQ ID NO: 176025 - DNA, 12 bp, Homo sapiens
aaactgaaaatc

SEQ ID NO: 176026 - DNA, 18 bp, Homo sapiens
aaactgaaaatctaatat

SEQ ID NO: 176027 - DNA, 14 bp, Homo sapiens
aaactgaagccaga

SEQ ID NO: 176028 - DNA, 12 bp, Homo sapiens
aaactgacttta

SEQ ID NO: 176029 - DNA, 17 bp, Homo sapiens
aaactgcattagaaatt

SEQ ID NO: 176030 - DNA, 12 bp, Homo sapiens
aaactgtgcacc

SEQ ID NO: 176031 - DNA, 12 bp, Homo sapiens
aaacttgtaaat

SEQ ID NO: 176032 - DNA, 20 bp, Homo sapiens
aaactttacccaaaaactaa

SEQ ID NO: 176033 - DNA, 12 bp, Homo sapiens
aaactttatgct

SEQ ID NO: 176034 - DNA, 23 bp, Homo sapiens
aaagaaaagataaagatgatcta

SEQ ID NO: 176035 - DNA, 13 bp, Homo sapiens
aaagaaaatatgc

SEQ ID NO: 176036 - DNA, 21 bp, Homo sapiens
agttaatatatcccagaaatt

SEQ ID NO: 176037 - DNA, 16 bp, Homo sapiens
agttacattaatgtta

SEQ ID NO: 176038 - DNA, 12 bp, Homo sapiens
agttaggaaata

SEQ ID NO: 176039 - DNA, 18 bp, Homo sapiens
agttaggaaataaaacct

SEQ ID NO: 176040 - DNA, 16 bp, Homo sapiens
agttaggatagcattt

SEQ ID NO: 176041 - DNA, 15 bp, Homo sapiens
agttatagtttcaga

SEQ ID NO: 176042 - DNA, 16 bp, Homo sapiens
agttatagtttcagat

SEQ ID NO: 176043 - DNA, 21 bp, Homo sapiens
agttatggcctatacactatt

SEQ ID NO: 176044 - DNA, 19 bp, Homo sapiens
agttatggctataggtgct

SEQ ID NO: 176045 - DNA, 13 bp, Homo sapiens
agttattgtacag

SEQ ID NO: 176046 - DNA, 18 bp, Homo sapiens
agttattgtacagctgtt

SEQ ID NO: 176047 - DNA, 20 bp, Homo sapiens
agttcaggtagctgcccctg

SEQ ID NO: 176048 - DNA, 20 bp, Homo sapiens
agttcatattccatatttat

SEQ ID NO: 176049 - DNA, 17 bp, Homo sapiens
agttccctacttcctgt

SEQ ID NO: 176050 - DNA, 21 bp, Homo sapiens
agttccctgaaaacccagaga

SEQ ID NO: 176051 - DNA, 24 bp, Homo sapiens
agttccctgaaaacccagagagga

SEQ ID NO: 176052 - DNA, 17 bp, Homo sapiens
agttcctcgccctgggt

SEQ ID NO: 176053 - DNA, 23 bp, Homo sapiens
agttcctgtcccttctcttaatt

SEQ ID NO: 176054 - DNA, 20 bp, Homo sapiens
agttccttcagcttccattt

SEQ ID NO: 176055 - DNA, 18 bp, Homo sapiens
agttcgagaccaacctga

SEQ ID NO: 176056 - DNA, 15 bp, Homo sapiens
agttctgagtgtttt

SEQ ID NO: 176057 - DNA, 12 bp, Homo sapiens
agttctgctcta

SEQ ID NO: 176058 - DNA, 12 bp, Homo sapiens
agttctgggtgc

SEQ ID NO: 176059 - DNA, 17 bp, Homo sapiens
agttctgggtgctccct

SEQ ID NO: 176060 - DNA, 18 bp, Homo sapiens
agttgaaaaacagctgag

SEQ ID NO: 176061 - DNA, 20 bp, Homo sapiens
agttgaaaagactccaaaga

SEQ ID NO: 176062 - DNA, 16 bp, Homo sapiens
agttgatgttgcattt

SEQ ID NO: 176063 - DNA, 13 bp, Homo sapiens
agttgattcagct

SEQ ID NO: 176064 - DNA, 14 bp, Homo sapiens
agttgattcagctc

SEQ ID NO: 176065 - DNA, 23 bp, Homo sapiens
agttgattcagctctgcaagaat

SEQ ID NO: 176066 - DNA, 14 bp, Homo sapiens
agttgctgtcataa

SEQ ID NO: 176067 - DNA, 23 bp, Homo sapiens
agttgggaacttcagatggacct

SEQ ID NO: 176068 - DNA, 19 bp, Homo sapiens
agttgtaccgcaatgtgac

SEQ ID NO: 176069 - DNA, 15 bp, Homo sapiens
agttgtatctctttt

SEQ ID NO: 176070 - DNA, 18 bp, Homo sapiens
agttgtgcacatggctta

SEQ ID NO: 176071 - DNA, 19 bp, Homo sapiens
agttgtgccttttatagct

SEQ ID NO: 176072 - DNA, 21 bp, Homo sapiens
agttgtgccttttatagctat

SEQ ID NO: 176073 - DNA, 22 bp, Homo sapiens
agttgttactaactaaactctc

SEQ ID NO: 176074 - DNA, 12 bp, Homo sapiens
agtttaaagcaa

SEQ ID NO: 176075 - DNA, 21 bp, Homo sapiens
agtttaaagctcgaaaacaat

SEQ ID NO: 176076 - DNA, 12 bp, Homo sapiens
agtttaacacaa

SEQ ID NO: 176077 - DNA, 15 bp, Homo sapiens
agtttacaagtgtat

SEQ ID NO: 176078 - DNA, 17 bp, Homo sapiens
agtttacaagtgtatat

SEQ ID NO: 176079 - DNA, 13 bp, Homo sapiens
agtttacattgta

SEQ ID NO: 176080 - DNA, 23 bp, Homo sapiens
agtttcagatatatatcatattg

SEQ ID NO: 176081 - DNA, 17 bp, Homo sapiens
agtttcattctcctgcc

SEQ ID NO: 176082 - DNA, 20 bp, Homo sapiens
agtttcattctcctgcctgt

SEQ ID NO: 176083 - DNA, 21 bp, Homo sapiens
agtttctagctagaaatatga

SEQ ID NO: 176084 - DNA, 18 bp, Homo sapiens
agtttgattattcagtgt

SEQ ID NO: 176085 - DNA, 13 bp, Homo sapiens
agtttgcagaaaa

SEQ ID NO: 176086 - DNA, 14 bp, Homo sapiens
agtttgtataactt

SEQ ID NO: 176087 - DNA, 17 bp, Homo sapiens
agtttgtataacttctt

SEQ ID NO: 176088 - DNA, 16 bp, Homo sapiens
agtttgtcctgtagag

SEQ ID NO: 176089 - DNA, 18 bp, Homo sapiens
agttttaactagaattta

SEQ ID NO: 176090 - DNA, 13 bp, Homo sapiens
agttttatcattt

SEQ ID NO: 176091 - DNA, 15 bp, Homo sapiens
agttttatcattttc

SEQ ID NO: 176092 - DNA, 17 bp, Homo sapiens
agttttcagtttgtata

SEQ ID NO: 176093 - DNA, 16 bp, Homo sapiens
agtttttgtaatttat

SEQ ID NO: 176094 - DNA, 19 bp, Homo sapiens
ataaaaaaacaatcatttg

SEQ ID NO: 176095 - DNA, 17 bp, Homo sapiens
ataaaaaccaagaagat

SEQ ID NO: 176096 - DNA, 20 bp, Homo sapiens
ataaaaagacattcttccaa

SEQ ID NO: 176097 - DNA, 22 bp, Homo sapiens
ataaaaagcctgcaatttcata

SEQ ID NO: 176098 - DNA, 12 bp, Homo sapiens
ataaaaaggcac

SEQ ID NO: 176099 - DNA, 18 bp, Homo sapiens
aaagtcaaaaggtgcctg

SEQ ID NO: 176100 - DNA, 20 bp, Homo sapiens
aaagtcaaaaggtgcctgtg

SEQ ID NO: 176101 - DNA, 17 bp, Homo sapiens
aaagtcaatgttttcag

SEQ ID NO: 176102 - DNA, 12 bp, Homo sapiens
aaagtctcttgt

SEQ ID NO: 176103 - DNA, 23 bp, Homo sapiens
aaagtctgtgtgatgaactttct

SEQ ID NO: 176104 - DNA, 20 bp, Homo sapiens
aaagtcttcactctctgaag

SEQ ID NO: 176105 - DNA, 15 bp, Homo sapiens
aaagtgataatttct

SEQ ID NO: 176106 - DNA, 23 bp, Homo sapiens
aaagtgcagctccgtttggcagt

SEQ ID NO: 176107 - DNA, 13 bp, Homo sapiens
aaagtgtgtatta

SEQ ID NO: 176108 - DNA, 14 bp, Homo sapiens
aaagtgtgtattaa

SEQ ID NO: 176109 - DNA, 23 bp, Homo sapiens
aaagtgtgtattaaaaaaaacaa

SEQ ID NO: 176110 - DNA, 19 bp, Homo sapiens
aaagtgttggctaatgaag

SEQ ID NO: 176111 - DNA, 13 bp, Homo sapiens
aaagtgtttgcct

SEQ ID NO: 176112 - DNA, 16 bp, Homo sapiens
aaagttggtgacagat

SEQ ID NO: 176113 - DNA, 14 bp, Homo sapiens
aaataaaaataaat

SEQ ID NO: 176114 - DNA, 20 bp, Homo sapiens
aaataaaaatattgtgttgt

SEQ ID NO: 176115 - DNA, 13 bp, Homo sapiens
aaataaaaccttt

SEQ ID NO: 176116 - DNA, 13 bp, Homo sapiens
aaataaaattatg

SEQ ID NO: 176117 - DNA, 15 bp, Homo sapiens
aaataaagtatatat

SEQ ID NO: 176118 - DNA, 16 bp, Homo sapiens
aaataaagtatatata

SEQ ID NO: 176119 - DNA, 20 bp, Homo sapiens
aaataaagtatatatagaat

SEQ ID NO: 176120 - DNA, 13 bp, Homo sapiens
aaataaatatata

SEQ ID NO: 176121 - DNA, 21 bp, Homo sapiens
aaataacacacatataaacat

SEQ ID NO: 176122 - DNA, 16 bp, Homo sapiens
aaataacttcaagcaa

SEQ ID NO: 176123 - DNA, 24 bp, Homo sapiens
aaataagaaacaactctttgagaa

SEQ ID NO: 176124 - DNA, 14 bp, Homo sapiens
aaataatcattctt

SEQ ID NO: 176125 - DNA, 14 bp, Homo sapiens
aaatacatgcatct

SEQ ID NO: 176126 - DNA, 21 bp, Homo sapiens
aaatagccgggcatggtggcg

SEQ ID NO: 176127 - DNA, 20 bp, Homo sapiens
aaatagtgcagaatctcata

SEQ ID NO: 176128 - DNA, 12 bp, Homo sapiens
aaatataaaact

SEQ ID NO: 176129 - DNA, 14 bp, Homo sapiens
aaatataattgaca

SEQ ID NO: 176130 - DNA, 16 bp, Homo sapiens
aaatatagctgtacaa

SEQ ID NO: 176131 - DNA, 21 bp, Homo sapiens
aaatatataaaaagaaaagat

SEQ ID NO: 176132 - DNA, 12 bp, Homo sapiens
aaatatataaat

SEQ ID NO: 176133 - DNA, 15 bp, Homo sapiens
aaatatataaatata

SEQ ID NO: 176134 - DNA, 18 bp, Homo sapiens
aaatatataaatatatat

SEQ ID NO: 176135 - DNA, 20 bp, Homo sapiens
aaatatatatatatataaaa

SEQ ID NO: 176136 - DNA, 21 bp, Homo sapiens
aaatatatttaagataattat

SEQ ID NO: 176137 - DNA, 13 bp, Homo sapiens
aaatatgcaaagc

SEQ ID NO: 176138 - DNA, 17 bp, Homo sapiens
aaatatgcaaagcactg

SEQ ID NO: 176139 - DNA, 19 bp, Homo sapiens
aaatatggctataaatata

SEQ ID NO: 176140 - DNA, 19 bp, Homo sapiens
aaatatgttgatgaaaaat

SEQ ID NO: 176141 - DNA, 15 bp, Homo sapiens
aaatattatgtgttt

SEQ ID NO: 176142 - DNA, 18 bp, Homo sapiens
aaatattccctagaaact

SEQ ID NO: 176143 - DNA, 20 bp, Homo sapiens
aaatattcctgcatttgtga

SEQ ID NO: 176144 - DNA, 15 bp, Homo sapiens
aaatatttatttatt

SEQ ID NO: 176145 - DNA, 14 bp, Homo sapiens
aaatattttgtcta

SEQ ID NO: 176146 - DNA, 15 bp, Homo sapiens
aaatattttgtctaa

SEQ ID NO: 176147 - DNA, 16 bp, Homo sapiens
aaatcaaatatgcaaa

SEQ ID NO: 176148 - DNA, 19 bp, Homo sapiens
aaatcaaatatgcaaagca

SEQ ID NO: 176149 - DNA, 19 bp, Homo sapiens
aaatcagccgtgtaaccat

SEQ ID NO: 176150 - DNA, 12 bp, Homo sapiens
aaatcagcctgc

SEQ ID NO: 176151 - DNA, 21 bp, Homo sapiens
aaatcagcctgctccagctgt

SEQ ID NO: 176152 - DNA, 19 bp, Homo sapiens
aaatcatttctgcatcagc

SEQ ID NO: 176153 - DNA, 20 bp, Homo sapiens
aaatcattttatatgtcaaa

SEQ ID NO: 176154 - DNA, 17 bp, Homo sapiens
aaatccctgtttaatat

SEQ ID NO: 176155 - DNA, 15 bp, Homo sapiens
aaatcctactgaatg

SEQ ID NO: 176156 - DNA, 11 bp, Homo sapiens
aaatcctctgg

SEQ ID NO: 176157 - DNA, 22 bp, Homo sapiens
aaatcggatctggggctctggg

SEQ ID NO: 176158 - DNA, 14 bp, Homo sapiens
aaatctatgccact

SEQ ID NO: 176159 - DNA, 20 bp, Homo sapiens
aaatctatgccactcagaat

SEQ ID NO: 176160 - DNA, 23 bp, Homo sapiens
aaatctcaaatttggattgctaa

SEQ ID NO: 176161 - DNA, 15 bp, Homo sapiens
aaatctctaatatgg

SEQ ID NO: 176162 - DNA, 23 bp, Homo sapiens
aaatctgcagaaggaaaaatgtg

SEQ ID NO: 176163 - DNA, 14 bp, Homo sapiens
aaatcttaacttga

SEQ ID NO: 176164 - DNA, 17 bp, Homo sapiens
aaatcttggcacagaaa

SEQ ID NO: 176165 - DNA, 16 bp, Homo sapiens
aaatgaaaatgtcttg

SEQ ID NO: 176166 - DNA, 17 bp, Homo sapiens
aaatgaaaatgtcttgt

SEQ ID NO: 176167 - DNA, 14 bp, Homo sapiens
aaatgaactgaagt

SEQ ID NO: 176168 - DNA, 21 bp, Homo sapiens
aaatgaactgaagtttcacat

SEQ ID NO: 176169 - DNA, 17 bp, Homo sapiens
aaatgaggaatgtatat

SEQ ID NO: 176170 - DNA, 14 bp, Homo sapiens
aaatgaggacatgt

SEQ ID NO: 176171 - DNA, 20 bp, Homo sapiens
aaatgcatccattcctcagg

SEQ ID NO: 176172 - DNA, 22 bp, Homo sapiens
aaatgcctcagtgtatttgtat

SEQ ID NO: 176173 - DNA, 17 bp, Homo sapiens
aaatgctgcgcccttcc

SEQ ID NO: 176174 - DNA, 14 bp, Homo sapiens
aaatggtccaggag

SEQ ID NO: 176175 - DNA, 15 bp, Homo sapiens
aaatgtatatgcact

SEQ ID NO: 176176 - DNA, 19 bp, Homo sapiens
aaatgtctagttgtaacac

SEQ ID NO: 176177 - DNA, 21 bp, Homo sapiens
aaatgtgatgaatactgtatt

SEQ ID NO: 176178 - DNA, 20 bp, Homo sapiens
aaatgttaagttgatggtga

SEQ ID NO: 176179 - DNA, 20 bp, Homo sapiens
aaatgttattttttaattat

SEQ ID NO: 176180 - DNA, 21 bp, Homo sapiens
aaatgttattttttaattatt

SEQ ID NO: 176181 - DNA, 20 bp, Homo sapiens
aaatgttcatcaatgaatga

SEQ ID NO: 176182 - DNA, 14 bp, Homo sapiens
aaattagatgaact

SEQ ID NO: 176183 - DNA, 18 bp, Homo sapiens
aaattagctgtgtgaaat

SEQ ID NO: 176184 - DNA, 17 bp, Homo sapiens
aaattataacttaaaat

SEQ ID NO: 176185 - DNA, 17 bp, Homo sapiens
aaattatgtatgtttac

SEQ ID NO: 176186 - DNA, 19 bp, Homo sapiens
aaattatgtatgtttacat

SEQ ID NO: 176187 - DNA, 20 bp, Homo sapiens
aaattatgttacatctgttt

SEQ ID NO: 176188 - DNA, 15 bp, Homo sapiens
aaattatttaataaa

SEQ ID NO: 176189 - DNA, 13 bp, Homo sapiens
aaattatttgtgt

SEQ ID NO: 176190 - DNA, 15 bp, Homo sapiens
atacagtgttatttt

SEQ ID NO: 176191 - DNA, 14 bp, Homo sapiens
atacatggataaca

SEQ ID NO: 176192 - DNA, 19 bp, Homo sapiens
atacattgaattagaaaca

SEQ ID NO: 176193 - DNA, 19 bp, Homo sapiens
ataccaatgaaaaaatgta

SEQ ID NO: 176194 - DNA, 21 bp, Homo sapiens
ataccaatgaaaaaatgtata

SEQ ID NO: 176195 - DNA, 18 bp, Homo sapiens
ataccagcttagatttta

SEQ ID NO: 176196 - DNA, 17 bp, Homo sapiens
ataccaggccgccccag

SEQ ID NO: 176197 - DNA, 16 bp, Homo sapiens
ataccccatcattcat

SEQ ID NO: 176198 - DNA, 12 bp, Homo sapiens
ataccctccccc

SEQ ID NO: 176199 - DNA, 15 bp, Homo sapiens
atacctcaacctatg

SEQ ID NO: 176200 - DNA, 18 bp, Homo sapiens
atacctcaacctatggta

SEQ ID NO: 176201 - DNA, 23 bp, Homo sapiens
atacgcaacataattaaattttg

SEQ ID NO: 176202 - DNA, 14 bp, Homo sapiens
atacgtccaccatg

SEQ ID NO: 176203 - DNA, 18 bp, Homo sapiens
atactaaaaatcatgaga

SEQ ID NO: 176204 - DNA, 17 bp, Homo sapiens
atactatggaatttctc

SEQ ID NO: 176205 - DNA, 22 bp, Homo sapiens
atactcttaggaagagaaacca

SEQ ID NO: 176206 - DNA, 12 bp, Homo sapiens
atactgtaacac

SEQ ID NO: 176207 - DNA, 22 bp, Homo sapiens
atagaaagccaaatcaaaatat

SEQ ID NO: 176208 - DNA, 21 bp, Homo sapiens
atagaactcagttttaactag

SEQ ID NO: 176209 - DNA, 16 bp, Homo sapiens
atagacatttgtaaat

SEQ ID NO: 176210 - DNA, 15 bp, Homo sapiens
atagagcaaaattga

SEQ ID NO: 176211 - DNA, 22 bp, Homo sapiens
atagagcaaaattgatgtgttt

SEQ ID NO: 176212 - DNA, 21 bp, Homo sapiens
atagagcacctagtccagtga

SEQ ID NO: 176213 - DNA, 13 bp, Homo sapiens
atagagcctgagg

SEQ ID NO: 176214 - DNA, 14 bp, Homo sapiens
atagagtgttatca

SEQ ID NO: 176215 - DNA, 19 bp, Homo sapiens
atagcatttttgatttatg

SEQ ID NO: 176216 - DNA, 17 bp, Homo sapiens
atagcccagacacagaa

SEQ ID NO: 176217 - DNA, 17 bp, Homo sapiens
atagcccatccctgcct

SEQ ID NO: 176218 - DNA, 14 bp, Homo sapiens
atagctattactgt

SEQ ID NO: 176219 - DNA, 18 bp, Homo sapiens
atagctattactgtctgg

SEQ ID NO: 176220 - DNA, 15 bp, Homo sapiens
atagctgtacaaata

SEQ ID NO: 176221 - DNA, 17 bp, Homo sapiens
atagctgtacaaatata

SEQ ID NO: 176222 - DNA, 23 bp, Homo sapiens
atagctgtacaaatataagaata

SEQ ID NO: 176223 - DNA, 20 bp, Homo sapiens
atagcttgtatagtgtaaaa

SEQ ID NO: 176224 - DNA, 21 bp, Homo sapiens
atagctttattttttaagtat

SEQ ID NO: 176225 - DNA, 22 bp, Homo sapiens
atagctttattttttaagtatt

SEQ ID NO: 176226 - DNA, 23 bp, Homo sapiens
atagctttattttttaagtattt

SEQ ID NO: 176227 - DNA, 21 bp, Homo sapiens
atagtattccattgtgtgagt

SEQ ID NO: 176228 - DNA, 21 bp, Homo sapiens
atagtatttgagagttctaaa

SEQ ID NO: 176229 - DNA, 22 bp, Homo sapiens
atagtcaaaccataaacttcat

SEQ ID NO: 176230 - DNA, 22 bp, Homo sapiens
atagtcaagaaaaattattgta

SEQ ID NO: 176231 - DNA, 17 bp, Homo sapiens
atagtccagctttgttc

SEQ ID NO: 176232 - DNA, 13 bp, Homo sapiens
atagtctttcagt

SEQ ID NO: 176233 - DNA, 13 bp, Homo sapiens
atagtgtaaaata

SEQ ID NO: 176234 - DNA, 14 bp, Homo sapiens
atagtgtaaaataa

SEQ ID NO: 176235 - DNA, 22 bp, Homo sapiens
atagttaagcgtgcataagtta

SEQ ID NO: 176236 - DNA, 14 bp, Homo sapiens
atagtttcagatat

SEQ ID NO: 176237 - DNA, 15 bp, Homo sapiens
atagtttgtacatgc

SEQ ID NO: 176238 - DNA, 22 bp, Homo sapiens
atataaaaagaaaagataaaga

SEQ ID NO: 176239 - DNA, 13 bp, Homo sapiens
atataaaactgcg

SEQ ID NO: 176240 - DNA, 20 bp, Homo sapiens
atataaacctaaaaaagata

SEQ ID NO: 176241 - DNA, 21 bp, Homo sapiens
atataaacctaaaaaagatat

SEQ ID NO: 176242 - DNA, 16 bp, Homo sapiens
atatacaataacataa

SEQ ID NO: 176243 - DNA, 17 bp, Homo sapiens
atatagctgtacaaata

SEQ ID NO: 176244 - DNA, 18 bp, Homo sapiens
atatagctgtacaaatat

SEQ ID NO: 176245 - DNA, 16 bp, Homo sapiens
atataggttgtgcaaa

SEQ ID NO: 176246 - DNA, 22 bp, Homo sapiens
atataggttgtgcaaattaaca

SEQ ID NO: 176247 - DNA, 18 bp, Homo sapiens
atatataaaataaatata

SEQ ID NO: 176248 - DNA, 22 bp, Homo sapiens
atatataagatggaagcttcca

SEQ ID NO: 176249 - DNA, 16 bp, Homo sapiens
atatataagtgtacat

SEQ ID NO: 176250 - DNA, 12 bp, Homo sapiens
atatatataaac

SEQ ID NO: 176251 - DNA, 17 bp, Homo sapiens
atatatggcagagttgt

SEQ ID NO: 176252 - DNA, 19 bp, Homo sapiens
atatatggcagagttgtaa

SEQ ID NO: 176253 - DNA, 21 bp, Homo sapiens
atatatggcagagttgtaaat

SEQ ID NO: 176254 - DNA, 12 bp, Homo sapiens
atatatgtattt

SEQ ID NO: 176255 - DNA, 15 bp, Homo sapiens
atatatttaatgata

SEQ ID NO: 176256 - DNA, 16 bp, Homo sapiens
atatatttaatgataa

SEQ ID NO: 176257 - DNA, 10 bp, Homo sapiens
atatatttat

SEQ ID NO: 176258 - DNA, 13 bp, Homo sapiens
atatatttataac

SEQ ID NO: 176259 - DNA, 16 bp, Homo sapiens
atatatttataactca

SEQ ID NO: 176260 - DNA, 21 bp, Homo sapiens
atatatttttatatttagtta

SEQ ID NO: 176261 - DNA, 17 bp, Homo sapiens
atatcagttactcagcc

SEQ ID NO: 176262 - DNA, 21 bp, Homo sapiens
atatcagttactcagccctgg

SEQ ID NO: 176263 - DNA, 23 bp, Homo sapiens
atatcagttactcagccctgggc

SEQ ID NO: 176264 - DNA, 19 bp, Homo sapiens
atatcatattggtattcac

SEQ ID NO: 176265 - DNA, 15 bp, Homo sapiens
atatcccctcccagt

SEQ ID NO: 176266 - DNA, 21 bp, Homo sapiens
atatgagcttccttctgtgaa

SEQ ID NO: 176267 - DNA, 23 bp, Homo sapiens
atatgaggatgcagagtcagcag

SEQ ID NO: 176268 - DNA, 12 bp, Homo sapiens
atatgatttata

SEQ ID NO: 176269 - DNA, 19 bp, Homo sapiens
atatgattttatttgacaa

SEQ ID NO: 176270 - DNA, 15 bp, Homo sapiens
atatgcaaagcactg

SEQ ID NO: 176271 - DNA, 13 bp, Homo sapiens
atatgcacttata

SEQ ID NO: 176272 - DNA, 19 bp, Homo sapiens
atatgcttatacacttaca

SEQ ID NO: 176273 - DNA, 16 bp, Homo sapiens
atatggcaaaaatggc

SEQ ID NO: 176274 - DNA, 19 bp, Homo sapiens
atatggcaagaaagctggt

SEQ ID NO: 176275 - DNA, 18 bp, Homo sapiens
atatggcagagttgtaaa

SEQ ID NO: 176276 - DNA, 22 bp, Homo sapiens
atatggcagagttgtaaatata

SEQ ID NO: 176277 - DNA, 15 bp, Homo sapiens
atatgggacattttt

SEQ ID NO: 176278 - DNA, 17 bp, Homo sapiens
atatgggacatttttga

SEQ ID NO: 176279 - DNA, 12 bp, Homo sapiens
atatgtaaaata

SEQ ID NO: 176280 - DNA, 13 bp, Homo sapiens
atatgtaaaataa

SEQ ID NO: 176281 - DNA, 14 bp, Homo sapiens
atatgtaaaataaa

SEQ ID NO: 176282 - DNA, 20 bp, Homo sapiens
atatgtaaaataaaattatg

SEQ ID NO: 176283 - DNA, 14 bp, Homo sapiens
atatgtcagggcgt

SEQ ID NO: 176284 - DNA, 19 bp, Homo sapiens
atatgtgctggaattctaa

SEQ ID NO: 176285 - DNA, 15 bp, Homo sapiens
atatgttcaactgga

SEQ ID NO: 176286 - DNA, 13 bp, Homo sapiens
atattaaaaatat

SEQ ID NO: 176287 - DNA, 14 bp, Homo sapiens
atattaaaaatata

SEQ ID NO: 176288 - DNA, 15 bp, Homo sapiens
atattaaaaatataa

SEQ ID NO: 176289 - DNA, 23 bp, Homo sapiens
atattaaatatgttagcaaagag

SEQ ID NO: 176290 - DNA, 17 bp, Homo sapiens
atattatgtgtttccat

SEQ ID NO: 176291 - DNA, 15 bp, Homo sapiens
atattcatttggaaa

SEQ ID NO: 176292 - DNA, 23 bp, Homo sapiens
atattccctagaaacttccaaat

SEQ ID NO: 176293 - DNA, 14 bp, Homo sapiens
atattgacttgtat

SEQ ID NO: 176294 - DNA, 13 bp, Homo sapiens
atattggtattca

SEQ ID NO: 176295 - DNA, 22 bp, Homo sapiens
atattgtcagagttctgctcta

SEQ ID NO: 176296 - DNA, 16 bp, Homo sapiens
atattgtcagatattt

SEQ ID NO: 176297 - DNA, 17 bp, Homo sapiens
atattgtgttgtgaatg

SEQ ID NO: 176298 - DNA, 15 bp, Homo sapiens
atatttaaaagaaag

SEQ ID NO: 176299 - DNA, 12 bp, Homo sapiens
atatttaatgat

SEQ ID NO: 176300 - DNA, 21 bp, Homo sapiens
atatttacatgaattgcattt

SEQ ID NO: 176301 - DNA, 23 bp, Homo sapiens
atatttactaagccacaagaaat

SEQ ID NO: 176302 - DNA, 22 bp, Homo sapiens
atatttagttatagtttcagat

SEQ ID NO: 176303 - DNA, 20 bp, Homo sapiens
atatttataactcatcataa

SEQ ID NO: 176304 - DNA, 19 bp, Homo sapiens
atatttatggggggagaac

SEQ ID NO: 176305 - DNA, 21 bp, Homo sapiens
atatttatgtctatttaagcc

SEQ ID NO: 176306 - DNA, 17 bp, Homo sapiens
atatttatttatttatt

SEQ ID NO: 176307 - DNA, 15 bp, Homo sapiens
atatttctgatataa

SEQ ID NO: 176308 - DNA, 12 bp, Homo sapiens
atattttaactt

SEQ ID NO: 176309 - DNA, 20 bp, Homo sapiens
atattttcaacgcagccctg

SEQ ID NO: 176310 - DNA, 19 bp, Homo sapiens
atattttcttccaagcaaa

SEQ ID NO: 176311 - DNA, 14 bp, Homo sapiens
atattttgtatata

SEQ ID NO: 176312 - DNA, 14 bp, Homo sapiens
atattttgtctaaa

SEQ ID NO: 176313 - DNA, 17 bp, Homo sapiens
atattttgtctaaaatg

SEQ ID NO: 176314 - DNA, 19 bp, Homo sapiens
atatttttatagacaaata

SEQ ID NO: 176315 - DNA, 20 bp, Homo sapiens
atattttttgttaaatgatt

SEQ ID NO: 176316 - DNA, 22 bp, Homo sapiens
atcaaacccggcggtcccctcc

SEQ ID NO: 176317 - DNA, 14 bp, Homo sapiens
atcaaactgaagcc

SEQ ID NO: 176318 - DNA, 15 bp, Homo sapiens
atcaaactgaagcca

SEQ ID NO: 176319 - DNA, 18 bp, Homo sapiens
atcaaagagagaaaataa

SEQ ID NO: 176320 - DNA, 19 bp, Homo sapiens
atcaaagaggttttaaaaa

SEQ ID NO: 176321 - DNA, 20 bp, Homo sapiens
atcaaatatgcaaagcactg

SEQ ID NO: 176322 - DNA, 22 bp, Homo sapiens
atcaaatggaaaggagaggaaa

SEQ ID NO: 176323 - DNA, 20 bp, Homo sapiens
atcaaatttcacgtcgtctt

SEQ ID NO: 176324 - DNA, 16 bp, Homo sapiens
atcaagcacagaagga

SEQ ID NO: 176325 - DNA, 22 bp, Homo sapiens
atcaagttattgacaaactctc

SEQ ID NO: 176326 - DNA, 22 bp, Homo sapiens
atcaagttggcttctaatcaaa

SEQ ID NO: 176327 - DNA, 22 bp, Homo sapiens
atcaatattgtcattcctgtat

SEQ ID NO: 176328 - DNA, 14 bp, Homo sapiens
atcacagaggcttc

SEQ ID NO: 176329 - DNA, 13 bp, Homo sapiens
atcacagcctctg

SEQ ID NO: 176330 - DNA, 13 bp, Homo sapiens
atcaccagacagg

SEQ ID NO: 176331 - DNA, 19 bp, Homo sapiens
atcaccgtgggctccctga

SEQ ID NO: 176332 - DNA, 22 bp, Homo sapiens
atcaccgtgggctccctgactg

SEQ ID NO: 176333 - DNA, 20 bp, Homo sapiens
atcaccttaggcagggaagt

SEQ ID NO: 176334 - DNA, 17 bp, Homo sapiens
atcactggagcaccagg

SEQ ID NO: 176335 - DNA, 18 bp, Homo sapiens
atcactggcaatgaaaaa

SEQ ID NO: 176336 - DNA, 23 bp, Homo sapiens
atcactggcaatgaaaaattctc

SEQ ID NO: 176337 - DNA, 21 bp, Homo sapiens
agttttattgagaattttaaa

SEQ ID NO: 176338 - DNA, 11 bp, Homo sapiens
agttttcagtt

SEQ ID NO: 176339 - DNA, 15 bp, Homo sapiens
agttttcagtttgta

SEQ ID NO: 176340 - DNA, 22 bp, Homo sapiens
agttttcctaagtgattgtatg

SEQ ID NO: 176341 - DNA, 17 bp, Homo sapiens
agttttctgagaaagac

SEQ ID NO: 176342 - DNA, 17 bp, Homo sapiens
agtttttatggggctga

SEQ ID NO: 176343 - DNA, 16 bp, Homo sapiens
agtttttgatagcttt

SEQ ID NO: 176344 - DNA, 17 bp, Homo sapiens
ataaaaaaacaatcatt

SEQ ID NO: 176345 - DNA, 12 bp, Homo sapiens
ataaaaaatgga

SEQ ID NO: 176346 - DNA, 20 bp, Homo sapiens
ataaaaagcctgcaatttca

SEQ ID NO: 176347 - DNA, 13 bp, Homo sapiens
ataaaaataaatt

SEQ ID NO: 176348 - DNA, 14 bp, Homo sapiens
ataaaacattaaga

SEQ ID NO: 176349 - DNA, 17 bp, Homo sapiens
ataaaacattaagaaaa

SEQ ID NO: 176350 - DNA, 22 bp, Homo sapiens
ataaaacattaagaaaatcata

SEQ ID NO: 176351 - DNA, 14 bp, Homo sapiens
ataaaacctttcaa

SEQ ID NO: 176352 - DNA, 20 bp, Homo sapiens
ataaaacctttcaaatttca

SEQ ID NO: 176353 - DNA, 14 bp, Homo sapiens
ataaaataaatata

SEQ ID NO: 176354 - DNA, 15 bp, Homo sapiens
ataaaataaatatat

SEQ ID NO: 176355 - DNA, 21 bp, Homo sapiens
ataaaataaatatatataaac

SEQ ID NO: 176356 - DNA, 19 bp, Homo sapiens
ataaaatgaggacatgttt

SEQ ID NO: 176357 - DNA, 19 bp, Homo sapiens
ataaaatgttgaaaagtca

SEQ ID NO: 176358 - DNA, 18 bp, Homo sapiens
ataaacctaaaaaagata

SEQ ID NO: 176359 - DNA, 20 bp, Homo sapiens
ataaacctaaaaaagatata

SEQ ID NO: 176360 - DNA, 15 bp, Homo sapiens
ataaactgactttat

SEQ ID NO: 176361 - DNA, 18 bp, Homo sapiens
ataaactgactttatcct

SEQ ID NO: 176362 - DNA, 14 bp, Homo sapiens
ataaagatgatcta

SEQ ID NO: 176363 - DNA, 14 bp, Homo sapiens
ataaagatgctctt

SEQ ID NO: 176364 - DNA, 15 bp, Homo sapiens
ataaagttctgtact

SEQ ID NO: 176365 - DNA, 14 bp, Homo sapiens
ataaataaaatgac

SEQ ID NO: 176366 - DNA, 15 bp, Homo sapiens
ataaataatctgtac

SEQ ID NO: 176367 - DNA, 23 bp, Homo sapiens
ataaatatataaaaagaaaagat

SEQ ID NO: 176368 - DNA, 15 bp, Homo sapiens
ataaatatatataaa

SEQ ID NO: 176369 - DNA, 22 bp, Homo sapiens
ataaatatatatatatataaaa

SEQ ID NO: 176370 - DNA, 23 bp, Homo sapiens
ataaatatatatatatataaaat

SEQ ID NO: 176371 - DNA, 15 bp, Homo sapiens
ataaatgtacattaa

SEQ ID NO: 176372 - DNA, 11 bp, Homo sapiens
ataaattattt

SEQ ID NO: 176373 - DNA, 14 bp, Homo sapiens
ataacaattcctct

SEQ ID NO: 176374 - DNA, 15 bp, Homo sapiens
ataacaattcctcta

SEQ ID NO: 176375 - DNA, 11 bp, Homo sapiens
ataacacacat

SEQ ID NO: 176376 - DNA, 16 bp, Homo sapiens
ataacagtaaatgtgc

SEQ ID NO: 176377 - DNA, 19 bp, Homo sapiens
ataaccagctgtaacacag

SEQ ID NO: 176378 - DNA, 13 bp, Homo sapiens
ataacctatatga

SEQ ID NO: 176379 - DNA, 20 bp, Homo sapiens
ataactactccggagacagg

SEQ ID NO: 176380 - DNA, 19 bp, Homo sapiens
ataactcatcataaaataa

SEQ ID NO: 176381 - DNA, 19 bp, Homo sapiens
ataacttaaaaaaatgaca

SEQ ID NO: 176382 - DNA, 16 bp, Homo sapiens
ataacttcttaaaagt

SEQ ID NO: 176383 - DNA, 18 bp, Homo sapiens
ataagaataaaatgttga

SEQ ID NO: 176384 - DNA, 18 bp, Homo sapiens
ataagaatggttgcctta

SEQ ID NO: 176385 - DNA, 17 bp, Homo sapiens
ataagacggatttattt

SEQ ID NO: 176386 - DNA, 16 bp, Homo sapiens
ataagagtagaaactg

SEQ ID NO: 176387 - DNA, 15 bp, Homo sapiens
ataagatatttttca

SEQ ID NO: 176388 - DNA, 18 bp, Homo sapiens
ataagatatttttcatga

SEQ ID NO: 176389 - DNA, 20 bp, Homo sapiens
ataagattagaatgaaaatt

SEQ ID NO: 176390 - DNA, 21 bp, Homo sapiens
ataagattcatatttacttct

SEQ ID NO: 176391 - DNA, 14 bp, Homo sapiens
ataagccagacatc

SEQ ID NO: 176392 - DNA, 15 bp, Homo sapiens
ataagtaaatgctag

SEQ ID NO: 176393 - DNA, 12 bp, Homo sapiens
ataagtaagaaa

SEQ ID NO: 176394 - DNA, 16 bp, Homo sapiens
ataagtactgtgtaca

SEQ ID NO: 176395 - DNA, 16 bp, Homo sapiens
ataagtcatgttcctt

SEQ ID NO: 176396 - DNA, 19 bp, Homo sapiens
ataagtgtacatatgtgct

SEQ ID NO: 176397 - DNA, 20 bp, Homo sapiens
ataagtgtacatatgtgctg

SEQ ID NO: 176398 - DNA, 22 bp, Homo sapiens
ataagtttatttcttaaatcta

SEQ ID NO: 176399 - DNA, 19 bp, Homo sapiens
ataataaacttttttgaaa

SEQ ID NO: 176400 - DNA, 18 bp, Homo sapiens
ataatatttttaatatat

SEQ ID NO: 176401 - DNA, 20 bp, Homo sapiens
ataatctggactcctctgtc

SEQ ID NO: 176402 - DNA, 22 bp, Homo sapiens
ataatctggactcctctgtcca

SEQ ID NO: 176403 - DNA, 21 bp, Homo sapiens
ataatgggattttcttttctt

SEQ ID NO: 176404 - DNA, 18 bp, Homo sapiens
ataatggttgactgggtt

SEQ ID NO: 176405 - DNA, 14 bp, Homo sapiens
ataattcttgtata

SEQ ID NO: 176406 - DNA, 22 bp, Homo sapiens
ataattgacaggattattggaa

SEQ ID NO: 176407 - DNA, 15 bp, Homo sapiens
ataatttaatgcatg

SEQ ID NO: 176408 - DNA, 14 bp, Homo sapiens
ataattttaagaaa

SEQ ID NO: 176409 - DNA, 19 bp, Homo sapiens
ataattttatgaatgtctt

SEQ ID NO: 176410 - DNA, 15 bp, Homo sapiens
ataatttttaaagta

SEQ ID NO: 176411 - DNA, 17 bp, Homo sapiens
ataattttttattcaag

SEQ ID NO: 176412 - DNA, 22 bp, Homo sapiens
atacaagccattctaaggaaat

SEQ ID NO: 176413 - DNA, 13 bp, Homo sapiens
atacacacagtta

SEQ ID NO: 176414 - DNA, 18 bp, Homo sapiens
atacacactcaaatcaag

SEQ ID NO: 176415 - DNA, 18 bp, Homo sapiens
atacaccgggcctggaga

SEQ ID NO: 176416 - DNA, 13 bp, Homo sapiens
atacacttacact

SEQ ID NO: 176417 - DNA, 22 bp, Homo sapiens
atacacttacactttatgcaca

SEQ ID NO: 176418 - DNA, 14 bp, Homo sapiens
atacagaactcttt

SEQ ID NO: 176419 - DNA, 16 bp, Homo sapiens
atacagaactctttca

SEQ ID NO: 176420 - DNA, 16 bp, Homo sapiens
atacagaggcaactgc

SEQ ID NO: 176421 - DNA, 21 bp, Homo sapiens
atacatattttatagaacttc

SEQ ID NO: 176422 - DNA, 16 bp, Homo sapiens
atacatgactcagcat

SEQ ID NO: 176423 - DNA, 15 bp, Homo sapiens
atacatgctgctaat

SEQ ID NO: 176424 - DNA, 17 bp, Homo sapiens
atacattgaattagaaa

SEQ ID NO: 176425 - DNA, 18 bp, Homo sapiens
ataccaaaattatttcag

SEQ ID NO: 176426 - DNA, 19 bp, Homo sapiens
ataccaaaattatttcaga

SEQ ID NO: 176427 - DNA, 16 bp, Homo sapiens
ataccagcgaggaggc

SEQ ID NO: 176428 - DNA, 12 bp, Homo sapiens
ataccagtgtgg

SEQ ID NO: 176429 - DNA, 18 bp, Homo sapiens
atacctgggcatactaat

SEQ ID NO: 176430 - DNA, 16 bp, Homo sapiens
atacgcactacatgtg

SEQ ID NO: 176431 - DNA, 17 bp, Homo sapiens
atacgcactacatgtgg

SEQ ID NO: 176432 - DNA, 20 bp, Homo sapiens
atactatttagtttttgtaa

SEQ ID NO: 176433 - DNA, 23 bp, Homo sapiens
atactatttagtttttgtaattt

SEQ ID NO: 176434 - DNA, 16 bp, Homo sapiens
atactctgcttagaat

SEQ ID NO: 176435 - DNA, 21 bp, Homo sapiens
atactcttaggaagagaaacc

SEQ ID NO: 176436 - DNA, 15 bp, Homo sapiens
atactgcagggccag

SEQ ID NO: 176437 - DNA, 19 bp, Homo sapiens
atactgcagggccaggact

SEQ ID NO: 176438 - DNA, 22 bp, Homo sapiens
atacttcagctcacacatgaga

SEQ ID NO: 176439 - DNA, 14 bp, Homo sapiens
atactttttttcac

SEQ ID NO: 176440 - DNA, 16 bp, Homo sapiens
atagaagctgtagtag

SEQ ID NO: 176441 - DNA, 22 bp, Homo sapiens
atagaatatttattacctctga

SEQ ID NO: 176442 - DNA, 15 bp, Homo sapiens
atagacttaaatctc

SEQ ID NO: 176443 - DNA, 17 bp, Homo sapiens
atagagcaaaattgatg

SEQ ID NO: 176444 - DNA, 21 bp, Homo sapiens
atagagcaaaattgatgtgtt

SEQ ID NO: 176445 - DNA, 16 bp, Homo sapiens
atagaggtaccagcaa

SEQ ID NO: 176446 - DNA, 15 bp, Homo sapiens
atagaggtgagggaa

SEQ ID NO: 176447 - DNA, 22 bp, Homo sapiens
atagaggtgagggaagcctgaa

SEQ ID NO: 176448 - DNA, 15 bp, Homo sapiens
atagagtatatgcac

SEQ ID NO: 176449 - DNA, 21 bp, Homo sapiens
atagagtgtacttaactattc

SEQ ID NO: 176450 - DNA, 23 bp, Homo sapiens
atagattggagccaccatgccca

SEQ ID NO: 176451 - DNA, 14 bp, Homo sapiens
atagcagattttaa

SEQ ID NO: 176452 - DNA, 22 bp, Homo sapiens
atagcagattttaattttgaat

SEQ ID NO: 176453 - DNA, 21 bp, Homo sapiens
atagcatttttgatttatgca

SEQ ID NO: 176454 - DNA, 18 bp, Homo sapiens
atagcccatccctgcctg

SEQ ID NO: 176455 - DNA, 18 bp, Homo sapiens
atagcctgcctcttctct

SEQ ID NO: 176456 - DNA, 22 bp, Homo sapiens
atagctattactgtctggtttt

SEQ ID NO: 176457 - DNA, 17 bp, Homo sapiens
atagcttgtatagtgta

SEQ ID NO: 176458 - DNA, 19 bp, Homo sapiens
atagctttattttttaagt

SEQ ID NO: 176459 - DNA, 17 bp, Homo sapiens
atagcttttattgtata

SEQ ID NO: 176460 - DNA, 18 bp, Homo sapiens
atagcttttattgtataa

SEQ ID NO: 176461 - DNA, 20 bp, Homo sapiens
ataggttgccaataatacac

SEQ ID NO: 176462 - DNA, 13 bp, Homo sapiens
atagtaaaaataa

SEQ ID NO: 176463 - DNA, 17 bp, Homo sapiens
atagtaccaatcatttt

SEQ ID NO: 176464 - DNA, 14 bp, Homo sapiens
atagtactggcatg

SEQ ID NO: 176465 - DNA, 20 bp, Homo sapiens
atagtcaaaccataaacttc

SEQ ID NO: 176466 - DNA, 20 bp, Homo sapiens
atagtgatgtaatcttgaat

SEQ ID NO: 176467 - DNA, 13 bp, Homo sapiens
atagttgtaacta

SEQ ID NO: 176468 - DNA, 20 bp, Homo sapiens
atagttgtaccgcaatgtga

SEQ ID NO: 176469 - DNA, 21 bp, Homo sapiens
atagtttcagatatatatcat

SEQ ID NO: 176470 - DNA, 17 bp, Homo sapiens
atataaaaagaaaagat

SEQ ID NO: 176471 - DNA, 18 bp, Homo sapiens
atataaaaagaaaagata

SEQ ID NO: 176472 - DNA, 20 bp, Homo sapiens
atataaaaagaaaagataaa

SEQ ID NO: 176473 - DNA, 16 bp, Homo sapiens
atataaaataaatata

SEQ ID NO: 176474 - DNA, 18 bp, Homo sapiens
atataaaataaatatata

SEQ ID NO: 176475 - DNA, 12 bp, Homo sapiens
atataaatatat

SEQ ID NO: 176476 - DNA, 14 bp, Homo sapiens
atataaatatatat

SEQ ID NO: 176477 - DNA, 23 bp, Homo sapiens
atataaatatatatatatataaa

SEQ ID NO: 176478 - DNA, 13 bp, Homo sapiens
atataactgcctt

SEQ ID NO: 176479 - DNA, 21 bp, Homo sapiens
atataataaatgtacattaat

SEQ ID NO: 176480 - DNA, 14 bp, Homo sapiens
atataccatttatc

SEQ ID NO: 176481 - DNA, 19 bp, Homo sapiens
atatactcactttctagat

SEQ ID NO: 176482 - DNA, 15 bp, Homo sapiens
atataggttgtgcaa

SEQ ID NO: 176483 - DNA, 13 bp, Homo sapiens
atatataaaataa

SEQ ID NO: 176484 - DNA, 16 bp, Homo sapiens
atatataaaataaata

SEQ ID NO: 176485 - DNA, 19 bp, Homo sapiens
atcacttgagacaaatcta

SEQ ID NO: 176486 - DNA, 14 bp, Homo sapiens
atcacttttcagtg

SEQ ID NO: 176487 - DNA, 15 bp, Homo sapiens
atcagaaaagggaag

SEQ ID NO: 176488 - DNA, 13 bp, Homo sapiens
atcagaacagcag

SEQ ID NO: 176489 - DNA, 22 bp, Homo sapiens
atcagaagaccacaaaaattga

SEQ ID NO: 176490 - DNA, 14 bp, Homo sapiens
atcagaagataact

SEQ ID NO: 176491 - DNA, 12 bp, Homo sapiens
atcagaaggaga

SEQ ID NO: 176492 - DNA, 18 bp, Homo sapiens
atcagaagtttctcagct

SEQ ID NO: 176493 - DNA, 19 bp, Homo sapiens
atcagaccctaccccacca

SEQ ID NO: 176494 - DNA, 11 bp, Homo sapiens
atcagcctctt

SEQ ID NO: 176495 - DNA, 11 bp, Homo sapiens
atcagcctggg

SEQ ID NO: 176496 - DNA, 20 bp, Homo sapiens
atcagcctgggcaatgtgat

SEQ ID NO: 176497 - DNA, 21 bp, Homo sapiens
atcagcctgtctcttccatat

SEQ ID NO: 176498 - DNA, 14 bp, Homo sapiens
atcagctatttact

SEQ ID NO: 176499 - DNA, 15 bp, Homo sapiens
atcagctccttcctg

SEQ ID NO: 176500 - DNA, 21 bp, Homo sapiens
atcagcttctatccttgactt

SEQ ID NO: 176501 - DNA, 15 bp, Homo sapiens
atcaggctatgtatg

SEQ ID NO: 176502 - DNA, 21 bp, Homo sapiens
atcagggcaatcccaacacat

SEQ ID NO: 176503 - DNA, 20 bp, Homo sapiens
atcaggtgcccatccctgga

SEQ ID NO: 176504 - DNA, 19 bp, Homo sapiens
atcagtcataactaaataa

SEQ ID NO: 176505 - DNA, 19 bp, Homo sapiens
atcagtgtgtctaaatttg

SEQ ID NO: 176506 - DNA, 23 bp, Homo sapiens
atcagtgtgtctaaatttgaatg

SEQ ID NO: 176507 - DNA, 17 bp, Homo sapiens
atcagttactcagccct

SEQ ID NO: 176508 - DNA, 15 bp, Homo sapiens
atcataaaacttgat

SEQ ID NO: 176509 - DNA, 13 bp, Homo sapiens
atcataaaataaa

SEQ ID NO: 176510 - DNA, 18 bp, Homo sapiens
atcatcatgtgtgtccac

SEQ ID NO: 176511 - DNA, 16 bp, Homo sapiens
atcatgaaatatgcat

SEQ ID NO: 176512 - DNA, 13 bp, Homo sapiens
atcatgacatgtt

SEQ ID NO: 176513 - DNA, 19 bp, Homo sapiens
atcatggaggtttgaagat

SEQ ID NO: 176514 - DNA, 11 bp, Homo sapiens
atcattaatac

SEQ ID NO: 176515 - DNA, 22 bp, Homo sapiens
atcattataactgaaggagaag

SEQ ID NO: 176516 - DNA, 24 bp, Homo sapiens
atcattctctgtctcatccatcat

SEQ ID NO: 176517 - DNA, 19 bp, Homo sapiens
atcatttattttttacatt

SEQ ID NO: 176518 - DNA, 22 bp, Homo sapiens
atcatttattttttacattatt

SEQ ID NO: 176519 - DNA, 18 bp, Homo sapiens
atcatttgcccttaagga

SEQ ID NO: 176520 - DNA, 23 bp, Homo sapiens
atcattttagaagactctaccag

SEQ ID NO: 176521 - DNA, 19 bp, Homo sapiens
atcattttgcctcttttct

SEQ ID NO: 176522 - DNA, 19 bp, Homo sapiens
atccaagatattttaaaat

SEQ ID NO: 176523 - DNA, 19 bp, Homo sapiens
atccactagtgcaaatcat

SEQ ID NO: 176524 - DNA, 21 bp, Homo sapiens
atccagcctctcccctgatta

SEQ ID NO: 176525 - DNA, 23 bp, Homo sapiens
atccatttcatctatttctgaga

SEQ ID NO: 176526 - DNA, 14 bp, Homo sapiens
atcccacaccctgg

SEQ ID NO: 176527 - DNA, 13 bp, Homo sapiens
atcccagaaatta

SEQ ID NO: 176528 - DNA, 17 bp, Homo sapiens
atcccagaaattagaaa

SEQ ID NO: 176529 - DNA, 22 bp, Homo sapiens
atcccagctacttgggaggctg

SEQ ID NO: 176530 - DNA, 22 bp, Homo sapiens
atcccaggacaccacacccagc

SEQ ID NO: 176531 - DNA, 16 bp, Homo sapiens
atcccattgccctggt

SEQ ID NO: 176532 - DNA, 17 bp, Homo sapiens
atcccattgccctggtt

SEQ ID NO: 176533 - DNA, 12 bp, Homo sapiens
atcccccagact

SEQ ID NO: 176534 - DNA, 14 bp, Homo sapiens
atcccgagcacctc

SEQ ID NO: 176535 - DNA, 12 bp, Homo sapiens
atccctacatgt

SEQ ID NO: 176536 - DNA, 14 bp, Homo sapiens
atccctatgctgcc

SEQ ID NO: 176537 - DNA, 17 bp, Homo sapiens
atccctatgggattcag

SEQ ID NO: 176538 - DNA, 17 bp, Homo sapiens
atccctcacctgtagca

SEQ ID NO: 176539 - DNA, 14 bp, Homo sapiens
atccctctcctccc

SEQ ID NO: 176540 - DNA, 14 bp, Homo sapiens
atccctgccagctc

SEQ ID NO: 176541 - DNA, 13 bp, Homo sapiens
atccctgtttaat

SEQ ID NO: 176542 - DNA, 14 bp, Homo sapiens
atccctgtttaata

SEQ ID NO: 176543 - DNA, 16 bp, Homo sapiens
atccctgtttaatatt

SEQ ID NO: 176544 - DNA, 17 bp, Homo sapiens
atccctgtttaatattt

SEQ ID NO: 176545 - DNA, 18 bp, Homo sapiens
atccctgtttaatattta

SEQ ID NO: 176546 - DNA, 21 bp, Homo sapiens
atccctgtttaatatttaaac

SEQ ID NO: 176547 - DNA, 14 bp, Homo sapiens
atccgaatctcttt

SEQ ID NO: 176548 - DNA, 12 bp, Homo sapiens
atccgaggcagg

SEQ ID NO: 176549 - DNA, 15 bp, Homo sapiens
atccggcagcctgga

SEQ ID NO: 176550 - DNA, 16 bp, Homo sapiens
atccgtagttccctga

SEQ ID NO: 176551 - DNA, 12 bp, Homo sapiens
atcctaatgaat

SEQ ID NO: 176552 - DNA, 20 bp, Homo sapiens
atcctatcagcctgtctctt

SEQ ID NO: 176553 - DNA, 12 bp, Homo sapiens
atcctatgtttt

SEQ ID NO: 176554 - DNA, 19 bp, Homo sapiens
atcctccacgttctgctca

SEQ ID NO: 176555 - DNA, 18 bp, Homo sapiens
atcctctgagtgtgacca

SEQ ID NO: 176556 - DNA, 14 bp, Homo sapiens
atcctctggctggc

SEQ ID NO: 176557 - DNA, 20 bp, Homo sapiens
atcctgcagcctcctcctga

SEQ ID NO: 176558 - DNA, 22 bp, Homo sapiens
atcctggacatgaagattcttt

SEQ ID NO: 176559 - DNA, 14 bp, Homo sapiens
atcctgtcctcagc

SEQ ID NO: 176560 - DNA, 18 bp, Homo sapiens
atcctgtcctcagcttct

SEQ ID NO: 176561 - DNA, 15 bp, Homo sapiens
atcctttctattgaa

SEQ ID NO: 176562 - DNA, 17 bp, Homo sapiens
atccttttatgttattt

SEQ ID NO: 176563 - DNA, 12 bp, Homo sapiens
atcgcctttccc

SEQ ID NO: 176564 - DNA, 17 bp, Homo sapiens
atcgcttcatgtaacta

SEQ ID NO: 176565 - DNA, 15 bp, Homo sapiens
atcggagcctcctct

SEQ ID NO: 176566 - DNA, 21 bp, Homo sapiens
atcggatctggggctctggga

SEQ ID NO: 176567 - DNA, 19 bp, Homo sapiens
atcggcccacagctcccac

SEQ ID NO: 176568 - DNA, 16 bp, Homo sapiens
atcgtaatgtacagat

SEQ ID NO: 176569 - DNA, 23 bp, Homo sapiens
atcgtgccgttactctccaacct

SEQ ID NO: 176570 - DNA, 15 bp, Homo sapiens
atctaacctcatctt

SEQ ID NO: 176571 - DNA, 20 bp, Homo sapiens
atctaaggatgtcacagggc

SEQ ID NO: 176572 - DNA, 13 bp, Homo sapiens
atctaagtgatat

SEQ ID NO: 176573 - DNA, 17 bp, Homo sapiens
atctaagtgatataaat

SEQ ID NO: 176574 - DNA, 14 bp, Homo sapiens
atctacccaaagga

SEQ ID NO: 176575 - DNA, 16 bp, Homo sapiens
atctactcagaaattt

SEQ ID NO: 176576 - DNA, 15 bp, Homo sapiens
atctatcaatagtca

SEQ ID NO: 176577 - DNA, 23 bp, Homo sapiens
atctattgctggcaaagacagaa

SEQ ID NO: 176578 - DNA, 15 bp, Homo sapiens
atctatttctgagaa

SEQ ID NO: 176579 - DNA, 15 bp, Homo sapiens
atctcaaaactgcac

SEQ ID NO: 176580 - DNA, 14 bp, Homo sapiens
atctcagggcctgg

SEQ ID NO: 176581 - DNA, 23 bp, Homo sapiens
atctcaggggccagaggaactgt

SEQ ID NO: 176582 - DNA, 17 bp, Homo sapiens
atctcataggttgccaa

SEQ ID NO: 176583 - DNA, 22 bp, Homo sapiens
atctcatggagaagcagaaata

SEQ ID NO: 176584 - DNA, 17 bp, Homo sapiens
atctcattgcttacaag

SEQ ID NO: 176585 - DNA, 13 bp, Homo sapiens
atctccacctgct

SEQ ID NO: 176586 - DNA, 15 bp, Homo sapiens
atctccacctgctcc

SEQ ID NO: 176587 - DNA, 15 bp, Homo sapiens
atctccactccagat

SEQ ID NO: 176588 - DNA, 19 bp, Homo sapiens
atctccctgccgcctcaat

SEQ ID NO: 176589 - DNA, 20 bp, Homo sapiens
atctcctgccttcctcctgg

SEQ ID NO: 176590 - DNA, 14 bp, Homo sapiens
atctctatttaata

SEQ ID NO: 176591 - DNA, 16 bp, Homo sapiens
atctcttattttacaa

SEQ ID NO: 176592 - DNA, 14 bp, Homo sapiens
atctgagaatcttt

SEQ ID NO: 176593 - DNA, 11 bp, Homo sapiens
atctgcagaag

SEQ ID NO: 176594 - DNA, 13 bp, Homo sapiens
atctgcagaagga

SEQ ID NO: 176595 - DNA, 14 bp, Homo sapiens
atctgcaggcagac

SEQ ID NO: 176596 - DNA, 15 bp, Homo sapiens
atctgcaggcagaca

SEQ ID NO: 176597 - DNA, 19 bp, Homo sapiens
atctgcaggcagacacgga

SEQ ID NO: 176598 - DNA, 19 bp, Homo sapiens
atctgcattttcaccccac

SEQ ID NO: 176599 - DNA, 19 bp, Homo sapiens
atctgcttacaattccctg

SEQ ID NO: 176600 - DNA, 16 bp, Homo sapiens
atctggactcctctgt

SEQ ID NO: 176601 - DNA, 19 bp, Homo sapiens
atctggactcctctgtcca

SEQ ID NO: 176602 - DNA, 22 bp, Homo sapiens
atctggactcctctgtccaggc

SEQ ID NO: 176603 - DNA, 17 bp, Homo sapiens
atctgggaccctttcct

SEQ ID NO: 176604 - DNA, 15 bp, Homo sapiens
atctgtacgtaagaa

SEQ ID NO: 176605 - DNA, 19 bp, Homo sapiens
atctgtataagtaagaaaa

SEQ ID NO: 176606 - DNA, 20 bp, Homo sapiens
atctgtataagtaagaaaat

SEQ ID NO: 176607 - DNA, 16 bp, Homo sapiens
atctgtgaattcagat

SEQ ID NO: 176608 - DNA, 13 bp, Homo sapiens
atctgtgtcttgt

SEQ ID NO: 176609 - DNA, 14 bp, Homo sapiens
atctgtgtcttgtt

SEQ ID NO: 176610 - DNA, 13 bp, Homo sapiens
atctgtgtgaaaa

SEQ ID NO: 176611 - DNA, 15 bp, Homo sapiens
atctgttgttttgtt

SEQ ID NO: 176612 - DNA, 13 bp, Homo sapiens
atcttattcacat

SEQ ID NO: 176613 - DNA, 19 bp, Homo sapiens
atcttctccatctggcagg

SEQ ID NO: 176614 - DNA, 14 bp, Homo sapiens
atcttcttcaccat

SEQ ID NO: 176615 - DNA, 24 bp, Homo sapiens
atcttgcaccccaaagctttcctg

SEQ ID NO: 176616 - DNA, 17 bp, Homo sapiens
atctttcacacttccac

SEQ ID NO: 176617 - DNA, 22 bp, Homo sapiens
atctttcacacttccaccagcc

SEQ ID NO: 176618 - DNA, 11 bp, Homo sapiens
atctttcttct

SEQ ID NO: 176619 - DNA, 19 bp, Homo sapiens
atctttcttctattttatt

SEQ ID NO: 176620 - DNA, 15 bp, Homo sapiens
atgaaaatgtcttgt

SEQ ID NO: 176621 - DNA, 19 bp, Homo sapiens
atgaaagatggctgtgcct

SEQ ID NO: 176622 - DNA, 15 bp, Homo sapiens
atgaaagcagggact

SEQ ID NO: 176623 - DNA, 23 bp, Homo sapiens
atgaaattttctagactttctgt

SEQ ID NO: 176624 - DNA, 16 bp, Homo sapiens
atgaacggtgagcatt

SEQ ID NO: 176625 - DNA, 17 bp, Homo sapiens
atgaactttctcttcat

SEQ ID NO: 176626 - DNA, 17 bp, Homo sapiens
atgaagggaaaggatat

SEQ ID NO: 176627 - DNA, 20 bp, Homo sapiens
atgaaggttaggatttaaca

SEQ ID NO: 176628 - DNA, 22 bp, Homo sapiens
atgaaggttaggatttaacagt

SEQ ID NO: 176629 - DNA, 21 bp, Homo sapiens
atgaagtactcatacatgtta

SEQ ID NO: 176630 - DNA, 17 bp, Homo sapiens
atgaataaagacaccta

SEQ ID NO: 176631 - DNA, 16 bp, Homo sapiens
atgacagctgtccctg

SEQ ID NO: 176632 - DNA, 17 bp, Homo sapiens
atgacatgttatatatt

SEQ ID NO: 176633 - DNA, 18 bp, Homo sapiens
atgacatttatttttcat

SEQ ID NO: 176634 - DNA, 20 bp, Homo sapiens
atatataaaataaatatata

SEQ ID NO: 176635 - DNA, 21 bp, Homo sapiens
atatataaacctaaaaaagat

SEQ ID NO: 176636 - DNA, 14 bp, Homo sapiens
atatatataaacct

SEQ ID NO: 176637 - DNA, 13 bp, Homo sapiens
atatatatataaa

SEQ ID NO: 176638 - DNA, 14 bp, Homo sapiens
atatatatatataa

SEQ ID NO: 176639 - DNA, 16 bp, Homo sapiens
atatatatatatataa

SEQ ID NO: 176640 - DNA, 13 bp, Homo sapiens
atatatcatattg

SEQ ID NO: 176641 - DNA, 20 bp, Homo sapiens
atatatcatattggtattca

SEQ ID NO: 176642 - DNA, 15 bp, Homo sapiens
atatatcatgagtga

SEQ ID NO: 176643 - DNA, 15 bp, Homo sapiens
atatatctgcttcag

SEQ ID NO: 176644 - DNA, 18 bp, Homo sapiens
atatatctgcttcagtgg

SEQ ID NO: 176645 - DNA, 14 bp, Homo sapiens
atatatggcagagt

SEQ ID NO: 176646 - DNA, 20 bp, Homo sapiens
atatatggcagagttgtaaa

SEQ ID NO: 176647 - DNA, 22 bp, Homo sapiens
atatatggcagagttgtaaata

SEQ ID NO: 176648 - DNA, 19 bp, Homo sapiens
atatattggtaacatcctt

SEQ ID NO: 176649 - DNA, 21 bp, Homo sapiens
atatattggtaacatcctttc

SEQ ID NO: 176650 - DNA, 13 bp, Homo sapiens
atatatttaatga

SEQ ID NO: 176651 - DNA, 12 bp, Homo sapiens
atatatttataa

SEQ ID NO: 176652 - DNA, 15 bp, Homo sapiens
atatcaatttaaaaa

SEQ ID NO: 176653 - DNA, 14 bp, Homo sapiens
atatcagaaaaggg

SEQ ID NO: 176654 - DNA, 18 bp, Homo sapiens
atatcatcagcatacctt

SEQ ID NO: 176655 - DNA, 21 bp, Homo sapiens
atatcatcagcatacctttat

SEQ ID NO: 176656 - DNA, 23 bp, Homo sapiens
atatcattataactgaaggagaa

SEQ ID NO: 176657 - DNA, 23 bp, Homo sapiens
atatcatttattttttacattat

SEQ ID NO: 176658 - DNA, 14 bp, Homo sapiens
atatccaccacctc

SEQ ID NO: 176659 - DNA, 15 bp, Homo sapiens
atatccctacatgta

SEQ ID NO: 176660 - DNA, 14 bp, Homo sapiens
atatgacagctgtc

SEQ ID NO: 176661 - DNA, 22 bp, Homo sapiens
atatgagcttccttctgtgaaa

SEQ ID NO: 176662 - DNA, 14 bp, Homo sapiens
atatgatatgtaaa

SEQ ID NO: 176663 - DNA, 21 bp, Homo sapiens
atatgattagtaaagaaatga

SEQ ID NO: 176664 - DNA, 22 bp, Homo sapiens
atatgattttatttgacaaaat

SEQ ID NO: 176665 - DNA, 14 bp, Homo sapiens
atatgcaaagcact

SEQ ID NO: 176666 - DNA, 23 bp, Homo sapiens
atatgcaaagcactgacttctaa

SEQ ID NO: 176667 - DNA, 19 bp, Homo sapiens
atgattaaccacttcagct

SEQ ID NO: 176668 - DNA, 16 bp, Homo sapiens
atgattaattcacctt

SEQ ID NO: 176669 - DNA, 15 bp, Homo sapiens
atgattagtaaagaa

SEQ ID NO: 176670 - DNA, 16 bp, Homo sapiens
atgattcagtgttaaa

SEQ ID NO: 176671 - DNA, 16 bp, Homo sapiens
atgattggattattca

SEQ ID NO: 176672 - DNA, 21 bp, Homo sapiens
atgattggattattcatttaa

SEQ ID NO: 176673 - DNA, 14 bp, Homo sapiens
atgatttcatttca

SEQ ID NO: 176674 - DNA, 13 bp, Homo sapiens
atgatttttagat

SEQ ID NO: 176675 - DNA, 15 bp, Homo sapiens
atgcaaagaaaatca

SEQ ID NO: 176676 - DNA, 12 bp, Homo sapiens
atgcaaagcact

SEQ ID NO: 176677 - DNA, 13 bp, Homo sapiens
atgcaaagcactg

SEQ ID NO: 176678 - DNA, 15 bp, Homo sapiens
atgcaaagcactgac

SEQ ID NO: 176679 - DNA, 19 bp, Homo sapiens
atgcaatttattaaaatga

SEQ ID NO: 176680 - DNA, 22 bp, Homo sapiens
atgcacacaaaacaaccctaga

SEQ ID NO: 176681 - DNA, 19 bp, Homo sapiens
atgcacttataattttcct

SEQ ID NO: 176682 - DNA, 17 bp, Homo sapiens
atgcatccattcctcag

SEQ ID NO: 176683 - DNA, 18 bp, Homo sapiens
atgcatccattcctcagg

SEQ ID NO: 176684 - DNA, 23 bp, Homo sapiens
atgcatccattcctcagggacag

SEQ ID NO: 176685 - DNA, 12 bp, Homo sapiens
atgcatggaaac

SEQ ID NO: 176686 - DNA, 15 bp, Homo sapiens
atgccactaaattga

SEQ ID NO: 176687 - DNA, 22 bp, Homo sapiens
atgccagagacggaagcctttt

SEQ ID NO: 176688 - DNA, 12 bp, Homo sapiens
atgccaggacac

SEQ ID NO: 176689 - DNA, 16 bp, Homo sapiens
atgccatcatctcctg

SEQ ID NO: 176690 - DNA, 21 bp, Homo sapiens
atgcccagggccactctgcct

SEQ ID NO: 176691 - DNA, 15 bp, Homo sapiens
atgcccttaaatcat

SEQ ID NO: 176692 - DNA, 22 bp, Homo sapiens
atgccgtggattgcacgtggcc

SEQ ID NO: 176693 - DNA, 12 bp, Homo sapiens
atgcctccaccg

SEQ ID NO: 176694 - DNA, 21 bp, Homo sapiens
atgcctccaccgctgcctaag

SEQ ID NO: 176695 - DNA, 22 bp, Homo sapiens
atgcctctgccaaaggatgtga

SEQ ID NO: 176696 - DNA, 15 bp, Homo sapiens
atgccttctccagac

SEQ ID NO: 176697 - DNA, 14 bp, Homo sapiens
atgctaaagaaaaa

SEQ ID NO: 176698 - DNA, 16 bp, Homo sapiens
atgctaacatctaaaa

SEQ ID NO: 176699 - DNA, 14 bp, Homo sapiens
atgctcaagttttt

SEQ ID NO: 176700 - DNA, 13 bp, Homo sapiens
atgctctctgcag

SEQ ID NO: 176701 - DNA, 21 bp, Homo sapiens
atgctctctgcagccagccca

SEQ ID NO: 176702 - DNA, 23 bp, Homo sapiens
atgctctgtgcgagggttactat

SEQ ID NO: 176703 - DNA, 16 bp, Homo sapiens
atgctgaaacaggaga

SEQ ID NO: 176704 - DNA, 20 bp, Homo sapiens
atgctgactgtactcctccc

SEQ ID NO: 176705 - DNA, 19 bp, Homo sapiens
atgctgctaattcaaagct

SEQ ID NO: 176706 - DNA, 12 bp, Homo sapiens
atgctggagaag

SEQ ID NO: 176707 - DNA, 14 bp, Homo sapiens
atgctgttgcctca

SEQ ID NO: 176708 - DNA, 16 bp, Homo sapiens
atgctgttgcctcatc

SEQ ID NO: 176709 - DNA, 13 bp, Homo sapiens
atgcttctcactg

SEQ ID NO: 176710 - DNA, 15 bp, Homo sapiens
atgcttggcttctca

SEQ ID NO: 176711 - DNA, 20 bp, Homo sapiens
atggaaactgttgccagaga

SEQ ID NO: 176712 - DNA, 16 bp, Homo sapiens
atggaacataaaatac

SEQ ID NO: 176713 - DNA, 16 bp, Homo sapiens
atggaaccgcaggaag

SEQ ID NO: 176714 - DNA, 18 bp, Homo sapiens
atggaaccgcaggaagct

SEQ ID NO: 176715 - DNA, 17 bp, Homo sapiens
atggaagattttaaatt

SEQ ID NO: 176716 - DNA, 15 bp, Homo sapiens
atggaagcttccagt

SEQ ID NO: 176717 - DNA, 17 bp, Homo sapiens
atggaaggtttgtatat

SEQ ID NO: 176718 - DNA, 17 bp, Homo sapiens
atggaatacagtgttat

SEQ ID NO: 176719 - DNA, 16 bp, Homo sapiens
atggaatgctgtgtta

SEQ ID NO: 176720 - DNA, 17 bp, Homo sapiens
atggacactccagtgcc

SEQ ID NO: 176721 - DNA, 19 bp, Homo sapiens
atggacatgatcttcttta

SEQ ID NO: 176722 - DNA, 12 bp, Homo sapiens
atggagcccagg

SEQ ID NO: 176723 - DNA, 13 bp, Homo sapiens
atggaggagaaga

SEQ ID NO: 176724 - DNA, 16 bp, Homo sapiens
atggaggaggaggcaa

SEQ ID NO: 176725 - DNA, 12 bp, Homo sapiens
atggaggcacac

SEQ ID NO: 176726 - DNA, 13 bp, Homo sapiens
atggcagaaggca

SEQ ID NO: 176727 - DNA, 15 bp, Homo sapiens
atggcagaaggcaaa

SEQ ID NO: 176728 - DNA, 20 bp, Homo sapiens
atggcagaaggcaaacccat

SEQ ID NO: 176729 - DNA, 17 bp, Homo sapiens
atggcagagttgtaaat

SEQ ID NO: 176730 - DNA, 21 bp, Homo sapiens
atggcagagttgtaaatatat

SEQ ID NO: 176731 - DNA, 11 bp, Homo sapiens
atggccctggg

SEQ ID NO: 176732 - DNA, 19 bp, Homo sapiens
atggctaagcaaaatgtga

SEQ ID NO: 176733 - DNA, 14 bp, Homo sapiens
atggctataaatat

SEQ ID NO: 176734 - DNA, 18 bp, Homo sapiens
atggctgactttgctctt

SEQ ID NO: 176735 - DNA, 17 bp, Homo sapiens
atggctgtgcctctgcc

SEQ ID NO: 176736 - DNA, 18 bp, Homo sapiens
atggctgtgcctctgcct

SEQ ID NO: 176737 - DNA, 20 bp, Homo sapiens
atggctgtgcctctgcctgt

SEQ ID NO: 176738 - DNA, 14 bp, Homo sapiens
atgggaaagcattg

SEQ ID NO: 176739 - DNA, 20 bp, Homo sapiens
atgggaaagcattgtaaatg

SEQ ID NO: 176740 - DNA, 17 bp, Homo sapiens
atgggaaggagggaggt

SEQ ID NO: 176741 - DNA, 13 bp, Homo sapiens
atgggactgggag

SEQ ID NO: 176742 - DNA, 15 bp, Homo sapiens
atgggactgggaggg

SEQ ID NO: 176743 - DNA, 16 bp, Homo sapiens
atgggactgggagggc

SEQ ID NO: 176744 - DNA, 18 bp, Homo sapiens
atgggagacccttgacac

SEQ ID NO: 176745 - DNA, 23 bp, Homo sapiens
atgggagagtagatggtgaaatt

SEQ ID NO: 176746 - DNA, 17 bp, Homo sapiens
atgggagccgggtctgc

SEQ ID NO: 176747 - DNA, 20 bp, Homo sapiens
atgggagccgggtctgcctc

SEQ ID NO: 176748 - DNA, 23 bp, Homo sapiens
atgggaggctcacccccttctcc

SEQ ID NO: 176749 - DNA, 21 bp, Homo sapiens
atgggggagtctgaagcagat

SEQ ID NO: 176750 - DNA, 17 bp, Homo sapiens
atgggggcactgaggac

SEQ ID NO: 176751 - DNA, 19 bp, Homo sapiens
atggtataatggttgactg

SEQ ID NO: 176752 - DNA, 17 bp, Homo sapiens
atggtcacgcacctggg

SEQ ID NO: 176753 - DNA, 14 bp, Homo sapiens
atggtctcagaaac

SEQ ID NO: 176754 - DNA, 18 bp, Homo sapiens
atggtctcagaaaccaaa

SEQ ID NO: 176755 - DNA, 16 bp, Homo sapiens
atggtgatgaaatgta

SEQ ID NO: 176756 - DNA, 21 bp, Homo sapiens
atgtaaaagagtcatctggta

SEQ ID NO: 176757 - DNA, 14 bp, Homo sapiens
atgtaaacaggaga

SEQ ID NO: 176758 - DNA, 17 bp, Homo sapiens
atgtaaacagtgcctgc

SEQ ID NO: 176759 - DNA, 23 bp, Homo sapiens
atgtaaacataattcttgtatat

SEQ ID NO: 176760 - DNA, 14 bp, Homo sapiens
atgtaaactgtgca

SEQ ID NO: 176761 - DNA, 13 bp, Homo sapiens
atgtaaatgtgca

SEQ ID NO: 176762 - DNA, 14 bp, Homo sapiens
atgtaaatgtgcat

SEQ ID NO: 176763 - DNA, 16 bp, Homo sapiens
atgtaagctgaaaata

SEQ ID NO: 176764 - DNA, 15 bp, Homo sapiens
atgtaatcaatgttt

SEQ ID NO: 176765 - DNA, 16 bp, Homo sapiens
atgtaatcaatgtttc

SEQ ID NO: 176766 - DNA, 21 bp, Homo sapiens
atgtacaaaatcgattggctt

SEQ ID NO: 176767 - DNA, 12 bp, Homo sapiens
atgtagaggaga

SEQ ID NO: 176768 - DNA, 13 bp, Homo sapiens
atgtagaggagaa

SEQ ID NO: 176769 - DNA, 19 bp, Homo sapiens
atgtagaggagaaactgga

SEQ ID NO: 176770 - DNA, 21 bp, Homo sapiens
atgtagcaaaatacatgacat

SEQ ID NO: 176771 - DNA, 22 bp, Homo sapiens
atgtaggaaagaccatttttcc

SEQ ID NO: 176772 - DNA, 18 bp, Homo sapiens
atgtagggtaaggtgcct

SEQ ID NO: 176773 - DNA, 16 bp, Homo sapiens
atgtatgtttacatat

SEQ ID NO: 176774 - DNA, 17 bp, Homo sapiens
atgtatgtttacatatc

SEQ ID NO: 176775 - DNA, 18 bp, Homo sapiens
atgtatgtttacatatca

SEQ ID NO: 176776 - DNA, 16 bp, Homo sapiens
atgtattgcacattgt

SEQ ID NO: 176777 - DNA, 13 bp, Homo sapiens
atgtcaccacctt

SEQ ID NO: 176778 - DNA, 19 bp, Homo sapiens
atgtcaccaccttcccagc

SEQ ID NO: 176779 - DNA, 19 bp, Homo sapiens
atgtcaccggatcctgggt

SEQ ID NO: 176780 - DNA, 20 bp, Homo sapiens
atgtcaccggatcctgggtg

SEQ ID NO: 176781 - DNA, 17 bp, Homo sapiens
atgtcagtaccttcaaa

SEQ ID NO: 176782 - DNA, 21 bp, Homo sapiens
atgtcatgtgtacaaaagttt

SEQ ID NO: 176783 - DNA, 16 bp, Homo sapiens
atgtccacagatgcct

SEQ ID NO: 176784 - DNA, 20 bp, Homo sapiens
atgtccacagatgcctccac

SEQ ID NO: 176785 - DNA, 18 bp, Homo sapiens
atgtccccaaacctgcaa

SEQ ID NO: 176786 - DNA, 15 bp, Homo sapiens
atgtctatttaagcc

SEQ ID NO: 176787 - DNA, 22 bp, Homo sapiens
atgtctcaggtccctgcagggc

SEQ ID NO: 176788 - DNA, 21 bp, Homo sapiens
aaattatttgtgtaatagaaa

SEQ ID NO: 176789 - DNA, 15 bp, Homo sapiens
aaattattttaaaca

SEQ ID NO: 176790 - DNA, 16 bp, Homo sapiens
aaattattttaaacaa

SEQ ID NO: 176791 - DNA, 16 bp, Homo sapiens
aaattccccaccctga

SEQ ID NO: 176792 - DNA, 21 bp, Homo sapiens
aaattctattctgatcttatt

SEQ ID NO: 176793 - DNA, 20 bp, Homo sapiens
aaattctcagtcagtaattg

SEQ ID NO: 176794 - DNA, 22 bp, Homo sapiens
aaattgacacttaaaaatggtt

SEQ ID NO: 176795 - DNA, 13 bp, Homo sapiens
aaattgctccttg

SEQ ID NO: 176796 - DNA, 13 bp, Homo sapiens
aaattgcttgaaa

SEQ ID NO: 176797 - DNA, 14 bp, Homo sapiens
aaatttgatttcta

SEQ ID NO: 176798 - DNA, 15 bp, Homo sapiens
aaatttggttctaat

SEQ ID NO: 176799 - DNA, 18 bp, Homo sapiens
aaatttgttataatgaat

SEQ ID NO: 176800 - DNA, 19 bp, Homo sapiens
aaatttgttattttgcaac

SEQ ID NO: 176801 - DNA, 12 bp, Homo sapiens
aaattttattcc

SEQ ID NO: 176802 - DNA, 20 bp, Homo sapiens
aaattttctagactttctgt

SEQ ID NO: 176803 - DNA, 13 bp, Homo sapiens
aacaaaaagaaca

SEQ ID NO: 176804 - DNA, 18 bp, Homo sapiens
aacaatgaagataaaaag

SEQ ID NO: 176805 - DNA, 13 bp, Homo sapiens
aacaattttaatg

SEQ ID NO: 176806 - DNA, 17 bp, Homo sapiens
aacacaaacccccactc

SEQ ID NO: 176807 - DNA, 20 bp, Homo sapiens
aacacactgaggcagggaag

SEQ ID NO: 176808 - DNA, 15 bp, Homo sapiens
aacacagcaagggtg

SEQ ID NO: 176809 - DNA, 19 bp, Homo sapiens
aacacagcgagactccgtc

SEQ ID NO: 176810 - DNA, 15 bp, Homo sapiens
atgtggtgggacagg

SEQ ID NO: 176811 - DNA, 21 bp, Homo sapiens
atgtggtgggacagggaccca

SEQ ID NO: 176812 - DNA, 15 bp, Homo sapiens
atgtggttacacact

SEQ ID NO: 176813 - DNA, 20 bp, Homo sapiens
atgtggttgcaaggccgctg

SEQ ID NO: 176814 - DNA, 13 bp, Homo sapiens
atgtggtttatag

SEQ ID NO: 176815 - DNA, 11 bp, Homo sapiens
atgtgtgccat

SEQ ID NO: 176816 - DNA, 18 bp, Homo sapiens
atgtgtgcgagtgtgtgc

SEQ ID NO: 176817 - DNA, 15 bp, Homo sapiens
atgtgtggcagattt

SEQ ID NO: 176818 - DNA, 23 bp, Homo sapiens
atgtgtgtccacgactgtctcca

SEQ ID NO: 176819 - DNA, 11 bp, Homo sapiens
atgtgtgtgca

SEQ ID NO: 176820 - DNA, 15 bp, Homo sapiens
atgttaagttacttc

SEQ ID NO: 176821 - DNA, 17 bp, Homo sapiens
atgttaagttacttcac

SEQ ID NO: 176822 - DNA, 23 bp, Homo sapiens
atgttaagttacttcactttaat

SEQ ID NO: 176823 - DNA, 20 bp, Homo sapiens
atgttacatctgttttaaat

SEQ ID NO: 176824 - DNA, 14 bp, Homo sapiens
atgttacattatta

SEQ ID NO: 176825 - DNA, 18 bp, Homo sapiens
atgttaggaaaatttcac

SEQ ID NO: 176826 - DNA, 19 bp, Homo sapiens
atgttaggaaaatttcaca

SEQ ID NO: 176827 - DNA, 17 bp, Homo sapiens
atgttatatattttttg

SEQ ID NO: 176828 - DNA, 15 bp, Homo sapiens
atgttattgcataat

SEQ ID NO: 176829 - DNA, 18 bp, Homo sapiens
atgttatttatatattgg

SEQ ID NO: 176830 - DNA, 20 bp, Homo sapiens
atgttatttatatattggta

SEQ ID NO: 176831 - DNA, 22 bp, Homo sapiens
atgttcaactggagacactatt

SEQ ID NO: 176832 - DNA, 18 bp, Homo sapiens
atgttcatcaatgaatga

SEQ ID NO: 176833 - DNA, 19 bp, Homo sapiens
atgttcatcccatgatgta

SEQ ID NO: 176834 - DNA, 16 bp, Homo sapiens
atgttcctagtgaaag

SEQ ID NO: 176835 - DNA, 17 bp, Homo sapiens
atgttcctagtgaaaga

SEQ ID NO: 176836 - DNA, 19 bp, Homo sapiens
atgttctaagtctttccat

SEQ ID NO: 176837 - DNA, 13 bp, Homo sapiens
atgttctggccct

SEQ ID NO: 176838 - DNA, 16 bp, Homo sapiens
atgttgaaaagtcaaa

SEQ ID NO: 176839 - DNA, 19 bp, Homo sapiens
atgttgaaaagtcaaactg

SEQ ID NO: 176840 - DNA, 22 bp, Homo sapiens
atgttgaatgcccacaggcaaa

SEQ ID NO: 176841 - DNA, 22 bp, Homo sapiens
atgttgcacacccactcagctc

SEQ ID NO: 176842 - DNA, 14 bp, Homo sapiens
atgttgtcaaagag

SEQ ID NO: 176843 - DNA, 15 bp, Homo sapiens
atgttgtgatgtatt

SEQ ID NO: 176844 - DNA, 12 bp, Homo sapiens
atgttgttattt

SEQ ID NO: 176845 - DNA, 13 bp, Homo sapiens
atgttgttattta

SEQ ID NO: 176846 - DNA, 16 bp, Homo sapiens
atgtttacactctttg

SEQ ID NO: 176847 - DNA, 21 bp, Homo sapiens
atgtttacactctttgtaaga

SEQ ID NO: 176848 - DNA, 22 bp, Homo sapiens
atgtttacactctttgtaagag

SEQ ID NO: 176849 - DNA, 13 bp, Homo sapiens
atgtttatttata

SEQ ID NO: 176850 - DNA, 22 bp, Homo sapiens
atgtttcttctaggttctaaaa

SEQ ID NO: 176851 - DNA, 14 bp, Homo sapiens
atgttttgacattt

SEQ ID NO: 176852 - DNA, 21 bp, Homo sapiens
atgtttttgttttctttgaat

SEQ ID NO: 176853 - DNA, 15 bp, Homo sapiens
attaaaaatataaaa

SEQ ID NO: 176854 - DNA, 17 bp, Homo sapiens
attaaaaatataaaact

SEQ ID NO: 176855 - DNA, 14 bp, Homo sapiens
attaaaaatatgga

SEQ ID NO: 176856 - DNA, 15 bp, Homo sapiens
attaaaagaatattt

SEQ ID NO: 176857 - DNA, 15 bp, Homo sapiens
attaaagactccagt

SEQ ID NO: 176858 - DNA, 20 bp, Homo sapiens
attaaatatgttagcaaaga

SEQ ID NO: 176859 - DNA, 18 bp, Homo sapiens
attaaattttgagttcta

SEQ ID NO: 176860 - DNA, 18 bp, Homo sapiens
attaaccacttcagctga

SEQ ID NO: 176861 - DNA, 13 bp, Homo sapiens
attaacctctgca

SEQ ID NO: 176862 - DNA, 13 bp, Homo sapiens
attaagaaaatca

SEQ ID NO: 176863 - DNA, 16 bp, Homo sapiens
attaagaaaatcatat

SEQ ID NO: 176864 - DNA, 16 bp, Homo sapiens
attaagatttccaagt

SEQ ID NO: 176865 - DNA, 22 bp, Homo sapiens
attaataaaaaatggaaagaat

SEQ ID NO: 176866 - DNA, 23 bp, Homo sapiens
attaatcaatcatctgtgtgaaa

SEQ ID NO: 176867 - DNA, 13 bp, Homo sapiens
attacacaaaaca

SEQ ID NO: 176868 - DNA, 18 bp, Homo sapiens
attacacaaaacaaatgc

SEQ ID NO: 176869 - DNA, 21 bp, Homo sapiens
attacaccagcctcgtcttca

SEQ ID NO: 176870 - DNA, 17 bp, Homo sapiens
attacagaggaagttat

SEQ ID NO: 176871 - DNA, 19 bp, Homo sapiens
attacagatgggcaaatta

SEQ ID NO: 176872 - DNA, 16 bp, Homo sapiens
attacatgtaaaacat

SEQ ID NO: 176873 - DNA, 18 bp, Homo sapiens
attacatttccaaatgaa

SEQ ID NO: 176874 - DNA, 12 bp, Homo sapiens
attaccagggac

SEQ ID NO: 176875 - DNA, 18 bp, Homo sapiens
attaccgcgttgtaaaat

SEQ ID NO: 176876 - DNA, 19 bp, Homo sapiens
attaccgcgttgtaaaata

SEQ ID NO: 176877 - DNA, 13 bp, Homo sapiens
attacctcctgag

SEQ ID NO: 176878 - DNA, 14 bp, Homo sapiens
attagaatgaaaat

SEQ ID NO: 176879 - DNA, 20 bp, Homo sapiens
attagagattacctcctgag

SEQ ID NO: 176880 - DNA, 17 bp, Homo sapiens
attagagtgtctttcca

SEQ ID NO: 176881 - DNA, 18 bp, Homo sapiens
attagccgggcatggtgg

SEQ ID NO: 176882 - DNA, 13 bp, Homo sapiens
attagtaacatgt

SEQ ID NO: 176883 - DNA, 17 bp, Homo sapiens
attagtaacatgtgtta

SEQ ID NO: 176884 - DNA, 21 bp, Homo sapiens
attataactgaaggagaaggt

SEQ ID NO: 176885 - DNA, 15 bp, Homo sapiens
attataacttaaaaa

SEQ ID NO: 176886 - DNA, 22 bp, Homo sapiens
attataacttaaaaaaatgaca

SEQ ID NO: 176887 - DNA, 20 bp, Homo sapiens
attataacttaaaatatttt

SEQ ID NO: 176888 - DNA, 15 bp, Homo sapiens
attataatttaatgc

SEQ ID NO: 176889 - DNA, 23 bp, Homo sapiens
attatcattttagaagactctac

SEQ ID NO: 176890 - DNA, 17 bp, Homo sapiens
attatccaggtaatcca

SEQ ID NO: 176891 - DNA, 18 bp, Homo sapiens
attatctcaaaactgcac

SEQ ID NO: 176892 - DNA, 23 bp, Homo sapiens
attatctcaaaactgcactgtca

SEQ ID NO: 176893 - DNA, 20 bp, Homo sapiens
attatggaagattttaaatt

SEQ ID NO: 176894 - DNA, 16 bp, Homo sapiens
attatgtatgtttaca

SEQ ID NO: 176895 - DNA, 17 bp, Homo sapiens
attatgtatgtttacat

SEQ ID NO: 176896 - DNA, 15 bp, Homo sapiens
attattcagtgtcac

SEQ ID NO: 176897 - DNA, 14 bp, Homo sapiens
attattcatttaaa

SEQ ID NO: 176898 - DNA, 19 bp, Homo sapiens
attattcatttaaaatgat

SEQ ID NO: 176899 - DNA, 23 bp, Homo sapiens
attattgtgtgttatttaaatga

SEQ ID NO: 176900 - DNA, 16 bp, Homo sapiens
attatttatatatgta

SEQ ID NO: 176901 - DNA, 23 bp, Homo sapiens
attatttgtgtaatagaaaactg

SEQ ID NO: 176902 - DNA, 21 bp, Homo sapiens
attattttaaacaaaatagaa

SEQ ID NO: 176903 - DNA, 18 bp, Homo sapiens
attcaaacagtctcagga

SEQ ID NO: 176904 - DNA, 19 bp, Homo sapiens
attcaaacagtctcaggaa

SEQ ID NO: 176905 - DNA, 22 bp, Homo sapiens
attcaagaaaacaacttcaata

SEQ ID NO: 176906 - DNA, 13 bp, Homo sapiens
attcacaatagaa

SEQ ID NO: 176907 - DNA, 22 bp, Homo sapiens
attcacaatgaaatgctctcct

SEQ ID NO: 176908 - DNA, 17 bp, Homo sapiens
attcagcactgatttca

SEQ ID NO: 176909 - DNA, 21 bp, Homo sapiens
attcagcactgatttcacaac

SEQ ID NO: 176910 - DNA, 22 bp, Homo sapiens
attcaggaaaactgacagagga

SEQ ID NO: 176911 - DNA, 22 bp, Homo sapiens
attcaggagagtagaacagata

SEQ ID NO: 176912 - DNA, 19 bp, Homo sapiens
attcatagcagcttattca

SEQ ID NO: 176913 - DNA, 14 bp, Homo sapiens
attcatatttactt

SEQ ID NO: 176914 - DNA, 16 bp, Homo sapiens
attcatgctactgcca

SEQ ID NO: 176915 - DNA, 21 bp, Homo sapiens
attcatgctactgccaacctg

SEQ ID NO: 176916 - DNA, 20 bp, Homo sapiens
attcattgaagtcagatgtg

SEQ ID NO: 176917 - DNA, 14 bp, Homo sapiens
attcatttaaaatg

SEQ ID NO: 176918 - DNA, 15 bp, Homo sapiens
attccaacagtgagt

SEQ ID NO: 176919 - DNA, 20 bp, Homo sapiens
attccacttataggaattga

SEQ ID NO: 176920 - DNA, 13 bp, Homo sapiens
attccatatttat

SEQ ID NO: 176921 - DNA, 16 bp, Homo sapiens
attccattgtgtgagt

SEQ ID NO: 176922 - DNA, 15 bp, Homo sapiens
attcccatctgtcac

SEQ ID NO: 176923 - DNA, 22 bp, Homo sapiens
attccccaggtggctgacccag

SEQ ID NO: 176924 - DNA, 13 bp, Homo sapiens
attccccattgcc

SEQ ID NO: 176925 - DNA, 20 bp, Homo sapiens
attccccattgcctcctcct

SEQ ID NO: 176926 - DNA, 15 bp, Homo sapiens
attccctctctctga

SEQ ID NO: 176927 - DNA, 18 bp, Homo sapiens
attcctacaaagatgttt

SEQ ID NO: 176928 - DNA, 14 bp, Homo sapiens
attcctcagggaca

SEQ ID NO: 176929 - DNA, 12 bp, Homo sapiens
attcctctggga

SEQ ID NO: 176930 - DNA, 22 bp, Homo sapiens
attcctctgggaatgttacatt

SEQ ID NO: 176931 - DNA, 15 bp, Homo sapiens
attcctgcagcctgg

SEQ ID NO: 176932 - DNA, 19 bp, Homo sapiens
attcctgcagcctggaggc

SEQ ID NO: 176933 - DNA, 18 bp, Homo sapiens
attcctgcatttgtgaaa

SEQ ID NO: 176934 - DNA, 22 bp, Homo sapiens
attcctgggaaatattccctag

SEQ ID NO: 176935 - DNA, 18 bp, Homo sapiens
attcctttgaagaggaaa

SEQ ID NO: 176936 - DNA, 14 bp, Homo sapiens
attctcactccacc

SEQ ID NO: 176937 - DNA, 16 bp, Homo sapiens
attctcactccaccac

SEQ ID NO: 176938 - DNA, 17 bp, Homo sapiens
attctcactccaccacc

SEQ ID NO: 176939 - DNA, 13 bp, Homo sapiens
attctcctgtgct

SEQ ID NO: 176940 - DNA, 14 bp, Homo sapiens
attctcctgtgcta

SEQ ID NO: 176941 - DNA, 20 bp, Homo sapiens
aagaattgaacccaggaggt

SEQ ID NO: 176942 - DNA, 20 bp, Homo sapiens
aagaattttcagaccccagc

SEQ ID NO: 176943 - DNA, 15 bp, Homo sapiens
aagacaagacttcag

SEQ ID NO: 176944 - DNA, 12 bp, Homo sapiens
aagacagaagcc

SEQ ID NO: 176945 - DNA, 21 bp, Homo sapiens
aagacattcttccaaaaagat

SEQ ID NO: 176946 - DNA, 15 bp, Homo sapiens
aagacgcctgagctc

SEQ ID NO: 176947 - DNA, 22 bp, Homo sapiens
aagacttcagtatgttgtcaaa

SEQ ID NO: 176948 - DNA, 19 bp, Homo sapiens
aagacttggcaacagaagc

SEQ ID NO: 176949 - DNA, 12 bp, Homo sapiens
aagacttgtttt

SEQ ID NO: 176950 - DNA, 13 bp, Homo sapiens
aagagaaaaaata

SEQ ID NO: 176951 - DNA, 20 bp, Homo sapiens
aagagaacccacgaacattc

SEQ ID NO: 176952 - DNA, 13 bp, Homo sapiens
attctgattccac

SEQ ID NO: 176953 - DNA, 17 bp, Homo sapiens
attctgtgtgttttcat

SEQ ID NO: 176954 - DNA, 21 bp, Homo sapiens
attctgtgtgttttcataata

SEQ ID NO: 176955 - DNA, 23 bp, Homo sapiens
attctgtgtgttttcataataaa

SEQ ID NO: 176956 - DNA, 16 bp, Homo sapiens
attcttgaaagctgtg

SEQ ID NO: 176957 - DNA, 15 bp, Homo sapiens
attcttgaaggaaaa

SEQ ID NO: 176958 - DNA, 12 bp, Homo sapiens
attcttgtatat

SEQ ID NO: 176959 - DNA, 21 bp, Homo sapiens
attctttcccaattcacatct

SEQ ID NO: 176960 - DNA, 14 bp, Homo sapiens
attgaaaaaataga

SEQ ID NO: 176961 - DNA, 15 bp, Homo sapiens
attgaactctttgaa

SEQ ID NO: 176962 - DNA, 16 bp, Homo sapiens
attgaagtcagatgtg

SEQ ID NO: 176963 - DNA, 22 bp, Homo sapiens
attgaattcttggttgaggaaa

SEQ ID NO: 176964 - DNA, 18 bp, Homo sapiens
attgacaataatttcagg

SEQ ID NO: 176965 - DNA, 15 bp, Homo sapiens
attgacacttaaaaa

SEQ ID NO: 176966 - DNA, 20 bp, Homo sapiens
attgacacttaaaaatggtt

SEQ ID NO: 176967 - DNA, 22 bp, Homo sapiens
attgactcaaatctccagtatt

SEQ ID NO: 176968 - DNA, 22 bp, Homo sapiens
attgagaaagagcacttaagag

SEQ ID NO: 176969 - DNA, 15 bp, Homo sapiens
attgagttttcagtg

SEQ ID NO: 176970 - DNA, 15 bp, Homo sapiens
attgatcaaattcat

SEQ ID NO: 176971 - DNA, 19 bp, Homo sapiens
attgatgtgtttatttata

SEQ ID NO: 176972 - DNA, 12 bp, Homo sapiens
attgcaccactg

SEQ ID NO: 176973 - DNA, 17 bp, Homo sapiens
attgcacgtggcctctt

SEQ ID NO: 176974 - DNA, 17 bp, Homo sapiens
attgcactccagcctgg

SEQ ID NO: 176975 - DNA, 13 bp, Homo sapiens
attgcacttttaa

SEQ ID NO: 176976 - DNA, 23 bp, Homo sapiens
attgcatctcccagataatgtga

SEQ ID NO: 176977 - DNA, 15 bp, Homo sapiens
attgcatctgtataa

SEQ ID NO: 176978 - DNA, 18 bp, Homo sapiens
attgcccatccatctgct

SEQ ID NO: 176979 - DNA, 11 bp, Homo sapiens
attgccctggt

SEQ ID NO: 176980 - DNA, 22 bp, Homo sapiens
attgctatgttttgacattttt

SEQ ID NO: 176981 - DNA, 12 bp, Homo sapiens
attgctccttga

SEQ ID NO: 176982 - DNA, 21 bp, Homo sapiens
attgctgccccatcagtgctc

SEQ ID NO: 176983 - DNA, 19 bp, Homo sapiens
attgctggcaaagacagaa

SEQ ID NO: 176984 - DNA, 12 bp, Homo sapiens
attgctgtgtat

SEQ ID NO: 176985 - DNA, 16 bp, Homo sapiens
attgcttaaaatagca

SEQ ID NO: 176986 - DNA, 21 bp, Homo sapiens
attgcttacaagcctaagaat

SEQ ID NO: 176987 - DNA, 16 bp, Homo sapiens
attgcttacattttta

SEQ ID NO: 176988 - DNA, 19 bp, Homo sapiens
attgcttacatttttacaa

SEQ ID NO: 176989 - DNA, 17 bp, Homo sapiens
attgcttcttctcctat

SEQ ID NO: 176990 - DNA, 23 bp, Homo sapiens
attgcttcttctcctatgtgtaa

SEQ ID NO: 176991 - DNA, 16 bp, Homo sapiens
attgcttgaaagaaaa

SEQ ID NO: 176992 - DNA, 23 bp, Homo sapiens
attgcttgaaagaaaatatgcat

SEQ ID NO: 176993 - DNA, 14 bp, Homo sapiens
attgctttggtcat

SEQ ID NO: 176994 - DNA, 14 bp, Homo sapiens
attggacccttcca

SEQ ID NO: 176995 - DNA, 19 bp, Homo sapiens
attggattattcatttaaa

SEQ ID NO: 176996 - DNA, 21 bp, Homo sapiens
attggattattcatttaaaat

SEQ ID NO: 176997 - DNA, 23 bp, Homo sapiens
attggctttgggttgcaggacct

SEQ ID NO: 176998 - DNA, 15 bp, Homo sapiens
attggtaacatcctt

SEQ ID NO: 176999 - DNA, 18 bp, Homo sapiens
attggtattcactaatct

SEQ ID NO: 177000 - DNA, 17 bp, Homo sapiens
attggtccagcttgctc

SEQ ID NO: 177001 - DNA, 21 bp, Homo sapiens
attgtaaaatagcttgtatag

SEQ ID NO: 177002 - DNA, 13 bp, Homo sapiens
attgtaaaatggt

SEQ ID NO: 177003 - DNA, 14 bp, Homo sapiens
attgtaaatagtat

SEQ ID NO: 177004 - DNA, 14 bp, Homo sapiens
attgtaaatgtgct

SEQ ID NO: 177005 - DNA, 13 bp, Homo sapiens
attgtaactgttc

SEQ ID NO: 177006 - DNA, 15 bp, Homo sapiens
attgtaactgttctt

SEQ ID NO: 177007 - DNA, 16 bp, Homo sapiens
attgtacagctgttta

SEQ ID NO: 177008 - DNA, 20 bp, Homo sapiens
attgtacagctgtttaagat

SEQ ID NO: 177009 - DNA, 12 bp, Homo sapiens
attgtacctctc

SEQ ID NO: 177010 - DNA, 13 bp, Homo sapiens
attgtataaacta

SEQ ID NO: 177011 - DNA, 22 bp, Homo sapiens
attgtataaactatcagtttgt

SEQ ID NO: 177012 - DNA, 22 bp, Homo sapiens
attgtataagattagaatgaaa

SEQ ID NO: 177013 - DNA, 23 bp, Homo sapiens
attgtattaggtgtcatttccat

SEQ ID NO: 177014 - DNA, 19 bp, Homo sapiens
attgtcagagttctgctct

SEQ ID NO: 177015 - DNA, 15 bp, Homo sapiens
attgtcattcctgta

SEQ ID NO: 177016 - DNA, 23 bp, Homo sapiens
attgtgatcagaccataatgtta

SEQ ID NO: 177017 - DNA, 17 bp, Homo sapiens
attgtggctgtcagcag

SEQ ID NO: 177018 - DNA, 20 bp, Homo sapiens
attgtggggatgatgaaata

SEQ ID NO: 177019 - DNA, 15 bp, Homo sapiens
attgtgtatattcat

SEQ ID NO: 177020 - DNA, 14 bp, Homo sapiens
attgtgttgtgaat

SEQ ID NO: 177021 - DNA, 15 bp, Homo sapiens
attgttaaaataact

SEQ ID NO: 177022 - DNA, 19 bp, Homo sapiens
attgtttaaaatcatttct

SEQ ID NO: 177023 - DNA, 21 bp, Homo sapiens
attgtttaagtgttgtaaata

SEQ ID NO: 177024 - DNA, 19 bp, Homo sapiens
attgtttcaaaataaaaac

SEQ ID NO: 177025 - DNA, 22 bp, Homo sapiens
attgtttcaattgcatctccca

SEQ ID NO: 177026 - DNA, 19 bp, Homo sapiens
atttaaacaataaatgtgc

SEQ ID NO: 177027 - DNA, 16 bp, Homo sapiens
atttaaacagcagtgt

SEQ ID NO: 177028 - DNA, 19 bp, Homo sapiens
atttaaagaacaccctata

SEQ ID NO: 177029 - DNA, 19 bp, Homo sapiens
atttaaagcttattaaaac

SEQ ID NO: 177030 - DNA, 16 bp, Homo sapiens
atttaacagtcattta

SEQ ID NO: 177031 - DNA, 18 bp, Homo sapiens
atttaacagtcatttaaa

SEQ ID NO: 177032 - DNA, 13 bp, Homo sapiens
atttaactggctt

SEQ ID NO: 177033 - DNA, 17 bp, Homo sapiens
atttaacttgtttccaa

SEQ ID NO: 177034 - DNA, 20 bp, Homo sapiens
atttaacttgtttccaatgt

SEQ ID NO: 177035 - DNA, 19 bp, Homo sapiens
atttaagcctcatatttaa

SEQ ID NO: 177036 - DNA, 16 bp, Homo sapiens
atttaataaaaaaaca

SEQ ID NO: 177037 - DNA, 15 bp, Homo sapiens
atttaatacagcagt

SEQ ID NO: 177038 - DNA, 18 bp, Homo sapiens
atttaatcttttttatgt

SEQ ID NO: 177039 - DNA, 13 bp, Homo sapiens
atttacaaagtgt

SEQ ID NO: 177040 - DNA, 20 bp, Homo sapiens
atttacatgaattgcatttt

SEQ ID NO: 177041 - DNA, 21 bp, Homo sapiens
atttactaagccacaagaaat

SEQ ID NO: 177042 - DNA, 17 bp, Homo sapiens
atttacttcttatacat

SEQ ID NO: 177043 - DNA, 20 bp, Homo sapiens
atttacttgccattactcaa

SEQ ID NO: 177044 - DNA, 22 bp, Homo sapiens
atttacttgccattactcaatt

SEQ ID NO: 177045 - DNA, 14 bp, Homo sapiens
atttagtcatgtga

SEQ ID NO: 177046 - DNA, 13 bp, Homo sapiens
atttataactcat

SEQ ID NO: 177047 - DNA, 14 bp, Homo sapiens
atttataactcatc

SEQ ID NO: 177048 - DNA, 20 bp, Homo sapiens
atttataactcatcataaaa

SEQ ID NO: 177049 - DNA, 17 bp, Homo sapiens
atttataagcagattta

SEQ ID NO: 177050 - DNA, 22 bp, Homo sapiens
atttataagcagatttaacaat

SEQ ID NO: 177051 - DNA, 14 bp, Homo sapiens
atttatactattta

SEQ ID NO: 177052 - DNA, 14 bp, Homo sapiens
atttatagtttgta

SEQ ID NO: 177053 - DNA, 22 bp, Homo sapiens
atttatagtttgtacatgcatt

SEQ ID NO: 177054 - DNA, 15 bp, Homo sapiens
atttatatatgtatt

SEQ ID NO: 177055 - DNA, 22 bp, Homo sapiens
atttatctctatttaatattta

SEQ ID NO: 177056 - DNA, 18 bp, Homo sapiens
atttatgagtttttgata

SEQ ID NO: 177057 - DNA, 19 bp, Homo sapiens
atttattaaaatgattgta

SEQ ID NO: 177058 - DNA, 14 bp, Homo sapiens
atttattttttaca

SEQ ID NO: 177059 - DNA, 19 bp, Homo sapiens
atttattttttacattatt

SEQ ID NO: 177060 - DNA, 13 bp, Homo sapiens
atttcacaacaga

SEQ ID NO: 177061 - DNA, 13 bp, Homo sapiens
atttcacattaat

SEQ ID NO: 177062 - DNA, 18 bp, Homo sapiens
atttcatctatttctgag

SEQ ID NO: 177063 - DNA, 20 bp, Homo sapiens
atttcatctatttctgagaa

SEQ ID NO: 177064 - DNA, 14 bp, Homo sapiens
atttcatgaaaatt

SEQ ID NO: 177065 - DNA, 15 bp, Homo sapiens
atttcatgatttcat

SEQ ID NO: 177066 - DNA, 13 bp, Homo sapiens
atttccaaataaa

SEQ ID NO: 177067 - DNA, 18 bp, Homo sapiens
atttccaaataaaatgag

SEQ ID NO: 177068 - DNA, 15 bp, Homo sapiens
atttccattatttat

SEQ ID NO: 177069 - DNA, 17 bp, Homo sapiens
atttccattatttatat

SEQ ID NO: 177070 - DNA, 22 bp, Homo sapiens
atttcctcaacgttgctcccca

SEQ ID NO: 177071 - DNA, 24 bp, Homo sapiens
atttcctcaacgttgctccccatc

SEQ ID NO: 177072 - DNA, 21 bp, Homo sapiens
atttctagaacatccctgcca

SEQ ID NO: 177073 - DNA, 23 bp, Homo sapiens
atttctagaacatccctgccagc

SEQ ID NO: 177074 - DNA, 12 bp, Homo sapiens
atttctatttat

SEQ ID NO: 177075 - DNA, 17 bp, Homo sapiens
atttctatttatttact

SEQ ID NO: 177076 - DNA, 18 bp, Homo sapiens
atttctcttactgcaaat

SEQ ID NO: 177077 - DNA, 11 bp, Homo sapiens
atttcttatag

SEQ ID NO: 177078 - DNA, 19 bp, Homo sapiens
atttgaagaatgaacaaat

SEQ ID NO: 177079 - DNA, 12 bp, Homo sapiens
atttgagtgttt

SEQ ID NO: 177080 - DNA, 23 bp, Homo sapiens
atttgattctgtgtgttttcata

SEQ ID NO: 177081 - DNA, 13 bp, Homo sapiens
atttgatttctat

SEQ ID NO: 177082 - DNA, 17 bp, Homo sapiens
atttgatttctattcaa

SEQ ID NO: 177083 - DNA, 22 bp, Homo sapiens
atttgcagctgagagaaaataa

SEQ ID NO: 177084 - DNA, 20 bp, Homo sapiens
atttggagacacaactattt

SEQ ID NO: 177085 - DNA, 17 bp, Homo sapiens
atttgggagacatgtga

SEQ ID NO: 177086 - DNA, 19 bp, Homo sapiens
atttgggagacatgtgaca

SEQ ID NO: 177087 - DNA, 15 bp, Homo sapiens
atttggttctaatag

SEQ ID NO: 177088 - DNA, 15 bp, Homo sapiens
atttgtatcacaaat

SEQ ID NO: 177089 - DNA, 12 bp, Homo sapiens
atttgtgtgtgt

SEQ ID NO: 177090 - DNA, 16 bp, Homo sapiens
atttgttattttgcaa

SEQ ID NO: 177091 - DNA, 20 bp, Homo sapiens
atttgttgaaattatgtatg

SEQ ID NO: 177092 - DNA, 21 bp, Homo sapiens
attttaaaaagtcttcactct

SEQ ID NO: 177093 - DNA, 16 bp, Homo sapiens
attttaaattcacaat

SEQ ID NO: 177094 - DNA, 14 bp, Homo sapiens
attttaagtattgc

SEQ ID NO: 177095 - DNA, 15 bp, Homo sapiens
aagtcgaattaatag

SEQ ID NO: 177096 - DNA, 15 bp, Homo sapiens
aagtctctgctggcc

SEQ ID NO: 177097 - DNA, 21 bp, Homo sapiens
aagtctctgctggcccagcca

SEQ ID NO: 177098 - DNA, 18 bp, Homo sapiens
aagtctggatctgggacc

SEQ ID NO: 177099 - DNA, 23 bp, Homo sapiens
aagtcttaaaataacttatatca

SEQ ID NO: 177100 - DNA, 21 bp, Homo sapiens
aagtgaaaaaggaggaagaga

SEQ ID NO: 177101 - DNA, 16 bp, Homo sapiens
aagtgaagaaaagtga

SEQ ID NO: 177102 - DNA, 18 bp, Homo sapiens
aagtgaatgctcaagttt

SEQ ID NO: 177103 - DNA, 15 bp, Homo sapiens
aagtgataatttctg

SEQ ID NO: 177104 - DNA, 18 bp, Homo sapiens
aagtgattgtatgaattt

SEQ ID NO: 177105 - DNA, 19 bp, Homo sapiens
aagtggaaaaatagcctgc

SEQ ID NO: 177106 - DNA, 21 bp, Homo sapiens
aagtggaaaaatagcctgcct

SEQ ID NO: 177107 - DNA, 21 bp, Homo sapiens
aagtgggccaggacaggcccg

SEQ ID NO: 177108 - DNA, 19 bp, Homo sapiens
aagtgtaggcagacacagg

SEQ ID NO: 177109 - DNA, 21 bp, Homo sapiens
aagtgtaggcagacacaggga

SEQ ID NO: 177110 - DNA, 14 bp, Homo sapiens
aagtgtctgtgtgc

SEQ ID NO: 177111 - DNA, 11 bp, Homo sapiens
aagtgtgtgtg

SEQ ID NO: 177112 - DNA, 13 bp, Homo sapiens
aagtgtgtgtgcg

SEQ ID NO: 177113 - DNA, 20 bp, Homo sapiens
aagttacaaattgcttgaaa

SEQ ID NO: 177114 - DNA, 15 bp, Homo sapiens
aagttacttattcta

SEQ ID NO: 177115 - DNA, 22 bp, Homo sapiens
aagttacttcactttaattctc

SEQ ID NO: 177116 - DNA, 14 bp, Homo sapiens
aagttattgacaaa

SEQ ID NO: 177117 - DNA, 18 bp, Homo sapiens
aagttattgacaaactct

SEQ ID NO: 177118 - DNA, 17 bp, Homo sapiens
aagttccctacttcctg

SEQ ID NO: 177119 - DNA, 15 bp, Homo sapiens
aagttctgacttgac

SEQ ID NO: 177120 - DNA, 15 bp, Homo sapiens
aagttctgagtgttt

SEQ ID NO: 177121 - DNA, 19 bp, Homo sapiens
aagttctgtactcaaatgt

SEQ ID NO: 177122 - DNA, 18 bp, Homo sapiens
aagttgtgccttttatag

SEQ ID NO: 177123 - DNA, 19 bp, Homo sapiens
aagttgtgccttttatagc

SEQ ID NO: 177124 - DNA, 20 bp, Homo sapiens
aagttgttactaactaaact

SEQ ID NO: 177125 - DNA, 18 bp, Homo sapiens
aagtttacaagtgtatat

SEQ ID NO: 177126 - DNA, 18 bp, Homo sapiens
aagtttacattgtaaata

SEQ ID NO: 177127 - DNA, 20 bp, Homo sapiens
aagtttcactgacttagaac

SEQ ID NO: 177128 - DNA, 21 bp, Homo sapiens
aagtttctagctagaaatatg

SEQ ID NO: 177129 - DNA, 15 bp, Homo sapiens
aagtttgatttcatt

SEQ ID NO: 177130 - DNA, 19 bp, Homo sapiens
aagtttggcaatagtttgc

SEQ ID NO: 177131 - DNA, 13 bp, Homo sapiens
aataaaaaatgga

SEQ ID NO: 177132 - DNA, 21 bp, Homo sapiens
aataaaaactgactccttaga

SEQ ID NO: 177133 - DNA, 13 bp, Homo sapiens
aataaaaaggcac

SEQ ID NO: 177134 - DNA, 16 bp, Homo sapiens
aataaaaataaatttg

SEQ ID NO: 177135 - DNA, 14 bp, Homo sapiens
aataaaacctttca

SEQ ID NO: 177136 - DNA, 19 bp, Homo sapiens
aataaaatgaggacatgtt

SEQ ID NO: 177137 - DNA, 10 bp, Homo sapiens
aataaaccat

SEQ ID NO: 177138 - DNA, 15 bp, Homo sapiens
aataaactctaaaca

SEQ ID NO: 177139 - DNA, 19 bp, Homo sapiens
aataaagttctgagtgttt

SEQ ID NO: 177140 - DNA, 12 bp, Homo sapiens
aataaatatata

SEQ ID NO: 177141 - DNA, 21 bp, Homo sapiens
aataaatcattaatactcttc

SEQ ID NO: 177142 - DNA, 20 bp, Homo sapiens
aataaatgtatcttattcac

SEQ ID NO: 177143 - DNA, 21 bp, Homo sapiens
aataaatgtatcttattcaca

SEQ ID NO: 177144 - DNA, 14 bp, Homo sapiens
aataaatgtcttgc

SEQ ID NO: 177145 - DNA, 12 bp, Homo sapiens
aataaattattt

SEQ ID NO: 177146 - DNA, 22 bp, Homo sapiens
aataagaaacaactctttgaga

SEQ ID NO: 177147 - DNA, 14 bp, Homo sapiens
aataagaatgattt

SEQ ID NO: 177148 - DNA, 13 bp, Homo sapiens
aataataaacttt

SEQ ID NO: 177149 - DNA, 11 bp, Homo sapiens
aataataatta

SEQ ID NO: 177150 - DNA, 14 bp, Homo sapiens
aataatacactaat

SEQ ID NO: 177151 - DNA, 20 bp, Homo sapiens
aataatacattgaattagaa

SEQ ID NO: 177152 - DNA, 19 bp, Homo sapiens
aataatgttaacatggaca

SEQ ID NO: 177153 - DNA, 18 bp, Homo sapiens
aataattatccagagttt

SEQ ID NO: 177154 - DNA, 21 bp, Homo sapiens
aataattgatcaaattcattt

SEQ ID NO: 177155 - DNA, 20 bp, Homo sapiens
aatacaaaaattagccgggc

SEQ ID NO: 177156 - DNA, 14 bp, Homo sapiens
aatacacactcaaa

SEQ ID NO: 177157 - DNA, 15 bp, Homo sapiens
aatacagtacaggca

SEQ ID NO: 177158 - DNA, 21 bp, Homo sapiens
aatacagtacaggcagcacag

SEQ ID NO: 177159 - DNA, 16 bp, Homo sapiens
aatacgcactacatgt

SEQ ID NO: 177160 - DNA, 18 bp, Homo sapiens
aatacgcactacatgtgg

SEQ ID NO: 177161 - DNA, 20 bp, Homo sapiens
aatactctaccctcttagaa

SEQ ID NO: 177162 - DNA, 11 bp, Homo sapiens
aatacttttgc

SEQ ID NO: 177163 - DNA, 13 bp, Homo sapiens
aatagaaaactga

SEQ ID NO: 177164 - DNA, 21 bp, Homo sapiens
aatagaaactcaccatgtaaa

SEQ ID NO: 177165 - DNA, 20 bp, Homo sapiens
aatagataagagtagaaact

SEQ ID NO: 177166 - DNA, 21 bp, Homo sapiens
aatagatatccacttgagaca

SEQ ID NO: 177167 - DNA, 19 bp, Homo sapiens
aatagcttgtatagtgtaa

SEQ ID NO: 177168 - DNA, 23 bp, Homo sapiens
aatagtatttgagagttctaaat

SEQ ID NO: 177169 - DNA, 22 bp, Homo sapiens
aatagttttattaataaacatt

SEQ ID NO: 177170 - DNA, 18 bp, Homo sapiens
aatataaaactgcgttaa

SEQ ID NO: 177171 - DNA, 16 bp, Homo sapiens
aatataagaataaaat

SEQ ID NO: 177172 - DNA, 19 bp, Homo sapiens
aatatagctgtacaaatat

SEQ ID NO: 177173 - DNA, 11 bp, Homo sapiens
aatatataaat

SEQ ID NO: 177174 - DNA, 13 bp, Homo sapiens
aatatataaatat

SEQ ID NO: 177175 - DNA, 17 bp, Homo sapiens
aatatataaatatatat

SEQ ID NO: 177176 - DNA, 12 bp, Homo sapiens
aatatatataaa

SEQ ID NO: 177177 - DNA, 15 bp, Homo sapiens
aatatatataaacct

SEQ ID NO: 177178 - DNA, 19 bp, Homo sapiens
aatatatatatatataaaa

SEQ ID NO: 177179 - DNA, 23 bp, Homo sapiens
aatatatggcagagttgtaaata

SEQ ID NO: 177180 - DNA, 13 bp, Homo sapiens
aatatattataat

SEQ ID NO: 177181 - DNA, 15 bp, Homo sapiens
aatatatttaagata

SEQ ID NO: 177182 - DNA, 14 bp, Homo sapiens
aatatatttaatga

SEQ ID NO: 177183 - DNA, 20 bp, Homo sapiens
aatatatttttatatttagt

SEQ ID NO: 177184 - DNA, 23 bp, Homo sapiens
aatatcatttattttttacatta

SEQ ID NO: 177185 - DNA, 16 bp, Homo sapiens
aatatcccctcccagt

SEQ ID NO: 177186 - DNA, 16 bp, Homo sapiens
aatatccctacatgta

SEQ ID NO: 177187 - DNA, 19 bp, Homo sapiens
aatatcttttttttaataa

SEQ ID NO: 177188 - DNA, 18 bp, Homo sapiens
aatatgattagtaaagaa

SEQ ID NO: 177189 - DNA, 17 bp, Homo sapiens
aatatggactcagtttt

SEQ ID NO: 177190 - DNA, 18 bp, Homo sapiens
aatatggctataaatata

SEQ ID NO: 177191 - DNA, 12 bp, Homo sapiens
aatatgtcctgg

SEQ ID NO: 177192 - DNA, 13 bp, Homo sapiens
aatatgtcctggg

SEQ ID NO: 177193 - DNA, 17 bp, Homo sapiens
aatattgacttgtatat

SEQ ID NO: 177194 - DNA, 17 bp, Homo sapiens
aatattgatatgcttat

SEQ ID NO: 177195 - DNA, 20 bp, Homo sapiens
aatattgctttggtcatatg

SEQ ID NO: 177196 - DNA, 13 bp, Homo sapiens
aatattgtccatt

SEQ ID NO: 177197 - DNA, 17 bp, Homo sapiens
aatattgtgttgtgaat

SEQ ID NO: 177198 - DNA, 12 bp, Homo sapiens
aatatttaaaca

SEQ ID NO: 177199 - DNA, 19 bp, Homo sapiens
aatatttaaacagcagtgt

SEQ ID NO: 177200 - DNA, 12 bp, Homo sapiens
aatatttaagac

SEQ ID NO: 177201 - DNA, 12 bp, Homo sapiens
aatatttattac

SEQ ID NO: 177202 - DNA, 12 bp, Homo sapiens
aatatttattat

SEQ ID NO: 177203 - DNA, 19 bp, Homo sapiens
aatatttattattttcacc

SEQ ID NO: 177204 - DNA, 11 bp, Homo sapiens
aatatttattt

SEQ ID NO: 177205 - DNA, 14 bp, Homo sapiens
aatattttgtctaa

SEQ ID NO: 177206 - DNA, 16 bp, Homo sapiens
aatattttgtctaaaa

SEQ ID NO: 177207 - DNA, 17 bp, Homo sapiens
aatatttttaatatata

SEQ ID NO: 177208 - DNA, 16 bp, Homo sapiens
aatcaaatatgcaaag

SEQ ID NO: 177209 - DNA, 15 bp, Homo sapiens
aatcaagaaacttaa

SEQ ID NO: 177210 - DNA, 15 bp, Homo sapiens
aatcaccaaaggctc

SEQ ID NO: 177211 - DNA, 20 bp, Homo sapiens
aatcaccacaccaaacctct

SEQ ID NO: 177212 - DNA, 17 bp, Homo sapiens
aatcactaaaaatgatc

SEQ ID NO: 177213 - DNA, 19 bp, Homo sapiens
aatcagcctgctccagctg

SEQ ID NO: 177214 - DNA, 20 bp, Homo sapiens
aatcagctccttcctggaga

SEQ ID NO: 177215 - DNA, 14 bp, Homo sapiens
aatcagtgtgtcta

SEQ ID NO: 177216 - DNA, 15 bp, Homo sapiens
aatcatctgtgtgaa

SEQ ID NO: 177217 - DNA, 20 bp, Homo sapiens
aatcatgaagatatttttcc

SEQ ID NO: 177218 - DNA, 16 bp, Homo sapiens
aatcatgtcaggcctg

SEQ ID NO: 177219 - DNA, 20 bp, Homo sapiens
aatcatttctatttctcctc

SEQ ID NO: 177220 - DNA, 22 bp, Homo sapiens
aatcattttaattattattctt

SEQ ID NO: 177221 - DNA, 19 bp, Homo sapiens
aatcattttatatgtcaaa

SEQ ID NO: 177222 - DNA, 19 bp, Homo sapiens
aatcccctcattcaggaaa

SEQ ID NO: 177223 - DNA, 11 bp, Homo sapiens
aatcctctggc

SEQ ID NO: 177224 - DNA, 13 bp, Homo sapiens
aatcctttactgt

SEQ ID NO: 177225 - DNA, 13 bp, Homo sapiens
aatcgatggggga

SEQ ID NO: 177226 - DNA, 13 bp, Homo sapiens
aatcgattggctt

SEQ ID NO: 177227 - DNA, 18 bp, Homo sapiens
aatcggcccacagctccc

SEQ ID NO: 177228 - DNA, 19 bp, Homo sapiens
aatctaatattaaaaatat

SEQ ID NO: 177229 - DNA, 15 bp, Homo sapiens
aatctacccaaagga

SEQ ID NO: 177230 - DNA, 14 bp, Homo sapiens
aatctattttgtaa

SEQ ID NO: 177231 - DNA, 13 bp, Homo sapiens
aatctcaccccat

SEQ ID NO: 177232 - DNA, 17 bp, Homo sapiens
aatctcattgcttacaa

SEQ ID NO: 177233 - DNA, 15 bp, Homo sapiens
aatctggactcctct

SEQ ID NO: 177234 - DNA, 18 bp, Homo sapiens
aatctggactcctctgtc

SEQ ID NO: 177235 - DNA, 20 bp, Homo sapiens
aatctggactcctctgtcca

SEQ ID NO: 177236 - DNA, 15 bp, Homo sapiens
aatctttattgagaa

SEQ ID NO: 177237 - DNA, 23 bp, Homo sapiens
caactttctgtaaactcaaaact

SEQ ID NO: 177238 - DNA, 15 bp, Homo sapiens
caagaaaacaacttc

SEQ ID NO: 177239 - DNA, 15 bp, Homo sapiens
caagaaatccctgtt

SEQ ID NO: 177240 - DNA, 15 bp, Homo sapiens
caagaaatgaaagca

SEQ ID NO: 177241 - DNA, 19 bp, Homo sapiens
caagaagtcaaagtaaaac

SEQ ID NO: 177242 - DNA, 18 bp, Homo sapiens
caagaatagatgctgact

SEQ ID NO: 177243 - DNA, 22 bp, Homo sapiens
caagagcccccttgacaccggg

SEQ ID NO: 177244 - DNA, 12 bp, Homo sapiens
caagagccttgg

SEQ ID NO: 177245 - DNA, 18 bp, Homo sapiens
caagagccttggtgtcca

SEQ ID NO: 177246 - DNA, 21 bp, Homo sapiens
caagagccttggtgtccacct

SEQ ID NO: 177247 - DNA, 23 bp, Homo sapiens
caagagccttggtgtccacctgg

SEQ ID NO: 177248 - DNA, 16 bp, Homo sapiens
caagagggaatccccg

SEQ ID NO: 177249 - DNA, 13 bp, Homo sapiens
caagagggcactg

SEQ ID NO: 177250 - DNA, 22 bp, Homo sapiens
atcccactttctatagcagatt

SEQ ID NO: 177251 - DNA, 21 bp, Homo sapiens
atcccagcactttgggaggcc

SEQ ID NO: 177252 - DNA, 14 bp, Homo sapiens
atcccatttaaaaa

SEQ ID NO: 177253 - DNA, 15 bp, Homo sapiens
atcccatttaaaaaa

SEQ ID NO: 177254 - DNA, 19 bp, Homo sapiens
atccctagtcttcaagcag

SEQ ID NO: 177255 - DNA, 19 bp, Homo sapiens
atccctatgctgcctaggc

SEQ ID NO: 177256 - DNA, 13 bp, Homo sapiens
atccctcacctgt

SEQ ID NO: 177257 - DNA, 17 bp, Homo sapiens
atccctcatctgtccct

SEQ ID NO: 177258 - DNA, 17 bp, Homo sapiens
atccctctacagagctt

SEQ ID NO: 177259 - DNA, 21 bp, Homo sapiens
atccctctacagagcttccct

SEQ ID NO: 177260 - DNA, 23 bp, Homo sapiens
atccctctacagagcttccctga

SEQ ID NO: 177261 - DNA, 15 bp, Homo sapiens
atccctgccagctct

SEQ ID NO: 177262 - DNA, 15 bp, Homo sapiens
atccctgtttaatat

SEQ ID NO: 177263 - DNA, 22 bp, Homo sapiens
atccctgtttaatatttaaaca

SEQ ID NO: 177264 - DNA, 13 bp, Homo sapiens
atccgaggcaggg

SEQ ID NO: 177265 - DNA, 17 bp, Homo sapiens
atccgtagttccctgaa

SEQ ID NO: 177266 - DNA, 21 bp, Homo sapiens
atccgtctttggcctcctcca

SEQ ID NO: 177267 - DNA, 19 bp, Homo sapiens
atcctaatcatccaatgct

SEQ ID NO: 177268 - DNA, 13 bp, Homo sapiens
atcctaatgaatg

SEQ ID NO: 177269 - DNA, 21 bp, Homo sapiens
atcctaggcatttgctgaata

SEQ ID NO: 177270 - DNA, 20 bp, Homo sapiens
atcctatgtttttgttcaaa

SEQ ID NO: 177271 - DNA, 15 bp, Homo sapiens
atcctcaatccagct

SEQ ID NO: 177272 - DNA, 23 bp, Homo sapiens
atcctcatttggggtagctagag

SEQ ID NO: 177273 - DNA, 10 bp, Homo sapiens
atcctctggc

SEQ ID NO: 177274 - DNA, 16 bp, Homo sapiens
atcctgcaattccact

SEQ ID NO: 177275 - DNA, 13 bp, Homo sapiens
atcctgcccctga

SEQ ID NO: 177276 - DNA, 18 bp, Homo sapiens
atcctgggcatccttctt

SEQ ID NO: 177277 - DNA, 22 bp, Homo sapiens
atcctgggtggtctgcaggcag

SEQ ID NO: 177278 - DNA, 23 bp, Homo sapiens
atcctgggtggtctgcaggcagg

SEQ ID NO: 177279 - DNA, 17 bp, Homo sapiens
atcctgtcctcagcttc

SEQ ID NO: 177280 - DNA, 13 bp, Homo sapiens
atcctgtgggtga

SEQ ID NO: 177281 - DNA, 14 bp, Homo sapiens
atcctttccagcat

SEQ ID NO: 177282 - DNA, 17 bp, Homo sapiens
atcctttccagcatgag

SEQ ID NO: 177283 - DNA, 18 bp, Homo sapiens
atccttttatgttattta

SEQ ID NO: 177284 - DNA, 13 bp, Homo sapiens
atctaacctcatc

SEQ ID NO: 177285 - DNA, 14 bp, Homo sapiens
atctaacctcatct

SEQ ID NO: 177286 - DNA, 15 bp, Homo sapiens
atctaagtgatataa

SEQ ID NO: 177287 - DNA, 18 bp, Homo sapiens
atctacactccagtgaga

SEQ ID NO: 177288 - DNA, 20 bp, Homo sapiens
atctatcaatagtcaagaaa

SEQ ID NO: 177289 - DNA, 19 bp, Homo sapiens
atctattcctggtagaata

SEQ ID NO: 177290 - DNA, 14 bp, Homo sapiens
atctcaccccatcc

SEQ ID NO: 177291 - DNA, 16 bp, Homo sapiens
atctcaccccatccca

SEQ ID NO: 177292 - DNA, 22 bp, Homo sapiens
atctcaccccatcccacaccct

SEQ ID NO: 177293 - DNA, 17 bp, Homo sapiens
atctcaggggccagagg

SEQ ID NO: 177294 - DNA, 14 bp, Homo sapiens
atctcattggaccc

SEQ ID NO: 177295 - DNA, 19 bp, Homo sapiens
atctcccagataatgtgaa

SEQ ID NO: 177296 - DNA, 20 bp, Homo sapiens
atctcctcgcaagctgggta

SEQ ID NO: 177297 - DNA, 17 bp, Homo sapiens
atctcctgccttcctcc

SEQ ID NO: 177298 - DNA, 20 bp, Homo sapiens
atctcgccacccctccttcc

SEQ ID NO: 177299 - DNA, 13 bp, Homo sapiens
atctctaatatgg

SEQ ID NO: 177300 - DNA, 15 bp, Homo sapiens
atctctaatatggca

SEQ ID NO: 177301 - DNA, 17 bp, Homo sapiens
atctctatttaatattt

SEQ ID NO: 177302 - DNA, 18 bp, Homo sapiens
atctctatttaatattta

SEQ ID NO: 177303 - DNA, 11 bp, Homo sapiens
atctctccctc

SEQ ID NO: 177304 - DNA, 23 bp, Homo sapiens
atctctccctcccctgccatttt

SEQ ID NO: 177305 - DNA, 19 bp, Homo sapiens
atctctcggttccacgtcc

SEQ ID NO: 177306 - DNA, 15 bp, Homo sapiens
atctcttgagcctgg

SEQ ID NO: 177307 - DNA, 18 bp, Homo sapiens
atctgatgcaagcaagaa

SEQ ID NO: 177308 - DNA, 15 bp, Homo sapiens
atctgcacccccctg

SEQ ID NO: 177309 - DNA, 20 bp, Homo sapiens
atctgcagaaggaaaaatgt

SEQ ID NO: 177310 - DNA, 12 bp, Homo sapiens
atctgcttcagt

SEQ ID NO: 177311 - DNA, 18 bp, Homo sapiens
atctggactcctctgtcc

SEQ ID NO: 177312 - DNA, 22 bp, Homo sapiens
atctgggaccctttccttcctt

SEQ ID NO: 177313 - DNA, 16 bp, Homo sapiens
atctggggctctggga

SEQ ID NO: 177314 - DNA, 17 bp, Homo sapiens
atctggtagatttttaa

SEQ ID NO: 177315 - DNA, 18 bp, Homo sapiens
atctgtataccctctgtt

SEQ ID NO: 177316 - DNA, 14 bp, Homo sapiens
atctgtatatacaa

SEQ ID NO: 177317 - DNA, 20 bp, Homo sapiens
atctgtatatacaataacat

SEQ ID NO: 177318 - DNA, 21 bp, Homo sapiens
atctgtgaaatgctggcattt

SEQ ID NO: 177319 - DNA, 21 bp, Homo sapiens
atctgtgcccagagatgggac

SEQ ID NO: 177320 - DNA, 21 bp, Homo sapiens
atctgtttaaagtagattaga

SEQ ID NO: 177321 - DNA, 22 bp, Homo sapiens
atctgttttaaatttatttcaa

SEQ ID NO: 177322 - DNA, 17 bp, Homo sapiens
atcttctttataattct

SEQ ID NO: 177323 - DNA, 16 bp, Homo sapiens
atcttgaattgtaact

SEQ ID NO: 177324 - DNA, 22 bp, Homo sapiens
atcttgaccaagcaggaagctc

SEQ ID NO: 177325 - DNA, 23 bp, Homo sapiens
atcttgaccaagcaggaagctca

SEQ ID NO: 177326 - DNA, 17 bp, Homo sapiens
atcttgactacagtcag

SEQ ID NO: 177327 - DNA, 23 bp, Homo sapiens
atcttgctttttttcaccaatat

SEQ ID NO: 177328 - DNA, 14 bp, Homo sapiens
atcttgtctctggg

SEQ ID NO: 177329 - DNA, 12 bp, Homo sapiens
atctttaaaata

SEQ ID NO: 177330 - DNA, 16 bp, Homo sapiens
atgaaaaaatgtatat

SEQ ID NO: 177331 - DNA, 21 bp, Homo sapiens
atgaaaggtttacattgtcaa

SEQ ID NO: 177332 - DNA, 13 bp, Homo sapiens
atgaaatatgcat

SEQ ID NO: 177333 - DNA, 15 bp, Homo sapiens
atgaacaaattgaac

SEQ ID NO: 177334 - DNA, 18 bp, Homo sapiens
atgaacaaattgaactct

SEQ ID NO: 177335 - DNA, 16 bp, Homo sapiens
atgaactcttaatcaa

SEQ ID NO: 177336 - DNA, 14 bp, Homo sapiens
atgaactgaagttt

SEQ ID NO: 177337 - DNA, 17 bp, Homo sapiens
atgaactgaagtttcac

SEQ ID NO: 177338 - DNA, 21 bp, Homo sapiens
atgaagatgtctaatagttat

SEQ ID NO: 177339 - DNA, 19 bp, Homo sapiens
atgaagattctcctgtgct

SEQ ID NO: 177340 - DNA, 17 bp, Homo sapiens
atgaatgaaacattttg

SEQ ID NO: 177341 - DNA, 23 bp, Homo sapiens
atgaatggactcaaactgccttg

SEQ ID NO: 177342 - DNA, 13 bp, Homo sapiens
atgaattgcattt

SEQ ID NO: 177343 - DNA, 19 bp, Homo sapiens
atgacaacagaagcttcag

SEQ ID NO: 177344 - DNA, 13 bp, Homo sapiens
atgacagagccag

SEQ ID NO: 177345 - DNA, 17 bp, Homo sapiens
atgacagctgtccctgt

SEQ ID NO: 177346 - DNA, 16 bp, Homo sapiens
atgactaaaaatatta

SEQ ID NO: 177347 - DNA, 18 bp, Homo sapiens
atgagaaggaatttgagt

SEQ ID NO: 177348 - DNA, 13 bp, Homo sapiens
atgagatccttta

SEQ ID NO: 177349 - DNA, 22 bp, Homo sapiens
atgagattgttttatcatgaca

SEQ ID NO: 177350 - DNA, 12 bp, Homo sapiens
atgagcctggca

SEQ ID NO: 177351 - DNA, 13 bp, Homo sapiens
atgagcctggcaa

SEQ ID NO: 177352 - DNA, 21 bp, Homo sapiens
atgagctatttccattccaga

SEQ ID NO: 177353 - DNA, 22 bp, Homo sapiens
atgagctatttccattccagaa

SEQ ID NO: 177354 - DNA, 14 bp, Homo sapiens
atgagctcctcttc

SEQ ID NO: 177355 - DNA, 13 bp, Homo sapiens
atgaggacatgtt

SEQ ID NO: 177356 - DNA, 14 bp, Homo sapiens
atgaggaggaagga

SEQ ID NO: 177357 - DNA, 21 bp, Homo sapiens
atgaggatgcagagtcagcag

SEQ ID NO: 177358 - DNA, 15 bp, Homo sapiens
atgaggggcccgagc

SEQ ID NO: 177359 - DNA, 15 bp, Homo sapiens
atgaggtactgagag

SEQ ID NO: 177360 - DNA, 15 bp, Homo sapiens
atgaggtgctgggag

SEQ ID NO: 177361 - DNA, 16 bp, Homo sapiens
atgaggtgctgggagg

SEQ ID NO: 177362 - DNA, 17 bp, Homo sapiens
atgagtgaataaatgtc

SEQ ID NO: 177363 - DNA, 13 bp, Homo sapiens
atgatatgtaaac

SEQ ID NO: 177364 - DNA, 21 bp, Homo sapiens
atgatatgtaaacataattct

SEQ ID NO: 177365 - DNA, 22 bp, Homo sapiens
atgatcatttgcccttaaggac

SEQ ID NO: 177366 - DNA, 13 bp, Homo sapiens
atgatccctgtgt

SEQ ID NO: 177367 - DNA, 14 bp, Homo sapiens
atgatcttctttat

SEQ ID NO: 177368 - DNA, 21 bp, Homo sapiens
atgatgatctttaaaatacac

SEQ ID NO: 177369 - DNA, 20 bp, Homo sapiens
atgattaaccacttcagctg

SEQ ID NO: 177370 - DNA, 14 bp, Homo sapiens
atgattggattatt

SEQ ID NO: 177371 - DNA, 14 bp, Homo sapiens
atgattgtaaaata

SEQ ID NO: 177372 - DNA, 14 bp, Homo sapiens
atgatttatagttt

SEQ ID NO: 177373 - DNA, 20 bp, Homo sapiens
atgatttatagtttgtacat

SEQ ID NO: 177374 - DNA, 16 bp, Homo sapiens
atgattttatttgaca

SEQ ID NO: 177375 - DNA, 18 bp, Homo sapiens
atgattttatttgacaaa

SEQ ID NO: 177376 - DNA, 22 bp, Homo sapiens
atgatttttagatgagattgtt

SEQ ID NO: 177377 - DNA, 23 bp, Homo sapiens
atgcaagatagtttatctaactt

SEQ ID NO: 177378 - DNA, 20 bp, Homo sapiens
atgcaattttgcatttgaat

SEQ ID NO: 177379 - DNA, 12 bp, Homo sapiens
atgttatttata

SEQ ID NO: 177380 - DNA, 14 bp, Homo sapiens
atgttcaactggag

SEQ ID NO: 177381 - DNA, 16 bp, Homo sapiens
atgttcagcactgtcc

SEQ ID NO: 177382 - DNA, 19 bp, Homo sapiens
atgttcagcactgtccctt

SEQ ID NO: 177383 - DNA, 19 bp, Homo sapiens
atgttcatcaatgaatgaa

SEQ ID NO: 177384 - DNA, 17 bp, Homo sapiens
atgttctaagaagtgaa

SEQ ID NO: 177385 - DNA, 14 bp, Homo sapiens
atgttgagggaaca

SEQ ID NO: 177386 - DNA, 20 bp, Homo sapiens
atgttgagggaacagacagg

SEQ ID NO: 177387 - DNA, 13 bp, Homo sapiens
atgttgtcaaaga

SEQ ID NO: 177388 - DNA, 15 bp, Homo sapiens
atgttgtcaaagaga

SEQ ID NO: 177389 - DNA, 21 bp, Homo sapiens
atgttgtgtttctgttcacct

SEQ ID NO: 177390 - DNA, 19 bp, Homo sapiens
atgtttacactctttgtaa

SEQ ID NO: 177391 - DNA, 13 bp, Homo sapiens
atgtttacatatc

SEQ ID NO: 177392 - DNA, 14 bp, Homo sapiens
atgtttagtaaact

SEQ ID NO: 177393 - DNA, 18 bp, Homo sapiens
atgtttattcctgataat

SEQ ID NO: 177394 - DNA, 19 bp, Homo sapiens
atgtttcacgaagtttgtt

SEQ ID NO: 177395 - DNA, 12 bp, Homo sapiens
atgtttctctgg

SEQ ID NO: 177396 - DNA, 17 bp, Homo sapiens
atgtttctctggcccca

SEQ ID NO: 177397 - DNA, 15 bp, Homo sapiens
atgtttcttctaggt

SEQ ID NO: 177398 - DNA, 19 bp, Homo sapiens
atgtttcttttgtatgtaa

SEQ ID NO: 177399 - DNA, 20 bp, Homo sapiens
atgtttcttttgtatgtaaa

SEQ ID NO: 177400 - DNA, 19 bp, Homo sapiens
atgtttttgttcaaagcca

SEQ ID NO: 177401 - DNA, 12 bp, Homo sapiens
attaaaaatata

SEQ ID NO: 177402 - DNA, 11 bp, Homo sapiens
attaaaatctt

SEQ ID NO: 177403 - DNA, 12 bp, Homo sapiens
attaaaatctta

SEQ ID NO: 177404 - DNA, 18 bp, Homo sapiens
attaaaatgattgtaaaa

SEQ ID NO: 177405 - DNA, 20 bp, Homo sapiens
attaaattttgagttctaca

SEQ ID NO: 177406 - DNA, 17 bp, Homo sapiens
attaaccacttcagctg

SEQ ID NO: 177407 - DNA, 15 bp, Homo sapiens
attaagaaaatcata

SEQ ID NO: 177408 - DNA, 15 bp, Homo sapiens
attaagaaaatctat

SEQ ID NO: 177409 - DNA, 17 bp, Homo sapiens
attaagccctcttccat

SEQ ID NO: 177410 - DNA, 20 bp, Homo sapiens
attaagccctcttccatcat

SEQ ID NO: 177411 - DNA, 13 bp, Homo sapiens
attaaggaagaca

SEQ ID NO: 177412 - DNA, 16 bp, Homo sapiens
attaataaaaaatgga

SEQ ID NO: 177413 - DNA, 19 bp, Homo sapiens
attaataaaaaatggaaag

SEQ ID NO: 177414 - DNA, 19 bp, Homo sapiens
attaatagcttttattgta

SEQ ID NO: 177415 - DNA, 19 bp, Homo sapiens
attaatatccctacatgta

SEQ ID NO: 177416 - DNA, 18 bp, Homo sapiens
aatgacatcaccacagtt

SEQ ID NO: 177417 - DNA, 21 bp, Homo sapiens
aatgaccagtaattgtgaaaa

SEQ ID NO: 177418 - DNA, 17 bp, Homo sapiens
aatgactaaaaatatta

SEQ ID NO: 177419 - DNA, 24 bp, Homo sapiens
aatgactaaaaatattataactta

SEQ ID NO: 177420 - DNA, 19 bp, Homo sapiens
aatgagaccctcgtggcct

SEQ ID NO: 177421 - DNA, 11 bp, Homo sapiens
aatgagcctgg

SEQ ID NO: 177422 - DNA, 12 bp, Homo sapiens
aatgagcctggc

SEQ ID NO: 177423 - DNA, 14 bp, Homo sapiens
aatgaggacatgtt

SEQ ID NO: 177424 - DNA, 16 bp, Homo sapiens
aatgatcataagtcta

SEQ ID NO: 177425 - DNA, 13 bp, Homo sapiens
aatgattcagtgt

SEQ ID NO: 177426 - DNA, 14 bp, Homo sapiens
aatgattcagtgtt

SEQ ID NO: 177427 - DNA, 22 bp, Homo sapiens
aatgattcagtgttaaatgtga

SEQ ID NO: 177428 - DNA, 20 bp, Homo sapiens
aatgattgtaaaatagcttg

SEQ ID NO: 177429 - DNA, 18 bp, Homo sapiens
aatgatttccaaagagaa

SEQ ID NO: 177430 - DNA, 19 bp, Homo sapiens
aatgattttatctgtgaat

SEQ ID NO: 177431 - DNA, 20 bp, Homo sapiens
aatgattttatctgtgaatt

SEQ ID NO: 177432 - DNA, 13 bp, Homo sapiens
aatgcataaaatg

SEQ ID NO: 177433 - DNA, 23 bp, Homo sapiens
aatgcatccattcctcagggaca

SEQ ID NO: 177434 - DNA, 20 bp, Homo sapiens
aatgcggccgcattccctga

SEQ ID NO: 177435 - DNA, 19 bp, Homo sapiens
aatgctaggttaattccaa

SEQ ID NO: 177436 - DNA, 12 bp, Homo sapiens
aatgctttcgat

SEQ ID NO: 177437 - DNA, 11 bp, Homo sapiens
aatgctttttg

SEQ ID NO: 177438 - DNA, 16 bp, Homo sapiens
aatgggaatattttat

SEQ ID NO: 177439 - DNA, 23 bp, Homo sapiens
aatgggcactgggatgagccgct

SEQ ID NO: 177440 - DNA, 19 bp, Homo sapiens
aatggtccaggagaaggcc

SEQ ID NO: 177441 - DNA, 22 bp, Homo sapiens
aatggtctttctaatgtgtgaa

SEQ ID NO: 177442 - DNA, 15 bp, Homo sapiens
aatggttgccttaaa

SEQ ID NO: 177443 - DNA, 17 bp, Homo sapiens
aatgtacatctggcctt

SEQ ID NO: 177444 - DNA, 14 bp, Homo sapiens
aatgtacccagtat

SEQ ID NO: 177445 - DNA, 12 bp, Homo sapiens
aatgtactgcat

SEQ ID NO: 177446 - DNA, 13 bp, Homo sapiens
aatgtatatgcac

SEQ ID NO: 177447 - DNA, 13 bp, Homo sapiens
aatgtatcttatt

SEQ ID NO: 177448 - DNA, 16 bp, Homo sapiens
aatgtatcttattcac

SEQ ID NO: 177449 - DNA, 18 bp, Homo sapiens
aatgtattgaacttggaa

SEQ ID NO: 177450 - DNA, 14 bp, Homo sapiens
aatgtatttttcct

SEQ ID NO: 177451 - DNA, 11 bp, Homo sapiens
aatgtcttgtg

SEQ ID NO: 177452 - DNA, 18 bp, Homo sapiens
aatgtctttgttggaaaa

SEQ ID NO: 177453 - DNA, 22 bp, Homo sapiens
aatgtctttgttggaaaagaat

SEQ ID NO: 177454 - DNA, 16 bp, Homo sapiens
aatgtgatattataca

SEQ ID NO: 177455 - DNA, 12 bp, Homo sapiens
aatgtgatgaat

SEQ ID NO: 177456 - DNA, 22 bp, Homo sapiens
aatgtgattcctttgaagagga

SEQ ID NO: 177457 - DNA, 17 bp, Homo sapiens
aatgtggcctaaaaatg

SEQ ID NO: 177458 - DNA, 16 bp, Homo sapiens
aatgtgtaattttgtt

SEQ ID NO: 177459 - DNA, 19 bp, Homo sapiens
aatgtgtaattttgttcta

SEQ ID NO: 177460 - DNA, 21 bp, Homo sapiens
aatgttattttttaattatta

SEQ ID NO: 177461 - DNA, 16 bp, Homo sapiens
aatgttcatcaatgaa

SEQ ID NO: 177462 - DNA, 21 bp, Homo sapiens
aatgttctctcttctccacct

SEQ ID NO: 177463 - DNA, 12 bp, Homo sapiens
aatgttgaaaag

SEQ ID NO: 177464 - DNA, 14 bp, Homo sapiens
aatgtttaatgctg

SEQ ID NO: 177465 - DNA, 22 bp, Homo sapiens
aatgtttcttctaggttctaaa

SEQ ID NO: 177466 - DNA, 22 bp, Homo sapiens
aattaaattttgagttctacat

SEQ ID NO: 177467 - DNA, 14 bp, Homo sapiens
aattaatagctttt

SEQ ID NO: 177468 - DNA, 13 bp, Homo sapiens
aattaatgacaga

SEQ ID NO: 177469 - DNA, 17 bp, Homo sapiens
aattacatgtaaaacat

SEQ ID NO: 177470 - DNA, 16 bp, Homo sapiens
aattataatatactat

SEQ ID NO: 177471 - DNA, 13 bp, Homo sapiens
aattattattctt

SEQ ID NO: 177472 - DNA, 11 bp, Homo sapiens
aattattattt

SEQ ID NO: 177473 - DNA, 14 bp, Homo sapiens
aattatttaataaa

SEQ ID NO: 177474 - DNA, 12 bp, Homo sapiens
aattatttgcat

SEQ ID NO: 177475 - DNA, 14 bp, Homo sapiens
aattatttgtgtaa

SEQ ID NO: 177476 - DNA, 15 bp, Homo sapiens
aattatttgtgtaat

SEQ ID NO: 177477 - DNA, 18 bp, Homo sapiens
aattatttgtgtaataga

SEQ ID NO: 177478 - DNA, 21 bp, Homo sapiens
aattatttgtgtaatagaaaa

SEQ ID NO: 177479 - DNA, 18 bp, Homo sapiens
aattattttaaacaaaat

SEQ ID NO: 177480 - DNA, 18 bp, Homo sapiens
aattcaaagctctattaa

SEQ ID NO: 177481 - DNA, 14 bp, Homo sapiens
aattcaaccctttg

SEQ ID NO: 177482 - DNA, 18 bp, Homo sapiens
aattcaaccctttgcccc

SEQ ID NO: 177483 - DNA, 15 bp, Homo sapiens
aattcaactcagact

SEQ ID NO: 177484 - DNA, 20 bp, Homo sapiens
aattcaagaaaacaacttca

SEQ ID NO: 177485 - DNA, 22 bp, Homo sapiens
aattcacatctaacctcatctt

SEQ ID NO: 177486 - DNA, 16 bp, Homo sapiens
aattcagtgctgtact

SEQ ID NO: 177487 - DNA, 14 bp, Homo sapiens
aattccactgtcaa

SEQ ID NO: 177488 - DNA, 22 bp, Homo sapiens
aattccacttataggaattgac

SEQ ID NO: 177489 - DNA, 16 bp, Homo sapiens
aattccctctctctga

SEQ ID NO: 177490 - DNA, 22 bp, Homo sapiens
aattcctatacgcagcgtgctt

SEQ ID NO: 177491 - DNA, 21 bp, Homo sapiens
aattcctctcactaaacttta

SEQ ID NO: 177492 - DNA, 13 bp, Homo sapiens
aattctaaatgaa

SEQ ID NO: 177493 - DNA, 15 bp, Homo sapiens
aattctacattgtca

SEQ ID NO: 177494 - DNA, 22 bp, Homo sapiens
aattctagctttgagcttaaga

SEQ ID NO: 177495 - DNA, 13 bp, Homo sapiens
aattctcatgtga

SEQ ID NO: 177496 - DNA, 20 bp, Homo sapiens
aattctcatgtgatcctttt

SEQ ID NO: 177497 - DNA, 16 bp, Homo sapiens
aattctgctacctcac

SEQ ID NO: 177498 - DNA, 18 bp, Homo sapiens
aattctgtttttctaggc

SEQ ID NO: 177499 - DNA, 18 bp, Homo sapiens
aattcttcaggtggaaaa

SEQ ID NO: 177500 - DNA, 15 bp, Homo sapiens
aattcttgaaggaaa

SEQ ID NO: 177501 - DNA, 16 bp, Homo sapiens
aattcttgaaggaaaa

SEQ ID NO: 177502 - DNA, 19 bp, Homo sapiens
aattcttggttgaggaaac

SEQ ID NO: 177503 - DNA, 15 bp, Homo sapiens
aattcttgtatatta

SEQ ID NO: 177504 - DNA, 20 bp, Homo sapiens
aattcttgtatattatggaa

SEQ ID NO: 177505 - DNA, 15 bp, Homo sapiens
aattgactcaaatct

SEQ ID NO: 177506 - DNA, 17 bp, Homo sapiens
aattgagttttcagtgg

SEQ ID NO: 177507 - DNA, 14 bp, Homo sapiens
aattgatgtgttta

SEQ ID NO: 177508 - DNA, 22 bp, Homo sapiens
aattgattattctgattccact

SEQ ID NO: 177509 - DNA, 18 bp, Homo sapiens
aattgcacttttaaacct

SEQ ID NO: 177510 - DNA, 12 bp, Homo sapiens
aattgctccttg

SEQ ID NO: 177511 - DNA, 20 bp, Homo sapiens
aattgcttacatttttacaa

SEQ ID NO: 177512 - DNA, 21 bp, Homo sapiens
aattgcttacatttttacaat

SEQ ID NO: 177513 - DNA, 15 bp, Homo sapiens
aattgcttgaaagaa

SEQ ID NO: 177514 - DNA, 17 bp, Homo sapiens
aattgcttgaaagaaaa

SEQ ID NO: 177515 - DNA, 22 bp, Homo sapiens
aattgcttgaaagaaaatatgc

SEQ ID NO: 177516 - DNA, 16 bp, Homo sapiens
aattgtcccttaaaca

SEQ ID NO: 177517 - DNA, 20 bp, Homo sapiens
aattgtttcaaaataaaaac

SEQ ID NO: 177518 - DNA, 15 bp, Homo sapiens
aatttatacaatatc

SEQ ID NO: 177519 - DNA, 19 bp, Homo sapiens
aatttatcttgtctctggg

SEQ ID NO: 177520 - DNA, 15 bp, Homo sapiens
aatttattaaaatga

SEQ ID NO: 177521 - DNA, 12 bp, Homo sapiens
aatttattcaat

SEQ ID NO: 177522 - DNA, 20 bp, Homo sapiens
aatttatttatactatttag

SEQ ID NO: 177523 - DNA, 18 bp, Homo sapiens
cagccccttgagaaacct

SEQ ID NO: 177524 - DNA, 15 bp, Homo sapiens
cagcccggcgccacc

SEQ ID NO: 177525 - DNA, 21 bp, Homo sapiens
cagcccggcgccaccatcctg

SEQ ID NO: 177526 - DNA, 18 bp, Homo sapiens
cagccctagggtggagag

SEQ ID NO: 177527 - DNA, 16 bp, Homo sapiens
cagccctccctgcccc

SEQ ID NO: 177528 - DNA, 22 bp, Homo sapiens
cagccctccctgcccctccctt

SEQ ID NO: 177529 - DNA, 12 bp, Homo sapiens
cagccctcctca

SEQ ID NO: 177530 - DNA, 16 bp, Homo sapiens
cagccctcctcacccc

SEQ ID NO: 177531 - DNA, 22 bp, Homo sapiens
cagccctcctcaccccgtctgg

SEQ ID NO: 177532 - DNA, 11 bp, Homo sapiens
cagccctgctt

SEQ ID NO: 177533 - DNA, 22 bp, Homo sapiens
cagccctgctttgggctgccct

SEQ ID NO: 177534 - DNA, 12 bp, Homo sapiens
cagccctggctc

SEQ ID NO: 177535 - DNA, 16 bp, Homo sapiens
cagccctggctctgca

SEQ ID NO: 177536 - DNA, 12 bp, Homo sapiens
cagccctgggcc

SEQ ID NO: 177537 - DNA, 13 bp, Homo sapiens
cagccctgggccc

SEQ ID NO: 177538 - DNA, 17 bp, Homo sapiens
cagccctgggccccacc

SEQ ID NO: 177539 - DNA, 19 bp, Homo sapiens
cagccgattcacctgagca

SEQ ID NO: 177540 - DNA, 22 bp, Homo sapiens
cagccgctcctgtctgccagcc

SEQ ID NO: 177541 - DNA, 20 bp, Homo sapiens
cagccgctgagcgaggagat

SEQ ID NO: 177542 - DNA, 13 bp, Homo sapiens
cagccggcacagg

SEQ ID NO: 177543 - DNA, 18 bp, Homo sapiens
cagccggcacagggtctg

SEQ ID NO: 177544 - DNA, 16 bp, Homo sapiens
cagccgtgccttcagc

SEQ ID NO: 177545 - DNA, 17 bp, Homo sapiens
cagcctagccgacctca

SEQ ID NO: 177546 - DNA, 19 bp, Homo sapiens
cagcctagccgacctcagc

SEQ ID NO: 177547 - DNA, 21 bp, Homo sapiens
cagcctagccgacctcagcct

SEQ ID NO: 177548 - DNA, 21 bp, Homo sapiens
cagcctcagtcctcccctcac

SEQ ID NO: 177549 - DNA, 22 bp, Homo sapiens
cagcctcagtcctcccctcaca

SEQ ID NO: 177550 - DNA, 14 bp, Homo sapiens
cagcctccaagctc

SEQ ID NO: 177551 - DNA, 16 bp, Homo sapiens
cagcctcccctgccag

SEQ ID NO: 177552 - DNA, 17 bp, Homo sapiens
cagcctcccctgccagg

SEQ ID NO: 177553 - DNA, 18 bp, Homo sapiens
cagcctccgtatttcaga

SEQ ID NO: 177554 - DNA, 17 bp, Homo sapiens
cagcctctcccctgatt

SEQ ID NO: 177555 - DNA, 23 bp, Homo sapiens
cagcctctcttggtttccttcct

SEQ ID NO: 177556 - DNA, 14 bp, Homo sapiens
cagcctctgacccc

SEQ ID NO: 177557 - DNA, 17 bp, Homo sapiens
cagcctctgacccctcc

SEQ ID NO: 177558 - DNA, 21 bp, Homo sapiens
cagcctctgacccctcctcac

SEQ ID NO: 177559 - DNA, 22 bp, Homo sapiens
cagcctctgacccctcctcact

SEQ ID NO: 177560 - DNA, 19 bp, Homo sapiens
cagcctctgagcccctggg

SEQ ID NO: 177561 - DNA, 11 bp, Homo sapiens
cagcctcttaa

SEQ ID NO: 177562 - DNA, 21 bp, Homo sapiens
cagcctcttaaagctgcctgt

SEQ ID NO: 177563 - DNA, 16 bp, Homo sapiens
cagcctctttctgtcc

SEQ ID NO: 177564 - DNA, 18 bp, Homo sapiens
cagcctgagcgacagtga

SEQ ID NO: 177565 - DNA, 15 bp, Homo sapiens
cagcctgctccagct

SEQ ID NO: 177566 - DNA, 12 bp, Homo sapiens
cagcctggaggc

SEQ ID NO: 177567 - DNA, 21 bp, Homo sapiens
cagcctggcacagggcagtgg

SEQ ID NO: 177568 - DNA, 17 bp, Homo sapiens
cagcctggtgggcctcc

SEQ ID NO: 177569 - DNA, 18 bp, Homo sapiens
cagcctggtgggcctcct

SEQ ID NO: 177570 - DNA, 19 bp, Homo sapiens
cagcctgtcccatggacac

SEQ ID NO: 177571 - DNA, 12 bp, Homo sapiens
cagcctgtggcg

SEQ ID NO: 177572 - DNA, 21 bp, Homo sapiens
cagccttcttccatcccagga

SEQ ID NO: 177573 - DNA, 19 bp, Homo sapiens
cagcctttctcccaggcca

SEQ ID NO: 177574 - DNA, 20 bp, Homo sapiens
cagcctttctcccaggccag

SEQ ID NO: 177575 - DNA, 19 bp, Homo sapiens
cagcctttgatcaggtggg

SEQ ID NO: 177576 - DNA, 21 bp, Homo sapiens
cagcgaaaggatgtaaacagt

SEQ ID NO: 177577 - DNA, 14 bp, Homo sapiens
attacacaaaacaa

SEQ ID NO: 177578 - DNA, 15 bp, Homo sapiens
attacagtgggtgcc

SEQ ID NO: 177579 - DNA, 16 bp, Homo sapiens
attaccgcgttgtaaa

SEQ ID NO: 177580 - DNA, 18 bp, Homo sapiens
attactgtctggttttaa

SEQ ID NO: 177581 - DNA, 23 bp, Homo sapiens
attagaaattagctgtgtgaaat

SEQ ID NO: 177582 - DNA, 19 bp, Homo sapiens
attagaacaggcaagtgaa

SEQ ID NO: 177583 - DNA, 13 bp, Homo sapiens
attagagaagaga

SEQ ID NO: 177584 - DNA, 21 bp, Homo sapiens
attagagcagatgacccctcc

SEQ ID NO: 177585 - DNA, 16 bp, Homo sapiens
attaggatttcatgat

SEQ ID NO: 177586 - DNA, 16 bp, Homo sapiens
attagtaaatgcttat

SEQ ID NO: 177587 - DNA, 16 bp, Homo sapiens
attagtaacatgtgtt

SEQ ID NO: 177588 - DNA, 14 bp, Homo sapiens
attagttaatatat

SEQ ID NO: 177589 - DNA, 16 bp, Homo sapiens
attataacttaaaata

SEQ ID NO: 177590 - DNA, 17 bp, Homo sapiens
attataatttaatgcat

SEQ ID NO: 177591 - DNA, 23 bp, Homo sapiens
attatagtgatgtaatcttgaat

SEQ ID NO: 177592 - DNA, 23 bp, Homo sapiens
attatataggttgtgcaaattaa

SEQ ID NO: 177593 - DNA, 14 bp, Homo sapiens
attatattaaaata

SEQ ID NO: 177594 - DNA, 17 bp, Homo sapiens
attatggaagattttaa

SEQ ID NO: 177595 - DNA, 17 bp, Homo sapiens
attattattaaaaatat

SEQ ID NO: 177596 - DNA, 15 bp, Homo sapiens
attattattcttcat

SEQ ID NO: 177597 - DNA, 13 bp, Homo sapiens
attattcagtgtc

SEQ ID NO: 177598 - DNA, 20 bp, Homo sapiens
attattcatttaaaatgatt

SEQ ID NO: 177599 - DNA, 13 bp, Homo sapiens
attatttaataaa

SEQ ID NO: 177600 - DNA, 21 bp, Homo sapiens
attatttaataaaaaaacaat

SEQ ID NO: 177601 - DNA, 14 bp, Homo sapiens
attcaaacagtctc

SEQ ID NO: 177602 - DNA, 15 bp, Homo sapiens
attcaaacagtctca

SEQ ID NO: 177603 - DNA, 20 bp, Homo sapiens
attcaaacagtctcaggaaa

SEQ ID NO: 177604 - DNA, 17 bp, Homo sapiens
attcaaagctctattaa

SEQ ID NO: 177605 - DNA, 15 bp, Homo sapiens
attcaaggtggccaa

SEQ ID NO: 177606 - DNA, 16 bp, Homo sapiens
attcaagtgtacagtg

SEQ ID NO: 177607 - DNA, 14 bp, Homo sapiens
attcaagttattgt

SEQ ID NO: 177608 - DNA, 16 bp, Homo sapiens
attcaattcctctggg

SEQ ID NO: 177609 - DNA, 18 bp, Homo sapiens
attcaattcctctgggaa

SEQ ID NO: 177610 - DNA, 14 bp, Homo sapiens
attcagagagcagc

SEQ ID NO: 177611 - DNA, 14 bp, Homo sapiens
attcagattttaaa

SEQ ID NO: 177612 - DNA, 14 bp, Homo sapiens
attcagctctgcaa

SEQ ID NO: 177613 - DNA, 18 bp, Homo sapiens
attcagctctgcaagaat

SEQ ID NO: 177614 - DNA, 17 bp, Homo sapiens
attcagtgcttcttaaa

SEQ ID NO: 177615 - DNA, 19 bp, Homo sapiens
attcatatttacttcttat

SEQ ID NO: 177616 - DNA, 20 bp, Homo sapiens
attcatctgtttttcttttt

SEQ ID NO: 177617 - DNA, 15 bp, Homo sapiens
attcattgaagtcag

SEQ ID NO: 177618 - DNA, 10 bp, Homo sapiens
attcatttaa

SEQ ID NO: 177619 - DNA, 17 bp, Homo sapiens
attcatttaaaatgatt

SEQ ID NO: 177620 - DNA, 11 bp, Homo sapiens
attcatttcaa

SEQ ID NO: 177621 - DNA, 22 bp, Homo sapiens
attcatttcaaagggagagaga

SEQ ID NO: 177622 - DNA, 15 bp, Homo sapiens
attccaaccccaact

SEQ ID NO: 177623 - DNA, 21 bp, Homo sapiens
attccagagagtggctcctcc

SEQ ID NO: 177624 - DNA, 17 bp, Homo sapiens
attccatatttattcaa

SEQ ID NO: 177625 - DNA, 20 bp, Homo sapiens
attcccagggaagtgctctg

SEQ ID NO: 177626 - DNA, 20 bp, Homo sapiens
attccctagaaacttccaaa

SEQ ID NO: 177627 - DNA, 14 bp, Homo sapiens
attccctctctctg

SEQ ID NO: 177628 - DNA, 19 bp, Homo sapiens
attccctgagtcaccagga

SEQ ID NO: 177629 - DNA, 21 bp, Homo sapiens
attcctatacgcagcgtgctt

SEQ ID NO: 177630 - DNA, 14 bp, Homo sapiens
attcctgcagcctg

SEQ ID NO: 177631 - DNA, 17 bp, Homo sapiens
attcctgcagcctggag

SEQ ID NO: 177632 - DNA, 22 bp, Homo sapiens
attcctgtggatgtaaagtgat

SEQ ID NO: 177633 - DNA, 20 bp, Homo sapiens
attccttagcttagacctca

SEQ ID NO: 177634 - DNA, 21 bp, Homo sapiens
attccttggcatgccttccag

SEQ ID NO: 177635 - DNA, 20 bp, Homo sapiens
attcctttgaagaggaaaat

SEQ ID NO: 177636 - DNA, 15 bp, Homo sapiens
attctaaatgaatgt

SEQ ID NO: 177637 - DNA, 18 bp, Homo sapiens
attctaaatgaatgttta

SEQ ID NO: 177638 - DNA, 15 bp, Homo sapiens
attctagctaatgta

SEQ ID NO: 177639 - DNA, 18 bp, Homo sapiens
attctagctaatgtaata

SEQ ID NO: 177640 - DNA, 15 bp, Homo sapiens
attctcactccacca

SEQ ID NO: 177641 - DNA, 12 bp, Homo sapiens
attctcatgtga

SEQ ID NO: 177642 - DNA, 17 bp, Homo sapiens
attctctctcctgtcca

SEQ ID NO: 177643 - DNA, 11 bp, Homo sapiens
attctctgagc

SEQ ID NO: 177644 - DNA, 18 bp, Homo sapiens
attctctgtctcatccat

SEQ ID NO: 177645 - DNA, 19 bp, Homo sapiens
attctctgtctcatccatc

SEQ ID NO: 177646 - DNA, 14 bp, Homo sapiens
attctcttatccaa

SEQ ID NO: 177647 - DNA, 15 bp, Homo sapiens
attctcttatccaac

SEQ ID NO: 177648 - DNA, 22 bp, Homo sapiens
attctgcgtcatgcttgtgtta

SEQ ID NO: 177649 - DNA, 19 bp, Homo sapiens
attctgctacctcactggg

SEQ ID NO: 177650 - DNA, 17 bp, Homo sapiens
attcttggttgaggaaa

SEQ ID NO: 177651 - DNA, 17 bp, Homo sapiens
attctttaaatttcatc

SEQ ID NO: 177652 - DNA, 13 bp, Homo sapiens
attcttttaaaag

SEQ ID NO: 177653 - DNA, 22 bp, Homo sapiens
attcttttaaaagacaagactt

SEQ ID NO: 177654 - DNA, 14 bp, Homo sapiens
attctttttaaagt

SEQ ID NO: 177655 - DNA, 15 bp, Homo sapiens
attgaaaaatcacca

SEQ ID NO: 177656 - DNA, 22 bp, Homo sapiens
attgaacaagttgtttcattga

SEQ ID NO: 177657 - DNA, 15 bp, Homo sapiens
attgaacccaggagg

SEQ ID NO: 177658 - DNA, 15 bp, Homo sapiens
attgacaagaactga

SEQ ID NO: 177659 - DNA, 17 bp, Homo sapiens
attgacaataatttcag

SEQ ID NO: 177660 - DNA, 20 bp, Homo sapiens
attgacaataatttcaggtt

SEQ ID NO: 177661 - DNA, 17 bp, Homo sapiens
attgacacttaaaaatg

SEQ ID NO: 177662 - DNA, 18 bp, Homo sapiens
attgacaggattattgga

SEQ ID NO: 177663 - DNA, 22 bp, Homo sapiens
attgacgacaagtgctgaacag

SEQ ID NO: 177664 - DNA, 21 bp, Homo sapiens
attgactatcaaactgaagcc

SEQ ID NO: 177665 - DNA, 20 bp, Homo sapiens
caggagattgagaaggagag

SEQ ID NO: 177666 - DNA, 22 bp, Homo sapiens
caggagattgagaaggagagaa

SEQ ID NO: 177667 - DNA, 17 bp, Homo sapiens
caggaggctgaggcaga

SEQ ID NO: 177668 - DNA, 18 bp, Homo sapiens
caggaggctgaggcagaa

SEQ ID NO: 177669 - DNA, 21 bp, Homo sapiens
caggaggctgaggcagaagaa

SEQ ID NO: 177670 - DNA, 17 bp, Homo sapiens
caggagttagaggccag

SEQ ID NO: 177671 - DNA, 18 bp, Homo sapiens
caggagttagaggccagc

SEQ ID NO: 177672 - DNA, 21 bp, Homo sapiens
caggagtttgagaccaacctg

SEQ ID NO: 177673 - DNA, 18 bp, Homo sapiens
caggataataaagtgttt

SEQ ID NO: 177674 - DNA, 15 bp, Homo sapiens
caggatagttgctcc

SEQ ID NO: 177675 - DNA, 18 bp, Homo sapiens
caggcaactgaggcagac

SEQ ID NO: 177676 - DNA, 14 bp, Homo sapiens
caggcacaaaatga

SEQ ID NO: 177677 - DNA, 16 bp, Homo sapiens
caggcacgaacccacc

SEQ ID NO: 177678 - DNA, 17 bp, Homo sapiens
caggcactgctgcccag

SEQ ID NO: 177679 - DNA, 23 bp, Homo sapiens
caggcactgctgcccagcctcca

SEQ ID NO: 177680 - DNA, 10 bp, Homo sapiens
caggcagaca

SEQ ID NO: 177681 - DNA, 20 bp, Homo sapiens
caggcaggaaggctgagagg

SEQ ID NO: 177682 - DNA, 14 bp, Homo sapiens
caggcaggtgcctg

SEQ ID NO: 177683 - DNA, 16 bp, Homo sapiens
caggcaggtgcctgga

SEQ ID NO: 177684 - DNA, 20 bp, Homo sapiens
caggcagtgatgctggatgc

SEQ ID NO: 177685 - DNA, 17 bp, Homo sapiens
caggcatggtggcccac

SEQ ID NO: 177686 - DNA, 13 bp, Homo sapiens
caggccccaggaa

SEQ ID NO: 177687 - DNA, 17 bp, Homo sapiens
caggccccaggaagccg

SEQ ID NO: 177688 - DNA, 18 bp, Homo sapiens
caggccccgcttgtccag

SEQ ID NO: 177689 - DNA, 22 bp, Homo sapiens
caggccccgcttgtccagcgcc

SEQ ID NO: 177690 - DNA, 19 bp, Homo sapiens
caggcccggcgcggtggct

SEQ ID NO: 177691 - DNA, 20 bp, Homo sapiens
caggccgccccagcctctga

SEQ ID NO: 177692 - DNA, 21 bp, Homo sapiens
caggccgccccagcctctgag

SEQ ID NO: 177693 - DNA, 19 bp, Homo sapiens
caggccggcgagccctgtg

SEQ ID NO: 177694 - DNA, 15 bp, Homo sapiens
caggcctgaaagagg

SEQ ID NO: 177695 - DNA, 18 bp, Homo sapiens
caggcctgccagacggca

SEQ ID NO: 177696 - DNA, 12 bp, Homo sapiens
caggcctgtgtg

SEQ ID NO: 177697 - DNA, 16 bp, Homo sapiens
caggcgatccacctgt

SEQ ID NO: 177698 - DNA, 20 bp, Homo sapiens
caggcgatccacctgtctca

SEQ ID NO: 177699 - DNA, 14 bp, Homo sapiens
caggctactctcct

SEQ ID NO: 177700 - DNA, 11 bp, Homo sapiens
caggctactgt

SEQ ID NO: 177701 - DNA, 14 bp, Homo sapiens
caggctactgtcag

SEQ ID NO: 177702 - DNA, 18 bp, Homo sapiens
caggctccttcctgtctt

SEQ ID NO: 177703 - DNA, 15 bp, Homo sapiens
caggctctgccctgc

SEQ ID NO: 177704 - DNA, 18 bp, Homo sapiens
caggctcttctcctttca

SEQ ID NO: 177705 - DNA, 13 bp, Homo sapiens
caggctggtctca

SEQ ID NO: 177706 - DNA, 17 bp, Homo sapiens
cagggaagagcagaacg

SEQ ID NO: 177707 - DNA, 22 bp, Homo sapiens
cagggaagagcagaacggagcc

SEQ ID NO: 177708 - DNA, 19 bp, Homo sapiens
cagggacagagacacctgc

SEQ ID NO: 177709 - DNA, 21 bp, Homo sapiens
cagggacagagacacctgcac

SEQ ID NO: 177710 - DNA, 22 bp, Homo sapiens
cagggacagagacacctgcacc

SEQ ID NO: 177711 - DNA, 13 bp, Homo sapiens
cagggacagagcc

SEQ ID NO: 177712 - DNA, 17 bp, Homo sapiens
cagggacagagccatgc

SEQ ID NO: 177713 - DNA, 12 bp, Homo sapiens
cagggacaggat

SEQ ID NO: 177714 - DNA, 16 bp, Homo sapiens
cagggacccctgccct

SEQ ID NO: 177715 - DNA, 17 bp, Homo sapiens
cagggagcggaaagcag

SEQ ID NO: 177716 - DNA, 18 bp, Homo sapiens
cagggagcggaaagcagc

SEQ ID NO: 177717 - DNA, 16 bp, Homo sapiens
cagggaggtcattttg

SEQ ID NO: 177718 - DNA, 18 bp, Homo sapiens
cagggcatgccccggcca

SEQ ID NO: 177719 - DNA, 21 bp, Homo sapiens
cagggcatgccccggccacct

SEQ ID NO: 177720 - DNA, 17 bp, Homo sapiens
cagggccaacttgaggg

SEQ ID NO: 177721 - DNA, 12 bp, Homo sapiens
cagggccactct

SEQ ID NO: 177722 - DNA, 17 bp, Homo sapiens
cagggccactctgcctc

SEQ ID NO: 177723 - DNA, 18 bp, Homo sapiens
cagggccactctgcctct

SEQ ID NO: 177724 - DNA, 12 bp, Homo sapiens
cagggccaggac

SEQ ID NO: 177725 - DNA, 18 bp, Homo sapiens
cagggccaggactgagcc

SEQ ID NO: 177726 - DNA, 14 bp, Homo sapiens
cagggccccagcac

SEQ ID NO: 177727 - DNA, 21 bp, Homo sapiens
cagggcccctcaccctgcctt

SEQ ID NO: 177728 - DNA, 22 bp, Homo sapiens
cagggcccctcaccctgcctta

SEQ ID NO: 177729 - DNA, 21 bp, Homo sapiens
cagggcctgagcctggccagc

SEQ ID NO: 177730 - DNA, 17 bp, Homo sapiens
cagggccttgcccagag

SEQ ID NO: 177731 - DNA, 20 bp, Homo sapiens
cagggccttgcccagagatg

SEQ ID NO: 177732 - DNA, 17 bp, Homo sapiens
cagggctaagagctagc

SEQ ID NO: 177733 - DNA, 13 bp, Homo sapiens
cagggctcagcct

SEQ ID NO: 177734 - DNA, 13 bp, Homo sapiens
cagggctcctggg

SEQ ID NO: 177735 - DNA, 21 bp, Homo sapiens
cagggctgacacgtccacccc

SEQ ID NO: 177736 - DNA, 21 bp, Homo sapiens
caggggagagggtctggagaa

SEQ ID NO: 177737 - DNA, 18 bp, Homo sapiens
caggggagtcccgtcagg

SEQ ID NO: 177738 - DNA, 13 bp, Homo sapiens
caggggctctgga

SEQ ID NO: 177739 - DNA, 13 bp, Homo sapiens
cagggggccaggt

SEQ ID NO: 177740 - DNA, 21 bp, Homo sapiens
cagggtattccagagtgggga

SEQ ID NO: 177741 - DNA, 21 bp, Homo sapiens
cagggtctctaccatcccctg

SEQ ID NO: 177742 - DNA, 14 bp, Homo sapiens
cagggtctgctctt

SEQ ID NO: 177743 - DNA, 20 bp, Homo sapiens
cagggtctgctctttctctg

SEQ ID NO: 177744 - DNA, 19 bp, Homo sapiens
cagggttgaccccagagga

SEQ ID NO: 177745 - DNA, 20 bp, Homo sapiens
cagggtttggctgtgtctaa

SEQ ID NO: 177746 - DNA, 21 bp, Homo sapiens
cagggtttggctgtgtctaaa

SEQ ID NO: 177747 - DNA, 18 bp, Homo sapiens
caggtagctgcccctggc

SEQ ID NO: 177748 - DNA, 19 bp, Homo sapiens
caggtagctgcccctggct

SEQ ID NO: 177749 - DNA, 20 bp, Homo sapiens
caggtagctgcccctggctc

SEQ ID NO: 177750 - DNA, 22 bp, Homo sapiens
caggtcaatacagtacaggcag

SEQ ID NO: 177751 - DNA, 22 bp, Homo sapiens
caggtctcccacgtgggagaca

SEQ ID NO: 177752 - DNA, 15 bp, Homo sapiens
caggtctcctcttaa

SEQ ID NO: 177753 - DNA, 22 bp, Homo sapiens
caggtgcccagctatacctgtg

SEQ ID NO: 177754 - DNA, 23 bp, Homo sapiens
caggtgcccagctatacctgtgc

SEQ ID NO: 177755 - DNA, 14 bp, Homo sapiens
caggtgcgaaagga

SEQ ID NO: 177756 - DNA, 21 bp, Homo sapiens
caggtgctacacccttttcca

SEQ ID NO: 177757 - DNA, 16 bp, Homo sapiens
caggtggctgacccag

SEQ ID NO: 177758 - DNA, 22 bp, Homo sapiens
caggtggggagactgggctgag

SEQ ID NO: 177759 - DNA, 23 bp, Homo sapiens
caggtggggagactgggctgagg

SEQ ID NO: 177760 - DNA, 23 bp, Homo sapiens
caggtggggagtcagggacccct

SEQ ID NO: 177761 - DNA, 20 bp, Homo sapiens
caggtgtgtccacctgggca

SEQ ID NO: 177762 - DNA, 14 bp, Homo sapiens
caggttccatcccg

SEQ ID NO: 177763 - DNA, 19 bp, Homo sapiens
cagtaacgcgtcttcctga

SEQ ID NO: 177764 - DNA, 20 bp, Homo sapiens
cagtaacgcgtcttcctgag

SEQ ID NO: 177765 - DNA, 18 bp, Homo sapiens
cagtaagggaaatagaaa

SEQ ID NO: 177766 - DNA, 13 bp, Homo sapiens
cagtaatatttat

SEQ ID NO: 177767 - DNA, 14 bp, Homo sapiens
cagtaattgtgaaa

SEQ ID NO: 177768 - DNA, 14 bp, Homo sapiens
cagtacaggcagca

SEQ ID NO: 177769 - DNA, 23 bp, Homo sapiens
cagtaccttcaaactagggccaa

SEQ ID NO: 177770 - DNA, 21 bp, Homo sapiens
cagtaggagcccagctctgaa

SEQ ID NO: 177771 - DNA, 20 bp, Homo sapiens
cagtatcaggcctgccagac

SEQ ID NO: 177772 - DNA, 12 bp, Homo sapiens
cagtatggcagc

SEQ ID NO: 177773 - DNA, 13 bp, Homo sapiens
cagtatgttgtca

SEQ ID NO: 177774 - DNA, 13 bp, Homo sapiens
cagtattcttgtc

SEQ ID NO: 177775 - DNA, 17 bp, Homo sapiens
cagtattttggagaaat

SEQ ID NO: 177776 - DNA, 19 bp, Homo sapiens
cagtattttggagaaatta

SEQ ID NO: 177777 - DNA, 20 bp, Homo sapiens
cagtattttggagaaattat

SEQ ID NO: 177778 - DNA, 19 bp, Homo sapiens
cagtcaaaacagagatgtg

SEQ ID NO: 177779 - DNA, 15 bp, Homo sapiens
cagtcaacctgggca

SEQ ID NO: 177780 - DNA, 15 bp, Homo sapiens
cagtcaaggagtggc

SEQ ID NO: 177781 - DNA, 17 bp, Homo sapiens
cagtcacctgcccagat

SEQ ID NO: 177782 - DNA, 15 bp, Homo sapiens
cagtcataactaaat

SEQ ID NO: 177783 - DNA, 18 bp, Homo sapiens
cagtcatcttgaccaagc

SEQ ID NO: 177784 - DNA, 21 bp, Homo sapiens
cagtcatcttgaccaagcagg

SEQ ID NO: 177785 - DNA, 24 bp, Homo sapiens
cagtcatcttgaccaagcaggaag

SEQ ID NO: 177786 - DNA, 12 bp, Homo sapiens
cagtcatttaaa

SEQ ID NO: 177787 - DNA, 18 bp, Homo sapiens
cagtccacctgagctgcc

SEQ ID NO: 177788 - DNA, 13 bp, Homo sapiens
cagtccatgaaga

SEQ ID NO: 177789 - DNA, 18 bp, Homo sapiens
cagtccccgtgccccgcc

SEQ ID NO: 177790 - DNA, 15 bp, Homo sapiens
cagtcctcccctcac

SEQ ID NO: 177791 - DNA, 19 bp, Homo sapiens
cagtcctgcctcagcctcc

SEQ ID NO: 177792 - DNA, 23 bp, Homo sapiens
cagtctacccacctcagcctcct

SEQ ID NO: 177793 - DNA, 15 bp, Homo sapiens
cagtctcgggtggct

SEQ ID NO: 177794 - DNA, 21 bp, Homo sapiens
cagtctgttccccatggccac

SEQ ID NO: 177795 - DNA, 18 bp, Homo sapiens
cagtgaatgattcagtgt

SEQ ID NO: 177796 - DNA, 20 bp, Homo sapiens
cagtgaatgattcagtgtta

SEQ ID NO: 177797 - DNA, 14 bp, Homo sapiens
cagtgacctgagga

SEQ ID NO: 177798 - DNA, 20 bp, Homo sapiens
cagtgagaaaaagctcctgt

SEQ ID NO: 177799 - DNA, 21 bp, Homo sapiens
cagtgagaaaaagctcctgtc

SEQ ID NO: 177800 - DNA, 15 bp, Homo sapiens
cagtgagtgagcctg

SEQ ID NO: 177801 - DNA, 20 bp, Homo sapiens
cagtgagtgagcctggctct

SEQ ID NO: 177802 - DNA, 18 bp, Homo sapiens
cagtgatgctggatgctc

SEQ ID NO: 177803 - DNA, 17 bp, Homo sapiens
cagtgattaccagggac

SEQ ID NO: 177804 - DNA, 18 bp, Homo sapiens
cagtgattaccagggact

SEQ ID NO: 177805 - DNA, 22 bp, Homo sapiens
cagtgattaccagggactgagg

SEQ ID NO: 177806 - DNA, 13 bp, Homo sapiens
cacagggctaaga

SEQ ID NO: 177807 - DNA, 15 bp, Homo sapiens
cacagggtctgctct

SEQ ID NO: 177808 - DNA, 16 bp, Homo sapiens
cacagggtctgctctt

SEQ ID NO: 177809 - DNA, 15 bp, Homo sapiens
cacaggtgtttatac

SEQ ID NO: 177810 - DNA, 22 bp, Homo sapiens
cacagtgaaggctgtccttacc

SEQ ID NO: 177811 - DNA, 18 bp, Homo sapiens
cacagtgcatctcagccc

SEQ ID NO: 177812 - DNA, 16 bp, Homo sapiens
cacagttcctcgccct

SEQ ID NO: 177813 - DNA, 20 bp, Homo sapiens
cacagttcctcgccctgggt

SEQ ID NO: 177814 - DNA, 14 bp, Homo sapiens
cacagttttctgag

SEQ ID NO: 177815 - DNA, 21 bp, Homo sapiens
cacagttttctgagaaagact

SEQ ID NO: 177816 - DNA, 16 bp, Homo sapiens
cacatacttgagactg

SEQ ID NO: 177817 - DNA, 15 bp, Homo sapiens
cacatagagatcatc

SEQ ID NO: 177818 - DNA, 21 bp, Homo sapiens
cacatagtgatggttcccctg

SEQ ID NO: 177819 - DNA, 21 bp, Homo sapiens
cacatataaacatcacacaca

SEQ ID NO: 177820 - DNA, 23 bp, Homo sapiens
cacatccatttcatctatttctg

SEQ ID NO: 177821 - DNA, 22 bp, Homo sapiens
cacatcctccacgttctgctca

SEQ ID NO: 177822 - DNA, 22 bp, Homo sapiens
cacatctcctccatactcagga

SEQ ID NO: 177823 - DNA, 18 bp, Homo sapiens
cacatctgtgtcttgttt

SEQ ID NO: 177824 - DNA, 18 bp, Homo sapiens
cacatctttcacacttcc

SEQ ID NO: 177825 - DNA, 11 bp, Homo sapiens
cacatgtgtgc

SEQ ID NO: 177826 - DNA, 14 bp, Homo sapiens
caccaacatcccat

SEQ ID NO: 177827 - DNA, 19 bp, Homo sapiens
caccaacccatcagaagga

SEQ ID NO: 177828 - DNA, 21 bp, Homo sapiens
caccaagcaggaaatgaaaat

SEQ ID NO: 177829 - DNA, 11 bp, Homo sapiens
caccacccaaa

SEQ ID NO: 177830 - DNA, 22 bp, Homo sapiens
caccacctaggccactcctcca

SEQ ID NO: 177831 - DNA, 19 bp, Homo sapiens
caccaccttcccagctctc

SEQ ID NO: 177832 - DNA, 19 bp, Homo sapiens
caccacgatgtggccctgg

SEQ ID NO: 177833 - DNA, 14 bp, Homo sapiens
caccagcctgcact

SEQ ID NO: 177834 - DNA, 20 bp, Homo sapiens
caccagcctttctcccaggc

SEQ ID NO: 177835 - DNA, 12 bp, Homo sapiens
caccaggaatgt

SEQ ID NO: 177836 - DNA, 17 bp, Homo sapiens
caccaggaatgttaaag

SEQ ID NO: 177837 - DNA, 19 bp, Homo sapiens
caccagggttgaccccaga

SEQ ID NO: 177838 - DNA, 23 bp, Homo sapiens
caccagggttgaccccagaggat

SEQ ID NO: 177839 - DNA, 15 bp, Homo sapiens
caccatccctttttg

SEQ ID NO: 177840 - DNA, 19 bp, Homo sapiens
caccatccctttttgaagt

SEQ ID NO: 177841 - DNA, 21 bp, Homo sapiens
caccatccctttttgaagtgt

SEQ ID NO: 177842 - DNA, 15 bp, Homo sapiens
caccatcctgcagcc

SEQ ID NO: 177843 - DNA, 20 bp, Homo sapiens
caccatcctgcagcctcctc

SEQ ID NO: 177844 - DNA, 23 bp, Homo sapiens
cacccaaaagtcaaaaggtgcct

SEQ ID NO: 177845 - DNA, 13 bp, Homo sapiens
cacccacagggct

SEQ ID NO: 177846 - DNA, 15 bp, Homo sapiens
cacccactcagctcc

SEQ ID NO: 177847 - DNA, 14 bp, Homo sapiens
cacccagacagctc

SEQ ID NO: 177848 - DNA, 16 bp, Homo sapiens
cacccagacagctccc

SEQ ID NO: 177849 - DNA, 18 bp, Homo sapiens
cacccagcaactccaact

SEQ ID NO: 177850 - DNA, 11 bp, Homo sapiens
cacccagccca

SEQ ID NO: 177851 - DNA, 12 bp, Homo sapiens
cacccagcctca

SEQ ID NO: 177852 - DNA, 13 bp, Homo sapiens
cacccagcctcag

SEQ ID NO: 177853 - DNA, 14 bp, Homo sapiens
cacccagcctcagt

SEQ ID NO: 177854 - DNA, 19 bp, Homo sapiens
cacccagcctcagtcctcc

SEQ ID NO: 177855 - DNA, 17 bp, Homo sapiens
cacccagtgagcactcc

SEQ ID NO: 177856 - DNA, 23 bp, Homo sapiens
cacccatcctatcagcctgtctc

SEQ ID NO: 177857 - DNA, 15 bp, Homo sapiens
cacccattttcacat

SEQ ID NO: 177858 - DNA, 16 bp, Homo sapiens
caccccagctgctccc

SEQ ID NO: 177859 - DNA, 18 bp, Homo sapiens
caccccagctgctcccct

SEQ ID NO: 177860 - DNA, 19 bp, Homo sapiens
caccccagctgctcccctc

SEQ ID NO: 177861 - DNA, 20 bp, Homo sapiens
caccccagctgctcccctcc

SEQ ID NO: 177862 - DNA, 15 bp, Homo sapiens
caccccagggcctga

SEQ ID NO: 177863 - DNA, 16 bp, Homo sapiens
caccccagggcctgag

SEQ ID NO: 177864 - DNA, 15 bp, Homo sapiens
caccccatcccacac

SEQ ID NO: 177865 - DNA, 13 bp, Homo sapiens
cacccccatctct

SEQ ID NO: 177866 - DNA, 19 bp, Homo sapiens
caccccccagaacctgtcc

SEQ ID NO: 177867 - DNA, 13 bp, Homo sapiens
cacccccctgggc

SEQ ID NO: 177868 - DNA, 14 bp, Homo sapiens
cacccctaaagaga

SEQ ID NO: 177869 - DNA, 20 bp, Homo sapiens
cacccctcaacacctctgca

SEQ ID NO: 177870 - DNA, 22 bp, Homo sapiens
cacccctcccctgccctagagc

SEQ ID NO: 177871 - DNA, 12 bp, Homo sapiens
cacccctccttc

SEQ ID NO: 177872 - DNA, 14 bp, Homo sapiens
cacccctccttcct

SEQ ID NO: 177873 - DNA, 15 bp, Homo sapiens
cacccctgccctggg

SEQ ID NO: 177874 - DNA, 18 bp, Homo sapiens
cacccctgtcctcactgc

SEQ ID NO: 177875 - DNA, 23 bp, Homo sapiens
cacccctgtcctcactgctccct

SEQ ID NO: 177876 - DNA, 14 bp, Homo sapiens
caccctccacctct

SEQ ID NO: 177877 - DNA, 16 bp, Homo sapiens
caccctcgaagcgcgc

SEQ ID NO: 177878 - DNA, 18 bp, Homo sapiens
caccctgccttatcttgc

SEQ ID NO: 177879 - DNA, 21 bp, Homo sapiens
caccctggaggatttcatctc

SEQ ID NO: 177880 - DNA, 21 bp, Homo sapiens
caccctggattgatcggagcc

SEQ ID NO: 177881 - DNA, 17 bp, Homo sapiens
caccctgtctaaaaaac

SEQ ID NO: 177882 - DNA, 16 bp, Homo sapiens
cacccttaccatgtgc

SEQ ID NO: 177883 - DNA, 14 bp, Homo sapiens
cacccttcccctcc

SEQ ID NO: 177884 - DNA, 17 bp, Homo sapiens
cacccttggaggctgtc

SEQ ID NO: 177885 - DNA, 22 bp, Homo sapiens
cacccttggaggctgtcttctc

SEQ ID NO: 177886 - DNA, 20 bp, Homo sapiens
caccctttgctgtgaggctg

SEQ ID NO: 177887 - DNA, 18 bp, Homo sapiens
caccgagagtagccgaga

SEQ ID NO: 177888 - DNA, 21 bp, Homo sapiens
caccggatcctgggtggtctg

SEQ ID NO: 177889 - DNA, 13 bp, Homo sapiens
caccgggcctgga

SEQ ID NO: 177890 - DNA, 15 bp, Homo sapiens
caccgtcatggctta

SEQ ID NO: 177891 - DNA, 15 bp, Homo sapiens
caccgtggctaagag

SEQ ID NO: 177892 - DNA, 22 bp, Homo sapiens
cacctaccatcagggacaggat

SEQ ID NO: 177893 - DNA, 14 bp, Homo sapiens
cacctataaaacag

SEQ ID NO: 177894 - DNA, 23 bp, Homo sapiens
cacctcaaaataccatgccattt

SEQ ID NO: 177895 - DNA, 13 bp, Homo sapiens
cacctcagcctcc

SEQ ID NO: 177896 - DNA, 18 bp, Homo sapiens
cacctcagcctcctgtgt

SEQ ID NO: 177897 - DNA, 12 bp, Homo sapiens
cacctcagcctt

SEQ ID NO: 177898 - DNA, 13 bp, Homo sapiens
cacctcagccttg

SEQ ID NO: 177899 - DNA, 9 bp, Homo sapiens
cacctcccc

SEQ ID NO: 177900 - DNA, 17 bp, Homo sapiens
cacctccccacgccctc

SEQ ID NO: 177901 - DNA, 14 bp, Homo sapiens
cacctccccccact

SEQ ID NO: 177902 - DNA, 17 bp, Homo sapiens
cacctccccccactgca

SEQ ID NO: 177903 - DNA, 18 bp, Homo sapiens
cacctccccccactgcag

SEQ ID NO: 177904 - DNA, 23 bp, Homo sapiens
cacctccccccactgcaggcccc

SEQ ID NO: 177905 - DNA, 14 bp, Homo sapiens
cacctcccctatcc

SEQ ID NO: 177906 - DNA, 12 bp, Homo sapiens
cacctctgcgga

SEQ ID NO: 177907 - DNA, 22 bp, Homo sapiens
cacctctgcggaccccagctgt

SEQ ID NO: 177908 - DNA, 13 bp, Homo sapiens
cacctctgtgacc

SEQ ID NO: 177909 - DNA, 19 bp, Homo sapiens
cacctctgtgacctcaggc

SEQ ID NO: 177910 - DNA, 22 bp, Homo sapiens
cacctctgtgacctcaggcact

SEQ ID NO: 177911 - DNA, 16 bp, Homo sapiens
cacctgagcaggacct

SEQ ID NO: 177912 - DNA, 21 bp, Homo sapiens
cacctgagcccggatgcttct

SEQ ID NO: 177913 - DNA, 17 bp, Homo sapiens
cacctgcacctcccccc

SEQ ID NO: 177914 - DNA, 22 bp, Homo sapiens
cacctgcatccgtagttccctg

SEQ ID NO: 177915 - DNA, 23 bp, Homo sapiens
cacctgccgacctcgtcctcccc

SEQ ID NO: 177916 - DNA, 14 bp, Homo sapiens
cacctgctcccagg

SEQ ID NO: 177917 - DNA, 13 bp, Homo sapiens
cacctgctgctgc

SEQ ID NO: 177918 - DNA, 18 bp, Homo sapiens
cacctggcactgctgtgc

SEQ ID NO: 177919 - DNA, 20 bp, Homo sapiens
cacctggccccatgtctctc

SEQ ID NO: 177920 - DNA, 22 bp, Homo sapiens
cacctggccccatgtctctcag

SEQ ID NO: 177921 - DNA, 15 bp, Homo sapiens
cacctggggcagtca

SEQ ID NO: 177922 - DNA, 20 bp, Homo sapiens
cacctggggcagtcacctgc

SEQ ID NO: 177923 - DNA, 23 bp, Homo sapiens
cacctggggcagtcacctgccca

SEQ ID NO: 177924 - DNA, 18 bp, Homo sapiens
cacctggggtgtgggagg

SEQ ID NO: 177925 - DNA, 17 bp, Homo sapiens
cacctggtggcctctgc

SEQ ID NO: 177926 - DNA, 21 bp, Homo sapiens
cacctgtaatcccagctactt

SEQ ID NO: 177927 - DNA, 15 bp, Homo sapiens
cacctgtagtcccag

SEQ ID NO: 177928 - DNA, 18 bp, Homo sapiens
cacctgtagtcccagcta

SEQ ID NO: 177929 - DNA, 20 bp, Homo sapiens
cacctgtagtcccagctact

SEQ ID NO: 177930 - DNA, 13 bp, Homo sapiens
cacctgtcaaaca

SEQ ID NO: 177931 - DNA, 23 bp, Homo sapiens
cacctgtcaaacaaagccagaag

SEQ ID NO: 177932 - DNA, 19 bp, Homo sapiens
cacctgtgcttcgggccct

SEQ ID NO: 177933 - DNA, 20 bp, Homo sapiens
cacctgtttttaagctgttt

SEQ ID NO: 177934 - DNA, 17 bp, Homo sapiens
caccttaggcagggaag

SEQ ID NO: 177935 - DNA, 12 bp, Homo sapiens
caccttcccagc

SEQ ID NO: 177936 - DNA, 22 bp, Homo sapiens
caccttcgtttactatgcctgt

SEQ ID NO: 177937 - DNA, 14 bp, Homo sapiens
cacctttaaagtgt

SEQ ID NO: 177938 - DNA, 15 bp, Homo sapiens
cacctttattaaaat

SEQ ID NO: 177939 - DNA, 18 bp, Homo sapiens
cacctttattaaaatctt

SEQ ID NO: 177940 - DNA, 17 bp, Homo sapiens
cacgaaatgttattttt

SEQ ID NO: 177941 - DNA, 16 bp, Homo sapiens
cacgactgtctccatg

SEQ ID NO: 177942 - DNA, 20 bp, Homo sapiens
cacgagctgtttactaggga

SEQ ID NO: 177943 - DNA, 15 bp, Homo sapiens
cacgatgaaaaactt

SEQ ID NO: 177944 - DNA, 15 bp, Homo sapiens
cacgcacctcccatc

SEQ ID NO: 177945 - DNA, 17 bp, Homo sapiens
cacgcacttcgggaggt

SEQ ID NO: 177946 - DNA, 15 bp, Homo sapiens
cacgccctcccctcc

SEQ ID NO: 177947 - DNA, 16 bp, Homo sapiens
cacgccctcccctccc

SEQ ID NO: 177948 - DNA, 15 bp, Homo sapiens
agccgtgccttcagc

SEQ ID NO: 177949 - DNA, 21 bp, Homo sapiens
agccgtggcttcccgctcagc

SEQ ID NO: 177950 - DNA, 16 bp, Homo sapiens
agccgtggtcctttgg

SEQ ID NO: 177951 - DNA, 19 bp, Homo sapiens
agcctagccgacctcagcc

SEQ ID NO: 177952 - DNA, 20 bp, Homo sapiens
agcctagccgacctcagcct

SEQ ID NO: 177953 - DNA, 15 bp, Homo sapiens
agcctcacagaagaa

SEQ ID NO: 177954 - DNA, 17 bp, Homo sapiens
agcctcagtcctcccct

SEQ ID NO: 177955 - DNA, 18 bp, Homo sapiens
agcctcagtcctcccctc

SEQ ID NO: 177956 - DNA, 20 bp, Homo sapiens
agcctcagtcctcccctcac

SEQ ID NO: 177957 - DNA, 18 bp, Homo sapiens
agcctccatgctgcctcc

SEQ ID NO: 177958 - DNA, 13 bp, Homo sapiens
agcctcccacccc

SEQ ID NO: 177959 - DNA, 15 bp, Homo sapiens
agcctcccctgccag

SEQ ID NO: 177960 - DNA, 19 bp, Homo sapiens
agcctcccctgccagggca

SEQ ID NO: 177961 - DNA, 20 bp, Homo sapiens
agcctcccctgccagggcag

SEQ ID NO: 177962 - DNA, 13 bp, Homo sapiens
agcctcctctctc

SEQ ID NO: 177963 - DNA, 20 bp, Homo sapiens
agcctcgccgtctgtgaatt

SEQ ID NO: 177964 - DNA, 13 bp, Homo sapiens
agcctctcccctg

SEQ ID NO: 177965 - DNA, 20 bp, Homo sapiens
agcctctgacccctcctcac

SEQ ID NO: 177966 - DNA, 22 bp, Homo sapiens
agcctctgggtcagtggtccac

SEQ ID NO: 177967 - DNA, 23 bp, Homo sapiens
agcctctgggtcagtggtccaca

SEQ ID NO: 177968 - DNA, 18 bp, Homo sapiens
agcctgagcgacagtgag

SEQ ID NO: 177969 - DNA, 15 bp, Homo sapiens
agcctgcaggtgctg

SEQ ID NO: 177970 - DNA, 18 bp, Homo sapiens
agcctgcaggtgctgctg

SEQ ID NO: 177971 - DNA, 20 bp, Homo sapiens
agcctgcaggtgctgctgcg

SEQ ID NO: 177972 - DNA, 16 bp, Homo sapiens
agcctgcctcttctct

SEQ ID NO: 177973 - DNA, 17 bp, Homo sapiens
agcctgctccagctgtt

SEQ ID NO: 177974 - DNA, 19 bp, Homo sapiens
agcctgctccagctgttca

SEQ ID NO: 177975 - DNA, 22 bp, Homo sapiens
agcctgctccagctgttcagct

SEQ ID NO: 177976 - DNA, 14 bp, Homo sapiens
agcctgctccccca

SEQ ID NO: 177977 - DNA, 23 bp, Homo sapiens
agcctgctcccccaccccctccc

SEQ ID NO: 177978 - DNA, 20 bp, Homo sapiens
agcctggcacagggcagtgg

SEQ ID NO: 177979 - DNA, 18 bp, Homo sapiens
agcctgggcaatgtgata

SEQ ID NO: 177980 - DNA, 14 bp, Homo sapiens
agcctggtgggcct

SEQ ID NO: 177981 - DNA, 15 bp, Homo sapiens
agcctgtaatcccag

SEQ ID NO: 177982 - DNA, 18 bp, Homo sapiens
agcctgtaatcccagcta

SEQ ID NO: 177983 - DNA, 22 bp, Homo sapiens
agccttccccttgcccagggct

SEQ ID NO: 177984 - DNA, 20 bp, Homo sapiens
agccttcttccatcccagga

SEQ ID NO: 177985 - DNA, 17 bp, Homo sapiens
agccttggtgtccacct

SEQ ID NO: 177986 - DNA, 19 bp, Homo sapiens
agccttggtgtccacctgg

SEQ ID NO: 177987 - DNA, 21 bp, Homo sapiens
agccttggtgtccacctggcc

SEQ ID NO: 177988 - DNA, 16 bp, Homo sapiens
agccttgtgtctacag

SEQ ID NO: 177989 - DNA, 15 bp, Homo sapiens
agcctttgcctcccc

SEQ ID NO: 177990 - DNA, 16 bp, Homo sapiens
agcctttggctctgga

SEQ ID NO: 177991 - DNA, 17 bp, Homo sapiens
agcctttggctctggag

SEQ ID NO: 177992 - DNA, 23 bp, Homo sapiens
agcctttggctctggagacagcc

SEQ ID NO: 177993 - DNA, 15 bp, Homo sapiens
agcgacagtgagact

SEQ ID NO: 177994 - DNA, 17 bp, Homo sapiens
agcgacagtgagactct

SEQ ID NO: 177995 - DNA, 20 bp, Homo sapiens
agcgaggagatgctccttgg

SEQ ID NO: 177996 - DNA, 22 bp, Homo sapiens
agcgaggtcaacagagaaggca

SEQ ID NO: 177997 - DNA, 19 bp, Homo sapiens
agcgcaggtttagtttact

SEQ ID NO: 177998 - DNA, 18 bp, Homo sapiens
agcgccagcctgtcccat

SEQ ID NO: 177999 - DNA, 21 bp, Homo sapiens
agcgcctagtggggtctccct

SEQ ID NO: 178000 - DNA, 19 bp, Homo sapiens
agcgcctgcccctcccaga

SEQ ID NO: 178001 - DNA, 20 bp, Homo sapiens
agcgcgccactcgcttcccc

SEQ ID NO: 178002 - DNA, 18 bp, Homo sapiens
agcgctgccgcaccccag

SEQ ID NO: 178003 - DNA, 20 bp, Homo sapiens
agcgctgccgcaccccagag

SEQ ID NO: 178004 - DNA, 13 bp, Homo sapiens
agcggaaagcagc

SEQ ID NO: 178005 - DNA, 23 bp, Homo sapiens
agcggaaagcagctcaaaggcac

SEQ ID NO: 178006 - DNA, 13 bp, Homo sapiens
agcggctggcagc

SEQ ID NO: 178007 - DNA, 13 bp, Homo sapiens
agcggtctcaggc

SEQ ID NO: 178008 - DNA, 12 bp, Homo sapiens
agcggtggccct

SEQ ID NO: 178009 - DNA, 14 bp, Homo sapiens
agcgtagcctctcc

SEQ ID NO: 178010 - DNA, 16 bp, Homo sapiens
agcgtcctcctctgtg

SEQ ID NO: 178011 - DNA, 19 bp, Homo sapiens
agcgtcctcctctgtgacc

SEQ ID NO: 178012 - DNA, 15 bp, Homo sapiens
agctaaaatgatttt

SEQ ID NO: 178013 - DNA, 16 bp, Homo sapiens
agctaatcagcattct

SEQ ID NO: 178014 - DNA, 21 bp, Homo sapiens
agctaatcagcattctcactc

SEQ ID NO: 178015 - DNA, 18 bp, Homo sapiens
agctacttgggaggctga

SEQ ID NO: 178016 - DNA, 22 bp, Homo sapiens
agctagaattccctctctctga

SEQ ID NO: 178017 - DNA, 14 bp, Homo sapiens
agctagcgctgccg

SEQ ID NO: 178018 - DNA, 16 bp, Homo sapiens
agctagcgctgccgca

SEQ ID NO: 178019 - DNA, 20 bp, Homo sapiens
agctagcgctgccgcacccc

SEQ ID NO: 178020 - DNA, 17 bp, Homo sapiens
agctatacctgtgcctc

SEQ ID NO: 178021 - DNA, 17 bp, Homo sapiens
agctatagacccgagga

SEQ ID NO: 178022 - DNA, 18 bp, Homo sapiens
agctatagacccgaggaa

SEQ ID NO: 178023 - DNA, 19 bp, Homo sapiens
agctatagacccgaggaaa

SEQ ID NO: 178024 - DNA, 20 bp, Homo sapiens
agctatttccattccagaat

SEQ ID NO: 178025 - DNA, 16 bp, Homo sapiens
agctcacacatgagat

SEQ ID NO: 178026 - DNA, 17 bp, Homo sapiens
agctcagacccccactc

SEQ ID NO: 178027 - DNA, 20 bp, Homo sapiens
agctcagacccccactctca

SEQ ID NO: 178028 - DNA, 17 bp, Homo sapiens
agctcagcgccagcctg

SEQ ID NO: 178029 - DNA, 20 bp, Homo sapiens
agctcagctttttgtctttt

SEQ ID NO: 178030 - DNA, 22 bp, Homo sapiens
agctcagctttttgtcttttct

SEQ ID NO: 178031 - DNA, 22 bp, Homo sapiens
agctccacaccctctcccagga

SEQ ID NO: 178032 - DNA, 18 bp, Homo sapiens
agctccactgtcaccctc

SEQ ID NO: 178033 - DNA, 15 bp, Homo sapiens
agctccatctccact

SEQ ID NO: 178034 - DNA, 17 bp, Homo sapiens
agctccccaccacccca

SEQ ID NO: 178035 - DNA, 21 bp, Homo sapiens
agctccccaccaccccagctg

SEQ ID NO: 178036 - DNA, 19 bp, Homo sapiens
agctcccctcggagaagag

SEQ ID NO: 178037 - DNA, 20 bp, Homo sapiens
agctcccctcggagaagagc

SEQ ID NO: 178038 - DNA, 21 bp, Homo sapiens
agctcctgtcctcccatcccc

SEQ ID NO: 178039 - DNA, 15 bp, Homo sapiens
agctccttgggaggc

SEQ ID NO: 178040 - DNA, 14 bp, Homo sapiens
agctcggtggaccc

SEQ ID NO: 178041 - DNA, 19 bp, Homo sapiens
agctctacccagggcctgc

SEQ ID NO: 178042 - DNA, 21 bp, Homo sapiens
agctctacccagggcctgcag

SEQ ID NO: 178043 - DNA, 13 bp, Homo sapiens
agctctcagccaa

SEQ ID NO: 178044 - DNA, 11 bp, Homo sapiens
agctctccctc

SEQ ID NO: 178045 - DNA, 15 bp, Homo sapiens
agctctccctctggc

SEQ ID NO: 178046 - DNA, 16 bp, Homo sapiens
agctctccctctggcc

SEQ ID NO: 178047 - DNA, 22 bp, Homo sapiens
agctctccctctggccctgcct

SEQ ID NO: 178048 - DNA, 21 bp, Homo sapiens
agctctgcagagcaggaaaca

SEQ ID NO: 178049 - DNA, 17 bp, Homo sapiens
agctctggtgacaccag

SEQ ID NO: 178050 - DNA, 16 bp, Homo sapiens
agctcttctccccagg

SEQ ID NO: 178051 - DNA, 12 bp, Homo sapiens
agctgaaaatat

SEQ ID NO: 178052 - DNA, 16 bp, Homo sapiens
agctgagagaaaataa

SEQ ID NO: 178053 - DNA, 13 bp, Homo sapiens
agctgagcaggga

SEQ ID NO: 178054 - DNA, 15 bp, Homo sapiens
agctgaggcagcagt

SEQ ID NO: 178055 - DNA, 15 bp, Homo sapiens
agctgcaagtgacat

SEQ ID NO: 178056 - DNA, 17 bp, Homo sapiens
agctgcagagacagaga

SEQ ID NO: 178057 - DNA, 19 bp, Homo sapiens
agctgcagagacagagagg

SEQ ID NO: 178058 - DNA, 15 bp, Homo sapiens
agctgctgaaacaac

SEQ ID NO: 178059 - DNA, 14 bp, Homo sapiens
agctggatgagaat

SEQ ID NO: 178060 - DNA, 15 bp, Homo sapiens
agctgggaggaaaag

SEQ ID NO: 178061 - DNA, 19 bp, Homo sapiens
agctgggaggcatggccct

SEQ ID NO: 178062 - DNA, 21 bp, Homo sapiens
agctgggaggcatggccctgg

SEQ ID NO: 178063 - DNA, 16 bp, Homo sapiens
agctgggttggaaaac

SEQ ID NO: 178064 - DNA, 16 bp, Homo sapiens
agctggttgaggtttc

SEQ ID NO: 178065 - DNA, 17 bp, Homo sapiens
agctgtacaaatataag

SEQ ID NO: 178066 - DNA, 23 bp, Homo sapiens
agctgtacaaatataagaataaa

SEQ ID NO: 178067 - DNA, 21 bp, Homo sapiens
agctgtagtagccctttctgt

SEQ ID NO: 178068 - DNA, 14 bp, Homo sapiens
agctgtccctgtca

SEQ ID NO: 178069 - DNA, 22 bp, Homo sapiens
agctgtccctgtcaccaagctc

SEQ ID NO: 178070 - DNA, 17 bp, Homo sapiens
agctgtgagccttggct

SEQ ID NO: 178071 - DNA, 18 bp, Homo sapiens
agctgtgagccttggctg

SEQ ID NO: 178072 - DNA, 18 bp, Homo sapiens
agctgtgtccttgcacct

SEQ ID NO: 178073 - DNA, 20 bp, Homo sapiens
agctgtgtccttgcacctgc

SEQ ID NO: 178074 - DNA, 24 bp, Homo sapiens
agctgtgtccttgcacctgcatcc

SEQ ID NO: 178075 - DNA, 23 bp, Homo sapiens
agctgtgtgaaataccagtgtgg

SEQ ID NO: 178076 - DNA, 19 bp, Homo sapiens
agctgttactgtcttcagt

SEQ ID NO: 178077 - DNA, 14 bp, Homo sapiens
agctgttcacagcc

SEQ ID NO: 178078 - DNA, 16 bp, Homo sapiens
agctgttcacagccag

SEQ ID NO: 178079 - DNA, 19 bp, Homo sapiens
agctgttcacagccagact

SEQ ID NO: 178080 - DNA, 14 bp, Homo sapiens
agctgttgagctgt

SEQ ID NO: 178081 - DNA, 15 bp, Homo sapiens
agctgttgagctgtt

SEQ ID NO: 178082 - DNA, 22 bp, Homo sapiens
agctgtttactagggatccctc

SEQ ID NO: 178083 - DNA, 17 bp, Homo sapiens
agcttagacctcagcct

SEQ ID NO: 178084 - DNA, 15 bp, Homo sapiens
agcttagactaaggc

SEQ ID NO: 178085 - DNA, 14 bp, Homo sapiens
agcttatctcaggg

SEQ ID NO: 178086 - DNA, 20 bp, Homo sapiens
agcttattaaaactcatttt

SEQ ID NO: 178087 - DNA, 22 bp, Homo sapiens
agcttattcatctgtttttctt

SEQ ID NO: 178088 - DNA, 17 bp, Homo sapiens
agcttccagtccaatct

SEQ ID NO: 178089 - DNA, 19 bp, Homo sapiens
agcttccttctgtgaaagt

SEQ ID NO: 178090 - DNA, 16 bp, Homo sapiens
agcttcttaaatgaga

SEQ ID NO: 178091 - DNA, 23 bp, Homo sapiens
agcttcttaatataactgcctta

SEQ ID NO: 178092 - DNA, 12 bp, Homo sapiens
agcttcttccag

SEQ ID NO: 178093 - DNA, 22 bp, Homo sapiens
agcttcttccaggtgcccagct

SEQ ID NO: 178094 - DNA, 15 bp, Homo sapiens
agagggaagaaaaga

SEQ ID NO: 178095 - DNA, 23 bp, Homo sapiens
agagggaagaaaagagctttctt

SEQ ID NO: 178096 - DNA, 12 bp, Homo sapiens
agagggacagat

SEQ ID NO: 178097 - DNA, 18 bp, Homo sapiens
agagggtctggagaagca

SEQ ID NO: 178098 - DNA, 18 bp, Homo sapiens
agaggtcaagcccaggag

SEQ ID NO: 178099 - DNA, 14 bp, Homo sapiens
agaggtgagggaag

SEQ ID NO: 178100 - DNA, 13 bp, Homo sapiens
agaggtggccaga

SEQ ID NO: 178101 - DNA, 18 bp, Homo sapiens
agaggtggccagagctgg

SEQ ID NO: 178102 - DNA, 23 bp, Homo sapiens
agagtagccgagagcctgctccc

SEQ ID NO: 178103 - DNA, 12 bp, Homo sapiens
agagtctgaaca

SEQ ID NO: 178104 - DNA, 17 bp, Homo sapiens
agagtctgaacagctgt

SEQ ID NO: 178105 - DNA, 13 bp, Homo sapiens
agagtgcaacagt

SEQ ID NO: 178106 - DNA, 22 bp, Homo sapiens
agagtgcaacagtagcatagga

SEQ ID NO: 178107 - DNA, 18 bp, Homo sapiens
agagtgcattgtgagggt

SEQ ID NO: 178108 - DNA, 12 bp, Homo sapiens
agagtgcccaga

SEQ ID NO: 178109 - DNA, 13 bp, Homo sapiens
agagtggctcctc

SEQ ID NO: 178110 - DNA, 19 bp, Homo sapiens
agagtgtgaaatagacatt

SEQ ID NO: 178111 - DNA, 14 bp, Homo sapiens
agagtgtgcctgaa

SEQ ID NO: 178112 - DNA, 19 bp, Homo sapiens
agagtgtgggaagggagag

SEQ ID NO: 178113 - DNA, 20 bp, Homo sapiens
agagttaatatatagaaggg

SEQ ID NO: 178114 - DNA, 14 bp, Homo sapiens
agagttctgctcta

SEQ ID NO: 178115 - DNA, 13 bp, Homo sapiens
agagttgtaaata

SEQ ID NO: 178116 - DNA, 15 bp, Homo sapiens
agataaagatgatct

SEQ ID NO: 178117 - DNA, 16 bp, Homo sapiens
agataaagatgatcta

SEQ ID NO: 178118 - DNA, 13 bp, Homo sapiens
agataaattataa

SEQ ID NO: 178119 - DNA, 21 bp, Homo sapiens
agataaccagctgtaacacag

SEQ ID NO: 178120 - DNA, 22 bp, Homo sapiens
agataatattaaggaagacaat

SEQ ID NO: 178121 - DNA, 17 bp, Homo sapiens
agataatcagcctctta

SEQ ID NO: 178122 - DNA, 19 bp, Homo sapiens
agataatcagtgtgtctaa

SEQ ID NO: 178123 - DNA, 19 bp, Homo sapiens
agataatgtgatattatac

SEQ ID NO: 178124 - DNA, 19 bp, Homo sapiens
agataccagcgaggaggct

SEQ ID NO: 178125 - DNA, 13 bp, Homo sapiens
agatatatatcat

SEQ ID NO: 178126 - DNA, 13 bp, Homo sapiens
agatatattaaaa

SEQ ID NO: 178127 - DNA, 17 bp, Homo sapiens
agatatggcagcgaaag

SEQ ID NO: 178128 - DNA, 15 bp, Homo sapiens
agatattaccagttt

SEQ ID NO: 178129 - DNA, 12 bp, Homo sapiens
agatattcaagt

SEQ ID NO: 178130 - DNA, 22 bp, Homo sapiens
agatattgtcagagttctgctc

SEQ ID NO: 178131 - DNA, 23 bp, Homo sapiens
agatatttacatgaattgcattt

SEQ ID NO: 178132 - DNA, 12 bp, Homo sapiens
agatatttttca

SEQ ID NO: 178133 - DNA, 16 bp, Homo sapiens
agatatttttcatgat

SEQ ID NO: 178134 - DNA, 19 bp, Homo sapiens
agatattttttcagaaata

SEQ ID NO: 178135 - DNA, 14 bp, Homo sapiens
agatcaaatttcac

SEQ ID NO: 178136 - DNA, 13 bp, Homo sapiens
agatcagcctggg

SEQ ID NO: 178137 - DNA, 20 bp, Homo sapiens
agatcctttaaatccttcca

SEQ ID NO: 178138 - DNA, 21 bp, Homo sapiens
agatcgtgccgttactctcca

SEQ ID NO: 178139 - DNA, 23 bp, Homo sapiens
agatctctgctttggaaatcaca

SEQ ID NO: 178140 - DNA, 16 bp, Homo sapiens
agatgaatgccgtgga

SEQ ID NO: 178141 - DNA, 11 bp, Homo sapiens
agatgacaaaa

SEQ ID NO: 178142 - DNA, 13 bp, Homo sapiens
agatgatcatttg

SEQ ID NO: 178143 - DNA, 21 bp, Homo sapiens
agatgcagcaaaatgtgaatg

SEQ ID NO: 178144 - DNA, 12 bp, Homo sapiens
agatgcctccac

SEQ ID NO: 178145 - DNA, 13 bp, Homo sapiens
agatgcctccacc

SEQ ID NO: 178146 - DNA, 15 bp, Homo sapiens
agatgcctccaccgc

SEQ ID NO: 178147 - DNA, 21 bp, Homo sapiens
agatgcctccaccgctgccta

SEQ ID NO: 178148 - DNA, 20 bp, Homo sapiens
agatgctccttgggcccttt

SEQ ID NO: 178149 - DNA, 13 bp, Homo sapiens
agatgctctttta

SEQ ID NO: 178150 - DNA, 20 bp, Homo sapiens
agatgctgactgtactcctc

SEQ ID NO: 178151 - DNA, 22 bp, Homo sapiens
agatgctggagaagagaggaga

SEQ ID NO: 178152 - DNA, 15 bp, Homo sapiens
agatgcttctcactg

SEQ ID NO: 178153 - DNA, 18 bp, Homo sapiens
agatgcttctcactgcca

SEQ ID NO: 178154 - DNA, 12 bp, Homo sapiens
agatggaagctt

SEQ ID NO: 178155 - DNA, 16 bp, Homo sapiens
agatggaagcttccag

SEQ ID NO: 178156 - DNA, 16 bp, Homo sapiens
agatggaggaggaggc

SEQ ID NO: 178157 - DNA, 18 bp, Homo sapiens
agatggattggtgtaaaa

SEQ ID NO: 178158 - DNA, 19 bp, Homo sapiens
agatggcctgagaagagag

SEQ ID NO: 178159 - DNA, 22 bp, Homo sapiens
agatggctgactttgctctttc

SEQ ID NO: 178160 - DNA, 18 bp, Homo sapiens
agatggctgtgcctctgc

SEQ ID NO: 178161 - DNA, 19 bp, Homo sapiens
agatggctgtgcctctgcc

SEQ ID NO: 178162 - DNA, 15 bp, Homo sapiens
agatgggactgggag

SEQ ID NO: 178163 - DNA, 21 bp, Homo sapiens
agatggtcacgcacctgggtg

SEQ ID NO: 178164 - DNA, 16 bp, Homo sapiens
agatgtgcaaatgcaa

SEQ ID NO: 178165 - DNA, 22 bp, Homo sapiens
agatgttttaccgtaataatta

SEQ ID NO: 178166 - DNA, 16 bp, Homo sapiens
agattagatcttttaa

SEQ ID NO: 178167 - DNA, 13 bp, Homo sapiens
agattcatattta

SEQ ID NO: 178168 - DNA, 18 bp, Homo sapiens
agattccagagagtggct

SEQ ID NO: 178169 - DNA, 21 bp, Homo sapiens
agattccccattgcctcctcc

SEQ ID NO: 178170 - DNA, 19 bp, Homo sapiens
agattctacatattcttta

SEQ ID NO: 178171 - DNA, 21 bp, Homo sapiens
agattgcgccattgcactcca

SEQ ID NO: 178172 - DNA, 16 bp, Homo sapiens
agattgcttaaaatag

SEQ ID NO: 178173 - DNA, 15 bp, Homo sapiens
agattgtgtaacaat

SEQ ID NO: 178174 - DNA, 14 bp, Homo sapiens
agattgttaaaata

SEQ ID NO: 178175 - DNA, 23 bp, Homo sapiens
agattgttttatcatgacatgtt

SEQ ID NO: 178176 - DNA, 18 bp, Homo sapiens
agatttagtgaaagctag

SEQ ID NO: 178177 - DNA, 17 bp, Homo sapiens
agattttaaaaagtctt

SEQ ID NO: 178178 - DNA, 17 bp, Homo sapiens
agattttcagaaaatat

SEQ ID NO: 178179 - DNA, 23 bp, Homo sapiens
agattttccacaagattcccaga

SEQ ID NO: 178180 - DNA, 17 bp, Homo sapiens
agatttttcatgatttt

SEQ ID NO: 178181 - DNA, 14 bp, Homo sapiens
agcaaaatcatttt

SEQ ID NO: 178182 - DNA, 15 bp, Homo sapiens
agcaaaatcatttta

SEQ ID NO: 178183 - DNA, 13 bp, Homo sapiens
agcaaactctgct

SEQ ID NO: 178184 - DNA, 14 bp, Homo sapiens
agcaaactctgctg

SEQ ID NO: 178185 - DNA, 14 bp, Homo sapiens
agcaacgcaggccc

SEQ ID NO: 178186 - DNA, 12 bp, Homo sapiens
agcaagactctg

SEQ ID NO: 178187 - DNA, 16 bp, Homo sapiens
agcaagtgagaccctg

SEQ ID NO: 178188 - DNA, 12 bp, Homo sapiens
agcaatatgcat

SEQ ID NO: 178189 - DNA, 18 bp, Homo sapiens
agcaatgacatctcaggg

SEQ ID NO: 178190 - DNA, 20 bp, Homo sapiens
agcacagagagggggccacc

SEQ ID NO: 178191 - DNA, 21 bp, Homo sapiens
agcacagagagggggccacct

SEQ ID NO: 178192 - DNA, 17 bp, Homo sapiens
agcacctagcctcgctc

SEQ ID NO: 178193 - DNA, 15 bp, Homo sapiens
agcacctgccgacct

SEQ ID NO: 178194 - DNA, 20 bp, Homo sapiens
agcacctgccgacctcgtcc

SEQ ID NO: 178195 - DNA, 13 bp, Homo sapiens
agcactaaagcag

SEQ ID NO: 178196 - DNA, 17 bp, Homo sapiens
agcactaaagcagtgga

SEQ ID NO: 178197 - DNA, 16 bp, Homo sapiens
agcactacataaactg

SEQ ID NO: 178198 - DNA, 21 bp, Homo sapiens
agcactacataaactgacttt

SEQ ID NO: 178199 - DNA, 19 bp, Homo sapiens
agcactgacttctaagtaa

SEQ ID NO: 178200 - DNA, 17 bp, Homo sapiens
agcactgatttcacaac

SEQ ID NO: 178201 - DNA, 17 bp, Homo sapiens
agcactgcttgaggaaa

SEQ ID NO: 178202 - DNA, 17 bp, Homo sapiens
agcactgggttgacttt

SEQ ID NO: 178203 - DNA, 15 bp, Homo sapiens
agcactgtcccttgc

SEQ ID NO: 178204 - DNA, 12 bp, Homo sapiens
agcacttaagag

SEQ ID NO: 178205 - DNA, 17 bp, Homo sapiens
agcacttaagagaatat

SEQ ID NO: 178206 - DNA, 18 bp, Homo sapiens
agcacttaagagaatatt

SEQ ID NO: 178207 - DNA, 17 bp, Homo sapiens
agcacttggagccaagg

SEQ ID NO: 178208 - DNA, 22 bp, Homo sapiens
agcactttgggaggccaaggtg

SEQ ID NO: 178209 - DNA, 13 bp, Homo sapiens
agcagaaatacat

SEQ ID NO: 178210 - DNA, 14 bp, Homo sapiens
agcagaacagtgat

SEQ ID NO: 178211 - DNA, 21 bp, Homo sapiens
agcagagaattctcttatcca

SEQ ID NO: 178212 - DNA, 14 bp, Homo sapiens
agcagaggggctga

SEQ ID NO: 178213 - DNA, 14 bp, Homo sapiens
agcagatgcaaaga

SEQ ID NO: 178214 - DNA, 18 bp, Homo sapiens
agcagatttaacaattcc

SEQ ID NO: 178215 - DNA, 16 bp, Homo sapiens
agcagcagggagggct

SEQ ID NO: 178216 - DNA, 18 bp, Homo sapiens
agcagccagctctcagcc

SEQ ID NO: 178217 - DNA, 23 bp, Homo sapiens
agcagccagctctcagccaacga

SEQ ID NO: 178218 - DNA, 13 bp, Homo sapiens
agcagccctcctc

SEQ ID NO: 178219 - DNA, 14 bp, Homo sapiens
agcagccctcctca

SEQ ID NO: 178220 - DNA, 12 bp, Homo sapiens
agcagctcaggc

SEQ ID NO: 178221 - DNA, 21 bp, Homo sapiens
agcagctcaggcacacttctt

SEQ ID NO: 178222 - DNA, 12 bp, Homo sapiens
agcagcttccag

SEQ ID NO: 178223 - DNA, 20 bp, Homo sapiens
agcagctttaaactcaggga

SEQ ID NO: 178224 - DNA, 22 bp, Homo sapiens
agcagctttaaactcagggaca

SEQ ID NO: 178225 - DNA, 21 bp, Homo sapiens
agcagcttttttttcccccct

SEQ ID NO: 178226 - DNA, 22 bp, Homo sapiens
agcaggaagcattcagagagca

SEQ ID NO: 178227 - DNA, 15 bp, Homo sapiens
agcaggaggccaggc

SEQ ID NO: 178228 - DNA, 16 bp, Homo sapiens
agcaggctactgtcag

SEQ ID NO: 178229 - DNA, 19 bp, Homo sapiens
agcaggggctacaagaggg

SEQ ID NO: 178230 - DNA, 20 bp, Homo sapiens
agcaggggctacaagaggga

SEQ ID NO: 178231 - DNA, 21 bp, Homo sapiens
agcaggggctacaagagggaa

SEQ ID NO: 178232 - DNA, 17 bp, Homo sapiens
agcaggtttttctcctc

SEQ ID NO: 178233 - DNA, 19 bp, Homo sapiens
agcagtcctgcctcagcct

SEQ ID NO: 178234 - DNA, 21 bp, Homo sapiens
agcagtgaatgattcagtgtt

SEQ ID NO: 178235 - DNA, 21 bp, Homo sapiens
agcagtgagaaaaagctcctg

SEQ ID NO: 178236 - DNA, 19 bp, Homo sapiens
agcagtggacaccaggagt

SEQ ID NO: 178237 - DNA, 15 bp, Homo sapiens
agacttccctgaatg

SEQ ID NO: 178238 - DNA, 17 bp, Homo sapiens
agacttggcaacagaag

SEQ ID NO: 178239 - DNA, 19 bp, Homo sapiens
agactttacatgacacagc

SEQ ID NO: 178240 - DNA, 20 bp, Homo sapiens
agactttacatgacacagct

SEQ ID NO: 178241 - DNA, 22 bp, Homo sapiens
agagaaaaaatattttcctgcc

SEQ ID NO: 178242 - DNA, 14 bp, Homo sapiens
agagaaagccaggc

SEQ ID NO: 178243 - DNA, 24 bp, Homo sapiens
agagaaagtgggtgagatgctgga

SEQ ID NO: 178244 - DNA, 22 bp, Homo sapiens
agagaacctcacgcacctccca

SEQ ID NO: 178245 - DNA, 12 bp, Homo sapiens
agagaaggcagg

SEQ ID NO: 178246 - DNA, 21 bp, Homo sapiens
agagacacctgcacctccccc

SEQ ID NO: 178247 - DNA, 22 bp, Homo sapiens
agagacacctgcacctcccccc

SEQ ID NO: 178248 - DNA, 15 bp, Homo sapiens
agagacagaaagcag

SEQ ID NO: 178249 - DNA, 14 bp, Homo sapiens
agagacccaaggag

SEQ ID NO: 178250 - DNA, 15 bp, Homo sapiens
agagaccgtcctcac

SEQ ID NO: 178251 - DNA, 22 bp, Homo sapiens
agagaccgtcctcacccctgtc

SEQ ID NO: 178252 - DNA, 23 bp, Homo sapiens
agagaccgtcctcacccctgtcc

SEQ ID NO: 178253 - DNA, 19 bp, Homo sapiens
agagactcagggccccagc

SEQ ID NO: 178254 - DNA, 17 bp, Homo sapiens
aggacaacgaggaagcc

SEQ ID NO: 178255 - DNA, 20 bp, Homo sapiens
aggacaccacacccagcctc

SEQ ID NO: 178256 - DNA, 23 bp, Homo sapiens
aggacaccacacccagcctcagt

SEQ ID NO: 178257 - DNA, 13 bp, Homo sapiens
aggacccagagga

SEQ ID NO: 178258 - DNA, 17 bp, Homo sapiens
aggacccggaggggcct

SEQ ID NO: 178259 - DNA, 19 bp, Homo sapiens
aggacctagggatgttctg

SEQ ID NO: 178260 - DNA, 22 bp, Homo sapiens
aggacctagggatgttctggcc

SEQ ID NO: 178261 - DNA, 13 bp, Homo sapiens
aggacctcaggtg

SEQ ID NO: 178262 - DNA, 20 bp, Homo sapiens
aggacgtgggcggcagagag

SEQ ID NO: 178263 - DNA, 12 bp, Homo sapiens
aggactctcagg

SEQ ID NO: 178264 - DNA, 18 bp, Homo sapiens
aggactctgcccagacca

SEQ ID NO: 178265 - DNA, 16 bp, Homo sapiens
aggactctgcctcctc

SEQ ID NO: 178266 - DNA, 19 bp, Homo sapiens
aggactgaattgtccccag

SEQ ID NO: 178267 - DNA, 19 bp, Homo sapiens
aggagaaactggaactctc

SEQ ID NO: 178268 - DNA, 16 bp, Homo sapiens
aggagaaatgcatcca

SEQ ID NO: 178269 - DNA, 12 bp, Homo sapiens
aggagaaggaag

SEQ ID NO: 178270 - DNA, 19 bp, Homo sapiens
aggagactcacctctgcct

SEQ ID NO: 178271 - DNA, 11 bp, Homo sapiens
aggagagagaa

SEQ ID NO: 178272 - DNA, 12 bp, Homo sapiens
aggagagagaaa

SEQ ID NO: 178273 - DNA, 21 bp, Homo sapiens
aggagagagaaagccaggcag

SEQ ID NO: 178274 - DNA, 18 bp, Homo sapiens
aggagaggagagaggcag

SEQ ID NO: 178275 - DNA, 16 bp, Homo sapiens
aggagatgctccttgg

SEQ ID NO: 178276 - DNA, 22 bp, Homo sapiens
aggagatgctccttgggccctt

SEQ ID NO: 178277 - DNA, 18 bp, Homo sapiens
aggagctgggatcctaag

SEQ ID NO: 178278 - DNA, 20 bp, Homo sapiens
agagactcagggccccagca

SEQ ID NO: 178279 - DNA, 14 bp, Homo sapiens
agagagaaaataaa

SEQ ID NO: 178280 - DNA, 14 bp, Homo sapiens
agagagagtgtttg

SEQ ID NO: 178281 - DNA, 21 bp, Homo sapiens
agagagatcaaatggaaagga

SEQ ID NO: 178282 - DNA, 16 bp, Homo sapiens
agagagcggtctcagg

SEQ ID NO: 178283 - DNA, 21 bp, Homo sapiens
agagagcggtctcaggctggt

SEQ ID NO: 178284 - DNA, 17 bp, Homo sapiens
agagaggagaggagaga

SEQ ID NO: 178285 - DNA, 16 bp, Homo sapiens
agagaggcagagagcg

SEQ ID NO: 178286 - DNA, 16 bp, Homo sapiens
agagagtggctcctcc

SEQ ID NO: 178287 - DNA, 15 bp, Homo sapiens
agagatcaaatggaa

SEQ ID NO: 178288 - DNA, 16 bp, Homo sapiens
agagatgcctccaccg

SEQ ID NO: 178289 - DNA, 17 bp, Homo sapiens
agagatgcctccaccgc

SEQ ID NO: 178290 - DNA, 12 bp, Homo sapiens
agagatggagga

SEQ ID NO: 178291 - DNA, 22 bp, Homo sapiens
agagatgggactgggagggccc

SEQ ID NO: 178292 - DNA, 23 bp, Homo sapiens
agagatgggactgggagggccca

SEQ ID NO: 178293 - DNA, 19 bp, Homo sapiens
agagattacctcctgagaa

SEQ ID NO: 178294 - DNA, 20 bp, Homo sapiens
agagattacctcctgagaaa

SEQ ID NO: 178295 - DNA, 14 bp, Homo sapiens
agagcaagactctg

SEQ ID NO: 178296 - DNA, 14 bp, Homo sapiens
agagcaagtctgga

SEQ ID NO: 178297 - DNA, 18 bp, Homo sapiens
agagcacctagtccagtg

SEQ ID NO: 178298 - DNA, 20 bp, Homo sapiens
agagcacttaagagaatatt

SEQ ID NO: 178299 - DNA, 20 bp, Homo sapiens
agagcagctttaaactcagg

SEQ ID NO: 178300 - DNA, 23 bp, Homo sapiens
agagcaggaagcattcagagagc

SEQ ID NO: 178301 - DNA, 24 bp, Homo sapiens
agagcagggattaacctctgcact

SEQ ID NO: 178302 - DNA, 14 bp, Homo sapiens
agagccagccctcc

SEQ ID NO: 178303 - DNA, 17 bp, Homo sapiens
agagccagccctccctg

SEQ ID NO: 178304 - DNA, 16 bp, Homo sapiens
agagccatgctgggaa

SEQ ID NO: 178305 - DNA, 17 bp, Homo sapiens
agagccgtgatgcctcc

SEQ ID NO: 178306 - DNA, 19 bp, Homo sapiens
agagcctgctcccccaccc

SEQ ID NO: 178307 - DNA, 17 bp, Homo sapiens
agagccttggtgtccac

SEQ ID NO: 178308 - DNA, 14 bp, Homo sapiens
agagctagcgctgc

SEQ ID NO: 178309 - DNA, 17 bp, Homo sapiens
agagctgtattaagcca

SEQ ID NO: 178310 - DNA, 21 bp, Homo sapiens
agagctgttcacagccagact

SEQ ID NO: 178311 - DNA, 15 bp, Homo sapiens
agagcttcttccagg

SEQ ID NO: 178312 - DNA, 17 bp, Homo sapiens
agaggaaaaaaatgact

SEQ ID NO: 178313 - DNA, 16 bp, Homo sapiens
agaggaaaatgaataa

SEQ ID NO: 178314 - DNA, 20 bp, Homo sapiens
agaggaaaatgaataataca

SEQ ID NO: 178315 - DNA, 12 bp, Homo sapiens
agaggaactgtc

SEQ ID NO: 178316 - DNA, 15 bp, Homo sapiens
agaggaactgtccag

SEQ ID NO: 178317 - DNA, 19 bp, Homo sapiens
agaggaactgtccagagag

SEQ ID NO: 178318 - DNA, 16 bp, Homo sapiens
agaggaaggggccaga

SEQ ID NO: 178319 - DNA, 20 bp, Homo sapiens
agaggaaggggccagaggct

SEQ ID NO: 178320 - DNA, 16 bp, Homo sapiens
agaggacgtgggcggc

SEQ ID NO: 178321 - DNA, 10 bp, Homo sapiens
agaggagaga

SEQ ID NO: 178322 - DNA, 11 bp, Homo sapiens
agaggagagag

SEQ ID NO: 178323 - DNA, 17 bp, Homo sapiens
agaggagagaggcagag

SEQ ID NO: 178324 - DNA, 17 bp, Homo sapiens
agaggagaggagagagg

SEQ ID NO: 178325 - DNA, 14 bp, Homo sapiens
agaggccagcctgg

SEQ ID NO: 178326 - DNA, 13 bp, Homo sapiens
agaggctgaggac

SEQ ID NO: 178327 - DNA, 17 bp, Homo sapiens
agaggctggaggcaggg

SEQ ID NO: 178328 - DNA, 14 bp, Homo sapiens
agaggcttcttcag

SEQ ID NO: 178329 - DNA, 21 bp, Homo sapiens
agaggcttcttcagatcagtg

SEQ ID NO: 178330 - DNA, 22 bp, Homo sapiens
agagggatgaggtgctgggagg

SEQ ID NO: 178331 - DNA, 23 bp, Homo sapiens
agagggatgaggtgctgggaggg

SEQ ID NO: 178332 - DNA, 16 bp, Homo sapiens
agagggcactctgctt

SEQ ID NO: 178333 - DNA, 18 bp, Homo sapiens
agagggccaagacttggc

SEQ ID NO: 178334 - DNA, 16 bp, Homo sapiens
agaggggcagaacagc

SEQ ID NO: 178335 - DNA, 12 bp, Homo sapiens
agagggggccac

SEQ ID NO: 178336 - DNA, 22 bp, Homo sapiens
agagggtctggagaagcagtga

SEQ ID NO: 178337 - DNA, 16 bp, Homo sapiens
agaggtcaagcccagg

SEQ ID NO: 178338 - DNA, 20 bp, Homo sapiens
agaggtcaagcccaggagga

SEQ ID NO: 178339 - DNA, 12 bp, Homo sapiens
agaggtcttttt

SEQ ID NO: 178340 - DNA, 16 bp, Homo sapiens
agaggtcttttttaaa

SEQ ID NO: 178341 - DNA, 15 bp, Homo sapiens
agaggttgcagtgag

SEQ ID NO: 178342 - DNA, 15 bp, Homo sapiens
agagtaaaaactgaa

SEQ ID NO: 178343 - DNA, 13 bp, Homo sapiens
agagtagacattt

SEQ ID NO: 178344 - DNA, 22 bp, Homo sapiens
agagtagatggtgaaatttatt

SEQ ID NO: 178345 - DNA, 22 bp, Homo sapiens
agagtagccgagagcctgctcc

SEQ ID NO: 178346 - DNA, 16 bp, Homo sapiens
agagtcagcagaactg

SEQ ID NO: 178347 - DNA, 22 bp, Homo sapiens
agagtcggaacggagaaaggtg

SEQ ID NO: 178348 - DNA, 13 bp, Homo sapiens
agagtctgaacag

SEQ ID NO: 178349 - DNA, 16 bp, Homo sapiens
agagtctgaacagctg

SEQ ID NO: 178350 - DNA, 14 bp, Homo sapiens
agagtgaacaaatt

SEQ ID NO: 178351 - DNA, 17 bp, Homo sapiens
agagtgcaacagtagca

SEQ ID NO: 178352 - DNA, 19 bp, Homo sapiens
agagtggctcctcccggtg

SEQ ID NO: 178353 - DNA, 14 bp, Homo sapiens
agagtgtctttcca

SEQ ID NO: 178354 - DNA, 15 bp, Homo sapiens
agagtgtctttccac

SEQ ID NO: 178355 - DNA, 17 bp, Homo sapiens
agagtgtggccttcgga

SEQ ID NO: 178356 - DNA, 23 bp, Homo sapiens
agagttaaatagagtatatgcac

SEQ ID NO: 178357 - DNA, 16 bp, Homo sapiens
agagttgtaaatatat

SEQ ID NO: 178358 - DNA, 18 bp, Homo sapiens
agagttgtaaatatataa

SEQ ID NO: 178359 - DNA, 22 bp, Homo sapiens
agagttgtaaatatataaatat

SEQ ID NO: 178360 - DNA, 11 bp, Homo sapiens
agataaagatg

SEQ ID NO: 178361 - DNA, 18 bp, Homo sapiens
agataatattaaggaaga

SEQ ID NO: 178362 - DNA, 13 bp, Homo sapiens
agataatgtgaaa

SEQ ID NO: 178363 - DNA, 18 bp, Homo sapiens
agataatgtgaaaatggt

SEQ ID NO: 178364 - DNA, 12 bp, Homo sapiens
agataattataa

SEQ ID NO: 178365 - DNA, 18 bp, Homo sapiens
agatacagaactctttca

SEQ ID NO: 178366 - DNA, 14 bp, Homo sapiens
agataccagcgagg

SEQ ID NO: 178367 - DNA, 21 bp, Homo sapiens
agataccagcgaggaggctcc

SEQ ID NO: 178368 - DNA, 15 bp, Homo sapiens
agataggtaaatacc

SEQ ID NO: 178369 - DNA, 21 bp, Homo sapiens
agatatattaaaaatataaaa

SEQ ID NO: 178370 - DNA, 15 bp, Homo sapiens
agatatgagttgttt

SEQ ID NO: 178371 - DNA, 17 bp, Homo sapiens
agatatgatatgtaaac

SEQ ID NO: 178372 - DNA, 21 bp, Homo sapiens
agatattttttcagaaatatg

SEQ ID NO: 178373 - DNA, 23 bp, Homo sapiens
agatcaaatttcacgtcgtcttc

SEQ ID NO: 178374 - DNA, 21 bp, Homo sapiens
agatcaatttgtaattgctta

SEQ ID NO: 178375 - DNA, 14 bp, Homo sapiens
agatcccccagact

SEQ ID NO: 178376 - DNA, 17 bp, Homo sapiens
agatgcaaagaggcaag

SEQ ID NO: 178377 - DNA, 18 bp, Homo sapiens
agatgcaaagaggcaaga

SEQ ID NO: 178378 - DNA, 20 bp, Homo sapiens
agatgcaaagaggcaagagg

SEQ ID NO: 178379 - DNA, 21 bp, Homo sapiens
agatgcctccaccccccagaa

SEQ ID NO: 178380 - DNA, 22 bp, Homo sapiens
agatgcctccaccccccagaac

SEQ ID NO: 178381 - DNA, 14 bp, Homo sapiens
agatgcctccaccg

SEQ ID NO: 178382 - DNA, 16 bp, Homo sapiens
agatgcctccaccgct

SEQ ID NO: 178383 - DNA, 15 bp, Homo sapiens
agatgctccttgggc

SEQ ID NO: 178384 - DNA, 22 bp, Homo sapiens
agatgctgaaacaggagagaaa

SEQ ID NO: 178385 - DNA, 23 bp, Homo sapiens
agatgctgactgtactcctccca

SEQ ID NO: 178386 - DNA, 11 bp, Homo sapiens
agatgctggag

SEQ ID NO: 178387 - DNA, 18 bp, Homo sapiens
agatgctggagaagagag

SEQ ID NO: 178388 - DNA, 19 bp, Homo sapiens
agatgctggagaagagagg

SEQ ID NO: 178389 - DNA, 13 bp, Homo sapiens
agatggaatgctg

SEQ ID NO: 178390 - DNA, 19 bp, Homo sapiens
agatggcccagctccccaa

SEQ ID NO: 178391 - DNA, 21 bp, Homo sapiens
agatggctgtgcctctgcctg

SEQ ID NO: 178392 - DNA, 19 bp, Homo sapiens
agatgggactgggagggcc

SEQ ID NO: 178393 - DNA, 15 bp, Homo sapiens
agatggtgaaattta

SEQ ID NO: 178394 - DNA, 14 bp, Homo sapiens
agatgtagaggaga

SEQ ID NO: 178395 - DNA, 17 bp, Homo sapiens
agatgtgaacacatcag

SEQ ID NO: 178396 - DNA, 16 bp, Homo sapiens
agggacttgaagttgt

SEQ ID NO: 178397 - DNA, 14 bp, Homo sapiens
agggagagcggggc

SEQ ID NO: 178398 - DNA, 16 bp, Homo sapiens
agggagagcggggcag

SEQ ID NO: 178399 - DNA, 17 bp, Homo sapiens
agggagcagacaggagg

SEQ ID NO: 178400 - DNA, 13 bp, Homo sapiens
agggatagagggg

SEQ ID NO: 178401 - DNA, 17 bp, Homo sapiens
agggatagcactgagca

SEQ ID NO: 178402 - DNA, 15 bp, Homo sapiens
agggatccctcatct

SEQ ID NO: 178403 - DNA, 16 bp, Homo sapiens
agggatgaggtgctgg

SEQ ID NO: 178404 - DNA, 17 bp, Homo sapiens
agggatgaggtgctggg

SEQ ID NO: 178405 - DNA, 17 bp, Homo sapiens
agggatggattccaacc

SEQ ID NO: 178406 - DNA, 18 bp, Homo sapiens
agggatgttctggccctc

SEQ ID NO: 178407 - DNA, 18 bp, Homo sapiens
agggattaacctctgcac

SEQ ID NO: 178408 - DNA, 20 bp, Homo sapiens
agggattagggagagaagat

SEQ ID NO: 178409 - DNA, 16 bp, Homo sapiens
agggcactgctgctgc

SEQ ID NO: 178410 - DNA, 16 bp, Homo sapiens
agggcactggtggccc

SEQ ID NO: 178411 - DNA, 22 bp, Homo sapiens
agggcagaggctggaggcaggg

SEQ ID NO: 178412 - DNA, 14 bp, Homo sapiens
agggcagcagggct

SEQ ID NO: 178413 - DNA, 15 bp, Homo sapiens
agggcagcagggcta

SEQ ID NO: 178414 - DNA, 17 bp, Homo sapiens
agggcagggacaggata

SEQ ID NO: 178415 - DNA, 17 bp, Homo sapiens
agggcagggccccaggc

SEQ ID NO: 178416 - DNA, 21 bp, Homo sapiens
agggcatgccccggccacctc

SEQ ID NO: 178417 - DNA, 22 bp, Homo sapiens
agggcatgccccggccacctct

SEQ ID NO: 178418 - DNA, 21 bp, Homo sapiens
agggccaagcccagcactgct

SEQ ID NO: 178419 - DNA, 18 bp, Homo sapiens
agggccacgtgccaggcc

SEQ ID NO: 178420 - DNA, 19 bp, Homo sapiens
agggccacgtgccaggccc

SEQ ID NO: 178421 - DNA, 22 bp, Homo sapiens
agggccaggcaggtgcctggac

SEQ ID NO: 178422 - DNA, 11 bp, Homo sapiens
agggcccagag

SEQ ID NO: 178423 - DNA, 17 bp, Homo sapiens
agggcccagagcaggaa

SEQ ID NO: 178424 - DNA, 18 bp, Homo sapiens
agggcccagagcaggaag

SEQ ID NO: 178425 - DNA, 18 bp, Homo sapiens
agggccccagcactaaag

SEQ ID NO: 178426 - DNA, 23 bp, Homo sapiens
agggcctgcaggacctgcctgta

SEQ ID NO: 178427 - DNA, 14 bp, Homo sapiens
agggccttgcccag

SEQ ID NO: 178428 - DNA, 23 bp, Homo sapiens
agggccttgcccagagatgcctc

SEQ ID NO: 178429 - DNA, 16 bp, Homo sapiens
agggcgtgactcaccc

SEQ ID NO: 178430 - DNA, 14 bp, Homo sapiens
agggctaagagcta

SEQ ID NO: 178431 - DNA, 15 bp, Homo sapiens
agggctaccctgagc

SEQ ID NO: 178432 - DNA, 24 bp, Homo sapiens
agggctagtgacttgtgtcccatg

SEQ ID NO: 178433 - DNA, 15 bp, Homo sapiens
agggctcagcctggt

SEQ ID NO: 178434 - DNA, 15 bp, Homo sapiens
agggctctaaaaaaa

SEQ ID NO: 178435 - DNA, 14 bp, Homo sapiens
aggggacgctggta

SEQ ID NO: 178436 - DNA, 18 bp, Homo sapiens
aggggagcatgggaagtg

SEQ ID NO: 178437 - DNA, 15 bp, Homo sapiens
aggggccagaggctc

SEQ ID NO: 178438 - DNA, 17 bp, Homo sapiens
aggggccagaggctcgt

SEQ ID NO: 178439 - DNA, 14 bp, Homo sapiens
aggggcgtgtggct

SEQ ID NO: 178440 - DNA, 17 bp, Homo sapiens
aggggctacaagaggga

SEQ ID NO: 178441 - DNA, 18 bp, Homo sapiens
aggggctacaagagggaa

SEQ ID NO: 178442 - DNA, 22 bp, Homo sapiens
aggggctctcagctcagcgcca

SEQ ID NO: 178443 - DNA, 17 bp, Homo sapiens
aggggctctggagagaa

SEQ ID NO: 178444 - DNA, 22 bp, Homo sapiens
aggggctgctgacctccacagc

SEQ ID NO: 178445 - DNA, 15 bp, Homo sapiens
agggggccacctccc

SEQ ID NO: 178446 - DNA, 19 bp, Homo sapiens
agggggccacctccccagg

SEQ ID NO: 178447 - DNA, 15 bp, Homo sapiens
agggggccaggtgca

SEQ ID NO: 178448 - DNA, 18 bp, Homo sapiens
aggggtctccaggaggag

SEQ ID NO: 178449 - DNA, 19 bp, Homo sapiens
agggtaccttgaacactgg

SEQ ID NO: 178450 - DNA, 23 bp, Homo sapiens
agggtaccttgaacactggggga

SEQ ID NO: 178451 - DNA, 21 bp, Homo sapiens
agggtcaggaaggatgagcat

SEQ ID NO: 178452 - DNA, 14 bp, Homo sapiens
agggtcaggagagg

SEQ ID NO: 178453 - DNA, 16 bp, Homo sapiens
agggtctagggagaga

SEQ ID NO: 178454 - DNA, 21 bp, Homo sapiens
agggtggacttagaaagcagg

SEQ ID NO: 178455 - DNA, 22 bp, Homo sapiens
agggtgtccggtccctgtccca

SEQ ID NO: 178456 - DNA, 13 bp, Homo sapiens
agggttataataa

SEQ ID NO: 178457 - DNA, 18 bp, Homo sapiens
agggttcagagactcagg

SEQ ID NO: 178458 - DNA, 17 bp, Homo sapiens
agggttctcctctcccc

SEQ ID NO: 178459 - DNA, 20 bp, Homo sapiens
agggttctcctctcccctct

SEQ ID NO: 178460 - DNA, 21 bp, Homo sapiens
agggttgttaatggtgcaaat

SEQ ID NO: 178461 - DNA, 20 bp, Homo sapiens
agggtttggctgtgtctaaa

SEQ ID NO: 178462 - DNA, 21 bp, Homo sapiens
aggtaatccaagatattttaa

SEQ ID NO: 178463 - DNA, 12 bp, Homo sapiens
aggtacactctt

SEQ ID NO: 178464 - DNA, 21 bp, Homo sapiens
aggtaccactgatttggagat

SEQ ID NO: 178465 - DNA, 16 bp, Homo sapiens
aggtacctttcacata

SEQ ID NO: 178466 - DNA, 16 bp, Homo sapiens
aggtagccctggccag

SEQ ID NO: 178467 - DNA, 20 bp, Homo sapiens
aggtagccctggccagaggc

SEQ ID NO: 178468 - DNA, 20 bp, Homo sapiens
aggtaggtggatcacctgag

SEQ ID NO: 178469 - DNA, 17 bp, Homo sapiens
aggtattcgtgcagcat

SEQ ID NO: 178470 - DNA, 18 bp, Homo sapiens
aggtcaagcccaggagga

SEQ ID NO: 178471 - DNA, 21 bp, Homo sapiens
aggtcaatacagtacaggcag

SEQ ID NO: 178472 - DNA, 22 bp, Homo sapiens
aggtcaatacagtacaggcagc

SEQ ID NO: 178473 - DNA, 23 bp, Homo sapiens
aggtcaatacagtacaggcagca

SEQ ID NO: 178474 - DNA, 18 bp, Homo sapiens
aggtcagcttgctgccct

SEQ ID NO: 178475 - DNA, 21 bp, Homo sapiens
aggtcaggagttagaggccag

SEQ ID NO: 178476 - DNA, 16 bp, Homo sapiens
aggtcaggagttccta

SEQ ID NO: 178477 - DNA, 15 bp, Homo sapiens
aggtctcctcttaaa

SEQ ID NO: 178478 - DNA, 17 bp, Homo sapiens
aggtctcctcttaaaaa

SEQ ID NO: 178479 - DNA, 23 bp, Homo sapiens
aggtgcacagacgtccctccacg

SEQ ID NO: 178480 - DNA, 17 bp, Homo sapiens
aggtgcagagtgcccag

SEQ ID NO: 178481 - DNA, 20 bp, Homo sapiens
aggtgcagagtgcccagaac

SEQ ID NO: 178482 - DNA, 21 bp, Homo sapiens
aggtgcatctggggaactaga

SEQ ID NO: 178483 - DNA, 19 bp, Homo sapiens
aggtgcccttggaggccag

SEQ ID NO: 178484 - DNA, 11 bp, Homo sapiens
aggtgcctgtg

SEQ ID NO: 178485 - DNA, 23 bp, Homo sapiens
aggtgccttcttattctcactcc

SEQ ID NO: 178486 - DNA, 18 bp, Homo sapiens
aggtggaaaaacatctga

SEQ ID NO: 178487 - DNA, 11 bp, Homo sapiens
aggtggaagcc

SEQ ID NO: 178488 - DNA, 16 bp, Homo sapiens
aggtggaagccctcct

SEQ ID NO: 178489 - DNA, 19 bp, Homo sapiens
aggtggaagccctccttcc

SEQ ID NO: 178490 - DNA, 19 bp, Homo sapiens
aggtggctgacccagtccc

SEQ ID NO: 178491 - DNA, 13 bp, Homo sapiens
aggtgggagcagg

SEQ ID NO: 178492 - DNA, 21 bp, Homo sapiens
aggtggggagactgggctgag

SEQ ID NO: 178493 - DNA, 13 bp, Homo sapiens
aggtggggagtca

SEQ ID NO: 178494 - DNA, 15 bp, Homo sapiens
aggtggtgcttacat

SEQ ID NO: 178495 - DNA, 12 bp, Homo sapiens
aggtgttgccaa

SEQ ID NO: 178496 - DNA, 14 bp, Homo sapiens
aggtgtttatacag

SEQ ID NO: 178497 - DNA, 17 bp, Homo sapiens
aggttaaggctgaggaa

SEQ ID NO: 178498 - DNA, 24 bp, Homo sapiens
aggttaaggctgaggaaaggccag

SEQ ID NO: 178499 - DNA, 21 bp, Homo sapiens
aggttaccctgtaacatgcaa

SEQ ID NO: 178500 - DNA, 18 bp, Homo sapiens
aggttaggatttaacagt

SEQ ID NO: 178501 - DNA, 16 bp, Homo sapiens
aggttcacgtgcagct

SEQ ID NO: 178502 - DNA, 16 bp, Homo sapiens
aggttcactaaagcag

SEQ ID NO: 178503 - DNA, 23 bp, Homo sapiens
aggttccgcttggagcagagggg

SEQ ID NO: 178504 - DNA, 18 bp, Homo sapiens
aggttgcagtgagccaag

SEQ ID NO: 178505 - DNA, 19 bp, Homo sapiens
aggttgcagtgagccaaga

SEQ ID NO: 178506 - DNA, 17 bp, Homo sapiens
aggttgtaaatgtgttt

SEQ ID NO: 178507 - DNA, 20 bp, Homo sapiens
aggttgtctgaagtcactgc

SEQ ID NO: 178508 - DNA, 14 bp, Homo sapiens
aggtttaagctgtt

SEQ ID NO: 178509 - DNA, 22 bp, Homo sapiens
aggtttacaatttacaaagtgt

SEQ ID NO: 178510 - DNA, 13 bp, Homo sapiens
aggtttgtatatt

SEQ ID NO: 178511 - DNA, 20 bp, Homo sapiens
aggtttgtatattgtcagat

SEQ ID NO: 178512 - DNA, 12 bp, Homo sapiens
aggttttgttgt

SEQ ID NO: 178513 - DNA, 17 bp, Homo sapiens
agtaaaaccacagcagt

SEQ ID NO: 178514 - DNA, 15 bp, Homo sapiens
agtaaagaaatgaca

SEQ ID NO: 178515 - DNA, 19 bp, Homo sapiens
agtaaagtgataatttctg

SEQ ID NO: 178516 - DNA, 11 bp, Homo sapiens
agtaaatgcta

SEQ ID NO: 178517 - DNA, 19 bp, Homo sapiens
agtaacaatgaagataaaa

SEQ ID NO: 178518 - DNA, 19 bp, Homo sapiens
agtaacgcgtcttcctgag

SEQ ID NO: 178519 - DNA, 16 bp, Homo sapiens
agtaagaaaatatttt

SEQ ID NO: 178520 - DNA, 17 bp, Homo sapiens
agtaagggaaatagaaa

SEQ ID NO: 178521 - DNA, 13 bp, Homo sapiens
agtaatagagcaa

SEQ ID NO: 178522 - DNA, 23 bp, Homo sapiens
agtaatttattgtttttccttgt

SEQ ID NO: 178523 - DNA, 14 bp, Homo sapiens
agtacaggcagcac

SEQ ID NO: 178524 - DNA, 19 bp, Homo sapiens
agtacaggcagcacagaga

SEQ ID NO: 178525 - DNA, 15 bp, Homo sapiens
agtacctataaagta

SEQ ID NO: 178526 - DNA, 15 bp, Homo sapiens
agtacctcctgcccc

SEQ ID NO: 178527 - DNA, 13 bp, Homo sapiens
agtactcatacat

SEQ ID NO: 178528 - DNA, 19 bp, Homo sapiens
agtagaaataatatgcatt

SEQ ID NO: 178529 - DNA, 13 bp, Homo sapiens
agtagaacagata

SEQ ID NO: 178530 - DNA, 17 bp, Homo sapiens
agtagatggtgaaattt

SEQ ID NO: 178531 - DNA, 21 bp, Homo sapiens
agtagatggtgaaatttatta

SEQ ID NO: 178532 - DNA, 16 bp, Homo sapiens
agtagccctttctgtg

SEQ ID NO: 178533 - DNA, 13 bp, Homo sapiens
agtaggtgcttga

SEQ ID NO: 178534 - DNA, 15 bp, Homo sapiens
agtagttaattctgt

SEQ ID NO: 178535 - DNA, 12 bp, Homo sapiens
agtagtttgtat

SEQ ID NO: 178536 - DNA, 15 bp, Homo sapiens
agtatctcagggcct

SEQ ID NO: 178537 - DNA, 18 bp, Homo sapiens
agtatctcctcgcaagct

SEQ ID NO: 178538 - DNA, 12 bp, Homo sapiens
agccccagagca

SEQ ID NO: 178539 - DNA, 18 bp, Homo sapiens
agccccaggcctctgtgt

SEQ ID NO: 178540 - DNA, 20 bp, Homo sapiens
agccccagtgccaagcacag

SEQ ID NO: 178541 - DNA, 17 bp, Homo sapiens
agcccccaggctgctgg

SEQ ID NO: 178542 - DNA, 23 bp, Homo sapiens
agccccgcagacctccccagccc

SEQ ID NO: 178543 - DNA, 18 bp, Homo sapiens
agccccgtggggttcctc

SEQ ID NO: 178544 - DNA, 15 bp, Homo sapiens
agcccctagcccagg

SEQ ID NO: 178545 - DNA, 19 bp, Homo sapiens
agcccctagcccaggagag

SEQ ID NO: 178546 - DNA, 23 bp, Homo sapiens
agcccctagcccaggagagagaa

SEQ ID NO: 178547 - DNA, 18 bp, Homo sapiens
agcccctcctctgccacc

SEQ ID NO: 178548 - DNA, 19 bp, Homo sapiens
agcccctcctctgccacct

SEQ ID NO: 178549 - DNA, 23 bp, Homo sapiens
agcccctcctctgccacctcccc

SEQ ID NO: 178550 - DNA, 19 bp, Homo sapiens
agccccttctcagaatcta

SEQ ID NO: 178551 - DNA, 16 bp, Homo sapiens
agccctagggtggaga

SEQ ID NO: 178552 - DNA, 17 bp, Homo sapiens
agccctagggtggagag

SEQ ID NO: 178553 - DNA, 15 bp, Homo sapiens
agccctcagaaccct

SEQ ID NO: 178554 - DNA, 18 bp, Homo sapiens
agccctcagaacccttgg

SEQ ID NO: 178555 - DNA, 24 bp, Homo sapiens
agccctcagaacccttggcttgcc

SEQ ID NO: 178556 - DNA, 15 bp, Homo sapiens
agccctccctgcccc

SEQ ID NO: 178557 - DNA, 12 bp, Homo sapiens
agccctcctcac

SEQ ID NO: 178558 - DNA, 12 bp, Homo sapiens
agccctccttcc

SEQ ID NO: 178559 - DNA, 13 bp, Homo sapiens
agccctcttccat

SEQ ID NO: 178560 - DNA, 19 bp, Homo sapiens
agccctcttccatcatgtc

SEQ ID NO: 178561 - DNA, 23 bp, Homo sapiens
agccctcttccatcatgtcccca

SEQ ID NO: 178562 - DNA, 21 bp, Homo sapiens
agccctgctttgggctgccct

SEQ ID NO: 178563 - DNA, 16 bp, Homo sapiens
agccctggccagaggc

SEQ ID NO: 178564 - DNA, 15 bp, Homo sapiens
agccctggctctgca

SEQ ID NO: 178565 - DNA, 17 bp, Homo sapiens
agccctgggccccacca

SEQ ID NO: 178566 - DNA, 21 bp, Homo sapiens
agccctgggccccaccaccta

SEQ ID NO: 178567 - DNA, 23 bp, Homo sapiens
agccctgtggatgagccctcaga

SEQ ID NO: 178568 - DNA, 13 bp, Homo sapiens
agcccttcatttg

SEQ ID NO: 178569 - DNA, 19 bp, Homo sapiens
agcccttccatgtcgcctc

SEQ ID NO: 178570 - DNA, 21 bp, Homo sapiens
agccctttacttgacctccta

SEQ ID NO: 178571 - DNA, 13 bp, Homo sapiens
agccctttctgtg

SEQ ID NO: 178572 - DNA, 16 bp, Homo sapiens
agccgacctcagcctt

SEQ ID NO: 178573 - DNA, 23 bp, Homo sapiens
agccgactgcacagcggcccctg

SEQ ID NO: 178574 - DNA, 13 bp, Homo sapiens
agccgagagcctg

SEQ ID NO: 178575 - DNA, 17 bp, Homo sapiens
agccgagagcctgctcc

SEQ ID NO: 178576 - DNA, 17 bp, Homo sapiens
agccgcatcttctccat

SEQ ID NO: 178577 - DNA, 21 bp, Homo sapiens
agccgcatcttctccatctgg

SEQ ID NO: 178578 - DNA, 21 bp, Homo sapiens
agccgctcctgtctgccagcc

SEQ ID NO: 178579 - DNA, 15 bp, Homo sapiens
agccgctgagcgagg

SEQ ID NO: 178580 - DNA, 12 bp, Homo sapiens
agccgctgctgg

SEQ ID NO: 178581 - DNA, 19 bp, Homo sapiens
agccgctgtgagcccctgg

SEQ ID NO: 178582 - DNA, 16 bp, Homo sapiens
agccggcacagggtct

SEQ ID NO: 178583 - DNA, 20 bp, Homo sapiens
agtctgtgccacgtgtttgt

SEQ ID NO: 178584 - DNA, 18 bp, Homo sapiens
agtctgtgtgatgaactt

SEQ ID NO: 178585 - DNA, 19 bp, Homo sapiens
agtctgtgtgatgaacttt

SEQ ID NO: 178586 - DNA, 17 bp, Homo sapiens
agtcttaaaataactta

SEQ ID NO: 178587 - DNA, 16 bp, Homo sapiens
agtcttcactctctga

SEQ ID NO: 178588 - DNA, 19 bp, Homo sapiens
agtcttcactctctgaaga

SEQ ID NO: 178589 - DNA, 20 bp, Homo sapiens
agtgaaaaaggaggaagaga

SEQ ID NO: 178590 - DNA, 16 bp, Homo sapiens
agtgaacaaatttaca

SEQ ID NO: 178591 - DNA, 22 bp, Homo sapiens
agtgaagaaaagtgaatgctca

SEQ ID NO: 178592 - DNA, 21 bp, Homo sapiens
agtgaaggcttctctctgtgg

SEQ ID NO: 178593 - DNA, 13 bp, Homo sapiens
agtgaatgaaaca

SEQ ID NO: 178594 - DNA, 17 bp, Homo sapiens
agtgaatgattcagtgt

SEQ ID NO: 178595 - DNA, 19 bp, Homo sapiens
agtgaatgattcagtgtta

SEQ ID NO: 178596 - DNA, 19 bp, Homo sapiens
agtgacagtggattgcatt

SEQ ID NO: 178597 - DNA, 20 bp, Homo sapiens
agtgacagtggattgcattt

SEQ ID NO: 178598 - DNA, 14 bp, Homo sapiens
agtgacctgaggaa

SEQ ID NO: 178599 - DNA, 23 bp, Homo sapiens
agtgactcatcctcttgaagatg

SEQ ID NO: 178600 - DNA, 18 bp, Homo sapiens
agtgacttgtgtcccatg

SEQ ID NO: 178601 - DNA, 14 bp, Homo sapiens
agtgagaaaaagct

SEQ ID NO: 178602 - DNA, 20 bp, Homo sapiens
agtgagaaaaagctcctgtc

SEQ ID NO: 178603 - DNA, 22 bp, Homo sapiens
agtgagaaaaagctcctgtcct

SEQ ID NO: 178604 - DNA, 20 bp, Homo sapiens
agtgagccgcatcttctcca

SEQ ID NO: 178605 - DNA, 22 bp, Homo sapiens
agtgagccgcatcttctccatc

SEQ ID NO: 178606 - DNA, 14 bp, Homo sapiens
agtgagcctggctc

SEQ ID NO: 178607 - DNA, 17 bp, Homo sapiens
agtgagctgtaggtgtg

SEQ ID NO: 178608 - DNA, 18 bp, Homo sapiens
agtgaggggaaaccaggg

SEQ ID NO: 178609 - DNA, 13 bp, Homo sapiens
agtgagggtcaga

SEQ ID NO: 178610 - DNA, 15 bp, Homo sapiens
agtgagggtcagaga

SEQ ID NO: 178611 - DNA, 13 bp, Homo sapiens
agtgagtgagcct

SEQ ID NO: 178612 - DNA, 19 bp, Homo sapiens
agtgataatttctggaatt

SEQ ID NO: 178613 - DNA, 18 bp, Homo sapiens
agtgattaccagggactg

SEQ ID NO: 178614 - DNA, 18 bp, Homo sapiens
agtgcaaatttgatacat

SEQ ID NO: 178615 - DNA, 23 bp, Homo sapiens
agtgcagtcctgatcagagccgt

SEQ ID NO: 178616 - DNA, 14 bp, Homo sapiens
agtgcatctcagcc

SEQ ID NO: 178617 - DNA, 15 bp, Homo sapiens
agtgcatctcagccc

SEQ ID NO: 178618 - DNA, 17 bp, Homo sapiens
agtgcatgctctctgca

SEQ ID NO: 178619 - DNA, 18 bp, Homo sapiens
agtgccttacctcctgcc

SEQ ID NO: 178620 - DNA, 19 bp, Homo sapiens
agtgccttacctcctgccc

SEQ ID NO: 178621 - DNA, 22 bp, Homo sapiens
agtgccttacctcctgcccagg

SEQ ID NO: 178622 - DNA, 11 bp, Homo sapiens
agtgctccctc

SEQ ID NO: 178623 - DNA, 14 bp, Homo sapiens
agtgctccctcaca

SEQ ID NO: 178624 - DNA, 20 bp, Homo sapiens
agtgctcgctttctatgtag

SEQ ID NO: 178625 - DNA, 17 bp, Homo sapiens
agtgctctgatccctct

SEQ ID NO: 178626 - DNA, 14 bp, Homo sapiens
agtgctgaacagtg

SEQ ID NO: 178627 - DNA, 21 bp, Homo sapiens
agtgcttcttaaagagttctt

SEQ ID NO: 178628 - DNA, 11 bp, Homo sapiens
agtggaaaaat

SEQ ID NO: 178629 - DNA, 22 bp, Homo sapiens
agtggacaccaggagtccctgg

SEQ ID NO: 178630 - DNA, 13 bp, Homo sapiens
agtggaccaggac

SEQ ID NO: 178631 - DNA, 15 bp, Homo sapiens
agtggaccaggacag

SEQ ID NO: 178632 - DNA, 16 bp, Homo sapiens
agtggaccaggacagg

SEQ ID NO: 178633 - DNA, 20 bp, Homo sapiens
agtggaccaggacaggacca

SEQ ID NO: 178634 - DNA, 16 bp, Homo sapiens
agtggagaattatata

SEQ ID NO: 178635 - DNA, 22 bp, Homo sapiens
agtggaggttaaggctgaggaa

SEQ ID NO: 178636 - DNA, 21 bp, Homo sapiens
agtggctcctcccggtgccca

SEQ ID NO: 178637 - DNA, 15 bp, Homo sapiens
agtggctggtccagg

SEQ ID NO: 178638 - DNA, 18 bp, Homo sapiens
agtggctggtccagggct

SEQ ID NO: 178639 - DNA, 19 bp, Homo sapiens
agtggctggtccagggcta

SEQ ID NO: 178640 - DNA, 17 bp, Homo sapiens
agtggctgtcatcagcc

SEQ ID NO: 178641 - DNA, 19 bp, Homo sapiens
agtggcttactacatgtgg

SEQ ID NO: 178642 - DNA, 15 bp, Homo sapiens
agtggcttcaaaata

SEQ ID NO: 178643 - DNA, 21 bp, Homo sapiens
agtgggacagggcatggccag

SEQ ID NO: 178644 - DNA, 14 bp, Homo sapiens
agtgggagaaaaca

SEQ ID NO: 178645 - DNA, 20 bp, Homo sapiens
agtgggccaggacaggcccg

SEQ ID NO: 178646 - DNA, 15 bp, Homo sapiens
agtggggacagagca

SEQ ID NO: 178647 - DNA, 20 bp, Homo sapiens
agtggggtctccctctcctg

SEQ ID NO: 178648 - DNA, 22 bp, Homo sapiens
agtggggtctccctctcctgcc

SEQ ID NO: 178649 - DNA, 13 bp, Homo sapiens
agtgtaaaataag

SEQ ID NO: 178650 - DNA, 16 bp, Homo sapiens
agtgtaggcagacaca

SEQ ID NO: 178651 - DNA, 18 bp, Homo sapiens
agtgtaggcagacacagg

SEQ ID NO: 178652 - DNA, 14 bp, Homo sapiens
agtgtatttgtatt

SEQ ID NO: 178653 - DNA, 17 bp, Homo sapiens
agtgtcccctccactgt

SEQ ID NO: 178654 - DNA, 19 bp, Homo sapiens
agtgtctcagtccacctga

SEQ ID NO: 178655 - DNA, 22 bp, Homo sapiens
agtgtctcggagggattcccct

SEQ ID NO: 178656 - DNA, 22 bp, Homo sapiens
agtgtctgtgtgcaagtgtgtg

SEQ ID NO: 178657 - DNA, 21 bp, Homo sapiens
agtgtgcctgaagtcccagat

SEQ ID NO: 178658 - DNA, 19 bp, Homo sapiens
agtgtgtatgtgcgtgtgt

SEQ ID NO: 178659 - DNA, 18 bp, Homo sapiens
agtgtgtccaagtgtgtg

SEQ ID NO: 178660 - DNA, 14 bp, Homo sapiens
agtgtgtctaaatt

SEQ ID NO: 178661 - DNA, 19 bp, Homo sapiens
agtgtgtgcacatgtgtgc

SEQ ID NO: 178662 - DNA, 16 bp, Homo sapiens
agtgtgtgcatgtgtg

SEQ ID NO: 178663 - DNA, 23 bp, Homo sapiens
agtgtgtgcatgtgtgtgctcag

SEQ ID NO: 178664 - DNA, 12 bp, Homo sapiens
agtgtgtgtgcg

SEQ ID NO: 178665 - DNA, 19 bp, Homo sapiens
agtgtgtttccttcagtgc

SEQ ID NO: 178666 - DNA, 13 bp, Homo sapiens
agtgttttctggg

SEQ ID NO: 178667 - DNA, 21 bp, Homo sapiens
agttaaatagagtatatgcac

SEQ ID NO: 178668 - DNA, 20 bp, Homo sapiens
agttaacacctttaaagtgt

SEQ ID NO: 178669 - DNA, 13 bp, Homo sapiens
agttactcagccc

SEQ ID NO: 178670 - DNA, 15 bp, Homo sapiens
agttactcagccctg

SEQ ID NO: 178671 - DNA, 16 bp, Homo sapiens
agttactcagccctgg

SEQ ID NO: 178672 - DNA, 19 bp, Homo sapiens
agttactcagccctgggcc

SEQ ID NO: 178673 - DNA, 23 bp, Homo sapiens
agttactcagccctgggccccac

SEQ ID NO: 178674 - DNA, 14 bp, Homo sapiens
agttaggaaataaa

SEQ ID NO: 178675 - DNA, 15 bp, Homo sapiens
agttaggaaataaaa

SEQ ID NO: 178676 - DNA, 22 bp, Homo sapiens
agttaggaaataaaacctttca

SEQ ID NO: 178677 - DNA, 13 bp, Homo sapiens
agttatagtttca

SEQ ID NO: 178678 - DNA, 19 bp, Homo sapiens
agttatgccgctagataca

SEQ ID NO: 178679 - DNA, 18 bp, Homo sapiens
acattattatcaacaata

SEQ ID NO: 178680 - DNA, 15 bp, Homo sapiens
acattcaataagcat

SEQ ID NO: 178681 - DNA, 23 bp, Homo sapiens
acattcaataagcatcaaactct

SEQ ID NO: 178682 - DNA, 16 bp, Homo sapiens
acattctgccaggccc

SEQ ID NO: 178683 - DNA, 19 bp, Homo sapiens
acattgtaaatagtatttg

SEQ ID NO: 178684 - DNA, 21 bp, Homo sapiens
acattgtaaatagtatttgag

SEQ ID NO: 178685 - DNA, 23 bp, Homo sapiens
acatttctctaagagaacaatgt

SEQ ID NO: 178686 - DNA, 15 bp, Homo sapiens
acatttggagtgttc

SEQ ID NO: 178687 - DNA, 17 bp, Homo sapiens
accaaaattatttcaga

SEQ ID NO: 178688 - DNA, 21 bp, Homo sapiens
accaaaggtgaaggaatatat

SEQ ID NO: 178689 - DNA, 18 bp, Homo sapiens
accaaataaaaatattgt

SEQ ID NO: 178690 - DNA, 16 bp, Homo sapiens
accaacatggagaaac

SEQ ID NO: 178691 - DNA, 13 bp, Homo sapiens
accaacctgacca

SEQ ID NO: 178692 - DNA, 14 bp, Homo sapiens
accaactttctgta

SEQ ID NO: 178693 - DNA, 18 bp, Homo sapiens
accaactttctgtaaact

SEQ ID NO: 178694 - DNA, 16 bp, Homo sapiens
accaagaagatgtctt

SEQ ID NO: 178695 - DNA, 13 bp, Homo sapiens
accaagcaggaag

SEQ ID NO: 178696 - DNA, 18 bp, Homo sapiens
accaagccgtggcttccc

SEQ ID NO: 178697 - DNA, 20 bp, Homo sapiens
accaaggctgattaaaccaa

SEQ ID NO: 178698 - DNA, 23 bp, Homo sapiens
accaagtttcaggtattaagaaa

SEQ ID NO: 178699 - DNA, 14 bp, Homo sapiens
accaatagattccc

SEQ ID NO: 178700 - DNA, 20 bp, Homo sapiens
accaatcattttaattatta

SEQ ID NO: 178701 - DNA, 15 bp, Homo sapiens
accaatgttctctct

SEQ ID NO: 178702 - DNA, 18 bp, Homo sapiens
accacaaatagtgctcgc

SEQ ID NO: 178703 - DNA, 17 bp, Homo sapiens
accacacccagcctcag

SEQ ID NO: 178704 - DNA, 21 bp, Homo sapiens
accacctaggccactcctcca

SEQ ID NO: 178705 - DNA, 14 bp, Homo sapiens
accacctccctcac

SEQ ID NO: 178706 - DNA, 16 bp, Homo sapiens
accaccttcccagctc

SEQ ID NO: 178707 - DNA, 17 bp, Homo sapiens
accaccttcccagctct

SEQ ID NO: 178708 - DNA, 17 bp, Homo sapiens
accacgatgtggccctg

SEQ ID NO: 178709 - DNA, 19 bp, Homo sapiens
accacgatgtggccctggc

SEQ ID NO: 178710 - DNA, 19 bp, Homo sapiens
accactgcagaagacagta

SEQ ID NO: 178711 - DNA, 13 bp, Homo sapiens
accacttcattct

SEQ ID NO: 178712 - DNA, 17 bp, Homo sapiens
accacttcattcttgaa

SEQ ID NO: 178713 - DNA, 15 bp, Homo sapiens
accacttcttttata

SEQ ID NO: 178714 - DNA, 15 bp, Homo sapiens
accagaagcaacaga

SEQ ID NO: 178715 - DNA, 16 bp, Homo sapiens
accagagaccgtcctc

SEQ ID NO: 178716 - DNA, 17 bp, Homo sapiens
accagcagcctggaccc

SEQ ID NO: 178717 - DNA, 22 bp, Homo sapiens
accagcctttctcccaggccag

SEQ ID NO: 178718 - DNA, 22 bp, Homo sapiens
accagcgtgtgactactccccc

SEQ ID NO: 178719 - DNA, 16 bp, Homo sapiens
accagcttagatttta

SEQ ID NO: 178720 - DNA, 22 bp, Homo sapiens
accaggcacgaacccacctgct

SEQ ID NO: 178721 - DNA, 23 bp, Homo sapiens
accagtgcccaaagtctgtgtga

SEQ ID NO: 178722 - DNA, 17 bp, Homo sapiens
accagtggtctcacatg

SEQ ID NO: 178723 - DNA, 21 bp, Homo sapiens
accagttgcacttggcctctg

SEQ ID NO: 178724 - DNA, 15 bp, Homo sapiens
accatcagggacagg

SEQ ID NO: 178725 - DNA, 12 bp, Homo sapiens
acccctgccctg

SEQ ID NO: 178726 - DNA, 14 bp, Homo sapiens
acccctgccctggg

SEQ ID NO: 178727 - DNA, 17 bp, Homo sapiens
acccctggcttttcact

SEQ ID NO: 178728 - DNA, 18 bp, Homo sapiens
acccctgtcctcactgct

SEQ ID NO: 178729 - DNA, 16 bp, Homo sapiens
acccgacagagggaag

SEQ ID NO: 178730 - DNA, 21 bp, Homo sapiens
acccggcggtcccctccgcca

SEQ ID NO: 178731 - DNA, 15 bp, Homo sapiens
acccgtacaacgtgt

SEQ ID NO: 178732 - DNA, 14 bp, Homo sapiens
acccgtccagacct

SEQ ID NO: 178733 - DNA, 16 bp, Homo sapiens
acccgttcacattttt

SEQ ID NO: 178734 - DNA, 14 bp, Homo sapiens
accctaccccacca

SEQ ID NO: 178735 - DNA, 23 bp, Homo sapiens
accctatattttgcatagtacca

SEQ ID NO: 178736 - DNA, 19 bp, Homo sapiens
accctattgctgcttgagg

SEQ ID NO: 178737 - DNA, 13 bp, Homo sapiens
accctcaggcagg

SEQ ID NO: 178738 - DNA, 10 bp, Homo sapiens
accctccccc

SEQ ID NO: 178739 - DNA, 16 bp, Homo sapiens
accctcgaagcgcgcc

SEQ ID NO: 178740 - DNA, 20 bp, Homo sapiens
accctcgaagcgcgccactc

SEQ ID NO: 178741 - DNA, 20 bp, Homo sapiens
accctcgtggccttccccag

SEQ ID NO: 178742 - DNA, 15 bp, Homo sapiens
accctctccacccca

SEQ ID NO: 178743 - DNA, 14 bp, Homo sapiens
accctctcccagga

SEQ ID NO: 178744 - DNA, 15 bp, Homo sapiens
accctctcccaggac

SEQ ID NO: 178745 - DNA, 18 bp, Homo sapiens
acccttacagcctctgac

SEQ ID NO: 178746 - DNA, 22 bp, Homo sapiens
acccttaccatgtgcctgatcc

SEQ ID NO: 178747 - DNA, 22 bp, Homo sapiens
acccttcccctccttctccctt

SEQ ID NO: 178748 - DNA, 19 bp, Homo sapiens
acccttcctcaccacttcc

SEQ ID NO: 178749 - DNA, 18 bp, Homo sapiens
accctttccttccttccc

SEQ ID NO: 178750 - DNA, 22 bp, Homo sapiens
accctttccttccttccctggc

SEQ ID NO: 178751 - DNA, 22 bp, Homo sapiens
accctttgctgtgaggctgtcc

SEQ ID NO: 178752 - DNA, 17 bp, Homo sapiens
accgaaacagcgctggg

SEQ ID NO: 178753 - DNA, 16 bp, Homo sapiens
accgagtctcttctcc

SEQ ID NO: 178754 - DNA, 20 bp, Homo sapiens
accgagtctcttctccactg

SEQ ID NO: 178755 - DNA, 14 bp, Homo sapiens
accgcaggaagctg

SEQ ID NO: 178756 - DNA, 15 bp, Homo sapiens
accgcgtctggtgac

SEQ ID NO: 178757 - DNA, 19 bp, Homo sapiens
accgcgttgtaaaatatag

SEQ ID NO: 178758 - DNA, 20 bp, Homo sapiens
accgctgcctaagtggctgc

SEQ ID NO: 178759 - DNA, 21 bp, Homo sapiens
accgctgcctaagtggctgct

SEQ ID NO: 178760 - DNA, 15 bp, Homo sapiens
acctaaaaaagatat

SEQ ID NO: 178761 - DNA, 19 bp, Homo sapiens
acctaacgccctatttttg

SEQ ID NO: 178762 - DNA, 15 bp, Homo sapiens
acctaattagagcag

SEQ ID NO: 178763 - DNA, 14 bp, Homo sapiens
acctaccatcaggg

SEQ ID NO: 178764 - DNA, 17 bp, Homo sapiens
acctaggccactcctcc

SEQ ID NO: 178765 - DNA, 20 bp, Homo sapiens
acctagggatgttctggccc

SEQ ID NO: 178766 - DNA, 19 bp, Homo sapiens
acctcaaaatgtctaagat

SEQ ID NO: 178767 - DNA, 22 bp, Homo sapiens
acctcacgcacctcccatccta

SEQ ID NO: 178768 - DNA, 14 bp, Homo sapiens
acctcagccatgag

SEQ ID NO: 178769 - DNA, 17 bp, Homo sapiens
acctcagcctgtgctgc

SEQ ID NO: 178770 - DNA, 18 bp, Homo sapiens
acctcaggcactagcctt

SEQ ID NO: 178771 - DNA, 18 bp, Homo sapiens
acctcagttttatcattt

SEQ ID NO: 178772 - DNA, 17 bp, Homo sapiens
acctcattgacaagaac

SEQ ID NO: 178773 - DNA, 21 bp, Homo sapiens
acctccccacgccctcccctc

SEQ ID NO: 178774 - DNA, 15 bp, Homo sapiens
acctccccagcccct

SEQ ID NO: 178775 - DNA, 13 bp, Homo sapiens
acctccccagcct

SEQ ID NO: 178776 - DNA, 14 bp, Homo sapiens
acctccccaggccg

SEQ ID NO: 178777 - DNA, 16 bp, Homo sapiens
acctccccccactgca

SEQ ID NO: 178778 - DNA, 17 bp, Homo sapiens
acctccccccactgcag

SEQ ID NO: 178779 - DNA, 22 bp, Homo sapiens
acctccccccactgcaggcccc

SEQ ID NO: 178780 - DNA, 14 bp, Homo sapiens
acctcccctatcca

SEQ ID NO: 178781 - DNA, 20 bp, Homo sapiens
acctcccctatccacccagc

SEQ ID NO: 178782 - DNA, 13 bp, Homo sapiens
acctcctgcccag

SEQ ID NO: 178783 - DNA, 15 bp, Homo sapiens
acctcctgcccagga

SEQ ID NO: 178784 - DNA, 21 bp, Homo sapiens
acctcctgcccaggagagcca

SEQ ID NO: 178785 - DNA, 14 bp, Homo sapiens
acctcgctggactc

SEQ ID NO: 178786 - DNA, 17 bp, Homo sapiens
acctcggtgccttcctc

SEQ ID NO: 178787 - DNA, 14 bp, Homo sapiens
acctcgtcctcccc

SEQ ID NO: 178788 - DNA, 22 bp, Homo sapiens
acctctcttatagaatatttat

SEQ ID NO: 178789 - DNA, 20 bp, Homo sapiens
acctctgaaaccctggacca

SEQ ID NO: 178790 - DNA, 15 bp, Homo sapiens
acctctgatacctca

SEQ ID NO: 178791 - DNA, 13 bp, Homo sapiens
acctctgcctcaa

SEQ ID NO: 178792 - DNA, 17 bp, Homo sapiens
acctctgcggaccccag

SEQ ID NO: 178793 - DNA, 19 bp, Homo sapiens
acctctgcggaccccagct

SEQ ID NO: 178794 - DNA, 19 bp, Homo sapiens
acctctgtgacctcaggca

SEQ ID NO: 178795 - DNA, 20 bp, Homo sapiens
acctgaaaacactgtgcaca

SEQ ID NO: 178796 - DNA, 23 bp, Homo sapiens
acctgagcccggatgcttctcca

SEQ ID NO: 178797 - DNA, 15 bp, Homo sapiens
acctgagctccccac

SEQ ID NO: 178798 - DNA, 21 bp, Homo sapiens
acctgatggcacttagctatc

SEQ ID NO: 178799 - DNA, 18 bp, Homo sapiens
acctgcaagggctcccca

SEQ ID NO: 178800 - DNA, 20 bp, Homo sapiens
acctgcacctccccccactg

SEQ ID NO: 178801 - DNA, 21 bp, Homo sapiens
acctgcccaacctgctctcct

SEQ ID NO: 178802 - DNA, 20 bp, Homo sapiens
acctgcccagatcccagaag

SEQ ID NO: 178803 - DNA, 18 bp, Homo sapiens
acctgccgacctcgtcct

SEQ ID NO: 178804 - DNA, 20 bp, Homo sapiens
acctgctgagggaccagcca

SEQ ID NO: 178805 - DNA, 17 bp, Homo sapiens
acctgctgggtaaactg

SEQ ID NO: 178806 - DNA, 16 bp, Homo sapiens
acctggagttcctgaa

SEQ ID NO: 178807 - DNA, 15 bp, Homo sapiens
acctggcactgctgt

SEQ ID NO: 178808 - DNA, 17 bp, Homo sapiens
acctggcactgctgtgc

SEQ ID NO: 178809 - DNA, 21 bp, Homo sapiens
acctggggtgtgggaggcccg

SEQ ID NO: 178810 - DNA, 22 bp, Homo sapiens
acctggttccggaatcctgtcc

SEQ ID NO: 178811 - DNA, 11 bp, Homo sapiens
acctgtaatca

SEQ ID NO: 178812 - DNA, 18 bp, Homo sapiens
acctgtagtcccagctac

SEQ ID NO: 178813 - DNA, 14 bp, Homo sapiens
acctgtccttgcac

SEQ ID NO: 178814 - DNA, 18 bp, Homo sapiens
acctgtgagtttaaagca

SEQ ID NO: 178815 - DNA, 19 bp, Homo sapiens
acctgtgagtttaaagcaa

SEQ ID NO: 178816 - DNA, 16 bp, Homo sapiens
acctgtgcctcggctt

SEQ ID NO: 178817 - DNA, 19 bp, Homo sapiens
acctgtgcttcgggccctt

SEQ ID NO: 178818 - DNA, 23 bp, Homo sapiens
acctgtgcttcgggcccttccca

SEQ ID NO: 178819 - DNA, 20 bp, Homo sapiens
acctgtttttaagctgtttc

SEQ ID NO: 178820 - DNA, 17 bp, Homo sapiens
accttaccaactttctg

SEQ ID NO: 178821 - DNA, 20 bp, Homo sapiens
accttaccaactttctgtaa

SEQ ID NO: 178822 - DNA, 19 bp, Homo sapiens
accttccatggctcttttt

SEQ ID NO: 178823 - DNA, 11 bp, Homo sapiens
accttcccagc

SEQ ID NO: 178824 - DNA, 13 bp, Homo sapiens
accttcccagctc

SEQ ID NO: 178825 - DNA, 17 bp, Homo sapiens
accttcccatgccctgg

SEQ ID NO: 178826 - DNA, 19 bp, Homo sapiens
accttgctttgatggaata

SEQ ID NO: 178827 - DNA, 17 bp, Homo sapiens
acctttattaaaatctt

SEQ ID NO: 178828 - DNA, 18 bp, Homo sapiens
acctttattaaaatctta

SEQ ID NO: 178829 - DNA, 16 bp, Homo sapiens
acctttattgtgatct

SEQ ID NO: 178830 - DNA, 18 bp, Homo sapiens
acctttattgtgatctat

SEQ ID NO: 178831 - DNA, 19 bp, Homo sapiens
accttttgaagtagtttgt

SEQ ID NO: 178832 - DNA, 15 bp, Homo sapiens
acctaacccctttcc

SEQ ID NO: 178833 - DNA, 16 bp, Homo sapiens
acctaacccctttcct

SEQ ID NO: 178834 - DNA, 18 bp, Homo sapiens
acctaacccctttcctgc

SEQ ID NO: 178835 - DNA, 16 bp, Homo sapiens
acctaattagagcaga

SEQ ID NO: 178836 - DNA, 18 bp, Homo sapiens
acctaggccactcctcca

SEQ ID NO: 178837 - DNA, 15 bp, Homo sapiens
acctataaaacaggt

SEQ ID NO: 178838 - DNA, 18 bp, Homo sapiens
acctataaaacaggtcaa

SEQ ID NO: 178839 - DNA, 16 bp, Homo sapiens
acctataaagtaaagc

SEQ ID NO: 178840 - DNA, 13 bp, Homo sapiens
acctatatgattt

SEQ ID NO: 178841 - DNA, 17 bp, Homo sapiens
acctatatgatttatag

SEQ ID NO: 178842 - DNA, 14 bp, Homo sapiens
acctatttgacata

SEQ ID NO: 178843 - DNA, 17 bp, Homo sapiens
acctcacgcacctccca

SEQ ID NO: 178844 - DNA, 21 bp, Homo sapiens
acctcactggggtcctggggc

SEQ ID NO: 178845 - DNA, 23 bp, Homo sapiens
acctcactggggtcctggggcct

SEQ ID NO: 178846 - DNA, 15 bp, Homo sapiens
acctcagcctcctgt

SEQ ID NO: 178847 - DNA, 16 bp, Homo sapiens
acctcagcctgtgctg

SEQ ID NO: 178848 - DNA, 19 bp, Homo sapiens
acctcagcctgtgctgccc

SEQ ID NO: 178849 - DNA, 14 bp, Homo sapiens
acctcagccttgga

SEQ ID NO: 178850 - DNA, 19 bp, Homo sapiens
acctcaggcactagccttt

SEQ ID NO: 178851 - DNA, 23 bp, Homo sapiens
acctcaggcactagcctttggct

SEQ ID NO: 178852 - DNA, 12 bp, Homo sapiens
acctccacagct

SEQ ID NO: 178853 - DNA, 14 bp, Homo sapiens
acctccacatcctc

SEQ ID NO: 178854 - DNA, 20 bp, Homo sapiens
acctcccacaaaggagagct

SEQ ID NO: 178855 - DNA, 15 bp, Homo sapiens
acctcccatcctaat

SEQ ID NO: 178856 - DNA, 14 bp, Homo sapiens
acctccccacgccc

SEQ ID NO: 178857 - DNA, 16 bp, Homo sapiens
acctccccagccccta

SEQ ID NO: 178858 - DNA, 19 bp, Homo sapiens
acctccccagcccctagcc

SEQ ID NO: 178859 - DNA, 23 bp, Homo sapiens
acctccccagcccctagcccagg

SEQ ID NO: 178860 - DNA, 13 bp, Homo sapiens
acctccccaggcc

SEQ ID NO: 178861 - DNA, 19 bp, Homo sapiens
acctccccaggccgtggct

SEQ ID NO: 178862 - DNA, 15 bp, Homo sapiens
acctccccccactgc

SEQ ID NO: 178863 - DNA, 17 bp, Homo sapiens
acctcccctatccaccc

SEQ ID NO: 178864 - DNA, 18 bp, Homo sapiens
acctcccctatccaccca

SEQ ID NO: 178865 - DNA, 23 bp, Homo sapiens
acctcctacgtcaaacatgaagt

SEQ ID NO: 178866 - DNA, 16 bp, Homo sapiens
acctcctccacaccag

SEQ ID NO: 178867 - DNA, 19 bp, Homo sapiens
acggacgaaccttgaaaac

SEQ ID NO: 178868 - DNA, 13 bp, Homo sapiens
acggagagcgcct

SEQ ID NO: 178869 - DNA, 19 bp, Homo sapiens
acggagccactcctctgac

SEQ ID NO: 178870 - DNA, 15 bp, Homo sapiens
acggatttatttttc

SEQ ID NO: 178871 - DNA, 13 bp, Homo sapiens
acggcacccaccc

SEQ ID NO: 178872 - DNA, 21 bp, Homo sapiens
acggccttcaactgaaaagac

SEQ ID NO: 178873 - DNA, 16 bp, Homo sapiens
acgggcagtagctgtg

SEQ ID NO: 178874 - DNA, 14 bp, Homo sapiens
acggggactgggga

SEQ ID NO: 178875 - DNA, 21 bp, Homo sapiens
acggtgccttttttcacggaa

SEQ ID NO: 178876 - DNA, 18 bp, Homo sapiens
acgtacttagcagctatc

SEQ ID NO: 178877 - DNA, 14 bp, Homo sapiens
acgtcaaacatgaa

SEQ ID NO: 178878 - DNA, 12 bp, Homo sapiens
acgtccctccac

SEQ ID NO: 178879 - DNA, 22 bp, Homo sapiens
acgtctgaccctctccacccca

SEQ ID NO: 178880 - DNA, 20 bp, Homo sapiens
acgtgactgccccaactcct

SEQ ID NO: 178881 - DNA, 23 bp, Homo sapiens
acgtgagagtgtcttcacggcag

SEQ ID NO: 178882 - DNA, 13 bp, Homo sapiens
acgtgccaggccc

SEQ ID NO: 178883 - DNA, 14 bp, Homo sapiens
acgtgccaggcccg

SEQ ID NO: 178884 - DNA, 18 bp, Homo sapiens
acgtgccaggcccggggc

SEQ ID NO: 178885 - DNA, 21 bp, Homo sapiens
acgtgccaggcccggggctgg

SEQ ID NO: 178886 - DNA, 12 bp, Homo sapiens
acgtggagaggg

SEQ ID NO: 178887 - DNA, 15 bp, Homo sapiens
acgtggagagggatg

SEQ ID NO: 178888 - DNA, 16 bp, Homo sapiens
acgtggcctcttgagc

SEQ ID NO: 178889 - DNA, 14 bp, Homo sapiens
acgtggctctgctg

SEQ ID NO: 178890 - DNA, 15 bp, Homo sapiens
acgtggctctgctgg

SEQ ID NO: 178891 - DNA, 16 bp, Homo sapiens
acgtgggagacaagaa

SEQ ID NO: 178892 - DNA, 16 bp, Homo sapiens
acgtgtgtgactcaga

SEQ ID NO: 178893 - DNA, 23 bp, Homo sapiens
acgtgtgtgactcagatgtctct

SEQ ID NO: 178894 - DNA, 13 bp, Homo sapiens
acgttcacccctc

SEQ ID NO: 178895 - DNA, 14 bp, Homo sapiens
acgttcacccctcc

SEQ ID NO: 178896 - DNA, 17 bp, Homo sapiens
actaacaggatatttaa

SEQ ID NO: 178897 - DNA, 23 bp, Homo sapiens
actaaccagggaagctgtccctc

SEQ ID NO: 178898 - DNA, 22 bp, Homo sapiens
actaactaaactctctttggga

SEQ ID NO: 178899 - DNA, 20 bp, Homo sapiens
actaactcctaggaaaatac

SEQ ID NO: 178900 - DNA, 16 bp, Homo sapiens
actaagccacaagaaa

SEQ ID NO: 178901 - DNA, 23 bp, Homo sapiens
actacacatccctaatgtgtgcc

SEQ ID NO: 178902 - DNA, 23 bp, Homo sapiens
actacaccatgtttgagctcaga

SEQ ID NO: 178903 - DNA, 17 bp, Homo sapiens
actacatcgccctccac

SEQ ID NO: 178904 - DNA, 18 bp, Homo sapiens
actacatgtggtttatag

SEQ ID NO: 178905 - DNA, 15 bp, Homo sapiens
actactcagggaatg

SEQ ID NO: 178906 - DNA, 20 bp, Homo sapiens
actactccggagacagggtt

SEQ ID NO: 178907 - DNA, 15 bp, Homo sapiens
actagaatttattca

SEQ ID NO: 178908 - DNA, 20 bp, Homo sapiens
actagagtctgaacagctgt

SEQ ID NO: 178909 - DNA, 23 bp, Homo sapiens
actagccaccaactcttgcaggt

SEQ ID NO: 178910 - DNA, 19 bp, Homo sapiens
actagcctttggctctgga

SEQ ID NO: 178911 - DNA, 22 bp, Homo sapiens
actagcctttggctctggagac

SEQ ID NO: 178912 - DNA, 23 bp, Homo sapiens
actagctagaagtgggccaggac

SEQ ID NO: 178913 - DNA, 20 bp, Homo sapiens
actagggatccctcatctgt

SEQ ID NO: 178914 - DNA, 16 bp, Homo sapiens
actagtgcaaatcata

SEQ ID NO: 178915 - DNA, 21 bp, Homo sapiens
actatagtccagctttgttct

SEQ ID NO: 178916 - DNA, 22 bp, Homo sapiens
actatcagtttgtcctgtagag

SEQ ID NO: 178917 - DNA, 15 bp, Homo sapiens
actatgactgctccc

SEQ ID NO: 178918 - DNA, 15 bp, Homo sapiens
actatgatttggaaa

SEQ ID NO: 178919 - DNA, 12 bp, Homo sapiens
actatgcctgtg

SEQ ID NO: 178920 - DNA, 13 bp, Homo sapiens
actatgttgataa

SEQ ID NO: 178921 - DNA, 16 bp, Homo sapiens
actattcaaacagtct

SEQ ID NO: 178922 - DNA, 22 bp, Homo sapiens
actattcaggagagtagaacag

SEQ ID NO: 178923 - DNA, 21 bp, Homo sapiens
actatttagtttttgtaattt

SEQ ID NO: 178924 - DNA, 16 bp, Homo sapiens
actatttgtctttcag

SEQ ID NO: 178925 - DNA, 18 bp, Homo sapiens
actatttgtctttcagga

SEQ ID NO: 178926 - DNA, 14 bp, Homo sapiens
actcaaatcaagaa

SEQ ID NO: 178927 - DNA, 22 bp, Homo sapiens
actcaaatgcttggcttctcat

SEQ ID NO: 178928 - DNA, 14 bp, Homo sapiens
actcaagccaagca

SEQ ID NO: 178929 - DNA, 22 bp, Homo sapiens
actcaagtgtctcagtccacct

SEQ ID NO: 178930 - DNA, 15 bp, Homo sapiens
actcaattgataaac

SEQ ID NO: 178931 - DNA, 18 bp, Homo sapiens
actcacccccaaggggca

SEQ ID NO: 178932 - DNA, 11 bp, Homo sapiens
actcacctctg

SEQ ID NO: 178933 - DNA, 13 bp, Homo sapiens
actcacctctgcc

SEQ ID NO: 178934 - DNA, 23 bp, Homo sapiens
actcacgataaataatcggccca

SEQ ID NO: 178935 - DNA, 14 bp, Homo sapiens
actcagaaattttt

SEQ ID NO: 178936 - DNA, 15 bp, Homo sapiens
actcagcagccctcc

SEQ ID NO: 178937 - DNA, 17 bp, Homo sapiens
actcagcagccctcctc

SEQ ID NO: 178938 - DNA, 18 bp, Homo sapiens
actcagcagccctcctca

SEQ ID NO: 178939 - DNA, 20 bp, Homo sapiens
actcagcagccctcctcacc

SEQ ID NO: 178940 - DNA, 11 bp, Homo sapiens
actcagccctg

SEQ ID NO: 178941 - DNA, 15 bp, Homo sapiens
actcagccctgggcc

SEQ ID NO: 178942 - DNA, 13 bp, Homo sapiens
actcaggaggctg

SEQ ID NO: 178943 - DNA, 14 bp, Homo sapiens
actcaggaggctga

SEQ ID NO: 178944 - DNA, 17 bp, Homo sapiens
actcaggatgcccaggg

SEQ ID NO: 178945 - DNA, 13 bp, Homo sapiens
actcagttttctt

SEQ ID NO: 178946 - DNA, 12 bp, Homo sapiens
actcatcataaa

SEQ ID NO: 178947 - DNA, 14 bp, Homo sapiens
actcatcataaaat

SEQ ID NO: 178948 - DNA, 16 bp, Homo sapiens
actcatcataaaataa

SEQ ID NO: 178949 - DNA, 15 bp, Homo sapiens
actccaccaacccat

SEQ ID NO: 178950 - DNA, 13 bp, Homo sapiens
actccaccaccca

SEQ ID NO: 178951 - DNA, 14 bp, Homo sapiens
actccaccacccaa

SEQ ID NO: 178952 - DNA, 13 bp, Homo sapiens
actccagacccct

SEQ ID NO: 178953 - DNA, 13 bp, Homo sapiens
actccagcctggg

SEQ ID NO: 178954 - DNA, 21 bp, Homo sapiens
actccagcctgggcaacacag

SEQ ID NO: 178955 - DNA, 14 bp, Homo sapiens
actccagtgccagc

SEQ ID NO: 178956 - DNA, 14 bp, Homo sapiens
actcccccaggtgg

SEQ ID NO: 178957 - DNA, 16 bp, Homo sapiens
actcccctgcactgga

SEQ ID NO: 178958 - DNA, 22 bp, Homo sapiens
actcccctgcactggagtccag

SEQ ID NO: 178959 - DNA, 14 bp, Homo sapiens
actcccttgggctc

SEQ ID NO: 178960 - DNA, 12 bp, Homo sapiens
actcctcccagg

SEQ ID NO: 178961 - DNA, 20 bp, Homo sapiens
actcctctgactcagggctc

SEQ ID NO: 178962 - DNA, 21 bp, Homo sapiens
actcctgggctcaagcagtct

SEQ ID NO: 178963 - DNA, 12 bp, Homo sapiens
actccttagaga

SEQ ID NO: 178964 - DNA, 11 bp, Homo sapiens
actccttcctg

SEQ ID NO: 178965 - DNA, 20 bp, Homo sapiens
actccttcctgccacctgct

SEQ ID NO: 178966 - DNA, 19 bp, Homo sapiens
actccttgtggtttatgtc

SEQ ID NO: 178967 - DNA, 21 bp, Homo sapiens
actccttgtggtttatgtcat

SEQ ID NO: 178968 - DNA, 12 bp, Homo sapiens
actcgcttcccc

SEQ ID NO: 178969 - DNA, 14 bp, Homo sapiens
actcgtatatgtct

SEQ ID NO: 178970 - DNA, 19 bp, Homo sapiens
actctaccagactgtgtat

SEQ ID NO: 178971 - DNA, 15 bp, Homo sapiens
actctagggaaaaac

SEQ ID NO: 178972 - DNA, 14 bp, Homo sapiens
actctcacatgttt

SEQ ID NO: 178973 - DNA, 22 bp, Homo sapiens
actctcaggaccaaagctttca

SEQ ID NO: 178974 - DNA, 19 bp, Homo sapiens
actctcaggatcaagaaag

SEQ ID NO: 178975 - DNA, 14 bp, Homo sapiens
actctcagtctctg

SEQ ID NO: 178976 - DNA, 14 bp, Homo sapiens
actctccaacctgg

SEQ ID NO: 178977 - DNA, 12 bp, Homo sapiens
actctgcctctg

SEQ ID NO: 178978 - DNA, 13 bp, Homo sapiens
actctgggaaata

SEQ ID NO: 178979 - DNA, 15 bp, Homo sapiens
actctgtctcagtcc

SEQ ID NO: 178980 - DNA, 18 bp, Homo sapiens
actctgtctcagtccatg

SEQ ID NO: 178981 - DNA, 18 bp, Homo sapiens
actcttaaaacccaagtg

SEQ ID NO: 178982 - DNA, 17 bp, Homo sapiens
actctttgaatgacaaa

SEQ ID NO: 178983 - DNA, 15 bp, Homo sapiens
actgaaaatctaata

SEQ ID NO: 178984 - DNA, 16 bp, Homo sapiens
actgaaaatctaatat

SEQ ID NO: 178985 - DNA, 23 bp, Homo sapiens
actgaaaatctaatattaaaaat

SEQ ID NO: 178986 - DNA, 11 bp, Homo sapiens
actgaaggaga

SEQ ID NO: 178987 - DNA, 21 bp, Homo sapiens
actgaaggagaaggtgcccca

SEQ ID NO: 178988 - DNA, 22 bp, Homo sapiens
actgacatgtggggccaggtca

SEQ ID NO: 178989 - DNA, 14 bp, Homo sapiens
actgactccttaga

SEQ ID NO: 178990 - DNA, 15 bp, Homo sapiens
actgacttctaagta

SEQ ID NO: 178991 - DNA, 16 bp, Homo sapiens
actgacttctaagtaa

SEQ ID NO: 178992 - DNA, 15 bp, Homo sapiens
aatgtacattaatta

SEQ ID NO: 178993 - DNA, 18 bp, Homo sapiens
aatgtactgcatatgaaa

SEQ ID NO: 178994 - DNA, 14 bp, Homo sapiens
aatgtatatgcact

SEQ ID NO: 178995 - DNA, 18 bp, Homo sapiens
aatgtcaccaccttccca

SEQ ID NO: 178996 - DNA, 15 bp, Homo sapiens
aatgtgaaaagaaaa

SEQ ID NO: 178997 - DNA, 23 bp, Homo sapiens
aatgtgaatcagaccctacccca

SEQ ID NO: 178998 - DNA, 21 bp, Homo sapiens
aatgtgattcctttgaagagg

SEQ ID NO: 178999 - DNA, 24 bp, Homo sapiens
aatgtgcattcttttaaaagacaa

SEQ ID NO: 179000 - DNA, 13 bp, Homo sapiens
aatgtgcccccag

SEQ ID NO: 179001 - DNA, 20 bp, Homo sapiens
aatgtggcctaaaaatgcaa

SEQ ID NO: 179002 - DNA, 15 bp, Homo sapiens
aatgtgtaattttgt

SEQ ID NO: 179003 - DNA, 15 bp, Homo sapiens
aatgttacattgttt

SEQ ID NO: 179004 - DNA, 22 bp, Homo sapiens
aatgttatttgttattttcagt

SEQ ID NO: 179005 - DNA, 21 bp, Homo sapiens
aatgttcatcccatgatgtag

SEQ ID NO: 179006 - DNA, 19 bp, Homo sapiens
aatgttgaaaagtcaaact

SEQ ID NO: 179007 - DNA, 15 bp, Homo sapiens
aatgttgttatttaa

SEQ ID NO: 179008 - DNA, 20 bp, Homo sapiens
aatgtttagcaaatacatat

SEQ ID NO: 179009 - DNA, 20 bp, Homo sapiens
aatgtttattcctgataata

SEQ ID NO: 179010 - DNA, 18 bp, Homo sapiens
aatgtttgtctcatccca

SEQ ID NO: 179011 - DNA, 16 bp, Homo sapiens
aattaaggcataagaa

SEQ ID NO: 179012 - DNA, 23 bp, Homo sapiens
aattaataaaaaatggaaagaat

SEQ ID NO: 179013 - DNA, 21 bp, Homo sapiens
aattaatatccctacatgtat

SEQ ID NO: 179014 - DNA, 12 bp, Homo sapiens
aattagagcaga

SEQ ID NO: 179015 - DNA, 17 bp, Homo sapiens
aattaggaagtgattat

SEQ ID NO: 179016 - DNA, 15 bp, Homo sapiens
aattatccagagttt

SEQ ID NO: 179017 - DNA, 15 bp, Homo sapiens
aattatgtatgttta

SEQ ID NO: 179018 - DNA, 18 bp, Homo sapiens
aattatgtatgtttacat

SEQ ID NO: 179019 - DNA, 21 bp, Homo sapiens
aattatgtatgtttacatatc

SEQ ID NO: 179020 - DNA, 12 bp, Homo sapiens
aattattgtaca

SEQ ID NO: 179021 - DNA, 21 bp, Homo sapiens
aattattgtacatttatagtt

SEQ ID NO: 179022 - DNA, 12 bp, Homo sapiens
aattattgtata

SEQ ID NO: 179023 - DNA, 12 bp, Homo sapiens
aattatttcaga

SEQ ID NO: 179024 - DNA, 17 bp, Homo sapiens
aattatttcagaaatgt

SEQ ID NO: 179025 - DNA, 19 bp, Homo sapiens
aattatttgtgtaatagaa

SEQ ID NO: 179026 - DNA, 15 bp, Homo sapiens
aattcagcactgatt

SEQ ID NO: 179027 - DNA, 23 bp, Homo sapiens
aattcagcactgatttcacaaca

SEQ ID NO: 179028 - DNA, 15 bp, Homo sapiens
aattcatttttttca

SEQ ID NO: 179029 - DNA, 17 bp, Homo sapiens
aattccaattatatgag

SEQ ID NO: 179030 - DNA, 21 bp, Homo sapiens
aattccctctctctgactctc

SEQ ID NO: 179031 - DNA, 14 bp, Homo sapiens
aattcctctgggaa

SEQ ID NO: 179032 - DNA, 23 bp, Homo sapiens
aattccttagcttagacctcagc

SEQ ID NO: 179033 - DNA, 19 bp, Homo sapiens
aattccttttctaactctc

SEQ ID NO: 179034 - DNA, 19 bp, Homo sapiens
aattctaaatgaatgttta

SEQ ID NO: 179035 - DNA, 16 bp, Homo sapiens
aattctcatgtgatcc

SEQ ID NO: 179036 - DNA, 15 bp, Homo sapiens
aattctgctacctca

SEQ ID NO: 179037 - DNA, 21 bp, Homo sapiens
aattcttgaaggaaaatgata

SEQ ID NO: 179038 - DNA, 16 bp, Homo sapiens
aattcttgtatattat

SEQ ID NO: 179039 - DNA, 19 bp, Homo sapiens
aattgacccacaagaaatg

SEQ ID NO: 179040 - DNA, 22 bp, Homo sapiens
aattgacccacaagaaatgaaa

SEQ ID NO: 179041 - DNA, 14 bp, Homo sapiens
aattgcacttttaa

SEQ ID NO: 179042 - DNA, 13 bp, Homo sapiens
aattgctgtgtat

SEQ ID NO: 179043 - DNA, 17 bp, Homo sapiens
aattgtaaaactgaggc

SEQ ID NO: 179044 - DNA, 14 bp, Homo sapiens
aattgtaactgttc

SEQ ID NO: 179045 - DNA, 11 bp, Homo sapiens
aattgtccctt

SEQ ID NO: 179046 - DNA, 18 bp, Homo sapiens
aattgtcccttaaacaaa

SEQ ID NO: 179047 - DNA, 20 bp, Homo sapiens
aattgtttaagtgttgtaaa

SEQ ID NO: 179048 - DNA, 14 bp, Homo sapiens
aatttaatgcatgt

SEQ ID NO: 179049 - DNA, 15 bp, Homo sapiens
aatttacaaagtgtg

SEQ ID NO: 179050 - DNA, 21 bp, Homo sapiens
aatttacaaagtgtgtattaa

SEQ ID NO: 179051 - DNA, 17 bp, Homo sapiens
aatttatacaatatcat

SEQ ID NO: 179052 - DNA, 17 bp, Homo sapiens
aatttattagttaatat

SEQ ID NO: 179053 - DNA, 21 bp, Homo sapiens
aatttattcaattcctctggg

SEQ ID NO: 179054 - DNA, 17 bp, Homo sapiens
aatttatttatactatt

SEQ ID NO: 179055 - DNA, 16 bp, Homo sapiens
aatttcatatgctgta

SEQ ID NO: 179056 - DNA, 16 bp, Homo sapiens
aatttcctttatattt

SEQ ID NO: 179057 - DNA, 15 bp, Homo sapiens
aatttctactttgaa

SEQ ID NO: 179058 - DNA, 17 bp, Homo sapiens
aatttctactttgaagt

SEQ ID NO: 179059 - DNA, 15 bp, Homo sapiens
aatttgatttctatt

SEQ ID NO: 179060 - DNA, 16 bp, Homo sapiens
aatttggattgctaat

SEQ ID NO: 179061 - DNA, 18 bp, Homo sapiens
aatttgggggaaaattta

SEQ ID NO: 179062 - DNA, 17 bp, Homo sapiens
aatttggttctaggccg

SEQ ID NO: 179063 - DNA, 15 bp, Homo sapiens
aatttgtaattgctt

SEQ ID NO: 179064 - DNA, 19 bp, Homo sapiens
aatgtgaaaagaaaaatga

SEQ ID NO: 179065 - DNA, 17 bp, Homo sapiens
aatgtgaatgggaaaag

SEQ ID NO: 179066 - DNA, 11 bp, Homo sapiens
aatgtgatatg

SEQ ID NO: 179067 - DNA, 20 bp, Homo sapiens
aatgtgatgaatactgtatt

SEQ ID NO: 179068 - DNA, 19 bp, Homo sapiens
aatgtgtgccatagagttt

SEQ ID NO: 179069 - DNA, 14 bp, Homo sapiens
aatgttaaagtcag

SEQ ID NO: 179070 - DNA, 15 bp, Homo sapiens
aatgttaaagtcagt

SEQ ID NO: 179071 - DNA, 23 bp, Homo sapiens
aatgttaattcagcactgatttc

SEQ ID NO: 179072 - DNA, 21 bp, Homo sapiens
aatgttatttgttattttcag

SEQ ID NO: 179073 - DNA, 23 bp, Homo sapiens
aatgttatttgttattttcagta

SEQ ID NO: 179074 - DNA, 16 bp, Homo sapiens
aatgttgaaaagtcaa

SEQ ID NO: 179075 - DNA, 20 bp, Homo sapiens
aatgtttacactctttgtaa

SEQ ID NO: 179076 - DNA, 23 bp, Homo sapiens
aatgtttcttctaggttctaaaa

SEQ ID NO: 179077 - DNA, 14 bp, Homo sapiens
aattaaattttgag

SEQ ID NO: 179078 - DNA, 13 bp, Homo sapiens
aattaatagcttt

SEQ ID NO: 179079 - DNA, 19 bp, Homo sapiens
aattaatatccctacatgt

SEQ ID NO: 179080 - DNA, 16 bp, Homo sapiens
aattagctgtgtgaaa

SEQ ID NO: 179081 - DNA, 17 bp, Homo sapiens
aattataacttaaaata

SEQ ID NO: 179082 - DNA, 23 bp, Homo sapiens
aattataacttaaaatattttat

SEQ ID NO: 179083 - DNA, 19 bp, Homo sapiens
aattatgagttatttttat

SEQ ID NO: 179084 - DNA, 16 bp, Homo sapiens
aattatgtatgtttac

SEQ ID NO: 179085 - DNA, 13 bp, Homo sapiens
aattattatttat

SEQ ID NO: 179086 - DNA, 18 bp, Homo sapiens
aattattatttatatatg

SEQ ID NO: 179087 - DNA, 22 bp, Homo sapiens
aattattatttatatatgtatt

SEQ ID NO: 179088 - DNA, 14 bp, Homo sapiens
aattattttaaaca

SEQ ID NO: 179089 - DNA, 22 bp, Homo sapiens
aattccactgtcaagaaagagc

SEQ ID NO: 179090 - DNA, 13 bp, Homo sapiens
aattccctgctgt

SEQ ID NO: 179091 - DNA, 13 bp, Homo sapiens
aattcctctggga

SEQ ID NO: 179092 - DNA, 19 bp, Homo sapiens
aattctcatgtgatccttt

SEQ ID NO: 179093 - DNA, 15 bp, Homo sapiens
aattctcttatccaa

SEQ ID NO: 179094 - DNA, 19 bp, Homo sapiens
aattctgctacctcactgg

SEQ ID NO: 179095 - DNA, 13 bp, Homo sapiens
aattcttggaata

SEQ ID NO: 179096 - DNA, 18 bp, Homo sapiens
aattcttggttgaggaaa

SEQ ID NO: 179097 - DNA, 14 bp, Homo sapiens
aattcttgtatatt

SEQ ID NO: 179098 - DNA, 13 bp, Homo sapiens
aattgacccacaa

SEQ ID NO: 179099 - DNA, 16 bp, Homo sapiens
aattgacccacaagaa

SEQ ID NO: 179100 - DNA, 14 bp, Homo sapiens
aattgattattctg

SEQ ID NO: 179101 - DNA, 23 bp, Homo sapiens
aattgattattctgattccactt

SEQ ID NO: 179102 - DNA, 23 bp, Homo sapiens
aattgctatgttttgacattttt

SEQ ID NO: 179103 - DNA, 18 bp, Homo sapiens
aattgctgtgtatctgat

SEQ ID NO: 179104 - DNA, 15 bp, Homo sapiens
aattgcttacatttt

SEQ ID NO: 179105 - DNA, 12 bp, Homo sapiens
aattgtatgtta

SEQ ID NO: 179106 - DNA, 22 bp, Homo sapiens
aattgtatgttaagttacttca

SEQ ID NO: 179107 - DNA, 20 bp, Homo sapiens
aattgtgccgagaaaagcat

SEQ ID NO: 179108 - DNA, 21 bp, Homo sapiens
aattgtggggatgatgaaata

SEQ ID NO: 179109 - DNA, 14 bp, Homo sapiens
aatttaaaaaataa

SEQ ID NO: 179110 - DNA, 17 bp, Homo sapiens
aatttacaaagtgtgta

SEQ ID NO: 179111 - DNA, 17 bp, Homo sapiens
aatttacagagacagaa

SEQ ID NO: 179112 - DNA, 19 bp, Homo sapiens
aatttacatactctgctta

SEQ ID NO: 179113 - DNA, 18 bp, Homo sapiens
aatttatcttgtctctgg

SEQ ID NO: 179114 - DNA, 16 bp, Homo sapiens
aatttatgagtttttg

SEQ ID NO: 179115 - DNA, 19 bp, Homo sapiens
aatttatgagtttttgata

SEQ ID NO: 179116 - DNA, 20 bp, Homo sapiens
aatttatgagtttttgatag

SEQ ID NO: 179117 - DNA, 14 bp, Homo sapiens
aatttcacattaat

SEQ ID NO: 179118 - DNA, 21 bp, Homo sapiens
aatttcctttatatttagtga

SEQ ID NO: 179119 - DNA, 16 bp, Homo sapiens
aatttctactttgaag

SEQ ID NO: 179120 - DNA, 19 bp, Homo sapiens
aatttctcccagtcattta

SEQ ID NO: 179121 - DNA, 20 bp, Homo sapiens
aatttcttcactgttgaaaa

SEQ ID NO: 179122 - DNA, 21 bp, Homo sapiens
aatttgatacatatgtgaata

SEQ ID NO: 179123 - DNA, 20 bp, Homo sapiens
aatttgtacatatgtaaaat

SEQ ID NO: 179124 - DNA, 12 bp, Homo sapiens
aattttaaatta

SEQ ID NO: 179125 - DNA, 13 bp, Homo sapiens
aattttaatttat

SEQ ID NO: 179126 - DNA, 15 bp, Homo sapiens
aattttaatttattt

SEQ ID NO: 179127 - DNA, 12 bp, Homo sapiens
aattttatgaat

SEQ ID NO: 179128 - DNA, 12 bp, Homo sapiens
aattttattcct

SEQ ID NO: 179129 - DNA, 17 bp, Homo sapiens
aattttcagaccccagc

SEQ ID NO: 179130 - DNA, 20 bp, Homo sapiens
aattttctagactttctgtt

SEQ ID NO: 179131 - DNA, 20 bp, Homo sapiens
aattttgagttctacataag

SEQ ID NO: 179132 - DNA, 19 bp, Homo sapiens
aattttgttctagttttca

SEQ ID NO: 179133 - DNA, 13 bp, Homo sapiens
aatttttaaagta

SEQ ID NO: 179134 - DNA, 15 bp, Homo sapiens
acagctcccacccca

SEQ ID NO: 179135 - DNA, 20 bp, Homo sapiens
acagctctgcatactcatta

SEQ ID NO: 179136 - DNA, 15 bp, Homo sapiens
acagctgagagactt

SEQ ID NO: 179137 - DNA, 19 bp, Homo sapiens
acagctgagagacttttaa

SEQ ID NO: 179138 - DNA, 22 bp, Homo sapiens
acagctgagagacttttaatca

SEQ ID NO: 179139 - DNA, 17 bp, Homo sapiens
acagctgcagagacaga

SEQ ID NO: 179140 - DNA, 16 bp, Homo sapiens
acagctgcctgcagta

SEQ ID NO: 179141 - DNA, 17 bp, Homo sapiens
acagctgtttaagatgg

SEQ ID NO: 179142 - DNA, 19 bp, Homo sapiens
acagctgtttaagatgggc

SEQ ID NO: 179143 - DNA, 17 bp, Homo sapiens
acagctttatcaccaga

SEQ ID NO: 179144 - DNA, 16 bp, Homo sapiens
acaggaaaatcctctg

SEQ ID NO: 179145 - DNA, 23 bp, Homo sapiens
acaggaaaatcctctggctggct

SEQ ID NO: 179146 - DNA, 22 bp, Homo sapiens
acaggaaagggaaggccccaca

SEQ ID NO: 179147 - DNA, 14 bp, Homo sapiens
acaggaccagattt

SEQ ID NO: 179148 - DNA, 11 bp, Homo sapiens
acaggagaaat

SEQ ID NO: 179149 - DNA, 18 bp, Homo sapiens
acaggagagaaaggggat

SEQ ID NO: 179150 - DNA, 13 bp, Homo sapiens
acaggagctggga

SEQ ID NO: 179151 - DNA, 14 bp, Homo sapiens
acaggagctgggat

SEQ ID NO: 179152 - DNA, 18 bp, Homo sapiens
acaggatgacctggataa

SEQ ID NO: 179153 - DNA, 19 bp, Homo sapiens
acaggcaactgaggcagac

SEQ ID NO: 179154 - DNA, 17 bp, Homo sapiens
acaggcagcacagagac

SEQ ID NO: 179155 - DNA, 22 bp, Homo sapiens
acaggcagcgatggtctcagaa

SEQ ID NO: 179156 - DNA, 13 bp, Homo sapiens
acaggcccttcct

SEQ ID NO: 179157 - DNA, 15 bp, Homo sapiens
acaggcccttcctct

SEQ ID NO: 179158 - DNA, 13 bp, Homo sapiens
acaggctcttagc

SEQ ID NO: 179159 - DNA, 15 bp, Homo sapiens
acagggaagagcaga

SEQ ID NO: 179160 - DNA, 22 bp, Homo sapiens
acagggcatgccccggccacct

SEQ ID NO: 179161 - DNA, 22 bp, Homo sapiens
acagggtctgctctttctctgc

SEQ ID NO: 179162 - DNA, 23 bp, Homo sapiens
acagggtttggctgtgtctaaac

SEQ ID NO: 179163 - DNA, 23 bp, Homo sapiens
acaggtcaatacagtacaggcag

SEQ ID NO: 179164 - DNA, 14 bp, Homo sapiens
acaggtctcctctt

SEQ ID NO: 179165 - DNA, 13 bp, Homo sapiens
acagtacaggcag

SEQ ID NO: 179166 - DNA, 16 bp, Homo sapiens
acagtacaggcagcac

SEQ ID NO: 179167 - DNA, 18 bp, Homo sapiens
acagtacaggcagcacag

SEQ ID NO: 179168 - DNA, 14 bp, Homo sapiens
acagtaggagccca

SEQ ID NO: 179169 - DNA, 17 bp, Homo sapiens
acagtcaaggagtggct

SEQ ID NO: 179170 - DNA, 15 bp, Homo sapiens
acagtctcaggaaat

SEQ ID NO: 179171 - DNA, 17 bp, Homo sapiens
acagtctcaggaaatca

SEQ ID NO: 179172 - DNA, 19 bp, Homo sapiens
acagtcttccatttgcaag

SEQ ID NO: 179173 - DNA, 14 bp, Homo sapiens
acagtgagactctg

SEQ ID NO: 179174 - DNA, 18 bp, Homo sapiens
acagtgagactctgtctc

SEQ ID NO: 179175 - DNA, 17 bp, Homo sapiens
acagtgcatctcagccc

SEQ ID NO: 179176 - DNA, 18 bp, Homo sapiens
acagtgcatctcagccca

SEQ ID NO: 179177 - DNA, 22 bp, Homo sapiens
acagtgttattttctttgaaat

SEQ ID NO: 179178 - DNA, 16 bp, Homo sapiens
acagttcctcgccctg

SEQ ID NO: 179179 - DNA, 20 bp, Homo sapiens
acagtttaataccacagctt

SEQ ID NO: 179180 - DNA, 14 bp, Homo sapiens
acagtttgctctag

SEQ ID NO: 179181 - DNA, 15 bp, Homo sapiens
acagttttctgagaa

SEQ ID NO: 179182 - DNA, 17 bp, Homo sapiens
acagttttctgagaaag

SEQ ID NO: 179183 - DNA, 15 bp, Homo sapiens
acataaactgacttt

SEQ ID NO: 179184 - DNA, 15 bp, Homo sapiens
acataagtaattcaa

SEQ ID NO: 179185 - DNA, 12 bp, Homo sapiens
acataatttttt

SEQ ID NO: 179186 - DNA, 18 bp, Homo sapiens
acatagaattaacacatg

SEQ ID NO: 179187 - DNA, 18 bp, Homo sapiens
acatagcccatccctgcc

SEQ ID NO: 179188 - DNA, 21 bp, Homo sapiens
acatagtgatggttcccctgt

SEQ ID NO: 179189 - DNA, 20 bp, Homo sapiens
acatataaacatcacacaca

SEQ ID NO: 179190 - DNA, 23 bp, Homo sapiens
acatataatgttgttatttaaag

SEQ ID NO: 179191 - DNA, 13 bp, Homo sapiens
acatcaacagata

SEQ ID NO: 179192 - DNA, 13 bp, Homo sapiens
acatcacacacac

SEQ ID NO: 179193 - DNA, 22 bp, Homo sapiens
acatcacccttaccatgtgcct

SEQ ID NO: 179194 - DNA, 21 bp, Homo sapiens
acatcaccgacgcgtctcctg

SEQ ID NO: 179195 - DNA, 22 bp, Homo sapiens
acatcaccgacgcgtctcctgt

SEQ ID NO: 179196 - DNA, 23 bp, Homo sapiens
acatcaccgacgcgtctcctgtt

SEQ ID NO: 179197 - DNA, 18 bp, Homo sapiens
acatcccgggacgcagca

SEQ ID NO: 179198 - DNA, 20 bp, Homo sapiens
acatctcaggggccagagga

SEQ ID NO: 179199 - DNA, 21 bp, Homo sapiens
acatctcctccatactcagga

SEQ ID NO: 179200 - DNA, 15 bp, Homo sapiens
acatctgtgtcttgt

SEQ ID NO: 179201 - DNA, 18 bp, Homo sapiens
acatcttagtatttgcat

SEQ ID NO: 179202 - DNA, 16 bp, Homo sapiens
acatcttcagcaaata

SEQ ID NO: 179203 - DNA, 15 bp, Homo sapiens
acatctttcacactt

SEQ ID NO: 179204 - DNA, 13 bp, Homo sapiens
acatgaagaagct

SEQ ID NO: 179205 - DNA, 17 bp, Homo sapiens
acatgaagattctttcc

SEQ ID NO: 179206 - DNA, 22 bp, Homo sapiens
acatgaagattctttcccaatt

SEQ ID NO: 179207 - DNA, 19 bp, Homo sapiens
acatgaagtgtgtttcctt

SEQ ID NO: 179208 - DNA, 14 bp, Homo sapiens
acatgacacagctt

SEQ ID NO: 179209 - DNA, 19 bp, Homo sapiens
acatgatcttctttataat

SEQ ID NO: 179210 - DNA, 15 bp, Homo sapiens
acatgcctgccccaa

SEQ ID NO: 179211 - DNA, 17 bp, Homo sapiens
acatgcgggctgggcag

SEQ ID NO: 179212 - DNA, 19 bp, Homo sapiens
acatggtgctacgcctgca

SEQ ID NO: 179213 - DNA, 18 bp, Homo sapiens
acatggtgggtccatggg

SEQ ID NO: 179214 - DNA, 21 bp, Homo sapiens
acatgtattgcacattgtaaa

SEQ ID NO: 179215 - DNA, 19 bp, Homo sapiens
acatgtcagtaccttcaaa

SEQ ID NO: 179216 - DNA, 21 bp, Homo sapiens
acatgtcagtaccttcaaact

SEQ ID NO: 179217 - DNA, 21 bp, Homo sapiens
acatgtgacatttatatattg

SEQ ID NO: 179218 - DNA, 18 bp, Homo sapiens
acatgtggggccaggtca

SEQ ID NO: 179219 - DNA, 16 bp, Homo sapiens
acatgtggtttataga

SEQ ID NO: 179220 - DNA, 16 bp, Homo sapiens
acatgtgtgcgtgtgc

SEQ ID NO: 179221 - DNA, 16 bp, Homo sapiens
acattaagaaaatcat

SEQ ID NO: 179222 - DNA, 21 bp, Homo sapiens
acattaatcaatcatctgtgt

SEQ ID NO: 179223 - DNA, 15 bp, Homo sapiens
acaggactctgcctc

SEQ ID NO: 179224 - DNA, 16 bp, Homo sapiens
acaggactctgcctcc

SEQ ID NO: 179225 - DNA, 18 bp, Homo sapiens
acaggcaactgaggcaga

SEQ ID NO: 179226 - DNA, 22 bp, Homo sapiens
acaggcccggcgcggtggctca

SEQ ID NO: 179227 - DNA, 22 bp, Homo sapiens
acaggcccttcctctccactgc

SEQ ID NO: 179228 - DNA, 19 bp, Homo sapiens
acaggctcttagcagcttc

SEQ ID NO: 179229 - DNA, 13 bp, Homo sapiens
acagggacttgaa

SEQ ID NO: 179230 - DNA, 14 bp, Homo sapiens
acagggtctgctct

SEQ ID NO: 179231 - DNA, 24 bp, Homo sapiens
acagggtctgctctttctctgcca

SEQ ID NO: 179232 - DNA, 12 bp, Homo sapiens
acagtacaggca

SEQ ID NO: 179233 - DNA, 14 bp, Homo sapiens
acagtacaggcagc

SEQ ID NO: 179234 - DNA, 13 bp, Homo sapiens
acagtaggagccc

SEQ ID NO: 179235 - DNA, 16 bp, Homo sapiens
acagtcaaaacagaga

SEQ ID NO: 179236 - DNA, 14 bp, Homo sapiens
acagtcatttaaaa

SEQ ID NO: 179237 - DNA, 13 bp, Homo sapiens
acagtctcaggaa

SEQ ID NO: 179238 - DNA, 14 bp, Homo sapiens
acagtcttccattt

SEQ ID NO: 179239 - DNA, 19 bp, Homo sapiens
acagtgattaccagggact

SEQ ID NO: 179240 - DNA, 20 bp, Homo sapiens
acagtgattaccagggactg

SEQ ID NO: 179241 - DNA, 15 bp, Homo sapiens
acagtgcatctcagc

SEQ ID NO: 179242 - DNA, 13 bp, Homo sapiens
acagtgcctgctg

SEQ ID NO: 179243 - DNA, 17 bp, Homo sapiens
acagtggattgcatttc

SEQ ID NO: 179244 - DNA, 20 bp, Homo sapiens
acagtgttattttctttgaa

SEQ ID NO: 179245 - DNA, 19 bp, Homo sapiens
acagtgtttcgacagctga

SEQ ID NO: 179246 - DNA, 15 bp, Homo sapiens
acagttcatatgtac

SEQ ID NO: 179247 - DNA, 12 bp, Homo sapiens
acagttcctcgc

SEQ ID NO: 179248 - DNA, 14 bp, Homo sapiens
acagttcctcgccc

SEQ ID NO: 179249 - DNA, 15 bp, Homo sapiens
acagttcctcgccct

SEQ ID NO: 179250 - DNA, 18 bp, Homo sapiens
acagttcctcgccctggg

SEQ ID NO: 179251 - DNA, 22 bp, Homo sapiens
acagttgctgtcataagaatga

SEQ ID NO: 179252 - DNA, 18 bp, Homo sapiens
acagttttctgagaaaga

SEQ ID NO: 179253 - DNA, 19 bp, Homo sapiens
acagttttctgagaaagac

SEQ ID NO: 179254 - DNA, 20 bp, Homo sapiens
acagttttctgagaaagact

SEQ ID NO: 179255 - DNA, 15 bp, Homo sapiens
acataccagcttaga

SEQ ID NO: 179256 - DNA, 14 bp, Homo sapiens
acatactctgctta

SEQ ID NO: 179257 - DNA, 19 bp, Homo sapiens
acatagcccatccctgcct

SEQ ID NO: 179258 - DNA, 16 bp, Homo sapiens
acatagtgatggttcc

SEQ ID NO: 179259 - DNA, 14 bp, Homo sapiens
acatatgtaaaata

SEQ ID NO: 179260 - DNA, 21 bp, Homo sapiens
acatatgtgctggaattctaa

SEQ ID NO: 179261 - DNA, 12 bp, Homo sapiens
acatattcattt

SEQ ID NO: 179262 - DNA, 18 bp, Homo sapiens
acatatttccaagaagtt

SEQ ID NO: 179263 - DNA, 16 bp, Homo sapiens
acatattttatagaac

SEQ ID NO: 179264 - DNA, 18 bp, Homo sapiens
acatattttatagaactt

SEQ ID NO: 179265 - DNA, 13 bp, Homo sapiens
acatccaagcttc

SEQ ID NO: 179266 - DNA, 16 bp, Homo sapiens
acatccaagcttcctt

SEQ ID NO: 179267 - DNA, 17 bp, Homo sapiens
acatcccattgccctgg

SEQ ID NO: 179268 - DNA, 14 bp, Homo sapiens
acatcgccctccac

SEQ ID NO: 179269 - DNA, 20 bp, Homo sapiens
acatctctttgatgtcatat

SEQ ID NO: 179270 - DNA, 13 bp, Homo sapiens
acatctgaaagcc

SEQ ID NO: 179271 - DNA, 16 bp, Homo sapiens
acatctgttttaaatt

SEQ ID NO: 179272 - DNA, 17 bp, Homo sapiens
acatctgttttaaattt

SEQ ID NO: 179273 - DNA, 14 bp, Homo sapiens
acatcttagtattt

SEQ ID NO: 179274 - DNA, 19 bp, Homo sapiens
acatcttggtcagatttga

SEQ ID NO: 179275 - DNA, 15 bp, Homo sapiens
acatgaagattcttt

SEQ ID NO: 179276 - DNA, 18 bp, Homo sapiens
acatgaagattctttccc

SEQ ID NO: 179277 - DNA, 19 bp, Homo sapiens
tgcagtcctgatcagagcc

SEQ ID NO: 179278 - DNA, 14 bp, Homo sapiens
tgcagtgagccgag

SEQ ID NO: 179279 - DNA, 11 bp, Homo sapiens
tgcataaaatg

SEQ ID NO: 179280 - DNA, 17 bp, Homo sapiens
tgcataacaattcctct

SEQ ID NO: 179281 - DNA, 20 bp, Homo sapiens
tgcatagattccctgagcag

SEQ ID NO: 179282 - DNA, 21 bp, Homo sapiens
tgcatagtaccaatcatttta

SEQ ID NO: 179283 - DNA, 22 bp, Homo sapiens
tgcatagtaccaatcattttaa

SEQ ID NO: 179284 - DNA, 23 bp, Homo sapiens
tgcatattcttatgtatgtgaaa

SEQ ID NO: 179285 - DNA, 22 bp, Homo sapiens
tgcatcgagtcaaaactcaaat

SEQ ID NO: 179286 - DNA, 17 bp, Homo sapiens
tgcatcgtttcatcttc

SEQ ID NO: 179287 - DNA, 21 bp, Homo sapiens
tgcatctcactggatgcaaag

SEQ ID NO: 179288 - DNA, 14 bp, Homo sapiens
tgcatctcagccca

SEQ ID NO: 179289 - DNA, 14 bp, Homo sapiens
tgcatctccacctg

SEQ ID NO: 179290 - DNA, 18 bp, Homo sapiens
tgcatctcccagataatg

SEQ ID NO: 179291 - DNA, 14 bp, Homo sapiens
tgcatgatgtattt

SEQ ID NO: 179292 - DNA, 17 bp, Homo sapiens
tgcatgctctctgcagc

SEQ ID NO: 179293 - DNA, 19 bp, Homo sapiens
tgcatgctctctgcagcca

SEQ ID NO: 179294 - DNA, 19 bp, Homo sapiens
tgcattaccgcgttgtaaa

SEQ ID NO: 179295 - DNA, 22 bp, Homo sapiens
tgcattaccgcgttgtaaaata

SEQ ID NO: 179296 - DNA, 14 bp, Homo sapiens
tgcattagaaatta

SEQ ID NO: 179297 - DNA, 15 bp, Homo sapiens
tgcattgaatatatt

SEQ ID NO: 179298 - DNA, 22 bp, Homo sapiens
tgcatttaaatacagtcttcca

SEQ ID NO: 179299 - DNA, 14 bp, Homo sapiens
tgcatttcctgaca

SEQ ID NO: 179300 - DNA, 19 bp, Homo sapiens
tgccaaaggatgtgatata

SEQ ID NO: 179301 - DNA, 14 bp, Homo sapiens
tgccacacttcagg

SEQ ID NO: 179302 - DNA, 22 bp, Homo sapiens
tgccacacttcaggctcttctc

SEQ ID NO: 179303 - DNA, 17 bp, Homo sapiens
tgccacagcctcccctg

SEQ ID NO: 179304 - DNA, 21 bp, Homo sapiens
tgccacagcctcccctgccag

SEQ ID NO: 179305 - DNA, 13 bp, Homo sapiens
tgccaccagagac

SEQ ID NO: 179306 - DNA, 18 bp, Homo sapiens
tgccaccagagaccgtcc

SEQ ID NO: 179307 - DNA, 19 bp, Homo sapiens
tgccaccagagaccgtcct

SEQ ID NO: 179308 - DNA, 21 bp, Homo sapiens
tgccaccagagaccgtcctca

SEQ ID NO: 179309 - DNA, 21 bp, Homo sapiens
tgccacctcccctatccaccc

SEQ ID NO: 179310 - DNA, 22 bp, Homo sapiens
tgccacctcccctatccaccca

SEQ ID NO: 179311 - DNA, 20 bp, Homo sapiens
tgccactaaattgacactta

SEQ ID NO: 179312 - DNA, 19 bp, Homo sapiens
tgccactgcctcttcctcc

SEQ ID NO: 179313 - DNA, 21 bp, Homo sapiens
tgccagacggcacccacccag

SEQ ID NO: 179314 - DNA, 22 bp, Homo sapiens
tgccagagacggaagccttttt

SEQ ID NO: 179315 - DNA, 21 bp, Homo sapiens
tgccagatgcctttatggctg

SEQ ID NO: 179316 - DNA, 12 bp, Homo sapiens
tgccagccagca

SEQ ID NO: 179317 - DNA, 15 bp, Homo sapiens
tgccagccagcagcc

SEQ ID NO: 179318 - DNA, 22 bp, Homo sapiens
tgccagctctgtatcaggaccc

SEQ ID NO: 179319 - DNA, 23 bp, Homo sapiens
tgccagctctgtatcaggaccca

SEQ ID NO: 179320 - DNA, 13 bp, Homo sapiens
tgccaggacacgc

SEQ ID NO: 179321 - DNA, 15 bp, Homo sapiens
tgccagggcagggcc

SEQ ID NO: 179322 - DNA, 17 bp, Homo sapiens
tgccagtgacagacagg

SEQ ID NO: 179323 - DNA, 19 bp, Homo sapiens
tgccagtgacagacaggct

SEQ ID NO: 179324 - DNA, 20 bp, Homo sapiens
tgccagtgacagacaggctc

SEQ ID NO: 179325 - DNA, 22 bp, Homo sapiens
tgccagtgccttacctcctgcc

SEQ ID NO: 179326 - DNA, 13 bp, Homo sapiens
tgccataaaacat

SEQ ID NO: 179327 - DNA, 20 bp, Homo sapiens
tgccataaaacattaagaaa

SEQ ID NO: 179328 - DNA, 23 bp, Homo sapiens
tgccataaaacattaagaaaatc

SEQ ID NO: 179329 - DNA, 13 bp, Homo sapiens
tgccataattact

SEQ ID NO: 179330 - DNA, 13 bp, Homo sapiens
tgccatcatctcc

SEQ ID NO: 179331 - DNA, 23 bp, Homo sapiens
tgccatcatctcctgccttcctc

SEQ ID NO: 179332 - DNA, 16 bp, Homo sapiens
tgccatggaggcacac

SEQ ID NO: 179333 - DNA, 18 bp, Homo sapiens
tgccatggaggcacacag

SEQ ID NO: 179334 - DNA, 22 bp, Homo sapiens
tgccatttaaagcttattaaaa

SEQ ID NO: 179335 - DNA, 18 bp, Homo sapiens
tgcccaacctgctctcct

SEQ ID NO: 179336 - DNA, 23 bp, Homo sapiens
tgcccaacctgctctcctcttgc

SEQ ID NO: 179337 - DNA, 24 bp, Homo sapiens
tgcccaacctgctctcctcttgcc

SEQ ID NO: 179338 - DNA, 16 bp, Homo sapiens
tgcccacacaccccaa

SEQ ID NO: 179339 - DNA, 21 bp, Homo sapiens
tgcccagaactggactcagga

SEQ ID NO: 179340 - DNA, 12 bp, Homo sapiens
tgcccagagatg

SEQ ID NO: 179341 - DNA, 21 bp, Homo sapiens
tgcccagagatgcctccaccg

SEQ ID NO: 179342 - DNA, 20 bp, Homo sapiens
tgcccagctatacctgtgcc

SEQ ID NO: 179343 - DNA, 19 bp, Homo sapiens
tgcccaggagagccagccc

SEQ ID NO: 179344 - DNA, 16 bp, Homo sapiens
tgcccagggctcagcc

SEQ ID NO: 179345 - DNA, 21 bp, Homo sapiens
tgcccagggctcagcctggtg

SEQ ID NO: 179346 - DNA, 23 bp, Homo sapiens
tgcccagggctcagcctggtggg

SEQ ID NO: 179347 - DNA, 13 bp, Homo sapiens
tgcccatccctgg

SEQ ID NO: 179348 - DNA, 14 bp, Homo sapiens
tgccccaaacaaat

SEQ ID NO: 179349 - DNA, 20 bp, Homo sapiens
tgccccaaacaaatatgcaa

SEQ ID NO: 179350 - DNA, 15 bp, Homo sapiens
tgccccaactcctgg

SEQ ID NO: 179351 - DNA, 15 bp, Homo sapiens
tgccccagggctccc

SEQ ID NO: 179352 - DNA, 18 bp, Homo sapiens
tgccccatcagtgctccc

SEQ ID NO: 179353 - DNA, 20 bp, Homo sapiens
tgccccatcagtgctccctc

SEQ ID NO: 179354 - DNA, 15 bp, Homo sapiens
tgccccggccacctc

SEQ ID NO: 179355 - DNA, 16 bp, Homo sapiens
tgccccggccacctct

SEQ ID NO: 179356 - DNA, 17 bp, Homo sapiens
tgccccggccacctctg

SEQ ID NO: 179357 - DNA, 18 bp, Homo sapiens
tgccccgtgcagactgga

SEQ ID NO: 179358 - DNA, 17 bp, Homo sapiens
tgcccgtcttcagccta

SEQ ID NO: 179359 - DNA, 11 bp, Homo sapiens
tgccctgctgc

SEQ ID NO: 179360 - DNA, 21 bp, Homo sapiens
tgccctgctgccgcctcccag

SEQ ID NO: 179361 - DNA, 18 bp, Homo sapiens
tgccctggatccatcagg

SEQ ID NO: 179362 - DNA, 16 bp, Homo sapiens
tgccctgggatgtcca

SEQ ID NO: 179363 - DNA, 17 bp, Homo sapiens
tgccctggtgctgccac

SEQ ID NO: 179364 - DNA, 19 bp, Homo sapiens
tgcccttggaggccagcca

SEQ ID NO: 179365 - DNA, 17 bp, Homo sapiens
tgcccttgtcccactca

SEQ ID NO: 179366 - DNA, 16 bp, Homo sapiens
tgccgcctcccagcct

SEQ ID NO: 179367 - DNA, 20 bp, Homo sapiens
tgccggtaaacacgcctgca

SEQ ID NO: 179368 - DNA, 20 bp, Homo sapiens
tgccgtgtgccctcgggcga

SEQ ID NO: 179369 - DNA, 15 bp, Homo sapiens
tgcctcaatgccagt

SEQ ID NO: 179370 - DNA, 16 bp, Homo sapiens
tgcctcaatgccagta

SEQ ID NO: 179371 - DNA, 15 bp, Homo sapiens
tgcctcaccccttgc

SEQ ID NO: 179372 - DNA, 14 bp, Homo sapiens
tgcctcagcctccg

SEQ ID NO: 179373 - DNA, 13 bp, Homo sapiens
tgcctccaccgct

SEQ ID NO: 179374 - DNA, 12 bp, Homo sapiens
tgcctcctcctt

SEQ ID NO: 179375 - DNA, 24 bp, Homo sapiens
tgcctcggcttttctcagctggat

SEQ ID NO: 179376 - DNA, 18 bp, Homo sapiens
tgcctctccctggccctc

SEQ ID NO: 179377 - DNA, 11 bp, Homo sapiens
tgcctctgcct

SEQ ID NO: 179378 - DNA, 15 bp, Homo sapiens
tgcctcttctgggag

SEQ ID NO: 179379 - DNA, 16 bp, Homo sapiens
tgcctcttctgggagg

SEQ ID NO: 179380 - DNA, 19 bp, Homo sapiens
tgcctcttctgggagggca

SEQ ID NO: 179381 - DNA, 16 bp, Homo sapiens
tgcctctttcatccac

SEQ ID NO: 179382 - DNA, 13 bp, Homo sapiens
tgcctgaagaaca

SEQ ID NO: 179383 - DNA, 18 bp, Homo sapiens
tgcctgacatttggagtg

SEQ ID NO: 179384 - DNA, 18 bp, Homo sapiens
tgcctgccccaaacaaat

SEQ ID NO: 179385 - DNA, 20 bp, Homo sapiens
tgcctgccccaaacaaatat

SEQ ID NO: 179386 - DNA, 23 bp, Homo sapiens
tgcctgctgaatgatttccaaag

SEQ ID NO: 179387 - DNA, 22 bp, Homo sapiens
tgcctgggctcccttgtgcgtg

SEQ ID NO: 179388 - DNA, 21 bp, Homo sapiens
tgcctgggtggggctgctcct

SEQ ID NO: 179389 - DNA, 24 bp, Homo sapiens
tgcctgggtggggctgctcctcca

SEQ ID NO: 179390 - DNA, 15 bp, Homo sapiens
tgcctgtaaacatag

SEQ ID NO: 179391 - DNA, 18 bp, Homo sapiens
tgcctgtagcccactctg

SEQ ID NO: 179392 - DNA, 21 bp, Homo sapiens
tgcctgtagttaggaaataaa

SEQ ID NO: 179393 - DNA, 11 bp, Homo sapiens
tgcctgtctcc

SEQ ID NO: 179394 - DNA, 22 bp, Homo sapiens
tgcctgtctcctttgcaggctc

SEQ ID NO: 179395 - DNA, 14 bp, Homo sapiens
tgcctgtgaggcag

SEQ ID NO: 179396 - DNA, 14 bp, Homo sapiens
tgcctgttcccatt

SEQ ID NO: 179397 - DNA, 15 bp, Homo sapiens
tgccttaaagaaagt

SEQ ID NO: 179398 - DNA, 14 bp, Homo sapiens
tgccttacctcctg

SEQ ID NO: 179399 - DNA, 14 bp, Homo sapiens
tgccttatcttgca

SEQ ID NO: 179400 - DNA, 23 bp, Homo sapiens
tgccttattagagtgtctttcca

SEQ ID NO: 179401 - DNA, 13 bp, Homo sapiens
tgccttcagctct

SEQ ID NO: 179402 - DNA, 16 bp, Homo sapiens
tgccttcctcctgggc

SEQ ID NO: 179403 - DNA, 23 bp, Homo sapiens
tgccttcttcggggaactcctgg

SEQ ID NO: 179404 - DNA, 13 bp, Homo sapiens
tgccttggcttca

SEQ ID NO: 179405 - DNA, 22 bp, Homo sapiens
tgccttttatagctattactgt

SEQ ID NO: 179406 - DNA, 21 bp, Homo sapiens
tgccttttttcacggaagttt

SEQ ID NO: 179407 - DNA, 13 bp, Homo sapiens
tgcgaaaggatga

SEQ ID NO: 179408 - DNA, 19 bp, Homo sapiens
tgcgaaaggatgaaagtga

SEQ ID NO: 179409 - DNA, 17 bp, Homo sapiens
tgcgcttttgctggtca

SEQ ID NO: 179410 - DNA, 15 bp, Homo sapiens
tgcggaatcagcttc

SEQ ID NO: 179411 - DNA, 23 bp, Homo sapiens
tgcggaccccagctgtgagcctt

SEQ ID NO: 179412 - DNA, 19 bp, Homo sapiens
tgcggccgcattccctgag

SEQ ID NO: 179413 - DNA, 19 bp, Homo sapiens
tgcgtccacgagctgttta

SEQ ID NO: 179414 - DNA, 19 bp, Homo sapiens
tgcgttagaatgaggagga

SEQ ID NO: 179415 - DNA, 21 bp, Homo sapiens
tgctaaagaaaaagtcatcca

SEQ ID NO: 179416 - DNA, 15 bp, Homo sapiens
tgctaaatgtgaatg

SEQ ID NO: 179417 - DNA, 13 bp, Homo sapiens
tgctaacatctaa

SEQ ID NO: 179418 - DNA, 16 bp, Homo sapiens
tgctaacatctaaaaa

SEQ ID NO: 179419 - DNA, 22 bp, Homo sapiens
tgctaatcagggaggtcatttt

SEQ ID NO: 179420 - DNA, 23 bp, Homo sapiens
tgctaatcagggaggtcattttg

SEQ ID NO: 179421 - DNA, 16 bp, Homo sapiens
tgctacaaaaacacag

SEQ ID NO: 179422 - DNA, 19 bp, Homo sapiens
tgctacaaaaacacagcaa

SEQ ID NO: 179423 - DNA, 17 bp, Homo sapiens
agtgtgtgcatgtgtgt

SEQ ID NO: 179424 - DNA, 18 bp, Homo sapiens
agtgtgtgcatgtgtgtg

SEQ ID NO: 179425 - DNA, 23 bp, Homo sapiens
agtgttagggaagggcctgccac

SEQ ID NO: 179426 - DNA, 16 bp, Homo sapiens
agtgttatcagtcata

SEQ ID NO: 179427 - DNA, 21 bp, Homo sapiens
agtgttccccttccactgagg

SEQ ID NO: 179428 - DNA, 20 bp, Homo sapiens
agtgttttaagataaattat

SEQ ID NO: 179429 - DNA, 20 bp, Homo sapiens
agttaatatatcccagaaat

SEQ ID NO: 179430 - DNA, 20 bp, Homo sapiens
agttacaaattgcttgaaag

SEQ ID NO: 179431 - DNA, 12 bp, Homo sapiens
agttactcagcc

SEQ ID NO: 179432 - DNA, 22 bp, Homo sapiens
agttacttcactttaattctca

SEQ ID NO: 179433 - DNA, 19 bp, Homo sapiens
agttagaggccagcctggc

SEQ ID NO: 179434 - DNA, 18 bp, Homo sapiens
agttaggatagcattttt

SEQ ID NO: 179435 - DNA, 19 bp, Homo sapiens
agttattgtacagctgttt

SEQ ID NO: 179436 - DNA, 21 bp, Homo sapiens
agttattgtacagctgtttaa

SEQ ID NO: 179437 - DNA, 22 bp, Homo sapiens
agttattgtacagctgtttaag

SEQ ID NO: 179438 - DNA, 22 bp, Homo sapiens
agttatttatgcctctgtattt

SEQ ID NO: 179439 - DNA, 13 bp, Homo sapiens
agttcaaacaaga

SEQ ID NO: 179440 - DNA, 19 bp, Homo sapiens
agttcatattccatattta

SEQ ID NO: 179441 - DNA, 17 bp, Homo sapiens
agttcatccattctatt

SEQ ID NO: 179442 - DNA, 19 bp, Homo sapiens
agttccctgaaaacccaga

SEQ ID NO: 179443 - DNA, 21 bp, Homo sapiens
agttcctgtcccttctcttaa

SEQ ID NO: 179444 - DNA, 20 bp, Homo sapiens
agttccttgatctgtatata

SEQ ID NO: 179445 - DNA, 16 bp, Homo sapiens
agttctgcagataaac

SEQ ID NO: 179446 - DNA, 19 bp, Homo sapiens
agttctgggtgctccctac

SEQ ID NO: 179447 - DNA, 17 bp, Homo sapiens
agttgaaaaacagctga

SEQ ID NO: 179448 - DNA, 19 bp, Homo sapiens
agttgaaaagactccaaag

SEQ ID NO: 179449 - DNA, 19 bp, Homo sapiens
agttgaatgacaacagaag

SEQ ID NO: 179450 - DNA, 15 bp, Homo sapiens
agttgattcagctct

SEQ ID NO: 179451 - DNA, 16 bp, Homo sapiens
agttgcagattcattt

SEQ ID NO: 179452 - DNA, 21 bp, Homo sapiens
agttgctccgcctctgctggc

SEQ ID NO: 179453 - DNA, 18 bp, Homo sapiens
agttggctggatgaaatt

SEQ ID NO: 179454 - DNA, 18 bp, Homo sapiens
agttgtaaatatataaat

SEQ ID NO: 179455 - DNA, 20 bp, Homo sapiens
agttgtaaatatataaatat

SEQ ID NO: 179456 - DNA, 18 bp, Homo sapiens
agttgtgccttttatagc

SEQ ID NO: 179457 - DNA, 23 bp, Homo sapiens
agttgtgccttttatagctatta

SEQ ID NO: 179458 - DNA, 20 bp, Homo sapiens
agttgtggtgctgacaaagc

SEQ ID NO: 179459 - DNA, 19 bp, Homo sapiens
agttgttactaactaaact

SEQ ID NO: 179460 - DNA, 20 bp, Homo sapiens
agttgttactaactaaactc

SEQ ID NO: 179461 - DNA, 20 bp, Homo sapiens
agttgttcaataataaatat

SEQ ID NO: 179462 - DNA, 16 bp, Homo sapiens
agtttacaagtgtata

SEQ ID NO: 179463 - DNA, 23 bp, Homo sapiens
agtttacaagtgtatatcagaaa

SEQ ID NO: 179464 - DNA, 15 bp, Homo sapiens
agtttacattgtaaa

SEQ ID NO: 179465 - DNA, 17 bp, Homo sapiens
agtttacattgtaaata

SEQ ID NO: 179466 - DNA, 14 bp, Homo sapiens
agtttaccttgtat

SEQ ID NO: 179467 - DNA, 20 bp, Homo sapiens
agtttaccttgtatactgta

SEQ ID NO: 179468 - DNA, 15 bp, Homo sapiens
agtttcactgactta

SEQ ID NO: 179469 - DNA, 18 bp, Homo sapiens
agtttcagagaagttctg

SEQ ID NO: 179470 - DNA, 15 bp, Homo sapiens
agtttcagatatata

SEQ ID NO: 179471 - DNA, 13 bp, Homo sapiens
agtttctcagctc

SEQ ID NO: 179472 - DNA, 18 bp, Homo sapiens
agtttgagatcagcctgg

SEQ ID NO: 179473 - DNA, 19 bp, Homo sapiens
agtttgagatcagcctggg

SEQ ID NO: 179474 - DNA, 20 bp, Homo sapiens
agtttgagatcagcctgggc

SEQ ID NO: 179475 - DNA, 23 bp, Homo sapiens
agtttgattattcagtgtcactg

SEQ ID NO: 179476 - DNA, 14 bp, Homo sapiens
agtttgcagaaaag

SEQ ID NO: 179477 - DNA, 20 bp, Homo sapiens
agtttgcagaaaagcacctg

SEQ ID NO: 179478 - DNA, 20 bp, Homo sapiens
agtttgggggttttgctgtt

SEQ ID NO: 179479 - DNA, 15 bp, Homo sapiens
agtttgtacatgcat

SEQ ID NO: 179480 - DNA, 13 bp, Homo sapiens
agtttgtatatac

SEQ ID NO: 179481 - DNA, 14 bp, Homo sapiens
agttttatcatttt

SEQ ID NO: 179482 - DNA, 16 bp, Homo sapiens
agttttattgagaatt

SEQ ID NO: 179483 - DNA, 12 bp, Homo sapiens
agttttcagtgg

SEQ ID NO: 179484 - DNA, 12 bp, Homo sapiens
agttttctgaga

SEQ ID NO: 179485 - DNA, 13 bp, Homo sapiens
agttttctgagaa

SEQ ID NO: 179486 - DNA, 19 bp, Homo sapiens
agttttctgagaaagacta

SEQ ID NO: 179487 - DNA, 23 bp, Homo sapiens
agttttctgagaaagactattca

SEQ ID NO: 179488 - DNA, 22 bp, Homo sapiens
ataaaaagaaaagataaagatg

SEQ ID NO: 179489 - DNA, 11 bp, Homo sapiens
ataaaaaggca

SEQ ID NO: 179490 - DNA, 21 bp, Homo sapiens
ataaaaaggcacctataaaac

SEQ ID NO: 179491 - DNA, 18 bp, Homo sapiens
ataaaacaggtcaataca

SEQ ID NO: 179492 - DNA, 11 bp, Homo sapiens
ataaaaccttt

SEQ ID NO: 179493 - DNA, 13 bp, Homo sapiens
ataaaacctttca

SEQ ID NO: 179494 - DNA, 21 bp, Homo sapiens
ataaaacctttcaaatttcac

SEQ ID NO: 179495 - DNA, 16 bp, Homo sapiens
ataaaataaagtatat

SEQ ID NO: 179496 - DNA, 16 bp, Homo sapiens
ataaaataaatatata

SEQ ID NO: 179497 - DNA, 23 bp, Homo sapiens
ataaaataatgggattttctttt

SEQ ID NO: 179498 - DNA, 13 bp, Homo sapiens
ataaaatgttgaa

SEQ ID NO: 179499 - DNA, 16 bp, Homo sapiens
ataaaatgttgaaaag

SEQ ID NO: 179500 - DNA, 16 bp, Homo sapiens
ataaacatcacacaca

SEQ ID NO: 179501 - DNA, 16 bp, Homo sapiens
ataaacctcaaaatgt

SEQ ID NO: 179502 - DNA, 13 bp, Homo sapiens
ataaactgacttt

SEQ ID NO: 179503 - DNA, 20 bp, Homo sapiens
ataaactgactttatcctca

SEQ ID NO: 179504 - DNA, 12 bp, Homo sapiens
ataaagacacct

SEQ ID NO: 179505 - DNA, 19 bp, Homo sapiens
ataaagatgatctactcag

SEQ ID NO: 179506 - DNA, 20 bp, Homo sapiens
ataaagatgatctactcaga

SEQ ID NO: 179507 - DNA, 18 bp, Homo sapiens
ataaagatggctgacttt

SEQ ID NO: 179508 - DNA, 17 bp, Homo sapiens
ataaagtaaagctaaaa

SEQ ID NO: 179509 - DNA, 16 bp, Homo sapiens
ataaagttggtgacag

SEQ ID NO: 179510 - DNA, 17 bp, Homo sapiens
ataaagttggtgacaga

SEQ ID NO: 179511 - DNA, 12 bp, Homo sapiens
ataaataaatgt

SEQ ID NO: 179512 - DNA, 12 bp, Homo sapiens
ataaatatatat

SEQ ID NO: 179513 - DNA, 13 bp, Homo sapiens
ataaattataagt

SEQ ID NO: 179514 - DNA, 23 bp, Homo sapiens
ataacagaaagcctgggtgacat

SEQ ID NO: 179515 - DNA, 14 bp, Homo sapiens
ataaccagctgtaa

SEQ ID NO: 179516 - DNA, 19 bp, Homo sapiens
ataactagtgttgcttgga

SEQ ID NO: 179517 - DNA, 14 bp, Homo sapiens
ataactgaaggaga

SEQ ID NO: 179518 - DNA, 18 bp, Homo sapiens
ataactgccttaaaactt

SEQ ID NO: 179519 - DNA, 13 bp, Homo sapiens
ataactgtgaagt

SEQ ID NO: 179520 - DNA, 12 bp, Homo sapiens
ataacttaaaaa

SEQ ID NO: 179521 - DNA, 12 bp, Homo sapiens
ataacttaaaat

SEQ ID NO: 179522 - DNA, 16 bp, Homo sapiens
ataacttcaagcaaac

SEQ ID NO: 179523 - DNA, 14 bp, Homo sapiens
ataagagaaagaaa

SEQ ID NO: 179524 - DNA, 17 bp, Homo sapiens
ataagcatcaaactctt

SEQ ID NO: 179525 - DNA, 21 bp, Homo sapiens
ataagccagacatcaacagat

SEQ ID NO: 179526 - DNA, 14 bp, Homo sapiens
ataaggatcagaac

SEQ ID NO: 179527 - DNA, 21 bp, Homo sapiens
ataaggtacctttcacataga

SEQ ID NO: 179528 - DNA, 13 bp, Homo sapiens
ataagtaagtttg

SEQ ID NO: 179529 - DNA, 17 bp, Homo sapiens
ataagtaattcaagaaa

SEQ ID NO: 179530 - DNA, 19 bp, Homo sapiens
ataagtactgtgtacagaa

SEQ ID NO: 179531 - DNA, 18 bp, Homo sapiens
ataagtatttcaaattgg

SEQ ID NO: 179532 - DNA, 14 bp, Homo sapiens
ataagtcatgttcc

SEQ ID NO: 179533 - DNA, 13 bp, Homo sapiens
ataagtgtacata

SEQ ID NO: 179534 - DNA, 12 bp, Homo sapiens
ataagtttattt

SEQ ID NO: 179535 - DNA, 12 bp, Homo sapiens
ataataaacttt

SEQ ID NO: 179536 - DNA, 21 bp, Homo sapiens
ataatacactaattcctttct

SEQ ID NO: 179537 - DNA, 14 bp, Homo sapiens
ataatcagcctctt

SEQ ID NO: 179538 - DNA, 15 bp, Homo sapiens
ataatcagcctctta

SEQ ID NO: 179539 - DNA, 18 bp, Homo sapiens
ataatgctgttgcctcat

SEQ ID NO: 179540 - DNA, 13 bp, Homo sapiens
ataatgtgaaaat

SEQ ID NO: 179541 - DNA, 16 bp, Homo sapiens
ataatgtgaaaatggt

SEQ ID NO: 179542 - DNA, 16 bp, Homo sapiens
ataattataatatact

SEQ ID NO: 179543 - DNA, 14 bp, Homo sapiens
ataattgatcaaat

SEQ ID NO: 179544 - DNA, 19 bp, Homo sapiens
ataatttgtacatatgtaa

SEQ ID NO: 179545 - DNA, 22 bp, Homo sapiens
ataatttgtacatatgtaaaat

SEQ ID NO: 179546 - DNA, 18 bp, Homo sapiens
ataatttttaaagtatat

SEQ ID NO: 179547 - DNA, 22 bp, Homo sapiens
atacaaaaaaaaaaaaaaatta

SEQ ID NO: 179548 - DNA, 15 bp, Homo sapiens
atacaatatcatcca

SEQ ID NO: 179549 - DNA, 15 bp, Homo sapiens
atacaattctacatt

SEQ ID NO: 179550 - DNA, 17 bp, Homo sapiens
atacacactcaaatcaa

SEQ ID NO: 179551 - DNA, 20 bp, Homo sapiens
atacacactcaaatcaagaa

SEQ ID NO: 179552 - DNA, 19 bp, Homo sapiens
atacactaattcctttcta

SEQ ID NO: 179553 - DNA, 22 bp, Homo sapiens
atacactatttgtgagcaaagg

SEQ ID NO: 179554 - DNA, 21 bp, Homo sapiens
atacactgaagttaacagaga

SEQ ID NO: 179555 - DNA, 20 bp, Homo sapiens
atacagccctcccccagcag

SEQ ID NO: 179556 - DNA, 19 bp, Homo sapiens
atacagtacaggcagcaca

SEQ ID NO: 179557 - DNA, 23 bp, Homo sapiens
atacagtgttattttctttgaaa

SEQ ID NO: 179558 - DNA, 14 bp, Homo sapiens
atacatatttccaa

SEQ ID NO: 179559 - DNA, 15 bp, Homo sapiens
atacattgaattaga

SEQ ID NO: 179560 - DNA, 16 bp, Homo sapiens
atacatttgataaagt

SEQ ID NO: 179561 - DNA, 14 bp, Homo sapiens
ataccaagtattta

SEQ ID NO: 179562 - DNA, 13 bp, Homo sapiens
atactaaaaatca

SEQ ID NO: 179563 - DNA, 14 bp, Homo sapiens
atactatatttatg

SEQ ID NO: 179564 - DNA, 16 bp, Homo sapiens
atactcattaggatgg

SEQ ID NO: 179565 - DNA, 19 bp, Homo sapiens
atactcttaggaagagaaa

SEQ ID NO: 179566 - DNA, 11 bp, Homo sapiens
atactgaagat

SEQ ID NO: 179567 - DNA, 13 bp, Homo sapiens
atactgaagatgc

SEQ ID NO: 179568 - DNA, 14 bp, Homo sapiens
atactgcagggcca

SEQ ID NO: 179569 - DNA, 19 bp, Homo sapiens
atactgtattttgtattgt

SEQ ID NO: 179570 - DNA, 12 bp, Homo sapiens
atactttacatg

SEQ ID NO: 179571 - DNA, 16 bp, Homo sapiens
atagaaaaaccctgcc

SEQ ID NO: 179572 - DNA, 21 bp, Homo sapiens
atagaaactcaccatgtaaaa

SEQ ID NO: 179573 - DNA, 13 bp, Homo sapiens
atagaatatttat

SEQ ID NO: 179574 - DNA, 17 bp, Homo sapiens
atagaattaacacatga

SEQ ID NO: 179575 - DNA, 13 bp, Homo sapiens
atagagctgtatt

SEQ ID NO: 179576 - DNA, 14 bp, Homo sapiens
atagagctgtatta

SEQ ID NO: 179577 - DNA, 16 bp, Homo sapiens
atagagtttaacacaa

SEQ ID NO: 179578 - DNA, 16 bp, Homo sapiens
atagcaacactctata

SEQ ID NO: 179579 - DNA, 15 bp, Homo sapiens
atagcactgagcaaa

SEQ ID NO: 179580 - DNA, 16 bp, Homo sapiens
atagcagacagtgttt

SEQ ID NO: 179581 - DNA, 18 bp, Homo sapiens
atagcagcttattcacaa

SEQ ID NO: 179582 - DNA, 12 bp, Homo sapiens
atagcccagaca

SEQ ID NO: 179583 - DNA, 14 bp, Homo sapiens
atagccgggcatgg

SEQ ID NO: 179584 - DNA, 14 bp, Homo sapiens
atagcttgtatagt

SEQ ID NO: 179585 - DNA, 18 bp, Homo sapiens
atagctttattttttaag

SEQ ID NO: 179586 - DNA, 15 bp, Homo sapiens
atagcttttattgta

SEQ ID NO: 179587 - DNA, 21 bp, Homo sapiens
ataggaaagtatttttttaag

SEQ ID NO: 179588 - DNA, 14 bp, Homo sapiens
ataggtgctacaaa

SEQ ID NO: 179589 - DNA, 15 bp, Homo sapiens
ataggtgctacaaaa

SEQ ID NO: 179590 - DNA, 21 bp, Homo sapiens
ataggtgctacaaaaacacag

SEQ ID NO: 179591 - DNA, 23 bp, Homo sapiens
ataggtgctacaaaaacacagca

SEQ ID NO: 179592 - DNA, 18 bp, Homo sapiens
ataggttgtaaatgtgtt

SEQ ID NO: 179593 - DNA, 14 bp, Homo sapiens
atagtaaaaataaa

SEQ ID NO: 179594 - DNA, 19 bp, Homo sapiens
atagtcaaaccataaactt

SEQ ID NO: 179595 - DNA, 21 bp, Homo sapiens
atagtcaagaaaaattattgt

SEQ ID NO: 179596 - DNA, 22 bp, Homo sapiens
atagtcatgtaagctgaaaata

SEQ ID NO: 179597 - DNA, 20 bp, Homo sapiens
atagtgctcgctttctatgt

SEQ ID NO: 179598 - DNA, 23 bp, Homo sapiens
atagtgctcgctttctatgtagt

SEQ ID NO: 179599 - DNA, 14 bp, Homo sapiens
atagtttattgaca

SEQ ID NO: 179600 - DNA, 13 bp, Homo sapiens
atagtttgtacat

SEQ ID NO: 179601 - DNA, 23 bp, Homo sapiens
atataaaaagaaaagataaagat

SEQ ID NO: 179602 - DNA, 22 bp, Homo sapiens
atataaaactgcgttaaaggct

SEQ ID NO: 179603 - DNA, 15 bp, Homo sapiens
atataaaataaatat

SEQ ID NO: 179604 - DNA, 14 bp, Homo sapiens
atataaacctaaaa

SEQ ID NO: 179605 - DNA, 22 bp, Homo sapiens
atataaatattagaaacagctt

SEQ ID NO: 179606 - DNA, 20 bp, Homo sapiens
atataactgccttaaaactt

SEQ ID NO: 179607 - DNA, 14 bp, Homo sapiens
atataagaataaaa

SEQ ID NO: 179608 - DNA, 14 bp, Homo sapiens
atataagtgtacat

SEQ ID NO: 179609 - DNA, 15 bp, Homo sapiens
atatagctgtacaaa

SEQ ID NO: 179610 - DNA, 20 bp, Homo sapiens
atatagctgtacaaatataa

SEQ ID NO: 179611 - DNA, 10 bp, Homo sapiens
atatataaaa

SEQ ID NO: 179612 - DNA, 19 bp, Homo sapiens
atatataaaaagaaaagat

SEQ ID NO: 179613 - DNA, 14 bp, Homo sapiens
atatataaatatat

SEQ ID NO: 179614 - DNA, 15 bp, Homo sapiens
atatataagtgtaca

SEQ ID NO: 179615 - DNA, 20 bp, Homo sapiens
atatataagtgtacatatgt

SEQ ID NO: 179616 - DNA, 13 bp, Homo sapiens
atatatagaatct

SEQ ID NO: 179617 - DNA, 11 bp, Homo sapiens
atatatataaa

SEQ ID NO: 179618 - DNA, 17 bp, Homo sapiens
atatatctgcttcagtg

SEQ ID NO: 179619 - DNA, 13 bp, Homo sapiens
atatatggcagag

SEQ ID NO: 179620 - DNA, 17 bp, Homo sapiens
atatattaaaaatataa

SEQ ID NO: 179621 - DNA, 18 bp, Homo sapiens
atatattaaaaatataaa

SEQ ID NO: 179622 - DNA, 14 bp, Homo sapiens
atatatttataact

SEQ ID NO: 179623 - DNA, 23 bp, Homo sapiens
atatatttataactcatcataaa

SEQ ID NO: 179624 - DNA, 14 bp, Homo sapiens
atatatttttatat

SEQ ID NO: 179625 - DNA, 15 bp, Homo sapiens
atatatttttatatt

SEQ ID NO: 179626 - DNA, 17 bp, Homo sapiens
atatcagaaaagggaag

SEQ ID NO: 179627 - DNA, 18 bp, Homo sapiens
atatcagttactcagccc

SEQ ID NO: 179628 - DNA, 22 bp, Homo sapiens
atatcagttactcagccctggg

SEQ ID NO: 179629 - DNA, 20 bp, Homo sapiens
atatcatcagcataccttta

SEQ ID NO: 179630 - DNA, 21 bp, Homo sapiens
atatcatgagtgaataaatgt

SEQ ID NO: 179631 - DNA, 16 bp, Homo sapiens
atatccaccacctccc

SEQ ID NO: 179632 - DNA, 16 bp, Homo sapiens
atatccctacatgtat

SEQ ID NO: 179633 - DNA, 15 bp, Homo sapiens
atatcctttctaaca

SEQ ID NO: 179634 - DNA, 20 bp, Homo sapiens
atatctaattattttgcagt

SEQ ID NO: 179635 - DNA, 13 bp, Homo sapiens
atatctgcttcag

SEQ ID NO: 179636 - DNA, 17 bp, Homo sapiens
atatctgggattctact

SEQ ID NO: 179637 - DNA, 21 bp, Homo sapiens
atatctgggattctactttaa

SEQ ID NO: 179638 - DNA, 15 bp, Homo sapiens
atatgacagctgtcc

SEQ ID NO: 179639 - DNA, 21 bp, Homo sapiens
atatgacagctgtccctgtca

SEQ ID NO: 179640 - DNA, 13 bp, Homo sapiens
atatgacctcatg

SEQ ID NO: 179641 - DNA, 13 bp, Homo sapiens
atatgactcacat

SEQ ID NO: 179642 - DNA, 16 bp, Homo sapiens
atatgatatgtaaaca

SEQ ID NO: 179643 - DNA, 20 bp, Homo sapiens
atatgatttaaatcagccgt

SEQ ID NO: 179644 - DNA, 16 bp, Homo sapiens
atatgattttatttga

SEQ ID NO: 179645 - DNA, 21 bp, Homo sapiens
atatgcttatacacttacact

SEQ ID NO: 179646 - DNA, 20 bp, Homo sapiens
atatggaacttctaatatat

SEQ ID NO: 179647 - DNA, 13 bp, Homo sapiens
atatggcaagaaa

SEQ ID NO: 179648 - DNA, 18 bp, Homo sapiens
atatggcaagaaagctgg

SEQ ID NO: 179649 - DNA, 23 bp, Homo sapiens
atatggcagagttgtaaatatat

SEQ ID NO: 179650 - DNA, 16 bp, Homo sapiens
atatgtaaaataaaat

SEQ ID NO: 179651 - DNA, 17 bp, Homo sapiens
atattaaaaatataaaa

SEQ ID NO: 179652 - DNA, 23 bp, Homo sapiens
atattaaaaatatggaacttcta

SEQ ID NO: 179653 - DNA, 14 bp, Homo sapiens
atattaatattcct

SEQ ID NO: 179654 - DNA, 22 bp, Homo sapiens
atattataatttttttcaatat

SEQ ID NO: 179655 - DNA, 13 bp, Homo sapiens
atattcatttcaa

SEQ ID NO: 179656 - DNA, 21 bp, Homo sapiens
atattcctgcagcctggaggc

SEQ ID NO: 179657 - DNA, 21 bp, Homo sapiens
atattcctgcatttgtgaaat

SEQ ID NO: 179658 - DNA, 15 bp, Homo sapiens
atattgacttgtata

SEQ ID NO: 179659 - DNA, 16 bp, Homo sapiens
atattgacttgtatat

SEQ ID NO: 179660 - DNA, 15 bp, Homo sapiens
atattggtattcact

SEQ ID NO: 179661 - DNA, 12 bp, Homo sapiens
atattgtcagat

SEQ ID NO: 179662 - DNA, 18 bp, Homo sapiens
atattgtcattcctgtat

SEQ ID NO: 179663 - DNA, 18 bp, Homo sapiens
atattgtgttgtgaatgt

SEQ ID NO: 179664 - DNA, 17 bp, Homo sapiens
atatttataactcatca

SEQ ID NO: 179665 - DNA, 15 bp, Homo sapiens
atatttatatattta

SEQ ID NO: 179666 - DNA, 19 bp, Homo sapiens
atatttatgtctatttaag

SEQ ID NO: 179667 - DNA, 23 bp, Homo sapiens
atattttcttccaagcaaaggtg

SEQ ID NO: 179668 - DNA, 21 bp, Homo sapiens
atattttgtatatatctgctt

SEQ ID NO: 179669 - DNA, 13 bp, Homo sapiens
atatttttataga

SEQ ID NO: 179670 - DNA, 14 bp, Homo sapiens
atatttttatagac

SEQ ID NO: 179671 - DNA, 18 bp, Homo sapiens
atattttttcagaaatat

SEQ ID NO: 179672 - DNA, 18 bp, Homo sapiens
atattttttgttaaatga

SEQ ID NO: 179673 - DNA, 17 bp, Homo sapiens
atcaaactgaagccaga

SEQ ID NO: 179674 - DNA, 20 bp, Homo sapiens
atcaaagaggttttaaaaaa

SEQ ID NO: 179675 - DNA, 17 bp, Homo sapiens
atcaaatatgcaaagca

SEQ ID NO: 179676 - DNA, 18 bp, Homo sapiens
atcaaatatgcaaagcac

SEQ ID NO: 179677 - DNA, 22 bp, Homo sapiens
atcaagcttcagtttcctggtc

SEQ ID NO: 179678 - DNA, 23 bp, Homo sapiens
atcaagttggcttctaatcaaag

SEQ ID NO: 179679 - DNA, 18 bp, Homo sapiens
atcaatattgtcattcct

SEQ ID NO: 179680 - DNA, 19 bp, Homo sapiens
atcaatcatctgtgtgaaa

SEQ ID NO: 179681 - DNA, 19 bp, Homo sapiens
atcaatgtttcttctaggt

SEQ ID NO: 179682 - DNA, 13 bp, Homo sapiens
atcaatttaaaaa

SEQ ID NO: 179683 - DNA, 20 bp, Homo sapiens
atcaatttgtaattgcttac

SEQ ID NO: 179684 - DNA, 15 bp, Homo sapiens
atcacagaggcttct

SEQ ID NO: 179685 - DNA, 20 bp, Homo sapiens
atcaccgtgggctccctgac

SEQ ID NO: 179686 - DNA, 16 bp, Homo sapiens
atcaccttaggcaggg

SEQ ID NO: 179687 - DNA, 17 bp, Homo sapiens
atcaccttaggcaggga

SEQ ID NO: 179688 - DNA, 19 bp, Homo sapiens
atcacttgaggtcaggagt

SEQ ID NO: 179689 - DNA, 13 bp, Homo sapiens
atcagaaaaggga

SEQ ID NO: 179690 - DNA, 14 bp, Homo sapiens
atcagaacagcaga

SEQ ID NO: 179691 - DNA, 16 bp, Homo sapiens
atcagaccataatgtt

SEQ ID NO: 179692 - DNA, 20 bp, Homo sapiens
atcagaccctaccccaccac

SEQ ID NO: 179693 - DNA, 21 bp, Homo sapiens
atcagcaaaccggggcctact

SEQ ID NO: 179694 - DNA, 15 bp, Homo sapiens
atcagcctcttaaag

SEQ ID NO: 179695 - DNA, 17 bp, Homo sapiens
atcagcctgctccagct

SEQ ID NO: 179696 - DNA, 20 bp, Homo sapiens
atcagcctgctccagctgtt

SEQ ID NO: 179697 - DNA, 15 bp, Homo sapiens
atcagctatttactg

SEQ ID NO: 179698 - DNA, 13 bp, Homo sapiens
atcagctccttcc

SEQ ID NO: 179699 - DNA, 21 bp, Homo sapiens
atcagctgctgaaacaacaaa

SEQ ID NO: 179700 - DNA, 23 bp, Homo sapiens
atcagctgctgaaacaacaaata

SEQ ID NO: 179701 - DNA, 16 bp, Homo sapiens
atcaggcctgccagac

SEQ ID NO: 179702 - DNA, 18 bp, Homo sapiens
atcagggaggtcattttg

SEQ ID NO: 179703 - DNA, 13 bp, Homo sapiens
atcaggtggggag

SEQ ID NO: 179704 - DNA, 19 bp, Homo sapiens
atcagttactcagccctgg

SEQ ID NO: 179705 - DNA, 16 bp, Homo sapiens
atcatataataaatgt

SEQ ID NO: 179706 - DNA, 21 bp, Homo sapiens
atcatattggtattcactaat

SEQ ID NO: 179707 - DNA, 13 bp, Homo sapiens
atcatcctttcca

SEQ ID NO: 179708 - DNA, 21 bp, Homo sapiens
atcatctattgctggcaaaga

SEQ ID NO: 179709 - DNA, 16 bp, Homo sapiens
atcatctgtgtgaaaa

SEQ ID NO: 179710 - DNA, 18 bp, Homo sapiens
atcatctgtgtgaaaatg

SEQ ID NO: 179711 - DNA, 14 bp, Homo sapiens
atcatgaaatatgc

SEQ ID NO: 179712 - DNA, 18 bp, Homo sapiens
atcatgacatgttatata

SEQ ID NO: 179713 - DNA, 16 bp, Homo sapiens
atcattctctgtctca

SEQ ID NO: 179714 - DNA, 19 bp, Homo sapiens
atcattcttatttcatgaa

SEQ ID NO: 179715 - DNA, 14 bp, Homo sapiens
atcattttaattat

SEQ ID NO: 179716 - DNA, 15 bp, Homo sapiens
atcattttaattatt

SEQ ID NO: 179717 - DNA, 16 bp, Homo sapiens
atcattttagaagact

SEQ ID NO: 179718 - DNA, 22 bp, Homo sapiens
atcattttagaagactctacca

SEQ ID NO: 179719 - DNA, 18 bp, Homo sapiens
atcattttatatgtcaaa

SEQ ID NO: 179720 - DNA, 20 bp, Homo sapiens
tgctacaaaaacacagcaag

SEQ ID NO: 179721 - DNA, 22 bp, Homo sapiens
tgctacctcactggggtcctgg

SEQ ID NO: 179722 - DNA, 16 bp, Homo sapiens
tgctacgcctgcatgt

SEQ ID NO: 179723 - DNA, 20 bp, Homo sapiens
tgctacgcctgcatgtaaac

SEQ ID NO: 179724 - DNA, 20 bp, Homo sapiens
tgctagatgtgcaaatgcaa

SEQ ID NO: 179725 - DNA, 18 bp, Homo sapiens
tgctagcacttggagcca

SEQ ID NO: 179726 - DNA, 23 bp, Homo sapiens
tgctaggttaattccaattatat

SEQ ID NO: 179727 - DNA, 21 bp, Homo sapiens
tgctataactatgttgataaa

SEQ ID NO: 179728 - DNA, 22 bp, Homo sapiens
tgctatcgcaccactgtgtatt

SEQ ID NO: 179729 - DNA, 18 bp, Homo sapiens
tgctcaaaatttgaagaa

SEQ ID NO: 179730 - DNA, 14 bp, Homo sapiens
tgctcacctggggt

SEQ ID NO: 179731 - DNA, 22 bp, Homo sapiens
tgctcacctggggtgtgggagg

SEQ ID NO: 179732 - DNA, 20 bp, Homo sapiens
tgctcatcattctctgtctc

SEQ ID NO: 179733 - DNA, 23 bp, Homo sapiens
tgctccccagccctggctctgca

SEQ ID NO: 179734 - DNA, 14 bp, Homo sapiens
tgctcccccacccc

SEQ ID NO: 179735 - DNA, 16 bp, Homo sapiens
tgctcccccaccccct

SEQ ID NO: 179736 - DNA, 23 bp, Homo sapiens
tgctcccccaccccctccccagg

SEQ ID NO: 179737 - DNA, 17 bp, Homo sapiens
tgctcccctccctcctc

SEQ ID NO: 179738 - DNA, 20 bp, Homo sapiens
tgctccctaccacctcccca

SEQ ID NO: 179739 - DNA, 13 bp, Homo sapiens
tgctccctgaagc

SEQ ID NO: 179740 - DNA, 15 bp, Homo sapiens
tgctccctgaagcca

SEQ ID NO: 179741 - DNA, 18 bp, Homo sapiens
tgctccctgaagccagcc

SEQ ID NO: 179742 - DNA, 13 bp, Homo sapiens
tgctcctccaggg

SEQ ID NO: 179743 - DNA, 16 bp, Homo sapiens
tgctccttgggccctt

SEQ ID NO: 179744 - DNA, 13 bp, Homo sapiens
tgctctcccctgc

SEQ ID NO: 179745 - DNA, 15 bp, Homo sapiens
tgctctcccctgccc

SEQ ID NO: 179746 - DNA, 14 bp, Homo sapiens
tgctctcctcttgc

SEQ ID NO: 179747 - DNA, 16 bp, Homo sapiens
tgctctcctcttgcca

SEQ ID NO: 179748 - DNA, 12 bp, Homo sapiens
tgctctcctttc

SEQ ID NO: 179749 - DNA, 14 bp, Homo sapiens
tgctgaacagtgga

SEQ ID NO: 179750 - DNA, 19 bp, Homo sapiens
tgctgactgtactcctccc

SEQ ID NO: 179751 - DNA, 17 bp, Homo sapiens
tgctgagggaccagcca

SEQ ID NO: 179752 - DNA, 19 bp, Homo sapiens
tgctgccacacttcaggct

SEQ ID NO: 179753 - DNA, 18 bp, Homo sapiens
tgctgccccatcagtgct

SEQ ID NO: 179754 - DNA, 21 bp, Homo sapiens
tgctgcccgtcttcagcctag

SEQ ID NO: 179755 - DNA, 14 bp, Homo sapiens
tgctgccctaggct

SEQ ID NO: 179756 - DNA, 19 bp, Homo sapiens
tgctgccgcctcccagcct

SEQ ID NO: 179757 - DNA, 15 bp, Homo sapiens
tgctgcgcccttccc

SEQ ID NO: 179758 - DNA, 17 bp, Homo sapiens
tgctgctaatcttcagg

SEQ ID NO: 179759 - DNA, 21 bp, Homo sapiens
tgctgctaatcttcagggcac

SEQ ID NO: 179760 - DNA, 21 bp, Homo sapiens
tgctggacggggactggggat

SEQ ID NO: 179761 - DNA, 18 bp, Homo sapiens
tgctggagaagagaggag

SEQ ID NO: 179762 - DNA, 13 bp, Homo sapiens
tgctggagctctg

SEQ ID NO: 179763 - DNA, 15 bp, Homo sapiens
tgctggaggtgggag

SEQ ID NO: 179764 - DNA, 17 bp, Homo sapiens
tgctggaggtgggagca

SEQ ID NO: 179765 - DNA, 17 bp, Homo sapiens
tgctggatggagcccag

SEQ ID NO: 179766 - DNA, 18 bp, Homo sapiens
tgctggatggagcccagg

SEQ ID NO: 179767 - DNA, 13 bp, Homo sapiens
tgctggctgcctt

SEQ ID NO: 179768 - DNA, 14 bp, Homo sapiens
tgctgggctctcca

SEQ ID NO: 179769 - DNA, 18 bp, Homo sapiens
tgctgggctctccacctc

SEQ ID NO: 179770 - DNA, 17 bp, Homo sapiens
tgctgggcttgtctgta

SEQ ID NO: 179771 - DNA, 18 bp, Homo sapiens
tgctgtctaacctgtgac

SEQ ID NO: 179772 - DNA, 14 bp, Homo sapiens
tgctgtgaggctgt

SEQ ID NO: 179773 - DNA, 16 bp, Homo sapiens
tgctgtgaggctgtcc

SEQ ID NO: 179774 - DNA, 23 bp, Homo sapiens
tgctgtggtgtgtccccctctgt

SEQ ID NO: 179775 - DNA, 21 bp, Homo sapiens
tgctgtgtatctgatagctct

SEQ ID NO: 179776 - DNA, 11 bp, Homo sapiens
tgctgtgttaa

SEQ ID NO: 179777 - DNA, 14 bp, Homo sapiens
tgctgttgcctcat

SEQ ID NO: 179778 - DNA, 20 bp, Homo sapiens
tgcttacaattccctgctgt

SEQ ID NO: 179779 - DNA, 12 bp, Homo sapiens
tgcttacatttt

SEQ ID NO: 179780 - DNA, 14 bp, Homo sapiens
tgcttacattttta

SEQ ID NO: 179781 - DNA, 18 bp, Homo sapiens
tgcttacatttttacaat

SEQ ID NO: 179782 - DNA, 15 bp, Homo sapiens
tgcttcgggcccttc

SEQ ID NO: 179783 - DNA, 17 bp, Homo sapiens
tgcttcttaaccccagt

SEQ ID NO: 179784 - DNA, 19 bp, Homo sapiens
tgcttcttaaccccagtaa

SEQ ID NO: 179785 - DNA, 21 bp, Homo sapiens
tgcttcttctcctatgtgtaa

SEQ ID NO: 179786 - DNA, 16 bp, Homo sapiens
tgcttgttccctctcc

SEQ ID NO: 179787 - DNA, 22 bp, Homo sapiens
tgctttgactgagcagactggt

SEQ ID NO: 179788 - DNA, 19 bp, Homo sapiens
tgctttgtaggtgtctcat

SEQ ID NO: 179789 - DNA, 17 bp, Homo sapiens
tggaaaaatagcctgcc

SEQ ID NO: 179790 - DNA, 20 bp, Homo sapiens
tggaaaaatagcctgcctct

SEQ ID NO: 179791 - DNA, 21 bp, Homo sapiens
tggaaactgttgccagagatg

SEQ ID NO: 179792 - DNA, 14 bp, Homo sapiens
tggaaaggagagga

SEQ ID NO: 179793 - DNA, 16 bp, Homo sapiens
tggaaaggagaggaaa

SEQ ID NO: 179794 - DNA, 22 bp, Homo sapiens
tggaaatatcagttactcagcc

SEQ ID NO: 179795 - DNA, 21 bp, Homo sapiens
tggaacataaaatacaatgtt

SEQ ID NO: 179796 - DNA, 16 bp, Homo sapiens
tggaaccgcaggaagc

SEQ ID NO: 179797 - DNA, 19 bp, Homo sapiens
tggaaccgcaggaagctgc

SEQ ID NO: 179798 - DNA, 23 bp, Homo sapiens
tggaaccgcaggaagctgctccg

SEQ ID NO: 179799 - DNA, 16 bp, Homo sapiens
tggaactcattcctgc

SEQ ID NO: 179800 - DNA, 21 bp, Homo sapiens
tggaactcattcctgcctgtc

SEQ ID NO: 179801 - DNA, 13 bp, Homo sapiens
tggaacttctaat

SEQ ID NO: 179802 - DNA, 15 bp, Homo sapiens
tggaagagcctgcag

SEQ ID NO: 179803 - DNA, 15 bp, Homo sapiens
tggaagccctccttc

SEQ ID NO: 179804 - DNA, 14 bp, Homo sapiens
tggaagcttccagt

SEQ ID NO: 179805 - DNA, 21 bp, Homo sapiens
tggaaggtttgtatattgtca

SEQ ID NO: 179806 - DNA, 18 bp, Homo sapiens
tggaagtgagggtcagag

SEQ ID NO: 179807 - DNA, 21 bp, Homo sapiens
tggaagtgagggtcagagagg

SEQ ID NO: 179808 - DNA, 15 bp, Homo sapiens
tggaatattgtccat

SEQ ID NO: 179809 - DNA, 20 bp, Homo sapiens
tggaatattgtccattgtcc

SEQ ID NO: 179810 - DNA, 14 bp, Homo sapiens
tggaatgtaatcaa

SEQ ID NO: 179811 - DNA, 22 bp, Homo sapiens
tggacaagcagaggtggccaga

SEQ ID NO: 179812 - DNA, 16 bp, Homo sapiens
tggacaatcatgaaat

SEQ ID NO: 179813 - DNA, 21 bp, Homo sapiens
tggacaccaggagtccctggt

SEQ ID NO: 179814 - DNA, 16 bp, Homo sapiens
tggacagacagaggat

SEQ ID NO: 179815 - DNA, 14 bp, Homo sapiens
tggaccaggacagg

SEQ ID NO: 179816 - DNA, 18 bp, Homo sapiens
tggaccaggacaggacca

SEQ ID NO: 179817 - DNA, 20 bp, Homo sapiens
tggacccagggatgacatgt

SEQ ID NO: 179818 - DNA, 14 bp, Homo sapiens
tggactcctctgtc

SEQ ID NO: 179819 - DNA, 18 bp, Homo sapiens
tggacttagaaagcaggg

SEQ ID NO: 179820 - DNA, 20 bp, Homo sapiens
tggacttagaaagcaggggc

SEQ ID NO: 179821 - DNA, 14 bp, Homo sapiens
tggagaaaccctgt

SEQ ID NO: 179822 - DNA, 17 bp, Homo sapiens
tggagaactcctagggt

SEQ ID NO: 179823 - DNA, 16 bp, Homo sapiens
tggagaagagaggaga

SEQ ID NO: 179824 - DNA, 17 bp, Homo sapiens
tggagacacaactattt

SEQ ID NO: 179825 - DNA, 19 bp, Homo sapiens
tggagacagccccagagca

SEQ ID NO: 179826 - DNA, 19 bp, Homo sapiens
tggagactggtcctgtgtg

SEQ ID NO: 179827 - DNA, 17 bp, Homo sapiens
tggagagtgcaacagta

SEQ ID NO: 179828 - DNA, 15 bp, Homo sapiens
tggagcaaagctgat

SEQ ID NO: 179829 - DNA, 13 bp, Homo sapiens
tggagcagagggg

SEQ ID NO: 179830 - DNA, 23 bp, Homo sapiens
tggaggaaaaccaagccgtggct

SEQ ID NO: 179831 - DNA, 21 bp, Homo sapiens
tggaggagaagaattttcaga

SEQ ID NO: 179832 - DNA, 13 bp, Homo sapiens
tggaggaggaggc

SEQ ID NO: 179833 - DNA, 14 bp, Homo sapiens
tggaggcagggcct

SEQ ID NO: 179834 - DNA, 14 bp, Homo sapiens
tggaggccagccag

SEQ ID NO: 179835 - DNA, 14 bp, Homo sapiens
tggaggctgtcttc

SEQ ID NO: 179836 - DNA, 17 bp, Homo sapiens
tggaggtgggagcagga

SEQ ID NO: 179837 - DNA, 17 bp, Homo sapiens
tggaggttaaggctgag

SEQ ID NO: 179838 - DNA, 21 bp, Homo sapiens
tggaggttaaggctgaggaaa

SEQ ID NO: 179839 - DNA, 22 bp, Homo sapiens
tggaggttaaggctgaggaaag

SEQ ID NO: 179840 - DNA, 14 bp, Homo sapiens
tggaggttgcagtg

SEQ ID NO: 179841 - DNA, 22 bp, Homo sapiens
tggagtcatggtccggtgtcct

SEQ ID NO: 179842 - DNA, 19 bp, Homo sapiens
tggagtgttccccttccac

SEQ ID NO: 179843 - DNA, 20 bp, Homo sapiens
tggagttcctgaacctgatg

SEQ ID NO: 179844 - DNA, 20 bp, Homo sapiens
tggatctgggaccctttcct

SEQ ID NO: 179845 - DNA, 19 bp, Homo sapiens
tggatgaagattctcctgt

SEQ ID NO: 179846 - DNA, 15 bp, Homo sapiens
tggatgagccctcag

SEQ ID NO: 179847 - DNA, 17 bp, Homo sapiens
tggatgagccctcagaa

SEQ ID NO: 179848 - DNA, 21 bp, Homo sapiens
tggatgatggtcttcagcctc

SEQ ID NO: 179849 - DNA, 17 bp, Homo sapiens
tggattccaaccccaac

SEQ ID NO: 179850 - DNA, 17 bp, Homo sapiens
tggcaaaaatggctaga

SEQ ID NO: 179851 - DNA, 13 bp, Homo sapiens
tggcaaagacaga

SEQ ID NO: 179852 - DNA, 12 bp, Homo sapiens
tggcaacagaag

SEQ ID NO: 179853 - DNA, 19 bp, Homo sapiens
tggcaagaaagctggtaaa

SEQ ID NO: 179854 - DNA, 22 bp, Homo sapiens
tggcacacacctgtagtcccag

SEQ ID NO: 179855 - DNA, 16 bp, Homo sapiens
tggcacagggcagtgg

SEQ ID NO: 179856 - DNA, 21 bp, Homo sapiens
tggcacatttccccagacctg

SEQ ID NO: 179857 - DNA, 16 bp, Homo sapiens
tggcaccagcagcctg

SEQ ID NO: 179858 - DNA, 17 bp, Homo sapiens
tggcaccagcagcctgg

SEQ ID NO: 179859 - DNA, 18 bp, Homo sapiens
tggcaccagcagcctgga

SEQ ID NO: 179860 - DNA, 21 bp, Homo sapiens
tggcacttagctatcagaaga

SEQ ID NO: 179861 - DNA, 19 bp, Homo sapiens
tggcagagttgtaaatata

SEQ ID NO: 179862 - DNA, 19 bp, Homo sapiens
tggcagataatcagcctct

SEQ ID NO: 179863 - DNA, 18 bp, Homo sapiens
tggcagcacctgtctcct

SEQ ID NO: 179864 - DNA, 17 bp, Homo sapiens
tggcagccgtgccttca

SEQ ID NO: 179865 - DNA, 20 bp, Homo sapiens
tggcagccgtgccttcagct

SEQ ID NO: 179866 - DNA, 21 bp, Homo sapiens
tggcagccgtgccttcagctc

SEQ ID NO: 179867 - DNA, 15 bp, Homo sapiens
tggcatgccttccag

SEQ ID NO: 179868 - DNA, 18 bp, Homo sapiens
tggccaaattatttgtgt

SEQ ID NO: 179869 - DNA, 20 bp, Homo sapiens
tggccaaattatttgtgtaa

SEQ ID NO: 179870 - DNA, 22 bp, Homo sapiens
tggccactccagacccctggct

SEQ ID NO: 179871 - DNA, 21 bp, Homo sapiens
tggccacttgggtcttccctg

SEQ ID NO: 179872 - DNA, 17 bp, Homo sapiens
tggccagagctgggagg

SEQ ID NO: 179873 - DNA, 11 bp, Homo sapiens
tggccaggtgg

SEQ ID NO: 179874 - DNA, 21 bp, Homo sapiens
tggccccatgtctctcagaat

SEQ ID NO: 179875 - DNA, 19 bp, Homo sapiens
tggcccgacagcctggcac

SEQ ID NO: 179876 - DNA, 20 bp, Homo sapiens
tggccctcacccctgccctg

SEQ ID NO: 179877 - DNA, 12 bp, Homo sapiens
tggccctgcctt

SEQ ID NO: 179878 - DNA, 13 bp, Homo sapiens
tggccctggcctg

SEQ ID NO: 179879 - DNA, 14 bp, Homo sapiens
tggccctggcctgc

SEQ ID NO: 179880 - DNA, 12 bp, Homo sapiens
tggccctggggt

SEQ ID NO: 179881 - DNA, 19 bp, Homo sapiens
tggccctgtccctcccacc

SEQ ID NO: 179882 - DNA, 22 bp, Homo sapiens
tggccggagcaaactctgctgt

SEQ ID NO: 179883 - DNA, 16 bp, Homo sapiens
tggcctctggctctca

SEQ ID NO: 179884 - DNA, 20 bp, Homo sapiens
tggcctcttgagcagtggct

SEQ ID NO: 179885 - DNA, 20 bp, Homo sapiens
tggcctgctgggctctccac

SEQ ID NO: 179886 - DNA, 21 bp, Homo sapiens
tggcctgctgggctctccacc

SEQ ID NO: 179887 - DNA, 13 bp, Homo sapiens
tggcctgggagag

SEQ ID NO: 179888 - DNA, 14 bp, Homo sapiens
tggcgcaagcctgt

SEQ ID NO: 179889 - DNA, 15 bp, Homo sapiens
tggcggctactcagc

SEQ ID NO: 179890 - DNA, 16 bp, Homo sapiens
tggcggctactcagca

SEQ ID NO: 179891 - DNA, 17 bp, Homo sapiens
tggcggctactcagcag

SEQ ID NO: 179892 - DNA, 22 bp, Homo sapiens
tggcggctactcagcagccctc

SEQ ID NO: 179893 - DNA, 15 bp, Homo sapiens
tggctaagagtgtcc

SEQ ID NO: 179894 - DNA, 18 bp, Homo sapiens
tggctaagcaaaatgtga

SEQ ID NO: 179895 - DNA, 19 bp, Homo sapiens
tggctaatgtactgcatat

SEQ ID NO: 179896 - DNA, 19 bp, Homo sapiens
tggctataaatatataaaa

SEQ ID NO: 179897 - DNA, 19 bp, Homo sapiens
tggctataggtgctacaaa

SEQ ID NO: 179898 - DNA, 23 bp, Homo sapiens
tggctataggtgctacaaaaaca

SEQ ID NO: 179899 - DNA, 13 bp, Homo sapiens
tggctcacgcctg

SEQ ID NO: 179900 - DNA, 21 bp, Homo sapiens
tggctcatattcctgcagcct

SEQ ID NO: 179901 - DNA, 14 bp, Homo sapiens
tggctcccacaggc

SEQ ID NO: 179902 - DNA, 17 bp, Homo sapiens
tggctcccacaggccct

SEQ ID NO: 179903 - DNA, 14 bp, Homo sapiens
tggctcctcccggt

SEQ ID NO: 179904 - DNA, 14 bp, Homo sapiens
tggctctgcaatgg

SEQ ID NO: 179905 - DNA, 21 bp, Homo sapiens
tggctctggagacagccccag

SEQ ID NO: 179906 - DNA, 17 bp, Homo sapiens
tggctgacccagtccct

SEQ ID NO: 179907 - DNA, 19 bp, Homo sapiens
tggctgacccagtccctgg

SEQ ID NO: 179908 - DNA, 13 bp, Homo sapiens
tggctgcccacac

SEQ ID NO: 179909 - DNA, 16 bp, Homo sapiens
tggctgcggcaccctt

SEQ ID NO: 179910 - DNA, 14 bp, Homo sapiens
tggctgctagcact

SEQ ID NO: 179911 - DNA, 14 bp, Homo sapiens
tggctgctgactga

SEQ ID NO: 179912 - DNA, 22 bp, Homo sapiens
tggctggatgaaattttctaga

SEQ ID NO: 179913 - DNA, 14 bp, Homo sapiens
tggctgtcagcagg

SEQ ID NO: 179914 - DNA, 15 bp, Homo sapiens
tggctgtgaggcccc

SEQ ID NO: 179915 - DNA, 17 bp, Homo sapiens
tggctgtgtctaaactg

SEQ ID NO: 179916 - DNA, 17 bp, Homo sapiens
tggcttcaaaatagaga

SEQ ID NO: 179917 - DNA, 20 bp, Homo sapiens
tggcttcacggaagagcctt

SEQ ID NO: 179918 - DNA, 23 bp, Homo sapiens
tggcttcacggaagagccttgcg

SEQ ID NO: 179919 - DNA, 16 bp, Homo sapiens
tggcttcccgctcagc

SEQ ID NO: 179920 - DNA, 18 bp, Homo sapiens
tggcttcccgctcagccc

SEQ ID NO: 179921 - DNA, 20 bp, Homo sapiens
tggcttcccgctcagccctc

SEQ ID NO: 179922 - DNA, 18 bp, Homo sapiens
tggcttttcactgctggc

SEQ ID NO: 179923 - DNA, 23 bp, Homo sapiens
tgggaaaaatgcccttaaatcat

SEQ ID NO: 179924 - DNA, 23 bp, Homo sapiens
tgggaaaataccccatcattcat

SEQ ID NO: 179925 - DNA, 16 bp, Homo sapiens
tgggaaagcattgtaa

SEQ ID NO: 179926 - DNA, 17 bp, Homo sapiens
tgggaaagcattgtaaa

SEQ ID NO: 179927 - DNA, 21 bp, Homo sapiens
tgggaaagcattgtaaatgtg

SEQ ID NO: 179928 - DNA, 13 bp, Homo sapiens
tgggaactagact

SEQ ID NO: 179929 - DNA, 21 bp, Homo sapiens
tgggaagacatggggaggaag

SEQ ID NO: 179930 - DNA, 23 bp, Homo sapiens
tgggaagaccagctttgcagtga

SEQ ID NO: 179931 - DNA, 15 bp, Homo sapiens
tgggactgggagggc

SEQ ID NO: 179932 - DNA, 21 bp, Homo sapiens
tgggagacaagaaatccctgt

SEQ ID NO: 179933 - DNA, 22 bp, Homo sapiens
tgggagacaagaaatccctgtt

SEQ ID NO: 179934 - DNA, 14 bp, Homo sapiens
tgggagccgggtct

SEQ ID NO: 179935 - DNA, 12 bp, Homo sapiens
tgggaggaaaag

SEQ ID NO: 179936 - DNA, 21 bp, Homo sapiens
tgggaggatctcttgagcctg

SEQ ID NO: 179937 - DNA, 22 bp, Homo sapiens
tgggaggatctcttgagcctgg

SEQ ID NO: 179938 - DNA, 20 bp, Homo sapiens
tgggaggccaaggtgggagg

SEQ ID NO: 179939 - DNA, 20 bp, Homo sapiens
tgggaggctcacccccttct

SEQ ID NO: 179940 - DNA, 11 bp, Homo sapiens
tgggaggctga

SEQ ID NO: 179941 - DNA, 18 bp, Homo sapiens
tgggagggagcagacagg

SEQ ID NO: 179942 - DNA, 19 bp, Homo sapiens
tgggagggagcagacagga

SEQ ID NO: 179943 - DNA, 23 bp, Homo sapiens
tgggaggggcgcccacctcccca

SEQ ID NO: 179944 - DNA, 18 bp, Homo sapiens
tgggaggtcaaggctgca

SEQ ID NO: 179945 - DNA, 20 bp, Homo sapiens
tgggaggtcaaggctgcagt

SEQ ID NO: 179946 - DNA, 16 bp, Homo sapiens
tgggatgagccgctgt

SEQ ID NO: 179947 - DNA, 21 bp, Homo sapiens
tgggatgttcagcactgtccc

SEQ ID NO: 179948 - DNA, 22 bp, Homo sapiens
tgggattctactttaagcacta

SEQ ID NO: 179949 - DNA, 19 bp, Homo sapiens
tgggattgagtctgtgcca

SEQ ID NO: 179950 - DNA, 15 bp, Homo sapiens
tgggcaaagcctagt

SEQ ID NO: 179951 - DNA, 21 bp, Homo sapiens
tgggcaaagcctagtgaaggc

SEQ ID NO: 179952 - DNA, 19 bp, Homo sapiens
tgggcacgctgtgggcagg

SEQ ID NO: 179953 - DNA, 22 bp, Homo sapiens
tgggcactgggatgagccgctg

SEQ ID NO: 179954 - DNA, 14 bp, Homo sapiens
tgggcagagcccaa

SEQ ID NO: 179955 - DNA, 15 bp, Homo sapiens
tgggcaggtgggagc

SEQ ID NO: 179956 - DNA, 17 bp, Homo sapiens
tgggccaggacaggccc

SEQ ID NO: 179957 - DNA, 18 bp, Homo sapiens
tgggccaggacaggcccg

SEQ ID NO: 179958 - DNA, 18 bp, Homo sapiens
tgggccctctctgctctg

SEQ ID NO: 179959 - DNA, 19 bp, Homo sapiens
tgggctccctgactgggag

SEQ ID NO: 179960 - DNA, 16 bp, Homo sapiens
tgggctctccacctca

SEQ ID NO: 179961 - DNA, 12 bp, Homo sapiens
tgggctgaggga

SEQ ID NO: 179962 - DNA, 19 bp, Homo sapiens
tgggctgccctggtgctgc

SEQ ID NO: 179963 - DNA, 20 bp, Homo sapiens
tgggctgccctggtgctgcc

SEQ ID NO: 179964 - DNA, 21 bp, Homo sapiens
tgggctgccctggtgctgcca

SEQ ID NO: 179965 - DNA, 18 bp, Homo sapiens
tggggaagcttcttaaat

SEQ ID NO: 179966 - DNA, 17 bp, Homo sapiens
tggggagactgggctga

SEQ ID NO: 179967 - DNA, 22 bp, Homo sapiens
tggggagccaacagaagcttcc

SEQ ID NO: 179968 - DNA, 14 bp, Homo sapiens
tggggcagcacaga

SEQ ID NO: 179969 - DNA, 16 bp, Homo sapiens
tggggcagcacagaga

SEQ ID NO: 179970 - DNA, 18 bp, Homo sapiens
tggggcagcacagagagg

SEQ ID NO: 179971 - DNA, 15 bp, Homo sapiens
tggggccaggtcacc

SEQ ID NO: 179972 - DNA, 13 bp, Homo sapiens
tggggctctggga

SEQ ID NO: 179973 - DNA, 17 bp, Homo sapiens
tggggctgctcctccag

SEQ ID NO: 179974 - DNA, 19 bp, Homo sapiens
tggggctgctcctccaggg

SEQ ID NO: 179975 - DNA, 19 bp, Homo sapiens
tgggggagtctgaagcaga

SEQ ID NO: 179976 - DNA, 14 bp, Homo sapiens
tgggggtgccagga

SEQ ID NO: 179977 - DNA, 15 bp, Homo sapiens
tgggggttctttctt

SEQ ID NO: 179978 - DNA, 20 bp, Homo sapiens
tgggggttctttcttcctct

SEQ ID NO: 179979 - DNA, 20 bp, Homo sapiens
tggggtagctagaggaacca

SEQ ID NO: 179980 - DNA, 16 bp, Homo sapiens
tggggtcctggggcct

SEQ ID NO: 179981 - DNA, 21 bp, Homo sapiens
tggggtctcacagtgttgccc

SEQ ID NO: 179982 - DNA, 23 bp, Homo sapiens
tggggtctcacagtgttgcccag

SEQ ID NO: 179983 - DNA, 13 bp, Homo sapiens
tggggtctccctc

SEQ ID NO: 179984 - DNA, 13 bp, Homo sapiens
tggggtgggagag

SEQ ID NO: 179985 - DNA, 15 bp, Homo sapiens
tggggttcagcccct

SEQ ID NO: 179986 - DNA, 17 bp, Homo sapiens
tggggttcagcccctcc

SEQ ID NO: 179987 - DNA, 18 bp, Homo sapiens
tgggtaatcgatggggga

SEQ ID NO: 179988 - DNA, 15 bp, Homo sapiens
tgggtacagagaggt

SEQ ID NO: 179989 - DNA, 18 bp, Homo sapiens
tgggtccatgggcagagc

SEQ ID NO: 179990 - DNA, 18 bp, Homo sapiens
tgggtcctcacatctttc

SEQ ID NO: 179991 - DNA, 20 bp, Homo sapiens
tgggtctcgctttgttgccc

SEQ ID NO: 179992 - DNA, 22 bp, Homo sapiens
tgggtcttcagggggccaggtg

SEQ ID NO: 179993 - DNA, 23 bp, Homo sapiens
tgggtgccccccttgccagacat

SEQ ID NO: 179994 - DNA, 20 bp, Homo sapiens
tgggtggcaccagcagcctg

SEQ ID NO: 179995 - DNA, 22 bp, Homo sapiens
tgggtggcaccagcagcctgga

SEQ ID NO: 179996 - DNA, 15 bp, Homo sapiens
tgggtggcctcggga

SEQ ID NO: 179997 - DNA, 21 bp, Homo sapiens
tgggtggggctgctcctccag

SEQ ID NO: 179998 - DNA, 22 bp, Homo sapiens
tgggtgtaacaggtctcctctt

SEQ ID NO: 179999 - DNA, 14 bp, Homo sapiens
tgggttgactttca

SEQ ID NO: 180000 - DNA, 21 bp, Homo sapiens
tggtaaactatttgtctttca

SEQ ID NO: 180001 - DNA, 13 bp, Homo sapiens
tggtaactgttaa

SEQ ID NO: 180002 - DNA, 14 bp, Homo sapiens
tggtaatattgact

SEQ ID NO: 180003 - DNA, 17 bp, Homo sapiens
tggtcacaggaagtaga

SEQ ID NO: 180004 - DNA, 22 bp, Homo sapiens
tggtcacaggaagtagaggagg

SEQ ID NO: 180005 - DNA, 13 bp, Homo sapiens
tggtcacagggca

SEQ ID NO: 180006 - DNA, 14 bp, Homo sapiens
tggtcactgccatg

SEQ ID NO: 180007 - DNA, 15 bp, Homo sapiens
tggtcagatttgaac

SEQ ID NO: 180008 - DNA, 16 bp, Homo sapiens
tggtcagatttgaact

SEQ ID NO: 180009 - DNA, 22 bp, Homo sapiens
tggtcagatttgaactcttcaa

SEQ ID NO: 180010 - DNA, 19 bp, Homo sapiens
tggtcagccctagggtgga

SEQ ID NO: 180011 - DNA, 12 bp, Homo sapiens
tggtccaggaga

SEQ ID NO: 180012 - DNA, 13 bp, Homo sapiens
tggtccagggcta

SEQ ID NO: 180013 - DNA, 12 bp, Homo sapiens
tggtctcagaaa

SEQ ID NO: 180014 - DNA, 14 bp, Homo sapiens
tggtcttcagcctc

SEQ ID NO: 180015 - DNA, 15 bp, Homo sapiens
tggtcttcagcctct

SEQ ID NO: 180016 - DNA, 18 bp, Homo sapiens
tggtgacaccagcctttc

SEQ ID NO: 180017 - DNA, 13 bp, Homo sapiens
tggtgctgccaca

SEQ ID NO: 180018 - DNA, 18 bp, Homo sapiens
tggtgctgccacacttca

SEQ ID NO: 180019 - DNA, 13 bp, Homo sapiens
tggtggagggcca

SEQ ID NO: 180020 - DNA, 19 bp, Homo sapiens
tggtggcccgacagcctgg

SEQ ID NO: 180021 - DNA, 21 bp, Homo sapiens
tggtggcccgacagcctggca

SEQ ID NO: 180022 - DNA, 12 bp, Homo sapiens
tggtgggagggg

SEQ ID NO: 180023 - DNA, 21 bp, Homo sapiens
tggtgggaggggcgcccacct

SEQ ID NO: 180024 - DNA, 23 bp, Homo sapiens
tggtgggaggggcgcccacctcc

SEQ ID NO: 180025 - DNA, 15 bp, Homo sapiens
tggtgtccacctggc

SEQ ID NO: 180026 - DNA, 18 bp, Homo sapiens
tggtgtccacctggcccc

SEQ ID NO: 180027 - DNA, 19 bp, Homo sapiens
tggtgtcctttccctccac

SEQ ID NO: 180028 - DNA, 23 bp, Homo sapiens
tggtgtgaccactgcagaagaca

SEQ ID NO: 180029 - DNA, 17 bp, Homo sapiens
tggtgttgcagaaggtt

SEQ ID NO: 180030 - DNA, 17 bp, Homo sapiens
tggttaatctttcctga

SEQ ID NO: 180031 - DNA, 15 bp, Homo sapiens
tggttctaatagaac

SEQ ID NO: 180032 - DNA, 15 bp, Homo sapiens
tggttgactgggttt

SEQ ID NO: 180033 - DNA, 21 bp, Homo sapiens
tggtttatagagggccaagac

SEQ ID NO: 180034 - DNA, 13 bp, Homo sapiens
tggtttccttcct

SEQ ID NO: 180035 - DNA, 21 bp, Homo sapiens
tggtttttaaaaaactgctga

SEQ ID NO: 180036 - DNA, 20 bp, Homo sapiens
tgtaaaatagcttgtatagt

SEQ ID NO: 180037 - DNA, 16 bp, Homo sapiens
tgtaaactcaaaactt

SEQ ID NO: 180038 - DNA, 21 bp, Homo sapiens
tgtaaactcaaaacttaacat

SEQ ID NO: 180039 - DNA, 18 bp, Homo sapiens
tgtaaactgcattagaaa

SEQ ID NO: 180040 - DNA, 18 bp, Homo sapiens
tgtaaagtatgtaaacag

SEQ ID NO: 180041 - DNA, 21 bp, Homo sapiens
tgtaaatatataaatatatat

SEQ ID NO: 180042 - DNA, 12 bp, Homo sapiens
tgtaaatattta

SEQ ID NO: 180043 - DNA, 20 bp, Homo sapiens
tgtaacactttacaatgttc

SEQ ID NO: 180044 - DNA, 20 bp, Homo sapiens
tgtaacaggtctcctcttaa

SEQ ID NO: 180045 - DNA, 16 bp, Homo sapiens
tgtaagctgaaaatat

SEQ ID NO: 180046 - DNA, 13 bp, Homo sapiens
tgtaagggaaact

SEQ ID NO: 180047 - DNA, 18 bp, Homo sapiens
tgtaagggaaactgccag

SEQ ID NO: 180048 - DNA, 15 bp, Homo sapiens
tgtaatcacagctac

SEQ ID NO: 180049 - DNA, 17 bp, Homo sapiens
tgtaatcatataataaa

SEQ ID NO: 180050 - DNA, 16 bp, Homo sapiens
tgtaatccgaatctct

SEQ ID NO: 180051 - DNA, 21 bp, Homo sapiens
tgtaatcttgaattgtaactg

SEQ ID NO: 180052 - DNA, 13 bp, Homo sapiens
tgtaatgatcata

SEQ ID NO: 180053 - DNA, 18 bp, Homo sapiens
tgtaattgcttacatttt

SEQ ID NO: 180054 - DNA, 23 bp, Homo sapiens
tgtaattttgttctagttttcag

SEQ ID NO: 180055 - DNA, 21 bp, Homo sapiens
tgtacaaaatcgattggcttt

SEQ ID NO: 180056 - DNA, 17 bp, Homo sapiens
tgtacagttatttatgc

SEQ ID NO: 180057 - DNA, 21 bp, Homo sapiens
tgtaccatgaaacaaagctgc

SEQ ID NO: 180058 - DNA, 19 bp, Homo sapiens
tgtactgcatatgaaagga

SEQ ID NO: 180059 - DNA, 15 bp, Homo sapiens
tgtacttaactattc

SEQ ID NO: 180060 - DNA, 21 bp, Homo sapiens
tgtagaaggagacagagctgg

SEQ ID NO: 180061 - DNA, 14 bp, Homo sapiens
tgtagagtgggagc

SEQ ID NO: 180062 - DNA, 16 bp, Homo sapiens
tgtagcccactctgct

SEQ ID NO: 180063 - DNA, 22 bp, Homo sapiens
tgtagcccactctgctcgcctt

SEQ ID NO: 180064 - DNA, 12 bp, Homo sapiens
tgtaggcagaca

SEQ ID NO: 180065 - DNA, 16 bp, Homo sapiens
tgtagggttataataa

SEQ ID NO: 180066 - DNA, 18 bp, Homo sapiens
tgtagtagccctttctgt

SEQ ID NO: 180067 - DNA, 14 bp, Homo sapiens
tgtagtcccagcta

SEQ ID NO: 180068 - DNA, 21 bp, Homo sapiens
tgtagtgcctctttcatccac

SEQ ID NO: 180069 - DNA, 23 bp, Homo sapiens
tgtagttaggaaataaaaccttt

SEQ ID NO: 180070 - DNA, 21 bp, Homo sapiens
tgtataacttcttaaaagttg

SEQ ID NO: 180071 - DNA, 22 bp, Homo sapiens
tgtataagattagaatgaaaat

SEQ ID NO: 180072 - DNA, 14 bp, Homo sapiens
tgtataagtaagaa

SEQ ID NO: 180073 - DNA, 23 bp, Homo sapiens
tgtatagtaaagtgataatttct

SEQ ID NO: 180074 - DNA, 24 bp, Homo sapiens
tgtatagtgtaaaataagaatgat

SEQ ID NO: 180075 - DNA, 20 bp, Homo sapiens
tgtatagttaggatagcatt

SEQ ID NO: 180076 - DNA, 17 bp, Homo sapiens
tgtatatacaataacat

SEQ ID NO: 180077 - DNA, 14 bp, Homo sapiens
tgtatatcagaaaa

SEQ ID NO: 180078 - DNA, 23 bp, Homo sapiens
tgtatattatggaagattttaaa

SEQ ID NO: 180079 - DNA, 19 bp, Homo sapiens
tgtatattgtcagatattt

SEQ ID NO: 180080 - DNA, 18 bp, Homo sapiens
tgtatatttaaaagaaag

SEQ ID NO: 180081 - DNA, 18 bp, Homo sapiens
tgtatcacaaatcttaac

SEQ ID NO: 180082 - DNA, 16 bp, Homo sapiens
tgtatccatgggggca

SEQ ID NO: 180083 - DNA, 13 bp, Homo sapiens
tgtatctgagcag

SEQ ID NO: 180084 - DNA, 20 bp, Homo sapiens
tgtatctgcaggcagacacg

SEQ ID NO: 180085 - DNA, 14 bp, Homo sapiens
tgtatgcactttgt

SEQ ID NO: 180086 - DNA, 15 bp, Homo sapiens
tgtatgtaaatgtgc

SEQ ID NO: 180087 - DNA, 16 bp, Homo sapiens
tgtatgtttacatatc

SEQ ID NO: 180088 - DNA, 17 bp, Homo sapiens
tgtattaaaaaaaacaa

SEQ ID NO: 180089 - DNA, 14 bp, Homo sapiens
tgtattcagcttta

SEQ ID NO: 180090 - DNA, 14 bp, Homo sapiens
tgtattctctgagc

SEQ ID NO: 180091 - DNA, 20 bp, Homo sapiens
tgtatttttttgcaagtgaa

SEQ ID NO: 180092 - DNA, 17 bp, Homo sapiens
tgtcaaagagagggctt

SEQ ID NO: 180093 - DNA, 15 bp, Homo sapiens
tgtcaactatgatat

SEQ ID NO: 180094 - DNA, 16 bp, Homo sapiens
tgtcaagtctctgctg

SEQ ID NO: 180095 - DNA, 19 bp, Homo sapiens
tgtcaagtctctgctggcc

SEQ ID NO: 180096 - DNA, 18 bp, Homo sapiens
tgtcaccctccacctctt

SEQ ID NO: 180097 - DNA, 19 bp, Homo sapiens
tgtcaccggatcctgggtg

SEQ ID NO: 180098 - DNA, 13 bp, Homo sapiens
tgtcactgtttct

SEQ ID NO: 180099 - DNA, 20 bp, Homo sapiens
tgtcagatattttttcagaa

SEQ ID NO: 180100 - DNA, 23 bp, Homo sapiens
tgtcagcgcaggtttagtttact

SEQ ID NO: 180101 - DNA, 20 bp, Homo sapiens
tgtcagctcccctcggagaa

SEQ ID NO: 180102 - DNA, 16 bp, Homo sapiens
tgtcagctgaacctgg

SEQ ID NO: 180103 - DNA, 16 bp, Homo sapiens
tgtcataagaatgaat

SEQ ID NO: 180104 - DNA, 23 bp, Homo sapiens
tgtcatctttcttctattttatt

SEQ ID NO: 180105 - DNA, 19 bp, Homo sapiens
tgtcattaccagacggttc

SEQ ID NO: 180106 - DNA, 22 bp, Homo sapiens
tgtccaacctaacccctttcct

SEQ ID NO: 180107 - DNA, 14 bp, Homo sapiens
tgtccacagatgcc

SEQ ID NO: 180108 - DNA, 20 bp, Homo sapiens
tgtccacagatgcctccacc

SEQ ID NO: 180109 - DNA, 16 bp, Homo sapiens
tgtccacgactgtctc

SEQ ID NO: 180110 - DNA, 19 bp, Homo sapiens
tgtccacgactgtctccat

SEQ ID NO: 180111 - DNA, 13 bp, Homo sapiens
tgtccatgtgtgt

SEQ ID NO: 180112 - DNA, 16 bp, Homo sapiens
tgtcccatgatccctg

SEQ ID NO: 180113 - DNA, 19 bp, Homo sapiens
tgtcccatggacactccag

SEQ ID NO: 180114 - DNA, 19 bp, Homo sapiens
tgtccccagtttgcagaaa

SEQ ID NO: 180115 - DNA, 18 bp, Homo sapiens
tgtccccctctgtccagg

SEQ ID NO: 180116 - DNA, 20 bp, Homo sapiens
tgtccctaccgagtctcttc

SEQ ID NO: 180117 - DNA, 14 bp, Homo sapiens
tgtccctcccacct

SEQ ID NO: 180118 - DNA, 16 bp, Homo sapiens
tgtccctcccacctct

SEQ ID NO: 180119 - DNA, 14 bp, Homo sapiens
tgtcctcactgctc

SEQ ID NO: 180120 - DNA, 18 bp, Homo sapiens
tgtcctcccatcccctgg

SEQ ID NO: 180121 - DNA, 19 bp, Homo sapiens
tgtcctcccatcccctgga

SEQ ID NO: 180122 - DNA, 13 bp, Homo sapiens
tgtcctttccctc

SEQ ID NO: 180123 - DNA, 14 bp, Homo sapiens
tgtcgcctctgcat

SEQ ID NO: 180124 - DNA, 11 bp, Homo sapiens
tgtctaaactg

SEQ ID NO: 180125 - DNA, 13 bp, Homo sapiens
tgtctaaactgca

SEQ ID NO: 180126 - DNA, 14 bp, Homo sapiens
tgtctaagatagta

SEQ ID NO: 180127 - DNA, 12 bp, Homo sapiens
tgtctacagaga

SEQ ID NO: 180128 - DNA, 17 bp, Homo sapiens
tgtctcaagagggcact

SEQ ID NO: 180129 - DNA, 23 bp, Homo sapiens
tgtctcaagagggcactggtggc

SEQ ID NO: 180130 - DNA, 13 bp, Homo sapiens
tgtctcagcctcc

SEQ ID NO: 180131 - DNA, 16 bp, Homo sapiens
tgtctcaggtccctgc

SEQ ID NO: 180132 - DNA, 17 bp, Homo sapiens
tgtctcagtccacctga

SEQ ID NO: 180133 - DNA, 21 bp, Homo sapiens
tgtctcagtccatgaagatgt

SEQ ID NO: 180134 - DNA, 22 bp, Homo sapiens
tgtctcagtccatgaagatgta

SEQ ID NO: 180135 - DNA, 12 bp, Homo sapiens
tgtctcatccca

SEQ ID NO: 180136 - DNA, 15 bp, Homo sapiens
tgtctccatggccct

SEQ ID NO: 180137 - DNA, 18 bp, Homo sapiens
tgtctctggcgtgtgggt

SEQ ID NO: 180138 - DNA, 23 bp, Homo sapiens
tgtctctgggcttggggcttcct

SEQ ID NO: 180139 - DNA, 13 bp, Homo sapiens
tgtctcttccata

SEQ ID NO: 180140 - DNA, 15 bp, Homo sapiens
tgtctggttttaaca

SEQ ID NO: 180141 - DNA, 17 bp, Homo sapiens
tgtcttcctgcattcac

SEQ ID NO: 180142 - DNA, 22 bp, Homo sapiens
tgtcttgatgcatgcactgttc

SEQ ID NO: 180143 - DNA, 13 bp, Homo sapiens
tgtgaaaagaaaa

SEQ ID NO: 180144 - DNA, 17 bp, Homo sapiens
tgtgaaaagaaaaatga

SEQ ID NO: 180145 - DNA, 14 bp, Homo sapiens
tgtgaaaatgggtt

SEQ ID NO: 180146 - DNA, 20 bp, Homo sapiens
tgtgaaaggaagctccactg

SEQ ID NO: 180147 - DNA, 21 bp, Homo sapiens
tgtgaacgatttagaaagaag

SEQ ID NO: 180148 - DNA, 18 bp, Homo sapiens
tgtgaagtgaatgaaaca

SEQ ID NO: 180149 - DNA, 20 bp, Homo sapiens
tgtgaatatggactcagttt

SEQ ID NO: 180150 - DNA, 15 bp, Homo sapiens
tgtgaatcagaccct

SEQ ID NO: 180151 - DNA, 18 bp, Homo sapiens
tgtgaatcagaccctacc

SEQ ID NO: 180152 - DNA, 16 bp, Homo sapiens
tgtgaatgggaaaaga

SEQ ID NO: 180153 - DNA, 23 bp, Homo sapiens
tgtgaatttcttcactgttgaaa

SEQ ID NO: 180154 - DNA, 20 bp, Homo sapiens
tgtgacctcaggcactagcc

SEQ ID NO: 180155 - DNA, 23 bp, Homo sapiens
tgtgactctttttagggccaggc

SEQ ID NO: 180156 - DNA, 12 bp, Homo sapiens
tgtgagcccctg

SEQ ID NO: 180157 - DNA, 14 bp, Homo sapiens
tgtgagccttggct

SEQ ID NO: 180158 - DNA, 13 bp, Homo sapiens
tgtgaggcagggg

SEQ ID NO: 180159 - DNA, 18 bp, Homo sapiens
tgtgaggcaggggcggag

SEQ ID NO: 180160 - DNA, 16 bp, Homo sapiens
tgtgaggccagggcag

SEQ ID NO: 180161 - DNA, 17 bp, Homo sapiens
tgtgaggccagggcaga

SEQ ID NO: 180162 - DNA, 19 bp, Homo sapiens
tgaggaatgtatatgtttt

SEQ ID NO: 180163 - DNA, 21 bp, Homo sapiens
tgaggacatgtttttgttttc

SEQ ID NO: 180164 - DNA, 23 bp, Homo sapiens
tgaggacttaaaatattcctgca

SEQ ID NO: 180165 - DNA, 16 bp, Homo sapiens
tgaggagtgtgagaat

SEQ ID NO: 180166 - DNA, 16 bp, Homo sapiens
tgaggatgggaaggag

SEQ ID NO: 180167 - DNA, 20 bp, Homo sapiens
tgaggcaaccacaggcagca

SEQ ID NO: 180168 - DNA, 15 bp, Homo sapiens
tgaggcagacagcag

SEQ ID NO: 180169 - DNA, 17 bp, Homo sapiens
tgaggcagacagcagct

SEQ ID NO: 180170 - DNA, 20 bp, Homo sapiens
tgaggcagacagcagctcag

SEQ ID NO: 180171 - DNA, 21 bp, Homo sapiens
tgaggcagcagtgtgaggcca

SEQ ID NO: 180172 - DNA, 12 bp, Homo sapiens
tgaggcctggac

SEQ ID NO: 180173 - DNA, 21 bp, Homo sapiens
tgaggctctgacccagtgaga

SEQ ID NO: 180174 - DNA, 22 bp, Homo sapiens
tgtgaggccagggcagagtgag

SEQ ID NO: 180175 - DNA, 14 bp, Homo sapiens
tgtgaggcccctgg

SEQ ID NO: 180176 - DNA, 23 bp, Homo sapiens
tgtgagtgtgtccaagtgtgtgt

SEQ ID NO: 180177 - DNA, 14 bp, Homo sapiens
tgtgatatataagt

SEQ ID NO: 180178 - DNA, 18 bp, Homo sapiens
tgtgatgaatactgtatt

SEQ ID NO: 180179 - DNA, 18 bp, Homo sapiens
tgtgatttagaactgtat

SEQ ID NO: 180180 - DNA, 20 bp, Homo sapiens
tgtgcaagtgtctgtgtgca

SEQ ID NO: 180181 - DNA, 19 bp, Homo sapiens
tgtgcacacacaccacaca

SEQ ID NO: 180182 - DNA, 20 bp, Homo sapiens
tgtgcacatctgtgtcttgt

SEQ ID NO: 180183 - DNA, 18 bp, Homo sapiens
tgtgcacatgtgtgcgtg

SEQ ID NO: 180184 - DNA, 14 bp, Homo sapiens
tgtgcaccagggtt

SEQ ID NO: 180185 - DNA, 12 bp, Homo sapiens
tgtgcagtgttg

SEQ ID NO: 180186 - DNA, 21 bp, Homo sapiens
tgtgccatagagtttaacaca

SEQ ID NO: 180187 - DNA, 13 bp, Homo sapiens
tgtgcctctgcct

SEQ ID NO: 180188 - DNA, 14 bp, Homo sapiens
tgtgcctctgcctg

SEQ ID NO: 180189 - DNA, 18 bp, Homo sapiens
tgtgccttttatagctat

SEQ ID NO: 180190 - DNA, 15 bp, Homo sapiens
tgtgcgtgcatgtgc

SEQ ID NO: 180191 - DNA, 20 bp, Homo sapiens
tgtgcgtgtgtccatgtgtg

SEQ ID NO: 180192 - DNA, 20 bp, Homo sapiens
tgtgctgcccgtcttcagcc

SEQ ID NO: 180193 - DNA, 19 bp, Homo sapiens
tgtgcttcgggcccttccc

SEQ ID NO: 180194 - DNA, 17 bp, Homo sapiens
tgtgctttgcattccta

SEQ ID NO: 180195 - DNA, 12 bp, Homo sapiens
tgtggagaagcg

SEQ ID NO: 180196 - DNA, 13 bp, Homo sapiens
tgtggagactggg

SEQ ID NO: 180197 - DNA, 18 bp, Homo sapiens
tgtggcaagcccctgccc

SEQ ID NO: 180198 - DNA, 24 bp, Homo sapiens
tgtggccaaaggagggtcaggaag

SEQ ID NO: 180199 - DNA, 14 bp, Homo sapiens
tgtggccctggcct

SEQ ID NO: 180200 - DNA, 10 bp, Homo sapiens
tgtggctcac

SEQ ID NO: 180201 - DNA, 22 bp, Homo sapiens
tgtggctcacgtgagagtgtct

SEQ ID NO: 180202 - DNA, 21 bp, Homo sapiens
tgtggctcctgggggttcttt

SEQ ID NO: 180203 - DNA, 19 bp, Homo sapiens
tgtggctgtcagcaggaag

SEQ ID NO: 180204 - DNA, 21 bp, Homo sapiens
tgtggctgtcagcaggaagca

SEQ ID NO: 180205 - DNA, 21 bp, Homo sapiens
tgtgggagggagcagacagga

SEQ ID NO: 180206 - DNA, 13 bp, Homo sapiens
tgtggtgctgaca

SEQ ID NO: 180207 - DNA, 23 bp, Homo sapiens
tgtggtgtgtccccctctgtcca

SEQ ID NO: 180208 - DNA, 23 bp, Homo sapiens
tgtgtacagaattctgctacctc

SEQ ID NO: 180209 - DNA, 16 bp, Homo sapiens
tgtgtacgtggagagg

SEQ ID NO: 180210 - DNA, 14 bp, Homo sapiens
tgtgtattaaaaaa

SEQ ID NO: 180211 - DNA, 19 bp, Homo sapiens
tgtgtattcattgaagtca

SEQ ID NO: 180212 - DNA, 18 bp, Homo sapiens
tgtgtccacgactgtctc

SEQ ID NO: 180213 - DNA, 20 bp, Homo sapiens
tgtgtcccatgatccctgtg

SEQ ID NO: 180214 - DNA, 16 bp, Homo sapiens
tgtgtccccctctgtc

SEQ ID NO: 180215 - DNA, 13 bp, Homo sapiens
tgtgtctaaactg

SEQ ID NO: 180216 - DNA, 19 bp, Homo sapiens
tgtgtctaaatttgaatgt

SEQ ID NO: 180217 - DNA, 14 bp, Homo sapiens
tgtgtctacagaga

SEQ ID NO: 180218 - DNA, 23 bp, Homo sapiens
tgtgtgaagatcacgttccttcc

SEQ ID NO: 180219 - DNA, 16 bp, Homo sapiens
tgtgtgatgaactttc

SEQ ID NO: 180220 - DNA, 17 bp, Homo sapiens
tgtgtgcaccttaccaa

SEQ ID NO: 180221 - DNA, 20 bp, Homo sapiens
tgtgtgcatgtgtgtgctca

SEQ ID NO: 180222 - DNA, 24 bp, Homo sapiens
tgtgtgccatagagtttaacacaa

SEQ ID NO: 180223 - DNA, 19 bp, Homo sapiens
tgtgttaagtatgtgtaaa

SEQ ID NO: 180224 - DNA, 13 bp, Homo sapiens
tgtgttgtctcta

SEQ ID NO: 180225 - DNA, 12 bp, Homo sapiens
tgttaaaataac

SEQ ID NO: 180226 - DNA, 14 bp, Homo sapiens
tgttaaaataacta

SEQ ID NO: 180227 - DNA, 16 bp, Homo sapiens
tgttaaccagaataaa

SEQ ID NO: 180228 - DNA, 18 bp, Homo sapiens
tgttacaaagttgtatgt

SEQ ID NO: 180229 - DNA, 15 bp, Homo sapiens
tgttacctgaaaaca

SEQ ID NO: 180230 - DNA, 16 bp, Homo sapiens
tgttacctgaaaacac

SEQ ID NO: 180231 - DNA, 23 bp, Homo sapiens
tgttacctgaaaacactgtgcac

SEQ ID NO: 180232 - DNA, 18 bp, Homo sapiens
tgttactaactaaactct

SEQ ID NO: 180233 - DNA, 16 bp, Homo sapiens
tgttactgtcttcagt

SEQ ID NO: 180234 - DNA, 16 bp, Homo sapiens
tgttaggaaaatttca

SEQ ID NO: 180235 - DNA, 14 bp, Homo sapiens
tgttataactactc

SEQ ID NO: 180236 - DNA, 23 bp, Homo sapiens
tgttattagagattacctcctga

SEQ ID NO: 180237 - DNA, 14 bp, Homo sapiens
tgttatttaaagaa

SEQ ID NO: 180238 - DNA, 19 bp, Homo sapiens
tgttattttctttgaaatt

SEQ ID NO: 180239 - DNA, 22 bp, Homo sapiens
tgttcaaagccagcgtcctcct

SEQ ID NO: 180240 - DNA, 16 bp, Homo sapiens
tgttcacactctcaca

SEQ ID NO: 180241 - DNA, 13 bp, Homo sapiens
tgttcagcactgt

SEQ ID NO: 180242 - DNA, 17 bp, Homo sapiens
tgttcagcactgtccct

SEQ ID NO: 180243 - DNA, 18 bp, Homo sapiens
tgttcagcactgtccctt

SEQ ID NO: 180244 - DNA, 11 bp, Homo sapiens
tgttcagctgg

SEQ ID NO: 180245 - DNA, 19 bp, Homo sapiens
tgttcatcccatgatgtag

SEQ ID NO: 180246 - DNA, 16 bp, Homo sapiens
tgttcccattcttgca

SEQ ID NO: 180247 - DNA, 13 bp, Homo sapiens
tgttccccatctg

SEQ ID NO: 180248 - DNA, 18 bp, Homo sapiens
tgttccccatggccactt

SEQ ID NO: 180249 - DNA, 14 bp, Homo sapiens
tgttccccttccac

SEQ ID NO: 180250 - DNA, 18 bp, Homo sapiens
tgttccctctccctgttg

SEQ ID NO: 180251 - DNA, 15 bp, Homo sapiens
tgttctagttttcag

SEQ ID NO: 180252 - DNA, 15 bp, Homo sapiens
tgttctggccctcac

SEQ ID NO: 180253 - DNA, 13 bp, Homo sapiens
tgttcttgaattt

SEQ ID NO: 180254 - DNA, 13 bp, Homo sapiens
tgttctttgggga

SEQ ID NO: 180255 - DNA, 14 bp, Homo sapiens
tgttgaaattatgt

SEQ ID NO: 180256 - DNA, 22 bp, Homo sapiens
tgttgaatgcccacaggcaaat

SEQ ID NO: 180257 - DNA, 17 bp, Homo sapiens
tgttgacagttcatatg

SEQ ID NO: 180258 - DNA, 17 bp, Homo sapiens
tgttgcaagtactgctg

SEQ ID NO: 180259 - DNA, 22 bp, Homo sapiens
tgttgcacacccactcagctcc

SEQ ID NO: 180260 - DNA, 23 bp, Homo sapiens
tgttgcacacccactcagctccg

SEQ ID NO: 180261 - DNA, 17 bp, Homo sapiens
tgttgcatgatgtattt

SEQ ID NO: 180262 - DNA, 12 bp, Homo sapiens
tgttgccagaga

SEQ ID NO: 180263 - DNA, 13 bp, Homo sapiens
tgttgtcagctga

SEQ ID NO: 180264 - DNA, 12 bp, Homo sapiens
tgttgtgaatgt

SEQ ID NO: 180265 - DNA, 14 bp, Homo sapiens
tgttgtgtttctgt

SEQ ID NO: 180266 - DNA, 11 bp, Homo sapiens
tgttgttattt

SEQ ID NO: 180267 - DNA, 13 bp, Homo sapiens
tgtttaaaatcat

SEQ ID NO: 180268 - DNA, 18 bp, Homo sapiens
tgtttaaaatcatttctg

SEQ ID NO: 180269 - DNA, 14 bp, Homo sapiens
tgtttaagatgggc

SEQ ID NO: 180270 - DNA, 21 bp, Homo sapiens
tgtttaagtgttgtaaatatt

SEQ ID NO: 180271 - DNA, 16 bp, Homo sapiens
tgtttacactctttgt

SEQ ID NO: 180272 - DNA, 18 bp, Homo sapiens
tgtttacactctttgtaa

SEQ ID NO: 180273 - DNA, 16 bp, Homo sapiens
tgtttataaacattgt

SEQ ID NO: 180274 - DNA, 19 bp, Homo sapiens
tgtttattaacaaattatg

SEQ ID NO: 180275 - DNA, 16 bp, Homo sapiens
tgtttcaaaataaaaa

SEQ ID NO: 180276 - DNA, 16 bp, Homo sapiens
tgtttcaattgcatct

SEQ ID NO: 180277 - DNA, 21 bp, Homo sapiens
tgtttccaatgtttagcaaat

SEQ ID NO: 180278 - DNA, 19 bp, Homo sapiens
tgtttccatattttatagg

SEQ ID NO: 180279 - DNA, 15 bp, Homo sapiens
tgtttccttcagtgc

SEQ ID NO: 180280 - DNA, 14 bp, Homo sapiens
tgtttcttttgtat

SEQ ID NO: 180281 - DNA, 20 bp, Homo sapiens
tgtttcttttgtatgtaaat

SEQ ID NO: 180282 - DNA, 14 bp, Homo sapiens
tgtttgagctcaga

SEQ ID NO: 180283 - DNA, 18 bp, Homo sapiens
tgtttggaatattgtcca

SEQ ID NO: 180284 - DNA, 17 bp, Homo sapiens
tgtttgtctgtcttcat

SEQ ID NO: 180285 - DNA, 19 bp, Homo sapiens
tgtttgtctgtcttcatag

SEQ ID NO: 180286 - DNA, 13 bp, Homo sapiens
tgtttgtgctgtg

SEQ ID NO: 180287 - DNA, 14 bp, Homo sapiens
tgtttgtgctgtgg

SEQ ID NO: 180288 - DNA, 15 bp, Homo sapiens
tgtttgtgctgtggt

SEQ ID NO: 180289 - DNA, 16 bp, Homo sapiens
tgtttgttgtcagctg

SEQ ID NO: 180290 - DNA, 22 bp, Homo sapiens
tgttttaaatacgcactacatg

SEQ ID NO: 180291 - DNA, 12 bp, Homo sapiens
tgttttatcatg

SEQ ID NO: 180292 - DNA, 15 bp, Homo sapiens
tgttttcagactcag

SEQ ID NO: 180293 - DNA, 11 bp, Homo sapiens
tgtttttcatt

SEQ ID NO: 180294 - DNA, 22 bp, Homo sapiens
ttaaaaaaaaacctgagcccca

SEQ ID NO: 180295 - DNA, 14 bp, Homo sapiens
ttaaaaaaaacaaa

SEQ ID NO: 180296 - DNA, 15 bp, Homo sapiens
ttaaaaaaaacaaaa

SEQ ID NO: 180297 - DNA, 22 bp, Homo sapiens
ttaaaaaaaacaaaaagaacaa

SEQ ID NO: 180298 - DNA, 23 bp, Homo sapiens
ttaaaaaaaacaaaaagaacaaa

SEQ ID NO: 180299 - DNA, 15 bp, Homo sapiens
ttaaaaatataaaac

SEQ ID NO: 180300 - DNA, 23 bp, Homo sapiens
ttaaaaatatggaacttctaata

SEQ ID NO: 180301 - DNA, 21 bp, Homo sapiens
ttaaaagaatattttaacttc

SEQ ID NO: 180302 - DNA, 16 bp, Homo sapiens
ttaaaagacaagactt

SEQ ID NO: 180303 - DNA, 15 bp, Homo sapiens
ttaaaagatgaaaat

SEQ ID NO: 180304 - DNA, 18 bp, Homo sapiens
ttaaaagatgaaaatatt

SEQ ID NO: 180305 - DNA, 15 bp, Homo sapiens
ttaaaataactagtg

SEQ ID NO: 180306 - DNA, 19 bp, Homo sapiens
ttaaaatacacactcaaat

SEQ ID NO: 180307 - DNA, 22 bp, Homo sapiens
ttaaaatagcaacactctatat

SEQ ID NO: 180308 - DNA, 13 bp, Homo sapiens
ttaaaatgttcac

SEQ ID NO: 180309 - DNA, 12 bp, Homo sapiens
ttaaacagcagt

SEQ ID NO: 180310 - DNA, 14 bp, Homo sapiens
ttaaactcagggac

SEQ ID NO: 180311 - DNA, 16 bp, Homo sapiens
ttaaactcagggacag

SEQ ID NO: 180312 - DNA, 20 bp, Homo sapiens
ttaaactcagggacagagcc

SEQ ID NO: 180313 - DNA, 15 bp, Homo sapiens
ttaaagctgcctgta

SEQ ID NO: 180314 - DNA, 21 bp, Homo sapiens
ttaaaggggcagaaaaactct

SEQ ID NO: 180315 - DNA, 16 bp, Homo sapiens
ttaaagtatatattta

SEQ ID NO: 180316 - DNA, 18 bp, Homo sapiens
ttaaatagtaaaaataaa

SEQ ID NO: 180317 - DNA, 21 bp, Homo sapiens
ttaaatatgttagcaaagagt

SEQ ID NO: 180318 - DNA, 16 bp, Homo sapiens
ttaaatctcattgctt

SEQ ID NO: 180319 - DNA, 16 bp, Homo sapiens
ttaacacaagtcctgt

SEQ ID NO: 180320 - DNA, 18 bp, Homo sapiens
ttaacacctttaaagtgt

SEQ ID NO: 180321 - DNA, 13 bp, Homo sapiens
ttaaccaaaggtg

SEQ ID NO: 180322 - DNA, 12 bp, Homo sapiens
ttaacctctgca

SEQ ID NO: 180323 - DNA, 16 bp, Homo sapiens
ttagagtgtctttcca

SEQ ID NO: 180324 - DNA, 13 bp, Homo sapiens
ttagatgttctaa

SEQ ID NO: 180325 - DNA, 20 bp, Homo sapiens
ttagcaaagagttaatatat

SEQ ID NO: 180326 - DNA, 16 bp, Homo sapiens
ttagcagtttgctttg

SEQ ID NO: 180327 - DNA, 17 bp, Homo sapiens
ttagcatgtgttgaaaa

SEQ ID NO: 180328 - DNA, 18 bp, Homo sapiens
ttagccaagtgtggtaga

SEQ ID NO: 180329 - DNA, 16 bp, Homo sapiens
ttagctgtgtgaaata

SEQ ID NO: 180330 - DNA, 12 bp, Homo sapiens
ttaggaaataaa

SEQ ID NO: 180331 - DNA, 18 bp, Homo sapiens
ttaggaaataaaaccttt

SEQ ID NO: 180332 - DNA, 21 bp, Homo sapiens
ttaggaaataaaacctttcaa

SEQ ID NO: 180333 - DNA, 15 bp, Homo sapiens
ttagggccaggcagg

SEQ ID NO: 180334 - DNA, 13 bp, Homo sapiens
ttaggtcaagaag

SEQ ID NO: 180335 - DNA, 18 bp, Homo sapiens
ttaggttggcaaaaaggc

SEQ ID NO: 180336 - DNA, 14 bp, Homo sapiens
ttagtaaagaaatg

SEQ ID NO: 180337 - DNA, 15 bp, Homo sapiens
ttagtaaagaaatga

SEQ ID NO: 180338 - DNA, 23 bp, Homo sapiens
ttagtaacatgtgttaagtattt

SEQ ID NO: 180339 - DNA, 13 bp, Homo sapiens
ttagtcatgtgac

SEQ ID NO: 180340 - DNA, 22 bp, Homo sapiens
ttagttatagtttcagatatat

SEQ ID NO: 180341 - DNA, 14 bp, Homo sapiens
ttagttccttgagt

SEQ ID NO: 180342 - DNA, 17 bp, Homo sapiens
ttagtttttgtaattta

SEQ ID NO: 180343 - DNA, 23 bp, Homo sapiens
ttataaaagaataaaattgcact

SEQ ID NO: 180344 - DNA, 20 bp, Homo sapiens
ttataactcatcataaaata

SEQ ID NO: 180345 - DNA, 15 bp, Homo sapiens
ttataatgaatgaaa

SEQ ID NO: 180346 - DNA, 16 bp, Homo sapiens
ttataattttcctaat

SEQ ID NO: 180347 - DNA, 15 bp, Homo sapiens
ttatagacaaataat

SEQ ID NO: 180348 - DNA, 21 bp, Homo sapiens
ttatagtgatgtaatcttgaa

SEQ ID NO: 180349 - DNA, 13 bp, Homo sapiens
ttatatatttata

SEQ ID NO: 180350 - DNA, 18 bp, Homo sapiens
ttatatttagttatagtt

SEQ ID NO: 180351 - DNA, 22 bp, Homo sapiens
ttatatttagttatagtttcag

SEQ ID NO: 180352 - DNA, 15 bp, Homo sapiens
ttatcaaaactttct

SEQ ID NO: 180353 - DNA, 21 bp, Homo sapiens
ttatcaccgtgggctccctga

SEQ ID NO: 180354 - DNA, 21 bp, Homo sapiens
ttatcagtcataactaaataa

SEQ ID NO: 180355 - DNA, 16 bp, Homo sapiens
ttatcattttcaaaat

SEQ ID NO: 180356 - DNA, 14 bp, Homo sapiens
ttatctctatttaa

SEQ ID NO: 180357 - DNA, 15 bp, Homo sapiens
ttatctctatttaat

SEQ ID NO: 180358 - DNA, 15 bp, Homo sapiens
ttatgagtttttgat

SEQ ID NO: 180359 - DNA, 23 bp, Homo sapiens
ttatgagtttttgatagctttat

SEQ ID NO: 180360 - DNA, 19 bp, Homo sapiens
ttatggaagattttaaatt

SEQ ID NO: 180361 - DNA, 17 bp, Homo sapiens
ttatgtcatcatacatg

SEQ ID NO: 180362 - DNA, 19 bp, Homo sapiens
ttatgtctgctgaataata

SEQ ID NO: 180363 - DNA, 20 bp, Homo sapiens
ttattaaaatgattgtaaaa

SEQ ID NO: 180364 - DNA, 19 bp, Homo sapiens
ttattaacaaattatgtta

SEQ ID NO: 180365 - DNA, 15 bp, Homo sapiens
ttattaataaacatt

SEQ ID NO: 180366 - DNA, 13 bp, Homo sapiens
ttattacctctga

SEQ ID NO: 180367 - DNA, 15 bp, Homo sapiens
ttattacctctgata

SEQ ID NO: 180368 - DNA, 17 bp, Homo sapiens
ttattagagtgtctttc

SEQ ID NO: 180369 - DNA, 13 bp, Homo sapiens
ttattcagtgtca

SEQ ID NO: 180370 - DNA, 14 bp, Homo sapiens
ttattcagtgtcac

SEQ ID NO: 180371 - DNA, 17 bp, Homo sapiens
ttattcctgataataat

SEQ ID NO: 180372 - DNA, 20 bp, Homo sapiens
ttattcctgataataattga

SEQ ID NO: 180373 - DNA, 13 bp, Homo sapiens
ttattctagatta

SEQ ID NO: 180374 - DNA, 16 bp, Homo sapiens
ttattctttttaaagt

SEQ ID NO: 180375 - DNA, 14 bp, Homo sapiens
ttattgagaaagag

SEQ ID NO: 180376 - DNA, 13 bp, Homo sapiens
ttattgcattata

SEQ ID NO: 180377 - DNA, 19 bp, Homo sapiens
ttattgtacagctgtttaa

SEQ ID NO: 180378 - DNA, 15 bp, Homo sapiens
ttattgtacctctct

SEQ ID NO: 180379 - DNA, 11 bp, Homo sapiens
ttatttcagaa

SEQ ID NO: 180380 - DNA, 17 bp, Homo sapiens
ttatttccaaataaaat

SEQ ID NO: 180381 - DNA, 18 bp, Homo sapiens
ttatttgcagagacagga

SEQ ID NO: 180382 - DNA, 13 bp, Homo sapiens
ttatttgtgtaat

SEQ ID NO: 180383 - DNA, 14 bp, Homo sapiens
ttattttaaacaaa

SEQ ID NO: 180384 - DNA, 17 bp, Homo sapiens
ttattttaaacaaaata

SEQ ID NO: 180385 - DNA, 12 bp, Homo sapiens
ttattttcagta

SEQ ID NO: 180386 - DNA, 12 bp, Homo sapiens
ttattttgcaac

SEQ ID NO: 180387 - DNA, 16 bp, Homo sapiens
ttattttttaattatt

SEQ ID NO: 180388 - DNA, 18 bp, Homo sapiens
ttattttttacattatta

SEQ ID NO: 180389 - DNA, 20 bp, Homo sapiens
ttcaacgcagccctgctttg

SEQ ID NO: 180390 - DNA, 12 bp, Homo sapiens
ttcaactcagac

SEQ ID NO: 180391 - DNA, 22 bp, Homo sapiens
ttcaagaaaacaacttcaatat

SEQ ID NO: 180392 - DNA, 17 bp, Homo sapiens
ttcaaggtggccaaatt

SEQ ID NO: 180393 - DNA, 16 bp, Homo sapiens
ttcaagtcacctcctt

SEQ ID NO: 180394 - DNA, 11 bp, Homo sapiens
ttcaatattta

SEQ ID NO: 180395 - DNA, 13 bp, Homo sapiens
ttcaattcagtgc

SEQ ID NO: 180396 - DNA, 16 bp, Homo sapiens
ttcaattcctctggga

SEQ ID NO: 180397 - DNA, 21 bp, Homo sapiens
ttcacaaccttctgtggctca

SEQ ID NO: 180398 - DNA, 15 bp, Homo sapiens
ttcacacttccacca

SEQ ID NO: 180399 - DNA, 18 bp, Homo sapiens
ttcacacttccaccagcc

SEQ ID NO: 180400 - DNA, 20 bp, Homo sapiens
ttcacacttccaccagcctg

SEQ ID NO: 180401 - DNA, 22 bp, Homo sapiens
ttcacagtgtttcgacagctga

SEQ ID NO: 180402 - DNA, 17 bp, Homo sapiens
ttcacataccctccccc

SEQ ID NO: 180403 - DNA, 20 bp, Homo sapiens
ttcacatctaacctcatctt

SEQ ID NO: 180404 - DNA, 22 bp, Homo sapiens
ttcacattaatatttgctgaca

SEQ ID NO: 180405 - DNA, 17 bp, Homo sapiens
ttcacatttttgtattt

SEQ ID NO: 180406 - DNA, 24 bp, Homo sapiens
ttcaccatttggcaatgccatcat

SEQ ID NO: 180407 - DNA, 14 bp, Homo sapiens
ttcaccccaccctt

SEQ ID NO: 180408 - DNA, 22 bp, Homo sapiens
ttcaccccagggcctgagcctg

SEQ ID NO: 180409 - DNA, 18 bp, Homo sapiens
ttcacggaagagccttgc

SEQ ID NO: 180410 - DNA, 22 bp, Homo sapiens
ttcacggaagttttcaatgatg

SEQ ID NO: 180411 - DNA, 13 bp, Homo sapiens
ttcactctctgaa

SEQ ID NO: 180412 - DNA, 18 bp, Homo sapiens
ttcactgctggctgcctt

SEQ ID NO: 180413 - DNA, 17 bp, Homo sapiens
ttcactggagttacatt

SEQ ID NO: 180414 - DNA, 21 bp, Homo sapiens
ttcactgttgaaaattatttt

SEQ ID NO: 180415 - DNA, 20 bp, Homo sapiens
ttcagaaaatattatgtgtt

SEQ ID NO: 180416 - DNA, 20 bp, Homo sapiens
ttcagacatagaattaacac

SEQ ID NO: 180417 - DNA, 10 bp, Homo sapiens
ttcagacccc

SEQ ID NO: 180418 - DNA, 15 bp, Homo sapiens
ttcagaccccagcgg

SEQ ID NO: 180419 - DNA, 15 bp, Homo sapiens
ttcagagactcaggg

SEQ ID NO: 180420 - DNA, 22 bp, Homo sapiens
ttcagaggccctcgctgccagc

SEQ ID NO: 180421 - DNA, 14 bp, Homo sapiens
ttcagcactgtccc

SEQ ID NO: 180422 - DNA, 15 bp, Homo sapiens
ttcagcactgtccct

SEQ ID NO: 180423 - DNA, 16 bp, Homo sapiens
ttcagcactgtccctt

SEQ ID NO: 180424 - DNA, 19 bp, Homo sapiens
ttcagcccctcctctgcca

SEQ ID NO: 180425 - DNA, 22 bp, Homo sapiens
ttcagcctagccgacctcagcc

SEQ ID NO: 180426 - DNA, 15 bp, Homo sapiens
ttcagcctctttctg

SEQ ID NO: 180427 - DNA, 21 bp, Homo sapiens
ttcaggggagtcccgtcagga

SEQ ID NO: 180428 - DNA, 22 bp, Homo sapiens
ttcagggggccaggtgcacaga

SEQ ID NO: 180429 - DNA, 14 bp, Homo sapiens
ttcaggtactaaat

SEQ ID NO: 180430 - DNA, 14 bp, Homo sapiens
ttcagtaagccgtg

SEQ ID NO: 180431 - DNA, 17 bp, Homo sapiens
ttcagtatgttgtcaaa

SEQ ID NO: 180432 - DNA, 19 bp, Homo sapiens
ttcagtatgttgtcaaaga

SEQ ID NO: 180433 - DNA, 18 bp, Homo sapiens
ttcagtattttggagaaa

SEQ ID NO: 180434 - DNA, 12 bp, Homo sapiens
ttcagtggagaa

SEQ ID NO: 180435 - DNA, 14 bp, Homo sapiens
ttcagtgggagaaa

SEQ ID NO: 180436 - DNA, 22 bp, Homo sapiens
ttcagtgttaaatgtgatgaat

SEQ ID NO: 180437 - DNA, 18 bp, Homo sapiens
ttcatacacagcctgggc

SEQ ID NO: 180438 - DNA, 14 bp, Homo sapiens
ttcatagatttcct

SEQ ID NO: 180439 - DNA, 13 bp, Homo sapiens
ttcatatgctgta

SEQ ID NO: 180440 - DNA, 20 bp, Homo sapiens
ttcatatgtaccatgtacat

SEQ ID NO: 180441 - DNA, 15 bp, Homo sapiens
ttcatcaatgaatga

SEQ ID NO: 180442 - DNA, 15 bp, Homo sapiens
ttcatccactagtgc

SEQ ID NO: 180443 - DNA, 16 bp, Homo sapiens
ttcatctatttctgag

SEQ ID NO: 180444 - DNA, 18 bp, Homo sapiens
ttcatctatttctgagaa

SEQ ID NO: 180445 - DNA, 17 bp, Homo sapiens
ttcatggcagaaggcaa

SEQ ID NO: 180446 - DNA, 19 bp, Homo sapiens
ttcatgtaaactgtgcacc

SEQ ID NO: 180447 - DNA, 9 bp, Homo sapiens
ttcattcag

SEQ ID NO: 180448 - DNA, 19 bp, Homo sapiens
ttcattcttgaaagctgtg

SEQ ID NO: 180449 - DNA, 14 bp, Homo sapiens
ttcatttaaaatga

SEQ ID NO: 180450 - DNA, 17 bp, Homo sapiens
ttcatttaaaatgatta

SEQ ID NO: 180451 - DNA, 15 bp, Homo sapiens
ttcatttcaactgtt

SEQ ID NO: 180452 - DNA, 15 bp, Homo sapiens
ttcatttttcctaac

SEQ ID NO: 180453 - DNA, 15 bp, Homo sapiens
ttccaaattctgctt

SEQ ID NO: 180454 - DNA, 15 bp, Homo sapiens
ttccaaccccaactc

SEQ ID NO: 180455 - DNA, 20 bp, Homo sapiens
ttccacaagattcccagaga

SEQ ID NO: 180456 - DNA, 21 bp, Homo sapiens
ttccacagcctgcaagtcagt

SEQ ID NO: 180457 - DNA, 11 bp, Homo sapiens
ttccaccagcc

SEQ ID NO: 180458 - DNA, 24 bp, Homo sapiens
ttccacggagccactcctctgact

SEQ ID NO: 180459 - DNA, 19 bp, Homo sapiens
ttccagaatatctgggatt

SEQ ID NO: 180460 - DNA, 17 bp, Homo sapiens
ttccagagagtggctcc

SEQ ID NO: 180461 - DNA, 18 bp, Homo sapiens
ttccagagagtggctcct

SEQ ID NO: 180462 - DNA, 20 bp, Homo sapiens
ttgtatctcttttgaatcca

SEQ ID NO: 180463 - DNA, 21 bp, Homo sapiens
ttgtatctgcaggcagacacg

SEQ ID NO: 180464 - DNA, 19 bp, Homo sapiens
ttgtatgttaagttacttc

SEQ ID NO: 180465 - DNA, 16 bp, Homo sapiens
ttgtattctctgagct

SEQ ID NO: 180466 - DNA, 16 bp, Homo sapiens
ttgtattgtttcaatt

SEQ ID NO: 180467 - DNA, 18 bp, Homo sapiens
ttgtcagatatgatatgt

SEQ ID NO: 180468 - DNA, 21 bp, Homo sapiens
ttgtcatataagattcatatt

SEQ ID NO: 180469 - DNA, 21 bp, Homo sapiens
ttgtcatctttcttctatttt

SEQ ID NO: 180470 - DNA, 13 bp, Homo sapiens
ttgtccagcgcct

SEQ ID NO: 180471 - DNA, 23 bp, Homo sapiens
ttgtcccatttctaaaggcctct

SEQ ID NO: 180472 - DNA, 12 bp, Homo sapiens
ttgtctctgggc

SEQ ID NO: 180473 - DNA, 18 bp, Homo sapiens
ttgtctgaagtcactgca

SEQ ID NO: 180474 - DNA, 22 bp, Homo sapiens
ttgtcttaaaaagtggaaaaat

SEQ ID NO: 180475 - DNA, 23 bp, Homo sapiens
ttgtctttgtaatgtcaccacct

SEQ ID NO: 180476 - DNA, 22 bp, Homo sapiens
ttgtgagtttaccttgtatact

SEQ ID NO: 180477 - DNA, 12 bp, Homo sapiens
ttgtgcccctgc

SEQ ID NO: 180478 - DNA, 16 bp, Homo sapiens
ttgtgccttttatagc

SEQ ID NO: 180479 - DNA, 17 bp, Homo sapiens
ttgtggggatgatgaaa

SEQ ID NO: 180480 - DNA, 14 bp, Homo sapiens
ttgtggtttatgtc

SEQ ID NO: 180481 - DNA, 15 bp, Homo sapiens
ttgtgtacagttatt

SEQ ID NO: 180482 - DNA, 17 bp, Homo sapiens
ttgttaatggtgcaaat

SEQ ID NO: 180483 - DNA, 13 bp, Homo sapiens
ttgttattttcag

SEQ ID NO: 180484 - DNA, 15 bp, Homo sapiens
ttgttattttgcaac

SEQ ID NO: 180485 - DNA, 19 bp, Homo sapiens
ttgttcaataataaatatt

SEQ ID NO: 180486 - DNA, 13 bp, Homo sapiens
ttgttcacactct

SEQ ID NO: 180487 - DNA, 15 bp, Homo sapiens
ttgttctagttttca

SEQ ID NO: 180488 - DNA, 16 bp, Homo sapiens
ttgttctagttttcag

SEQ ID NO: 180489 - DNA, 21 bp, Homo sapiens
ttgttggaaaagaatacagaa

SEQ ID NO: 180490 - DNA, 17 bp, Homo sapiens
ttgtttaaaatcatttc

SEQ ID NO: 180491 - DNA, 20 bp, Homo sapiens
ttgtttattctttttaaagt

SEQ ID NO: 180492 - DNA, 19 bp, Homo sapiens
ttgttttatcatgacatgt

SEQ ID NO: 180493 - DNA, 14 bp, Homo sapiens
ttgttttcattatc

SEQ ID NO: 180494 - DNA, 18 bp, Homo sapiens
ttgttttcttctgtatgt

SEQ ID NO: 180495 - DNA, 21 bp, Homo sapiens
ttgtttttccttgtatttaaa

SEQ ID NO: 180496 - DNA, 19 bp, Homo sapiens
ttgttttttttttccactt

SEQ ID NO: 180497 - DNA, 20 bp, Homo sapiens
tttaaatacagtcttccatt

SEQ ID NO: 180498 - DNA, 20 bp, Homo sapiens
tttaaattataacttaaaat

SEQ ID NO: 180499 - DNA, 19 bp, Homo sapiens
tttaacacaagtcctgtga

SEQ ID NO: 180500 - DNA, 21 bp, Homo sapiens
tttaaccaaaggtgaaggaat

SEQ ID NO: 180501 - DNA, 22 bp, Homo sapiens
tttaacgaatgaagatgtctaa

SEQ ID NO: 180502 - DNA, 14 bp, Homo sapiens
tttaactgccttgt

SEQ ID NO: 180503 - DNA, 22 bp, Homo sapiens
tttaagacagtcccatcaaaac

SEQ ID NO: 180504 - DNA, 21 bp, Homo sapiens
ttttaaccaaaggtgaaggaa

SEQ ID NO: 180505 - DNA, 16 bp, Homo sapiens
ttttaactagaattta

SEQ ID NO: 180506 - DNA, 20 bp, Homo sapiens
ttttaagggtttgtggaaaa

SEQ ID NO: 180507 - DNA, 14 bp, Homo sapiens
ttttaagttgctga

SEQ ID NO: 180508 - DNA, 11 bp, Homo sapiens
ttttaattatt

SEQ ID NO: 180509 - DNA, 20 bp, Homo sapiens
ttttaattattatttatata

SEQ ID NO: 180510 - DNA, 15 bp, Homo sapiens
ttttaattgattatt

SEQ ID NO: 180511 - DNA, 16 bp, Homo sapiens
ttttacagctgcctgc

SEQ ID NO: 180512 - DNA, 15 bp, Homo sapiens
ttttacattctgaat

SEQ ID NO: 180513 - DNA, 21 bp, Homo sapiens
ttttagaccctattgctgctt

SEQ ID NO: 180514 - DNA, 23 bp, Homo sapiens
ttttatatttagttatagtttca

SEQ ID NO: 180515 - DNA, 15 bp, Homo sapiens
ttttatcatgacatg

SEQ ID NO: 180516 - DNA, 12 bp, Homo sapiens
ttttattaaatt

SEQ ID NO: 180517 - DNA, 14 bp, Homo sapiens
ttttattcaagtta

SEQ ID NO: 180518 - DNA, 14 bp, Homo sapiens
ttttattgttttca

SEQ ID NO: 180519 - DNA, 15 bp, Homo sapiens
ttttatttgacaaaa

SEQ ID NO: 180520 - DNA, 13 bp, Homo sapiens
ttttatttttcta

SEQ ID NO: 180521 - DNA, 21 bp, Homo sapiens
ttttcaacgcagccctgcttt

SEQ ID NO: 180522 - DNA, 22 bp, Homo sapiens
ttttcaacgcagccctgctttg

SEQ ID NO: 180523 - DNA, 16 bp, Homo sapiens
ttttcaatatttatta

SEQ ID NO: 180524 - DNA, 15 bp, Homo sapiens
ttttcacggaagttt

SEQ ID NO: 180525 - DNA, 19 bp, Homo sapiens
ttttcacggaagttttcaa

SEQ ID NO: 180526 - DNA, 19 bp, Homo sapiens
ttttcactgctggctgcct

SEQ ID NO: 180527 - DNA, 22 bp, Homo sapiens
ttttcagaaaatattatgtgtt

SEQ ID NO: 180528 - DNA, 23 bp, Homo sapiens
ttttcagaaaatattatgtgttt

SEQ ID NO: 180529 - DNA, 11 bp, Homo sapiens
ttttcagaccc

SEQ ID NO: 180530 - DNA, 16 bp, Homo sapiens
ttttcagactcagact

SEQ ID NO: 180531 - DNA, 15 bp, Homo sapiens
ttttcatctgttgtt

SEQ ID NO: 180532 - DNA, 21 bp, Homo sapiens
ttttcatgattttgaaaccat

SEQ ID NO: 180533 - DNA, 19 bp, Homo sapiens
ttttccaggtttaagctgt

SEQ ID NO: 180534 - DNA, 16 bp, Homo sapiens
ttttcccccctagaaa

SEQ ID NO: 180535 - DNA, 19 bp, Homo sapiens
ttttccccggtcccttgag

SEQ ID NO: 180536 - DNA, 13 bp, Homo sapiens
ttttcctaagtga

SEQ ID NO: 180537 - DNA, 20 bp, Homo sapiens
ttttcctaataaagttctgt

SEQ ID NO: 180538 - DNA, 17 bp, Homo sapiens
ttttctttgaatgcttt

SEQ ID NO: 180539 - DNA, 19 bp, Homo sapiens
ttttgaagtagtttgtata

SEQ ID NO: 180540 - DNA, 11 bp, Homo sapiens
ttttgagaaag

SEQ ID NO: 180541 - DNA, 14 bp, Homo sapiens
ttttgagttctaca

SEQ ID NO: 180542 - DNA, 23 bp, Homo sapiens
ttttgatgaacaaaatttcctaa

SEQ ID NO: 180543 - DNA, 21 bp, Homo sapiens
ttttgcaacctcgctggactc

SEQ ID NO: 180544 - DNA, 23 bp, Homo sapiens
ttttgcaagtgaaggtttacaat

SEQ ID NO: 180545 - DNA, 21 bp, Homo sapiens
ttttgcagcccagacaaatgt

SEQ ID NO: 180546 - DNA, 19 bp, Homo sapiens
ttttgcatttgaataaagc

SEQ ID NO: 180547 - DNA, 18 bp, Homo sapiens
ttttgcccttcacagtgt

SEQ ID NO: 180548 - DNA, 15 bp, Homo sapiens
ttttgtaaagatgcc

SEQ ID NO: 180549 - DNA, 22 bp, Homo sapiens
ttttgtaggggtcaaagaaatg

SEQ ID NO: 180550 - DNA, 15 bp, Homo sapiens
ttttgttttcattat

SEQ ID NO: 180551 - DNA, 17 bp, Homo sapiens
tttttaaaatatttatt

SEQ ID NO: 180552 - DNA, 18 bp, Homo sapiens
tttttaataaaaaggcac

SEQ ID NO: 180553 - DNA, 13 bp, Homo sapiens
tttttacaataaa

SEQ ID NO: 180554 - DNA, 16 bp, Homo sapiens
tttttactacagttgt

SEQ ID NO: 180555 - DNA, 23 bp, Homo sapiens
tttttatctccccttcacatgca

SEQ ID NO: 180556 - DNA, 19 bp, Homo sapiens
tttttcaaagatgtgttgc

SEQ ID NO: 180557 - DNA, 16 bp, Homo sapiens
tttttcacggaagttt

SEQ ID NO: 180558 - DNA, 14 bp, Homo sapiens
tttttccccaaagt

SEQ ID NO: 180559 - DNA, 16 bp, Homo sapiens
tttttccccaaagtct

SEQ ID NO: 180560 - DNA, 14 bp, Homo sapiens
tttttgaagtgtag

SEQ ID NO: 180561 - DNA, 15 bp, Homo sapiens
tttttgcaagtgaag

SEQ ID NO: 180562 - DNA, 13 bp, Homo sapiens
tttttgtcttttc

SEQ ID NO: 180563 - DNA, 19 bp, Homo sapiens
ttttttaaccaaaggtgaa

SEQ ID NO: 180564 - DNA, 13 bp, Homo sapiens
ttttttatgctaa

SEQ ID NO: 180565 - DNA, 18 bp, Homo sapiens
ttttttcaatatttatta

SEQ ID NO: 180566 - DNA, 16 bp, Homo sapiens
ttctgagtttcattct

SEQ ID NO: 180567 - DNA, 19 bp, Homo sapiens
ttctgagtttcattctcct

SEQ ID NO: 180568 - DNA, 23 bp, Homo sapiens
ttctgagtttcattctcctgcct

SEQ ID NO: 180569 - DNA, 21 bp, Homo sapiens
ttctgcaagcacatctgcatt

SEQ ID NO: 180570 - DNA, 16 bp, Homo sapiens
ttctgctacctcactg

SEQ ID NO: 180571 - DNA, 21 bp, Homo sapiens
ttctgctacctcactggggtc

SEQ ID NO: 180572 - DNA, 14 bp, Homo sapiens
ttctgctcatcatt

SEQ ID NO: 180573 - DNA, 19 bp, Homo sapiens
ttctgctcatcattctctg

SEQ ID NO: 180574 - DNA, 14 bp, Homo sapiens
ttctgggagggcag

SEQ ID NO: 180575 - DNA, 19 bp, Homo sapiens
ttctgtaaactcaaaactt

SEQ ID NO: 180576 - DNA, 16 bp, Homo sapiens
ttctgtaggttctgtg

SEQ ID NO: 180577 - DNA, 18 bp, Homo sapiens
ttctgtattttgtttttg

SEQ ID NO: 180578 - DNA, 15 bp, Homo sapiens
ttctgtccctcacag

SEQ ID NO: 180579 - DNA, 14 bp, Homo sapiens
ttctgtcccttctg

SEQ ID NO: 180580 - DNA, 16 bp, Homo sapiens
ttctgtctcatatgat

SEQ ID NO: 180581 - DNA, 17 bp, Homo sapiens
ttctgtcttcacaacag

SEQ ID NO: 180582 - DNA, 22 bp, Homo sapiens
ttcttaaggattgtgatatttt

SEQ ID NO: 180583 - DNA, 19 bp, Homo sapiens
ttcttattctcactccacc

SEQ ID NO: 180584 - DNA, 14 bp, Homo sapiens
ttcttatttcatga

SEQ ID NO: 180585 - DNA, 16 bp, Homo sapiens
ttcttatttcatgaaa

SEQ ID NO: 180586 - DNA, 21 bp, Homo sapiens
ttcttcattcaatacaagtgt

SEQ ID NO: 180587 - DNA, 20 bp, Homo sapiens
ttcttccaggtgcccagcta

SEQ ID NO: 180588 - DNA, 13 bp, Homo sapiens
ttcttccatccca

SEQ ID NO: 180589 - DNA, 17 bp, Homo sapiens
ttcttccatcccaggac

SEQ ID NO: 180590 - DNA, 18 bp, Homo sapiens
ttcttctaggttctaaaa

SEQ ID NO: 180591 - DNA, 14 bp, Homo sapiens
ttcttgaaagctgt

SEQ ID NO: 180592 - DNA, 21 bp, Homo sapiens
ttcttgcctactatgccagat

SEQ ID NO: 180593 - DNA, 15 bp, Homo sapiens
ttctttcttcctctg

SEQ ID NO: 180594 - DNA, 15 bp, Homo sapiens
ttctttgaaattgtt

SEQ ID NO: 180595 - DNA, 11 bp, Homo sapiens
ttctttgaatg

SEQ ID NO: 180596 - DNA, 12 bp, Homo sapiens
ttcttttgtaaa

SEQ ID NO: 180597 - DNA, 16 bp, Homo sapiens
ttgaaaagactccaaa

SEQ ID NO: 180598 - DNA, 22 bp, Homo sapiens
ttgaaaagactccaaagaaatg

SEQ ID NO: 180599 - DNA, 19 bp, Homo sapiens
ttgaaaccaccttttatta

SEQ ID NO: 180600 - DNA, 23 bp, Homo sapiens
ttgaaactgagatgtgaacacat

SEQ ID NO: 180601 - DNA, 18 bp, Homo sapiens
ttgaaattatgtatgttt

SEQ ID NO: 180602 - DNA, 19 bp, Homo sapiens
ttgaaattgtttaagtgtt

SEQ ID NO: 180603 - DNA, 13 bp, Homo sapiens
ttgaacactgggg

SEQ ID NO: 180604 - DNA, 17 bp, Homo sapiens
ttgaagtgtaggcagac

SEQ ID NO: 180605 - DNA, 18 bp, Homo sapiens
ttgaagtgtaggcagaca

SEQ ID NO: 180606 - DNA, 21 bp, Homo sapiens
ttgaataaagcctgcttttta

SEQ ID NO: 180607 - DNA, 19 bp, Homo sapiens
ttgaatatattataatctt

SEQ ID NO: 180608 - DNA, 13 bp, Homo sapiens
ttgaatcacagta

SEQ ID NO: 180609 - DNA, 21 bp, Homo sapiens
ttgaatgacaacagaagcttc

SEQ ID NO: 180610 - DNA, 15 bp, Homo sapiens
ttgaatgctttttga

SEQ ID NO: 180611 - DNA, 23 bp, Homo sapiens
ttgaatgttatttgttattttca

SEQ ID NO: 180612 - DNA, 23 bp, Homo sapiens
ttgaattagaaacataaataaaa

SEQ ID NO: 180613 - DNA, 18 bp, Homo sapiens
ttgacaaaggcaagcact

SEQ ID NO: 180614 - DNA, 16 bp, Homo sapiens
ttgacaaccatgagac

SEQ ID NO: 180615 - DNA, 18 bp, Homo sapiens
ttgacaataaatgtgctt

SEQ ID NO: 180616 - DNA, 18 bp, Homo sapiens
ttgacaataatttcaggt

SEQ ID NO: 180617 - DNA, 12 bp, Homo sapiens
ttgacacctgct

SEQ ID NO: 180618 - DNA, 17 bp, Homo sapiens
ttgacacttaaaaatgg

SEQ ID NO: 180619 - DNA, 15 bp, Homo sapiens
atccacccagcccat

SEQ ID NO: 180620 - DNA, 13 bp, Homo sapiens
atccacctgtctc

SEQ ID NO: 180621 - DNA, 18 bp, Homo sapiens
atccacctgtctcagcct

SEQ ID NO: 180622 - DNA, 21 bp, Homo sapiens
atccacctgtctcagcctccc

SEQ ID NO: 180623 - DNA, 22 bp, Homo sapiens
atccagagtttagaggaaaaaa

SEQ ID NO: 180624 - DNA, 14 bp, Homo sapiens
atccaggtaatcca

SEQ ID NO: 180625 - DNA, 13 bp, Homo sapiens
atccatcaggcca

SEQ ID NO: 180626 - DNA, 16 bp, Homo sapiens
atccatgggggcaggg

SEQ ID NO: 180627 - DNA, 19 bp, Homo sapiens
atccatgggggcagggcat

SEQ ID NO: 180628 - DNA, 18 bp, Homo sapiens
atccattcctcagggaca

SEQ ID NO: 180629 - DNA, 20 bp, Homo sapiens
atccatttcatctatttctg

SEQ ID NO: 180630 - DNA, 22 bp, Homo sapiens
atccatttcatctatttctgag

SEQ ID NO: 180631 - DNA, 22 bp, Homo sapiens
atcccaaagccttgtgtctaca

SEQ ID NO: 180632 - DNA, 16 bp, Homo sapiens
atcccacttgcccctg

SEQ ID NO: 180633 - DNA, 22 bp, Homo sapiens
atcccagcactttgggaggctg

SEQ ID NO: 180634 - DNA, 16 bp, Homo sapiens
atgacagatgttgaat

SEQ ID NO: 180635 - DNA, 14 bp, Homo sapiens
attcacaatagaaa

SEQ ID NO: 180636 - DNA, 20 bp, Homo sapiens
attcacatctaacctcatct

SEQ ID NO: 180637 - DNA, 19 bp, Homo sapiens
attcacccagacagctccc

SEQ ID NO: 180638 - DNA, 13 bp, Homo sapiens
attcacctgagca

SEQ ID NO: 180639 - DNA, 23 bp, Homo sapiens
attcaccttccagtgtctcggag

SEQ ID NO: 180640 - DNA, 14 bp, Homo sapiens
attcacttgcattt

SEQ ID NO: 180641 - DNA, 19 bp, Homo sapiens
attcagattttaaaaagtc

SEQ ID NO: 180642 - DNA, 20 bp, Homo sapiens
attcagcactgatttcacaa

SEQ ID NO: 180643 - DNA, 14 bp, Homo sapiens
attcagtgcttctt

SEQ ID NO: 180644 - DNA, 19 bp, Homo sapiens
attcagtgcttcttaaaga

SEQ ID NO: 180645 - DNA, 14 bp, Homo sapiens
attcagtgtcactg

SEQ ID NO: 180646 - DNA, 18 bp, Homo sapiens
attcatatttacttctta

SEQ ID NO: 180647 - DNA, 20 bp, Homo sapiens
attcatatttacttcttata

SEQ ID NO: 180648 - DNA, 16 bp, Homo sapiens
attcatattttctttc

SEQ ID NO: 180649 - DNA, 15 bp, Homo sapiens
attcatttaaaatga

SEQ ID NO: 180650 - DNA, 16 bp, Homo sapiens
attcatttaaaatgat

SEQ ID NO: 180651 - DNA, 19 bp, Homo sapiens
attcatttgagttatttta

SEQ ID NO: 180652 - DNA, 16 bp, Homo sapiens
attccacctgcaatca

SEQ ID NO: 180653 - DNA, 12 bp, Homo sapiens
attccagaatat

SEQ ID NO: 180654 - DNA, 16 bp, Homo sapiens
attccagaatatctgg

SEQ ID NO: 180655 - DNA, 18 bp, Homo sapiens
attccagagacatcagca

SEQ ID NO: 180656 - DNA, 18 bp, Homo sapiens
attccagagagtggctcc

SEQ ID NO: 180657 - DNA, 19 bp, Homo sapiens
attccagagagtggctcct

SEQ ID NO: 180658 - DNA, 15 bp, Homo sapiens
attccattgtgtgag

SEQ ID NO: 180659 - DNA, 12 bp, Homo sapiens
attcccagagac

SEQ ID NO: 180660 - DNA, 22 bp, Homo sapiens
attcccagggaagtgctctgat

SEQ ID NO: 180661 - DNA, 22 bp, Homo sapiens
attccccaccctgaaagccctg

SEQ ID NO: 180662 - DNA, 21 bp, Homo sapiens
attccccaggtggctgaccca

SEQ ID NO: 180663 - DNA, 17 bp, Homo sapiens
attccccattgcctcct

SEQ ID NO: 180664 - DNA, 21 bp, Homo sapiens
attccctagaaacttccaaat

SEQ ID NO: 180665 - DNA, 16 bp, Homo sapiens
attccctctctctgac

SEQ ID NO: 180666 - DNA, 20 bp, Homo sapiens
attccctctctctgactctc

SEQ ID NO: 180667 - DNA, 20 bp, Homo sapiens
attccctgagtcaccaggaa

SEQ ID NO: 180668 - DNA, 13 bp, Homo sapiens
attcctctgggaa

SEQ ID NO: 180669 - DNA, 13 bp, Homo sapiens
attcctgcagcct

SEQ ID NO: 180670 - DNA, 15 bp, Homo sapiens
attcctgcatttgtg

SEQ ID NO: 180671 - DNA, 15 bp, Homo sapiens
attcctgcctgtctc

SEQ ID NO: 180672 - DNA, 17 bp, Homo sapiens
attcctgcctgtctcct

SEQ ID NO: 180673 - DNA, 21 bp, Homo sapiens
attccttagcttagacctcag

SEQ ID NO: 180674 - DNA, 22 bp, Homo sapiens
attccttagcttagacctcagc

SEQ ID NO: 180675 - DNA, 16 bp, Homo sapiens
attcctttgaagagga

SEQ ID NO: 180676 - DNA, 21 bp, Homo sapiens
attcggtgtgcaccagggttg

SEQ ID NO: 180677 - DNA, 17 bp, Homo sapiens
attctaaatgaatgttt

SEQ ID NO: 180678 - DNA, 15 bp, Homo sapiens
attctaagtgaaatt

SEQ ID NO: 180679 - DNA, 17 bp, Homo sapiens
attctactttaagcact

SEQ ID NO: 180680 - DNA, 15 bp, Homo sapiens
attctagctttgagc

SEQ ID NO: 180681 - DNA, 15 bp, Homo sapiens
attctatctattcct

SEQ ID NO: 180682 - DNA, 15 bp, Homo sapiens
attctcatgtgatcc

SEQ ID NO: 180683 - DNA, 12 bp, Homo sapiens
attctctgtctc

SEQ ID NO: 180684 - DNA, 14 bp, Homo sapiens
attctctgtctcat

SEQ ID NO: 180685 - DNA, 17 bp, Homo sapiens
attctctgtctcatcca

SEQ ID NO: 180686 - DNA, 20 bp, Homo sapiens
attctgaccacccttctcat

SEQ ID NO: 180687 - DNA, 14 bp, Homo sapiens
attctgattacaca

SEQ ID NO: 180688 - DNA, 15 bp, Homo sapiens
attctgattacacaa

SEQ ID NO: 180689 - DNA, 19 bp, Homo sapiens
attctgcaagcacatctgc

SEQ ID NO: 180690 - DNA, 14 bp, Homo sapiens
attctgccaggccc

SEQ ID NO: 180691 - DNA, 23 bp, Homo sapiens
attctgccaggcccccaagcctg

SEQ ID NO: 180692 - DNA, 17 bp, Homo sapiens
attcttatttcatgaaa

SEQ ID NO: 180693 - DNA, 18 bp, Homo sapiens
attcttgaaggaaaatga

SEQ ID NO: 180694 - DNA, 13 bp, Homo sapiens
attcttgagttta

SEQ ID NO: 180695 - DNA, 18 bp, Homo sapiens
attcttggttgaggaaac

SEQ ID NO: 180696 - DNA, 18 bp, Homo sapiens
attcttttaaaagacaag

SEQ ID NO: 180697 - DNA, 16 bp, Homo sapiens
attctttttaaagtat

SEQ ID NO: 180698 - DNA, 18 bp, Homo sapiens
attgaaaaaatagagcct

SEQ ID NO: 180699 - DNA, 22 bp, Homo sapiens
attgaaaaaatagagcctgagg

SEQ ID NO: 180700 - DNA, 14 bp, Homo sapiens
attgaacccaggag

SEQ ID NO: 180701 - DNA, 20 bp, Homo sapiens
attgaattcttggttgagga

SEQ ID NO: 180702 - DNA, 19 bp, Homo sapiens
attgacacttaaaaatggt

SEQ ID NO: 180703 - DNA, 18 bp, Homo sapiens
attgacccacaagaaatg

SEQ ID NO: 180704 - DNA, 21 bp, Homo sapiens
attgacgacaagtgctgaaca

SEQ ID NO: 180705 - DNA, 14 bp, Homo sapiens
attgacttgtatat

SEQ ID NO: 180706 - DNA, 17 bp, Homo sapiens
attgagaaagagcactt

SEQ ID NO: 180707 - DNA, 21 bp, Homo sapiens
attgagaaagagcacttaaga

SEQ ID NO: 180708 - DNA, 16 bp, Homo sapiens
attgagaaggagagaa

SEQ ID NO: 180709 - DNA, 21 bp, Homo sapiens
attgagaattttaaattataa

SEQ ID NO: 180710 - DNA, 17 bp, Homo sapiens
attgatcaaattcattt

SEQ ID NO: 180711 - DNA, 19 bp, Homo sapiens
attgatcggagcctcctct

SEQ ID NO: 180712 - DNA, 15 bp, Homo sapiens
attgcacattgtaaa

SEQ ID NO: 180713 - DNA, 15 bp, Homo sapiens
attgcactccagcct

SEQ ID NO: 180714 - DNA, 16 bp, Homo sapiens
attgcactccagcctg

SEQ ID NO: 180715 - DNA, 19 bp, Homo sapiens
attgcactccagcctgggc

SEQ ID NO: 180716 - DNA, 15 bp, Homo sapiens
attgcatctcccaga

SEQ ID NO: 180717 - DNA, 22 bp, Homo sapiens
attgcatctcccagataatgtg

SEQ ID NO: 180718 - DNA, 13 bp, Homo sapiens
attgcatctgtat

SEQ ID NO: 180719 - DNA, 14 bp, Homo sapiens
attgcatctgtata

SEQ ID NO: 180720 - DNA, 20 bp, Homo sapiens
attgctgccccatcagtgct

SEQ ID NO: 180721 - DNA, 20 bp, Homo sapiens
attgctggcaaagacagaag

SEQ ID NO: 180722 - DNA, 14 bp, Homo sapiens
attgcttacatttt

SEQ ID NO: 180723 - DNA, 18 bp, Homo sapiens
attgctttggtcatatga

SEQ ID NO: 180724 - DNA, 18 bp, Homo sapiens
attggattattcatttaa

SEQ ID NO: 180725 - DNA, 22 bp, Homo sapiens
attggattattcatttaaaatg

SEQ ID NO: 180726 - DNA, 19 bp, Homo sapiens
attggggaagactgtggct

SEQ ID NO: 180727 - DNA, 14 bp, Homo sapiens
attggtccagcttg

SEQ ID NO: 180728 - DNA, 15 bp, Homo sapiens
attggtccagcttgc

SEQ ID NO: 180729 - DNA, 15 bp, Homo sapiens
attgtaaaatagctt

SEQ ID NO: 180730 - DNA, 19 bp, Homo sapiens
attgtaaaatagcttgtat

SEQ ID NO: 180731 - DNA, 15 bp, Homo sapiens
attgtaaatgtgctt

SEQ ID NO: 180732 - DNA, 17 bp, Homo sapiens
attgtaaatgtgctttt

SEQ ID NO: 180733 - DNA, 19 bp, Homo sapiens
attgtaactgttcttgaat

SEQ ID NO: 180734 - DNA, 17 bp, Homo sapiens
attgtacagctgtttaa

SEQ ID NO: 180735 - DNA, 21 bp, Homo sapiens
attgtggggatgatgaaataa

SEQ ID NO: 180736 - DNA, 12 bp, Homo sapiens
cggccacctctg

SEQ ID NO: 180737 - DNA, 12 bp, Homo sapiens
cggcccacagct

SEQ ID NO: 180738 - DNA, 15 bp, Homo sapiens
cggcccacagctccc

SEQ ID NO: 180739 - DNA, 17 bp, Homo sapiens
cggccccctccatcggg

SEQ ID NO: 180740 - DNA, 11 bp, Homo sapiens
cggccctgggg

SEQ ID NO: 180741 - DNA, 12 bp, Homo sapiens
cggccctggggc

SEQ ID NO: 180742 - DNA, 13 bp, Homo sapiens
cggccgcattccc

SEQ ID NO: 180743 - DNA, 13 bp, Homo sapiens
cggcgccaccatc

SEQ ID NO: 180744 - DNA, 13 bp, Homo sapiens
cggctactcagca

SEQ ID NO: 180745 - DNA, 19 bp, Homo sapiens
cggctactcagcagccctc

SEQ ID NO: 180746 - DNA, 20 bp, Homo sapiens
cggctcgagcagtcctgcct

SEQ ID NO: 180747 - DNA, 16 bp, Homo sapiens
cggcttttctcagctg

SEQ ID NO: 180748 - DNA, 23 bp, Homo sapiens
cgggaaggagggttagggagggg

SEQ ID NO: 180749 - DNA, 20 bp, Homo sapiens
cgggagcggtggccctgtcc

SEQ ID NO: 180750 - DNA, 20 bp, Homo sapiens
cgggaggcagaggttgcagt

SEQ ID NO: 180751 - DNA, 17 bp, Homo sapiens
cgggaggtcgaggcagg

SEQ ID NO: 180752 - DNA, 21 bp, Homo sapiens
cgggcatggtggcgcaagcct

SEQ ID NO: 180753 - DNA, 16 bp, Homo sapiens
cgggctgggagctctg

SEQ ID NO: 180754 - DNA, 20 bp, Homo sapiens
cgggctgggagctctgcaga

SEQ ID NO: 180755 - DNA, 14 bp, Homo sapiens
cgggctgggcagct

SEQ ID NO: 180756 - DNA, 15 bp, Homo sapiens
cggggaactcctgga

SEQ ID NO: 180757 - DNA, 13 bp, Homo sapiens
cgggtctgcctct

SEQ ID NO: 180758 - DNA, 21 bp, Homo sapiens
cgggttttattgtttaaaatc

SEQ ID NO: 180759 - DNA, 18 bp, Homo sapiens
cggtcccctccgccaggc

SEQ ID NO: 180760 - DNA, 19 bp, Homo sapiens
cggtgcctgggtggggctg

SEQ ID NO: 180761 - DNA, 14 bp, Homo sapiens
cggtggccctgtcc

SEQ ID NO: 180762 - DNA, 14 bp, Homo sapiens
cggttcaccagcct

SEQ ID NO: 180763 - DNA, 16 bp, Homo sapiens
cggttcaccagcctct

SEQ ID NO: 180764 - DNA, 19 bp, Homo sapiens
cggttccacgtccccctgg

SEQ ID NO: 180765 - DNA, 20 bp, Homo sapiens
cggttccacgtccccctggg

SEQ ID NO: 180766 - DNA, 17 bp, Homo sapiens
cgtagtagggtcaggcc

SEQ ID NO: 180767 - DNA, 22 bp, Homo sapiens
cgtagttccctgaaaacccaga

SEQ ID NO: 180768 - DNA, 22 bp, Homo sapiens
cgtatatgtctcaggtccctgc

SEQ ID NO: 180769 - DNA, 19 bp, Homo sapiens
cgtcatcacttttcagtga

SEQ ID NO: 180770 - DNA, 22 bp, Homo sapiens
cgtccaccatggggtcctacca

SEQ ID NO: 180771 - DNA, 20 bp, Homo sapiens
cgtccggcagttctgggtgc

SEQ ID NO: 180772 - DNA, 22 bp, Homo sapiens
cgtcctcacccctgtcctcact

SEQ ID NO: 180773 - DNA, 13 bp, Homo sapiens
cgtcctccccctg

SEQ ID NO: 180774 - DNA, 15 bp, Homo sapiens
cgtcctccccctgcc

SEQ ID NO: 180775 - DNA, 16 bp, Homo sapiens
cgtcctccccctgcca

SEQ ID NO: 180776 - DNA, 12 bp, Homo sapiens
cgtcctcctctg

SEQ ID NO: 180777 - DNA, 13 bp, Homo sapiens
cgtcctcctctgt

SEQ ID NO: 180778 - DNA, 15 bp, Homo sapiens
cgtcctcctctgtga

SEQ ID NO: 180779 - DNA, 14 bp, Homo sapiens
cgtcctgccacctg

SEQ ID NO: 180780 - DNA, 16 bp, Homo sapiens
cgtctgaccctctcca

SEQ ID NO: 180781 - DNA, 17 bp, Homo sapiens
cgtctggggttcagccc

SEQ ID NO: 180782 - DNA, 23 bp, Homo sapiens
cgtcttagaagtggaccaggaca

SEQ ID NO: 180783 - DNA, 14 bp, Homo sapiens
cgtcttcagcctag

SEQ ID NO: 180784 - DNA, 13 bp, Homo sapiens
cgtgactcaccca

SEQ ID NO: 180785 - DNA, 15 bp, Homo sapiens
cgtgactcacccaag

SEQ ID NO: 180786 - DNA, 17 bp, Homo sapiens
cgtgactgccccaactc

SEQ ID NO: 180787 - DNA, 21 bp, Homo sapiens
cgtgactgccccaactcctgg

SEQ ID NO: 180788 - DNA, 17 bp, Homo sapiens
cgtgatgcctccctgtt

SEQ ID NO: 180789 - DNA, 13 bp, Homo sapiens
cgtgcatgtgcac

SEQ ID NO: 180790 - DNA, 13 bp, Homo sapiens
cgtgccaggcccg

SEQ ID NO: 180791 - DNA, 17 bp, Homo sapiens
cgtgccgttactctcca

SEQ ID NO: 180792 - DNA, 19 bp, Homo sapiens
cgtgccgttactctccaac

SEQ ID NO: 180793 - DNA, 20 bp, Homo sapiens
ctactcagcagccctcctca

SEQ ID NO: 180794 - DNA, 17 bp, Homo sapiens
ctactctcctcggcccc

SEQ ID NO: 180795 - DNA, 14 bp, Homo sapiens
ctactgacatgtgg

SEQ ID NO: 180796 - DNA, 17 bp, Homo sapiens
ctactgactttctcagc

SEQ ID NO: 180797 - DNA, 18 bp, Homo sapiens
ctacttgggaggctgaga

SEQ ID NO: 180798 - DNA, 22 bp, Homo sapiens
ctagaagattttgaaattttta

SEQ ID NO: 180799 - DNA, 13 bp, Homo sapiens
ctagaatttattc

SEQ ID NO: 180800 - DNA, 12 bp, Homo sapiens
ctagactttctg

SEQ ID NO: 180801 - DNA, 13 bp, Homo sapiens
ctagactttctgt

SEQ ID NO: 180802 - DNA, 14 bp, Homo sapiens
ctagactttctgtt

SEQ ID NO: 180803 - DNA, 19 bp, Homo sapiens
ctagaggaaccaaccccca

SEQ ID NO: 180804 - DNA, 13 bp, Homo sapiens
ctagatttatgaa

SEQ ID NO: 180805 - DNA, 23 bp, Homo sapiens
ctagcagcagggagggcttctgc

SEQ ID NO: 180806 - DNA, 22 bp, Homo sapiens
ctagcagtgatgaaaatgaatc

SEQ ID NO: 180807 - DNA, 14 bp, Homo sapiens
ctagcccaggagag

SEQ ID NO: 180808 - DNA, 15 bp, Homo sapiens
ctagcccaggagaga

SEQ ID NO: 180809 - DNA, 20 bp, Homo sapiens
ctagcccctgtggagactgg

SEQ ID NO: 180810 - DNA, 13 bp, Homo sapiens
ctagccgacctca

SEQ ID NO: 180811 - DNA, 15 bp, Homo sapiens
ctagccgacctcagc

SEQ ID NO: 180812 - DNA, 18 bp, Homo sapiens
ctagccgacctcagcctt

SEQ ID NO: 180813 - DNA, 19 bp, Homo sapiens
ctagccgacctcagccttc

SEQ ID NO: 180814 - DNA, 19 bp, Homo sapiens
ctagccttgaggagtgtga

SEQ ID NO: 180815 - DNA, 19 bp, Homo sapiens
ctagcctttggctctggag

SEQ ID NO: 180816 - DNA, 21 bp, Homo sapiens
ctagcctttggctctggagac

SEQ ID NO: 180817 - DNA, 12 bp, Homo sapiens
ctagcgctgccg

SEQ ID NO: 180818 - DNA, 22 bp, Homo sapiens
ctagctaatgtaataactgtga

SEQ ID NO: 180819 - DNA, 14 bp, Homo sapiens
ctagctagaaatat

SEQ ID NO: 180820 - DNA, 23 bp, Homo sapiens
ctagctagaagtgggccaggaca

SEQ ID NO: 180821 - DNA, 22 bp, Homo sapiens
ctagctccacaccctctcccag

SEQ ID NO: 180822 - DNA, 18 bp, Homo sapiens
ctagctgttgagctgttt

SEQ ID NO: 180823 - DNA, 19 bp, Homo sapiens
ctaggagctgggaggaaaa

SEQ ID NO: 180824 - DNA, 16 bp, Homo sapiens
ctaggccactcctcca

SEQ ID NO: 180825 - DNA, 17 bp, Homo sapiens
ctaggtcagcttgctgc

SEQ ID NO: 180826 - DNA, 16 bp, Homo sapiens
ctagtactaactccta

SEQ ID NO: 180827 - DNA, 22 bp, Homo sapiens
ctagtacttgggagacctgtaa

SEQ ID NO: 180828 - DNA, 16 bp, Homo sapiens
ctagtcagagagagtg

SEQ ID NO: 180829 - DNA, 15 bp, Homo sapiens
ctagtcctttactaa

SEQ ID NO: 180830 - DNA, 18 bp, Homo sapiens
ctagtgaaagaggcagct

SEQ ID NO: 180831 - DNA, 18 bp, Homo sapiens
ctagtggggtctccctct

SEQ ID NO: 180832 - DNA, 21 bp, Homo sapiens
ctagtggggtctccctctcct

SEQ ID NO: 180833 - DNA, 22 bp, Homo sapiens
ctagtggggtctccctctcctg

SEQ ID NO: 180834 - DNA, 13 bp, Homo sapiens
ctataaaacaggt

SEQ ID NO: 180835 - DNA, 14 bp, Homo sapiens
ctatacctgtgcct

SEQ ID NO: 180836 - DNA, 19 bp, Homo sapiens
ctatacctgtgcctcggct

SEQ ID NO: 180837 - DNA, 20 bp, Homo sapiens
ctataggtgctacaaaaaca

SEQ ID NO: 180838 - DNA, 22 bp, Homo sapiens
ctataggtgctacaaaaacaca

SEQ ID NO: 180839 - DNA, 22 bp, Homo sapiens
ctatatagtttattgacaataa

SEQ ID NO: 180840 - DNA, 17 bp, Homo sapiens
ctatatgatttatagtt

SEQ ID NO: 180841 - DNA, 18 bp, Homo sapiens
ctatatgatttatagttt

SEQ ID NO: 180842 - DNA, 22 bp, Homo sapiens
ctatattttttgttaaatgatt

SEQ ID NO: 180843 - DNA, 13 bp, Homo sapiens
ctatcaaactgaa

SEQ ID NO: 180844 - DNA, 15 bp, Homo sapiens
ctatccacccagccc

SEQ ID NO: 180845 - DNA, 19 bp, Homo sapiens
ctatgaactctgttttctt

SEQ ID NO: 180846 - DNA, 20 bp, Homo sapiens
ctatgatatggtaaaagtta

SEQ ID NO: 180847 - DNA, 15 bp, Homo sapiens
ctatgatttggaaaa

SEQ ID NO: 180848 - DNA, 19 bp, Homo sapiens
ctatgatttggaaaataaa

SEQ ID NO: 180849 - DNA, 15 bp, Homo sapiens
ctatggggatggtcc

SEQ ID NO: 180850 - DNA, 19 bp, Homo sapiens
ctatgggggcactgaggac

SEQ ID NO: 180851 - DNA, 22 bp, Homo sapiens
ctatgtaggaaagaccattttt

SEQ ID NO: 180852 - DNA, 23 bp, Homo sapiens
ctatgtaggaaagaccatttttc

SEQ ID NO: 180853 - DNA, 23 bp, Homo sapiens
ctatgtcatttgctggagctctg

SEQ ID NO: 180854 - DNA, 17 bp, Homo sapiens
attttttaagtatttat

SEQ ID NO: 180855 - DNA, 19 bp, Homo sapiens
attttttaagtatttatat

SEQ ID NO: 180856 - DNA, 20 bp, Homo sapiens
attttttaagtatttatata

SEQ ID NO: 180857 - DNA, 22 bp, Homo sapiens
attttttaagtatttatatatt

SEQ ID NO: 180858 - DNA, 15 bp, Homo sapiens
attttttaattatta

SEQ ID NO: 180859 - DNA, 12 bp, Homo sapiens
attttttattgt

SEQ ID NO: 180860 - DNA, 22 bp, Homo sapiens
attttttcagaaatatgtggtt

SEQ ID NO: 180861 - DNA, 19 bp, Homo sapiens
atttttttaaccaaaggtg

SEQ ID NO: 180862 - DNA, 21 bp, Homo sapiens
atttttttaaccaaaggtgaa

SEQ ID NO: 180863 - DNA, 21 bp, Homo sapiens
atttttttcactggagttaca

SEQ ID NO: 180864 - DNA, 14 bp, Homo sapiens
caaaaacacagcaa

SEQ ID NO: 180865 - DNA, 15 bp, Homo sapiens
caaaaacagcctcac

SEQ ID NO: 180866 - DNA, 22 bp, Homo sapiens
caaaaacagcctcacagaagaa

SEQ ID NO: 180867 - DNA, 12 bp, Homo sapiens
caaaaagaacaa

SEQ ID NO: 180868 - DNA, 13 bp, Homo sapiens
caaaaaggcagga

SEQ ID NO: 180869 - DNA, 19 bp, Homo sapiens
caaaaattcaactcagact

SEQ ID NO: 180870 - DNA, 21 bp, Homo sapiens
caaaacaaatgccacacatca

SEQ ID NO: 180871 - DNA, 16 bp, Homo sapiens
caaaactcctgtcttt

SEQ ID NO: 180872 - DNA, 17 bp, Homo sapiens
caaaactgcactgtcaa

SEQ ID NO: 180873 - DNA, 18 bp, Homo sapiens
caaaactgcactgtcaag

SEQ ID NO: 180874 - DNA, 13 bp, Homo sapiens
caaaacttaacat

SEQ ID NO: 180875 - DNA, 23 bp, Homo sapiens
caaaacttcagacatagaattaa

SEQ ID NO: 180876 - DNA, 18 bp, Homo sapiens
caaaagatgcttctcact

SEQ ID NO: 180877 - DNA, 15 bp, Homo sapiens
caaaaggcagaagca

SEQ ID NO: 180878 - DNA, 20 bp, Homo sapiens
caaaagggtgtctgagccct

SEQ ID NO: 180879 - DNA, 13 bp, Homo sapiens
caaaaggtgcctg

SEQ ID NO: 180880 - DNA, 19 bp, Homo sapiens
caaaaggttcactaaagca

SEQ ID NO: 180881 - DNA, 19 bp, Homo sapiens
caaaagtcaaaaggtgcct

SEQ ID NO: 180882 - DNA, 15 bp, Homo sapiens
caaaagttctgactt

SEQ ID NO: 180883 - DNA, 18 bp, Homo sapiens
caaaagttctgacttgac

SEQ ID NO: 180884 - DNA, 18 bp, Homo sapiens
caaaataattttaagaaa

SEQ ID NO: 180885 - DNA, 22 bp, Homo sapiens
caaaataattttaagaaatcaa

SEQ ID NO: 180886 - DNA, 13 bp, Homo sapiens
caaaatagagaat

SEQ ID NO: 180887 - DNA, 16 bp, Homo sapiens
caaaatcattttaatg

SEQ ID NO: 180888 - DNA, 22 bp, Homo sapiens
caaaatcattttatatgtcaaa

SEQ ID NO: 180889 - DNA, 17 bp, Homo sapiens
caaaatgaggaatgtat

SEQ ID NO: 180890 - DNA, 18 bp, Homo sapiens
caaaatgaggaatgtata

SEQ ID NO: 180891 - DNA, 20 bp, Homo sapiens
caaaatgaggaatgtatatg

SEQ ID NO: 180892 - DNA, 11 bp, Homo sapiens
caaaatttgtt

SEQ ID NO: 180893 - DNA, 13 bp, Homo sapiens
caaacagccacac

SEQ ID NO: 180894 - DNA, 15 bp, Homo sapiens
caaacagtctcagga

SEQ ID NO: 180895 - DNA, 18 bp, Homo sapiens
caaacatcctatcaacaa

SEQ ID NO: 180896 - DNA, 14 bp, Homo sapiens
caaacatgaagtgt

SEQ ID NO: 180897 - DNA, 22 bp, Homo sapiens
caaacatgaagtgtgtttcctt

SEQ ID NO: 180898 - DNA, 15 bp, Homo sapiens
caaaccataaacttc

SEQ ID NO: 180899 - DNA, 16 bp, Homo sapiens
caaacgctgcctgccc

SEQ ID NO: 180900 - DNA, 12 bp, Homo sapiens
caaactctgctg

SEQ ID NO: 180901 - DNA, 13 bp, Homo sapiens
caaactctgctgt

SEQ ID NO: 180902 - DNA, 13 bp, Homo sapiens
caaagaggcaaga

SEQ ID NO: 180903 - DNA, 15 bp, Homo sapiens
caaagaggcaagagg

SEQ ID NO: 180904 - DNA, 14 bp, Homo sapiens
caaagaggttttaa

SEQ ID NO: 180905 - DNA, 17 bp, Homo sapiens
caaagagtagacatttc

SEQ ID NO: 180906 - DNA, 22 bp, Homo sapiens
caaagatgtttgtcagatatga

SEQ ID NO: 180907 - DNA, 15 bp, Homo sapiens
caaagcaaggaaact

SEQ ID NO: 180908 - DNA, 14 bp, Homo sapiens
caaagcaataatag

SEQ ID NO: 180909 - DNA, 16 bp, Homo sapiens
caaagcaataatagta

SEQ ID NO: 180910 - DNA, 22 bp, Homo sapiens
caaagcaggggagtatgcaaaa

SEQ ID NO: 180911 - DNA, 17 bp, Homo sapiens
caaagcattgagcaaag

SEQ ID NO: 180912 - DNA, 14 bp, Homo sapiens
caaagccagaagct

SEQ ID NO: 180913 - DNA, 18 bp, Homo sapiens
caaagccagaagctgagc

SEQ ID NO: 180914 - DNA, 23 bp, Homo sapiens
caaagccccttgctctcccctgc

SEQ ID NO: 180915 - DNA, 17 bp, Homo sapiens
caaagccttgtgtctac

SEQ ID NO: 180916 - DNA, 23 bp, Homo sapiens
caaagctctattaagatttccaa

SEQ ID NO: 180917 - DNA, 22 bp, Homo sapiens
caaagcttggaagagcctgcag

SEQ ID NO: 180918 - DNA, 13 bp, Homo sapiens
caaaggatactgt

SEQ ID NO: 180919 - DNA, 15 bp, Homo sapiens
caaaggcaagcactt

SEQ ID NO: 180920 - DNA, 14 bp, Homo sapiens
caaagggagagaga

SEQ ID NO: 180921 - DNA, 13 bp, Homo sapiens
caaagtctgtgtg

SEQ ID NO: 180922 - DNA, 22 bp, Homo sapiens
caaagttccctacttcctgtga

SEQ ID NO: 180923 - DNA, 16 bp, Homo sapiens
caaataaaaatattgt

SEQ ID NO: 180924 - DNA, 18 bp, Homo sapiens
caaataaactctaaacat

SEQ ID NO: 180925 - DNA, 15 bp, Homo sapiens
caaatagtgctcgct

SEQ ID NO: 180926 - DNA, 22 bp, Homo sapiens
caaatataagaataaaatgttg

SEQ ID NO: 180927 - DNA, 14 bp, Homo sapiens
caaatatgtcctgg

SEQ ID NO: 180928 - DNA, 15 bp, Homo sapiens
caaatatgtcctggg

SEQ ID NO: 180929 - DNA, 19 bp, Homo sapiens
caaatgctgcgcccttccc

SEQ ID NO: 180930 - DNA, 13 bp, Homo sapiens
caaatggaaagga

SEQ ID NO: 180931 - DNA, 21 bp, Homo sapiens
caaatggaaaggagaggaaag

SEQ ID NO: 180932 - DNA, 17 bp, Homo sapiens
caaatgtcatcagaact

SEQ ID NO: 180933 - DNA, 20 bp, Homo sapiens
caaatgtgtatcggatgctt

SEQ ID NO: 180934 - DNA, 14 bp, Homo sapiens
caaatgttcatcaa

SEQ ID NO: 180935 - DNA, 20 bp, Homo sapiens
caaatgttcatcaatgaatg

SEQ ID NO: 180936 - DNA, 17 bp, Homo sapiens
caaattgaactctttga

SEQ ID NO: 180937 - DNA, 21 bp, Homo sapiens
caaattggagcttcatggcag

SEQ ID NO: 180938 - DNA, 16 bp, Homo sapiens
caaatttacagagaca

SEQ ID NO: 180939 - DNA, 23 bp, Homo sapiens
caaatttacagagacagaaagca

SEQ ID NO: 180940 - DNA, 19 bp, Homo sapiens
caacaaagccaacagtcaa

SEQ ID NO: 180941 - DNA, 15 bp, Homo sapiens
caacaagagtttatt

SEQ ID NO: 180942 - DNA, 13 bp, Homo sapiens
caacaatttctac

SEQ ID NO: 180943 - DNA, 20 bp, Homo sapiens
caacacctctgcacaagctg

SEQ ID NO: 180944 - DNA, 23 bp, Homo sapiens
caacacgagcaggctactgtcag

SEQ ID NO: 180945 - DNA, 16 bp, Homo sapiens
caacagaagcttcaga

SEQ ID NO: 180946 - DNA, 17 bp, Homo sapiens
caacagatcaatttgta

SEQ ID NO: 180947 - DNA, 23 bp, Homo sapiens
caacagcgacatagcccatccct

SEQ ID NO: 180948 - DNA, 14 bp, Homo sapiens
caacaggagctggg

SEQ ID NO: 180949 - DNA, 21 bp, Homo sapiens
caacaggagctgggatcctaa

SEQ ID NO: 180950 - DNA, 20 bp, Homo sapiens
caacagtagcataggaccct

SEQ ID NO: 180951 - DNA, 18 bp, Homo sapiens
caacagtcaaaacagaga

SEQ ID NO: 180952 - DNA, 14 bp, Homo sapiens
caacagttccttca

SEQ ID NO: 180953 - DNA, 22 bp, Homo sapiens
caacagttttttatgctaatca

SEQ ID NO: 180954 - DNA, 15 bp, Homo sapiens
caacatcccattgcc

SEQ ID NO: 180955 - DNA, 20 bp, Homo sapiens
caaccaagtcatgtgcattt

SEQ ID NO: 180956 - DNA, 23 bp, Homo sapiens
caaccatgagaccactgttatca

SEQ ID NO: 180957 - DNA, 22 bp, Homo sapiens
caacccatgatgagctcctctt

SEQ ID NO: 180958 - DNA, 15 bp, Homo sapiens
caaccccaactccag

SEQ ID NO: 180959 - DNA, 16 bp, Homo sapiens
caacccccatttctat

SEQ ID NO: 180960 - DNA, 19 bp, Homo sapiens
caacccttttgtctgcctc

SEQ ID NO: 180961 - DNA, 14 bp, Homo sapiens
caacctcattgaca

SEQ ID NO: 180962 - DNA, 15 bp, Homo sapiens
caacctgaccaacat

SEQ ID NO: 180963 - DNA, 21 bp, Homo sapiens
caacctgctctcctcttgcca

SEQ ID NO: 180964 - DNA, 23 bp, Homo sapiens
caacctgctctcctcttgccact

SEQ ID NO: 180965 - DNA, 16 bp, Homo sapiens
caaccttctgtggctc

SEQ ID NO: 180966 - DNA, 17 bp, Homo sapiens
caaccttctgtggctca

SEQ ID NO: 180967 - DNA, 15 bp, Homo sapiens
caacgaggaagccct

SEQ ID NO: 180968 - DNA, 15 bp, Homo sapiens
caacgtggggcagca

SEQ ID NO: 180969 - DNA, 22 bp, Homo sapiens
caactaacaagaaactcacccc

SEQ ID NO: 180970 - DNA, 18 bp, Homo sapiens
caactatgatttggaaaa

SEQ ID NO: 180971 - DNA, 12 bp, Homo sapiens
caactcagacta

SEQ ID NO: 180972 - DNA, 13 bp, Homo sapiens
caactctttgaga

SEQ ID NO: 180973 - DNA, 17 bp, Homo sapiens
caactgaccagcctcca

SEQ ID NO: 180974 - DNA, 19 bp, Homo sapiens
caactgaccagcctccatg

SEQ ID NO: 180975 - DNA, 16 bp, Homo sapiens
caactgaggcagacag

SEQ ID NO: 180976 - DNA, 20 bp, Homo sapiens
caactgaggcagacagcagc

SEQ ID NO: 180977 - DNA, 22 bp, Homo sapiens
caactgaggcagacagcagctc

SEQ ID NO: 180978 - DNA, 16 bp, Homo sapiens
caactgcattggcttt

SEQ ID NO: 180979 - DNA, 17 bp, Homo sapiens
caacttcaagtgcatgc

SEQ ID NO: 180980 - DNA, 22 bp, Homo sapiens
caacttcaagtgcatgctctct

SEQ ID NO: 180981 - DNA, 21 bp, Homo sapiens
caacttgagggcccagagcag

SEQ ID NO: 180982 - DNA, 16 bp, Homo sapiens
caacttgtaaatgtgg

SEQ ID NO: 180983 - DNA, 12 bp, Homo sapiens
caactttctgta

SEQ ID NO: 180984 - DNA, 18 bp, Homo sapiens
caagaaaacaacttcaat

SEQ ID NO: 180985 - DNA, 17 bp, Homo sapiens
caagaaactcaccccca

SEQ ID NO: 180986 - DNA, 15 bp, Homo sapiens
caagaaagaaacccg

SEQ ID NO: 180987 - DNA, 22 bp, Homo sapiens
caagaaagaaacccgacagagg

SEQ ID NO: 180988 - DNA, 17 bp, Homo sapiens
caagaaatgaaagcagg

SEQ ID NO: 180989 - DNA, 16 bp, Homo sapiens
caagaaatttgatttc

SEQ ID NO: 180990 - DNA, 16 bp, Homo sapiens
cacgtgtgtgactcag

SEQ ID NO: 180991 - DNA, 19 bp, Homo sapiens
cacgttccttactgcagaa

SEQ ID NO: 180992 - DNA, 22 bp, Homo sapiens
cactaaactttacccaaaaact

SEQ ID NO: 180993 - DNA, 12 bp, Homo sapiens
cactaaagcagt

SEQ ID NO: 180994 - DNA, 13 bp, Homo sapiens
cactaaagcagtg

SEQ ID NO: 180995 - DNA, 16 bp, Homo sapiens
cactaaagtatgtaaa

SEQ ID NO: 180996 - DNA, 22 bp, Homo sapiens
cactaaagtatgtaaagtatgt

SEQ ID NO: 180997 - DNA, 20 bp, Homo sapiens
cactagcctttggctctgga

SEQ ID NO: 180998 - DNA, 20 bp, Homo sapiens
cactagggcagggacaggat

SEQ ID NO: 180999 - DNA, 16 bp, Homo sapiens
cactagtgcaaatcat

SEQ ID NO: 181000 - DNA, 17 bp, Homo sapiens
cactatggtatttgagt

SEQ ID NO: 181001 - DNA, 20 bp, Homo sapiens
cactcaaaagctgggcaggt

SEQ ID NO: 181002 - DNA, 12 bp, Homo sapiens
cactcaagccaa

SEQ ID NO: 181003 - DNA, 15 bp, Homo sapiens
cactcaagccaagca

SEQ ID NO: 181004 - DNA, 18 bp, Homo sapiens
cactcaagccaagcagcc

SEQ ID NO: 181005 - DNA, 18 bp, Homo sapiens
cactcaccagtgtcccct

SEQ ID NO: 181006 - DNA, 10 bp, Homo sapiens
cactccacca

SEQ ID NO: 181007 - DNA, 11 bp, Homo sapiens
cactccaccac

SEQ ID NO: 181008 - DNA, 14 bp, Homo sapiens
cactccaccaccca

SEQ ID NO: 181009 - DNA, 17 bp, Homo sapiens
cactccagacccctggc

SEQ ID NO: 181010 - DNA, 13 bp, Homo sapiens
cactccagcctga

SEQ ID NO: 181011 - DNA, 13 bp, Homo sapiens
cactccagctcct

SEQ ID NO: 181012 - DNA, 21 bp, Homo sapiens
cactccagtgagacagctctg

SEQ ID NO: 181013 - DNA, 13 bp, Homo sapiens
cactccagtgcca

SEQ ID NO: 181014 - DNA, 14 bp, Homo sapiens
cactcccctgcact

SEQ ID NO: 181015 - DNA, 13 bp, Homo sapiens
cactcctacctgg

SEQ ID NO: 181016 - DNA, 20 bp, Homo sapiens
cactcctctgactcagggct

SEQ ID NO: 181017 - DNA, 24 bp, Homo sapiens
cactccttcctgccacctgctgct

SEQ ID NO: 181018 - DNA, 13 bp, Homo sapiens
cactcgcttcccc

SEQ ID NO: 181019 - DNA, 20 bp, Homo sapiens
cactcgcttcccccatagcc

SEQ ID NO: 181020 - DNA, 14 bp, Homo sapiens
cactctacttagca

SEQ ID NO: 181021 - DNA, 15 bp, Homo sapiens
cactctgcctctgcc

SEQ ID NO: 181022 - DNA, 18 bp, Homo sapiens
cactctgctcgccttagc

SEQ ID NO: 181023 - DNA, 15 bp, Homo sapiens
cactctttgtaagag

SEQ ID NO: 181024 - DNA, 20 bp, Homo sapiens
cactgaaaaatctaagtgat

SEQ ID NO: 181025 - DNA, 23 bp, Homo sapiens
cactgaaaaatctaagtgatata

SEQ ID NO: 181026 - DNA, 23 bp, Homo sapiens
cactgaattaatgacagagccag

SEQ ID NO: 181027 - DNA, 16 bp, Homo sapiens
cactgacagcctccca

SEQ ID NO: 181028 - DNA, 14 bp, Homo sapiens
cactgacttctaag

SEQ ID NO: 181029 - DNA, 15 bp, Homo sapiens
cactgacttctaagt

SEQ ID NO: 181030 - DNA, 19 bp, Homo sapiens
cactgagataccagcgagg

SEQ ID NO: 181031 - DNA, 14 bp, Homo sapiens
cactgagggcagtc

SEQ ID NO: 181032 - DNA, 18 bp, Homo sapiens
cactgatttcacaacaga

SEQ ID NO: 181033 - DNA, 19 bp, Homo sapiens
cactgatttcacaacagat

SEQ ID NO: 181034 - DNA, 14 bp, Homo sapiens
cactgatttggaga

SEQ ID NO: 181035 - DNA, 16 bp, Homo sapiens
cactgatttggagata

SEQ ID NO: 181036 - DNA, 13 bp, Homo sapiens
cactgcaagagcc

SEQ ID NO: 181037 - DNA, 15 bp, Homo sapiens
cactgcaagagcctt

SEQ ID NO: 181038 - DNA, 17 bp, Homo sapiens
cactgcaagagccttgg

SEQ ID NO: 181039 - DNA, 18 bp, Homo sapiens
cactgcacagtgcatctc

SEQ ID NO: 181040 - DNA, 21 bp, Homo sapiens
cactgcacagtgcatctcagc

SEQ ID NO: 181041 - DNA, 21 bp, Homo sapiens
cactgccataaaacattaaga

SEQ ID NO: 181042 - DNA, 22 bp, Homo sapiens
cactgccttcgatacaccgggc

SEQ ID NO: 181043 - DNA, 18 bp, Homo sapiens
cactgctccctgaagcca

SEQ ID NO: 181044 - DNA, 22 bp, Homo sapiens
cactgctccctgaagccagcct

SEQ ID NO: 181045 - DNA, 12 bp, Homo sapiens
cactgctggctg

SEQ ID NO: 181046 - DNA, 21 bp, Homo sapiens
cactgctggctgccttagaac

SEQ ID NO: 181047 - DNA, 14 bp, Homo sapiens
cactgcttgaggaa

SEQ ID NO: 181048 - DNA, 15 bp, Homo sapiens
cactgcttgaggaaa

SEQ ID NO: 181049 - DNA, 16 bp, Homo sapiens
cactggagcaccaggc

SEQ ID NO: 181050 - DNA, 17 bp, Homo sapiens
cactggagcaccaggca

SEQ ID NO: 181051 - DNA, 21 bp, Homo sapiens
cacctgagcaggacctctgaa

SEQ ID NO: 181052 - DNA, 23 bp, Homo sapiens
cacctgagcccggatgcttctcc

SEQ ID NO: 181053 - DNA, 14 bp, Homo sapiens
cacctgcacctccc

SEQ ID NO: 181054 - DNA, 15 bp, Homo sapiens
cacctgcacctcccc

SEQ ID NO: 181055 - DNA, 23 bp, Homo sapiens
cacctgctgagaaaacatgcctc

SEQ ID NO: 181056 - DNA, 18 bp, Homo sapiens
cacctgctgagagaccca

SEQ ID NO: 181057 - DNA, 16 bp, Homo sapiens
cacctggccccatgtc

SEQ ID NO: 181058 - DNA, 10 bp, Homo sapiens
cacctggggt

SEQ ID NO: 181059 - DNA, 20 bp, Homo sapiens
cacctggggtgtgggaggcc

SEQ ID NO: 181060 - DNA, 20 bp, Homo sapiens
cacctggttccggaatcctg

SEQ ID NO: 181061 - DNA, 21 bp, Homo sapiens
cacctggttccggaatcctgt

SEQ ID NO: 181062 - DNA, 15 bp, Homo sapiens
cacctgtagcagcca

SEQ ID NO: 181063 - DNA, 19 bp, Homo sapiens
cacctgtagtcccagctac

SEQ ID NO: 181064 - DNA, 20 bp, Homo sapiens
cacctgtcaaacaaagccag

SEQ ID NO: 181065 - DNA, 21 bp, Homo sapiens
cacctgtcaaacaaagccaga

SEQ ID NO: 181066 - DNA, 19 bp, Homo sapiens
cacctgtgagtttaaagca

SEQ ID NO: 181067 - DNA, 19 bp, Homo sapiens
cacctgtttttaagctgtt

SEQ ID NO: 181068 - DNA, 18 bp, Homo sapiens
caccttaccaactttctg

SEQ ID NO: 181069 - DNA, 18 bp, Homo sapiens
caccttaggcagggaagt

SEQ ID NO: 181070 - DNA, 13 bp, Homo sapiens
caccttcccagct

SEQ ID NO: 181071 - DNA, 22 bp, Homo sapiens
caccttcccagctctccctctg

SEQ ID NO: 181072 - DNA, 23 bp, Homo sapiens
caccttcgtttactatgcctgtg

SEQ ID NO: 181073 - DNA, 20 bp, Homo sapiens
caccttgggatgatgcctca

SEQ ID NO: 181074 - DNA, 14 bp, Homo sapiens
cacctttattaaaa

SEQ ID NO: 181075 - DNA, 15 bp, Homo sapiens
cacgaaatgttattt

SEQ ID NO: 181076 - DNA, 16 bp, Homo sapiens
cacgaacccacctgct

SEQ ID NO: 181077 - DNA, 15 bp, Homo sapiens
cacgatgtggccctg

SEQ ID NO: 181078 - DNA, 16 bp, Homo sapiens
cacgatgtggccctgg

SEQ ID NO: 181079 - DNA, 17 bp, Homo sapiens
cacgatgtggccctggc

SEQ ID NO: 181080 - DNA, 14 bp, Homo sapiens
cacgcccatgtgtg

SEQ ID NO: 181081 - DNA, 13 bp, Homo sapiens
cacgccctcccct

SEQ ID NO: 181082 - DNA, 20 bp, Homo sapiens
cacgccctcccctcccctgc

SEQ ID NO: 181083 - DNA, 20 bp, Homo sapiens
cacgcctgtaatcctagcac

SEQ ID NO: 181084 - DNA, 14 bp, Homo sapiens
cacgctttctagct

SEQ ID NO: 181085 - DNA, 16 bp, Homo sapiens
cacggaagagccttgc

SEQ ID NO: 181086 - DNA, 17 bp, Homo sapiens
cacggacgtttccatca

SEQ ID NO: 181087 - DNA, 18 bp, Homo sapiens
cacggagccactcctctg

SEQ ID NO: 181088 - DNA, 20 bp, Homo sapiens
cacggatccatgtagcagga

SEQ ID NO: 181089 - DNA, 20 bp, Homo sapiens
cacgtagtagggtcaggcca

SEQ ID NO: 181090 - DNA, 15 bp, Homo sapiens
cacgtccccctgggg

SEQ ID NO: 181091 - DNA, 18 bp, Homo sapiens
cacgtctgaccctctcca

SEQ ID NO: 181092 - DNA, 13 bp, Homo sapiens
cacgtgccaggcc

SEQ ID NO: 181093 - DNA, 15 bp, Homo sapiens
catgtggtttataga

SEQ ID NO: 181094 - DNA, 15 bp, Homo sapiens
catgtgtgagtgtgt

SEQ ID NO: 181095 - DNA, 21 bp, Homo sapiens
catgtgtgagtgtgtgcaagt

SEQ ID NO: 181096 - DNA, 17 bp, Homo sapiens
catgtgtgcgagtgtgt

SEQ ID NO: 181097 - DNA, 19 bp, Homo sapiens
catgtgtgcgagtgtgtgc

SEQ ID NO: 181098 - DNA, 12 bp, Homo sapiens
catgtgtgtcca

SEQ ID NO: 181099 - DNA, 22 bp, Homo sapiens
catgtgtgtccacgactgtctc

SEQ ID NO: 181100 - DNA, 23 bp, Homo sapiens
catgtgtgtccacgactgtctcc

SEQ ID NO: 181101 - DNA, 15 bp, Homo sapiens
catgtgtgtgcaagt

SEQ ID NO: 181102 - DNA, 16 bp, Homo sapiens
catgtgttaagtattt

SEQ ID NO: 181103 - DNA, 14 bp, Homo sapiens
catgtgttgaaaaa

SEQ ID NO: 181104 - DNA, 22 bp, Homo sapiens
catgttatatattttttgtagg

SEQ ID NO: 181105 - DNA, 14 bp, Homo sapiens
catgttccttcaag

SEQ ID NO: 181106 - DNA, 16 bp, Homo sapiens
catgttccttcaagat

SEQ ID NO: 181107 - DNA, 23 bp, Homo sapiens
catgttgcacacccactcagctc

SEQ ID NO: 181108 - DNA, 15 bp, Homo sapiens
catgttttgtttacg

SEQ ID NO: 181109 - DNA, 17 bp, Homo sapiens
catgtttttgttttctt

SEQ ID NO: 181110 - DNA, 11 bp, Homo sapiens
cattaagaaaa

SEQ ID NO: 181111 - DNA, 14 bp, Homo sapiens
cattaagaaaatca

SEQ ID NO: 181112 - DNA, 15 bp, Homo sapiens
cattaagaaaatcat

SEQ ID NO: 181113 - DNA, 17 bp, Homo sapiens
cattaagccctcttcca

SEQ ID NO: 181114 - DNA, 16 bp, Homo sapiens
cattaatatttgctga

SEQ ID NO: 181115 - DNA, 18 bp, Homo sapiens
cattaatcaatcatctgt

SEQ ID NO: 181116 - DNA, 23 bp, Homo sapiens
cattaatcaatcatctgtgtgaa

SEQ ID NO: 181117 - DNA, 13 bp, Homo sapiens
cattaatgttaat

SEQ ID NO: 181118 - DNA, 23 bp, Homo sapiens
cattactcaattgataaacattt

SEQ ID NO: 181119 - DNA, 18 bp, Homo sapiens
cattagcagtttgctttg

SEQ ID NO: 181120 - DNA, 12 bp, Homo sapiens
cattatctcaaa

SEQ ID NO: 181121 - DNA, 21 bp, Homo sapiens
cattcaataagcatcaaactc

SEQ ID NO: 181122 - DNA, 14 bp, Homo sapiens
cattcacccagaca

SEQ ID NO: 181123 - DNA, 15 bp, Homo sapiens
cattcagagagcagc

SEQ ID NO: 181124 - DNA, 23 bp, Homo sapiens
cattcaggaaaactgacagagga

SEQ ID NO: 181125 - DNA, 13 bp, Homo sapiens
cattccccaggtg

SEQ ID NO: 181126 - DNA, 17 bp, Homo sapiens
cattccctgagtcacca

SEQ ID NO: 181127 - DNA, 13 bp, Homo sapiens
cattcctatttct

SEQ ID NO: 181128 - DNA, 14 bp, Homo sapiens
cattcctgcctgtc

SEQ ID NO: 181129 - DNA, 15 bp, Homo sapiens
cattcctgcctgtct

SEQ ID NO: 181130 - DNA, 13 bp, Homo sapiens
cattcctgtattc

SEQ ID NO: 181131 - DNA, 17 bp, Homo sapiens
cattctcactcctacct

SEQ ID NO: 181132 - DNA, 16 bp, Homo sapiens
cattctctctcctgtc

SEQ ID NO: 181133 - DNA, 21 bp, Homo sapiens
cattgaattcttggttgagga

SEQ ID NO: 181134 - DNA, 16 bp, Homo sapiens
cattgacaagaactga

SEQ ID NO: 181135 - DNA, 18 bp, Homo sapiens
cattgctgggcttgtctg

SEQ ID NO: 181136 - DNA, 15 bp, Homo sapiens
cattgtagagcttct

SEQ ID NO: 181137 - DNA, 22 bp, Homo sapiens
cattgtgggatgttcagcactg

SEQ ID NO: 181138 - DNA, 17 bp, Homo sapiens
cattgtttattaacaaa

SEQ ID NO: 181139 - DNA, 22 bp, Homo sapiens
cattgtttgtctgtcttcatag

SEQ ID NO: 181140 - DNA, 12 bp, Homo sapiens
catttaaaaaaa

SEQ ID NO: 181141 - DNA, 21 bp, Homo sapiens
catttaaaaaaaaaatttgtt

SEQ ID NO: 181142 - DNA, 18 bp, Homo sapiens
catttaaaatgattagaa

SEQ ID NO: 181143 - DNA, 23 bp, Homo sapiens
catttagtttgattattcagtgt

SEQ ID NO: 181144 - DNA, 15 bp, Homo sapiens
catttatatattgaa

SEQ ID NO: 181145 - DNA, 22 bp, Homo sapiens
catttatatattgaattaatat

SEQ ID NO: 181146 - DNA, 14 bp, Homo sapiens
catttcatctattt

SEQ ID NO: 181147 - DNA, 17 bp, Homo sapiens
catttcatctatttctg

SEQ ID NO: 181148 - DNA, 23 bp, Homo sapiens
catttctaaaggcctcttccttg

SEQ ID NO: 181149 - DNA, 19 bp, Homo sapiens
catttctatttctcctcca

SEQ ID NO: 181150 - DNA, 15 bp, Homo sapiens
catttctctaagaga

SEQ ID NO: 181151 - DNA, 21 bp, Homo sapiens
catttggagacacaactattt

SEQ ID NO: 181152 - DNA, 23 bp, Homo sapiens
catttggagtgttccccttccac

SEQ ID NO: 181153 - DNA, 20 bp, Homo sapiens
cattttagaagactctacca

SEQ ID NO: 181154 - DNA, 17 bp, Homo sapiens
cattttcaccccaccct

SEQ ID NO: 181155 - DNA, 15 bp, Homo sapiens
catttttacaataaa

SEQ ID NO: 181156 - DNA, 20 bp, Homo sapiens
catttttgaatacaggcata

SEQ ID NO: 181157 - DNA, 17 bp, Homo sapiens
catttttgatttatgca

SEQ ID NO: 181158 - DNA, 16 bp, Homo sapiens
ccaaaattatttcaga

SEQ ID NO: 181159 - DNA, 17 bp, Homo sapiens
ccaaagaaatgtaaggg

SEQ ID NO: 181160 - DNA, 22 bp, Homo sapiens
ccaaagccaccagactgacaaa

SEQ ID NO: 181161 - DNA, 23 bp, Homo sapiens
ccaaagccccttgctctcccctg

SEQ ID NO: 181162 - DNA, 16 bp, Homo sapiens
ccaaagctttcatgta

SEQ ID NO: 181163 - DNA, 17 bp, Homo sapiens
ccaaagctttcctgccc

SEQ ID NO: 181164 - DNA, 16 bp, Homo sapiens
ccaaagtcttaaaata

SEQ ID NO: 181165 - DNA, 15 bp, Homo sapiens
ccaaatcccctaagc

SEQ ID NO: 181166 - DNA, 23 bp, Homo sapiens
ccaaattccttggcatgccttcc

SEQ ID NO: 181167 - DNA, 23 bp, Homo sapiens
ccaaatttcatacctatcatctt

SEQ ID NO: 181168 - DNA, 22 bp, Homo sapiens
ccaacagcgacatagcccatcc

SEQ ID NO: 181169 - DNA, 12 bp, Homo sapiens
ccaacagtgagt

SEQ ID NO: 181170 - DNA, 12 bp, Homo sapiens
ccaacagttcct

SEQ ID NO: 181171 - DNA, 16 bp, Homo sapiens
ccaacatcaacatctt

SEQ ID NO: 181172 - DNA, 22 bp, Homo sapiens
ccaacatggagaaaccctgtct

SEQ ID NO: 181173 - DNA, 20 bp, Homo sapiens
ccaaccaagtggctcccaca

SEQ ID NO: 181174 - DNA, 14 bp, Homo sapiens
ccaaccccaactcc

SEQ ID NO: 181175 - DNA, 15 bp, Homo sapiens
ccaaccctcagagcc

SEQ ID NO: 181176 - DNA, 17 bp, Homo sapiens
ccaacctggggagccag

SEQ ID NO: 181177 - DNA, 15 bp, Homo sapiens
ccaacgtggggcagc

SEQ ID NO: 181178 - DNA, 19 bp, Homo sapiens
ccaactaacaagaaactca

SEQ ID NO: 181179 - DNA, 15 bp, Homo sapiens
ccaactcctggaagc

SEQ ID NO: 181180 - DNA, 19 bp, Homo sapiens
ccaactcctggaagctgtg

SEQ ID NO: 181181 - DNA, 19 bp, Homo sapiens
ccaacttgagggcccagag

SEQ ID NO: 181182 - DNA, 20 bp, Homo sapiens
ccaacttgagggcccagagc

SEQ ID NO: 181183 - DNA, 21 bp, Homo sapiens
ccaacttgagggcccagagca

SEQ ID NO: 181184 - DNA, 13 bp, Homo sapiens
ccaactttctgta

SEQ ID NO: 181185 - DNA, 19 bp, Homo sapiens
ccaagaatagatgctgact

SEQ ID NO: 181186 - DNA, 20 bp, Homo sapiens
ccaagacttggcaacagaag

SEQ ID NO: 181187 - DNA, 20 bp, Homo sapiens
ccaagacttggtgtcctttc

SEQ ID NO: 181188 - DNA, 18 bp, Homo sapiens
ccaagcaggaagctcaga

SEQ ID NO: 181189 - DNA, 16 bp, Homo sapiens
ccaagccgtggcttcc

SEQ ID NO: 181190 - DNA, 21 bp, Homo sapiens
ccaagccgtggcttcccgctc

SEQ ID NO: 181191 - DNA, 23 bp, Homo sapiens
ccaagccgtggcttcccgctcag

SEQ ID NO: 181192 - DNA, 20 bp, Homo sapiens
ccaagcgaggtcaacagaga

SEQ ID NO: 181193 - DNA, 18 bp, Homo sapiens
ccaagctcacagttcctc

SEQ ID NO: 181194 - DNA, 14 bp, Homo sapiens
ccaagctccatctc

SEQ ID NO: 181195 - DNA, 15 bp, Homo sapiens
ccaagctccttggga

SEQ ID NO: 181196 - DNA, 17 bp, Homo sapiens
ccaagctccttgggagg

SEQ ID NO: 181197 - DNA, 19 bp, Homo sapiens
ccaagctccttgggaggcc

SEQ ID NO: 181198 - DNA, 17 bp, Homo sapiens
ccaagcttcctttgttt

SEQ ID NO: 181199 - DNA, 21 bp, Homo sapiens
ccaaggaggaaaaacagacaa

SEQ ID NO: 181200 - DNA, 16 bp, Homo sapiens
ccaaggctctgagcaa

SEQ ID NO: 181201 - DNA, 20 bp, Homo sapiens
ccaaggggcagtctggaggg

SEQ ID NO: 181202 - DNA, 20 bp, Homo sapiens
ccaagggttcagagactcag

SEQ ID NO: 181203 - DNA, 23 bp, Homo sapiens
ccaagggttcagagactcagggc

SEQ ID NO: 181204 - DNA, 20 bp, Homo sapiens
ccaagtcaagtgaaaaagga

SEQ ID NO: 181205 - DNA, 14 bp, Homo sapiens
ccaagtctacagag

SEQ ID NO: 181206 - DNA, 13 bp, Homo sapiens
ccaagtggctccc

SEQ ID NO: 181207 - DNA, 19 bp, Homo sapiens
ccaagttccgtcagtccaa

SEQ ID NO: 181208 - DNA, 18 bp, Homo sapiens
ccaagttgtggtgctgac

SEQ ID NO: 181209 - DNA, 22 bp, Homo sapiens
ccaagttgtggtgctgacaaag

SEQ ID NO: 181210 - DNA, 12 bp, Homo sapiens
ccaatattataa

SEQ ID NO: 181211 - DNA, 14 bp, Homo sapiens
ccaatcattttaat

SEQ ID NO: 181212 - DNA, 13 bp, Homo sapiens
ccaatcctatgtt

SEQ ID NO: 181213 - DNA, 14 bp, Homo sapiens
ccaatcctatgttt

SEQ ID NO: 181214 - DNA, 23 bp, Homo sapiens
ccaatgaaaaaatgtatatgcac

SEQ ID NO: 181215 - DNA, 22 bp, Homo sapiens
ccacaagaaatgaaagcaggga

SEQ ID NO: 181216 - DNA, 15 bp, Homo sapiens
ccacaagaaatttga

SEQ ID NO: 181217 - DNA, 16 bp, Homo sapiens
ccacaagaaatttgat

SEQ ID NO: 181218 - DNA, 21 bp, Homo sapiens
ccacaagaaatttgatttcta

SEQ ID NO: 181219 - DNA, 16 bp, Homo sapiens
ccacaagattcccaga

SEQ ID NO: 181220 - DNA, 17 bp, Homo sapiens
ccacaagattcccagag

SEQ ID NO: 181221 - DNA, 18 bp, Homo sapiens
ccacaagattcccagaga

SEQ ID NO: 181222 - DNA, 24 bp, Homo sapiens
ccacaagattcccagagacaggaa

SEQ ID NO: 181223 - DNA, 12 bp, Homo sapiens
ccacacacccca

SEQ ID NO: 181224 - DNA, 13 bp, Homo sapiens
ccacacaccccaa

SEQ ID NO: 181225 - DNA, 15 bp, Homo sapiens
ccacacccagcctca

SEQ ID NO: 181226 - DNA, 21 bp, Homo sapiens
ccacaccctcccccgccactc

SEQ ID NO: 181227 - DNA, 15 bp, Homo sapiens
ccacaccctctccca

SEQ ID NO: 181228 - DNA, 18 bp, Homo sapiens
ccacaccctctcccagga

SEQ ID NO: 181229 - DNA, 16 bp, Homo sapiens
ccacacttcaggctct

SEQ ID NO: 181230 - DNA, 18 bp, Homo sapiens
ccacagatgcctccaccc

SEQ ID NO: 181231 - DNA, 12 bp, Homo sapiens
ccacagcagttg

SEQ ID NO: 181232 - DNA, 17 bp, Homo sapiens
ccacagcagttgaaaag

SEQ ID NO: 181233 - DNA, 13 bp, Homo sapiens
ccacagctcccac

SEQ ID NO: 181234 - DNA, 19 bp, Homo sapiens
ccacagctcccaccccacc

SEQ ID NO: 181235 - DNA, 19 bp, Homo sapiens
ccacaggcccttcctctcc

SEQ ID NO: 181236 - DNA, 23 bp, Homo sapiens
ccacaggtgtttatacagctcag

SEQ ID NO: 181237 - DNA, 23 bp, Homo sapiens
ccacatagtgatggttcccctgt

SEQ ID NO: 181238 - DNA, 16 bp, Homo sapiens
ccacatgggaggctca

SEQ ID NO: 181239 - DNA, 15 bp, Homo sapiens
ccaccaacatcccat

SEQ ID NO: 181240 - DNA, 21 bp, Homo sapiens
ccagctctgtatcaggaccca

SEQ ID NO: 181241 - DNA, 21 bp, Homo sapiens
ccagctgctcccctccctcct

SEQ ID NO: 181242 - DNA, 17 bp, Homo sapiens
ccagctgggttggaaaa

SEQ ID NO: 181243 - DNA, 20 bp, Homo sapiens
ccagctgtgagccttggctg

SEQ ID NO: 181244 - DNA, 22 bp, Homo sapiens
ccagctgtgggtacagagaggt

SEQ ID NO: 181245 - DNA, 23 bp, Homo sapiens
ccagctgtgggtacagagaggtc

SEQ ID NO: 181246 - DNA, 16 bp, Homo sapiens
ccagctgttcagctgg

SEQ ID NO: 181247 - DNA, 19 bp, Homo sapiens
ccagcttaaaggggctaga

SEQ ID NO: 181248 - DNA, 23 bp, Homo sapiens
ccagcttgctcttcagtgggaga

SEQ ID NO: 181249 - DNA, 16 bp, Homo sapiens
ccagcttgttatttat

SEQ ID NO: 181250 - DNA, 11 bp, Homo sapiens
ccaggaagccg

SEQ ID NO: 181251 - DNA, 20 bp, Homo sapiens
ccaggaatgttaaagtcagt

SEQ ID NO: 181252 - DNA, 17 bp, Homo sapiens
ccaggacaccacaccca

SEQ ID NO: 181253 - DNA, 18 bp, Homo sapiens
ccaggacaccacacccag

SEQ ID NO: 181254 - DNA, 20 bp, Homo sapiens
ccaggacaccacacccagcc

SEQ ID NO: 181255 - DNA, 21 bp, Homo sapiens
ccaggacaccacacccagcct

SEQ ID NO: 181256 - DNA, 15 bp, Homo sapiens
ccaggacaggcccgg

SEQ ID NO: 181257 - DNA, 17 bp, Homo sapiens
ccaggagagagaaagcc

SEQ ID NO: 181258 - DNA, 21 bp, Homo sapiens
ccaggagagagaaagccaggc

SEQ ID NO: 181259 - DNA, 16 bp, Homo sapiens
ccaggagagccagccc

SEQ ID NO: 181260 - DNA, 19 bp, Homo sapiens
ccaggagagccagccctcc

SEQ ID NO: 181261 - DNA, 18 bp, Homo sapiens
ccaggaggtcgaccccaa

SEQ ID NO: 181262 - DNA, 19 bp, Homo sapiens
ccaggcacgaacccacctg

SEQ ID NO: 181263 - DNA, 22 bp, Homo sapiens
ccaggcacgaacccacctgctg

SEQ ID NO: 181264 - DNA, 14 bp, Homo sapiens
ccaggcaggtagcc

SEQ ID NO: 181265 - DNA, 18 bp, Homo sapiens
ccaggcaggtagccaggg

SEQ ID NO: 181266 - DNA, 13 bp, Homo sapiens
ccaggcatggtgg

SEQ ID NO: 181267 - DNA, 17 bp, Homo sapiens
ccaggccccaggaagcc

SEQ ID NO: 181268 - DNA, 15 bp, Homo sapiens
ccaggccgccccagc

SEQ ID NO: 181269 - DNA, 21 bp, Homo sapiens
ccaggccgccccagcctctga

SEQ ID NO: 181270 - DNA, 14 bp, Homo sapiens
ccaggccgtggctg

SEQ ID NO: 181271 - DNA, 14 bp, Homo sapiens
ccaggctccttcct

SEQ ID NO: 181272 - DNA, 14 bp, Homo sapiens
ccaggctggtctca

SEQ ID NO: 181273 - DNA, 17 bp, Homo sapiens
ccagggaagctgtccct

SEQ ID NO: 181274 - DNA, 18 bp, Homo sapiens
ccagggagcggaaagcag

SEQ ID NO: 181275 - DNA, 19 bp, Homo sapiens
ccagggagcggaaagcagc

SEQ ID NO: 181276 - DNA, 20 bp, Homo sapiens
ccagggagcggaaagcagct

SEQ ID NO: 181277 - DNA, 23 bp, Homo sapiens
ccagggagcggaaagcagctcaa

SEQ ID NO: 181278 - DNA, 23 bp, Homo sapiens
ccagggatgccatctgtgggcac

SEQ ID NO: 181279 - DNA, 17 bp, Homo sapiens
ccagggccactctgcct

SEQ ID NO: 181280 - DNA, 14 bp, Homo sapiens
ccagggcctgagcc

SEQ ID NO: 181281 - DNA, 17 bp, Homo sapiens
ccagggcctgagcctgg

SEQ ID NO: 181282 - DNA, 23 bp, Homo sapiens
ccagggcctgcaggacctgcctg

SEQ ID NO: 181283 - DNA, 12 bp, Homo sapiens
ccagggctcagc

SEQ ID NO: 181284 - DNA, 13 bp, Homo sapiens
ccagggctcagcc

SEQ ID NO: 181285 - DNA, 16 bp, Homo sapiens
ccagggctcagcctgg

SEQ ID NO: 181286 - DNA, 16 bp, Homo sapiens
ccaggggatgggaggt

SEQ ID NO: 181287 - DNA, 20 bp, Homo sapiens
ccagggggactagcccctgt

SEQ ID NO: 181288 - DNA, 21 bp, Homo sapiens
ccagggtggacttagaaagca

SEQ ID NO: 181289 - DNA, 21 bp, Homo sapiens
ccagggttgaccccagaggat

SEQ ID NO: 181290 - DNA, 16 bp, Homo sapiens
ccaggtctcacgggca

SEQ ID NO: 181291 - DNA, 17 bp, Homo sapiens
ccaggtgccagttatgg

SEQ ID NO: 181292 - DNA, 16 bp, Homo sapiens
ccaggtggccactcca

SEQ ID NO: 181293 - DNA, 21 bp, Homo sapiens
ccaggtggccactccagaccc

SEQ ID NO: 181294 - DNA, 17 bp, Homo sapiens
ccaggtggctgacccag

SEQ ID NO: 181295 - DNA, 13 bp, Homo sapiens
ccaggtttaagct

SEQ ID NO: 181296 - DNA, 19 bp, Homo sapiens
ccagtaacgcgtcttcctg

SEQ ID NO: 181297 - DNA, 20 bp, Homo sapiens
ccagtaacgcgtcttcctga

SEQ ID NO: 181298 - DNA, 13 bp, Homo sapiens
ccagtatcgctca

SEQ ID NO: 181299 - DNA, 22 bp, Homo sapiens
ccagtattctaggtagtgccct

SEQ ID NO: 181300 - DNA, 14 bp, Homo sapiens
ccagtcaacctggg

SEQ ID NO: 181301 - DNA, 15 bp, Homo sapiens
ccagtccccgtgccc

SEQ ID NO: 181302 - DNA, 22 bp, Homo sapiens
ccagtccctgggggaagccctg

SEQ ID NO: 181303 - DNA, 12 bp, Homo sapiens
ccagtctgaccc

SEQ ID NO: 181304 - DNA, 15 bp, Homo sapiens
ccagtgacagacagg

SEQ ID NO: 181305 - DNA, 18 bp, Homo sapiens
ccagtgacagacaggctc

SEQ ID NO: 181306 - DNA, 19 bp, Homo sapiens
ccagtgacctgaggaagcg

SEQ ID NO: 181307 - DNA, 20 bp, Homo sapiens
ccagtgacctgctgggtaaa

SEQ ID NO: 181308 - DNA, 19 bp, Homo sapiens
ccagtgccttacctcctgc

SEQ ID NO: 181309 - DNA, 14 bp, Homo sapiens
ccagttgcacttgg

SEQ ID NO: 181310 - DNA, 13 bp, Homo sapiens
ccagtttgcagaa

SEQ ID NO: 181311 - DNA, 20 bp, Homo sapiens
ccataaaacattaagaaaat

SEQ ID NO: 181312 - DNA, 14 bp, Homo sapiens
ccataaacttcatg

SEQ ID NO: 181313 - DNA, 16 bp, Homo sapiens
ccataaacttcatggt

SEQ ID NO: 181314 - DNA, 21 bp, Homo sapiens
ccataatctggactcctctgt

SEQ ID NO: 181315 - DNA, 18 bp, Homo sapiens
ccatcaacaaaaattgtc

SEQ ID NO: 181316 - DNA, 16 bp, Homo sapiens
ccatcatcatgtgtgt

SEQ ID NO: 181317 - DNA, 17 bp, Homo sapiens
ccatccacatgggagcc

SEQ ID NO: 181318 - DNA, 16 bp, Homo sapiens
ccatcccacaccctgg

SEQ ID NO: 181319 - DNA, 15 bp, Homo sapiens
ccatcccctggactg

SEQ ID NO: 181320 - DNA, 16 bp, Homo sapiens
ccatcccctgtagagt

SEQ ID NO: 181321 - DNA, 22 bp, Homo sapiens
ccatccctcgtggtccccaaca

SEQ ID NO: 181322 - DNA, 22 bp, Homo sapiens
ccatcctaatcatccaatgctc

SEQ ID NO: 181323 - DNA, 23 bp, Homo sapiens
ccatcctaatcatccaatgctca

SEQ ID NO: 181324 - DNA, 15 bp, Homo sapiens
ccatcctgcagcctc

SEQ ID NO: 181325 - DNA, 16 bp, Homo sapiens
ccatcctgcagcctcc

SEQ ID NO: 181326 - DNA, 18 bp, Homo sapiens
ccatcctgcagcctcctc

SEQ ID NO: 181327 - DNA, 22 bp, Homo sapiens
ccatcctgcagcctcctcctga

SEQ ID NO: 181328 - DNA, 14 bp, Homo sapiens
ccatctcgccaccc

SEQ ID NO: 181329 - DNA, 20 bp, Homo sapiens
ccatctcgccacccctcctt

SEQ ID NO: 181330 - DNA, 22 bp, Homo sapiens
ccatctcgccacccctccttcc

SEQ ID NO: 181331 - DNA, 11 bp, Homo sapiens
catactctgct

SEQ ID NO: 181332 - DNA, 14 bp, Homo sapiens
catagagtttaaca

SEQ ID NO: 181333 - DNA, 16 bp, Homo sapiens
catagcagattttaat

SEQ ID NO: 181334 - DNA, 15 bp, Homo sapiens
catagccaccccaga

SEQ ID NO: 181335 - DNA, 16 bp, Homo sapiens
catagcccatccctgc

SEQ ID NO: 181336 - DNA, 18 bp, Homo sapiens
catagcccatccctgcct

SEQ ID NO: 181337 - DNA, 18 bp, Homo sapiens
cataggaaaagtacattt

SEQ ID NO: 181338 - DNA, 23 bp, Homo sapiens
cataggaaaagtacatttaatac

SEQ ID NO: 181339 - DNA, 22 bp, Homo sapiens
catagtaccaatcattttaatt

SEQ ID NO: 181340 - DNA, 22 bp, Homo sapiens
catagtgaccggctgcttttcc

SEQ ID NO: 181341 - DNA, 20 bp, Homo sapiens
catataaacatcacacacac

SEQ ID NO: 181342 - DNA, 17 bp, Homo sapiens
catataatgttgttatt

SEQ ID NO: 181343 - DNA, 18 bp, Homo sapiens
catatataactagctaga

SEQ ID NO: 181344 - DNA, 18 bp, Homo sapiens
catatccagtattgttcc

SEQ ID NO: 181345 - DNA, 20 bp, Homo sapiens
catatgactcacatgatgca

SEQ ID NO: 181346 - DNA, 13 bp, Homo sapiens
catatgaggatgc

SEQ ID NO: 181347 - DNA, 13 bp, Homo sapiens
catatgtaaaata

SEQ ID NO: 181348 - DNA, 17 bp, Homo sapiens
catatgtgaatatggac

SEQ ID NO: 181349 - DNA, 17 bp, Homo sapiens
catattccatatttatt

SEQ ID NO: 181350 - DNA, 14 bp, Homo sapiens
catatttacttctt

SEQ ID NO: 181351 - DNA, 13 bp, Homo sapiens
catcaacaaaaat

SEQ ID NO: 181352 - DNA, 18 bp, Homo sapiens
catcaatgaatgaatgaa

SEQ ID NO: 181353 - DNA, 12 bp, Homo sapiens
catcacacacac

SEQ ID NO: 181354 - DNA, 19 bp, Homo sapiens
catcaccgacgcgtctcct

SEQ ID NO: 181355 - DNA, 22 bp, Homo sapiens
catcaccgacgcgtctcctgtt

SEQ ID NO: 181356 - DNA, 16 bp, Homo sapiens
catcaccttaggcagg

SEQ ID NO: 181357 - DNA, 18 bp, Homo sapiens
catcaccttaggcaggga

SEQ ID NO: 181358 - DNA, 15 bp, Homo sapiens
catcacttttcagtg

SEQ ID NO: 181359 - DNA, 13 bp, Homo sapiens
catcagaagataa

SEQ ID NO: 181360 - DNA, 15 bp, Homo sapiens
catcagaaggagaag

SEQ ID NO: 181361 - DNA, 23 bp, Homo sapiens
catcagaaggagaaggaaggaga

SEQ ID NO: 181362 - DNA, 20 bp, Homo sapiens
catcagcatacctttattgt

SEQ ID NO: 181363 - DNA, 15 bp, Homo sapiens
catcagctgctgaaa

SEQ ID NO: 181364 - DNA, 17 bp, Homo sapiens
catcagctgctgaaaca

SEQ ID NO: 181365 - DNA, 20 bp, Homo sapiens
catcagcttgccctgttaaa

SEQ ID NO: 181366 - DNA, 20 bp, Homo sapiens
catcatctcctgccttcctc

SEQ ID NO: 181367 - DNA, 14 bp, Homo sapiens
catcattctctgtc

SEQ ID NO: 181368 - DNA, 17 bp, Homo sapiens
catccacatgggagccg

SEQ ID NO: 181369 - DNA, 20 bp, Homo sapiens
catccactagtgcaaatcat

SEQ ID NO: 181370 - DNA, 22 bp, Homo sapiens
catccactagtgcaaatcatag

SEQ ID NO: 181371 - DNA, 13 bp, Homo sapiens
catccatcatcat

SEQ ID NO: 181372 - DNA, 14 bp, Homo sapiens
catccattcctcag

SEQ ID NO: 181373 - DNA, 21 bp, Homo sapiens
catcccaggacaccacaccca

SEQ ID NO: 181374 - DNA, 15 bp, Homo sapiens
catcccattgccctg

SEQ ID NO: 181375 - DNA, 16 bp, Homo sapiens
catcccattgccctgg

SEQ ID NO: 181376 - DNA, 14 bp, Homo sapiens
catcccctgtagag

SEQ ID NO: 181377 - DNA, 21 bp, Homo sapiens
catcccgggacgcagcaggag

SEQ ID NO: 181378 - DNA, 19 bp, Homo sapiens
catccctgattcctgttgt

SEQ ID NO: 181379 - DNA, 21 bp, Homo sapiens
catccctgccagctcttctgc

SEQ ID NO: 181380 - DNA, 14 bp, Homo sapiens
catccctgcctggt

SEQ ID NO: 181381 - DNA, 15 bp, Homo sapiens
catccctgcctggtc

SEQ ID NO: 181382 - DNA, 14 bp, Homo sapiens
catccctggaaggt

SEQ ID NO: 181383 - DNA, 15 bp, Homo sapiens
catccctggaaggtg

SEQ ID NO: 181384 - DNA, 13 bp, Homo sapiens
catccgaggcagg

SEQ ID NO: 181385 - DNA, 21 bp, Homo sapiens
catccgtagttccctgaaaac

SEQ ID NO: 181386 - DNA, 20 bp, Homo sapiens
catcctaatcatccaatgct

SEQ ID NO: 181387 - DNA, 12 bp, Homo sapiens
catcctgcagcc

SEQ ID NO: 181388 - DNA, 23 bp, Homo sapiens
catctaatagcgggttactttca

SEQ ID NO: 181389 - DNA, 13 bp, Homo sapiens
catctatttctga

SEQ ID NO: 181390 - DNA, 15 bp, Homo sapiens
catctatttctgaga

SEQ ID NO: 181391 - DNA, 19 bp, Homo sapiens
catctcactggatgcaaag

SEQ ID NO: 181392 - DNA, 13 bp, Homo sapiens
catctcagcccac

SEQ ID NO: 181393 - DNA, 20 bp, Homo sapiens
catctcagcctaccatgaga

SEQ ID NO: 181394 - DNA, 12 bp, Homo sapiens
catctcaggggc

SEQ ID NO: 181395 - DNA, 19 bp, Homo sapiens
catctcaggggccagagga

SEQ ID NO: 181396 - DNA, 22 bp, Homo sapiens
catctcccagataatgtgaaaa

SEQ ID NO: 181397 - DNA, 20 bp, Homo sapiens
catctcctccatactcagga

SEQ ID NO: 181398 - DNA, 15 bp, Homo sapiens
catctctccctcccc

SEQ ID NO: 181399 - DNA, 12 bp, Homo sapiens
catctgaaagcc

SEQ ID NO: 181400 - DNA, 18 bp, Homo sapiens
catctgcacccccctggg

SEQ ID NO: 181401 - DNA, 20 bp, Homo sapiens
catctgcttacaattccctg

SEQ ID NO: 181402 - DNA, 22 bp, Homo sapiens
catctgtataagtaagaaaata

SEQ ID NO: 181403 - DNA, 11 bp, Homo sapiens
catctgtgtct

SEQ ID NO: 181404 - DNA, 21 bp, Homo sapiens
catcttaggttggcaaaaagg

SEQ ID NO: 181405 - DNA, 22 bp, Homo sapiens
catcttaggttggcaaaaaggc

SEQ ID NO: 181406 - DNA, 20 bp, Homo sapiens
catcttgaccaagcaggaag

SEQ ID NO: 181407 - DNA, 24 bp, Homo sapiens
catcttgaccaagcaggaagctca

SEQ ID NO: 181408 - DNA, 13 bp, Homo sapiens
catgaaatatgca

SEQ ID NO: 181409 - DNA, 12 bp, Homo sapiens
catgacacagct

SEQ ID NO: 181410 - DNA, 19 bp, Homo sapiens
catgacatgttatatattt

SEQ ID NO: 181411 - DNA, 20 bp, Homo sapiens
catgagaataagagaaagaa

SEQ ID NO: 181412 - DNA, 19 bp, Homo sapiens
catgagaccactgttatca

SEQ ID NO: 181413 - DNA, 16 bp, Homo sapiens
catgaggagttgctgt

SEQ ID NO: 181414 - DNA, 16 bp, Homo sapiens
catgaggggcccgagc

SEQ ID NO: 181415 - DNA, 20 bp, Homo sapiens
catgaggggcccgagcagaa

SEQ ID NO: 181416 - DNA, 16 bp, Homo sapiens
catgaggtactgagag

SEQ ID NO: 181417 - DNA, 19 bp, Homo sapiens
catgaggtactgagagtga

SEQ ID NO: 181418 - DNA, 14 bp, Homo sapiens
catgatatgtcagg

SEQ ID NO: 181419 - DNA, 21 bp, Homo sapiens
catgatccctgtgttgtctct

SEQ ID NO: 181420 - DNA, 22 bp, Homo sapiens
catgatccctgtgttgtctcta

SEQ ID NO: 181421 - DNA, 13 bp, Homo sapiens
catgatctccctg

SEQ ID NO: 181422 - DNA, 18 bp, Homo sapiens
catgatctccctgccgcc

SEQ ID NO: 181423 - DNA, 20 bp, Homo sapiens
catgatctccctgccgcctc

SEQ ID NO: 181424 - DNA, 15 bp, Homo sapiens
catgatgagctcctc

SEQ ID NO: 181425 - DNA, 18 bp, Homo sapiens
catgatgagctcctcttc

SEQ ID NO: 181426 - DNA, 22 bp, Homo sapiens
catgatgttaaccagaataaag

SEQ ID NO: 181427 - DNA, 24 bp, Homo sapiens
catgattaaccacttcagctgact

SEQ ID NO: 181428 - DNA, 16 bp, Homo sapiens
catgcatctccacctg

SEQ ID NO: 181429 - DNA, 14 bp, Homo sapiens
catgcattcataca

SEQ ID NO: 181430 - DNA, 19 bp, Homo sapiens
catgccagcttatctcagg

SEQ ID NO: 181431 - DNA, 18 bp, Homo sapiens
catgccccggccacctct

SEQ ID NO: 181432 - DNA, 21 bp, Homo sapiens
catgccttccagcaccctgca

SEQ ID NO: 181433 - DNA, 20 bp, Homo sapiens
catgcgggctgggcagctgt

SEQ ID NO: 181434 - DNA, 14 bp, Homo sapiens
catgctcctggccc

SEQ ID NO: 181435 - DNA, 17 bp, Homo sapiens
catgctcctggcccact

SEQ ID NO: 181436 - DNA, 20 bp, Homo sapiens
catgctctctgcagccagcc

SEQ ID NO: 181437 - DNA, 14 bp, Homo sapiens
catgctgcctccag

SEQ ID NO: 181438 - DNA, 14 bp, Homo sapiens
catggacactccag

SEQ ID NO: 181439 - DNA, 18 bp, Homo sapiens
catggacactccagtgcc

SEQ ID NO: 181440 - DNA, 15 bp, Homo sapiens
catggagaaaccctg

SEQ ID NO: 181441 - DNA, 16 bp, Homo sapiens
catggagaaaccctgt

SEQ ID NO: 181442 - DNA, 15 bp, Homo sapiens
catggagaagcagaa

SEQ ID NO: 181443 - DNA, 16 bp, Homo sapiens
catggaggcacacagc

SEQ ID NO: 181444 - DNA, 13 bp, Homo sapiens
catggcagaaggc

SEQ ID NO: 181445 - DNA, 20 bp, Homo sapiens
catggcttaatgtttattcc

SEQ ID NO: 181446 - DNA, 20 bp, Homo sapiens
catgggaaatgtcaacaagt

SEQ ID NO: 181447 - DNA, 22 bp, Homo sapiens
catgggagccgggtctgcctct

SEQ ID NO: 181448 - DNA, 14 bp, Homo sapiens
catgggaggctcac

SEQ ID NO: 181449 - DNA, 15 bp, Homo sapiens
catgggcagagccca

SEQ ID NO: 181450 - DNA, 17 bp, Homo sapiens
catgggcagagcccaag

SEQ ID NO: 181451 - DNA, 13 bp, Homo sapiens
catgggggcaggg

SEQ ID NO: 181452 - DNA, 17 bp, Homo sapiens
catggtccggtgtcctt

SEQ ID NO: 181453 - DNA, 19 bp, Homo sapiens
catggttaaggtaaagtaa

SEQ ID NO: 181454 - DNA, 16 bp, Homo sapiens
catgtaaactgtgcac

SEQ ID NO: 181455 - DNA, 17 bp, Homo sapiens
catgtaagctgaaaata

SEQ ID NO: 181456 - DNA, 20 bp, Homo sapiens
catgtacatgaagaagctaa

SEQ ID NO: 181457 - DNA, 13 bp, Homo sapiens
catgtaccccaat

SEQ ID NO: 181458 - DNA, 19 bp, Homo sapiens
catgtactgagccttgtaa

SEQ ID NO: 181459 - DNA, 14 bp, Homo sapiens
catgtagcaggact

SEQ ID NO: 181460 - DNA, 20 bp, Homo sapiens
catgtagcaggactgaattg

SEQ ID NO: 181461 - DNA, 18 bp, Homo sapiens
catgtaggaagtaggaag

SEQ ID NO: 181462 - DNA, 17 bp, Homo sapiens
catgtattgcacattgt

SEQ ID NO: 181463 - DNA, 18 bp, Homo sapiens
catgtattgcacattgta

SEQ ID NO: 181464 - DNA, 21 bp, Homo sapiens
catgtattgcacattgtaaaa

SEQ ID NO: 181465 - DNA, 18 bp, Homo sapiens
catgtcagcaaaaagcaa

SEQ ID NO: 181466 - DNA, 20 bp, Homo sapiens
catgtcagcaaaaagcaaaa

SEQ ID NO: 181467 - DNA, 23 bp, Homo sapiens
catgtcagcaaaaagcaaaatca

SEQ ID NO: 181468 - DNA, 21 bp, Homo sapiens
catgtccccaaacctgcaagg

SEQ ID NO: 181469 - DNA, 17 bp, Homo sapiens
catgtccctacacccct

SEQ ID NO: 181470 - DNA, 23 bp, Homo sapiens
catgtccctaccgagtctcttct

SEQ ID NO: 181471 - DNA, 14 bp, Homo sapiens
catgtcgcctctgc

SEQ ID NO: 181472 - DNA, 16 bp, Homo sapiens
catgtgaccactctgt

SEQ ID NO: 181473 - DNA, 12 bp, Homo sapiens
catgtgatcctt

SEQ ID NO: 181474 - DNA, 16 bp, Homo sapiens
catgtgatccttttat

SEQ ID NO: 181475 - DNA, 19 bp, Homo sapiens
catgtgatccttttatgtt

SEQ ID NO: 181476 - DNA, 15 bp, Homo sapiens
catgtgcctgatcca

SEQ ID NO: 181477 - DNA, 17 bp, Homo sapiens
catgtggaatataaaga

SEQ ID NO: 181478 - DNA, 15 bp, Homo sapiens
catgtggggccaggt

SEQ ID NO: 181479 - DNA, 17 bp, Homo sapiens
cacactcccctgcactg

SEQ ID NO: 181480 - DNA, 18 bp, Homo sapiens
cacactgaggcagggaag

SEQ ID NO: 181481 - DNA, 20 bp, Homo sapiens
cacactgcaagagccttggt

SEQ ID NO: 181482 - DNA, 23 bp, Homo sapiens
cacactgtagcattacagtgggt

SEQ ID NO: 181483 - DNA, 17 bp, Homo sapiens
cacacttcaggctcttc

SEQ ID NO: 181484 - DNA, 20 bp, Homo sapiens
cacacttcaggctcttctcc

SEQ ID NO: 181485 - DNA, 19 bp, Homo sapiens
cacacttccaccagcctgc

SEQ ID NO: 181486 - DNA, 15 bp, Homo sapiens
cacagaaagactgag

SEQ ID NO: 181487 - DNA, 13 bp, Homo sapiens
cacagaacccttg

SEQ ID NO: 181488 - DNA, 18 bp, Homo sapiens
cacagaggcttcttcaga

SEQ ID NO: 181489 - DNA, 19 bp, Homo sapiens
cacagcagttgaaaagact

SEQ ID NO: 181490 - DNA, 23 bp, Homo sapiens
cacagcctcccctgccagggcag

SEQ ID NO: 181491 - DNA, 10 bp, Homo sapiens
cacagcctct

SEQ ID NO: 181492 - DNA, 12 bp, Homo sapiens
cacagcctctga

SEQ ID NO: 181493 - DNA, 15 bp, Homo sapiens
cacagcctctgaccc

SEQ ID NO: 181494 - DNA, 17 bp, Homo sapiens
cacagcctctgacccct

SEQ ID NO: 181495 - DNA, 14 bp, Homo sapiens
cacagcggcccctg

SEQ ID NO: 181496 - DNA, 15 bp, Homo sapiens
cacagctacctcttc

SEQ ID NO: 181497 - DNA, 19 bp, Homo sapiens
cacagctcccaccccaccc

SEQ ID NO: 181498 - DNA, 18 bp, Homo sapiens
cacagctgagagactttt

SEQ ID NO: 181499 - DNA, 20 bp, Homo sapiens
cacagctttatcaccagaga

SEQ ID NO: 181500 - DNA, 15 bp, Homo sapiens
cacaggacatttctc

SEQ ID NO: 181501 - DNA, 17 bp, Homo sapiens
cacaggacatttctcta

SEQ ID NO: 181502 - DNA, 13 bp, Homo sapiens
cacaggcaactga

SEQ ID NO: 181503 - DNA, 14 bp, Homo sapiens
cacaggcaactgag

SEQ ID NO: 181504 - DNA, 19 bp, Homo sapiens
cacaggcaactgaggcaga

SEQ ID NO: 181505 - DNA, 20 bp, Homo sapiens
cacaggcaactgaggcagac

SEQ ID NO: 181506 - DNA, 22 bp, Homo sapiens
cacaggcaactgaggcagacag

SEQ ID NO: 181507 - DNA, 16 bp, Homo sapiens
cacaggcccttcctct

SEQ ID NO: 181508 - DNA, 21 bp, Homo sapiens
ccaccaacccatcagaaggag

SEQ ID NO: 181509 - DNA, 11 bp, Homo sapiens
ccaccacccaa

SEQ ID NO: 181510 - DNA, 14 bp, Homo sapiens
ccaccaccccagct

SEQ ID NO: 181511 - DNA, 12 bp, Homo sapiens
ccaccacctagg

SEQ ID NO: 181512 - DNA, 18 bp, Homo sapiens
ccaccacctaggccactc

SEQ ID NO: 181513 - DNA, 12 bp, Homo sapiens
ccaccacctccc

SEQ ID NO: 181514 - DNA, 20 bp, Homo sapiens
ccaccacgatgtggccctgg

SEQ ID NO: 181515 - DNA, 18 bp, Homo sapiens
ccaccatcaccagacagg

SEQ ID NO: 181516 - DNA, 14 bp, Homo sapiens
ccaccatcctgcag

SEQ ID NO: 181517 - DNA, 15 bp, Homo sapiens
ccaccatgcccagct

SEQ ID NO: 181518 - DNA, 12 bp, Homo sapiens
ccacccagccca

SEQ ID NO: 181519 - DNA, 19 bp, Homo sapiens
ccaccccagaaatggtgaa

SEQ ID NO: 181520 - DNA, 17 bp, Homo sapiens
ccaccccagtgcaccca

SEQ ID NO: 181521 - DNA, 19 bp, Homo sapiens
ccaccccctccccagggga

SEQ ID NO: 181522 - DNA, 17 bp, Homo sapiens
ccacccccttcagtgcc

SEQ ID NO: 181523 - DNA, 18 bp, Homo sapiens
ccacccccttcagtgccc

SEQ ID NO: 181524 - DNA, 22 bp, Homo sapiens
ccacccccttcagtgcccacca

SEQ ID NO: 181525 - DNA, 14 bp, Homo sapiens
ccacccttcccctc

SEQ ID NO: 181526 - DNA, 15 bp, Homo sapiens
ccaccgctgcctaag

SEQ ID NO: 181527 - DNA, 17 bp, Homo sapiens
ccacctaggccactcct

SEQ ID NO: 181528 - DNA, 18 bp, Homo sapiens
ccacctaggccactcctc

SEQ ID NO: 181529 - DNA, 20 bp, Homo sapiens
ccacctaggccactcctcca

SEQ ID NO: 181530 - DNA, 16 bp, Homo sapiens
ccacctcagcctcctg

SEQ ID NO: 181531 - DNA, 19 bp, Homo sapiens
ccacctcccctatccaccc

SEQ ID NO: 181532 - DNA, 13 bp, Homo sapiens
ccacctccctcac

SEQ ID NO: 181533 - DNA, 18 bp, Homo sapiens
ccacctctgtgacctcag

SEQ ID NO: 181534 - DNA, 14 bp, Homo sapiens
ccacctgcccaacc

SEQ ID NO: 181535 - DNA, 22 bp, Homo sapiens
ccacctgctgagagacccaagg

SEQ ID NO: 181536 - DNA, 22 bp, Homo sapiens
ccacctggccccatgtctctca

SEQ ID NO: 181537 - DNA, 15 bp, Homo sapiens
ccacctggggcagtc

SEQ ID NO: 181538 - DNA, 17 bp, Homo sapiens
ccacctggtggcctctg

SEQ ID NO: 181539 - DNA, 21 bp, Homo sapiens
ccacctggttccggaatcctg

SEQ ID NO: 181540 - DNA, 19 bp, Homo sapiens
ccacctgtcaaacaaagcc

SEQ ID NO: 181541 - DNA, 20 bp, Homo sapiens
ccacctgtctcagcctccca

SEQ ID NO: 181542 - DNA, 14 bp, Homo sapiens
ccaccttcccatgc

SEQ ID NO: 181543 - DNA, 20 bp, Homo sapiens
ccacctttattaaaatctta

SEQ ID NO: 181544 - DNA, 14 bp, Homo sapiens
ccacgactgtctcc

SEQ ID NO: 181545 - DNA, 20 bp, Homo sapiens
ccacgatgtggccctggcct

SEQ ID NO: 181546 - DNA, 15 bp, Homo sapiens
ccacgccctcccctc

SEQ ID NO: 181547 - DNA, 21 bp, Homo sapiens
ccacgccctcccctcccctgc

SEQ ID NO: 181548 - DNA, 21 bp, Homo sapiens
ccacggagccactcctctgac

SEQ ID NO: 181549 - DNA, 20 bp, Homo sapiens
ccacgtctgctaacttggag

SEQ ID NO: 181550 - DNA, 15 bp, Homo sapiens
ccacgtgccaggccc

SEQ ID NO: 181551 - DNA, 16 bp, Homo sapiens
ccacgtgccaggcccg

SEQ ID NO: 181552 - DNA, 23 bp, Homo sapiens
ccacgtgccaggcccggggctgg

SEQ ID NO: 181553 - DNA, 17 bp, Homo sapiens
ccacgttcacccctcca

SEQ ID NO: 181554 - DNA, 15 bp, Homo sapiens
ccacgttccttactg

SEQ ID NO: 181555 - DNA, 18 bp, Homo sapiens
ccactcaagccaagcagc

SEQ ID NO: 181556 - DNA, 11 bp, Homo sapiens
ccactcagctc

SEQ ID NO: 181557 - DNA, 15 bp, Homo sapiens
ccactcagctccgtg

SEQ ID NO: 181558 - DNA, 12 bp, Homo sapiens
ccactcctctga

SEQ ID NO: 181559 - DNA, 13 bp, Homo sapiens
ccactccttcctg

SEQ ID NO: 181560 - DNA, 22 bp, Homo sapiens
ccactccttcctgccacctgct

SEQ ID NO: 181561 - DNA, 13 bp, Homo sapiens
ccactcgcttccc

SEQ ID NO: 181562 - DNA, 16 bp, Homo sapiens
ccactcgcttccccca

SEQ ID NO: 181563 - DNA, 21 bp, Homo sapiens
ccactcgcttcccccatagcc

SEQ ID NO: 181564 - DNA, 14 bp, Homo sapiens
ccactctcattccc

SEQ ID NO: 181565 - DNA, 16 bp, Homo sapiens
ccactctcattcccca

SEQ ID NO: 181566 - DNA, 16 bp, Homo sapiens
ccactgacagcctccc

SEQ ID NO: 181567 - DNA, 13 bp, Homo sapiens
ccactgagggcag

SEQ ID NO: 181568 - DNA, 19 bp, Homo sapiens
ccactgcactccagcctgg

SEQ ID NO: 181569 - DNA, 20 bp, Homo sapiens
ccactgcactccagcctggg

SEQ ID NO: 181570 - DNA, 16 bp, Homo sapiens
ccactgcctactgcat

SEQ ID NO: 181571 - DNA, 11 bp, Homo sapiens
ccactgcctct

SEQ ID NO: 181572 - DNA, 13 bp, Homo sapiens
ccactgcctcttc

SEQ ID NO: 181573 - DNA, 22 bp, Homo sapiens
ccactggggaaataacagctgt

SEQ ID NO: 181574 - DNA, 19 bp, Homo sapiens
ccactgtcactgtttctct

SEQ ID NO: 181575 - DNA, 15 bp, Homo sapiens
ccactgtgaagagaa

SEQ ID NO: 181576 - DNA, 19 bp, Homo sapiens
ccacttagaaattgcattt

SEQ ID NO: 181577 - DNA, 16 bp, Homo sapiens
ccacttcttttataac

SEQ ID NO: 181578 - DNA, 16 bp, Homo sapiens
ccacttgggtcttccc

SEQ ID NO: 181579 - DNA, 17 bp, Homo sapiens
ccacttgggtcttccct

SEQ ID NO: 181580 - DNA, 16 bp, Homo sapiens
ccacttttattcattt

SEQ ID NO: 181581 - DNA, 17 bp, Homo sapiens
ccagaacacactccatc

SEQ ID NO: 181582 - DNA, 19 bp, Homo sapiens
ccagaacgtggctctgctg

SEQ ID NO: 181583 - DNA, 21 bp, Homo sapiens
ccagaacgtggctctgctggc

SEQ ID NO: 181584 - DNA, 22 bp, Homo sapiens
ccagaagtttgagatcagcctg

SEQ ID NO: 181585 - DNA, 23 bp, Homo sapiens
ccagaatggtctttctaatgtgt

SEQ ID NO: 181586 - DNA, 14 bp, Homo sapiens
ccagacatcaacag

SEQ ID NO: 181587 - DNA, 14 bp, Homo sapiens
ccagacccctggct

SEQ ID NO: 181588 - DNA, 13 bp, Homo sapiens
ccagacctgagct

SEQ ID NO: 181589 - DNA, 15 bp, Homo sapiens
ccagacctgagctcc

SEQ ID NO: 181590 - DNA, 19 bp, Homo sapiens
ccagaccttgttcacactc

SEQ ID NO: 181591 - DNA, 14 bp, Homo sapiens
ccagaccttttatc

SEQ ID NO: 181592 - DNA, 16 bp, Homo sapiens
ccagacggttcaccag

SEQ ID NO: 181593 - DNA, 18 bp, Homo sapiens
ccagacggttcaccagcc

SEQ ID NO: 181594 - DNA, 20 bp, Homo sapiens
ccagacggttcaccagcctc

SEQ ID NO: 181595 - DNA, 13 bp, Homo sapiens
ccagactgtgtat

SEQ ID NO: 181596 - DNA, 20 bp, Homo sapiens
ccagactttacatgacacag

SEQ ID NO: 181597 - DNA, 18 bp, Homo sapiens
ccagagaccgtcctcacc

SEQ ID NO: 181598 - DNA, 19 bp, Homo sapiens
ccagagacggaagcctttt

SEQ ID NO: 181599 - DNA, 18 bp, Homo sapiens
ccagagagcaactctgag

SEQ ID NO: 181600 - DNA, 21 bp, Homo sapiens
ccagagagcaactctgagatc

SEQ ID NO: 181601 - DNA, 14 bp, Homo sapiens
ccagagagtggctc

SEQ ID NO: 181602 - DNA, 15 bp, Homo sapiens
ccagagagtggctcc

SEQ ID NO: 181603 - DNA, 14 bp, Homo sapiens
ccagagatgcctcc

SEQ ID NO: 181604 - DNA, 20 bp, Homo sapiens
ccagagatgcctccaccgct

SEQ ID NO: 181605 - DNA, 23 bp, Homo sapiens
ccagagatgcctccaccgctgcc

SEQ ID NO: 181606 - DNA, 22 bp, Homo sapiens
ccagagatgggactgggagggc

SEQ ID NO: 181607 - DNA, 14 bp, Homo sapiens
ccagagcaggaagc

SEQ ID NO: 181608 - DNA, 14 bp, Homo sapiens
ccagagcagggtgt

SEQ ID NO: 181609 - DNA, 14 bp, Homo sapiens
ccagaggaactgtc

SEQ ID NO: 181610 - DNA, 17 bp, Homo sapiens
cctctgactcagggctc

SEQ ID NO: 181611 - DNA, 20 bp, Homo sapiens
cctctgcacaagctgcaccc

SEQ ID NO: 181612 - DNA, 19 bp, Homo sapiens
cctctgccaaaggatgtga

SEQ ID NO: 181613 - DNA, 17 bp, Homo sapiens
cctctgccaccagagac

SEQ ID NO: 181614 - DNA, 24 bp, Homo sapiens
cctctgccaccagagaccgtcctc

SEQ ID NO: 181615 - DNA, 11 bp, Homo sapiens
cctctgcctca

SEQ ID NO: 181616 - DNA, 12 bp, Homo sapiens
cctctgcctcaa

SEQ ID NO: 181617 - DNA, 17 bp, Homo sapiens
cctctgcggaccccagc

SEQ ID NO: 181618 - DNA, 21 bp, Homo sapiens
cctctgctggcacatttcccc

SEQ ID NO: 181619 - DNA, 18 bp, Homo sapiens
cctctggccctgccttct

SEQ ID NO: 181620 - DNA, 15 bp, Homo sapiens
cctctgtccaggcac

SEQ ID NO: 181621 - DNA, 17 bp, Homo sapiens
cctctgtccaggcactg

SEQ ID NO: 181622 - DNA, 14 bp, Homo sapiens
cctctgtccagggc

SEQ ID NO: 181623 - DNA, 15 bp, Homo sapiens
cctctgtccagggcc

SEQ ID NO: 181624 - DNA, 20 bp, Homo sapiens
cctctgtccagggccctgag

SEQ ID NO: 181625 - DNA, 15 bp, Homo sapiens
cctctgtgacctcag

SEQ ID NO: 181626 - DNA, 17 bp, Homo sapiens
cctctgtgacctcaggc

SEQ ID NO: 181627 - DNA, 17 bp, Homo sapiens
cctcttaaagctgcctg

SEQ ID NO: 181628 - DNA, 22 bp, Homo sapiens
cctgtagttaggaaataaaacc

SEQ ID NO: 181629 - DNA, 13 bp, Homo sapiens
cctgtccctccca

SEQ ID NO: 181630 - DNA, 16 bp, Homo sapiens
cctgtccctcccacct

SEQ ID NO: 181631 - DNA, 15 bp, Homo sapiens
cctgtcctcactgct

SEQ ID NO: 181632 - DNA, 21 bp, Homo sapiens
cctgtcctcactgctccctga

SEQ ID NO: 181633 - DNA, 21 bp, Homo sapiens
cctgtccttctctcacctcct

SEQ ID NO: 181634 - DNA, 23 bp, Homo sapiens
cctgtctcctttcaccccagggc

SEQ ID NO: 181635 - DNA, 13 bp, Homo sapiens
cctgtctcttcca

SEQ ID NO: 181636 - DNA, 16 bp, Homo sapiens
cctgtctgccagccag

SEQ ID NO: 181637 - DNA, 17 bp, Homo sapiens
cctgtctgccagccagc

SEQ ID NO: 181638 - DNA, 15 bp, Homo sapiens
cctgtcttcctgcat

SEQ ID NO: 181639 - DNA, 19 bp, Homo sapiens
cctgtcttcctgcattcac

SEQ ID NO: 181640 - DNA, 22 bp, Homo sapiens
cctgtcttcctgcattcaccca

SEQ ID NO: 181641 - DNA, 17 bp, Homo sapiens
cctgtgaggcaggggcg

SEQ ID NO: 181642 - DNA, 20 bp, Homo sapiens
cctgtgcagccgctgagcga

SEQ ID NO: 181643 - DNA, 21 bp, Homo sapiens
cctgtgcagccgctgagcgag

SEQ ID NO: 181644 - DNA, 15 bp, Homo sapiens
cctgtgcctctggga

SEQ ID NO: 181645 - DNA, 19 bp, Homo sapiens
cctgtgcctctgggactgg

SEQ ID NO: 181646 - DNA, 22 bp, Homo sapiens
cctgtgcttcgggcccttccca

SEQ ID NO: 181647 - DNA, 16 bp, Homo sapiens
cctgtggcggtgcctg

SEQ ID NO: 181648 - DNA, 19 bp, Homo sapiens
cctgtggcggtgcctgggt

SEQ ID NO: 181649 - DNA, 20 bp, Homo sapiens
cctgtgttgtctctagagca

SEQ ID NO: 181650 - DNA, 20 bp, Homo sapiens
cctgttaaaagatgaaaata

SEQ ID NO: 181651 - DNA, 21 bp, Homo sapiens
cctgttaaaagatgaaaatat

SEQ ID NO: 181652 - DNA, 23 bp, Homo sapiens
cctgttacctaattagagcagat

SEQ ID NO: 181653 - DNA, 21 bp, Homo sapiens
cctgtttaatatttaaacagc

SEQ ID NO: 181654 - DNA, 17 bp, Homo sapiens
cctgtttttaagctgtt

SEQ ID NO: 181655 - DNA, 16 bp, Homo sapiens
cctgtttttctgggtg

SEQ ID NO: 181656 - DNA, 20 bp, Homo sapiens
ccttaaggacaaaaatgaac

SEQ ID NO: 181657 - DNA, 21 bp, Homo sapiens
ccttacagtaggagcccagct

SEQ ID NO: 181658 - DNA, 18 bp, Homo sapiens
ccttaccaactttctgta

SEQ ID NO: 181659 - DNA, 12 bp, Homo sapiens
ccttactgcaga

SEQ ID NO: 181660 - DNA, 14 bp, Homo sapiens
ccttagaacctttc

SEQ ID NO: 181661 - DNA, 15 bp, Homo sapiens
ccttaggcagggaag

SEQ ID NO: 181662 - DNA, 17 bp, Homo sapiens
ccttatctgtgctcagg

SEQ ID NO: 181663 - DNA, 14 bp, Homo sapiens
ccttcaaccattcc

SEQ ID NO: 181664 - DNA, 24 bp, Homo sapiens
ccttcaactgaaaagactcagtgt

SEQ ID NO: 181665 - DNA, 11 bp, Homo sapiens
ccttcagtgcc

SEQ ID NO: 181666 - DNA, 15 bp, Homo sapiens
ccttcagtgcccacc

SEQ ID NO: 181667 - DNA, 19 bp, Homo sapiens
ccttccaacaggagctggg

SEQ ID NO: 181668 - DNA, 21 bp, Homo sapiens
ccttccacggatccatgtagc

SEQ ID NO: 181669 - DNA, 17 bp, Homo sapiens
ccttccatctcgccacc

SEQ ID NO: 181670 - DNA, 18 bp, Homo sapiens
ccttccatgtcgcctctg

SEQ ID NO: 181671 - DNA, 21 bp, Homo sapiens
ccttccatgtcgcctctgcat

SEQ ID NO: 181672 - DNA, 16 bp, Homo sapiens
ccttcccaaaggactc

SEQ ID NO: 181673 - DNA, 18 bp, Homo sapiens
ccttcccaaaggactcca

SEQ ID NO: 181674 - DNA, 12 bp, Homo sapiens
ccttcccagctc

SEQ ID NO: 181675 - DNA, 17 bp, Homo sapiens
ccttcccagctctccct

SEQ ID NO: 181676 - DNA, 19 bp, Homo sapiens
ccttccccctccaatccca

SEQ ID NO: 181677 - DNA, 12 bp, Homo sapiens
ccttccctctcc

SEQ ID NO: 181678 - DNA, 11 bp, Homo sapiens
ccttccctggc

SEQ ID NO: 181679 - DNA, 14 bp, Homo sapiens
ccttcctctccact

SEQ ID NO: 181680 - DNA, 17 bp, Homo sapiens
ccttcctctccactgcc

SEQ ID NO: 181681 - DNA, 17 bp, Homo sapiens
ccttcctgtcttcctgc

SEQ ID NO: 181682 - DNA, 16 bp, Homo sapiens
ccttccttccctggct

SEQ ID NO: 181683 - DNA, 20 bp, Homo sapiens
ccttcgatacaccgggcctg

SEQ ID NO: 181684 - DNA, 23 bp, Homo sapiens
ccttcgatacaccgggcctggag

SEQ ID NO: 181685 - DNA, 19 bp, Homo sapiens
ccttcgtttactatgcctg

SEQ ID NO: 181686 - DNA, 20 bp, Homo sapiens
ccttcgtttactatgcctgt

SEQ ID NO: 181687 - DNA, 23 bp, Homo sapiens
ccttcgtttactatgcctgtgtc

SEQ ID NO: 181688 - DNA, 14 bp, Homo sapiens
ccttctcagaatct

SEQ ID NO: 181689 - DNA, 11 bp, Homo sapiens
ccttctccatc

SEQ ID NO: 181690 - DNA, 13 bp, Homo sapiens
ccttctccatcca

SEQ ID NO: 181691 - DNA, 18 bp, Homo sapiens
ccttctctcacctcctaa

SEQ ID NO: 181692 - DNA, 22 bp, Homo sapiens
ccttctgtaaaggtttttggaa

SEQ ID NO: 181693 - DNA, 18 bp, Homo sapiens
ccttcttattctcactcc

SEQ ID NO: 181694 - DNA, 22 bp, Homo sapiens
ccttcttattctcactccacca

SEQ ID NO: 181695 - DNA, 18 bp, Homo sapiens
ccttcttccatcccagga

SEQ ID NO: 181696 - DNA, 19 bp, Homo sapiens
ccttcttccatcccaggac

SEQ ID NO: 181697 - DNA, 21 bp, Homo sapiens
ccttgaatatcccctcccagt

SEQ ID NO: 181698 - DNA, 21 bp, Homo sapiens
ccttgaccagcagatcccagc

SEQ ID NO: 181699 - DNA, 23 bp, Homo sapiens
ccttgaccagcagatcccagctc

SEQ ID NO: 181700 - DNA, 19 bp, Homo sapiens
ccttgagaaaccttattgt

SEQ ID NO: 181701 - DNA, 16 bp, Homo sapiens
ccttgagacctcagcc

SEQ ID NO: 181702 - DNA, 14 bp, Homo sapiens
ccttgatctgtata

SEQ ID NO: 181703 - DNA, 19 bp, Homo sapiens
ccttgatggagatatttac

SEQ ID NO: 181704 - DNA, 18 bp, Homo sapiens
ccttgcacccctcactct

SEQ ID NO: 181705 - DNA, 13 bp, Homo sapiens
ccttgcccagggc

SEQ ID NO: 181706 - DNA, 19 bp, Homo sapiens
ccttgcctcaatgccagta

SEQ ID NO: 181707 - DNA, 20 bp, Homo sapiens
ccttgcctcaatgccagtaa

SEQ ID NO: 181708 - DNA, 21 bp, Homo sapiens
ccttgcgcttttgctggtcac

SEQ ID NO: 181709 - DNA, 16 bp, Homo sapiens
ccttggaggccagcca

SEQ ID NO: 181710 - DNA, 16 bp, Homo sapiens
ccttggcttgcccacg

SEQ ID NO: 181711 - DNA, 19 bp, Homo sapiens
ccttgggaggccccactgg

SEQ ID NO: 181712 - DNA, 17 bp, Homo sapiens
ccttgggccctttgagt

SEQ ID NO: 181713 - DNA, 14 bp, Homo sapiens
ccttggggcaggca

SEQ ID NO: 181714 - DNA, 16 bp, Homo sapiens
ccttggggcaggcagt

SEQ ID NO: 181715 - DNA, 15 bp, Homo sapiens
ccttggtggcaagag

SEQ ID NO: 181716 - DNA, 17 bp, Homo sapiens
ccttggtggcaagagcc

SEQ ID NO: 181717 - DNA, 16 bp, Homo sapiens
ccttggtgtccacctg

SEQ ID NO: 181718 - DNA, 17 bp, Homo sapiens
ccttggtgtccacctgg

SEQ ID NO: 181719 - DNA, 16 bp, Homo sapiens
ccttggttcccccact

SEQ ID NO: 181720 - DNA, 16 bp, Homo sapiens
ccttgtaattctaaat

SEQ ID NO: 181721 - DNA, 13 bp, Homo sapiens
ccttgtatttaaa

SEQ ID NO: 181722 - DNA, 16 bp, Homo sapiens
ccttgtatttaaatat

SEQ ID NO: 181723 - DNA, 15 bp, Homo sapiens
cctttcaaatttcac

SEQ ID NO: 181724 - DNA, 16 bp, Homo sapiens
cctttcaaatttcaca

SEQ ID NO: 181725 - DNA, 22 bp, Homo sapiens
cctttcacaaaattttattcct

SEQ ID NO: 181726 - DNA, 15 bp, Homo sapiens
cctttcacaaccttc

SEQ ID NO: 181727 - DNA, 15 bp, Homo sapiens
cctttccccagccca

SEQ ID NO: 181728 - DNA, 16 bp, Homo sapiens
cctttccccagcccag

SEQ ID NO: 181729 - DNA, 20 bp, Homo sapiens
cctttccctccactccttcc

SEQ ID NO: 181730 - DNA, 12 bp, Homo sapiens
cctttgaagagg

SEQ ID NO: 181731 - DNA, 22 bp, Homo sapiens
cctttgagtgcagtcctgatca

SEQ ID NO: 181732 - DNA, 22 bp, Homo sapiens
cctttgctgtgaggctgtcctg

SEQ ID NO: 181733 - DNA, 19 bp, Homo sapiens
cctttgtttttttttcctg

SEQ ID NO: 181734 - DNA, 15 bp, Homo sapiens
ccttttatgttattt

SEQ ID NO: 181735 - DNA, 15 bp, Homo sapiens
ccttttcactacacc

SEQ ID NO: 181736 - DNA, 21 bp, Homo sapiens
cctttttccccaaagtcttaa

SEQ ID NO: 181737 - DNA, 22 bp, Homo sapiens
ccttttttcacggaagttttca

SEQ ID NO: 181738 - DNA, 22 bp, Homo sapiens
cgaaacaggctactctcctcgg

SEQ ID NO: 181739 - DNA, 14 bp, Homo sapiens
cgaaaccccatctc

SEQ ID NO: 181740 - DNA, 22 bp, Homo sapiens
cgaaatgttattttttaattat

SEQ ID NO: 181741 - DNA, 20 bp, Homo sapiens
cgaacatggaactcattcct

SEQ ID NO: 181742 - DNA, 14 bp, Homo sapiens
cgaacccacctgct

SEQ ID NO: 181743 - DNA, 23 bp, Homo sapiens
cgaacccacctgctgagagaccc

SEQ ID NO: 181744 - DNA, 13 bp, Homo sapiens
cgaaccccaagga

SEQ ID NO: 181745 - DNA, 18 bp, Homo sapiens
cgaagaagggtccttccc

SEQ ID NO: 181746 - DNA, 16 bp, Homo sapiens
cgaattaatagctttt

SEQ ID NO: 181747 - DNA, 12 bp, Homo sapiens
cgacagcctggc

SEQ ID NO: 181748 - DNA, 12 bp, Homo sapiens
cgaccacctgcc

SEQ ID NO: 181749 - DNA, 14 bp, Homo sapiens
cgaccacctgccca

SEQ ID NO: 181750 - DNA, 12 bp, Homo sapiens
cgacctcagcct

SEQ ID NO: 181751 - DNA, 13 bp, Homo sapiens
cgacctcagcctt

SEQ ID NO: 181752 - DNA, 22 bp, Homo sapiens
cgacctcgtcctccccctgcca

SEQ ID NO: 181753 - DNA, 15 bp, Homo sapiens
cgacgcgtctcctgt

SEQ ID NO: 181754 - DNA, 17 bp, Homo sapiens
cgagaccaacctgacca

SEQ ID NO: 181755 - DNA, 19 bp, Homo sapiens
cgagagcctgctcccccac

SEQ ID NO: 181756 - DNA, 19 bp, Homo sapiens
cgagagtagccgagagcct

SEQ ID NO: 181757 - DNA, 20 bp, Homo sapiens
cgagagtagccgagagcctg

SEQ ID NO: 181758 - DNA, 23 bp, Homo sapiens
cgagccctgtggatgagccctca

SEQ ID NO: 181759 - DNA, 14 bp, Homo sapiens
cgaggaaactcaga

SEQ ID NO: 181760 - DNA, 11 bp, Homo sapiens
cgaggaagccc

SEQ ID NO: 181761 - DNA, 16 bp, Homo sapiens
cgaggtatgaggtcta

SEQ ID NO: 181762 - DNA, 16 bp, Homo sapiens
cgaggtcaacagagaa

SEQ ID NO: 181763 - DNA, 21 bp, Homo sapiens
cgaggtcaacagagaaggcag

SEQ ID NO: 181764 - DNA, 14 bp, Homo sapiens
cgagtcactgcctc

SEQ ID NO: 181765 - DNA, 18 bp, Homo sapiens
cgagtcactgcctctccc

SEQ ID NO: 181766 - DNA, 21 bp, Homo sapiens
cgagtctcttctccactggat

SEQ ID NO: 181767 - DNA, 21 bp, Homo sapiens
cgatacaccgggcctggagaa

SEQ ID NO: 181768 - DNA, 20 bp, Homo sapiens
cgatccacctgtctcagcct

SEQ ID NO: 181769 - DNA, 11 bp, Homo sapiens
cgatgtggccc

SEQ ID NO: 181770 - DNA, 16 bp, Homo sapiens
ctaatcctctttttct

SEQ ID NO: 181771 - DNA, 22 bp, Homo sapiens
ctaatcttcagggcactgctgc

SEQ ID NO: 181772 - DNA, 14 bp, Homo sapiens
ctaatgtactgcat

SEQ ID NO: 181773 - DNA, 15 bp, Homo sapiens
ctaattcctttctat

SEQ ID NO: 181774 - DNA, 21 bp, Homo sapiens
ctaatttatcttgtctctggg

SEQ ID NO: 181775 - DNA, 12 bp, Homo sapiens
ctaatttttaag

SEQ ID NO: 181776 - DNA, 17 bp, Homo sapiens
ctaatttttaagcaaaa

SEQ ID NO: 181777 - DNA, 15 bp, Homo sapiens
ctacaaaaacacagc

SEQ ID NO: 181778 - DNA, 16 bp, Homo sapiens
ctacaaaaacacagca

SEQ ID NO: 181779 - DNA, 14 bp, Homo sapiens
ctacaacttcagca

SEQ ID NO: 181780 - DNA, 19 bp, Homo sapiens
ctacaagctaaaattagat

SEQ ID NO: 181781 - DNA, 18 bp, Homo sapiens
ctacacccttttccagct

SEQ ID NO: 181782 - DNA, 22 bp, Homo sapiens
ctacagagaacctggagttcct

SEQ ID NO: 181783 - DNA, 17 bp, Homo sapiens
ctacagagcttccctga

SEQ ID NO: 181784 - DNA, 15 bp, Homo sapiens
ctacagtcaggaaag

SEQ ID NO: 181785 - DNA, 21 bp, Homo sapiens
ctacagtcaggaaaggaatca

SEQ ID NO: 181786 - DNA, 13 bp, Homo sapiens
ctacagttgaaaa

SEQ ID NO: 181787 - DNA, 22 bp, Homo sapiens
ctacagttgaaaaacagctgag

SEQ ID NO: 181788 - DNA, 18 bp, Homo sapiens
ctacataaactgacttta

SEQ ID NO: 181789 - DNA, 20 bp, Homo sapiens
ctacataaactgactttatc

SEQ ID NO: 181790 - DNA, 18 bp, Homo sapiens
ctacatactatggaattt

SEQ ID NO: 181791 - DNA, 11 bp, Homo sapiens
ctaccacctcc

SEQ ID NO: 181792 - DNA, 17 bp, Homo sapiens
ctaccacctccccagcc

SEQ ID NO: 181793 - DNA, 17 bp, Homo sapiens
ctaccactcctgccaag

SEQ ID NO: 181794 - DNA, 15 bp, Homo sapiens
ctaccatcagggaca

SEQ ID NO: 181795 - DNA, 11 bp, Homo sapiens
ctacccagggc

SEQ ID NO: 181796 - DNA, 14 bp, Homo sapiens
ctacccagggcctg

SEQ ID NO: 181797 - DNA, 13 bp, Homo sapiens
ctaccccaccacg

SEQ ID NO: 181798 - DNA, 17 bp, Homo sapiens
ctacctcactggggtcc

SEQ ID NO: 181799 - DNA, 20 bp, Homo sapiens
ctacctgacactcccttggg

SEQ ID NO: 181800 - DNA, 17 bp, Homo sapiens
ctacgttaccaggcagg

SEQ ID NO: 181801 - DNA, 21 bp, Homo sapiens
ctactacatcgccctccacat

SEQ ID NO: 181802 - DNA, 15 bp, Homo sapiens
ctactcagcagccct

SEQ ID NO: 181803 - DNA, 17 bp, Homo sapiens
ctactcagcagccctcc

SEQ ID NO: 181804 - DNA, 22 bp, Homo sapiens
ctactcagcagccctcctcacc

SEQ ID NO: 181805 - DNA, 20 bp, Homo sapiens
ctactgacatgtggggccag

SEQ ID NO: 181806 - DNA, 20 bp, Homo sapiens
ctacttcctgtgacttcagc

SEQ ID NO: 181807 - DNA, 15 bp, Homo sapiens
ctacttgggaggctg

SEQ ID NO: 181808 - DNA, 15 bp, Homo sapiens
ctactttaagcacta

SEQ ID NO: 181809 - DNA, 14 bp, Homo sapiens
ctagaaacttccaa

SEQ ID NO: 181810 - DNA, 13 bp, Homo sapiens
ctagaaatatgat

SEQ ID NO: 181811 - DNA, 15 bp, Homo sapiens
ctagaaatatgattt

SEQ ID NO: 181812 - DNA, 16 bp, Homo sapiens
ctagaattccctctct

SEQ ID NO: 181813 - DNA, 20 bp, Homo sapiens
ctagaattccctctctctga

SEQ ID NO: 181814 - DNA, 22 bp, Homo sapiens
ctagaattccctctctctgact

SEQ ID NO: 181815 - DNA, 15 bp, Homo sapiens
ctagaatttattcaa

SEQ ID NO: 181816 - DNA, 22 bp, Homo sapiens
ctagaatttattcaattcctct

SEQ ID NO: 181817 - DNA, 23 bp, Homo sapiens
ctagaatttattcaattcctctg

SEQ ID NO: 181818 - DNA, 19 bp, Homo sapiens
ctagagtctgaacagctgt

SEQ ID NO: 181819 - DNA, 20 bp, Homo sapiens
ctagagtctgaacagctgta

SEQ ID NO: 181820 - DNA, 21 bp, Homo sapiens
ctagagtgaacttgggccact

SEQ ID NO: 181821 - DNA, 17 bp, Homo sapiens
ctagcactttgggaggc

SEQ ID NO: 181822 - DNA, 22 bp, Homo sapiens
ctagcagcagggagggcttctg

SEQ ID NO: 181823 - DNA, 15 bp, Homo sapiens
ctagccaccaactct

SEQ ID NO: 181824 - DNA, 22 bp, Homo sapiens
ctagccaccaactcttgcaggt

SEQ ID NO: 181825 - DNA, 13 bp, Homo sapiens
ctagcccaggaga

SEQ ID NO: 181826 - DNA, 18 bp, Homo sapiens
ctagcccaggagagagaa

SEQ ID NO: 181827 - DNA, 23 bp, Homo sapiens
ctagcccaggagagagaaagcca

SEQ ID NO: 181828 - DNA, 13 bp, Homo sapiens
ctagcccctgtgg

SEQ ID NO: 181829 - DNA, 14 bp, Homo sapiens
ctagcccctgtgga

SEQ ID NO: 181830 - DNA, 16 bp, Homo sapiens
ctagcctttggctctg

SEQ ID NO: 181831 - DNA, 17 bp, Homo sapiens
ctagcctttggctctgg

SEQ ID NO: 181832 - DNA, 20 bp, Homo sapiens
ctagcctttggctctggaga

SEQ ID NO: 181833 - DNA, 23 bp, Homo sapiens
ctagcctttggctctggagacag

SEQ ID NO: 181834 - DNA, 16 bp, Homo sapiens
ctagcgctgccgcacc

SEQ ID NO: 181835 - DNA, 15 bp, Homo sapiens
ctagctagaaatatg

SEQ ID NO: 181836 - DNA, 21 bp, Homo sapiens
ctaggcatttgctgaatacag

SEQ ID NO: 181837 - DNA, 14 bp, Homo sapiens
ctaggccactcctc

SEQ ID NO: 181838 - DNA, 19 bp, Homo sapiens
ctaggccactcctccaaag

SEQ ID NO: 181839 - DNA, 15 bp, Homo sapiens
ctaggctggagccca

SEQ ID NO: 181840 - DNA, 19 bp, Homo sapiens
ctagggaaaaaccagcgtg

SEQ ID NO: 181841 - DNA, 23 bp, Homo sapiens
ctagggatccctcatctgtccct

SEQ ID NO: 181842 - DNA, 16 bp, Homo sapiens
ctagggccaagcccag

SEQ ID NO: 181843 - DNA, 17 bp, Homo sapiens
ctagtagttcctgctac

SEQ ID NO: 181844 - DNA, 15 bp, Homo sapiens
ctagtatcaaaagaa

SEQ ID NO: 181845 - DNA, 21 bp, Homo sapiens
ctagtgaaggcttctctctgt

SEQ ID NO: 181846 - DNA, 14 bp, Homo sapiens
ctagtgaatgaatc

SEQ ID NO: 181847 - DNA, 19 bp, Homo sapiens
ctagtgacttgtgtcccat

SEQ ID NO: 181848 - DNA, 15 bp, Homo sapiens
ctagtggcttcaaaa

SEQ ID NO: 181849 - DNA, 19 bp, Homo sapiens
ctagtggggtctccctctc

SEQ ID NO: 181850 - DNA, 19 bp, Homo sapiens
ctagttttcagtttgtata

SEQ ID NO: 181851 - DNA, 22 bp, Homo sapiens
ctagttttcagtttgtatatac

SEQ ID NO: 181852 - DNA, 17 bp, Homo sapiens
ctataaagtaaagctaa

SEQ ID NO: 181853 - DNA, 19 bp, Homo sapiens
ctatacgcagcgtgcttta

SEQ ID NO: 181854 - DNA, 13 bp, Homo sapiens
ctatatgatttat

SEQ ID NO: 181855 - DNA, 16 bp, Homo sapiens
ctatatgatttatagt

SEQ ID NO: 181856 - DNA, 19 bp, Homo sapiens
ctatatgatttatagtttg

SEQ ID NO: 181857 - DNA, 16 bp, Homo sapiens
ctatcaaactgaagcc

SEQ ID NO: 181858 - DNA, 20 bp, Homo sapiens
ctatcaatagtcaagaaaaa

SEQ ID NO: 181859 - DNA, 13 bp, Homo sapiens
ctatcagaagacc

SEQ ID NO: 181860 - DNA, 15 bp, Homo sapiens
ctatcagcctgtctc

SEQ ID NO: 181861 - DNA, 17 bp, Homo sapiens
ctatccacccagcccat

SEQ ID NO: 181862 - DNA, 19 bp, Homo sapiens
ctatccacccagcccattc

SEQ ID NO: 181863 - DNA, 19 bp, Homo sapiens
ctatcctgaaaattctgta

SEQ ID NO: 181864 - DNA, 14 bp, Homo sapiens
ctatgctgcctagg

SEQ ID NO: 181865 - DNA, 22 bp, Homo sapiens
ctatgtaacatgtaggaagtag

SEQ ID NO: 181866 - DNA, 16 bp, Homo sapiens
ctattaagatttccaa

SEQ ID NO: 181867 - DNA, 16 bp, Homo sapiens
ctattataatttaatg

SEQ ID NO: 181868 - DNA, 18 bp, Homo sapiens
ctattcaaacagtctcag

SEQ ID NO: 181869 - DNA, 22 bp, Homo sapiens
ctattcaaggtggccaaattat

SEQ ID NO: 181870 - DNA, 16 bp, Homo sapiens
ctattgctgcttgagg

SEQ ID NO: 181871 - DNA, 11 bp, Homo sapiens
ctattggtaaa

SEQ ID NO: 181872 - DNA, 22 bp, Homo sapiens
ctattgtcccctagcaaggcat

SEQ ID NO: 181873 - DNA, 22 bp, Homo sapiens
ctattgtttattctttttaaag

SEQ ID NO: 181874 - DNA, 20 bp, Homo sapiens
ctatttagtttttgtaattt

SEQ ID NO: 181875 - DNA, 15 bp, Homo sapiens
ctatttatttactga

SEQ ID NO: 181876 - DNA, 14 bp, Homo sapiens
ctatttccattcca

SEQ ID NO: 181877 - DNA, 15 bp, Homo sapiens
ctatttctcctccat

SEQ ID NO: 181878 - DNA, 17 bp, Homo sapiens
ctcaaaactgcactgtc

SEQ ID NO: 181879 - DNA, 22 bp, Homo sapiens
ctcaaagacaatgttattttcc

SEQ ID NO: 181880 - DNA, 21 bp, Homo sapiens
ctcaaatcttttagtcattat

SEQ ID NO: 181881 - DNA, 19 bp, Homo sapiens
ctcaagagggcactggtgg

SEQ ID NO: 181882 - DNA, 16 bp, Homo sapiens
ctcaagatgaaggcaa

SEQ ID NO: 181883 - DNA, 22 bp, Homo sapiens
ctcaagtgtctcagtccacctg

SEQ ID NO: 181884 - DNA, 14 bp, Homo sapiens
ctcaagttgaaaga

SEQ ID NO: 181885 - DNA, 20 bp, Homo sapiens
ctgttaaaagatgaaaatat

SEQ ID NO: 181886 - DNA, 18 bp, Homo sapiens
ctgttaaattgctgtgta

SEQ ID NO: 181887 - DNA, 12 bp, Homo sapiens
ctgttcacccac

SEQ ID NO: 181888 - DNA, 15 bp, Homo sapiens
ctgttcactctactt

SEQ ID NO: 181889 - DNA, 22 bp, Homo sapiens
ctgttcagctactcccactccc

SEQ ID NO: 181890 - DNA, 18 bp, Homo sapiens
ctgttcagctggttgagg

SEQ ID NO: 181891 - DNA, 18 bp, Homo sapiens
ctgttcccattcttgcat

SEQ ID NO: 181892 - DNA, 21 bp, Homo sapiens
ctgttgaaaattattttaaac

SEQ ID NO: 181893 - DNA, 13 bp, Homo sapiens
ctgttgccagaga

SEQ ID NO: 181894 - DNA, 21 bp, Homo sapiens
ctgttggcagtgagtgagcct

SEQ ID NO: 181895 - DNA, 22 bp, Homo sapiens
ctgttggcagtgagtgagcctg

SEQ ID NO: 181896 - DNA, 20 bp, Homo sapiens
ctgttgttttgttttaaata

SEQ ID NO: 181897 - DNA, 20 bp, Homo sapiens
ctgtttaatatttaaacagc

SEQ ID NO: 181898 - DNA, 13 bp, Homo sapiens
ctgtttctctgct

SEQ ID NO: 181899 - DNA, 22 bp, Homo sapiens
ctgttttaaatttatttcaaaa

SEQ ID NO: 181900 - DNA, 13 bp, Homo sapiens
ctgttttctcttg

SEQ ID NO: 181901 - DNA, 12 bp, Homo sapiens
ctgttttgaatt

SEQ ID NO: 181902 - DNA, 19 bp, Homo sapiens
ctgtttttaagctgtttcc

SEQ ID NO: 181903 - DNA, 21 bp, Homo sapiens
ctgtttttctgggtggcctcg

SEQ ID NO: 181904 - DNA, 13 bp, Homo sapiens
ctgttttttagtt

SEQ ID NO: 181905 - DNA, 15 bp, Homo sapiens
cttaaaaaaatgaca

SEQ ID NO: 181906 - DNA, 17 bp, Homo sapiens
cttaaaaaaatgacaga

SEQ ID NO: 181907 - DNA, 18 bp, Homo sapiens
cttaaaaaacttgtaaat

SEQ ID NO: 181908 - DNA, 17 bp, Homo sapiens
cttaaaaaataaaaact

SEQ ID NO: 181909 - DNA, 12 bp, Homo sapiens
cttaaaaatggt

SEQ ID NO: 181910 - DNA, 20 bp, Homo sapiens
cttaaaatattcctgcattt

SEQ ID NO: 181911 - DNA, 13 bp, Homo sapiens
cttaaacaaaaat

SEQ ID NO: 181912 - DNA, 18 bp, Homo sapiens
cttaaattttaatttatt

SEQ ID NO: 181913 - DNA, 14 bp, Homo sapiens
cttaagagaatatt

SEQ ID NO: 181914 - DNA, 20 bp, Homo sapiens
cttaaggattgtgatatttt

SEQ ID NO: 181915 - DNA, 23 bp, Homo sapiens
cttaatgtttattcctgataata

SEQ ID NO: 181916 - DNA, 19 bp, Homo sapiens
cttaattaaaagaatattt

SEQ ID NO: 181917 - DNA, 18 bp, Homo sapiens
cttacaagcctaagaatc

SEQ ID NO: 181918 - DNA, 16 bp, Homo sapiens
cttacagcctctgact

SEQ ID NO: 181919 - DNA, 23 bp, Homo sapiens
cttacagtaggagcccagctctg

SEQ ID NO: 181920 - DNA, 22 bp, Homo sapiens
cttacataattttttattcaag

SEQ ID NO: 181921 - DNA, 15 bp, Homo sapiens
cttacattgtgaaac

SEQ ID NO: 181922 - DNA, 14 bp, Homo sapiens
cttacatttttaca

SEQ ID NO: 181923 - DNA, 14 bp, Homo sapiens
cttaccaactttct

SEQ ID NO: 181924 - DNA, 15 bp, Homo sapiens
cttaccaactttctg

SEQ ID NO: 181925 - DNA, 17 bp, Homo sapiens
cttaccaactttctgta

SEQ ID NO: 181926 - DNA, 13 bp, Homo sapiens
cttacctcctgcc

SEQ ID NO: 181927 - DNA, 17 bp, Homo sapiens
cttacctcctgcccagg

SEQ ID NO: 181928 - DNA, 21 bp, Homo sapiens
cttacctcggtgccttcctct

SEQ ID NO: 181929 - DNA, 13 bp, Homo sapiens
cttactgcagaat

SEQ ID NO: 181930 - DNA, 21 bp, Homo sapiens
cttactttcctttccccagcc

SEQ ID NO: 181931 - DNA, 20 bp, Homo sapiens
cttagaaaaaccaccaccat

SEQ ID NO: 181932 - DNA, 18 bp, Homo sapiens
cttagaaagcaggggcta

SEQ ID NO: 181933 - DNA, 17 bp, Homo sapiens
cttagaaattgcatttc

SEQ ID NO: 181934 - DNA, 17 bp, Homo sapiens
cttagaagtggaccagg

SEQ ID NO: 181935 - DNA, 21 bp, Homo sapiens
cttagaagtggaccaggacag

SEQ ID NO: 181936 - DNA, 14 bp, Homo sapiens
cttagacttctgct

SEQ ID NO: 181937 - DNA, 16 bp, Homo sapiens
cttagacttctgcttt

SEQ ID NO: 181938 - DNA, 14 bp, Homo sapiens
cttagatgttctaa

SEQ ID NO: 181939 - DNA, 15 bp, Homo sapiens
cttagcagcttccag

SEQ ID NO: 181940 - DNA, 16 bp, Homo sapiens
cttagcagcttccaga

SEQ ID NO: 181941 - DNA, 14 bp, Homo sapiens
cttagcttagacct

SEQ ID NO: 181942 - DNA, 19 bp, Homo sapiens
cttagcttagacctcagcc

SEQ ID NO: 181943 - DNA, 20 bp, Homo sapiens
cttagcttagacctcagcct

SEQ ID NO: 181944 - DNA, 23 bp, Homo sapiens
cttagcttagacctcagcctgtg

SEQ ID NO: 181945 - DNA, 16 bp, Homo sapiens
cttaggggctgctgac

SEQ ID NO: 181946 - DNA, 15 bp, Homo sapiens
cttatacatttgata

SEQ ID NO: 181947 - DNA, 13 bp, Homo sapiens
cttatagaatatt

SEQ ID NO: 181948 - DNA, 15 bp, Homo sapiens
cttatagaatattta

SEQ ID NO: 181949 - DNA, 19 bp, Homo sapiens
cttataggaattgacccac

SEQ ID NO: 181950 - DNA, 23 bp, Homo sapiens
cttatagtcaatgtttcttttat

SEQ ID NO: 181951 - DNA, 21 bp, Homo sapiens
cttatattaatattcctcagt

SEQ ID NO: 181952 - DNA, 21 bp, Homo sapiens
cttatcctaaaacaaatagtt

SEQ ID NO: 181953 - DNA, 14 bp, Homo sapiens
cttatctgtgctca

SEQ ID NO: 181954 - DNA, 15 bp, Homo sapiens
cttatgattgcagat

SEQ ID NO: 181955 - DNA, 15 bp, Homo sapiens
cttattgtacctctc

SEQ ID NO: 181956 - DNA, 21 bp, Homo sapiens
cttatttattcatattttctt

SEQ ID NO: 181957 - DNA, 17 bp, Homo sapiens
cttcaactgaccagcct

SEQ ID NO: 181958 - DNA, 20 bp, Homo sapiens
cttcaactgaccagcctcca

SEQ ID NO: 181959 - DNA, 18 bp, Homo sapiens
cttcaagatcatgtaccc

SEQ ID NO: 181960 - DNA, 15 bp, Homo sapiens
cttcaattaataaaa

SEQ ID NO: 181961 - DNA, 12 bp, Homo sapiens
cttcacaacaga

SEQ ID NO: 181962 - DNA, 17 bp, Homo sapiens
cttcacacacaggcaac

SEQ ID NO: 181963 - DNA, 21 bp, Homo sapiens
cttcacacacaggcaactgag

SEQ ID NO: 181964 - DNA, 18 bp, Homo sapiens
cttcacactgcaagagcc

SEQ ID NO: 181965 - DNA, 12 bp, Homo sapiens
cttcacagtgtt

SEQ ID NO: 181966 - DNA, 17 bp, Homo sapiens
cttcacataccctcccc

SEQ ID NO: 181967 - DNA, 17 bp, Homo sapiens
cttcaccatttggcaat

SEQ ID NO: 181968 - DNA, 15 bp, Homo sapiens
cttcaccccccactc

SEQ ID NO: 181969 - DNA, 15 bp, Homo sapiens
cttcacggaagagcc

SEQ ID NO: 181970 - DNA, 13 bp, Homo sapiens
cttcacggcagga

SEQ ID NO: 181971 - DNA, 16 bp, Homo sapiens
cttcacggcaggacaa

SEQ ID NO: 181972 - DNA, 15 bp, Homo sapiens
cttcactgttgaaaa

SEQ ID NO: 181973 - DNA, 16 bp, Homo sapiens
cttcactgttgaaaat

SEQ ID NO: 181974 - DNA, 18 bp, Homo sapiens
cttcactgttgaaaatta

SEQ ID NO: 181975 - DNA, 17 bp, Homo sapiens
gacagccccagagcagg

SEQ ID NO: 181976 - DNA, 11 bp, Homo sapiens
gacagcctggc

SEQ ID NO: 181977 - DNA, 13 bp, Homo sapiens
gacagcctggcac

SEQ ID NO: 181978 - DNA, 17 bp, Homo sapiens
gacagctccctctgcct

SEQ ID NO: 181979 - DNA, 18 bp, Homo sapiens
gacagctccctctgcctg

SEQ ID NO: 181980 - DNA, 17 bp, Homo sapiens
gacagctgtccctgtca

SEQ ID NO: 181981 - DNA, 22 bp, Homo sapiens
gacagctgtccctgtcaccaag

SEQ ID NO: 181982 - DNA, 17 bp, Homo sapiens
gacaggaaagggaaggc

SEQ ID NO: 181983 - DNA, 17 bp, Homo sapiens
gacaggctcttagcagc

SEQ ID NO: 181984 - DNA, 13 bp, Homo sapiens
gacagggacccac

SEQ ID NO: 181985 - DNA, 20 bp, Homo sapiens
gacagggcatggccaggtgg

SEQ ID NO: 181986 - DNA, 16 bp, Homo sapiens
gacagtcaaggagtgg

SEQ ID NO: 181987 - DNA, 21 bp, Homo sapiens
gacagtgagactctgtctcag

SEQ ID NO: 181988 - DNA, 17 bp, Homo sapiens
gacagttcatatgtacc

SEQ ID NO: 181989 - DNA, 20 bp, Homo sapiens
gacatagaattaacacatga

SEQ ID NO: 181990 - DNA, 15 bp, Homo sapiens
gacatccaagcttcc

SEQ ID NO: 181991 - DNA, 22 bp, Homo sapiens
gacatccatgtttgtaaaacta

SEQ ID NO: 181992 - DNA, 23 bp, Homo sapiens
gacatccatgtttgtaaaactac

SEQ ID NO: 181993 - DNA, 18 bp, Homo sapiens
gacatctcaggggccaga

SEQ ID NO: 181994 - DNA, 21 bp, Homo sapiens
gacatctgtttctaaatgttt

SEQ ID NO: 181995 - DNA, 20 bp, Homo sapiens
gacatgaagattctttccca

SEQ ID NO: 181996 - DNA, 14 bp, Homo sapiens
gacatgaatatgat

SEQ ID NO: 181997 - DNA, 21 bp, Homo sapiens
gacatgcgggctgggcagctg

SEQ ID NO: 181998 - DNA, 12 bp, Homo sapiens
gacatgtgacat

SEQ ID NO: 181999 - DNA, 17 bp, Homo sapiens
gacatgtggggccaggt

SEQ ID NO: 182000 - DNA, 14 bp, Homo sapiens
gacatgtggtggga

SEQ ID NO: 182001 - DNA, 15 bp, Homo sapiens
gacatgttatatatt

SEQ ID NO: 182002 - DNA, 17 bp, Homo sapiens
gacattctgccaggccc

SEQ ID NO: 182003 - DNA, 22 bp, Homo sapiens
gacattctgccaggcccccaag

SEQ ID NO: 182004 - DNA, 16 bp, Homo sapiens
gacatttctctaagag

SEQ ID NO: 182005 - DNA, 20 bp, Homo sapiens
gacatttctcttactgcaaa

SEQ ID NO: 182006 - DNA, 22 bp, Homo sapiens
gaccaaattccttggcatgcct

SEQ ID NO: 182007 - DNA, 23 bp, Homo sapiens
gaccaaattccttggcatgcctt

SEQ ID NO: 182008 - DNA, 22 bp, Homo sapiens
gaccaacatggagaaaccctgt

SEQ ID NO: 182009 - DNA, 18 bp, Homo sapiens
gaccaaggggtgggccac

SEQ ID NO: 182010 - DNA, 21 bp, Homo sapiens
gaccactgcagaagacagtat

SEQ ID NO: 182011 - DNA, 16 bp, Homo sapiens
gaccagcagatcccag

SEQ ID NO: 182012 - DNA, 17 bp, Homo sapiens
gaccagcagatcccagc

SEQ ID NO: 182013 - DNA, 16 bp, Homo sapiens
gaccaggacaggacca

SEQ ID NO: 182014 - DNA, 17 bp, Homo sapiens
gaccagtcaacctgggc

SEQ ID NO: 182015 - DNA, 20 bp, Homo sapiens
gaccataatgttacattatt

SEQ ID NO: 182016 - DNA, 13 bp, Homo sapiens
gaccatcctattt

SEQ ID NO: 182017 - DNA, 22 bp, Homo sapiens
gacccacaagaaatgaaagcag

SEQ ID NO: 182018 - DNA, 16 bp, Homo sapiens
gacccagccctcatcc

SEQ ID NO: 182019 - DNA, 14 bp, Homo sapiens
gacccagtccctgg

SEQ ID NO: 182020 - DNA, 15 bp, Homo sapiens
gacccagtccctggg

SEQ ID NO: 182021 - DNA, 16 bp, Homo sapiens
gacccagtccctgggg

SEQ ID NO: 182022 - DNA, 17 bp, Homo sapiens
gacccatcacgcctgtg

SEQ ID NO: 182023 - DNA, 19 bp, Homo sapiens
gacccccactctcattccc

SEQ ID NO: 182024 - DNA, 23 bp, Homo sapiens
gacccccactctcattccccagg

SEQ ID NO: 182025 - DNA, 19 bp, Homo sapiens
gacccctcccctaatgcct

SEQ ID NO: 182026 - DNA, 23 bp, Homo sapiens
gacccctcctcactggccatccc

SEQ ID NO: 182027 - DNA, 16 bp, Homo sapiens
gaccctaccccaccac

SEQ ID NO: 182028 - DNA, 16 bp, Homo sapiens
gaccctattgctgctt

SEQ ID NO: 182029 - DNA, 16 bp, Homo sapiens
gaccctctccacccca

SEQ ID NO: 182030 - DNA, 15 bp, Homo sapiens
gaccctctgccacca

SEQ ID NO: 182031 - DNA, 12 bp, Homo sapiens
gaccctgtctca

SEQ ID NO: 182032 - DNA, 17 bp, Homo sapiens
gacccttacagcctctg

SEQ ID NO: 182033 - DNA, 14 bp, Homo sapiens
gaccctttccttcc

SEQ ID NO: 182034 - DNA, 20 bp, Homo sapiens
gacctagggatgttctggcc

SEQ ID NO: 182035 - DNA, 22 bp, Homo sapiens
gacctagggatgttctggccct

SEQ ID NO: 182036 - DNA, 11 bp, Homo sapiens
gacctcagcca

SEQ ID NO: 182037 - DNA, 11 bp, Homo sapiens
gacctcagcct

SEQ ID NO: 182038 - DNA, 16 bp, Homo sapiens
gacctccccagcccct

SEQ ID NO: 182039 - DNA, 17 bp, Homo sapiens
gacctcctaacaagtag

SEQ ID NO: 182040 - DNA, 13 bp, Homo sapiens
gacctcgtcctcc

SEQ ID NO: 182041 - DNA, 15 bp, Homo sapiens
gacctcgtcctcccc

SEQ ID NO: 182042 - DNA, 17 bp, Homo sapiens
gacctcgtcctccccct

SEQ ID NO: 182043 - DNA, 22 bp, Homo sapiens
gacctgagctccccaccacccc

SEQ ID NO: 182044 - DNA, 20 bp, Homo sapiens
gacctgctgagggaccagcc

SEQ ID NO: 182045 - DNA, 21 bp, Homo sapiens
gacctgctgagggaccagcca

SEQ ID NO: 182046 - DNA, 17 bp, Homo sapiens
gacctggtgctgcctct

SEQ ID NO: 182047 - DNA, 19 bp, Homo sapiens
gacctgtgtcactacgtga

SEQ ID NO: 182048 - DNA, 13 bp, Homo sapiens
gacgcctgaggaa

SEQ ID NO: 182049 - DNA, 12 bp, Homo sapiens
gacgcctggggg

SEQ ID NO: 182050 - DNA, 18 bp, Homo sapiens
gacgctggtagagatgga

SEQ ID NO: 182051 - DNA, 16 bp, Homo sapiens
gacggggactggggat

SEQ ID NO: 182052 - DNA, 18 bp, Homo sapiens
gacggttcaccagcctct

SEQ ID NO: 182053 - DNA, 19 bp, Homo sapiens
gactcagaagcctctgggt

SEQ ID NO: 182054 - DNA, 23 bp, Homo sapiens
gactcagacaggaaagggaaggc

SEQ ID NO: 182055 - DNA, 16 bp, Homo sapiens
gactcaggatgcccag

SEQ ID NO: 182056 - DNA, 14 bp, Homo sapiens
gactcagggcccca

SEQ ID NO: 182057 - DNA, 20 bp, Homo sapiens
gactcagggccccagcacta

SEQ ID NO: 182058 - DNA, 17 bp, Homo sapiens
gactcattctgaaggag

SEQ ID NO: 182059 - DNA, 11 bp, Homo sapiens
gactccaaaga

SEQ ID NO: 182060 - DNA, 18 bp, Homo sapiens
gactccaaagaaatgtaa

SEQ ID NO: 182061 - DNA, 16 bp, Homo sapiens
gactccacccatccta

SEQ ID NO: 182062 - DNA, 11 bp, Homo sapiens
gactcctctgt

SEQ ID NO: 182063 - DNA, 14 bp, Homo sapiens
gactcctctgtcca

SEQ ID NO: 182064 - DNA, 17 bp, Homo sapiens
gactctaggtgcccttg

SEQ ID NO: 182065 - DNA, 19 bp, Homo sapiens
gactctaggtgcccttgga

SEQ ID NO: 182066 - DNA, 14 bp, Homo sapiens
gactctcagtctct

SEQ ID NO: 182067 - DNA, 16 bp, Homo sapiens
gactctcagtctctga

SEQ ID NO: 182068 - DNA, 18 bp, Homo sapiens
gactctcagtctctgagc

SEQ ID NO: 182069 - DNA, 20 bp, Homo sapiens
gactctcagtctctgagcag

SEQ ID NO: 182070 - DNA, 17 bp, Homo sapiens
gactcttttgccattaa

SEQ ID NO: 182071 - DNA, 19 bp, Homo sapiens
gactctttttagggccagg

SEQ ID NO: 182072 - DNA, 18 bp, Homo sapiens
gactgaattgtccccagt

SEQ ID NO: 182073 - DNA, 16 bp, Homo sapiens
gactgaccctgatcag

SEQ ID NO: 182074 - DNA, 14 bp, Homo sapiens
gactgagcagactg

SEQ ID NO: 182075 - DNA, 22 bp, Homo sapiens
gactgagccccgcagacctccc

SEQ ID NO: 182076 - DNA, 23 bp, Homo sapiens
gactgccccgtgcagactggagg

SEQ ID NO: 182077 - DNA, 13 bp, Homo sapiens
gactgcccggcag

SEQ ID NO: 182078 - DNA, 15 bp, Homo sapiens
gactgctccccagcc

SEQ ID NO: 182079 - DNA, 21 bp, Homo sapiens
gactgctccccagccctggct

SEQ ID NO: 182080 - DNA, 22 bp, Homo sapiens
gactggcacagttttctgagaa

SEQ ID NO: 182081 - DNA, 18 bp, Homo sapiens
gactgggagccgcagcag

SEQ ID NO: 182082 - DNA, 23 bp, Homo sapiens
gactgggagccgcagcagctccc

SEQ ID NO: 182083 - DNA, 13 bp, Homo sapiens
gactgggaggtag

SEQ ID NO: 182084 - DNA, 15 bp, Homo sapiens
gactgggctgaggga

SEQ ID NO: 182085 - DNA, 16 bp, Homo sapiens
gactgggctgagggag

SEQ ID NO: 182086 - DNA, 18 bp, Homo sapiens
gactggggatgtgggagg

SEQ ID NO: 182087 - DNA, 20 bp, Homo sapiens
gactggggatgtgggaggga

SEQ ID NO: 182088 - DNA, 23 bp, Homo sapiens
gactggggatgtgggagggagca

SEQ ID NO: 182089 - DNA, 14 bp, Homo sapiens
gactggggggcttg

SEQ ID NO: 182090 - DNA, 16 bp, Homo sapiens
gactgtactcctccca

SEQ ID NO: 182091 - DNA, 17 bp, Homo sapiens
gactgtactcctcccag

SEQ ID NO: 182092 - DNA, 18 bp, Homo sapiens
gactgtactcctcccagg

SEQ ID NO: 182093 - DNA, 18 bp, Homo sapiens
gactgtctccatggccct

SEQ ID NO: 182094 - DNA, 16 bp, Homo sapiens
gacttagaaagcaggg

SEQ ID NO: 182095 - DNA, 19 bp, Homo sapiens
gacttagaaagcaggggct

SEQ ID NO: 182096 - DNA, 13 bp, Homo sapiens
gacttcagtatgt

SEQ ID NO: 182097 - DNA, 24 bp, Homo sapiens
gacttctaagtaaaaccacagcag

SEQ ID NO: 182098 - DNA, 17 bp, Homo sapiens
gacttggcaacagaagc

SEQ ID NO: 182099 - DNA, 19 bp, Homo sapiens
gacttgtatattttaagaa

SEQ ID NO: 182100 - DNA, 13 bp, Homo sapiens
gacttgtgtccca

SEQ ID NO: 182101 - DNA, 11 bp, Homo sapiens
gactttcctct

SEQ ID NO: 182102 - DNA, 11 bp, Homo sapiens
gactttcctgc

SEQ ID NO: 182103 - DNA, 23 bp, Homo sapiens
gactttctcagcctctgaatatg

SEQ ID NO: 182104 - DNA, 11 bp, Homo sapiens
gactttctgtt

SEQ ID NO: 182105 - DNA, 13 bp, Homo sapiens
gactttctgttgg

SEQ ID NO: 182106 - DNA, 17 bp, Homo sapiens
gagaaaaagctcctgtc

SEQ ID NO: 182107 - DNA, 19 bp, Homo sapiens
gagaaagagcacttaagag

SEQ ID NO: 182108 - DNA, 16 bp, Homo sapiens
gagaaagccaggcagg

SEQ ID NO: 182109 - DNA, 22 bp, Homo sapiens
gagaacacagccgattcacctg

SEQ ID NO: 182110 - DNA, 12 bp, Homo sapiens
gagaagagagga

SEQ ID NO: 182111 - DNA, 15 bp, Homo sapiens
gagaagagaggagag

SEQ ID NO: 182112 - DNA, 22 bp, Homo sapiens
gagaaggacccggaggggcctg

SEQ ID NO: 182113 - DNA, 23 bp, Homo sapiens
gagaaggacccggaggggcctgg

SEQ ID NO: 182114 - DNA, 12 bp, Homo sapiens
gagaaggagaga

SEQ ID NO: 182115 - DNA, 14 bp, Homo sapiens
gagaaggagagaaa

SEQ ID NO: 182116 - DNA, 15 bp, Homo sapiens
gagaaggtccttaat

SEQ ID NO: 182117 - DNA, 22 bp, Homo sapiens
gagaataagagaaagaaaatga

SEQ ID NO: 182118 - DNA, 14 bp, Homo sapiens
gagaatcacttgaa

SEQ ID NO: 182119 - DNA, 15 bp, Homo sapiens
gagaatcacttgaac

SEQ ID NO: 182120 - DNA, 19 bp, Homo sapiens
gagaatctttattgagaaa

SEQ ID NO: 182121 - DNA, 13 bp, Homo sapiens
gagacacctgcac

SEQ ID NO: 182122 - DNA, 15 bp, Homo sapiens
gagacacctgcacct

SEQ ID NO: 182123 - DNA, 19 bp, Homo sapiens
cttcactgttgaaaattat

SEQ ID NO: 182124 - DNA, 20 bp, Homo sapiens
cttcagcctagccgacctca

SEQ ID NO: 182125 - DNA, 22 bp, Homo sapiens
cttcagcctagccgacctcagc

SEQ ID NO: 182126 - DNA, 20 bp, Homo sapiens
cttcagcctccccaccttct

SEQ ID NO: 182127 - DNA, 20 bp, Homo sapiens
cttcagcctctttctgtccc

SEQ ID NO: 182128 - DNA, 15 bp, Homo sapiens
cttcagctgactttt

SEQ ID NO: 182129 - DNA, 19 bp, Homo sapiens
cttcagggcactgctgctg

SEQ ID NO: 182130 - DNA, 21 bp, Homo sapiens
cttcaggggagtcccgtcagg

SEQ ID NO: 182131 - DNA, 22 bp, Homo sapiens
cttcaggggagtcccgtcagga

SEQ ID NO: 182132 - DNA, 23 bp, Homo sapiens
cttcaggggagtcccgtcaggac

SEQ ID NO: 182133 - DNA, 14 bp, Homo sapiens
cttcagggttctcc

SEQ ID NO: 182134 - DNA, 14 bp, Homo sapiens
cttcagtaagccgt

SEQ ID NO: 182135 - DNA, 19 bp, Homo sapiens
cttcagtatgttgtcaaag

SEQ ID NO: 182136 - DNA, 17 bp, Homo sapiens
cttcagtggagaattat

SEQ ID NO: 182137 - DNA, 15 bp, Homo sapiens
cttcataacaatttt

SEQ ID NO: 182138 - DNA, 11 bp, Homo sapiens
cttcatcctct

SEQ ID NO: 182139 - DNA, 15 bp, Homo sapiens
cttcatggcagaagg

SEQ ID NO: 182140 - DNA, 14 bp, Homo sapiens
cttcatttggagat

SEQ ID NO: 182141 - DNA, 13 bp, Homo sapiens
cttcatttttcct

SEQ ID NO: 182142 - DNA, 16 bp, Homo sapiens
cttcatttttcctaac

SEQ ID NO: 182143 - DNA, 17 bp, Homo sapiens
cttcatttttcctaaca

SEQ ID NO: 182144 - DNA, 16 bp, Homo sapiens
cttccaaatcccctaa

SEQ ID NO: 182145 - DNA, 16 bp, Homo sapiens
cttccaagcaaaggtg

SEQ ID NO: 182146 - DNA, 15 bp, Homo sapiens
cttccaccagcctgc

SEQ ID NO: 182147 - DNA, 20 bp, Homo sapiens
cttccagtccaatctcatgg

SEQ ID NO: 182148 - DNA, 17 bp, Homo sapiens
cttccatcatgtcccca

SEQ ID NO: 182149 - DNA, 14 bp, Homo sapiens
cttccatcccagga

SEQ ID NO: 182150 - DNA, 17 bp, Homo sapiens
cttccatgtcgcctctg

SEQ ID NO: 182151 - DNA, 18 bp, Homo sapiens
cttccatgtcgcctctgc

SEQ ID NO: 182152 - DNA, 16 bp, Homo sapiens
cttccatttgtgtgtg

SEQ ID NO: 182153 - DNA, 15 bp, Homo sapiens
cttcccagctctccc

SEQ ID NO: 182154 - DNA, 16 bp, Homo sapiens
cttcccatcactggag

SEQ ID NO: 182155 - DNA, 14 bp, Homo sapiens
cttcccccatagcc

SEQ ID NO: 182156 - DNA, 18 bp, Homo sapiens
cttcccccatagccaccc

SEQ ID NO: 182157 - DNA, 20 bp, Homo sapiens
cttcccccgcaatgtgcccc

SEQ ID NO: 182158 - DNA, 16 bp, Homo sapiens
cttcccgctcagccct

SEQ ID NO: 182159 - DNA, 18 bp, Homo sapiens
cttcccgctcagccctcc

SEQ ID NO: 182160 - DNA, 15 bp, Homo sapiens
cttccctcacaccgc

SEQ ID NO: 182161 - DNA, 14 bp, Homo sapiens
cttccctgactcat

SEQ ID NO: 182162 - DNA, 22 bp, Homo sapiens
cttccctgtatgattccttgat

SEQ ID NO: 182163 - DNA, 13 bp, Homo sapiens
cttccctttctgc

SEQ ID NO: 182164 - DNA, 13 bp, Homo sapiens
cttcctccctcat

SEQ ID NO: 182165 - DNA, 22 bp, Homo sapiens
cttcctcctgggccctctctgc

SEQ ID NO: 182166 - DNA, 13 bp, Homo sapiens
cttcctctgctga

SEQ ID NO: 182167 - DNA, 17 bp, Homo sapiens
cttcctgccacctgctg

SEQ ID NO: 182168 - DNA, 22 bp, Homo sapiens
cttcctggagactgcccagcta

SEQ ID NO: 182169 - DNA, 20 bp, Homo sapiens
cttcctgtcttcctgcattc

SEQ ID NO: 182170 - DNA, 14 bp, Homo sapiens
cttccttccctggc

SEQ ID NO: 182171 - DNA, 14 bp, Homo sapiens
cttccttgaccagc

SEQ ID NO: 182172 - DNA, 19 bp, Homo sapiens
cttccttggactcatttta

SEQ ID NO: 182173 - DNA, 20 bp, Homo sapiens
cttccttggactcattttaa

SEQ ID NO: 182174 - DNA, 23 bp, Homo sapiens
cttcgaggtggatcacagaggct

SEQ ID NO: 182175 - DNA, 16 bp, Homo sapiens
cttcgatacaccgggc

SEQ ID NO: 182176 - DNA, 17 bp, Homo sapiens
cttcgggcccttcccac

SEQ ID NO: 182177 - DNA, 21 bp, Homo sapiens
cttcgtgcggaatcagcttct

SEQ ID NO: 182178 - DNA, 18 bp, Homo sapiens
cttcgtttactatgcctg

SEQ ID NO: 182179 - DNA, 22 bp, Homo sapiens
cttctaagtaaaaccacagcag

SEQ ID NO: 182180 - DNA, 11 bp, Homo sapiens
cttctaatata

SEQ ID NO: 182181 - DNA, 15 bp, Homo sapiens
cttctaatatatttt

SEQ ID NO: 182182 - DNA, 21 bp, Homo sapiens
cttctacttttaagttgctga

SEQ ID NO: 182183 - DNA, 15 bp, Homo sapiens
cttctcaggctctgc

SEQ ID NO: 182184 - DNA, 21 bp, Homo sapiens
cttctcattccaacagtgagt

SEQ ID NO: 182185 - DNA, 14 bp, Homo sapiens
cttctccactggat

SEQ ID NO: 182186 - DNA, 23 bp, Homo sapiens
cttctccagacaaaccagaagca

SEQ ID NO: 182187 - DNA, 14 bp, Homo sapiens
cttctccatccaca

SEQ ID NO: 182188 - DNA, 17 bp, Homo sapiens
cttctccatctggcagg

SEQ ID NO: 182189 - DNA, 15 bp, Homo sapiens
cttctcctatgtgta

SEQ ID NO: 182190 - DNA, 16 bp, Homo sapiens
cttctcctatgtgtaa

SEQ ID NO: 182191 - DNA, 19 bp, Homo sapiens
cttctcctgacccagtccc

SEQ ID NO: 182192 - DNA, 17 bp, Homo sapiens
cttctcctttcacaacc

SEQ ID NO: 182193 - DNA, 22 bp, Homo sapiens
cttctcctttcacaaccttctg

SEQ ID NO: 182194 - DNA, 14 bp, Homo sapiens
cttctctcacctcc

SEQ ID NO: 182195 - DNA, 18 bp, Homo sapiens
cttctctcacctcctaaa

SEQ ID NO: 182196 - DNA, 21 bp, Homo sapiens
cttctctgtgaacgatttaga

SEQ ID NO: 182197 - DNA, 20 bp, Homo sapiens
cttctgccatttctgagatc

SEQ ID NO: 182198 - DNA, 19 bp, Homo sapiens
cttctgggagggcagcagg

SEQ ID NO: 182199 - DNA, 23 bp, Homo sapiens
cttctgggagggcagcagggcta

SEQ ID NO: 182200 - DNA, 18 bp, Homo sapiens
cttctgtcttcacaacag

SEQ ID NO: 182201 - DNA, 21 bp, Homo sapiens
cttctgtcttcacaacagatt

SEQ ID NO: 182202 - DNA, 22 bp, Homo sapiens
cttctgtcttcacaacagatta

SEQ ID NO: 182203 - DNA, 13 bp, Homo sapiens
cttctgtggctca

SEQ ID NO: 182204 - DNA, 13 bp, Homo sapiens
cttcttaaagagt

SEQ ID NO: 182205 - DNA, 21 bp, Homo sapiens
cttcttaaatgagaaggaatt

SEQ ID NO: 182206 - DNA, 18 bp, Homo sapiens
cttcttaatataactgcc

SEQ ID NO: 182207 - DNA, 20 bp, Homo sapiens
cttcttaatataactgcctt

SEQ ID NO: 182208 - DNA, 16 bp, Homo sapiens
cttcttatacatttga

SEQ ID NO: 182209 - DNA, 14 bp, Homo sapiens
cttcttattctcac

SEQ ID NO: 182210 - DNA, 17 bp, Homo sapiens
cttcttattctcactcc

SEQ ID NO: 182211 - DNA, 22 bp, Homo sapiens
cttcttattctcactccaccac

SEQ ID NO: 182212 - DNA, 17 bp, Homo sapiens
cttcttcagccacctct

SEQ ID NO: 182213 - DNA, 14 bp, Homo sapiens
cttcttccatccca

SEQ ID NO: 182214 - DNA, 15 bp, Homo sapiens
cttcttccatcccag

SEQ ID NO: 182215 - DNA, 21 bp, Homo sapiens
cttcttcggggaactcctgga

SEQ ID NO: 182216 - DNA, 13 bp, Homo sapiens
cttcttttgtgaa

SEQ ID NO: 182217 - DNA, 20 bp, Homo sapiens
cttctttttattttcttttg

SEQ ID NO: 182218 - DNA, 13 bp, Homo sapiens
cttgaaagaaaat

SEQ ID NO: 182219 - DNA, 13 bp, Homo sapiens
cttgaaagctgtg

SEQ ID NO: 182220 - DNA, 15 bp, Homo sapiens
cttgaacactggggg

SEQ ID NO: 182221 - DNA, 16 bp, Homo sapiens
cttgaacactggggga

SEQ ID NO: 182222 - DNA, 14 bp, Homo sapiens
cttgaacccgggag

SEQ ID NO: 182223 - DNA, 20 bp, Homo sapiens
cttgaacccgggaggcagag

SEQ ID NO: 182224 - DNA, 15 bp, Homo sapiens
cttgaccaagcagga

SEQ ID NO: 182225 - DNA, 19 bp, Homo sapiens
cttgaccaagcaggaagct

SEQ ID NO: 182226 - DNA, 20 bp, Homo sapiens
cttgaccaagcaggaagctc

SEQ ID NO: 182227 - DNA, 19 bp, Homo sapiens
cttgaccagcagatcccag

SEQ ID NO: 182228 - DNA, 22 bp, Homo sapiens
cttgaccagcagatcccagctc

SEQ ID NO: 182229 - DNA, 23 bp, Homo sapiens
cttgaccagcagatcccagctca

SEQ ID NO: 182230 - DNA, 11 bp, Homo sapiens
cttgagaaacc

SEQ ID NO: 182231 - DNA, 16 bp, Homo sapiens
cttgagacctcagcca

SEQ ID NO: 182232 - DNA, 17 bp, Homo sapiens
cttgagactgttttgaa

SEQ ID NO: 182233 - DNA, 12 bp, Homo sapiens
cttgagcctggg

SEQ ID NO: 182234 - DNA, 15 bp, Homo sapiens
cttgagcctgggagg

SEQ ID NO: 182235 - DNA, 16 bp, Homo sapiens
cttgagcctgggaggt

SEQ ID NO: 182236 - DNA, 13 bp, Homo sapiens
cttgagctcagga

SEQ ID NO: 182237 - DNA, 17 bp, Homo sapiens
cttgagggcccagagca

SEQ ID NO: 182238 - DNA, 19 bp, Homo sapiens
cttgagggcccagagcagg

SEQ ID NO: 182239 - DNA, 19 bp, Homo sapiens
cttgagttgattcagctct

SEQ ID NO: 182240 - DNA, 21 bp, Homo sapiens
cttgcactaaagtatgtaaag

SEQ ID NO: 182241 - DNA, 20 bp, Homo sapiens
cttgcaggtctcaacccttt

SEQ ID NO: 182242 - DNA, 23 bp, Homo sapiens
cttgcatcaatttttcttatttc

SEQ ID NO: 182243 - DNA, 18 bp, Homo sapiens
cttgcattgaatatatta

SEQ ID NO: 182244 - DNA, 23 bp, Homo sapiens
cttgcccagagatgcctccaccg

SEQ ID NO: 182245 - DNA, 22 bp, Homo sapiens
cttgccctgttaaaagatgaaa

SEQ ID NO: 182246 - DNA, 19 bp, Homo sapiens
cttgctctcccctgccctg

SEQ ID NO: 182247 - DNA, 17 bp, Homo sapiens
cttgctggacggggact

SEQ ID NO: 182248 - DNA, 19 bp, Homo sapiens
cttggaagagcctgcaggt

SEQ ID NO: 182249 - DNA, 18 bp, Homo sapiens
cttggagccccagtgcca

SEQ ID NO: 182250 - DNA, 17 bp, Homo sapiens
cttggctgtagaaggag

SEQ ID NO: 182251 - DNA, 12 bp, Homo sapiens
cttggctgtgag

SEQ ID NO: 182252 - DNA, 21 bp, Homo sapiens
cttggctgtgaggcccctgga

SEQ ID NO: 182253 - DNA, 20 bp, Homo sapiens
cttggcttcaggggagtccc

SEQ ID NO: 182254 - DNA, 14 bp, Homo sapiens
cttggcttgcccac

SEQ ID NO: 182255 - DNA, 14 bp, Homo sapiens
cttgggaggcccca

SEQ ID NO: 182256 - DNA, 20 bp, Homo sapiens
cttgggccactgtgaagaga

SEQ ID NO: 182257 - DNA, 14 bp, Homo sapiens
cttgggccctttga

SEQ ID NO: 182258 - DNA, 23 bp, Homo sapiens
cttgggcttccatttgtgtgtgt

SEQ ID NO: 182259 - DNA, 15 bp, Homo sapiens
cttggggggctgagg

SEQ ID NO: 182260 - DNA, 21 bp, Homo sapiens
cttggtgtcctttccctccac

SEQ ID NO: 182261 - DNA, 18 bp, Homo sapiens
cttgtaaaaattaaaagt

SEQ ID NO: 182262 - DNA, 14 bp, Homo sapiens
cttgtaactccacc

SEQ ID NO: 182263 - DNA, 15 bp, Homo sapiens
cttgtaactccacca

SEQ ID NO: 182264 - DNA, 23 bp, Homo sapiens
cttgtaattctaaatgaatgttt

SEQ ID NO: 182265 - DNA, 17 bp, Homo sapiens
cttgtatagtgtaaaat

SEQ ID NO: 182266 - DNA, 23 bp, Homo sapiens
cttgtatattttaagaaataaca

SEQ ID NO: 182267 - DNA, 21 bp, Homo sapiens
cttgtatgaaagatggctgtg

SEQ ID NO: 182268 - DNA, 18 bp, Homo sapiens
cttgtatttaaatattaa

SEQ ID NO: 182269 - DNA, 14 bp, Homo sapiens
cttgtccagcgcct

SEQ ID NO: 182270 - DNA, 21 bp, Homo sapiens
gagacacctgcacctcccccc

SEQ ID NO: 182271 - DNA, 13 bp, Homo sapiens
gagacagccccag

SEQ ID NO: 182272 - DNA, 18 bp, Homo sapiens
gagacagccccagagcag

SEQ ID NO: 182273 - DNA, 20 bp, Homo sapiens
gagacagctctgcatactca

SEQ ID NO: 182274 - DNA, 12 bp, Homo sapiens
gagacaggaagg

SEQ ID NO: 182275 - DNA, 13 bp, Homo sapiens
gagacagggtttg

SEQ ID NO: 182276 - DNA, 22 bp, Homo sapiens
gagacagggtttggctgtgtct

SEQ ID NO: 182277 - DNA, 17 bp, Homo sapiens
gagaccaacctgaccaa

SEQ ID NO: 182278 - DNA, 22 bp, Homo sapiens
gagaccaagactctgaaatctc

SEQ ID NO: 182279 - DNA, 19 bp, Homo sapiens
gagaccctcgtggccttcc

SEQ ID NO: 182280 - DNA, 15 bp, Homo sapiens
gagaccctctgccac

SEQ ID NO: 182281 - DNA, 18 bp, Homo sapiens
gagactcacctctgcctc

SEQ ID NO: 182282 - DNA, 14 bp, Homo sapiens
gagactcagacagg

SEQ ID NO: 182283 - DNA, 13 bp, Homo sapiens
gagactgggctga

SEQ ID NO: 182284 - DNA, 17 bp, Homo sapiens
gagactgggctgaggga

SEQ ID NO: 182285 - DNA, 19 bp, Homo sapiens
gagactggggggcttgaaa

SEQ ID NO: 182286 - DNA, 16 bp, Homo sapiens
gagactggtcctgtgt

SEQ ID NO: 182287 - DNA, 23 bp, Homo sapiens
gagactggtcctgtgtgcagtga

SEQ ID NO: 182288 - DNA, 22 bp, Homo sapiens
gagactgtctcaagagggcact

SEQ ID NO: 182289 - DNA, 23 bp, Homo sapiens
gagactgtctcaagagggcactg

SEQ ID NO: 182290 - DNA, 21 bp, Homo sapiens
gagagaaagccaggcaggtag

SEQ ID NO: 182291 - DNA, 14 bp, Homo sapiens
gagagacccaagga

SEQ ID NO: 182292 - DNA, 12 bp, Homo sapiens
gagagagaaagc

SEQ ID NO: 182293 - DNA, 15 bp, Homo sapiens
gagagaggcagagag

SEQ ID NO: 182294 - DNA, 16 bp, Homo sapiens
gagagccaccaagagg

SEQ ID NO: 182295 - DNA, 14 bp, Homo sapiens
gagagccagccctc

SEQ ID NO: 182296 - DNA, 14 bp, Homo sapiens
gagagcctgctccc

SEQ ID NO: 182297 - DNA, 14 bp, Homo sapiens
gagagcggtctcag

SEQ ID NO: 182298 - DNA, 19 bp, Homo sapiens
gagaggaatgcctgtgtga

SEQ ID NO: 182299 - DNA, 16 bp, Homo sapiens
gagaggacgtgggcgg

SEQ ID NO: 182300 - DNA, 15 bp, Homo sapiens
gagaggagagaggca

SEQ ID NO: 182301 - DNA, 18 bp, Homo sapiens
gagaggtcaagcccagga

SEQ ID NO: 182302 - DNA, 19 bp, Homo sapiens
gagagtgaacaaatttaca

SEQ ID NO: 182303 - DNA, 20 bp, Homo sapiens
gagagtgtgaaatagacatt

SEQ ID NO: 182304 - DNA, 15 bp, Homo sapiens
gagataccagcgagg

SEQ ID NO: 182305 - DNA, 23 bp, Homo sapiens
gagatcaaatggaaaggagagga

SEQ ID NO: 182306 - DNA, 22 bp, Homo sapiens
gagatcgtgccgttactctcca

SEQ ID NO: 182307 - DNA, 19 bp, Homo sapiens
gagatgcctccaccgctgc

SEQ ID NO: 182308 - DNA, 23 bp, Homo sapiens
gagatgcctccaccgctgcctaa

SEQ ID NO: 182309 - DNA, 18 bp, Homo sapiens
gagatgctggagaagaga

SEQ ID NO: 182310 - DNA, 14 bp, Homo sapiens
gagatggggtgggg

SEQ ID NO: 182311 - DNA, 17 bp, Homo sapiens
gagattgagaaggagag

SEQ ID NO: 182312 - DNA, 21 bp, Homo sapiens
gagattgtgcccctgcactcc

SEQ ID NO: 182313 - DNA, 12 bp, Homo sapiens
gagatttttcat

SEQ ID NO: 182314 - DNA, 15 bp, Homo sapiens
gagcacactgtagca

SEQ ID NO: 182315 - DNA, 13 bp, Homo sapiens
gagcaccagggga

SEQ ID NO: 182316 - DNA, 19 bp, Homo sapiens
gagcacctccacatcctcc

SEQ ID NO: 182317 - DNA, 20 bp, Homo sapiens
gagcactcccaagtctacag

SEQ ID NO: 182318 - DNA, 17 bp, Homo sapiens
gagcactgggttgactt

SEQ ID NO: 182319 - DNA, 18 bp, Homo sapiens
gagcacttaagagaatat

SEQ ID NO: 182320 - DNA, 23 bp, Homo sapiens
gagcagaacggagccccaggcct

SEQ ID NO: 182321 - DNA, 18 bp, Homo sapiens
gagcagctttaaactcag

SEQ ID NO: 182322 - DNA, 22 bp, Homo sapiens
gagcagctttaaactcagggac

SEQ ID NO: 182323 - DNA, 22 bp, Homo sapiens
gagcaggaagcattcagagagc

SEQ ID NO: 182324 - DNA, 18 bp, Homo sapiens
gagcaggagattgagaag

SEQ ID NO: 182325 - DNA, 20 bp, Homo sapiens
gagcaggagattgagaagga

SEQ ID NO: 182326 - DNA, 23 bp, Homo sapiens
gagcaggagattgagaaggagag

SEQ ID NO: 182327 - DNA, 20 bp, Homo sapiens
gagcagggattaacctctgc

SEQ ID NO: 182328 - DNA, 16 bp, Homo sapiens
gagcagggtgttggga

SEQ ID NO: 182329 - DNA, 16 bp, Homo sapiens
gagcagtcctgcctca

SEQ ID NO: 182330 - DNA, 20 bp, Homo sapiens
gagcagtcctgcctcagcct

SEQ ID NO: 182331 - DNA, 14 bp, Homo sapiens
gagcagtggctggt

SEQ ID NO: 182332 - DNA, 19 bp, Homo sapiens
gagcattgtggctgtcagc

SEQ ID NO: 182333 - DNA, 14 bp, Homo sapiens
gagccagccctccc

SEQ ID NO: 182334 - DNA, 15 bp, Homo sapiens
gagccagccctccct

SEQ ID NO: 182335 - DNA, 20 bp, Homo sapiens
gagccagccctccctgtcct

SEQ ID NO: 182336 - DNA, 21 bp, Homo sapiens
gagccagccctccctgtcctc

SEQ ID NO: 182337 - DNA, 13 bp, Homo sapiens
gagccccaggcct

SEQ ID NO: 182338 - DNA, 12 bp, Homo sapiens
gagccccagtgc

SEQ ID NO: 182339 - DNA, 14 bp, Homo sapiens
gagccccagtgcca

SEQ ID NO: 182340 - DNA, 17 bp, Homo sapiens
gagccccagtgccaagc

SEQ ID NO: 182341 - DNA, 16 bp, Homo sapiens
gagccccattcctggg

SEQ ID NO: 182342 - DNA, 22 bp, Homo sapiens
gagccccgcagacctccccagc

SEQ ID NO: 182343 - DNA, 23 bp, Homo sapiens
gagccccgcagacctccccagcc

SEQ ID NO: 182344 - DNA, 14 bp, Homo sapiens
gagcccctggtcct

SEQ ID NO: 182345 - DNA, 15 bp, Homo sapiens
gagccctcaaagtga

SEQ ID NO: 182346 - DNA, 18 bp, Homo sapiens
gagccctgtggatgagcc

SEQ ID NO: 182347 - DNA, 18 bp, Homo sapiens
gagcccttatctgtgctc

SEQ ID NO: 182348 - DNA, 22 bp, Homo sapiens
gagccgcatcttctccatctgg

SEQ ID NO: 182349 - DNA, 20 bp, Homo sapiens
gagccgctgtgagcccctgg

SEQ ID NO: 182350 - DNA, 22 bp, Homo sapiens
gagcctcctctctcaaactggg

SEQ ID NO: 182351 - DNA, 18 bp, Homo sapiens
gagcctgcaggtgctgct

SEQ ID NO: 182352 - DNA, 19 bp, Homo sapiens
gagcctgcggcctgctgga

SEQ ID NO: 182353 - DNA, 17 bp, Homo sapiens
gagcctgctcccccacc

SEQ ID NO: 182354 - DNA, 18 bp, Homo sapiens
gagcctgctcccccaccc

SEQ ID NO: 182355 - DNA, 10 bp, Homo sapiens
gagcctggca

SEQ ID NO: 182356 - DNA, 15 bp, Homo sapiens
gagcctggcaagaat

SEQ ID NO: 182357 - DNA, 12 bp, Homo sapiens
gagcctggctct

SEQ ID NO: 182358 - DNA, 19 bp, Homo sapiens
gagccttggtgtccacctg

SEQ ID NO: 182359 - DNA, 15 bp, Homo sapiens
gagcgacagtgagac

SEQ ID NO: 182360 - DNA, 18 bp, Homo sapiens
gagcgaggagatgctcct

SEQ ID NO: 182361 - DNA, 16 bp, Homo sapiens
gagcgcctgcccctcc

SEQ ID NO: 182362 - DNA, 16 bp, Homo sapiens
gagcggaaagcagctc

SEQ ID NO: 182363 - DNA, 16 bp, Homo sapiens
gagcggtctcaggctg

SEQ ID NO: 182364 - DNA, 23 bp, Homo sapiens
gagcggtctcaggctggtgggag

SEQ ID NO: 182365 - DNA, 17 bp, Homo sapiens
gagcggtggccctgtcc

SEQ ID NO: 182366 - DNA, 17 bp, Homo sapiens
gagctagcagcagggag

SEQ ID NO: 182367 - DNA, 15 bp, Homo sapiens
gagctcagaccccca

SEQ ID NO: 182368 - DNA, 19 bp, Homo sapiens
gagctccccaccaccccag

SEQ ID NO: 182369 - DNA, 20 bp, Homo sapiens
gagctccccaccaccccagc

SEQ ID NO: 182370 - DNA, 15 bp, Homo sapiens
gagctctacccaggg

SEQ ID NO: 182371 - DNA, 21 bp, Homo sapiens
gagctctacccagggcctgca

SEQ ID NO: 182372 - DNA, 20 bp, Homo sapiens
gagctgccatccagggatgc

SEQ ID NO: 182373 - DNA, 12 bp, Homo sapiens
gagctgggaggc

SEQ ID NO: 182374 - DNA, 18 bp, Homo sapiens
gagctgtattaagccact

SEQ ID NO: 182375 - DNA, 17 bp, Homo sapiens
gagctgtttactaggga

SEQ ID NO: 182376 - DNA, 13 bp, Homo sapiens
gagcttccctgac

SEQ ID NO: 182377 - DNA, 20 bp, Homo sapiens
gagctttgaaaattcagtgg

SEQ ID NO: 182378 - DNA, 21 bp, Homo sapiens
gaggaaaaccaagccgtggct

SEQ ID NO: 182379 - DNA, 13 bp, Homo sapiens
gaggaaaggccag

SEQ ID NO: 182380 - DNA, 19 bp, Homo sapiens
gaggaactgtccagagagc

SEQ ID NO: 182381 - DNA, 19 bp, Homo sapiens
gaggaaggggccagaggct

SEQ ID NO: 182382 - DNA, 17 bp, Homo sapiens
gaggaatgatgaagctt

SEQ ID NO: 182383 - DNA, 16 bp, Homo sapiens
gaggacgtgggcggca

SEQ ID NO: 182384 - DNA, 22 bp, Homo sapiens
gaggacgtgggcggcagagagg

SEQ ID NO: 182385 - DNA, 20 bp, Homo sapiens
gaggagaagaattttcagac

SEQ ID NO: 182386 - DNA, 22 bp, Homo sapiens
gaggagaagaattttcagaccc

SEQ ID NO: 182387 - DNA, 15 bp, Homo sapiens
gaggagagaggcaga

SEQ ID NO: 182388 - DNA, 14 bp, Homo sapiens
gaggagaggagaga

SEQ ID NO: 182389 - DNA, 19 bp, Homo sapiens
gaggatctcttgagcctgg

SEQ ID NO: 182390 - DNA, 22 bp, Homo sapiens
gaggatctcttgagcctgggag

SEQ ID NO: 182391 - DNA, 19 bp, Homo sapiens
gaggatgggaaggagggag

SEQ ID NO: 182392 - DNA, 23 bp, Homo sapiens
gaggcagaagaattgaacccagg

SEQ ID NO: 182393 - DNA, 12 bp, Homo sapiens
gaggcagacagc

SEQ ID NO: 182394 - DNA, 16 bp, Homo sapiens
gaggcagacagcagct

SEQ ID NO: 182395 - DNA, 22 bp, Homo sapiens
gaggcagacagcagctcaggca

SEQ ID NO: 182396 - DNA, 11 bp, Homo sapiens
gaggcagagag

SEQ ID NO: 182397 - DNA, 22 bp, Homo sapiens
gaggcagagagcggtctcaggc

SEQ ID NO: 182398 - DNA, 14 bp, Homo sapiens
gaggcagggaagtc

SEQ ID NO: 182399 - DNA, 15 bp, Homo sapiens
gaggcagggccttgc

SEQ ID NO: 182400 - DNA, 18 bp, Homo sapiens
gaggcagggccttgccca

SEQ ID NO: 182401 - DNA, 13 bp, Homo sapiens
gaggcatggccct

SEQ ID NO: 182402 - DNA, 17 bp, Homo sapiens
gaggccaaggtgggagg

SEQ ID NO: 182403 - DNA, 12 bp, Homo sapiens
gaggccagcctg

SEQ ID NO: 182404 - DNA, 13 bp, Homo sapiens
gaggcccctggac

SEQ ID NO: 182405 - DNA, 20 bp, Homo sapiens
gaggcctggactttcctgca

SEQ ID NO: 182406 - DNA, 18 bp, Homo sapiens
gaggctgagatgggagaa

SEQ ID NO: 182407 - DNA, 14 bp, Homo sapiens
gaggctgaggcctg

SEQ ID NO: 182408 - DNA, 18 bp, Homo sapiens
gagggaacagacaggaga

SEQ ID NO: 182409 - DNA, 12 bp, Homo sapiens
gagggagatgga

SEQ ID NO: 182410 - DNA, 18 bp, Homo sapiens
gagggcactggtggcccg

SEQ ID NO: 182411 - DNA, 14 bp, Homo sapiens
gagggcagcagggc

SEQ ID NO: 182412 - DNA, 15 bp, Homo sapiens
gagggcagcagggct

SEQ ID NO: 182413 - DNA, 14 bp, Homo sapiens
gagggcccagagca

SEQ ID NO: 182414 - DNA, 15 bp, Homo sapiens
gagggcccagagcag

SEQ ID NO: 182415 - DNA, 18 bp, Homo sapiens
gagggcccagagcaggaa

SEQ ID NO: 182416 - DNA, 20 bp, Homo sapiens
gagggcccagagcaggaagc

SEQ ID NO: 182417 - DNA, 20 bp, Homo sapiens
gagggcgtgactcacccaag

SEQ ID NO: 182418 - DNA, 18 bp, Homo sapiens
cttgtccagcgcctagtg

SEQ ID NO: 182419 - DNA, 16 bp, Homo sapiens
cttgtcccactcaagc

SEQ ID NO: 182420 - DNA, 20 bp, Homo sapiens
cttgtcccctcctcactccc

SEQ ID NO: 182421 - DNA, 21 bp, Homo sapiens
cttgtcccctcctcactccct

SEQ ID NO: 182422 - DNA, 13 bp, Homo sapiens
cttgtctctgggc

SEQ ID NO: 182423 - DNA, 13 bp, Homo sapiens
cttgtctgtagat

SEQ ID NO: 182424 - DNA, 15 bp, Homo sapiens
cttgtgcagtgttga

SEQ ID NO: 182425 - DNA, 21 bp, Homo sapiens
cttgtgctggatggagcccag

SEQ ID NO: 182426 - DNA, 23 bp, Homo sapiens
cttgtgctggatggagcccaggc

SEQ ID NO: 182427 - DNA, 14 bp, Homo sapiens
cttgtgtcccatga

SEQ ID NO: 182428 - DNA, 18 bp, Homo sapiens
ctttaaagggatggcaag

SEQ ID NO: 182429 - DNA, 19 bp, Homo sapiens
ctttaagcactacataaac

SEQ ID NO: 182430 - DNA, 19 bp, Homo sapiens
ctttacatgcaatttatta

SEQ ID NO: 182431 - DNA, 18 bp, Homo sapiens
ctttagaatgagagtgtg

SEQ ID NO: 182432 - DNA, 13 bp, Homo sapiens
ctttataattcta

SEQ ID NO: 182433 - DNA, 15 bp, Homo sapiens
ctttattgagaaaga

SEQ ID NO: 182434 - DNA, 14 bp, Homo sapiens
ctttattgtgatct

SEQ ID NO: 182435 - DNA, 14 bp, Homo sapiens
ctttcaaatttcac

SEQ ID NO: 182436 - DNA, 17 bp, Homo sapiens
ctttcacaaaattttat

SEQ ID NO: 182437 - DNA, 14 bp, Homo sapiens
ctttcacacttcca

SEQ ID NO: 182438 - DNA, 23 bp, Homo sapiens
ctttcacacttccaccagcctgc

SEQ ID NO: 182439 - DNA, 17 bp, Homo sapiens
ctttcacatagagatca

SEQ ID NO: 182440 - DNA, 15 bp, Homo sapiens
ctttcaccccagggc

SEQ ID NO: 182441 - DNA, 21 bp, Homo sapiens
ctttcaccccagggcctgagc

SEQ ID NO: 182442 - DNA, 12 bp, Homo sapiens
ctttcaggtact

SEQ ID NO: 182443 - DNA, 20 bp, Homo sapiens
ctttcatgtaaactgtgcac

SEQ ID NO: 182444 - DNA, 21 bp, Homo sapiens
ctttcatgtaaactgtgcacc

SEQ ID NO: 182445 - DNA, 18 bp, Homo sapiens
ctttccattggatctcat

SEQ ID NO: 182446 - DNA, 14 bp, Homo sapiens
ctttccccagccca

SEQ ID NO: 182447 - DNA, 13 bp, Homo sapiens
ctttcctgcccca

SEQ ID NO: 182448 - DNA, 11 bp, Homo sapiens
ctttccttcct

SEQ ID NO: 182449 - DNA, 17 bp, Homo sapiens
ctttctaatgtgtgaat

SEQ ID NO: 182450 - DNA, 17 bp, Homo sapiens
ctttctagttcagctgc

SEQ ID NO: 182451 - DNA, 16 bp, Homo sapiens
ctttctattgaaaaat

SEQ ID NO: 182452 - DNA, 20 bp, Homo sapiens
ctttctcagcctctgaatat

SEQ ID NO: 182453 - DNA, 13 bp, Homo sapiens
ctttctctgccag

SEQ ID NO: 182454 - DNA, 16 bp, Homo sapiens
ctttctctgccagtga

SEQ ID NO: 182455 - DNA, 18 bp, Homo sapiens
ctttctctgccagtgaca

SEQ ID NO: 182456 - DNA, 16 bp, Homo sapiens
ctttctgcttgtgtta

SEQ ID NO: 182457 - DNA, 18 bp, Homo sapiens
ctttctgtcccttctgtc

SEQ ID NO: 182458 - DNA, 23 bp, Homo sapiens
ctttctgtcccttctgtccctca

SEQ ID NO: 182459 - DNA, 21 bp, Homo sapiens
ctttctgtgtgcaccttacca

SEQ ID NO: 182460 - DNA, 11 bp, Homo sapiens
ctttcttcctc

SEQ ID NO: 182461 - DNA, 13 bp, Homo sapiens
ctttgaagaggaa

SEQ ID NO: 182462 - DNA, 14 bp, Homo sapiens
ctttgaagaggaaa

SEQ ID NO: 182463 - DNA, 16 bp, Homo sapiens
ctttgaagtcatacca

SEQ ID NO: 182464 - DNA, 13 bp, Homo sapiens
ctttgaatgcttt

SEQ ID NO: 182465 - DNA, 16 bp, Homo sapiens
ctttgaatgctttttg

SEQ ID NO: 182466 - DNA, 16 bp, Homo sapiens
ctttgagcttaagaat

SEQ ID NO: 182467 - DNA, 17 bp, Homo sapiens
ctttgagtttcctcagg

SEQ ID NO: 182468 - DNA, 18 bp, Homo sapiens
ctttgagtttcctcaggc

SEQ ID NO: 182469 - DNA, 15 bp, Homo sapiens
ctttgatcaggtggg

SEQ ID NO: 182470 - DNA, 21 bp, Homo sapiens
ctttgatgattaattcacctt

SEQ ID NO: 182471 - DNA, 18 bp, Homo sapiens
ctttgatgtcatatggaa

SEQ ID NO: 182472 - DNA, 20 bp, Homo sapiens
ctttgattaaagactccagt

SEQ ID NO: 182473 - DNA, 22 bp, Homo sapiens
ctttgcagccggcacagggtct

SEQ ID NO: 182474 - DNA, 23 bp, Homo sapiens
ctttgccccacctttattaaaat

SEQ ID NO: 182475 - DNA, 11 bp, Homo sapiens
ctttgctgcca

SEQ ID NO: 182476 - DNA, 14 bp, Homo sapiens
ctttggctctggag

SEQ ID NO: 182477 - DNA, 13 bp, Homo sapiens
ctttgggaggcca

SEQ ID NO: 182478 - DNA, 14 bp, Homo sapiens
ctttgggctgccct

SEQ ID NO: 182479 - DNA, 15 bp, Homo sapiens
ctttgggctgccctg

SEQ ID NO: 182480 - DNA, 15 bp, Homo sapiens
ctttgtcccggggct

SEQ ID NO: 182481 - DNA, 16 bp, Homo sapiens
cttttaaaagacaaga

SEQ ID NO: 182482 - DNA, 22 bp, Homo sapiens
cttttaaaagacaagacttcag

SEQ ID NO: 182483 - DNA, 23 bp, Homo sapiens
cttttaaaggggcagaaaaactc

SEQ ID NO: 182484 - DNA, 19 bp, Homo sapiens
cttttagttgtatctcttt

SEQ ID NO: 182485 - DNA, 18 bp, Homo sapiens
cttttatagctattactg

SEQ ID NO: 182486 - DNA, 17 bp, Homo sapiens
cttttattcatttgagt

SEQ ID NO: 182487 - DNA, 13 bp, Homo sapiens
cttttattgtata

SEQ ID NO: 182488 - DNA, 19 bp, Homo sapiens
cttttgaatccatgcttgg

SEQ ID NO: 182489 - DNA, 21 bp, Homo sapiens
cttttgaatccatgcttgggt

SEQ ID NO: 182490 - DNA, 23 bp, Homo sapiens
cttttgaatccatgcttgggtgt

SEQ ID NO: 182491 - DNA, 17 bp, Homo sapiens
cttttgccattaaactt

SEQ ID NO: 182492 - DNA, 15 bp, Homo sapiens
cttttgtatgtaaat

SEQ ID NO: 182493 - DNA, 18 bp, Homo sapiens
cttttgtatgtaaatgtg

SEQ ID NO: 182494 - DNA, 14 bp, Homo sapiens
ctttttaataaaaa

SEQ ID NO: 182495 - DNA, 13 bp, Homo sapiens
ctttttgaagtgt

SEQ ID NO: 182496 - DNA, 19 bp, Homo sapiens
ctttttgaatgttatttgt

SEQ ID NO: 182497 - DNA, 21 bp, Homo sapiens
cttttttcacggaagttttca

SEQ ID NO: 182498 - DNA, 20 bp, Homo sapiens
gaaaaaaaatgttctttggg

SEQ ID NO: 182499 - DNA, 19 bp, Homo sapiens
gaaaaaatattttcctgcc

SEQ ID NO: 182500 - DNA, 20 bp, Homo sapiens
gaaaaacttccatgaggcca

SEQ ID NO: 182501 - DNA, 21 bp, Homo sapiens
gaaaaagctcctgtcctccca

SEQ ID NO: 182502 - DNA, 19 bp, Homo sapiens
gaaaaccaagccgtggctt

SEQ ID NO: 182503 - DNA, 22 bp, Homo sapiens
gaaaacccagagaggaatcaga

SEQ ID NO: 182504 - DNA, 17 bp, Homo sapiens
gaaaacggttaaaactg

SEQ ID NO: 182505 - DNA, 16 bp, Homo sapiens
gaaaactgaaaatcta

SEQ ID NO: 182506 - DNA, 20 bp, Homo sapiens
gaaaactgaaaatctaatat

SEQ ID NO: 182507 - DNA, 20 bp, Homo sapiens
gaaaagactccaaagaaatg

SEQ ID NO: 182508 - DNA, 17 bp, Homo sapiens
gaaaagcacctgccgac

SEQ ID NO: 182509 - DNA, 14 bp, Homo sapiens
gaaaagtacattta

SEQ ID NO: 182510 - DNA, 14 bp, Homo sapiens
gaaaagtcaaactg

SEQ ID NO: 182511 - DNA, 16 bp, Homo sapiens
gaaaagtgaatgctca

SEQ ID NO: 182512 - DNA, 15 bp, Homo sapiens
gaaaatatgcatcta

SEQ ID NO: 182513 - DNA, 21 bp, Homo sapiens
gaaaatattatgtgtttccat

SEQ ID NO: 182514 - DNA, 18 bp, Homo sapiens
gaaaatattttgtctaaa

SEQ ID NO: 182515 - DNA, 19 bp, Homo sapiens
gaaaatattttgtctaaaa

SEQ ID NO: 182516 - DNA, 14 bp, Homo sapiens
gaaaatcagcctgc

SEQ ID NO: 182517 - DNA, 16 bp, Homo sapiens
gaaaatcagcctgctc

SEQ ID NO: 182518 - DNA, 13 bp, Homo sapiens
gaaaatgaataat

SEQ ID NO: 182519 - DNA, 15 bp, Homo sapiens
gaaacaataaagaga

SEQ ID NO: 182520 - DNA, 14 bp, Homo sapiens
gaaacacaatattt

SEQ ID NO: 182521 - DNA, 21 bp, Homo sapiens
gaaacacactgaggcagggaa

SEQ ID NO: 182522 - DNA, 13 bp, Homo sapiens
gaaacataaataa

SEQ ID NO: 182523 - DNA, 20 bp, Homo sapiens
gaaacatgactcgtatatgt

SEQ ID NO: 182524 - DNA, 20 bp, Homo sapiens
gaaaccagggcctgagccaa

SEQ ID NO: 182525 - DNA, 17 bp, Homo sapiens
gaaaccccatctctact

SEQ ID NO: 182526 - DNA, 17 bp, Homo sapiens
gaaacccttgaaaagac

SEQ ID NO: 182527 - DNA, 18 bp, Homo sapiens
gaaacctgaaaaaaagtt

SEQ ID NO: 182528 - DNA, 20 bp, Homo sapiens
gaaactcaccatgtaaaaga

SEQ ID NO: 182529 - DNA, 15 bp, Homo sapiens
gaaactgccagcaac

SEQ ID NO: 182530 - DNA, 18 bp, Homo sapiens
gaaactgtagtctcagga

SEQ ID NO: 182531 - DNA, 16 bp, Homo sapiens
gaaagaaaatatgcat

SEQ ID NO: 182532 - DNA, 17 bp, Homo sapiens
gaaagaaaatatgcatc

SEQ ID NO: 182533 - DNA, 22 bp, Homo sapiens
gaaagaaacccgacagagggaa

SEQ ID NO: 182534 - DNA, 18 bp, Homo sapiens
gaaagagcacttaagaga

SEQ ID NO: 182535 - DNA, 23 bp, Homo sapiens
gaaagagcacttaagagaatatt

SEQ ID NO: 182536 - DNA, 22 bp, Homo sapiens
gaaagatggctgtgcctctgcc

SEQ ID NO: 182537 - DNA, 14 bp, Homo sapiens
gaaagcagaacagt

SEQ ID NO: 182538 - DNA, 22 bp, Homo sapiens
gaaagcagaacagtgattacca

SEQ ID NO: 182539 - DNA, 12 bp, Homo sapiens
gaaagcaggggc

SEQ ID NO: 182540 - DNA, 14 bp, Homo sapiens
gaaagccaggcagg

SEQ ID NO: 182541 - DNA, 13 bp, Homo sapiens
gaaagctagagat

SEQ ID NO: 182542 - DNA, 21 bp, Homo sapiens
gaaagctggtaaactatttgt

SEQ ID NO: 182543 - DNA, 18 bp, Homo sapiens
gaaaggaagctccactgt

SEQ ID NO: 182544 - DNA, 20 bp, Homo sapiens
gaaaggatgtaaacagtgcc

SEQ ID NO: 182545 - DNA, 14 bp, Homo sapiens
gaaaggattcatgt

SEQ ID NO: 182546 - DNA, 19 bp, Homo sapiens
gaaaggccagctggcagca

SEQ ID NO: 182547 - DNA, 18 bp, Homo sapiens
gaaaggttaccctgtaac

SEQ ID NO: 182548 - DNA, 23 bp, Homo sapiens
gaaagtgggtgagatgctggaga

SEQ ID NO: 182549 - DNA, 14 bp, Homo sapiens
gaaataaaaccttt

SEQ ID NO: 182550 - DNA, 13 bp, Homo sapiens
gaaataataaatc

SEQ ID NO: 182551 - DNA, 17 bp, Homo sapiens
gaaataataaatctggt

SEQ ID NO: 182552 - DNA, 19 bp, Homo sapiens
gaaataatgtacatctggc

SEQ ID NO: 182553 - DNA, 21 bp, Homo sapiens
gaaatacaattctacattgtc

SEQ ID NO: 182554 - DNA, 12 bp, Homo sapiens
gaaatacatatt

SEQ ID NO: 182555 - DNA, 19 bp, Homo sapiens
gaaatagaaaaaccctgcc

SEQ ID NO: 182556 - DNA, 13 bp, Homo sapiens
gaaatataattga

SEQ ID NO: 182557 - DNA, 15 bp, Homo sapiens
gaaatatgattttat

SEQ ID NO: 182558 - DNA, 17 bp, Homo sapiens
gaaatatgcacaatagc

SEQ ID NO: 182559 - DNA, 18 bp, Homo sapiens
gaaatatgcacaatagca

SEQ ID NO: 182560 - DNA, 19 bp, Homo sapiens
gaaatcaaagagagaaaat

SEQ ID NO: 182561 - DNA, 19 bp, Homo sapiens
gaaatcaaatatgcaaagc

SEQ ID NO: 182562 - DNA, 20 bp, Homo sapiens
gaaatcagtaatatttatat

SEQ ID NO: 182563 - DNA, 12 bp, Homo sapiens
gaaatctcaccc

SEQ ID NO: 182564 - DNA, 23 bp, Homo sapiens
gaaatgcatccattcctcaggga

SEQ ID NO: 182565 - DNA, 22 bp, Homo sapiens
gaaatgttattttttaattatt

SEQ ID NO: 182566 - DNA, 18 bp, Homo sapiens
gaggggcagaacagccgc

SEQ ID NO: 182567 - DNA, 13 bp, Homo sapiens
gaggggcccgagc

SEQ ID NO: 182568 - DNA, 18 bp, Homo sapiens
gaggggcctggcagccgt

SEQ ID NO: 182569 - DNA, 11 bp, Homo sapiens
gaggggctctc

SEQ ID NO: 182570 - DNA, 12 bp, Homo sapiens
gaggggctctca

SEQ ID NO: 182571 - DNA, 23 bp, Homo sapiens
gaggggctctcagctcagcgcca

SEQ ID NO: 182572 - DNA, 15 bp, Homo sapiens
gagggtcaggaagga

SEQ ID NO: 182573 - DNA, 16 bp, Homo sapiens
gagggtcaggaaggat

SEQ ID NO: 182574 - DNA, 19 bp, Homo sapiens
gagggtcaggactgtgact

SEQ ID NO: 182575 - DNA, 15 bp, Homo sapiens
gagggtctggagaag

SEQ ID NO: 182576 - DNA, 12 bp, Homo sapiens
gagggtggaata

SEQ ID NO: 182577 - DNA, 18 bp, Homo sapiens
gagggttgttctcctaga

SEQ ID NO: 182578 - DNA, 15 bp, Homo sapiens
gaggtcaacagagaa

SEQ ID NO: 182579 - DNA, 23 bp, Homo sapiens
gaggtcaacagagaaggcaggaa

SEQ ID NO: 182580 - DNA, 16 bp, Homo sapiens
gaggtcaagcccagga

SEQ ID NO: 182581 - DNA, 17 bp, Homo sapiens
gaggtcaagcccaggag

SEQ ID NO: 182582 - DNA, 15 bp, Homo sapiens
gaggtcgaggcagga

SEQ ID NO: 182583 - DNA, 23 bp, Homo sapiens
gaggtgctactgactttctcagc

SEQ ID NO: 182584 - DNA, 15 bp, Homo sapiens
gaggtgggagcagga

SEQ ID NO: 182585 - DNA, 16 bp, Homo sapiens
gaggtgggatatccct

SEQ ID NO: 182586 - DNA, 15 bp, Homo sapiens
gaggttgcagtgagc

SEQ ID NO: 182587 - DNA, 19 bp, Homo sapiens
gagtagaaactgcagggaa

SEQ ID NO: 182588 - DNA, 18 bp, Homo sapiens
gagtagatggtgaaattt

SEQ ID NO: 182589 - DNA, 21 bp, Homo sapiens
gagtagccgagagcctgctcc

SEQ ID NO: 182590 - DNA, 21 bp, Homo sapiens
gagtagttgatgttgcatttt

SEQ ID NO: 182591 - DNA, 12 bp, Homo sapiens
gagtatatgcac

SEQ ID NO: 182592 - DNA, 19 bp, Homo sapiens
gagtcaaaactcaaatgct

SEQ ID NO: 182593 - DNA, 15 bp, Homo sapiens
gagtcactgcctctc

SEQ ID NO: 182594 - DNA, 18 bp, Homo sapiens
gagtcagggacccctgcc

SEQ ID NO: 182595 - DNA, 20 bp, Homo sapiens
gagtcatgatctccctgccg

SEQ ID NO: 182596 - DNA, 13 bp, Homo sapiens
gagtccagtctct

SEQ ID NO: 182597 - DNA, 23 bp, Homo sapiens
gagtcgtcatcacttttcagtga

SEQ ID NO: 182598 - DNA, 22 bp, Homo sapiens
gagtgaacaaatttacagagac

SEQ ID NO: 182599 - DNA, 23 bp, Homo sapiens
gagtgagacccagccctcatccc

SEQ ID NO: 182600 - DNA, 22 bp, Homo sapiens
gagtgatacaacttcaagtgca

SEQ ID NO: 182601 - DNA, 18 bp, Homo sapiens
gagtgcagtcctgatcag

SEQ ID NO: 182602 - DNA, 15 bp, Homo sapiens
gagtggctcctcccg

SEQ ID NO: 182603 - DNA, 23 bp, Homo sapiens
gagtgggggatcacagcctctga

SEQ ID NO: 182604 - DNA, 18 bp, Homo sapiens
gagtgtacttaactattc

SEQ ID NO: 182605 - DNA, 18 bp, Homo sapiens
gagtgtgggaagggagag

SEQ ID NO: 182606 - DNA, 11 bp, Homo sapiens
gagtgtgtgca

SEQ ID NO: 182607 - DNA, 19 bp, Homo sapiens
gagtgttccccttccactg

SEQ ID NO: 182608 - DNA, 23 bp, Homo sapiens
gagttattttaattatcttttct

SEQ ID NO: 182609 - DNA, 21 bp, Homo sapiens
gagttcaggtagctgcccctg

SEQ ID NO: 182610 - DNA, 22 bp, Homo sapiens
gagttcaggtagctgcccctgg

SEQ ID NO: 182611 - DNA, 11 bp, Homo sapiens
gagttctacat

SEQ ID NO: 182612 - DNA, 21 bp, Homo sapiens
gagttcttaaggattgtgata

SEQ ID NO: 182613 - DNA, 17 bp, Homo sapiens
gagttgattcagctctg

SEQ ID NO: 182614 - DNA, 14 bp, Homo sapiens
gagttgtaaatata

SEQ ID NO: 182615 - DNA, 19 bp, Homo sapiens
gagttgtaaatatataaat

SEQ ID NO: 182616 - DNA, 19 bp, Homo sapiens
gagtttcattctcctgcct

SEQ ID NO: 182617 - DNA, 11 bp, Homo sapiens
gataaagatga

SEQ ID NO: 182618 - DNA, 12 bp, Homo sapiens
gataaattataa

SEQ ID NO: 182619 - DNA, 23 bp, Homo sapiens
gataacctatatgatttatagtt

SEQ ID NO: 182620 - DNA, 18 bp, Homo sapiens
gataactgcaattttaat

SEQ ID NO: 182621 - DNA, 22 bp, Homo sapiens
gataagagtagaaactgcaggg

SEQ ID NO: 182622 - DNA, 13 bp, Homo sapiens
gataatcagcctc

SEQ ID NO: 182623 - DNA, 15 bp, Homo sapiens
gataatcagcctctt

SEQ ID NO: 182624 - DNA, 15 bp, Homo sapiens
gataatgctgttgcc

SEQ ID NO: 182625 - DNA, 20 bp, Homo sapiens
gatacaacttcaagtgcatg

SEQ ID NO: 182626 - DNA, 16 bp, Homo sapiens
gatactgtaacacttt

SEQ ID NO: 182627 - DNA, 23 bp, Homo sapiens
gatagcatttttgatttatgcat

SEQ ID NO: 182628 - DNA, 22 bp, Homo sapiens
gatagtctttcagttaaggaga

SEQ ID NO: 182629 - DNA, 14 bp, Homo sapiens
gatatattaaaaat

SEQ ID NO: 182630 - DNA, 20 bp, Homo sapiens
gatatattaaaaatataaaa

SEQ ID NO: 182631 - DNA, 16 bp, Homo sapiens
gatatgggacattttt

SEQ ID NO: 182632 - DNA, 22 bp, Homo sapiens
gatattttcaacgcagccctgc

SEQ ID NO: 182633 - DNA, 23 bp, Homo sapiens
gatattttcaacgcagccctgct

SEQ ID NO: 182634 - DNA, 20 bp, Homo sapiens
gatattttcttccaagcaaa

SEQ ID NO: 182635 - DNA, 18 bp, Homo sapiens
gatatttttccatttttt

SEQ ID NO: 182636 - DNA, 14 bp, Homo sapiens
gatcaagaaagtgt

SEQ ID NO: 182637 - DNA, 14 bp, Homo sapiens
gatcacctgaggtc

SEQ ID NO: 182638 - DNA, 23 bp, Homo sapiens
gatcagagccgtggtcctttggg

SEQ ID NO: 182639 - DNA, 19 bp, Homo sapiens
gatcagcaaaccggggcct

SEQ ID NO: 182640 - DNA, 21 bp, Homo sapiens
gatcatcctttccagcatgag

SEQ ID NO: 182641 - DNA, 14 bp, Homo sapiens
gatccacctgtctc

SEQ ID NO: 182642 - DNA, 19 bp, Homo sapiens
gatccacctgtctcagcct

SEQ ID NO: 182643 - DNA, 19 bp, Homo sapiens
gatccatgtagcaggactg

SEQ ID NO: 182644 - DNA, 17 bp, Homo sapiens
gatcccagctcacgtca

SEQ ID NO: 182645 - DNA, 18 bp, Homo sapiens
gatccctcatctgtccct

SEQ ID NO: 182646 - DNA, 23 bp, Homo sapiens
gatccctctacagagcttccctg

SEQ ID NO: 182647 - DNA, 14 bp, Homo sapiens
gatccctgtgttgt

SEQ ID NO: 182648 - DNA, 21 bp, Homo sapiens
gatccctgtgttgtctctaga

SEQ ID NO: 182649 - DNA, 23 bp, Homo sapiens
gatcctgggtggtctgcaggcag

SEQ ID NO: 182650 - DNA, 17 bp, Homo sapiens
gatcggagcctcctctc

SEQ ID NO: 182651 - DNA, 12 bp, Homo sapiens
gatctccctgcc

SEQ ID NO: 182652 - DNA, 13 bp, Homo sapiens
gatctccctgccg

SEQ ID NO: 182653 - DNA, 15 bp, Homo sapiens
gatctccctgccgcc

SEQ ID NO: 182654 - DNA, 12 bp, Homo sapiens
gatctcttgagc

SEQ ID NO: 182655 - DNA, 19 bp, Homo sapiens
gatctcttgagcctgggag

SEQ ID NO: 182656 - DNA, 12 bp, Homo sapiens
gatctgaacaga

SEQ ID NO: 182657 - DNA, 17 bp, Homo sapiens
gatctgatgcaagcaag

SEQ ID NO: 182658 - DNA, 20 bp, Homo sapiens
gatctgtatatacaataaca

SEQ ID NO: 182659 - DNA, 16 bp, Homo sapiens
gatctgtgcccagaga

SEQ ID NO: 182660 - DNA, 19 bp, Homo sapiens
gatcttggcttactgcagc

SEQ ID NO: 182661 - DNA, 14 bp, Homo sapiens
gatgaaaaatagca

SEQ ID NO: 182662 - DNA, 17 bp, Homo sapiens
gatgacaacttcccagt

SEQ ID NO: 182663 - DNA, 12 bp, Homo sapiens
gatgacccctcc

SEQ ID NO: 182664 - DNA, 17 bp, Homo sapiens
gatgacccctcccctaa

SEQ ID NO: 182665 - DNA, 15 bp, Homo sapiens
gatgacctggataac

SEQ ID NO: 182666 - DNA, 11 bp, Homo sapiens
gatgagctcta

SEQ ID NO: 182667 - DNA, 16 bp, Homo sapiens
gatgagctctacccag

SEQ ID NO: 182668 - DNA, 13 bp, Homo sapiens
gatgatcctaggc

SEQ ID NO: 182669 - DNA, 21 bp, Homo sapiens
gatgatggtcttcagcctctt

SEQ ID NO: 182670 - DNA, 14 bp, Homo sapiens
gatgcaaagaaaat

SEQ ID NO: 182671 - DNA, 15 bp, Homo sapiens
gatgcaaagaggcaa

SEQ ID NO: 182672 - DNA, 12 bp, Homo sapiens
gatgcctccacc

SEQ ID NO: 182673 - DNA, 13 bp, Homo sapiens
gatgcctccaccg

SEQ ID NO: 182674 - DNA, 13 bp, Homo sapiens
gatgctccttggg

SEQ ID NO: 182675 - DNA, 20 bp, Homo sapiens
gatgctgactgtactcctcc

SEQ ID NO: 182676 - DNA, 22 bp, Homo sapiens
gatggaaccgcaggaagctgct

SEQ ID NO: 182677 - DNA, 23 bp, Homo sapiens
gatggagactggtcctgtgtgca

SEQ ID NO: 182678 - DNA, 17 bp, Homo sapiens
gatggagcccaggcggg

SEQ ID NO: 182679 - DNA, 19 bp, Homo sapiens
gatggagcccaggcgggag

SEQ ID NO: 182680 - DNA, 22 bp, Homo sapiens
gatggagcccaggcgggagcgg

SEQ ID NO: 182681 - DNA, 14 bp, Homo sapiens
gatggaggagaaga

SEQ ID NO: 182682 - DNA, 11 bp, Homo sapiens
gatggaggagg

SEQ ID NO: 182683 - DNA, 18 bp, Homo sapiens
gatggataacctatatga

SEQ ID NO: 182684 - DNA, 12 bp, Homo sapiens
gatggattccaa

SEQ ID NO: 182685 - DNA, 21 bp, Homo sapiens
gatggattccaaccccaactc

SEQ ID NO: 182686 - DNA, 21 bp, Homo sapiens
gatggcacttagctatcagaa

SEQ ID NO: 182687 - DNA, 14 bp, Homo sapiens
gatggcgctaggca

SEQ ID NO: 182688 - DNA, 13 bp, Homo sapiens
gatggctgtgcct

SEQ ID NO: 182689 - DNA, 19 bp, Homo sapiens
gatgggatggtggagggcc

SEQ ID NO: 182690 - DNA, 14 bp, Homo sapiens
gatggggaaggagg

SEQ ID NO: 182691 - DNA, 23 bp, Homo sapiens
gatgggtctggtttgcagagctt

SEQ ID NO: 182692 - DNA, 19 bp, Homo sapiens
gatgtaaacagtgcctgct

SEQ ID NO: 182693 - DNA, 20 bp, Homo sapiens
gatgtaaacagtgcctgctg

SEQ ID NO: 182694 - DNA, 21 bp, Homo sapiens
gatgtaaacagtgcctgctga

SEQ ID NO: 182695 - DNA, 12 bp, Homo sapiens
gatgtaaagtga

SEQ ID NO: 182696 - DNA, 17 bp, Homo sapiens
gatgtagaggagaaact

SEQ ID NO: 182697 - DNA, 11 bp, Homo sapiens
gatgtgatata

SEQ ID NO: 182698 - DNA, 12 bp, Homo sapiens
gatgtggccctg

SEQ ID NO: 182699 - DNA, 14 bp, Homo sapiens
gatgtggccctggc

SEQ ID NO: 182700 - DNA, 21 bp, Homo sapiens
gatgtggccctggcctgctgg

SEQ ID NO: 182701 - DNA, 22 bp, Homo sapiens
gatgtgggagggagcagacagg

SEQ ID NO: 182702 - DNA, 20 bp, Homo sapiens
gatgttcagcactgtccctt

SEQ ID NO: 182703 - DNA, 22 bp, Homo sapiens
gatgttcagcactgtcccttgc

SEQ ID NO: 182704 - DNA, 14 bp, Homo sapiens
gatgttctggccct

SEQ ID NO: 182705 - DNA, 23 bp, Homo sapiens
gatgtttcttttgtatgtaaatg

SEQ ID NO: 182706 - DNA, 19 bp, Homo sapiens
gattaaccacttcagctga

SEQ ID NO: 182707 - DNA, 21 bp, Homo sapiens
gattaaccacttcagctgact

SEQ ID NO: 182708 - DNA, 17 bp, Homo sapiens
gattaacctctgcacta

SEQ ID NO: 182709 - DNA, 14 bp, Homo sapiens
gattacatgcatgt

SEQ ID NO: 182710 - DNA, 22 bp, Homo sapiens
gattacctagtagtcatttcat

SEQ ID NO: 182711 - DNA, 13 bp, Homo sapiens
gattacctcctga

SEQ ID NO: 182712 - DNA, 14 bp, Homo sapiens
gattagaaggcaag

SEQ ID NO: 182713 - DNA, 22 bp, Homo sapiens
gattagaatgaaaattgtatgt

SEQ ID NO: 182714 - DNA, 13 bp, Homo sapiens
gaaattatttaat

SEQ ID NO: 182715 - DNA, 15 bp, Homo sapiens
gaaattatttaataa

SEQ ID NO: 182716 - DNA, 17 bp, Homo sapiens
gaaattatttaataaaa

SEQ ID NO: 182717 - DNA, 22 bp, Homo sapiens
gaaattgtttaagtgttgtaaa

SEQ ID NO: 182718 - DNA, 20 bp, Homo sapiens
gaaattttctagactttctg

SEQ ID NO: 182719 - DNA, 18 bp, Homo sapiens
gaaatttttattaaatta

SEQ ID NO: 182720 - DNA, 19 bp, Homo sapiens
gaaatttttattaaattat

SEQ ID NO: 182721 - DNA, 16 bp, Homo sapiens
gaacaaaaaaatctgc

SEQ ID NO: 182722 - DNA, 17 bp, Homo sapiens
gaacaaatttacagaga

SEQ ID NO: 182723 - DNA, 19 bp, Homo sapiens
gaacaagttgtttcattga

SEQ ID NO: 182724 - DNA, 20 bp, Homo sapiens
gaacactgggggaggggaca

SEQ ID NO: 182725 - DNA, 18 bp, Homo sapiens
gaacagataatcagtgtg

SEQ ID NO: 182726 - DNA, 16 bp, Homo sapiens
gaacagtgattaccag

SEQ ID NO: 182727 - DNA, 20 bp, Homo sapiens
gaacagtgattaccagggac

SEQ ID NO: 182728 - DNA, 13 bp, Homo sapiens
gaacatacttcag

SEQ ID NO: 182729 - DNA, 23 bp, Homo sapiens
gaacatcaccgacgcgtctcctg

SEQ ID NO: 182730 - DNA, 15 bp, Homo sapiens
gaacatccctgccag

SEQ ID NO: 182731 - DNA, 18 bp, Homo sapiens
gaaccatgaagacaggat

SEQ ID NO: 182732 - DNA, 21 bp, Homo sapiens
gaaccatgtcagcaaaaagca

SEQ ID NO: 182733 - DNA, 12 bp, Homo sapiens
gaacccacctgc

SEQ ID NO: 182734 - DNA, 12 bp, Homo sapiens
gaacccttggct

SEQ ID NO: 182735 - DNA, 16 bp, Homo sapiens
gaacccttggcttgcc

SEQ ID NO: 182736 - DNA, 18 bp, Homo sapiens
gaacccttggcttgccca

SEQ ID NO: 182737 - DNA, 18 bp, Homo sapiens
gattgagaaggagagaaa

SEQ ID NO: 182738 - DNA, 19 bp, Homo sapiens
gattgagaaggagagaaag

SEQ ID NO: 182739 - DNA, 19 bp, Homo sapiens
gattgatagagtgttatca

SEQ ID NO: 182740 - DNA, 22 bp, Homo sapiens
gattgatcggagcctcctctct

SEQ ID NO: 182741 - DNA, 23 bp, Homo sapiens
gattgcaccactgcactccagcc

SEQ ID NO: 182742 - DNA, 21 bp, Homo sapiens
gattgctgccccatcagtgct

SEQ ID NO: 182743 - DNA, 16 bp, Homo sapiens
gattggctttaaacac

SEQ ID NO: 182744 - DNA, 16 bp, Homo sapiens
gattgttaaaataact

SEQ ID NO: 182745 - DNA, 12 bp, Homo sapiens
gattgttttatc

SEQ ID NO: 182746 - DNA, 20 bp, Homo sapiens
gatttacctgttttcgcacc

SEQ ID NO: 182747 - DNA, 15 bp, Homo sapiens
gatttagaactgtat

SEQ ID NO: 182748 - DNA, 22 bp, Homo sapiens
gatttagtgaaagctagagata

SEQ ID NO: 182749 - DNA, 21 bp, Homo sapiens
gatttatagtttgtacatgca

SEQ ID NO: 182750 - DNA, 21 bp, Homo sapiens
gatttcagaaagagcaagtct

SEQ ID NO: 182751 - DNA, 20 bp, Homo sapiens
gatttcatttcaactgtttg

SEQ ID NO: 182752 - DNA, 15 bp, Homo sapiens
gattttaattttgaa

SEQ ID NO: 182753 - DNA, 21 bp, Homo sapiens
gattttgaaaccatgaagaga

SEQ ID NO: 182754 - DNA, 20 bp, Homo sapiens
gattttttacagctgcctgc

SEQ ID NO: 182755 - DNA, 16 bp, Homo sapiens
gcaaaagactaattta

SEQ ID NO: 182756 - DNA, 15 bp, Homo sapiens
gcaaaagatgcttct

SEQ ID NO: 182757 - DNA, 22 bp, Homo sapiens
gcaaaagatgcttctcactgcc

SEQ ID NO: 182758 - DNA, 15 bp, Homo sapiens
gcaaaatttgatgcc

SEQ ID NO: 182759 - DNA, 20 bp, Homo sapiens
gcaaaatttgatgccaggac

SEQ ID NO: 182760 - DNA, 16 bp, Homo sapiens
gcaaacgctgcctgcc

SEQ ID NO: 182761 - DNA, 18 bp, Homo sapiens
gcaaacgctgcctgcccg

SEQ ID NO: 182762 - DNA, 13 bp, Homo sapiens
gcaaactctgctg

SEQ ID NO: 182763 - DNA, 14 bp, Homo sapiens
gcaaactctgctgt

SEQ ID NO: 182764 - DNA, 12 bp, Homo sapiens
gcaaagcattga

SEQ ID NO: 182765 - DNA, 20 bp, Homo sapiens
gcaaaggggtcccatagagg

SEQ ID NO: 182766 - DNA, 23 bp, Homo sapiens
gcaaaggggtcccatagaggtga

SEQ ID NO: 182767 - DNA, 15 bp, Homo sapiens
gcaaatcatagctgg

SEQ ID NO: 182768 - DNA, 15 bp, Homo sapiens
gcaaatgtggctcct

SEQ ID NO: 182769 - DNA, 22 bp, Homo sapiens
gcaacaatacatgctgctaatt

SEQ ID NO: 182770 - DNA, 17 bp, Homo sapiens
gcaacactctatattta

SEQ ID NO: 182771 - DNA, 13 bp, Homo sapiens
gcaacagaaaaaa

SEQ ID NO: 182772 - DNA, 13 bp, Homo sapiens
gcaactgaggcag

SEQ ID NO: 182773 - DNA, 13 bp, Homo sapiens
gcaagctgggtaa

SEQ ID NO: 182774 - DNA, 17 bp, Homo sapiens
gcaagcttggctgtaga

SEQ ID NO: 182775 - DNA, 14 bp, Homo sapiens
gcaagtatgtgagt

SEQ ID NO: 182776 - DNA, 21 bp, Homo sapiens
gcaagtgtatgcacgtgtgca

SEQ ID NO: 182777 - DNA, 22 bp, Homo sapiens
gcaagtgtgtgcatgtgtgcga

SEQ ID NO: 182778 - DNA, 14 bp, Homo sapiens
gcaatatgtaaata

SEQ ID NO: 182779 - DNA, 19 bp, Homo sapiens
gcaatgacatctcaggggc

SEQ ID NO: 182780 - DNA, 14 bp, Homo sapiens
gcaatgggcactgg

SEQ ID NO: 182781 - DNA, 16 bp, Homo sapiens
gcaatgggcactggga

SEQ ID NO: 182782 - DNA, 17 bp, Homo sapiens
gcaattccgcatttaat

SEQ ID NO: 182783 - DNA, 14 bp, Homo sapiens
gcaattgggatggc

SEQ ID NO: 182784 - DNA, 16 bp, Homo sapiens
gcaatttatacaatat

SEQ ID NO: 182785 - DNA, 14 bp, Homo sapiens
gcaatttcatatgc

SEQ ID NO: 182786 - DNA, 14 bp, Homo sapiens
gcacaagctgcacc

SEQ ID NO: 182787 - DNA, 13 bp, Homo sapiens
gcacacacctgta

SEQ ID NO: 182788 - DNA, 19 bp, Homo sapiens
gcacacagctgcagagaca

SEQ ID NO: 182789 - DNA, 17 bp, Homo sapiens
gcacacccactcagctc

SEQ ID NO: 182790 - DNA, 17 bp, Homo sapiens
gcacacgtcatgtttct

SEQ ID NO: 182791 - DNA, 20 bp, Homo sapiens
gcacactcccctgcactgga

SEQ ID NO: 182792 - DNA, 21 bp, Homo sapiens
gcacactcccctgcactggag

SEQ ID NO: 182793 - DNA, 14 bp, Homo sapiens
gcacactttgccat

SEQ ID NO: 182794 - DNA, 22 bp, Homo sapiens
gcacactttgccatattttcac

SEQ ID NO: 182795 - DNA, 16 bp, Homo sapiens
gcacagggcagtggga

SEQ ID NO: 182796 - DNA, 12 bp, Homo sapiens
gcacagggtctg

SEQ ID NO: 182797 - DNA, 14 bp, Homo sapiens
gcacagttttctga

SEQ ID NO: 182798 - DNA, 13 bp, Homo sapiens
gcacatctgcatt

SEQ ID NO: 182799 - DNA, 18 bp, Homo sapiens
gcacatctgtgtcttgtt

SEQ ID NO: 182800 - DNA, 19 bp, Homo sapiens
gcaccactgcactccagcc

SEQ ID NO: 182801 - DNA, 12 bp, Homo sapiens
gcaccataactt

SEQ ID NO: 182802 - DNA, 14 bp, Homo sapiens
gcaccatccctttt

SEQ ID NO: 182803 - DNA, 19 bp, Homo sapiens
gcacccacccagcacccag

SEQ ID NO: 182804 - DNA, 13 bp, Homo sapiens
gcacccccctggg

SEQ ID NO: 182805 - DNA, 14 bp, Homo sapiens
gcacccccctgggc

SEQ ID NO: 182806 - DNA, 19 bp, Homo sapiens
gcaccctcaggcaggtggg

SEQ ID NO: 182807 - DNA, 21 bp, Homo sapiens
gcaccgtcatggcttaatgtt

SEQ ID NO: 182808 - DNA, 19 bp, Homo sapiens
gcacctaaaccaccagtgc

SEQ ID NO: 182809 - DNA, 16 bp, Homo sapiens
gcacctagtccagtga

SEQ ID NO: 182810 - DNA, 14 bp, Homo sapiens
gcacctcccatcct

SEQ ID NO: 182811 - DNA, 17 bp, Homo sapiens
gcacctccccccactgc

SEQ ID NO: 182812 - DNA, 18 bp, Homo sapiens
gcacctccccccactgca

SEQ ID NO: 182813 - DNA, 17 bp, Homo sapiens
gcacgcccatgtgtgag

SEQ ID NO: 182814 - DNA, 18 bp, Homo sapiens
gcacgcccatgtgtgagt

SEQ ID NO: 182815 - DNA, 16 bp, Homo sapiens
gcacgctgtgggcagg

SEQ ID NO: 182816 - DNA, 20 bp, Homo sapiens
gcacgtagtagggtcaggcc

SEQ ID NO: 182817 - DNA, 15 bp, Homo sapiens
gcacgtggcctcttg

SEQ ID NO: 182818 - DNA, 14 bp, Homo sapiens
gcactaaagcagtg

SEQ ID NO: 182819 - DNA, 20 bp, Homo sapiens
gcactaaagcagtggacacc

SEQ ID NO: 182820 - DNA, 21 bp, Homo sapiens
gcactacatgtggtttataga

SEQ ID NO: 182821 - DNA, 21 bp, Homo sapiens
gcactaccactcctgccaagg

SEQ ID NO: 182822 - DNA, 13 bp, Homo sapiens
gcactagcctttg

SEQ ID NO: 182823 - DNA, 15 bp, Homo sapiens
gcactccagcctggg

SEQ ID NO: 182824 - DNA, 17 bp, Homo sapiens
gcactccagcctgggtg

SEQ ID NO: 182825 - DNA, 15 bp, Homo sapiens
gcactgacttctaag

SEQ ID NO: 182826 - DNA, 21 bp, Homo sapiens
gcactgagataccagcgagga

SEQ ID NO: 182827 - DNA, 15 bp, Homo sapiens
gcactgctgcccagc

SEQ ID NO: 182828 - DNA, 16 bp, Homo sapiens
gcactgcttgaggaaa

SEQ ID NO: 182829 - DNA, 17 bp, Homo sapiens
gcactgcttgaggaaaa

SEQ ID NO: 182830 - DNA, 18 bp, Homo sapiens
gcactggagtccagtctc

SEQ ID NO: 182831 - DNA, 22 bp, Homo sapiens
gcactggtggcccgacagcctg

SEQ ID NO: 182832 - DNA, 23 bp, Homo sapiens
gcactggtggcccgacagcctgg

SEQ ID NO: 182833 - DNA, 15 bp, Homo sapiens
gcactgtcaagatga

SEQ ID NO: 182834 - DNA, 23 bp, Homo sapiens
gcactgtcccttgcctcaatgcc

SEQ ID NO: 182835 - DNA, 18 bp, Homo sapiens
gcactgttccccctgtgc

SEQ ID NO: 182836 - DNA, 19 bp, Homo sapiens
gcactgttccccctgtgca

SEQ ID NO: 182837 - DNA, 20 bp, Homo sapiens
gcactgttccccctgtgcag

SEQ ID NO: 182838 - DNA, 18 bp, Homo sapiens
gcacttaagagaatattt

SEQ ID NO: 182839 - DNA, 22 bp, Homo sapiens
gcacttgcacgcccatgtgtga

SEQ ID NO: 182840 - DNA, 16 bp, Homo sapiens
gcacttggagccaagg

SEQ ID NO: 182841 - DNA, 14 bp, Homo sapiens
gcacttggcctctg

SEQ ID NO: 182842 - DNA, 17 bp, Homo sapiens
gcagaaaagcacctgcc

SEQ ID NO: 182843 - DNA, 21 bp, Homo sapiens
gcagaaaagcacctgccgacc

SEQ ID NO: 182844 - DNA, 21 bp, Homo sapiens
gcagaacgtattggtccagct

SEQ ID NO: 182845 - DNA, 22 bp, Homo sapiens
gcagaagaatgggaatatttta

SEQ ID NO: 182846 - DNA, 23 bp, Homo sapiens
gcagaagaattgaacccaggagg

SEQ ID NO: 182847 - DNA, 20 bp, Homo sapiens
gcagaaggaaaaatgtgtaa

SEQ ID NO: 182848 - DNA, 18 bp, Homo sapiens
gcagacacagggacttga

SEQ ID NO: 182849 - DNA, 19 bp, Homo sapiens
gcagacacagggacttgaa

SEQ ID NO: 182850 - DNA, 23 bp, Homo sapiens
gcagacacagggacttgaagttg

SEQ ID NO: 182851 - DNA, 17 bp, Homo sapiens
gcagacagcagctcagg

SEQ ID NO: 182852 - DNA, 21 bp, Homo sapiens
gcagacagcagctcaggcaca

SEQ ID NO: 182853 - DNA, 17 bp, Homo sapiens
gcagacaggaggaatca

SEQ ID NO: 182854 - DNA, 16 bp, Homo sapiens
gcagacctccccagcc

SEQ ID NO: 182855 - DNA, 17 bp, Homo sapiens
gcagacctccccagccc

SEQ ID NO: 182856 - DNA, 19 bp, Homo sapiens
gcagacctccccagcccct

SEQ ID NO: 182857 - DNA, 14 bp, Homo sapiens
gcagactggagggg

SEQ ID NO: 182858 - DNA, 21 bp, Homo sapiens
gcagagaattctcttatccaa

SEQ ID NO: 182859 - DNA, 16 bp, Homo sapiens
gcagagcccaagggaa

SEQ ID NO: 182860 - DNA, 16 bp, Homo sapiens
gcagagcttcttccag

SEQ ID NO: 182861 - DNA, 16 bp, Homo sapiens
gcagagggcagaggct

SEQ ID NO: 182862 - DNA, 14 bp, Homo sapiens
gcagaggtggccag

SEQ ID NO: 182863 - DNA, 13 bp, Homo sapiens
gcagagtcagcag

SEQ ID NO: 182864 - DNA, 18 bp, Homo sapiens
gcagataaacagtagtga

SEQ ID NO: 182865 - DNA, 12 bp, Homo sapiens
gcagatcccagc

SEQ ID NO: 182866 - DNA, 13 bp, Homo sapiens
gcagatgacaaaa

SEQ ID NO: 182867 - DNA, 14 bp, Homo sapiens
gcagattggagaaa

SEQ ID NO: 182868 - DNA, 22 bp, Homo sapiens
gacaccagcctttctcccaggc

SEQ ID NO: 182869 - DNA, 20 bp, Homo sapiens
gacaccggggtggtgggaac

SEQ ID NO: 182870 - DNA, 20 bp, Homo sapiens
gacacctgcacctcccccca

SEQ ID NO: 182871 - DNA, 19 bp, Homo sapiens
gacacggatctgagaatct

SEQ ID NO: 182872 - DNA, 14 bp, Homo sapiens
gacacgtccacccc

SEQ ID NO: 182873 - DNA, 15 bp, Homo sapiens
gacacgtccacccca

SEQ ID NO: 182874 - DNA, 16 bp, Homo sapiens
gacacttaaaaatggt

SEQ ID NO: 182875 - DNA, 21 bp, Homo sapiens
gacacttttcatgtgtgattt

SEQ ID NO: 182876 - DNA, 14 bp, Homo sapiens
gacagaaagcagaa

SEQ ID NO: 182877 - DNA, 13 bp, Homo sapiens
gacagacacacac

SEQ ID NO: 182878 - DNA, 15 bp, Homo sapiens
gacagacaggctctt

SEQ ID NO: 182879 - DNA, 18 bp, Homo sapiens
gaattagaaacataaata

SEQ ID NO: 182880 - DNA, 23 bp, Homo sapiens
gaattcttgaaggaaaatgatac

SEQ ID NO: 182881 - DNA, 15 bp, Homo sapiens
gaattgaacccagga

SEQ ID NO: 182882 - DNA, 21 bp, Homo sapiens
gaattgacccacaagaaatga

SEQ ID NO: 182883 - DNA, 17 bp, Homo sapiens
gaatttattcaattcct

SEQ ID NO: 182884 - DNA, 23 bp, Homo sapiens
gaatttattcaattcctctggga

SEQ ID NO: 182885 - DNA, 17 bp, Homo sapiens
gaatttgagtgctctga

SEQ ID NO: 182886 - DNA, 23 bp, Homo sapiens
gaattttcagaccccagcggctg

SEQ ID NO: 182887 - DNA, 17 bp, Homo sapiens
gacaaaaacagcctcac

SEQ ID NO: 182888 - DNA, 21 bp, Homo sapiens
gacaaaaattcaactcagact

SEQ ID NO: 182889 - DNA, 17 bp, Homo sapiens
gacaaccactggtctgt

SEQ ID NO: 182890 - DNA, 14 bp, Homo sapiens
gacaaggtagccct

SEQ ID NO: 182891 - DNA, 20 bp, Homo sapiens
gacaagtgctgaacagtgga

SEQ ID NO: 182892 - DNA, 19 bp, Homo sapiens
gacaatcatgaaatatgca

SEQ ID NO: 182893 - DNA, 21 bp, Homo sapiens
gacaatcatgaaatatgcatc

SEQ ID NO: 182894 - DNA, 12 bp, Homo sapiens
gacaatgtgaaa

SEQ ID NO: 182895 - DNA, 18 bp, Homo sapiens
gacaatgtgaaaagaaaa

SEQ ID NO: 182896 - DNA, 22 bp, Homo sapiens
gacacagctttatcaccagaga

SEQ ID NO: 182897 - DNA, 16 bp, Homo sapiens
gacacagggacttgaa

SEQ ID NO: 182898 - DNA, 15 bp, Homo sapiens
gacaccacacccagc

SEQ ID NO: 182899 - DNA, 19 bp, Homo sapiens
gacaccacacccagcctca

SEQ ID NO: 182900 - DNA, 21 bp, Homo sapiens
gacaccacacccagcctcagt

SEQ ID NO: 182901 - DNA, 20 bp, Homo sapiens
gacaccagcctttctcccag

SEQ ID NO: 182902 - DNA, 15 bp, Homo sapiens
gacacctgcacctcc

SEQ ID NO: 182903 - DNA, 16 bp, Homo sapiens
gacacctgcacctccc

SEQ ID NO: 182904 - DNA, 17 bp, Homo sapiens
gacacctgcacctcccc

SEQ ID NO: 182905 - DNA, 13 bp, Homo sapiens
gacacctgccctg

SEQ ID NO: 182906 - DNA, 20 bp, Homo sapiens
gacacggatctgagaatctt

SEQ ID NO: 182907 - DNA, 16 bp, Homo sapiens
gacactagaagatttt

SEQ ID NO: 182908 - DNA, 16 bp, Homo sapiens
gacactccagtgccag

SEQ ID NO: 182909 - DNA, 15 bp, Homo sapiens
ctcactgttgaattt

SEQ ID NO: 182910 - DNA, 21 bp, Homo sapiens
ctcagaaatttttatttttct

SEQ ID NO: 182911 - DNA, 12 bp, Homo sapiens
ctcagaatattg

SEQ ID NO: 182912 - DNA, 22 bp, Homo sapiens
ctcagacaggaaagggaaggcc

SEQ ID NO: 182913 - DNA, 22 bp, Homo sapiens
ctcagacccccactctcattcc

SEQ ID NO: 182914 - DNA, 23 bp, Homo sapiens
ctcagacccccactctcattccc

SEQ ID NO: 182915 - DNA, 18 bp, Homo sapiens
ctcagagggttgttctcc

SEQ ID NO: 182916 - DNA, 16 bp, Homo sapiens
ctcagcatacctgctg

SEQ ID NO: 182917 - DNA, 15 bp, Homo sapiens
ctcagccatgaggag

SEQ ID NO: 182918 - DNA, 21 bp, Homo sapiens
ctcagccctccctgcccctcc

SEQ ID NO: 182919 - DNA, 15 bp, Homo sapiens
ctcagccctgggccc

SEQ ID NO: 182920 - DNA, 19 bp, Homo sapiens
ctcagccctgggccccacc

SEQ ID NO: 182921 - DNA, 23 bp, Homo sapiens
ctcagcctcctgtgtagctggga

SEQ ID NO: 182922 - DNA, 18 bp, Homo sapiens
ctcagcctggtgggcctc

SEQ ID NO: 182923 - DNA, 15 bp, Homo sapiens
ctcagccttggataa

SEQ ID NO: 182924 - DNA, 15 bp, Homo sapiens
ctcagctcagcgcca

SEQ ID NO: 182925 - DNA, 16 bp, Homo sapiens
ctcagctcagcgccag

SEQ ID NO: 182926 - DNA, 23 bp, Homo sapiens
ctcagctggatgatggtcttcag

SEQ ID NO: 182927 - DNA, 21 bp, Homo sapiens
ctcagctttttgtcttttctg

SEQ ID NO: 182928 - DNA, 16 bp, Homo sapiens
ctcaggactcagaagc

SEQ ID NO: 182929 - DNA, 16 bp, Homo sapiens
ctcaggactcctctcc

SEQ ID NO: 182930 - DNA, 13 bp, Homo sapiens
ctcaggaggctga

SEQ ID NO: 182931 - DNA, 23 bp, Homo sapiens
ctcaggaggctgaggcagaagaa

SEQ ID NO: 182932 - DNA, 18 bp, Homo sapiens
ctcaggagtttgagacca

SEQ ID NO: 182933 - DNA, 15 bp, Homo sapiens
ctcaggatgcccagg

SEQ ID NO: 182934 - DNA, 16 bp, Homo sapiens
ctcaggatgcccaggg

SEQ ID NO: 182935 - DNA, 14 bp, Homo sapiens
ctcaggcactagcc

SEQ ID NO: 182936 - DNA, 23 bp, Homo sapiens
ctcaggcactagcctttggctct

SEQ ID NO: 182937 - DNA, 18 bp, Homo sapiens
ctcaggcaggtgggatgg

SEQ ID NO: 182938 - DNA, 19 bp, Homo sapiens
ctcaggctctgccctgccc

SEQ ID NO: 182939 - DNA, 11 bp, Homo sapiens
ctcaggctgct

SEQ ID NO: 182940 - DNA, 17 bp, Homo sapiens
ctcaggctgctggagga

SEQ ID NO: 182941 - DNA, 17 bp, Homo sapiens
ctcaggctggtgggagg

SEQ ID NO: 182942 - DNA, 23 bp, Homo sapiens
ctcagggacagagacacctgcac

SEQ ID NO: 182943 - DNA, 18 bp, Homo sapiens
ctcagggacagagccatg

SEQ ID NO: 182944 - DNA, 15 bp, Homo sapiens
ctcagggcctggtcg

SEQ ID NO: 182945 - DNA, 17 bp, Homo sapiens
ctcaggggccagaggaa

SEQ ID NO: 182946 - DNA, 17 bp, Homo sapiens
ctcaggggcgtgtggct

SEQ ID NO: 182947 - DNA, 14 bp, Homo sapiens
ctcaggtgagaagc

SEQ ID NO: 182948 - DNA, 16 bp, Homo sapiens
ctcagtccacctgagc

SEQ ID NO: 182949 - DNA, 17 bp, Homo sapiens
ctcagtccacctgagct

SEQ ID NO: 182950 - DNA, 18 bp, Homo sapiens
ctcagtccacctgagctg

SEQ ID NO: 182951 - DNA, 17 bp, Homo sapiens
ctcagtcctcccctcac

SEQ ID NO: 182952 - DNA, 19 bp, Homo sapiens
ctcagtcctcccctcacag

SEQ ID NO: 182953 - DNA, 20 bp, Homo sapiens
ctcagtcctcccctcacagc

SEQ ID NO: 182954 - DNA, 21 bp, Homo sapiens
ctcagtcctcccctcacagcc

SEQ ID NO: 182955 - DNA, 12 bp, Homo sapiens
ctcagtgtattt

SEQ ID NO: 182956 - DNA, 20 bp, Homo sapiens
ctcagttcatccattctatt

SEQ ID NO: 182957 - DNA, 12 bp, Homo sapiens
ctcagtttccct

SEQ ID NO: 182958 - DNA, 14 bp, Homo sapiens
ctcatacgtccacc

SEQ ID NO: 182959 - DNA, 15 bp, Homo sapiens
ctcatattcctgcag

SEQ ID NO: 182960 - DNA, 15 bp, Homo sapiens
ctcatcataaaataa

SEQ ID NO: 182961 - DNA, 20 bp, Homo sapiens
ctcatcattctctgtctcat

SEQ ID NO: 182962 - DNA, 23 bp, Homo sapiens
ctcatcattctctgtctcatcca

SEQ ID NO: 182963 - DNA, 14 bp, Homo sapiens
ctcatccgaggcag

SEQ ID NO: 182964 - DNA, 17 bp, Homo sapiens
ctcatccgaggcagggt

SEQ ID NO: 182965 - DNA, 15 bp, Homo sapiens
ctcatctgtccctcc

SEQ ID NO: 182966 - DNA, 17 bp, Homo sapiens
ctcatctgtccctccgg

SEQ ID NO: 182967 - DNA, 18 bp, Homo sapiens
ctcatctgtccctccggg

SEQ ID NO: 182968 - DNA, 17 bp, Homo sapiens
ctcatcttcttcaccat

SEQ ID NO: 182969 - DNA, 14 bp, Homo sapiens
ctcatgcatctcca

SEQ ID NO: 182970 - DNA, 14 bp, Homo sapiens
ctcatgtgatcctt

SEQ ID NO: 182971 - DNA, 21 bp, Homo sapiens
ctcattagcattttgctaaat

SEQ ID NO: 182972 - DNA, 18 bp, Homo sapiens
ctcattccaccttcccat

SEQ ID NO: 182973 - DNA, 21 bp, Homo sapiens
ctcattccaccttcccatgcc

SEQ ID NO: 182974 - DNA, 12 bp, Homo sapiens
ctcattccccag

SEQ ID NO: 182975 - DNA, 13 bp, Homo sapiens
ctcattcctgcct

SEQ ID NO: 182976 - DNA, 18 bp, Homo sapiens
ctcattcctgcctgtctc

SEQ ID NO: 182977 - DNA, 13 bp, Homo sapiens
ctcattggaccct

SEQ ID NO: 182978 - DNA, 17 bp, Homo sapiens
ctccacaccctctccca

SEQ ID NO: 182979 - DNA, 12 bp, Homo sapiens
ctccaccaaccc

SEQ ID NO: 182980 - DNA, 20 bp, Homo sapiens
ctccaccaacccatcagaag

SEQ ID NO: 182981 - DNA, 12 bp, Homo sapiens
ctccaccaccca

SEQ ID NO: 182982 - DNA, 14 bp, Homo sapiens
ctccaccacccaaa

SEQ ID NO: 182983 - DNA, 14 bp, Homo sapiens
ctccacccatccta

SEQ ID NO: 182984 - DNA, 16 bp, Homo sapiens
ctccaccccccagaac

SEQ ID NO: 182985 - DNA, 22 bp, Homo sapiens
ctccaccccccagaacctgtcc

SEQ ID NO: 182986 - DNA, 23 bp, Homo sapiens
ctccaccccccagaacctgtcct

SEQ ID NO: 182987 - DNA, 14 bp, Homo sapiens
ctccaccgctgcct

SEQ ID NO: 182988 - DNA, 12 bp, Homo sapiens
ctccacctcagc

SEQ ID NO: 182989 - DNA, 13 bp, Homo sapiens
ctccacctcagcc

SEQ ID NO: 182990 - DNA, 18 bp, Homo sapiens
ctccacctcagccttgga

SEQ ID NO: 182991 - DNA, 17 bp, Homo sapiens
ctccacctgctcccagg

SEQ ID NO: 182992 - DNA, 18 bp, Homo sapiens
ctccacctgctcccaggc

SEQ ID NO: 182993 - DNA, 18 bp, Homo sapiens
ctccacgttcacccctcc

SEQ ID NO: 182994 - DNA, 20 bp, Homo sapiens
ctccacgttctgctcatcat

SEQ ID NO: 182995 - DNA, 12 bp, Homo sapiens
ctccactccttc

SEQ ID NO: 182996 - DNA, 15 bp, Homo sapiens
ctccactccttcctg

SEQ ID NO: 182997 - DNA, 13 bp, Homo sapiens
ctccactggatgg

SEQ ID NO: 182998 - DNA, 9 bp, Homo sapiens
ctccactgt

SEQ ID NO: 182999 - DNA, 18 bp, Homo sapiens
ctccactgtcaccctcca

SEQ ID NO: 183000 - DNA, 16 bp, Homo sapiens
ctctatttaatattta

SEQ ID NO: 183001 - DNA, 22 bp, Homo sapiens
ctctcaaatcttttagtcatta

SEQ ID NO: 183002 - DNA, 11 bp, Homo sapiens
ctctcagccaa

SEQ ID NO: 183003 - DNA, 23 bp, Homo sapiens
ctctcagccaacgagtaatttat

SEQ ID NO: 183004 - DNA, 17 bp, Homo sapiens
ctctcagctcagcgcca

SEQ ID NO: 183005 - DNA, 15 bp, Homo sapiens
ctctcattccccagg

SEQ ID NO: 183006 - DNA, 20 bp, Homo sapiens
ctctcattccccaggtggct

SEQ ID NO: 183007 - DNA, 10 bp, Homo sapiens
ctctccacct

SEQ ID NO: 183008 - DNA, 16 bp, Homo sapiens
ctctccacctcagcct

SEQ ID NO: 183009 - DNA, 18 bp, Homo sapiens
ctctccacctcagccttg

SEQ ID NO: 183010 - DNA, 20 bp, Homo sapiens
ctctccacctcagccttgga

SEQ ID NO: 183011 - DNA, 11 bp, Homo sapiens
ctctccactgc

SEQ ID NO: 183012 - DNA, 14 bp, Homo sapiens
ctctccactgcctt

SEQ ID NO: 183013 - DNA, 15 bp, Homo sapiens
ctctccactgccttc

SEQ ID NO: 183014 - DNA, 13 bp, Homo sapiens
ctctcccaggacc

SEQ ID NO: 183015 - DNA, 16 bp, Homo sapiens
ctctcccctgccctgc

SEQ ID NO: 183016 - DNA, 17 bp, Homo sapiens
ctctcccctgccctgct

SEQ ID NO: 183017 - DNA, 12 bp, Homo sapiens
ctctccctctgg

SEQ ID NO: 183018 - DNA, 13 bp, Homo sapiens
ctctccctctggc

SEQ ID NO: 183019 - DNA, 18 bp, Homo sapiens
ctctccctctggccctgc

SEQ ID NO: 183020 - DNA, 20 bp, Homo sapiens
ctctcctcctgcccacctgt

SEQ ID NO: 183021 - DNA, 22 bp, Homo sapiens
ctctcctcttgccactgcctct

SEQ ID NO: 183022 - DNA, 12 bp, Homo sapiens
ctctcctgccta

SEQ ID NO: 183023 - DNA, 21 bp, Homo sapiens
ctctcctgtccaacctaaccc

SEQ ID NO: 183024 - DNA, 20 bp, Homo sapiens
ctctctcctcctgcccacct

SEQ ID NO: 183025 - DNA, 13 bp, Homo sapiens
ctctctctgactc

SEQ ID NO: 183026 - DNA, 14 bp, Homo sapiens
ctctctctgactct

SEQ ID NO: 183027 - DNA, 20 bp, Homo sapiens
ctctctgaagatgatcattt

SEQ ID NO: 183028 - DNA, 12 bp, Homo sapiens
ctctctgctctg

SEQ ID NO: 183029 - DNA, 14 bp, Homo sapiens
ctctctgctctgcg

SEQ ID NO: 183030 - DNA, 18 bp, Homo sapiens
ctctcttatagaatattt

SEQ ID NO: 183031 - DNA, 18 bp, Homo sapiens
ctctgaagatgatcattt

SEQ ID NO: 183032 - DNA, 16 bp, Homo sapiens
ctctgacccagtgaga

SEQ ID NO: 183033 - DNA, 13 bp, Homo sapiens
ctctgacccctcc

SEQ ID NO: 183034 - DNA, 19 bp, Homo sapiens
ctctgaccgaaacagcgct

SEQ ID NO: 183035 - DNA, 14 bp, Homo sapiens
ctctgactcagggc

SEQ ID NO: 183036 - DNA, 15 bp, Homo sapiens
ctctgactcagggct

SEQ ID NO: 183037 - DNA, 15 bp, Homo sapiens
ctctgactctcaaat

SEQ ID NO: 183038 - DNA, 15 bp, Homo sapiens
ctctgagctgtgcag

SEQ ID NO: 183039 - DNA, 16 bp, Homo sapiens
ctctgagtatctcctc

SEQ ID NO: 183040 - DNA, 21 bp, Homo sapiens
ctctgatccctctacagagct

SEQ ID NO: 183041 - DNA, 21 bp, Homo sapiens
ctctgcacaagctgcaccctc

SEQ ID NO: 183042 - DNA, 22 bp, Homo sapiens
ctctgcactactgacatgtggg

SEQ ID NO: 183043 - DNA, 16 bp, Homo sapiens
ctctgcagccagccca

SEQ ID NO: 183044 - DNA, 19 bp, Homo sapiens
ctctgcagccagcccagcc

SEQ ID NO: 183045 - DNA, 23 bp, Homo sapiens
ctctgcatactcattaggatggc

SEQ ID NO: 183046 - DNA, 14 bp, Homo sapiens
ctctgcattctagt

SEQ ID NO: 183047 - DNA, 15 bp, Homo sapiens
ctctgcattctagta

SEQ ID NO: 183048 - DNA, 10 bp, Homo sapiens
ctctgccacc

SEQ ID NO: 183049 - DNA, 18 bp, Homo sapiens
ctctgccaccagagaccg

SEQ ID NO: 183050 - DNA, 13 bp, Homo sapiens
ctctgccagtgac

SEQ ID NO: 183051 - DNA, 20 bp, Homo sapiens
ctctgccagtgacagacagg

SEQ ID NO: 183052 - DNA, 15 bp, Homo sapiens
ctctgcctcctcttc

SEQ ID NO: 183053 - DNA, 15 bp, Homo sapiens
ctctgcggaccccag

SEQ ID NO: 183054 - DNA, 20 bp, Homo sapiens
ctctgcggaccccagctgtg

SEQ ID NO: 183055 - DNA, 16 bp, Homo sapiens
ctctgctcgccttagc

SEQ ID NO: 183056 - DNA, 17 bp, Homo sapiens
ctctgctcgccttagca

SEQ ID NO: 183057 - DNA, 14 bp, Homo sapiens
ctctgctggccgga

SEQ ID NO: 183058 - DNA, 15 bp, Homo sapiens
ctctggagacagccc

SEQ ID NO: 183059 - DNA, 24 bp, Homo sapiens
ctctggagacagccccagagcagg

SEQ ID NO: 183060 - DNA, 12 bp, Homo sapiens
ctctggagagaa

SEQ ID NO: 183061 - DNA, 13 bp, Homo sapiens
ctctggagagaaa

SEQ ID NO: 183062 - DNA, 15 bp, Homo sapiens
ctctggagagaaaca

SEQ ID NO: 183063 - DNA, 18 bp, Homo sapiens
ctctggccctgccttctt

SEQ ID NO: 183064 - DNA, 12 bp, Homo sapiens
ctctggctctca

SEQ ID NO: 183065 - DNA, 19 bp, Homo sapiens
ctctgggaaataagagaga

SEQ ID NO: 183066 - DNA, 17 bp, Homo sapiens
ctctgggtcagtggtcc

SEQ ID NO: 183067 - DNA, 17 bp, Homo sapiens
ctctggtaatattgact

SEQ ID NO: 183068 - DNA, 16 bp, Homo sapiens
ctctggtgacaccagc

SEQ ID NO: 183069 - DNA, 18 bp, Homo sapiens
ctctggtgacaccagcct

SEQ ID NO: 183070 - DNA, 12 bp, Homo sapiens
ctctgtccaggc

SEQ ID NO: 183071 - DNA, 14 bp, Homo sapiens
ctctgtccaggcac

SEQ ID NO: 183072 - DNA, 19 bp, Homo sapiens
ctctgtccaggcactgaga

SEQ ID NO: 183073 - DNA, 14 bp, Homo sapiens
ctctgtccagggcc

SEQ ID NO: 183074 - DNA, 15 bp, Homo sapiens
cgcagacctccccag

SEQ ID NO: 183075 - DNA, 20 bp, Homo sapiens
cgcagacctccccagcccct

SEQ ID NO: 183076 - DNA, 13 bp, Homo sapiens
cgcaggaagctgc

SEQ ID NO: 183077 - DNA, 13 bp, Homo sapiens
cgcatcttctcca

SEQ ID NO: 183078 - DNA, 14 bp, Homo sapiens
cgcatcttctccat

SEQ ID NO: 183079 - DNA, 13 bp, Homo sapiens
cgccaaggctggg

SEQ ID NO: 183080 - DNA, 16 bp, Homo sapiens
cgccaaggctggggga

SEQ ID NO: 183081 - DNA, 23 bp, Homo sapiens
cgccaccatcctgcagcctcctc

SEQ ID NO: 183082 - DNA, 15 bp, Homo sapiens
cgccactcctgaacc

SEQ ID NO: 183083 - DNA, 15 bp, Homo sapiens
cgccattgcactcca

SEQ ID NO: 183084 - DNA, 14 bp, Homo sapiens
cgcccacctcccca

SEQ ID NO: 183085 - DNA, 12 bp, Homo sapiens
cgccccagcctc

SEQ ID NO: 183086 - DNA, 14 bp, Homo sapiens
cgccctcccctccc

SEQ ID NO: 183087 - DNA, 18 bp, Homo sapiens
cgccctcccctcccctgc

SEQ ID NO: 183088 - DNA, 22 bp, Homo sapiens
cgccctcccctcccctgctgca

SEQ ID NO: 183089 - DNA, 17 bp, Homo sapiens
cgcctcaatgtggttgc

SEQ ID NO: 183090 - DNA, 22 bp, Homo sapiens
cgcctcaatgtggttgcaaggc

SEQ ID NO: 183091 - DNA, 23 bp, Homo sapiens
cgcctgacaaccactggtctgta

SEQ ID NO: 183092 - DNA, 18 bp, Homo sapiens
cgcctgcaaacgctgcct

SEQ ID NO: 183093 - DNA, 21 bp, Homo sapiens
cgcctgcaaacgctgcctgcc

SEQ ID NO: 183094 - DNA, 17 bp, Homo sapiens
cgcctgcatgtaaacac

SEQ ID NO: 183095 - DNA, 18 bp, Homo sapiens
cgcctgtaatcccagcac

SEQ ID NO: 183096 - DNA, 12 bp, Homo sapiens
cgccttgttctt

SEQ ID NO: 183097 - DNA, 19 bp, Homo sapiens
cgcggtggctcacgcctgt

SEQ ID NO: 183098 - DNA, 17 bp, Homo sapiens
cgctcctgtctgccagc

SEQ ID NO: 183099 - DNA, 20 bp, Homo sapiens
cgctcctgtctgccagccag

SEQ ID NO: 183100 - DNA, 21 bp, Homo sapiens
cgctcctgtctgccagccagc

SEQ ID NO: 183101 - DNA, 20 bp, Homo sapiens
cgctgccgcaccccagagtg

SEQ ID NO: 183102 - DNA, 20 bp, Homo sapiens
cgctgcctaagtggctgctg

SEQ ID NO: 183103 - DNA, 16 bp, Homo sapiens
cgctgtgagcccctgg

SEQ ID NO: 183104 - DNA, 13 bp, Homo sapiens
cgcttcccccata

SEQ ID NO: 183105 - DNA, 17 bp, Homo sapiens
cgcttgtccagcgccta

SEQ ID NO: 183106 - DNA, 19 bp, Homo sapiens
cgcttttgctggtcactgc

SEQ ID NO: 183107 - DNA, 13 bp, Homo sapiens
cggaagttttcaa

SEQ ID NO: 183108 - DNA, 13 bp, Homo sapiens
cggaccccagctg

SEQ ID NO: 183109 - DNA, 11 bp, Homo sapiens
cggagccactc

SEQ ID NO: 183110 - DNA, 12 bp, Homo sapiens
cggagccccagg

SEQ ID NO: 183111 - DNA, 22 bp, Homo sapiens
cggagccccaggcctctgtgtc

SEQ ID NO: 183112 - DNA, 22 bp, Homo sapiens
cggagcctcatccgaggcaggg

SEQ ID NO: 183113 - DNA, 15 bp, Homo sapiens
cggaggggcctggca

SEQ ID NO: 183114 - DNA, 18 bp, Homo sapiens
cggagtatctgggaactg

SEQ ID NO: 183115 - DNA, 14 bp, Homo sapiens
cggatcctgggtgg

SEQ ID NO: 183116 - DNA, 14 bp, Homo sapiens
cggatctgagaatc

SEQ ID NO: 183117 - DNA, 16 bp, Homo sapiens
cggatttatttttcca

SEQ ID NO: 183118 - DNA, 14 bp, Homo sapiens
cggcacagggtctg

SEQ ID NO: 183119 - DNA, 18 bp, Homo sapiens
cggcacagggtctgctct

SEQ ID NO: 183120 - DNA, 21 bp, Homo sapiens
cggcacagggtctgctctttc

SEQ ID NO: 183121 - DNA, 15 bp, Homo sapiens
cggcacccacccagc

SEQ ID NO: 183122 - DNA, 21 bp, Homo sapiens
cggcaggacaacgaggaagcc

SEQ ID NO: 183123 - DNA, 22 bp, Homo sapiens
cggcaggacaacgaggaagccc

SEQ ID NO: 183124 - DNA, 16 bp, Homo sapiens
cggcagttctgggtgc

SEQ ID NO: 183125 - DNA, 21 bp, Homo sapiens
cggcagttctgggtgctccct

SEQ ID NO: 183126 - DNA, 14 bp, Homo sapiens
cggccacctctgcg

SEQ ID NO: 183127 - DNA, 22 bp, Homo sapiens
cggcccacagctcccaccccac

SEQ ID NO: 183128 - DNA, 18 bp, Homo sapiens
cggccgcattccctgagt

SEQ ID NO: 183129 - DNA, 15 bp, Homo sapiens
cggcctttggcttca

SEQ ID NO: 183130 - DNA, 15 bp, Homo sapiens
cggcgccaccatcct

SEQ ID NO: 183131 - DNA, 13 bp, Homo sapiens
cggcgcggtggct

SEQ ID NO: 183132 - DNA, 12 bp, Homo sapiens
cggctactcagc

SEQ ID NO: 183133 - DNA, 21 bp, Homo sapiens
cggctactcagcagccctcct

SEQ ID NO: 183134 - DNA, 20 bp, Homo sapiens
cggctgagtcatgatctccc

SEQ ID NO: 183135 - DNA, 23 bp, Homo sapiens
cggctgagtcatgatctccctgc

SEQ ID NO: 183136 - DNA, 23 bp, Homo sapiens
cggctggcagcccacccctcaac

SEQ ID NO: 183137 - DNA, 12 bp, Homo sapiens
cgggaaggaggg

SEQ ID NO: 183138 - DNA, 13 bp, Homo sapiens
cgggacctggtgc

SEQ ID NO: 183139 - DNA, 17 bp, Homo sapiens
cgggagcggtggccctg

SEQ ID NO: 183140 - DNA, 18 bp, Homo sapiens
cgggaggtcgaggcagga

SEQ ID NO: 183141 - DNA, 20 bp, Homo sapiens
cgggcctggagaactagaga

SEQ ID NO: 183142 - DNA, 11 bp, Homo sapiens
cgggctcagca

SEQ ID NO: 183143 - DNA, 15 bp, Homo sapiens
cgggctgggcagctg

SEQ ID NO: 183144 - DNA, 15 bp, Homo sapiens
cgggcttttccccgg

SEQ ID NO: 183145 - DNA, 16 bp, Homo sapiens
cggggaactcctggaa

SEQ ID NO: 183146 - DNA, 15 bp, Homo sapiens
cggggccccagggct

SEQ ID NO: 183147 - DNA, 15 bp, Homo sapiens
cgggtgctcagggct

SEQ ID NO: 183148 - DNA, 18 bp, Homo sapiens
cgggtgctcagggctgac

SEQ ID NO: 183149 - DNA, 23 bp, Homo sapiens
cggtcccttgagacctcagccat

SEQ ID NO: 183150 - DNA, 20 bp, Homo sapiens
cggtgcctgggtggggctgc

SEQ ID NO: 183151 - DNA, 22 bp, Homo sapiens
cggtgccttttttcacggaagt

SEQ ID NO: 183152 - DNA, 16 bp, Homo sapiens
cggtggccctgtccct

SEQ ID NO: 183153 - DNA, 20 bp, Homo sapiens
cggtggctcacgcctgtaat

SEQ ID NO: 183154 - DNA, 15 bp, Homo sapiens
cggtgtgcaccaggg

SEQ ID NO: 183155 - DNA, 13 bp, Homo sapiens
cggtgtggagaag

SEQ ID NO: 183156 - DNA, 15 bp, Homo sapiens
cggttcaccagcctc

SEQ ID NO: 183157 - DNA, 14 bp, Homo sapiens
cgtaataattatta

SEQ ID NO: 183158 - DNA, 22 bp, Homo sapiens
cgtacttagcagctatctctca

SEQ ID NO: 183159 - DNA, 17 bp, Homo sapiens
cgtcagtatcaggcctg

SEQ ID NO: 183160 - DNA, 13 bp, Homo sapiens
cgtccccctgggg

SEQ ID NO: 183161 - DNA, 17 bp, Homo sapiens
cgtcctcacccctgtcc

SEQ ID NO: 183162 - DNA, 22 bp, Homo sapiens
cgtcctccccctgccagtgcct

SEQ ID NO: 183163 - DNA, 14 bp, Homo sapiens
cgtcctcctctgtg

SEQ ID NO: 183164 - DNA, 20 bp, Homo sapiens
cgtcctgccacctggggcag

SEQ ID NO: 183165 - DNA, 23 bp, Homo sapiens
cgtctgctaacttggagccccag

SEQ ID NO: 183166 - DNA, 20 bp, Homo sapiens
cgtcttagcaagaagtaaaa

SEQ ID NO: 183167 - DNA, 13 bp, Homo sapiens
cgtcttcagccta

SEQ ID NO: 183168 - DNA, 15 bp, Homo sapiens
cgtcttcagcctagc

SEQ ID NO: 183169 - DNA, 23 bp, Homo sapiens
cgtcttcattaagccctcttcca

SEQ ID NO: 183170 - DNA, 19 bp, Homo sapiens
cgtgaaggccgagaagcaa

SEQ ID NO: 183171 - DNA, 14 bp, Homo sapiens
cgtgactcacccaa

SEQ ID NO: 183172 - DNA, 18 bp, Homo sapiens
cgtgactcacccaagcat

SEQ ID NO: 183173 - DNA, 13 bp, Homo sapiens
cgtgactgcccca

SEQ ID NO: 183174 - DNA, 20 bp, Homo sapiens
cgtgactgccccaactcctg

SEQ ID NO: 183175 - DNA, 22 bp, Homo sapiens
cgtgactgccccaactcctgga

SEQ ID NO: 183176 - DNA, 19 bp, Homo sapiens
cgtgaggatgtcactcaga

SEQ ID NO: 183177 - DNA, 13 bp, Homo sapiens
cgtgatcttggct

SEQ ID NO: 183178 - DNA, 23 bp, Homo sapiens
cgtgatgtagggtaaggtgcctt

SEQ ID NO: 183179 - DNA, 14 bp, Homo sapiens
cgtgcagcatatga

SEQ ID NO: 183180 - DNA, 17 bp, Homo sapiens
cgtgccccgcctccccg

SEQ ID NO: 183181 - DNA, 22 bp, Homo sapiens
cgtgcttgtttgctcacctggg

SEQ ID NO: 183182 - DNA, 12 bp, Homo sapiens
cgtggagaggga

SEQ ID NO: 183183 - DNA, 13 bp, Homo sapiens
cgtggagagggat

SEQ ID NO: 183184 - DNA, 17 bp, Homo sapiens
cgtggattgcacgtggc

SEQ ID NO: 183185 - DNA, 21 bp, Homo sapiens
cgtggcagataatcagcctct

SEQ ID NO: 183186 - DNA, 16 bp, Homo sapiens
cgtggcctcttgagca

SEQ ID NO: 183187 - DNA, 22 bp, Homo sapiens
cgtggctaagagtgtcctagga

SEQ ID NO: 183188 - DNA, 17 bp, Homo sapiens
cgtgggctccctgactg

SEQ ID NO: 183189 - DNA, 18 bp, Homo sapiens
cgtggggcagcacagaga

SEQ ID NO: 183190 - DNA, 20 bp, Homo sapiens
cgtgtaaccatggacccaat

SEQ ID NO: 183191 - DNA, 16 bp, Homo sapiens
cgtgtcacctgtgctt

SEQ ID NO: 183192 - DNA, 22 bp, Homo sapiens
cgtgtgtgcaagtgtctgtgtg

SEQ ID NO: 183193 - DNA, 14 bp, Homo sapiens
cgttgtaaaatata

SEQ ID NO: 183194 - DNA, 14 bp, Homo sapiens
cgtttactatgcct

SEQ ID NO: 183195 - DNA, 23 bp, Homo sapiens
cgttttgtgtggtggcacctcct

SEQ ID NO: 183196 - DNA, 22 bp, Homo sapiens
ctaaaaaagatatattaaaaat

SEQ ID NO: 183197 - DNA, 23 bp, Homo sapiens
ctaaaatgattttatctgtgaat

SEQ ID NO: 183198 - DNA, 22 bp, Homo sapiens
ctaaaatgcctcagtgtatttg

SEQ ID NO: 183199 - DNA, 15 bp, Homo sapiens
ctaaatctctaatat

SEQ ID NO: 183200 - DNA, 21 bp, Homo sapiens
ctaaatgtggagaaactgtag

SEQ ID NO: 183201 - DNA, 22 bp, Homo sapiens
ctaacaagtcataggttaatat

SEQ ID NO: 183202 - DNA, 22 bp, Homo sapiens
ctaacaatcagctccttcctgg

SEQ ID NO: 183203 - DNA, 22 bp, Homo sapiens
ctaacatataatgttgttattt

SEQ ID NO: 183204 - DNA, 23 bp, Homo sapiens
ctaacatataatgttgttattta

SEQ ID NO: 183205 - DNA, 21 bp, Homo sapiens
ctaaccagggaagctgtccct

SEQ ID NO: 183206 - DNA, 14 bp, Homo sapiens
ctaacccctttcct

SEQ ID NO: 183207 - DNA, 17 bp, Homo sapiens
gatgaggtgctgggagg

SEQ ID NO: 183208 - DNA, 17 bp, Homo sapiens
gatgcaaagaggcaaga

SEQ ID NO: 183209 - DNA, 18 bp, Homo sapiens
gatgccatctgtgggcac

SEQ ID NO: 183210 - DNA, 20 bp, Homo sapiens
gatgcccagggccactctgc

SEQ ID NO: 183211 - DNA, 21 bp, Homo sapiens
gatgcccagggccactctgcc

SEQ ID NO: 183212 - DNA, 22 bp, Homo sapiens
gatgcccagggccactctgcct

SEQ ID NO: 183213 - DNA, 23 bp, Homo sapiens
gatgcctcatgatatgtcagggc

SEQ ID NO: 183214 - DNA, 20 bp, Homo sapiens
gatgcctccaccgctgccta

SEQ ID NO: 183215 - DNA, 15 bp, Homo sapiens
gatgctgactagtga

SEQ ID NO: 183216 - DNA, 16 bp, Homo sapiens
gatgctggagaagaga

SEQ ID NO: 183217 - DNA, 14 bp, Homo sapiens
gatgctggatgctc

SEQ ID NO: 183218 - DNA, 18 bp, Homo sapiens
gatgctggatgctccttc

SEQ ID NO: 183219 - DNA, 23 bp, Homo sapiens
gatgcttctcactgccatgccag

SEQ ID NO: 183220 - DNA, 18 bp, Homo sapiens
gatggaaccgcaggaagc

SEQ ID NO: 183221 - DNA, 22 bp, Homo sapiens
gatggagactggtcctgtgtgc

SEQ ID NO: 183222 - DNA, 20 bp, Homo sapiens
gatggagccagctctgcatt

SEQ ID NO: 183223 - DNA, 23 bp, Homo sapiens
gatggaggaaaaccaagccgtgg

SEQ ID NO: 183224 - DNA, 13 bp, Homo sapiens
gatggaggagaag

SEQ ID NO: 183225 - DNA, 19 bp, Homo sapiens
gatggaggttctctcggag

SEQ ID NO: 183226 - DNA, 13 bp, Homo sapiens
gatggcctgagaa

SEQ ID NO: 183227 - DNA, 14 bp, Homo sapiens
gatgggactgggag

SEQ ID NO: 183228 - DNA, 20 bp, Homo sapiens
gatgggatggtggagggcca

SEQ ID NO: 183229 - DNA, 13 bp, Homo sapiens
gatggggaaggag

SEQ ID NO: 183230 - DNA, 21 bp, Homo sapiens
gatgggggagtctgaagcaga

SEQ ID NO: 183231 - DNA, 15 bp, Homo sapiens
gatggtggagggcca

SEQ ID NO: 183232 - DNA, 22 bp, Homo sapiens
gctggagcccagggagcggaaa

SEQ ID NO: 183233 - DNA, 16 bp, Homo sapiens
gctggaggcagggcct

SEQ ID NO: 183234 - DNA, 17 bp, Homo sapiens
gctggaggtgggagcag

SEQ ID NO: 183235 - DNA, 20 bp, Homo sapiens
gctggcggctactcagcagc

SEQ ID NO: 183236 - DNA, 21 bp, Homo sapiens
gctggcggctactcagcagcc

SEQ ID NO: 183237 - DNA, 15 bp, Homo sapiens
gctgggagctctgca

SEQ ID NO: 183238 - DNA, 21 bp, Homo sapiens
gctgggagggatagagggggg

SEQ ID NO: 183239 - DNA, 15 bp, Homo sapiens
gctgggctctccacc

SEQ ID NO: 183240 - DNA, 20 bp, Homo sapiens
gctgggctctccacctcagc

SEQ ID NO: 183241 - DNA, 21 bp, Homo sapiens
gctgggtaaactgtggatgat

SEQ ID NO: 183242 - DNA, 14 bp, Homo sapiens
gctggtagagatgg

SEQ ID NO: 183243 - DNA, 15 bp, Homo sapiens
gctggtagagatgga

SEQ ID NO: 183244 - DNA, 13 bp, Homo sapiens
gctggtcactgcc

SEQ ID NO: 183245 - DNA, 13 bp, Homo sapiens
gctggtgggaggg

SEQ ID NO: 183246 - DNA, 22 bp, Homo sapiens
gctgtaatctatgaattctaag

SEQ ID NO: 183247 - DNA, 16 bp, Homo sapiens
gctgtacaaatataag

SEQ ID NO: 183248 - DNA, 13 bp, Homo sapiens
gctgtagaaggag

SEQ ID NO: 183249 - DNA, 13 bp, Homo sapiens
gctgtcatctcag

SEQ ID NO: 183250 - DNA, 18 bp, Homo sapiens
gctgtccctgtcaccaag

SEQ ID NO: 183251 - DNA, 22 bp, Homo sapiens
gctgtccttacccatctgcacc

SEQ ID NO: 183252 - DNA, 20 bp, Homo sapiens
gctgtcttctcaggctctgc

SEQ ID NO: 183253 - DNA, 17 bp, Homo sapiens
gctgtgacttctccagg

SEQ ID NO: 183254 - DNA, 13 bp, Homo sapiens
gctgtgagccttg

SEQ ID NO: 183255 - DNA, 22 bp, Homo sapiens
gctgtgaggcccctggacaagc

SEQ ID NO: 183256 - DNA, 14 bp, Homo sapiens
gctgtgaggctgtc

SEQ ID NO: 183257 - DNA, 15 bp, Homo sapiens
gctgtgaggctgtcc

SEQ ID NO: 183258 - DNA, 16 bp, Homo sapiens
gctgtgcctctgcctg

SEQ ID NO: 183259 - DNA, 23 bp, Homo sapiens
gctgtgggcaggtgggagcttga

SEQ ID NO: 183260 - DNA, 21 bp, Homo sapiens
gctgtgtccttgcacctgcat

SEQ ID NO: 183261 - DNA, 20 bp, Homo sapiens
gctgttcacccacagggcta

SEQ ID NO: 183262 - DNA, 15 bp, Homo sapiens
gctgtttactaggga

SEQ ID NO: 183263 - DNA, 11 bp, Homo sapiens
gctgtttcctt

SEQ ID NO: 183264 - DNA, 21 bp, Homo sapiens
gctgtttgtttgacaaagaaa

SEQ ID NO: 183265 - DNA, 12 bp, Homo sapiens
gcttaatgttta

SEQ ID NO: 183266 - DNA, 20 bp, Homo sapiens
gcttacaattccctgctgtc

SEQ ID NO: 183267 - DNA, 11 bp, Homo sapiens
gcttacatttt

SEQ ID NO: 183268 - DNA, 14 bp, Homo sapiens
gcttacatttttac

SEQ ID NO: 183269 - DNA, 19 bp, Homo sapiens
gcttacatttttacaataa

SEQ ID NO: 183270 - DNA, 19 bp, Homo sapiens
gcttagacctcagcctgtg

SEQ ID NO: 183271 - DNA, 12 bp, Homo sapiens
gcttatacactt

SEQ ID NO: 183272 - DNA, 20 bp, Homo sapiens
gcttatacacttacacttta

SEQ ID NO: 183273 - DNA, 16 bp, Homo sapiens
gcttcaaaatagagaa

SEQ ID NO: 183274 - DNA, 18 bp, Homo sapiens
gcttcacggaagagcctt

SEQ ID NO: 183275 - DNA, 19 bp, Homo sapiens
gcttcacggaagagccttg

SEQ ID NO: 183276 - DNA, 17 bp, Homo sapiens
gcttcagcctccccacc

SEQ ID NO: 183277 - DNA, 19 bp, Homo sapiens
gcttcagtttcctggtctg

SEQ ID NO: 183278 - DNA, 18 bp, Homo sapiens
gcttcccccatagccacc

SEQ ID NO: 183279 - DNA, 14 bp, Homo sapiens
gcttcccctctctc

SEQ ID NO: 183280 - DNA, 16 bp, Homo sapiens
gcttcccctctctcct

SEQ ID NO: 183281 - DNA, 18 bp, Homo sapiens
gcttcccgctcagccctc

SEQ ID NO: 183282 - DNA, 18 bp, Homo sapiens
gcttcgggcccttcccac

SEQ ID NO: 183283 - DNA, 16 bp, Homo sapiens
gcttctcatacgtcca

SEQ ID NO: 183284 - DNA, 14 bp, Homo sapiens
gcttctctctgtgg

SEQ ID NO: 183285 - DNA, 16 bp, Homo sapiens
gcttctctctgtggga

SEQ ID NO: 183286 - DNA, 23 bp, Homo sapiens
gcttcttttagttgtatctcttt

SEQ ID NO: 183287 - DNA, 19 bp, Homo sapiens
gcttgagtttggggaatgc

SEQ ID NO: 183288 - DNA, 18 bp, Homo sapiens
gcttgccctgttaaaaga

SEQ ID NO: 183289 - DNA, 14 bp, Homo sapiens
gcttggagcagagg

SEQ ID NO: 183290 - DNA, 21 bp, Homo sapiens
gcttgggtgtaacaggtctcc

SEQ ID NO: 183291 - DNA, 22 bp, Homo sapiens
gcttgggtgtaacaggtctcct

SEQ ID NO: 183292 - DNA, 23 bp, Homo sapiens
gcttgggtgtaacaggtctcctc

SEQ ID NO: 183293 - DNA, 16 bp, Homo sapiens
gcttgtaactccacca

SEQ ID NO: 183294 - DNA, 14 bp, Homo sapiens
gcttgtatagtgta

SEQ ID NO: 183295 - DNA, 15 bp, Homo sapiens
gcttgtccagcgcct

SEQ ID NO: 183296 - DNA, 19 bp, Homo sapiens
gcttgtttgctcacctggg

SEQ ID NO: 183297 - DNA, 18 bp, Homo sapiens
gctttaaactcagggaca

SEQ ID NO: 183298 - DNA, 22 bp, Homo sapiens
gctttaaactcagggacagagc

SEQ ID NO: 183299 - DNA, 13 bp, Homo sapiens
gctttatttttta

SEQ ID NO: 183300 - DNA, 21 bp, Homo sapiens
gctttcatgtaaactgtgcac

SEQ ID NO: 183301 - DNA, 17 bp, Homo sapiens
gctttcctgccccaggc

SEQ ID NO: 183302 - DNA, 19 bp, Homo sapiens
gctttcctgccccaggcct

SEQ ID NO: 183303 - DNA, 15 bp, Homo sapiens
gctttgactgagcag

SEQ ID NO: 183304 - DNA, 20 bp, Homo sapiens
gctttgcattcctacaaaga

SEQ ID NO: 183305 - DNA, 16 bp, Homo sapiens
gctttgggctgccctg

SEQ ID NO: 183306 - DNA, 18 bp, Homo sapiens
gctttgggctgccctggt

SEQ ID NO: 183307 - DNA, 23 bp, Homo sapiens
gctttgttttgcacactttgcca

SEQ ID NO: 183308 - DNA, 14 bp, Homo sapiens
gcttttacttaaac

SEQ ID NO: 183309 - DNA, 14 bp, Homo sapiens
gcttttcactgctg

SEQ ID NO: 183310 - DNA, 18 bp, Homo sapiens
gcttttcactgctggctg

SEQ ID NO: 183311 - DNA, 18 bp, Homo sapiens
gcttttccccggtccctt

SEQ ID NO: 183312 - DNA, 22 bp, Homo sapiens
gcttttccccggtcccttgaga

SEQ ID NO: 183313 - DNA, 20 bp, Homo sapiens
gcttttccttggggcaggca

SEQ ID NO: 183314 - DNA, 22 bp, Homo sapiens
gcactagcctttggctctggag

SEQ ID NO: 183315 - DNA, 12 bp, Homo sapiens
gcactgatttca

SEQ ID NO: 183316 - DNA, 15 bp, Homo sapiens
gcactgatttcacaa

SEQ ID NO: 183317 - DNA, 19 bp, Homo sapiens
gcactgatttcacaacaga

SEQ ID NO: 183318 - DNA, 20 bp, Homo sapiens
gcactgatttcacaacagat

SEQ ID NO: 183319 - DNA, 17 bp, Homo sapiens
gcactggagtccagtct

SEQ ID NO: 183320 - DNA, 24 bp, Homo sapiens
gcactggtggcccgacagcctggc

SEQ ID NO: 183321 - DNA, 15 bp, Homo sapiens
gcactgttccccctg

SEQ ID NO: 183322 - DNA, 17 bp, Homo sapiens
gcacttagctatcagaa

SEQ ID NO: 183323 - DNA, 19 bp, Homo sapiens
gcacttagctatcagaaga

SEQ ID NO: 183324 - DNA, 18 bp, Homo sapiens
gcacttggagacttgtat

SEQ ID NO: 183325 - DNA, 15 bp, Homo sapiens
gcagaaaagcacctg

SEQ ID NO: 183326 - DNA, 18 bp, Homo sapiens
gcagaaaagcacctgccg

SEQ ID NO: 183327 - DNA, 23 bp, Homo sapiens
gcagaacagccgctcctgtctgc

SEQ ID NO: 183328 - DNA, 13 bp, Homo sapiens
gcagaacagtgat

SEQ ID NO: 183329 - DNA, 18 bp, Homo sapiens
gcagaacagtgattacca

SEQ ID NO: 183330 - DNA, 13 bp, Homo sapiens
gcagaacggagcc

SEQ ID NO: 183331 - DNA, 15 bp, Homo sapiens
gcagaaggaaaaatg

SEQ ID NO: 183332 - DNA, 16 bp, Homo sapiens
gcagacacagggactt

SEQ ID NO: 183333 - DNA, 23 bp, Homo sapiens
gcagacacggatctgagaatctt

SEQ ID NO: 183334 - DNA, 14 bp, Homo sapiens
gcagacagcagctc

SEQ ID NO: 183335 - DNA, 16 bp, Homo sapiens
gcagacagcagctcag

SEQ ID NO: 183336 - DNA, 18 bp, Homo sapiens
gcagacagcagctcaggc

SEQ ID NO: 183337 - DNA, 20 bp, Homo sapiens
gcagacagcagctcaggcac

SEQ ID NO: 183338 - DNA, 14 bp, Homo sapiens
gcagacaggaggaa

SEQ ID NO: 183339 - DNA, 15 bp, Homo sapiens
gcagacctccccagc

SEQ ID NO: 183340 - DNA, 12 bp, Homo sapiens
gcagactggagg

SEQ ID NO: 183341 - DNA, 13 bp, Homo sapiens
gcagactggaggg

SEQ ID NO: 183342 - DNA, 15 bp, Homo sapiens
gcagactggagggga

SEQ ID NO: 183343 - DNA, 21 bp, Homo sapiens
gcagaggctggaggcagggcc

SEQ ID NO: 183344 - DNA, 15 bp, Homo sapiens
gcagaggtggccaga

SEQ ID NO: 183345 - DNA, 18 bp, Homo sapiens
gcagaggttgcagtgagc

SEQ ID NO: 183346 - DNA, 23 bp, Homo sapiens
gcagaggttgcagtgagccgaga

SEQ ID NO: 183347 - DNA, 13 bp, Homo sapiens
gcagagttgtaaa

SEQ ID NO: 183348 - DNA, 16 bp, Homo sapiens
gcagagttgtaaatat

SEQ ID NO: 183349 - DNA, 17 bp, Homo sapiens
gcagagttgtaaatata

SEQ ID NO: 183350 - DNA, 21 bp, Homo sapiens
gcagagttgtaaatatataaa

SEQ ID NO: 183351 - DNA, 17 bp, Homo sapiens
gcagataatcagcctct

SEQ ID NO: 183352 - DNA, 19 bp, Homo sapiens
gcagataatcagcctctta

SEQ ID NO: 183353 - DNA, 15 bp, Homo sapiens
gcagatcccagctca

SEQ ID NO: 183354 - DNA, 22 bp, Homo sapiens
gcagatgcaaagaggcaagagg

SEQ ID NO: 183355 - DNA, 18 bp, Homo sapiens
gcagatggaatgctgtgt

SEQ ID NO: 183356 - DNA, 18 bp, Homo sapiens
gcagatgtccttgatgct

SEQ ID NO: 183357 - DNA, 19 bp, Homo sapiens
gcagattcatttttctttc

SEQ ID NO: 183358 - DNA, 20 bp, Homo sapiens
gcagattcatttttctttct

SEQ ID NO: 183359 - DNA, 23 bp, Homo sapiens
gcagatttagtgaaagctagaga

SEQ ID NO: 183360 - DNA, 16 bp, Homo sapiens
gcagcaggaggccagg

SEQ ID NO: 183361 - DNA, 18 bp, Homo sapiens
gcagcagggagggcttct

SEQ ID NO: 183362 - DNA, 19 bp, Homo sapiens
gcagcagggagggcttctg

SEQ ID NO: 183363 - DNA, 20 bp, Homo sapiens
gcagcagggagggcttctgc

SEQ ID NO: 183364 - DNA, 21 bp, Homo sapiens
gcagcagtgtgaggccagggc

SEQ ID NO: 183365 - DNA, 22 bp, Homo sapiens
gcagcagtgtgaggccagggca

SEQ ID NO: 183366 - DNA, 15 bp, Homo sapiens
gcagcatcttcaaac

SEQ ID NO: 183367 - DNA, 17 bp, Homo sapiens
gcagccaagctccttgg

SEQ ID NO: 183368 - DNA, 17 bp, Homo sapiens
gcagccagcccagccca

SEQ ID NO: 183369 - DNA, 14 bp, Homo sapiens
gcagccctgctttg

SEQ ID NO: 183370 - DNA, 16 bp, Homo sapiens
gcagccgctgagcgag

SEQ ID NO: 183371 - DNA, 17 bp, Homo sapiens
gcagcctttgcctcccc

SEQ ID NO: 183372 - DNA, 15 bp, Homo sapiens
gcagcttattcacaa

SEQ ID NO: 183373 - DNA, 19 bp, Homo sapiens
gcagctttaaactcaggga

SEQ ID NO: 183374 - DNA, 20 bp, Homo sapiens
gcagctttaaactcagggac

SEQ ID NO: 183375 - DNA, 23 bp, Homo sapiens
gcaggaaatgaaaatgtcttgtg

SEQ ID NO: 183376 - DNA, 18 bp, Homo sapiens
gcaggaagcaacgaaggg

SEQ ID NO: 183377 - DNA, 18 bp, Homo sapiens
gcaggaagctcagactgg

SEQ ID NO: 183378 - DNA, 21 bp, Homo sapiens
gcaggagattgagaaggagag

SEQ ID NO: 183379 - DNA, 23 bp, Homo sapiens
gcaggagattgagaaggagagaa

SEQ ID NO: 183380 - DNA, 16 bp, Homo sapiens
gcaggaggccaggccg

SEQ ID NO: 183381 - DNA, 21 bp, Homo sapiens
gcaggatagttgctccgcctc

SEQ ID NO: 183382 - DNA, 9 bp, Homo sapiens
gcaggcagt

SEQ ID NO: 183383 - DNA, 19 bp, Homo sapiens
gcagggattaacctctgca

SEQ ID NO: 183384 - DNA, 21 bp, Homo sapiens
gcagggccccaggcattgcca

SEQ ID NO: 183385 - DNA, 18 bp, Homo sapiens
gcagggccttgcccagag

SEQ ID NO: 183386 - DNA, 19 bp, Homo sapiens
gcagggccttgcccagaga

SEQ ID NO: 183387 - DNA, 17 bp, Homo sapiens
gcagggctaccctgagc

SEQ ID NO: 183388 - DNA, 16 bp, Homo sapiens
gcaggggctctggaga

SEQ ID NO: 183389 - DNA, 14 bp, Homo sapiens
gcagggtcaggaga

SEQ ID NO: 183390 - DNA, 19 bp, Homo sapiens
gcaggtagccagggggact

SEQ ID NO: 183391 - DNA, 21 bp, Homo sapiens
gcaggtagccagggggactag

SEQ ID NO: 183392 - DNA, 17 bp, Homo sapiens
gcaggtggggagactgg

SEQ ID NO: 183393 - DNA, 20 bp, Homo sapiens
gcagtctatatgtttgtata

SEQ ID NO: 183394 - DNA, 18 bp, Homo sapiens
gcagtctcgggtggctag

SEQ ID NO: 183395 - DNA, 21 bp, Homo sapiens
gcagtgagccgcatcttctcc

SEQ ID NO: 183396 - DNA, 14 bp, Homo sapiens
gcagtgagctgaga

SEQ ID NO: 183397 - DNA, 15 bp, Homo sapiens
gcagtgagtgagcct

SEQ ID NO: 183398 - DNA, 19 bp, Homo sapiens
gcagtgagtgagcctggct

SEQ ID NO: 183399 - DNA, 14 bp, Homo sapiens
gcagtggctggtcc

SEQ ID NO: 183400 - DNA, 18 bp, Homo sapiens
gcagtggctggtccaggg

SEQ ID NO: 183401 - DNA, 18 bp, Homo sapiens
gcagtgtcatcagaagat

SEQ ID NO: 183402 - DNA, 16 bp, Homo sapiens
gcataacaattcctct

SEQ ID NO: 183403 - DNA, 22 bp, Homo sapiens
gcatagaggtaccagcaatatg

SEQ ID NO: 183404 - DNA, 18 bp, Homo sapiens
gcatagattccctgagca

SEQ ID NO: 183405 - DNA, 21 bp, Homo sapiens
gcatagtattccattgtgtga

SEQ ID NO: 183406 - DNA, 22 bp, Homo sapiens
gcatcattatttgcagagacag

SEQ ID NO: 183407 - DNA, 14 bp, Homo sapiens
gcatccattcctca

SEQ ID NO: 183408 - DNA, 15 bp, Homo sapiens
gcatccattcctcag

SEQ ID NO: 183409 - DNA, 18 bp, Homo sapiens
gcatccgtagttccctga

SEQ ID NO: 183410 - DNA, 19 bp, Homo sapiens
gcatccgtagttccctgaa

SEQ ID NO: 183411 - DNA, 15 bp, Homo sapiens
gcatctcagcccaca

SEQ ID NO: 183412 - DNA, 15 bp, Homo sapiens
gcatctccacctgct

SEQ ID NO: 183413 - DNA, 18 bp, Homo sapiens
gcatctccacctgctccc

SEQ ID NO: 183414 - DNA, 13 bp, Homo sapiens
gcatctcccagat

SEQ ID NO: 183415 - DNA, 13 bp, Homo sapiens
gcatctgtataag

SEQ ID NO: 183416 - DNA, 13 bp, Homo sapiens
gcatcttctccat

SEQ ID NO: 183417 - DNA, 21 bp, Homo sapiens
gcatgaggaactagccaccaa

SEQ ID NO: 183418 - DNA, 22 bp, Homo sapiens
gcatgcactgttccccctgtgc

SEQ ID NO: 183419 - DNA, 16 bp, Homo sapiens
gcatgccccggccacc

SEQ ID NO: 183420 - DNA, 21 bp, Homo sapiens
gcatgccccggccacctctgc

SEQ ID NO: 183421 - DNA, 13 bp, Homo sapiens
gcatgctctctgc

SEQ ID NO: 183422 - DNA, 13 bp, Homo sapiens
gcatggccctggg

SEQ ID NO: 183423 - DNA, 15 bp, Homo sapiens
gcatgtaaacacgcc

SEQ ID NO: 183424 - DNA, 19 bp, Homo sapiens
gcatgtaaacacgcctgca

SEQ ID NO: 183425 - DNA, 18 bp, Homo sapiens
gcattaccgcgttgtaaa

SEQ ID NO: 183426 - DNA, 19 bp, Homo sapiens
gcattaccgcgttgtaaaa

SEQ ID NO: 183427 - DNA, 20 bp, Homo sapiens
gcattaccgcgttgtaaaat

SEQ ID NO: 183428 - DNA, 13 bp, Homo sapiens
gcattagaaatta

SEQ ID NO: 183429 - DNA, 15 bp, Homo sapiens
gcattattgcattat

SEQ ID NO: 183430 - DNA, 12 bp, Homo sapiens
gcattcacccag

SEQ ID NO: 183431 - DNA, 15 bp, Homo sapiens
gcattcacccagaca

SEQ ID NO: 183432 - DNA, 19 bp, Homo sapiens
gcattcacccagacagctc

SEQ ID NO: 183433 - DNA, 20 bp, Homo sapiens
gcattcacccagacagctcc

SEQ ID NO: 183434 - DNA, 13 bp, Homo sapiens
gcattccctgagt

SEQ ID NO: 183435 - DNA, 22 bp, Homo sapiens
gcattccctgagtcaccaggaa

SEQ ID NO: 183436 - DNA, 13 bp, Homo sapiens
gcattctagtact

SEQ ID NO: 183437 - DNA, 18 bp, Homo sapiens
gcattctcactcctacct

SEQ ID NO: 183438 - DNA, 22 bp, Homo sapiens
gcattctgccgtgtgccctcgg

SEQ ID NO: 183439 - DNA, 20 bp, Homo sapiens
gcattcttttaaaagacaag

SEQ ID NO: 183440 - DNA, 16 bp, Homo sapiens
gcattgccaagggctt

SEQ ID NO: 183441 - DNA, 12 bp, Homo sapiens
gcatttgtgaaa

SEQ ID NO: 183442 - DNA, 22 bp, Homo sapiens
gcattttgctaaatgtgaatga

SEQ ID NO: 183443 - DNA, 19 bp, Homo sapiens
gccaaagcctcctccagcc

SEQ ID NO: 183444 - DNA, 23 bp, Homo sapiens
gccaaaggagggtcaggaaggat

SEQ ID NO: 183445 - DNA, 17 bp, Homo sapiens
gccaaaggatgtgatat

SEQ ID NO: 183446 - DNA, 17 bp, Homo sapiens
gccaaatatgtcctggg

SEQ ID NO: 183447 - DNA, 20 bp, Homo sapiens
gccaacttgagggcccagag

SEQ ID NO: 183448 - DNA, 21 bp, Homo sapiens
gccaacttgagggcccagagc

SEQ ID NO: 183449 - DNA, 12 bp, Homo sapiens
gccaagacttgg

SEQ ID NO: 183450 - DNA, 22 bp, Homo sapiens
gccaagcacctagcctcgctct

SEQ ID NO: 183451 - DNA, 12 bp, Homo sapiens
gccaagcagcca

SEQ ID NO: 183452 - DNA, 21 bp, Homo sapiens
gccaagccctccccatcccat

SEQ ID NO: 183453 - DNA, 19 bp, Homo sapiens
gccaagctccttgggaggc

SEQ ID NO: 183454 - DNA, 14 bp, Homo sapiens
gccaaggtgggagg

SEQ ID NO: 183455 - DNA, 14 bp, Homo sapiens
gccacaagaaattt

SEQ ID NO: 183456 - DNA, 13 bp, Homo sapiens
gccacaccctccc

SEQ ID NO: 183457 - DNA, 19 bp, Homo sapiens
gccaccaagagggacgcct

SEQ ID NO: 183458 - DNA, 14 bp, Homo sapiens
gccaccacgtccag

SEQ ID NO: 183459 - DNA, 15 bp, Homo sapiens
gccaccacgtccagc

SEQ ID NO: 183460 - DNA, 16 bp, Homo sapiens
gccaccacgtccagct

SEQ ID NO: 183461 - DNA, 16 bp, Homo sapiens
gaggctgaggcagaag

SEQ ID NO: 183462 - DNA, 16 bp, Homo sapiens
gaggctgaggcctgga

SEQ ID NO: 183463 - DNA, 19 bp, Homo sapiens
gaggctgaggcctggactt

SEQ ID NO: 183464 - DNA, 14 bp, Homo sapiens
gaggctggaggcag

SEQ ID NO: 183465 - DNA, 16 bp, Homo sapiens
gaggctggaggcaggg

SEQ ID NO: 183466 - DNA, 18 bp, Homo sapiens
gaggctggaggcagggcc

SEQ ID NO: 183467 - DNA, 20 bp, Homo sapiens
gaggctgtcttctcaggctc

SEQ ID NO: 183468 - DNA, 22 bp, Homo sapiens
gaggctgtcttctcaggctctg

SEQ ID NO: 183469 - DNA, 16 bp, Homo sapiens
gaggcttcttcagatc

SEQ ID NO: 183470 - DNA, 15 bp, Homo sapiens
gagggacgcctgggg

SEQ ID NO: 183471 - DNA, 20 bp, Homo sapiens
gagggagcagacaggaggaa

SEQ ID NO: 183472 - DNA, 18 bp, Homo sapiens
gagggatgaggtgctggg

SEQ ID NO: 183473 - DNA, 22 bp, Homo sapiens
gagggatgaggtgctgggaggg

SEQ ID NO: 183474 - DNA, 16 bp, Homo sapiens
gagggcactggtggcc

SEQ ID NO: 183475 - DNA, 12 bp, Homo sapiens
gagggcagcagg

SEQ ID NO: 183476 - DNA, 16 bp, Homo sapiens
gagggcagcagggcta

SEQ ID NO: 183477 - DNA, 19 bp, Homo sapiens
gagggcagcagggctaccc

SEQ ID NO: 183478 - DNA, 21 bp, Homo sapiens
gaggggacgctggtagagatg

SEQ ID NO: 183479 - DNA, 16 bp, Homo sapiens
gaggggcgcccacctc

SEQ ID NO: 183480 - DNA, 19 bp, Homo sapiens
gaggggctctcagctcagc

SEQ ID NO: 183481 - DNA, 18 bp, Homo sapiens
gagggggccacctcccca

SEQ ID NO: 183482 - DNA, 13 bp, Homo sapiens
gagggtcagagag

SEQ ID NO: 183483 - DNA, 15 bp, Homo sapiens
gagggtcagagagga

SEQ ID NO: 183484 - DNA, 21 bp, Homo sapiens
gaggtaggtggatcacctgag

SEQ ID NO: 183485 - DNA, 13 bp, Homo sapiens
gaggtatgaggtc

SEQ ID NO: 183486 - DNA, 16 bp, Homo sapiens
gaggtcaacagagaag

SEQ ID NO: 183487 - DNA, 22 bp, Homo sapiens
gaggtcaacagagaaggcagga

SEQ ID NO: 183488 - DNA, 20 bp, Homo sapiens
gaggtcaagcccaggaggac

SEQ ID NO: 183489 - DNA, 22 bp, Homo sapiens
gaggtcaggagttagaggccag

SEQ ID NO: 183490 - DNA, 19 bp, Homo sapiens
gaggtgcagagtgcccaga

SEQ ID NO: 183491 - DNA, 20 bp, Homo sapiens
gaggtggatcacagaggctt

SEQ ID NO: 183492 - DNA, 18 bp, Homo sapiens
gaggtgggagcaggagat

SEQ ID NO: 183493 - DNA, 11 bp, Homo sapiens
gaggtgggagg

SEQ ID NO: 183494 - DNA, 19 bp, Homo sapiens
gaggttaaggctgaggaaa

SEQ ID NO: 183495 - DNA, 19 bp, Homo sapiens
gaggttgcagtgagctgag

SEQ ID NO: 183496 - DNA, 16 bp, Homo sapiens
gaggtttcaaacctcc

SEQ ID NO: 183497 - DNA, 19 bp, Homo sapiens
gaggttttaaaaaaatccc

SEQ ID NO: 183498 - DNA, 17 bp, Homo sapiens
gagtatcaggtctccca

SEQ ID NO: 183499 - DNA, 23 bp, Homo sapiens
gagtatctcctcgcaagctgggt

SEQ ID NO: 183500 - DNA, 19 bp, Homo sapiens
gagtcaatcccctcattca

SEQ ID NO: 183501 - DNA, 22 bp, Homo sapiens
gagtcagggacccctgcccttg

SEQ ID NO: 183502 - DNA, 12 bp, Homo sapiens
gagtctcttctc

SEQ ID NO: 183503 - DNA, 14 bp, Homo sapiens
gagtctgaagcaga

SEQ ID NO: 183504 - DNA, 19 bp, Homo sapiens
gagtgacagtggattgcat

SEQ ID NO: 183505 - DNA, 13 bp, Homo sapiens
gagtgagcctggc

SEQ ID NO: 183506 - DNA, 22 bp, Homo sapiens
gagtgcagtcctgatcagagcc

SEQ ID NO: 183507 - DNA, 14 bp, Homo sapiens
gagtgcccagaact

SEQ ID NO: 183508 - DNA, 19 bp, Homo sapiens
gagtgtcttaattaaaaga

SEQ ID NO: 183509 - DNA, 22 bp, Homo sapiens
gagtgtctttccacggagccac

SEQ ID NO: 183510 - DNA, 17 bp, Homo sapiens
gagtgtgcctgaagtcc

SEQ ID NO: 183511 - DNA, 20 bp, Homo sapiens
gagtgtgcctgaagtcccag

SEQ ID NO: 183512 - DNA, 14 bp, Homo sapiens
gagttagaggccag

SEQ ID NO: 183513 - DNA, 20 bp, Homo sapiens
gagttagaggccagcctggc

SEQ ID NO: 183514 - DNA, 19 bp, Homo sapiens
gagttcaggtagctgcccc

SEQ ID NO: 183515 - DNA, 12 bp, Homo sapiens
gagttgtaaata

SEQ ID NO: 183516 - DNA, 16 bp, Homo sapiens
gagttgttttcagact

SEQ ID NO: 183517 - DNA, 13 bp, Homo sapiens
gagtttaaagcaa

SEQ ID NO: 183518 - DNA, 18 bp, Homo sapiens
gagtttcattctcctgcc

SEQ ID NO: 183519 - DNA, 20 bp, Homo sapiens
gagtttcattctcctgcctg

SEQ ID NO: 183520 - DNA, 19 bp, Homo sapiens
gagtttttatggggctgaa

SEQ ID NO: 183521 - DNA, 13 bp, Homo sapiens
gataaacagtagt

SEQ ID NO: 183522 - DNA, 18 bp, Homo sapiens
gataaataatcggcccac

SEQ ID NO: 183523 - DNA, 17 bp, Homo sapiens
gataacctatatgattt

SEQ ID NO: 183524 - DNA, 11 bp, Homo sapiens
gataactctcc

SEQ ID NO: 183525 - DNA, 19 bp, Homo sapiens
gatacaccgggcctggaga

SEQ ID NO: 183526 - DNA, 15 bp, Homo sapiens
gataccagcgaggag

SEQ ID NO: 183527 - DNA, 22 bp, Homo sapiens
gataccagcgaggaggctccag

SEQ ID NO: 183528 - DNA, 22 bp, Homo sapiens
gatactgtaacactttacaatg

SEQ ID NO: 183529 - DNA, 13 bp, Homo sapiens
gatactttacatg

SEQ ID NO: 183530 - DNA, 18 bp, Homo sapiens
gatactttgatattttca

SEQ ID NO: 183531 - DNA, 17 bp, Homo sapiens
gatagcatttttgattt

SEQ ID NO: 183532 - DNA, 14 bp, Homo sapiens
gatagtctttcagt

SEQ ID NO: 183533 - DNA, 17 bp, Homo sapiens
gatatattaaaaatata

SEQ ID NO: 183534 - DNA, 18 bp, Homo sapiens
gatatattaaaaatataa

SEQ ID NO: 183535 - DNA, 17 bp, Homo sapiens
gatatgggacatttttg

SEQ ID NO: 183536 - DNA, 22 bp, Homo sapiens
gatcaaaccccgaccacctgcc

SEQ ID NO: 183537 - DNA, 16 bp, Homo sapiens
gatcagaccataatgt

SEQ ID NO: 183538 - DNA, 12 bp, Homo sapiens
gatcagcctggg

SEQ ID NO: 183539 - DNA, 15 bp, Homo sapiens
gatcagcctgggcaa

SEQ ID NO: 183540 - DNA, 13 bp, Homo sapiens
gatcaggtgggga

SEQ ID NO: 183541 - DNA, 21 bp, Homo sapiens
gatcatttgcccttaaggaca

SEQ ID NO: 183542 - DNA, 17 bp, Homo sapiens
gatccagcctctcccct

SEQ ID NO: 183543 - DNA, 19 bp, Homo sapiens
gatcccagctcacgtcaca

SEQ ID NO: 183544 - DNA, 14 bp, Homo sapiens
gatccctcatctgt

SEQ ID NO: 183545 - DNA, 18 bp, Homo sapiens
gatccctgtgttgtctct

SEQ ID NO: 183546 - DNA, 19 bp, Homo sapiens
gatccctgtgttgtctcta

SEQ ID NO: 183547 - DNA, 20 bp, Homo sapiens
gatccctgtgttgtctctag

SEQ ID NO: 183548 - DNA, 18 bp, Homo sapiens
gatcctaagggctcaccg

SEQ ID NO: 183549 - DNA, 23 bp, Homo sapiens
gatcctaatgaatgcataaaatg

SEQ ID NO: 183550 - DNA, 14 bp, Homo sapiens
gatccttttatgtt

SEQ ID NO: 183551 - DNA, 20 bp, Homo sapiens
gatcggagcctcctctctca

SEQ ID NO: 183552 - DNA, 18 bp, Homo sapiens
gatcgtctgactggtgtt

SEQ ID NO: 183553 - DNA, 16 bp, Homo sapiens
gatctatcaatagtca

SEQ ID NO: 183554 - DNA, 21 bp, Homo sapiens
gatctcattggacccttccat

SEQ ID NO: 183555 - DNA, 14 bp, Homo sapiens
gatctccctgccgc

SEQ ID NO: 183556 - DNA, 17 bp, Homo sapiens
gatctcttgagcctggg

SEQ ID NO: 183557 - DNA, 14 bp, Homo sapiens
gatctgagaatctt

SEQ ID NO: 183558 - DNA, 15 bp, Homo sapiens
gatctgagaatcttt

SEQ ID NO: 183559 - DNA, 17 bp, Homo sapiens
gatctggggctctggga

SEQ ID NO: 183560 - DNA, 19 bp, Homo sapiens
gatctgtgcccagagatgg

SEQ ID NO: 183561 - DNA, 14 bp, Homo sapiens
gatgaaaatatttg

SEQ ID NO: 183562 - DNA, 16 bp, Homo sapiens
gatgaaatgtaaatac

SEQ ID NO: 183563 - DNA, 13 bp, Homo sapiens
gatgaactttctc

SEQ ID NO: 183564 - DNA, 16 bp, Homo sapiens
gatgacccctccccta

SEQ ID NO: 183565 - DNA, 15 bp, Homo sapiens
gatgagccctcagaa

SEQ ID NO: 183566 - DNA, 23 bp, Homo sapiens
gatgagccgctgtgagcccctgg

SEQ ID NO: 183567 - DNA, 19 bp, Homo sapiens
gatgagctctacccagggc

SEQ ID NO: 183568 - DNA, 14 bp, Homo sapiens
gatgaggtgctggg

SEQ ID NO: 183569 - DNA, 18 bp, Homo sapiens
gccgcattccctgagtca

SEQ ID NO: 183570 - DNA, 15 bp, Homo sapiens
gccgccatgctcctg

SEQ ID NO: 183571 - DNA, 12 bp, Homo sapiens
gccgcctcccag

SEQ ID NO: 183572 - DNA, 15 bp, Homo sapiens
gccgctcctgtctgc

SEQ ID NO: 183573 - DNA, 21 bp, Homo sapiens
gccgctcctgtctgccagcca

SEQ ID NO: 183574 - DNA, 15 bp, Homo sapiens
gccgctgagcgagga

SEQ ID NO: 183575 - DNA, 17 bp, Homo sapiens
gccgctgtgagcccctg

SEQ ID NO: 183576 - DNA, 21 bp, Homo sapiens
gccggcacagggtctgctctt

SEQ ID NO: 183577 - DNA, 14 bp, Homo sapiens
gccggccctggggc

SEQ ID NO: 183578 - DNA, 17 bp, Homo sapiens
gccggcgagccctgtgg

SEQ ID NO: 183579 - DNA, 23 bp, Homo sapiens
gccgggcatggtggcgcaagcct

SEQ ID NO: 183580 - DNA, 17 bp, Homo sapiens
gccgggtgctcagggct

SEQ ID NO: 183581 - DNA, 23 bp, Homo sapiens
gccgtggattgcacgtggcctct

SEQ ID NO: 183582 - DNA, 18 bp, Homo sapiens
gccgtggctgcggcaccc

SEQ ID NO: 183583 - DNA, 12 bp, Homo sapiens
gccgtggcttcc

SEQ ID NO: 183584 - DNA, 13 bp, Homo sapiens
gccgtggcttccc

SEQ ID NO: 183585 - DNA, 22 bp, Homo sapiens
gccgtggcttcccgctcagccc

SEQ ID NO: 183586 - DNA, 14 bp, Homo sapiens
gcctaaaaatgcaa

SEQ ID NO: 183587 - DNA, 17 bp, Homo sapiens
gcctaaaaatgcaactt

SEQ ID NO: 183588 - DNA, 17 bp, Homo sapiens
gcctaagtgcagccccg

SEQ ID NO: 183589 - DNA, 17 bp, Homo sapiens
gcctagccgacctcagc

SEQ ID NO: 183590 - DNA, 19 bp, Homo sapiens
gcctagccgacctcagcct

SEQ ID NO: 183591 - DNA, 19 bp, Homo sapiens
gcctagtggggtctccctc

SEQ ID NO: 183592 - DNA, 22 bp, Homo sapiens
gcctcaatgtgaatcagaccct

SEQ ID NO: 183593 - DNA, 13 bp, Homo sapiens
gcctcacagaaga

SEQ ID NO: 183594 - DNA, 15 bp, Homo sapiens
gcctcacagaagaat

SEQ ID NO: 183595 - DNA, 24 bp, Homo sapiens
gcctcagtcctcccctcacagcct

SEQ ID NO: 183596 - DNA, 17 bp, Homo sapiens
gcctcatccgaggcagg

SEQ ID NO: 183597 - DNA, 18 bp, Homo sapiens
gcctcatccgaggcaggg

SEQ ID NO: 183598 - DNA, 19 bp, Homo sapiens
gcctcatccgaggcagggt

SEQ ID NO: 183599 - DNA, 22 bp, Homo sapiens
gcctcatctataacatgcattt

SEQ ID NO: 183600 - DNA, 17 bp, Homo sapiens
gcctccaagctccatct

SEQ ID NO: 183601 - DNA, 12 bp, Homo sapiens
gcctccaccgct

SEQ ID NO: 183602 - DNA, 11 bp, Homo sapiens
gcctccatgct

SEQ ID NO: 183603 - DNA, 12 bp, Homo sapiens
gcctcccacccc

SEQ ID NO: 183604 - DNA, 14 bp, Homo sapiens
gcctcccacgactg

SEQ ID NO: 183605 - DNA, 21 bp, Homo sapiens
gcctcccacgactgcccggca

SEQ ID NO: 183606 - DNA, 13 bp, Homo sapiens
gcctcccagcctg

SEQ ID NO: 183607 - DNA, 21 bp, Homo sapiens
gcctccctgttgaagctctgg

SEQ ID NO: 183608 - DNA, 16 bp, Homo sapiens
gcctccgtatttcaga

SEQ ID NO: 183609 - DNA, 16 bp, Homo sapiens
gcctcctccttcccaa

SEQ ID NO: 183610 - DNA, 23 bp, Homo sapiens
gcctctacctgacactcccttgg

SEQ ID NO: 183611 - DNA, 16 bp, Homo sapiens
gcctctccctggccct

SEQ ID NO: 183612 - DNA, 19 bp, Homo sapiens
gcctctcggtggccagcag

SEQ ID NO: 183613 - DNA, 19 bp, Homo sapiens
gcctctcttggtttccttc

SEQ ID NO: 183614 - DNA, 13 bp, Homo sapiens
gcctctgacccct

SEQ ID NO: 183615 - DNA, 15 bp, Homo sapiens
gcctctgacccctcc

SEQ ID NO: 183616 - DNA, 19 bp, Homo sapiens
gcctctgacccctcctcac

SEQ ID NO: 183617 - DNA, 13 bp, Homo sapiens
gcctctgggtcag

SEQ ID NO: 183618 - DNA, 22 bp, Homo sapiens
gcctctgggtcagtggtccaca

SEQ ID NO: 183619 - DNA, 15 bp, Homo sapiens
gcctctgtgtccttc

SEQ ID NO: 183620 - DNA, 18 bp, Homo sapiens
gcctctgtgtccttccct

SEQ ID NO: 183621 - DNA, 15 bp, Homo sapiens
gcctcttctgggagg

SEQ ID NO: 183622 - DNA, 17 bp, Homo sapiens
gcctctttctgtccctt

SEQ ID NO: 183623 - DNA, 16 bp, Homo sapiens
gcctgaaagaggctga

SEQ ID NO: 183624 - DNA, 23 bp, Homo sapiens
gcctgaaaggagcccttatctgt

SEQ ID NO: 183625 - DNA, 22 bp, Homo sapiens
gcctgagaagagagatcaaatg

SEQ ID NO: 183626 - DNA, 20 bp, Homo sapiens
gcctgagcgacagtgagact

SEQ ID NO: 183627 - DNA, 18 bp, Homo sapiens
gcctgatccagcctctcc

SEQ ID NO: 183628 - DNA, 18 bp, Homo sapiens
gcctgcaggacctgcctg

SEQ ID NO: 183629 - DNA, 19 bp, Homo sapiens
gcctgcaggacctgcctgt

SEQ ID NO: 183630 - DNA, 20 bp, Homo sapiens
gcctgcaggacctgcctgta

SEQ ID NO: 183631 - DNA, 14 bp, Homo sapiens
gcctgcccctccca

SEQ ID NO: 183632 - DNA, 16 bp, Homo sapiens
gcctgcccctcccaga

SEQ ID NO: 183633 - DNA, 18 bp, Homo sapiens
gcctgcccctcccagaac

SEQ ID NO: 183634 - DNA, 16 bp, Homo sapiens
gcctgctccagctgtt

SEQ ID NO: 183635 - DNA, 13 bp, Homo sapiens
gcctgctgggctc

SEQ ID NO: 183636 - DNA, 17 bp, Homo sapiens
gcctgctgggctctcca

SEQ ID NO: 183637 - DNA, 23 bp, Homo sapiens
gcctgctgggctctccacctcag

SEQ ID NO: 183638 - DNA, 14 bp, Homo sapiens
gcctggactttcct

SEQ ID NO: 183639 - DNA, 17 bp, Homo sapiens
gcctggactttcctgca

SEQ ID NO: 183640 - DNA, 22 bp, Homo sapiens
gcctggaggccgggtgctcagg

SEQ ID NO: 183641 - DNA, 19 bp, Homo sapiens
gcctggcacagggcagtgg

SEQ ID NO: 183642 - DNA, 12 bp, Homo sapiens
gcctggcagccg

SEQ ID NO: 183643 - DNA, 20 bp, Homo sapiens
gcctggcagccgtgccttca

SEQ ID NO: 183644 - DNA, 15 bp, Homo sapiens
gcctggcccccagct

SEQ ID NO: 183645 - DNA, 21 bp, Homo sapiens
gcctgggaggtcaaggctgca

SEQ ID NO: 183646 - DNA, 22 bp, Homo sapiens
gcctgggaggtcaaggctgcag

SEQ ID NO: 183647 - DNA, 16 bp, Homo sapiens
gcctgggggtgccagg

SEQ ID NO: 183648 - DNA, 20 bp, Homo sapiens
gcctgggtgacagagcaaga

SEQ ID NO: 183649 - DNA, 19 bp, Homo sapiens
gcctgggtggggctgctcc

SEQ ID NO: 183650 - DNA, 22 bp, Homo sapiens
gcctgggtggggctgctcctcc

SEQ ID NO: 183651 - DNA, 18 bp, Homo sapiens
gcctgtaatcacagctac

SEQ ID NO: 183652 - DNA, 15 bp, Homo sapiens
gcctgtaatcccagc

SEQ ID NO: 183653 - DNA, 18 bp, Homo sapiens
gcctgtaatcccagctac

SEQ ID NO: 183654 - DNA, 19 bp, Homo sapiens
gcctgtaatcccagctact

SEQ ID NO: 183655 - DNA, 22 bp, Homo sapiens
gcctgtagttaggaaataaaac

SEQ ID NO: 183656 - DNA, 13 bp, Homo sapiens
gcctgtctccttt

SEQ ID NO: 183657 - DNA, 13 bp, Homo sapiens
gcctgtctcttcc

SEQ ID NO: 183658 - DNA, 23 bp, Homo sapiens
gcctgtgaggtgcagagtgccca

SEQ ID NO: 183659 - DNA, 23 bp, Homo sapiens
gcctgttcccattcttgcatggc

SEQ ID NO: 183660 - DNA, 13 bp, Homo sapiens
gccttaaaacttt

SEQ ID NO: 183661 - DNA, 16 bp, Homo sapiens
gccttaaagaaagtcg

SEQ ID NO: 183662 - DNA, 16 bp, Homo sapiens
gccttacctcctgccc

SEQ ID NO: 183663 - DNA, 17 bp, Homo sapiens
gccttagaacctttctt

SEQ ID NO: 183664 - DNA, 14 bp, Homo sapiens
gccttccccagcct

SEQ ID NO: 183665 - DNA, 20 bp, Homo sapiens
gccttccgtaacccaactct

SEQ ID NO: 183666 - DNA, 18 bp, Homo sapiens
gccttcgatacaccgggc

SEQ ID NO: 183667 - DNA, 19 bp, Homo sapiens
gccttcttattctcactcc

SEQ ID NO: 183668 - DNA, 17 bp, Homo sapiens
gccttcttccatcccag

SEQ ID NO: 183669 - DNA, 20 bp, Homo sapiens
gccttcttccatcccaggac

SEQ ID NO: 183670 - DNA, 23 bp, Homo sapiens
gccttcttcggggaactcctgga

SEQ ID NO: 183671 - DNA, 17 bp, Homo sapiens
gccttgaatatcccctc

SEQ ID NO: 183672 - DNA, 23 bp, Homo sapiens
gccttggataatgctgttgcctc

SEQ ID NO: 183673 - DNA, 18 bp, Homo sapiens
gccttggtgtccacctgg

SEQ ID NO: 183674 - DNA, 19 bp, Homo sapiens
gccttggtgtccacctggc

SEQ ID NO: 183675 - DNA, 21 bp, Homo sapiens
gccttggtgtccacctggccc

SEQ ID NO: 183676 - DNA, 17 bp, Homo sapiens
gccttgtgtctacagag

SEQ ID NO: 183677 - DNA, 22 bp, Homo sapiens
gcctttgagtttcctcaggctg

SEQ ID NO: 183678 - DNA, 18 bp, Homo sapiens
gcgttagaatgaggagga

SEQ ID NO: 183679 - DNA, 15 bp, Homo sapiens
gcgttgtaaaatata

SEQ ID NO: 183680 - DNA, 20 bp, Homo sapiens
gctaacttggagccccagtg

SEQ ID NO: 183681 - DNA, 17 bp, Homo sapiens
gctaatcagcattctca

SEQ ID NO: 183682 - DNA, 17 bp, Homo sapiens
gctacaaaaacacagca

SEQ ID NO: 183683 - DNA, 14 bp, Homo sapiens
gctacctcactggg

SEQ ID NO: 183684 - DNA, 12 bp, Homo sapiens
gctacgcctgca

SEQ ID NO: 183685 - DNA, 11 bp, Homo sapiens
gctactcagca

SEQ ID NO: 183686 - DNA, 18 bp, Homo sapiens
gctactcagcagccctcc

SEQ ID NO: 183687 - DNA, 22 bp, Homo sapiens
gctactcagcagccctcctcac

SEQ ID NO: 183688 - DNA, 14 bp, Homo sapiens
gctactcaggaggc

SEQ ID NO: 183689 - DNA, 23 bp, Homo sapiens
gctactcaggaggctgaggcaga

SEQ ID NO: 183690 - DNA, 21 bp, Homo sapiens
gctagaagtgggccaggacag

SEQ ID NO: 183691 - DNA, 22 bp, Homo sapiens
gctagaattccctctctctgac

SEQ ID NO: 183692 - DNA, 15 bp, Homo sapiens
gctagacacccattt

SEQ ID NO: 183693 - DNA, 15 bp, Homo sapiens
gctagcgctgccgca

SEQ ID NO: 183694 - DNA, 18 bp, Homo sapiens
gctaggcatacaagtagg

SEQ ID NO: 183695 - DNA, 18 bp, Homo sapiens
gctagtcagagagagtgt

SEQ ID NO: 183696 - DNA, 21 bp, Homo sapiens
gctagtgacttgtgtcccatg

SEQ ID NO: 183697 - DNA, 13 bp, Homo sapiens
gctataggtgcta

SEQ ID NO: 183698 - DNA, 18 bp, Homo sapiens
gctatggggagaaaagac

SEQ ID NO: 183699 - DNA, 23 bp, Homo sapiens
gctcaaaatttgaagaatgaaca

SEQ ID NO: 183700 - DNA, 16 bp, Homo sapiens
gctcaaaggcacagtg

SEQ ID NO: 183701 - DNA, 19 bp, Homo sapiens
gctcaaggaaaggcctgaa

SEQ ID NO: 183702 - DNA, 15 bp, Homo sapiens
gctcacacatgagat

SEQ ID NO: 183703 - DNA, 22 bp, Homo sapiens
gctcacagaacccttggagcca

SEQ ID NO: 183704 - DNA, 15 bp, Homo sapiens
gctcacagttcctcg

SEQ ID NO: 183705 - DNA, 22 bp, Homo sapiens
gctcacagttcctcgccctggg

SEQ ID NO: 183706 - DNA, 23 bp, Homo sapiens
gctcacagttcctcgccctgggt

SEQ ID NO: 183707 - DNA, 20 bp, Homo sapiens
gctcacccccttctccatcc

SEQ ID NO: 183708 - DNA, 12 bp, Homo sapiens
gctcacctgggg

SEQ ID NO: 183709 - DNA, 13 bp, Homo sapiens
gctcacctggggt

SEQ ID NO: 183710 - DNA, 15 bp, Homo sapiens
gctcagacccccact

SEQ ID NO: 183711 - DNA, 23 bp, Homo sapiens
gctcagagggttgttctcctaga

SEQ ID NO: 183712 - DNA, 20 bp, Homo sapiens
gctcagcaaaagatgcttct

SEQ ID NO: 183713 - DNA, 11 bp, Homo sapiens
gctcagcctgg

SEQ ID NO: 183714 - DNA, 18 bp, Homo sapiens
gctcagcctggtgggcct

SEQ ID NO: 183715 - DNA, 20 bp, Homo sapiens
gctcagctactgatttttgt

SEQ ID NO: 183716 - DNA, 17 bp, Homo sapiens
gctcaggactcagaagc

SEQ ID NO: 183717 - DNA, 16 bp, Homo sapiens
gctcatcattctctgt

SEQ ID NO: 183718 - DNA, 20 bp, Homo sapiens
gctcatcattctctgtctca

SEQ ID NO: 183719 - DNA, 19 bp, Homo sapiens
gctccaccaagaaagcagg

SEQ ID NO: 183720 - DNA, 16 bp, Homo sapiens
gctcccacaggccctt

SEQ ID NO: 183721 - DNA, 20 bp, Homo sapiens
gctcccacaggcccttcctc

SEQ ID NO: 183722 - DNA, 21 bp, Homo sapiens
gctcccaccccacccccttca

SEQ ID NO: 183723 - DNA, 20 bp, Homo sapiens
gctccccactgcctactgca

SEQ ID NO: 183724 - DNA, 14 bp, Homo sapiens
gctccccagccctg

SEQ ID NO: 183725 - DNA, 14 bp, Homo sapiens
gctcccccaccccc

SEQ ID NO: 183726 - DNA, 22 bp, Homo sapiens
gctcccccaccccctccccagg

SEQ ID NO: 183727 - DNA, 20 bp, Homo sapiens
gctccctaccacctccccag

SEQ ID NO: 183728 - DNA, 13 bp, Homo sapiens
gctccctctgcct

SEQ ID NO: 183729 - DNA, 23 bp, Homo sapiens
gctccctctgcctgaaccttcca

SEQ ID NO: 183730 - DNA, 13 bp, Homo sapiens
gctccctgaagcc

SEQ ID NO: 183731 - DNA, 16 bp, Homo sapiens
gctccctgaagccagc

SEQ ID NO: 183732 - DNA, 18 bp, Homo sapiens
gctccctgaagccagcct

SEQ ID NO: 183733 - DNA, 21 bp, Homo sapiens
gctccctgtaacctcttcaga

SEQ ID NO: 183734 - DNA, 14 bp, Homo sapiens
gctccgcctctgct

SEQ ID NO: 183735 - DNA, 14 bp, Homo sapiens
gctcctccagggcc

SEQ ID NO: 183736 - DNA, 18 bp, Homo sapiens
gctcctccagggccacgt

SEQ ID NO: 183737 - DNA, 14 bp, Homo sapiens
gctcctggcccact

SEQ ID NO: 183738 - DNA, 18 bp, Homo sapiens
gctcctggcccactgcat

SEQ ID NO: 183739 - DNA, 20 bp, Homo sapiens
gctcctgtctgccagccagc

SEQ ID NO: 183740 - DNA, 23 bp, Homo sapiens
gctccttcctggagactgcccag

SEQ ID NO: 183741 - DNA, 13 bp, Homo sapiens
gctccttcctgtc

SEQ ID NO: 183742 - DNA, 15 bp, Homo sapiens
gctccttgactcctt

SEQ ID NO: 183743 - DNA, 14 bp, Homo sapiens
gctccttgggaggc

SEQ ID NO: 183744 - DNA, 21 bp, Homo sapiens
gctccttgggaggccccactg

SEQ ID NO: 183745 - DNA, 17 bp, Homo sapiens
gctccttgggccctttg

SEQ ID NO: 183746 - DNA, 17 bp, Homo sapiens
gctcgagcagtcctgcc

SEQ ID NO: 183747 - DNA, 14 bp, Homo sapiens
gctcggtggaccca

SEQ ID NO: 183748 - DNA, 17 bp, Homo sapiens
gctcggtggacccaggg

SEQ ID NO: 183749 - DNA, 14 bp, Homo sapiens
gctctacccagggc

SEQ ID NO: 183750 - DNA, 18 bp, Homo sapiens
gctctcaagttatcaggg

SEQ ID NO: 183751 - DNA, 17 bp, Homo sapiens
gctctcagccaacgagt

SEQ ID NO: 183752 - DNA, 18 bp, Homo sapiens
gctctcagctcagcgcca

SEQ ID NO: 183753 - DNA, 17 bp, Homo sapiens
gctctccacctcagcct

SEQ ID NO: 183754 - DNA, 18 bp, Homo sapiens
gctctccacctcagcctt

SEQ ID NO: 183755 - DNA, 19 bp, Homo sapiens
gctctccacctcagccttg

SEQ ID NO: 183756 - DNA, 16 bp, Homo sapiens
gctctcccctgccctg

SEQ ID NO: 183757 - DNA, 18 bp, Homo sapiens
gctctccctctggccctg

SEQ ID NO: 183758 - DNA, 23 bp, Homo sapiens
gctctccctctggccctgccttc

SEQ ID NO: 183759 - DNA, 15 bp, Homo sapiens
gctctcctcttgcca

SEQ ID NO: 183760 - DNA, 17 bp, Homo sapiens
gctctctgcagccagcc

SEQ ID NO: 183761 - DNA, 21 bp, Homo sapiens
gctctctgcagccagcccagc

SEQ ID NO: 183762 - DNA, 15 bp, Homo sapiens
gctctgacccagtga

SEQ ID NO: 183763 - DNA, 17 bp, Homo sapiens
gctctgacccagtgaga

SEQ ID NO: 183764 - DNA, 22 bp, Homo sapiens
gctctgatccctctacagagct

SEQ ID NO: 183765 - DNA, 23 bp, Homo sapiens
gctctgcaatgggcactgggatg

SEQ ID NO: 183766 - DNA, 20 bp, Homo sapiens
gctctggagacagccccaga

SEQ ID NO: 183767 - DNA, 19 bp, Homo sapiens
gctctggtgacaccagcct

SEQ ID NO: 183768 - DNA, 18 bp, Homo sapiens
gctcttagcagcttccag

SEQ ID NO: 183769 - DNA, 23 bp, Homo sapiens
gctcttctcctttcacaaccttc

SEQ ID NO: 183770 - DNA, 14 bp, Homo sapiens
gctcttctgccggc

SEQ ID NO: 183771 - DNA, 19 bp, Homo sapiens
gctcttggcaggtactcag

SEQ ID NO: 183772 - DNA, 14 bp, Homo sapiens
gctctttctctgcc

SEQ ID NO: 183773 - DNA, 11 bp, Homo sapiens
gctgaaaatat

SEQ ID NO: 183774 - DNA, 16 bp, Homo sapiens
gctgaaacaggagaga

SEQ ID NO: 183775 - DNA, 17 bp, Homo sapiens
gctgaatacagaggcaa

SEQ ID NO: 183776 - DNA, 23 bp, Homo sapiens
gctgactctaggtgcccttggag

SEQ ID NO: 183777 - DNA, 18 bp, Homo sapiens
gctgactgtactcctccc

SEQ ID NO: 183778 - DNA, 14 bp, Homo sapiens
gtcagggacccctg

SEQ ID NO: 183779 - DNA, 15 bp, Homo sapiens
gtcataccaatgaaa

SEQ ID NO: 183780 - DNA, 15 bp, Homo sapiens
gtcataggttaatat

SEQ ID NO: 183781 - DNA, 15 bp, Homo sapiens
gtcatcacttttcag

SEQ ID NO: 183782 - DNA, 16 bp, Homo sapiens
gtcatcacttttcagt

SEQ ID NO: 183783 - DNA, 18 bp, Homo sapiens
gtcatcttgaccaagcag

SEQ ID NO: 183784 - DNA, 20 bp, Homo sapiens
gtcatcttgaccaagcagga

SEQ ID NO: 183785 - DNA, 17 bp, Homo sapiens
gtcatgatctccctgcc

SEQ ID NO: 183786 - DNA, 22 bp, Homo sapiens
gtcatgatctccctgccgcctc

SEQ ID NO: 183787 - DNA, 20 bp, Homo sapiens
gtcatggcttaatgtttatt

SEQ ID NO: 183788 - DNA, 22 bp, Homo sapiens
gtcatttgctgagcatgtactg

SEQ ID NO: 183789 - DNA, 20 bp, Homo sapiens
gtccaacgtggggcagcaca

SEQ ID NO: 183790 - DNA, 19 bp, Homo sapiens
gtccaagtgtgtgtgcgtg

SEQ ID NO: 183791 - DNA, 21 bp, Homo sapiens
gtccacctggccccatgtctc

SEQ ID NO: 183792 - DNA, 21 bp, Homo sapiens
gtccagaccttgttcacactc

SEQ ID NO: 183793 - DNA, 17 bp, Homo sapiens
gtccagcttgctcttca

SEQ ID NO: 183794 - DNA, 21 bp, Homo sapiens
gtccaggatgctaacatctaa

SEQ ID NO: 183795 - DNA, 14 bp, Homo sapiens
gtccagggccctga

SEQ ID NO: 183796 - DNA, 22 bp, Homo sapiens
gtccatgaagatgtagaggaga

SEQ ID NO: 183797 - DNA, 13 bp, Homo sapiens
gtccatgtgtgtg

SEQ ID NO: 183798 - DNA, 12 bp, Homo sapiens
gtcccactcaag

SEQ ID NO: 183799 - DNA, 17 bp, Homo sapiens
gtcccagatacttgggg

SEQ ID NO: 183800 - DNA, 22 bp, Homo sapiens
gtcccatggacactccagtgcc

SEQ ID NO: 183801 - DNA, 23 bp, Homo sapiens
gtcccatggacactccagtgcca

SEQ ID NO: 183802 - DNA, 17 bp, Homo sapiens
gtccccaaacctgcaag

SEQ ID NO: 183803 - DNA, 15 bp, Homo sapiens
gtccccacctgggac

SEQ ID NO: 183804 - DNA, 19 bp, Homo sapiens
gtccccaggccccaggaag

SEQ ID NO: 183805 - DNA, 19 bp, Homo sapiens
gtccccagtttgcagaaaa

SEQ ID NO: 183806 - DNA, 22 bp, Homo sapiens
gtccccctggggcttctcctga

SEQ ID NO: 183807 - DNA, 15 bp, Homo sapiens
gtccccgtgccccgc

SEQ ID NO: 183808 - DNA, 22 bp, Homo sapiens
gtccccgtgccccgcctccccg

SEQ ID NO: 183809 - DNA, 19 bp, Homo sapiens
gtcccgtcaggacgttgag

SEQ ID NO: 183810 - DNA, 16 bp, Homo sapiens
gtccctacacccctcc

SEQ ID NO: 183811 - DNA, 21 bp, Homo sapiens
gtccctaccgagtctcttctc

SEQ ID NO: 183812 - DNA, 20 bp, Homo sapiens
gtccctccacgttcacccct

SEQ ID NO: 183813 - DNA, 21 bp, Homo sapiens
gtccctccacgttcacccctc

SEQ ID NO: 183814 - DNA, 17 bp, Homo sapiens
gtccctcccacctctgt

SEQ ID NO: 183815 - DNA, 18 bp, Homo sapiens
gtccctcccacctctgtg

SEQ ID NO: 183816 - DNA, 21 bp, Homo sapiens
gtccctgggggaagccctgga

SEQ ID NO: 183817 - DNA, 23 bp, Homo sapiens
gtccctgggggaagccctggatt

SEQ ID NO: 183818 - DNA, 19 bp, Homo sapiens
gtcccttctcttaatttaa

SEQ ID NO: 183819 - DNA, 14 bp, Homo sapiens
gtcccttgagacct

SEQ ID NO: 183820 - DNA, 21 bp, Homo sapiens
gtcccttgagacctcagccat

SEQ ID NO: 183821 - DNA, 14 bp, Homo sapiens
gtcccttgcctcaa

SEQ ID NO: 183822 - DNA, 16 bp, Homo sapiens
gtcctaactggtatag

SEQ ID NO: 183823 - DNA, 16 bp, Homo sapiens
gtcctaccaatagatt

SEQ ID NO: 183824 - DNA, 21 bp, Homo sapiens
gtcctcacccctgtcctcact

SEQ ID NO: 183825 - DNA, 18 bp, Homo sapiens
gtcctcacggtgcctttt

SEQ ID NO: 183826 - DNA, 18 bp, Homo sapiens
gtcctcactgctccctga

SEQ ID NO: 183827 - DNA, 16 bp, Homo sapiens
gtcctcccatcccctg

SEQ ID NO: 183828 - DNA, 15 bp, Homo sapiens
gtcctccccctgcca

SEQ ID NO: 183829 - DNA, 17 bp, Homo sapiens
gtcctccccctgccagt

SEQ ID NO: 183830 - DNA, 20 bp, Homo sapiens
gtcctccccctgccagtgcc

SEQ ID NO: 183831 - DNA, 21 bp, Homo sapiens
gtcctccccctgccagtgcct

SEQ ID NO: 183832 - DNA, 12 bp, Homo sapiens
gtcctcccctca

SEQ ID NO: 183833 - DNA, 19 bp, Homo sapiens
gtcctcccctcacagcctc

SEQ ID NO: 183834 - DNA, 13 bp, Homo sapiens
gtcctcctctgtg

SEQ ID NO: 183835 - DNA, 15 bp, Homo sapiens
gtcctgatcagagcc

SEQ ID NO: 183836 - DNA, 17 bp, Homo sapiens
gtcctgatcagagccgt

SEQ ID NO: 183837 - DNA, 16 bp, Homo sapiens
gtcctgccacctgggg

SEQ ID NO: 183838 - DNA, 17 bp, Homo sapiens
gtcctgccacctggggc

SEQ ID NO: 183839 - DNA, 18 bp, Homo sapiens
gtcctgccacctggggca

SEQ ID NO: 183840 - DNA, 17 bp, Homo sapiens
gtcctgcctcagcctcc

SEQ ID NO: 183841 - DNA, 22 bp, Homo sapiens
gtcctggggcctcggagcctca

SEQ ID NO: 183842 - DNA, 21 bp, Homo sapiens
gtccttccctctccccaagac

SEQ ID NO: 183843 - DNA, 18 bp, Homo sapiens
gtccttctctcacctcct

SEQ ID NO: 183844 - DNA, 16 bp, Homo sapiens
gtccttgcacccctca

SEQ ID NO: 183845 - DNA, 19 bp, Homo sapiens
gtccttgcacccctcactc

SEQ ID NO: 183846 - DNA, 17 bp, Homo sapiens
gtccttgcacctgcatc

SEQ ID NO: 183847 - DNA, 18 bp, Homo sapiens
gtccttttcactacacca

SEQ ID NO: 183848 - DNA, 17 bp, Homo sapiens
gtcgaattaatagcttt

SEQ ID NO: 183849 - DNA, 15 bp, Homo sapiens
gtcgaggggctctca

SEQ ID NO: 183850 - DNA, 16 bp, Homo sapiens
gtcgaggggctctcag

SEQ ID NO: 183851 - DNA, 18 bp, Homo sapiens
gtcgggagttcgagacca

SEQ ID NO: 183852 - DNA, 13 bp, Homo sapiens
gtctaggagctgg

SEQ ID NO: 183853 - DNA, 13 bp, Homo sapiens
gtctattctagtc

SEQ ID NO: 183854 - DNA, 10 bp, Homo sapiens
gtctatttaa

SEQ ID NO: 183855 - DNA, 12 bp, Homo sapiens
gtctatttaagc

SEQ ID NO: 183856 - DNA, 17 bp, Homo sapiens
gtctcaggctggtggga

SEQ ID NO: 183857 - DNA, 22 bp, Homo sapiens
gtctcaggctggtgggaggggc

SEQ ID NO: 183858 - DNA, 22 bp, Homo sapiens
gtgggctggtgacccagtcaga

SEQ ID NO: 183859 - DNA, 15 bp, Homo sapiens
gtggggattgcccat

SEQ ID NO: 183860 - DNA, 19 bp, Homo sapiens
gtggggcagcacagagagg

SEQ ID NO: 183861 - DNA, 14 bp, Homo sapiens
gtggggctgctcct

SEQ ID NO: 183862 - DNA, 20 bp, Homo sapiens
gtgggggatcacagcctctg

SEQ ID NO: 183863 - DNA, 17 bp, Homo sapiens
gtgggggcagagggcag

SEQ ID NO: 183864 - DNA, 22 bp, Homo sapiens
gtgggggcagagggcagaggct

SEQ ID NO: 183865 - DNA, 17 bp, Homo sapiens
gtggggtctccctctcc

SEQ ID NO: 183866 - DNA, 21 bp, Homo sapiens
gtggggtctccctctcctgcc

SEQ ID NO: 183867 - DNA, 17 bp, Homo sapiens
gtgggtactattctgat

SEQ ID NO: 183868 - DNA, 13 bp, Homo sapiens
gtgggtcttcagg

SEQ ID NO: 183869 - DNA, 23 bp, Homo sapiens
gtgggtgagatgctggagaagag

SEQ ID NO: 183870 - DNA, 13 bp, Homo sapiens
gtggtccccaaca

SEQ ID NO: 183871 - DNA, 14 bp, Homo sapiens
gtggtctgcaggca

SEQ ID NO: 183872 - DNA, 23 bp, Homo sapiens
gtgtaattttgttctagttttca

SEQ ID NO: 183873 - DNA, 15 bp, Homo sapiens
gtgtaggcagacaca

SEQ ID NO: 183874 - DNA, 16 bp, Homo sapiens
gtgtcagcatagaagt

SEQ ID NO: 183875 - DNA, 17 bp, Homo sapiens
gtgtccaagtgtgtgtg

SEQ ID NO: 183876 - DNA, 13 bp, Homo sapiens
gtgtccacctggc

SEQ ID NO: 183877 - DNA, 18 bp, Homo sapiens
gtgtccacgactgtctcc

SEQ ID NO: 183878 - DNA, 18 bp, Homo sapiens
gtgtccccctctgtccag

SEQ ID NO: 183879 - DNA, 13 bp, Homo sapiens
gtgtcccctccac

SEQ ID NO: 183880 - DNA, 20 bp, Homo sapiens
gtgtcccctccactgtcaca

SEQ ID NO: 183881 - DNA, 14 bp, Homo sapiens
gtgtccggtccctg

SEQ ID NO: 183882 - DNA, 14 bp, Homo sapiens
gtgtcctaggagta

SEQ ID NO: 183883 - DNA, 15 bp, Homo sapiens
gtgtcctcacggtgc

SEQ ID NO: 183884 - DNA, 18 bp, Homo sapiens
gtgtccttgcacctgcat

SEQ ID NO: 183885 - DNA, 22 bp, Homo sapiens
gtgtctcagtccacctgagctg

SEQ ID NO: 183886 - DNA, 22 bp, Homo sapiens
gtgtctgagccctcaaagtgag

SEQ ID NO: 183887 - DNA, 21 bp, Homo sapiens
gtgtgaccactgcagaagaca

SEQ ID NO: 183888 - DNA, 17 bp, Homo sapiens
gtgtgactactccccca

SEQ ID NO: 183889 - DNA, 21 bp, Homo sapiens
gtgtgccatagagtttaacac

SEQ ID NO: 183890 - DNA, 18 bp, Homo sapiens
gtgtgttttcataataaa

SEQ ID NO: 183891 - DNA, 23 bp, Homo sapiens
gtgttagggaagggcctgccaca

SEQ ID NO: 183892 - DNA, 17 bp, Homo sapiens
gtgttatttaaatgagt

SEQ ID NO: 183893 - DNA, 13 bp, Homo sapiens
gtgttgcagaagg

SEQ ID NO: 183894 - DNA, 19 bp, Homo sapiens
gtgttgccaaatatgtcct

SEQ ID NO: 183895 - DNA, 20 bp, Homo sapiens
gtgttgccaaatatgtcctg

SEQ ID NO: 183896 - DNA, 20 bp, Homo sapiens
gtgttgcccaggctggtctc

SEQ ID NO: 183897 - DNA, 14 bp, Homo sapiens
gtgttgggatactg

SEQ ID NO: 183898 - DNA, 20 bp, Homo sapiens
gttaaagtcagtgggaacgt

SEQ ID NO: 183899 - DNA, 19 bp, Homo sapiens
gttaaatagagtatatgca

SEQ ID NO: 183900 - DNA, 20 bp, Homo sapiens
gttaaatagagtatatgcac

SEQ ID NO: 183901 - DNA, 21 bp, Homo sapiens
gttaaatagagtatatgcact

SEQ ID NO: 183902 - DNA, 17 bp, Homo sapiens
gttaaattgctgtgtat

SEQ ID NO: 183903 - DNA, 17 bp, Homo sapiens
gttaaggctgaggaaag

SEQ ID NO: 183904 - DNA, 14 bp, Homo sapiens
gttaagtatgtgta

SEQ ID NO: 183905 - DNA, 17 bp, Homo sapiens
gttactaactaaactct

SEQ ID NO: 183906 - DNA, 14 bp, Homo sapiens
gttactcagccctg

SEQ ID NO: 183907 - DNA, 17 bp, Homo sapiens
gttactcagccctgggc

SEQ ID NO: 183908 - DNA, 18 bp, Homo sapiens
gttactctccaacctgga

SEQ ID NO: 183909 - DNA, 16 bp, Homo sapiens
gttactgttatagagg

SEQ ID NO: 183910 - DNA, 23 bp, Homo sapiens
gttacttcactttaattctcatg

SEQ ID NO: 183911 - DNA, 17 bp, Homo sapiens
gttaggaaataaaacct

SEQ ID NO: 183912 - DNA, 21 bp, Homo sapiens
gttaggaaataaaacctttca

SEQ ID NO: 183913 - DNA, 23 bp, Homo sapiens
gttaggatttaacagtcatttaa

SEQ ID NO: 183914 - DNA, 13 bp, Homo sapiens
gttagggaggggt

SEQ ID NO: 183915 - DNA, 18 bp, Homo sapiens
gttaggtagagggagttg

SEQ ID NO: 183916 - DNA, 12 bp, Homo sapiens
gttagtcatttg

SEQ ID NO: 183917 - DNA, 14 bp, Homo sapiens
gttataaagataca

SEQ ID NO: 183918 - DNA, 15 bp, Homo sapiens
gttataaagatacag

SEQ ID NO: 183919 - DNA, 22 bp, Homo sapiens
gttatcaccgtgggctccctga

SEQ ID NO: 183920 - DNA, 22 bp, Homo sapiens
gttattagagattacctcctga

SEQ ID NO: 183921 - DNA, 10 bp, Homo sapiens
gttatttaaa

SEQ ID NO: 183922 - DNA, 14 bp, Homo sapiens
gttatttatatatt

SEQ ID NO: 183923 - DNA, 19 bp, Homo sapiens
gttatttgttattttcagt

SEQ ID NO: 183924 - DNA, 13 bp, Homo sapiens
gttcaaagccagc

SEQ ID NO: 183925 - DNA, 11 bp, Homo sapiens
gttcaccagcc

SEQ ID NO: 183926 - DNA, 12 bp, Homo sapiens
gttcaccagcct

SEQ ID NO: 183927 - DNA, 16 bp, Homo sapiens
gttcacccacagggct

SEQ ID NO: 183928 - DNA, 14 bp, Homo sapiens
gttcacccctccac

SEQ ID NO: 183929 - DNA, 19 bp, Homo sapiens
gttcacgtgcagctcaagg

SEQ ID NO: 183930 - DNA, 15 bp, Homo sapiens
gttcactaaagcagt

SEQ ID NO: 183931 - DNA, 24 bp, Homo sapiens
gttcactctacttagcatgtccct

SEQ ID NO: 183932 - DNA, 16 bp, Homo sapiens
gttcacttttgacaaa

SEQ ID NO: 183933 - DNA, 17 bp, Homo sapiens
gttcagagactcagggc

SEQ ID NO: 183934 - DNA, 15 bp, Homo sapiens
gttcagcccctcctc

SEQ ID NO: 183935 - DNA, 19 bp, Homo sapiens
gttcagcccctcctctgcc

SEQ ID NO: 183936 - DNA, 20 bp, Homo sapiens
gttcagcccctcctctgcca

SEQ ID NO: 183937 - DNA, 22 bp, Homo sapiens
gttcatatgtaccatgtacatg

SEQ ID NO: 183938 - DNA, 20 bp, Homo sapiens
gttccacgtccccctggggc

SEQ ID NO: 183939 - DNA, 18 bp, Homo sapiens
gttccccatctgggtcct

SEQ ID NO: 183940 - DNA, 13 bp, Homo sapiens
gttccccttccac

SEQ ID NO: 183941 - DNA, 13 bp, Homo sapiens
gttcctcgccctg

SEQ ID NO: 183942 - DNA, 14 bp, Homo sapiens
gttccttactgcag

SEQ ID NO: 183943 - DNA, 13 bp, Homo sapiens
gttcgtagctttc

SEQ ID NO: 183944 - DNA, 19 bp, Homo sapiens
gttctaagtctttccattg

SEQ ID NO: 183945 - DNA, 13 bp, Homo sapiens
gttctagttttca

SEQ ID NO: 183946 - DNA, 14 bp, Homo sapiens
gttctagttttcag

SEQ ID NO: 183947 - DNA, 17 bp, Homo sapiens
gttctcaggtgttgcca

SEQ ID NO: 183948 - DNA, 17 bp, Homo sapiens
gttctcctctcccctct

SEQ ID NO: 183949 - DNA, 18 bp, Homo sapiens
gttctcctctcccctcta

SEQ ID NO: 183950 - DNA, 15 bp, Homo sapiens
gttctgctcatcatt

SEQ ID NO: 183951 - DNA, 21 bp, Homo sapiens
gttctggccctcacccctgcc

SEQ ID NO: 183952 - DNA, 23 bp, Homo sapiens
gttctggccctcacccctgccct

SEQ ID NO: 183953 - DNA, 17 bp, Homo sapiens
gttctgtctcatatgat

SEQ ID NO: 183954 - DNA, 15 bp, Homo sapiens
gttctttcttcctct

SEQ ID NO: 183955 - DNA, 17 bp, Homo sapiens
gttctttcttcctctgc

SEQ ID NO: 183956 - DNA, 13 bp, Homo sapiens
gttcttttaaagg

SEQ ID NO: 183957 - DNA, 22 bp, Homo sapiens
gttgaaaagactccaaagaaat

SEQ ID NO: 183958 - DNA, 13 bp, Homo sapiens
gttgaagctctgg

SEQ ID NO: 183959 - DNA, 19 bp, Homo sapiens
gttgaatgacaacagaagc

SEQ ID NO: 183960 - DNA, 20 bp, Homo sapiens
gttgagaattgtgctcaaaa

SEQ ID NO: 183961 - DNA, 19 bp, Homo sapiens
gttgagggaacagacagga

SEQ ID NO: 183962 - DNA, 17 bp, Homo sapiens
gttgcaaggccgctgtt

SEQ ID NO: 183963 - DNA, 23 bp, Homo sapiens
gttgcaaggccgctgttcaccca

SEQ ID NO: 183964 - DNA, 20 bp, Homo sapiens
gttgcacacccactcagctc

SEQ ID NO: 183965 - DNA, 19 bp, Homo sapiens
gttgccaaatatgtcctgg

SEQ ID NO: 183966 - DNA, 18 bp, Homo sapiens
gttgctccgcctctgctg

SEQ ID NO: 183967 - DNA, 22 bp, Homo sapiens
gttgctccgcctctgctggcac

SEQ ID NO: 183968 - DNA, 19 bp, Homo sapiens
gttgctgtcataagaatga

SEQ ID NO: 183969 - DNA, 15 bp, Homo sapiens
gttggaaaagaatac

SEQ ID NO: 183970 - DNA, 15 bp, Homo sapiens
gttggtgttgcagaa

SEQ ID NO: 183971 - DNA, 14 bp, Homo sapiens
gttgtaaatatata

SEQ ID NO: 183972 - DNA, 19 bp, Homo sapiens
gttgtctgaagtcactgca

SEQ ID NO: 183973 - DNA, 17 bp, Homo sapiens
gttgtggtgctgacaaa

SEQ ID NO: 183974 - DNA, 16 bp, Homo sapiens
gttgttatggaaactg

SEQ ID NO: 183975 - DNA, 19 bp, Homo sapiens
gttgttttttgaaaacatg

SEQ ID NO: 183976 - DNA, 16 bp, Homo sapiens
gtttaaaatcatttct

SEQ ID NO: 183977 - DNA, 23 bp, Homo sapiens
gtttaagaaaaaataacacacat

SEQ ID NO: 183978 - DNA, 15 bp, Homo sapiens
gtttaatatttaaac

SEQ ID NO: 183979 - DNA, 16 bp, Homo sapiens
gtttacaatttacaaa

SEQ ID NO: 183980 - DNA, 19 bp, Homo sapiens
gtttacaatttacaaagtg

SEQ ID NO: 183981 - DNA, 16 bp, Homo sapiens
gtttactatgcctgtg

SEQ ID NO: 183982 - DNA, 17 bp, Homo sapiens
gtttactatgcctgtgt

SEQ ID NO: 183983 - DNA, 20 bp, Homo sapiens
gtttactatgcctgtgtctt

SEQ ID NO: 183984 - DNA, 13 bp, Homo sapiens
gtttagaaagctt

SEQ ID NO: 183985 - DNA, 20 bp, Homo sapiens
gtttatagagggccaagact

SEQ ID NO: 183986 - DNA, 21 bp, Homo sapiens
gtttatagagggccaagactt

SEQ ID NO: 183987 - DNA, 14 bp, Homo sapiens
gtttatgattccac

SEQ ID NO: 183988 - DNA, 13 bp, Homo sapiens
gtttattaacaaa

SEQ ID NO: 183989 - DNA, 15 bp, Homo sapiens
gtttcaaaataaaaa

SEQ ID NO: 183990 - DNA, 15 bp, Homo sapiens
gtttcaattcagtgc

SEQ ID NO: 183991 - DNA, 22 bp, Homo sapiens
gtttcaattccacctgcaatca

SEQ ID NO: 183992 - DNA, 22 bp, Homo sapiens
gtttcaattgcatctcccagat

SEQ ID NO: 183993 - DNA, 20 bp, Homo sapiens
gtttcactgacttagaacca

SEQ ID NO: 183994 - DNA, 16 bp, Homo sapiens
gtttcagatatatatc

SEQ ID NO: 183995 - DNA, 16 bp, Homo sapiens
gtttcattctcctgcc

SEQ ID NO: 183996 - DNA, 19 bp, Homo sapiens
gtttcatttagtcatgtga

SEQ ID NO: 183997 - DNA, 23 bp, Homo sapiens
gtttccaatgtttagcaaataca

SEQ ID NO: 183998 - DNA, 16 bp, Homo sapiens
gtttcctcaggctgct

SEQ ID NO: 183999 - DNA, 22 bp, Homo sapiens
gtttcctcaggctgctggagga

SEQ ID NO: 184000 - DNA, 14 bp, Homo sapiens
gtttccttcagtgc

SEQ ID NO: 184001 - DNA, 23 bp, Homo sapiens
gtttctagctagaaatatgattt

SEQ ID NO: 184002 - DNA, 14 bp, Homo sapiens
gtttctcagctccc

SEQ ID NO: 184003 - DNA, 12 bp, Homo sapiens
gtttctctgctg

SEQ ID NO: 184004 - DNA, 17 bp, Homo sapiens
gtttcttttgtatgtaa

SEQ ID NO: 184005 - DNA, 20 bp, Homo sapiens
gtttcttttgtatgtaaatg

SEQ ID NO: 184006 - DNA, 16 bp, Homo sapiens
taggtcaagaagaaga

SEQ ID NO: 184007 - DNA, 18 bp, Homo sapiens
taggtcaagaagaagatg

SEQ ID NO: 184008 - DNA, 18 bp, Homo sapiens
taggtgctacaaaaacac

SEQ ID NO: 184009 - DNA, 16 bp, Homo sapiens
taggtgtcatttccat

SEQ ID NO: 184010 - DNA, 17 bp, Homo sapiens
taggtgtgggggaagca

SEQ ID NO: 184011 - DNA, 22 bp, Homo sapiens
taggttaattccaattatatga

SEQ ID NO: 184012 - DNA, 21 bp, Homo sapiens
taggttggcaaaaaggcagga

SEQ ID NO: 184013 - DNA, 15 bp, Homo sapiens
taggtttttttgtat

SEQ ID NO: 184014 - DNA, 23 bp, Homo sapiens
tagtaccaatcattttaattatt

SEQ ID NO: 184015 - DNA, 17 bp, Homo sapiens
tagtagccctttctgtg

SEQ ID NO: 184016 - DNA, 19 bp, Homo sapiens
tagtagccctttctgtgtg

SEQ ID NO: 184017 - DNA, 18 bp, Homo sapiens
tagtcaaaccataaactt

SEQ ID NO: 184018 - DNA, 20 bp, Homo sapiens
tagtcccagctactcaggag

SEQ ID NO: 184019 - DNA, 12 bp, Homo sapiens
tagtctcaggac

SEQ ID NO: 184020 - DNA, 15 bp, Homo sapiens
tagtcttcaagcaga

SEQ ID NO: 184021 - DNA, 13 bp, Homo sapiens
tagtgatggttcc

SEQ ID NO: 184022 - DNA, 22 bp, Homo sapiens
tagtggggtctccctctcctgc

SEQ ID NO: 184023 - DNA, 22 bp, Homo sapiens
tagtgtaaaataagaatgattt

SEQ ID NO: 184024 - DNA, 20 bp, Homo sapiens
tagttaggatagcatttttg

SEQ ID NO: 184025 - DNA, 15 bp, Homo sapiens
tagttatagtttcag

SEQ ID NO: 184026 - DNA, 15 bp, Homo sapiens
tagttcgtagctttc

SEQ ID NO: 184027 - DNA, 15 bp, Homo sapiens
tagttgctccgcctc

SEQ ID NO: 184028 - DNA, 21 bp, Homo sapiens
tagttgtaccgcaatgtgact

SEQ ID NO: 184029 - DNA, 21 bp, Homo sapiens
tagtttgattattcagtgtca

SEQ ID NO: 184030 - DNA, 17 bp, Homo sapiens
tagtttttgtaatttat

SEQ ID NO: 184031 - DNA, 21 bp, Homo sapiens
tataaaaagaaaagataaaga

SEQ ID NO: 184032 - DNA, 19 bp, Homo sapiens
tataaaactgcgttaaagg

SEQ ID NO: 184033 - DNA, 22 bp, Homo sapiens
tataaaactgcgttaaaggctc

SEQ ID NO: 184034 - DNA, 13 bp, Homo sapiens
tataaaataaata

SEQ ID NO: 184035 - DNA, 15 bp, Homo sapiens
tataaaataaatata

SEQ ID NO: 184036 - DNA, 19 bp, Homo sapiens
tataaaataaatatatata

SEQ ID NO: 184037 - DNA, 16 bp, Homo sapiens
gtctcaggtccctgca

SEQ ID NO: 184038 - DNA, 11 bp, Homo sapiens
gtctcatccca

SEQ ID NO: 184039 - DNA, 23 bp, Homo sapiens
gtctcgctttgttgcccaggctg

SEQ ID NO: 184040 - DNA, 16 bp, Homo sapiens
gtctcttctccactgg

SEQ ID NO: 184041 - DNA, 17 bp, Homo sapiens
gtctcttctccactgga

SEQ ID NO: 184042 - DNA, 15 bp, Homo sapiens
gtctgaacagctgta

SEQ ID NO: 184043 - DNA, 16 bp, Homo sapiens
gtctgaagtcactgca

SEQ ID NO: 184044 - DNA, 19 bp, Homo sapiens
gtctgcagcccggcgccac

SEQ ID NO: 184045 - DNA, 13 bp, Homo sapiens
gtctgcaggcagg

SEQ ID NO: 184046 - DNA, 15 bp, Homo sapiens
gtctgccagccagca

SEQ ID NO: 184047 - DNA, 20 bp, Homo sapiens
gtctgctctttctctgccag

SEQ ID NO: 184048 - DNA, 15 bp, Homo sapiens
gtctggcttcacaga

SEQ ID NO: 184049 - DNA, 23 bp, Homo sapiens
gtctggggttcagcccctcctct

SEQ ID NO: 184050 - DNA, 21 bp, Homo sapiens
gtctgttccccatggccactt

SEQ ID NO: 184051 - DNA, 23 bp, Homo sapiens
gtcttagaagtggaccaggacag

SEQ ID NO: 184052 - DNA, 14 bp, Homo sapiens
gtcttatttcctca

SEQ ID NO: 184053 - DNA, 15 bp, Homo sapiens
gtcttcacggcagga

SEQ ID NO: 184054 - DNA, 12 bp, Homo sapiens
gtcttcagccta

SEQ ID NO: 184055 - DNA, 13 bp, Homo sapiens
gtcttcagcctag

SEQ ID NO: 184056 - DNA, 23 bp, Homo sapiens
gtcttcagcctagccgacctcag

SEQ ID NO: 184057 - DNA, 22 bp, Homo sapiens
gtcttcagcctctttctgtccc

SEQ ID NO: 184058 - DNA, 16 bp, Homo sapiens
gtcttcagtaagccgt

SEQ ID NO: 184059 - DNA, 12 bp, Homo sapiens
gtcttcctgagt

SEQ ID NO: 184060 - DNA, 17 bp, Homo sapiens
gtcttcctgcattcacc

SEQ ID NO: 184061 - DNA, 15 bp, Homo sapiens
gtcttctcaggctct

SEQ ID NO: 184062 - DNA, 18 bp, Homo sapiens
gtcttctcaggctctgcc

SEQ ID NO: 184063 - DNA, 20 bp, Homo sapiens
gtcttctccaccacgctggg

SEQ ID NO: 184064 - DNA, 20 bp, Homo sapiens
gtcttggcagcacctgtctc

SEQ ID NO: 184065 - DNA, 21 bp, Homo sapiens
gtctttcaggaccttttgaag

SEQ ID NO: 184066 - DNA, 16 bp, Homo sapiens
gtctttgtaatgtcac

SEQ ID NO: 184067 - DNA, 18 bp, Homo sapiens
gtctttgtaatgtcacca

SEQ ID NO: 184068 - DNA, 19 bp, Homo sapiens
gtctttgtaatgtcaccac

SEQ ID NO: 184069 - DNA, 21 bp, Homo sapiens
gtctttgtaatgtcaccacct

SEQ ID NO: 184070 - DNA, 14 bp, Homo sapiens
gtgaaaagaaaaat

SEQ ID NO: 184071 - DNA, 17 bp, Homo sapiens
gtgaaaatggtccagga

SEQ ID NO: 184072 - DNA, 21 bp, Homo sapiens
gtgaacaaatttacagagaca

SEQ ID NO: 184073 - DNA, 15 bp, Homo sapiens
gtgaacacatcagct

SEQ ID NO: 184074 - DNA, 14 bp, Homo sapiens
gtgaacgatttaga

SEQ ID NO: 184075 - DNA, 23 bp, Homo sapiens
gtgaagaaaagtgaatgctcaag

SEQ ID NO: 184076 - DNA, 15 bp, Homo sapiens
gtgaaggaatatatg

SEQ ID NO: 184077 - DNA, 21 bp, Homo sapiens
gtgaatgatgatcctaggcat

SEQ ID NO: 184078 - DNA, 22 bp, Homo sapiens
gtgaattcttgaaggaaaatga

SEQ ID NO: 184079 - DNA, 15 bp, Homo sapiens
gtgacagacaggctc

SEQ ID NO: 184080 - DNA, 20 bp, Homo sapiens
gtgacatgcgggctgggcag

SEQ ID NO: 184081 - DNA, 21 bp, Homo sapiens
gtgacatgcgggctgggcagc

SEQ ID NO: 184082 - DNA, 22 bp, Homo sapiens
gtgacatgcgggctgggcagct

SEQ ID NO: 184083 - DNA, 22 bp, Homo sapiens
gtgacatttgggagacatgtga

SEQ ID NO: 184084 - DNA, 15 bp, Homo sapiens
gtgaccaatgtcttg

SEQ ID NO: 184085 - DNA, 16 bp, Homo sapiens
gtgaccaatgtcttga

SEQ ID NO: 184086 - DNA, 16 bp, Homo sapiens
gtgactgccccaactc

SEQ ID NO: 184087 - DNA, 21 bp, Homo sapiens
gtgactgccccaactcctgga

SEQ ID NO: 184088 - DNA, 23 bp, Homo sapiens
gtgactgccccaactcctggaag

SEQ ID NO: 184089 - DNA, 18 bp, Homo sapiens
gtgactgtggcacacgcc

SEQ ID NO: 184090 - DNA, 17 bp, Homo sapiens
gtgacttgtgtcccatg

SEQ ID NO: 184091 - DNA, 13 bp, Homo sapiens
gtgagagtgagct

SEQ ID NO: 184092 - DNA, 15 bp, Homo sapiens
gtgagatgctggaga

SEQ ID NO: 184093 - DNA, 17 bp, Homo sapiens
gtgagatgctggagaag

SEQ ID NO: 184094 - DNA, 20 bp, Homo sapiens
gtgagatgctggagaagaga

SEQ ID NO: 184095 - DNA, 21 bp, Homo sapiens
gtgagcaagaagtcaaagtaa

SEQ ID NO: 184096 - DNA, 19 bp, Homo sapiens
gtgagcactcccaagtcta

SEQ ID NO: 184097 - DNA, 17 bp, Homo sapiens
gtgagcagactggtggg

SEQ ID NO: 184098 - DNA, 18 bp, Homo sapiens
gtgagccgcatcttctcc

SEQ ID NO: 184099 - DNA, 16 bp, Homo sapiens
gtgagcctggctcttg

SEQ ID NO: 184100 - DNA, 21 bp, Homo sapiens
gtgaggatggcctctgctaag

SEQ ID NO: 184101 - DNA, 19 bp, Homo sapiens
gtgaggatgggaaggaggg

SEQ ID NO: 184102 - DNA, 14 bp, Homo sapiens
gtgaggccagggca

SEQ ID NO: 184103 - DNA, 23 bp, Homo sapiens
gtgagtgtgtccaagtgtgtgtg

SEQ ID NO: 184104 - DNA, 15 bp, Homo sapiens
gtgatgaactttctc

SEQ ID NO: 184105 - DNA, 17 bp, Homo sapiens
gtgatgggaaagcattg

SEQ ID NO: 184106 - DNA, 22 bp, Homo sapiens
gtgatggttcccctgttcactc

SEQ ID NO: 184107 - DNA, 11 bp, Homo sapiens
gtgattaccag

SEQ ID NO: 184108 - DNA, 19 bp, Homo sapiens
gtgattcctttgaagagga

SEQ ID NO: 184109 - DNA, 20 bp, Homo sapiens
gtgcaagtatgtgagtgtgt

SEQ ID NO: 184110 - DNA, 22 bp, Homo sapiens
gtgcacagacgtccctccacgt

SEQ ID NO: 184111 - DNA, 23 bp, Homo sapiens
gtgcaccatccctttttgaagtg

SEQ ID NO: 184112 - DNA, 21 bp, Homo sapiens
gtgcaccttaccaactttctg

SEQ ID NO: 184113 - DNA, 14 bp, Homo sapiens
gtgcagactggagg

SEQ ID NO: 184114 - DNA, 15 bp, Homo sapiens
gtgcagactggaggg

SEQ ID NO: 184115 - DNA, 23 bp, Homo sapiens
gtgcagactggaggggacgctgg

SEQ ID NO: 184116 - DNA, 15 bp, Homo sapiens
gtgcagcatatgagg

SEQ ID NO: 184117 - DNA, 16 bp, Homo sapiens
gtgcagtcctgatcag

SEQ ID NO: 184118 - DNA, 19 bp, Homo sapiens
gtgcagtggcccccacaga

SEQ ID NO: 184119 - DNA, 18 bp, Homo sapiens
gtgcatctcagcccacat

SEQ ID NO: 184120 - DNA, 16 bp, Homo sapiens
gtgcatgctctctgca

SEQ ID NO: 184121 - DNA, 19 bp, Homo sapiens
gtgcattcttttaaaagac

SEQ ID NO: 184122 - DNA, 22 bp, Homo sapiens
gtgccaaacaaaaaggttctca

SEQ ID NO: 184123 - DNA, 17 bp, Homo sapiens
gtgccaagcacagtgcc

SEQ ID NO: 184124 - DNA, 22 bp, Homo sapiens
gtgcccagaactggactcagga

SEQ ID NO: 184125 - DNA, 20 bp, Homo sapiens
gtgcccagctatacctgtgc

SEQ ID NO: 184126 - DNA, 22 bp, Homo sapiens
gtgcccagctatacctgtgcct

SEQ ID NO: 184127 - DNA, 20 bp, Homo sapiens
gtgccccccttgccagacat

SEQ ID NO: 184128 - DNA, 12 bp, Homo sapiens
gtgccctgcccc

SEQ ID NO: 184129 - DNA, 16 bp, Homo sapiens
gtgcccttggaggcca

SEQ ID NO: 184130 - DNA, 15 bp, Homo sapiens
gtgcctgtgaggcag

SEQ ID NO: 184131 - DNA, 14 bp, Homo sapiens
gtgccttacctcct

SEQ ID NO: 184132 - DNA, 15 bp, Homo sapiens
gtgccttacctcctg

SEQ ID NO: 184133 - DNA, 20 bp, Homo sapiens
gtgccttacctcctgcccag

SEQ ID NO: 184134 - DNA, 23 bp, Homo sapiens
gtgccttcttattctcactccac

SEQ ID NO: 184135 - DNA, 22 bp, Homo sapiens
gtgccttttttcacggaagttt

SEQ ID NO: 184136 - DNA, 14 bp, Homo sapiens
gtgcgagtgtgtgc

SEQ ID NO: 184137 - DNA, 12 bp, Homo sapiens
gtgcgtgggtga

SEQ ID NO: 184138 - DNA, 13 bp, Homo sapiens
gtgcgtgtgtcca

SEQ ID NO: 184139 - DNA, 13 bp, Homo sapiens
gtgctcagggctg

SEQ ID NO: 184140 - DNA, 18 bp, Homo sapiens
gtgctccctaccacctcc

SEQ ID NO: 184141 - DNA, 21 bp, Homo sapiens
gtgctgccacacttcaggctc

SEQ ID NO: 184142 - DNA, 21 bp, Homo sapiens
gtgctgcccgtcttcagccta

SEQ ID NO: 184143 - DNA, 18 bp, Homo sapiens
gtgctggaattctaacaa

SEQ ID NO: 184144 - DNA, 24 bp, Homo sapiens
gtgctggaggtgggagcaggagat

SEQ ID NO: 184145 - DNA, 15 bp, Homo sapiens
gtgctgtgcccaagt

SEQ ID NO: 184146 - DNA, 21 bp, Homo sapiens
gtgcttatcccatagccagga

SEQ ID NO: 184147 - DNA, 18 bp, Homo sapiens
gtggaagccctccttcca

SEQ ID NO: 184148 - DNA, 16 bp, Homo sapiens
gtggacttagaaagca

SEQ ID NO: 184149 - DNA, 22 bp, Homo sapiens
gtggacttagaaagcaggggct

SEQ ID NO: 184150 - DNA, 12 bp, Homo sapiens
gtggagggccac

SEQ ID NO: 184151 - DNA, 21 bp, Homo sapiens
gtggaggttaaggctgaggaa

SEQ ID NO: 184152 - DNA, 13 bp, Homo sapiens
gtggatcacagag

SEQ ID NO: 184153 - DNA, 15 bp, Homo sapiens
gtggatcacagaggc

SEQ ID NO: 184154 - DNA, 16 bp, Homo sapiens
gtggatcacagaggct

SEQ ID NO: 184155 - DNA, 14 bp, Homo sapiens
gtggcaccagcagc

SEQ ID NO: 184156 - DNA, 20 bp, Homo sapiens
gtggcagataatcagcctct

SEQ ID NO: 184157 - DNA, 15 bp, Homo sapiens
gtggcatagcccaga

SEQ ID NO: 184158 - DNA, 14 bp, Homo sapiens
gtggcatcacctta

SEQ ID NO: 184159 - DNA, 20 bp, Homo sapiens
gtggcatcaccttaggcagg

SEQ ID NO: 184160 - DNA, 21 bp, Homo sapiens
gtggccactccagacccctgg

SEQ ID NO: 184161 - DNA, 18 bp, Homo sapiens
gtggcccgacagcctggc

SEQ ID NO: 184162 - DNA, 18 bp, Homo sapiens
gtggccctggcctgctgg

SEQ ID NO: 184163 - DNA, 21 bp, Homo sapiens
gtggccctgtccctcccacct

SEQ ID NO: 184164 - DNA, 15 bp, Homo sapiens
gtggccttccccagc

SEQ ID NO: 184165 - DNA, 19 bp, Homo sapiens
gtggccttccccagcctct

SEQ ID NO: 184166 - DNA, 20 bp, Homo sapiens
gtggcgactctatagactct

SEQ ID NO: 184167 - DNA, 14 bp, Homo sapiens
gtggcggtgcctgg

SEQ ID NO: 184168 - DNA, 17 bp, Homo sapiens
gtggctagtcagagaga

SEQ ID NO: 184169 - DNA, 19 bp, Homo sapiens
gtggctagtcagagagagt

SEQ ID NO: 184170 - DNA, 15 bp, Homo sapiens
gtggctctgctggcc

SEQ ID NO: 184171 - DNA, 15 bp, Homo sapiens
gtggctgacccagtc

SEQ ID NO: 184172 - DNA, 21 bp, Homo sapiens
gtggctgggtccaggggatgg

SEQ ID NO: 184173 - DNA, 14 bp, Homo sapiens
gtggctgtcagcag

SEQ ID NO: 184174 - DNA, 19 bp, Homo sapiens
gtggcttcccgctcagccc

SEQ ID NO: 184175 - DNA, 17 bp, Homo sapiens
gtgggaacgtgactgcc

SEQ ID NO: 184176 - DNA, 17 bp, Homo sapiens
gtgggaagcgtctgtcc

SEQ ID NO: 184177 - DNA, 14 bp, Homo sapiens
gtgggagggagcag

SEQ ID NO: 184178 - DNA, 20 bp, Homo sapiens
gtgggcacgctgtgggcagg

SEQ ID NO: 184179 - DNA, 21 bp, Homo sapiens
gtgggcacgctgtgggcaggt

SEQ ID NO: 184180 - DNA, 18 bp, Homo sapiens
gtgggccaggacaggccc

SEQ ID NO: 184181 - DNA, 20 bp, Homo sapiens
gtgggcctcctctgtccagg

SEQ ID NO: 184182 - DNA, 13 bp, Homo sapiens
gtgggctccctga

SEQ ID NO: 184183 - DNA, 14 bp, Homo sapiens
gtgggctccctgac

SEQ ID NO: 184184 - DNA, 15 bp, Homo sapiens
gtttgagctcagacc

SEQ ID NO: 184185 - DNA, 22 bp, Homo sapiens
gtttgcagaaaagcacctgccg

SEQ ID NO: 184186 - DNA, 16 bp, Homo sapiens
gtttgcagatgacaaa

SEQ ID NO: 184187 - DNA, 17 bp, Homo sapiens
gtttgctcacctggggt

SEQ ID NO: 184188 - DNA, 20 bp, Homo sapiens
gtttgctttgtatgcacttt

SEQ ID NO: 184189 - DNA, 17 bp, Homo sapiens
gtttggcaatagtttgc

SEQ ID NO: 184190 - DNA, 19 bp, Homo sapiens
gtttggcaatagtttgcat

SEQ ID NO: 184191 - DNA, 16 bp, Homo sapiens
gtttgggtatattcat

SEQ ID NO: 184192 - DNA, 19 bp, Homo sapiens
gtttgtggaaaatgaaaat

SEQ ID NO: 184193 - DNA, 19 bp, Homo sapiens
gttttaactagaatttatt

SEQ ID NO: 184194 - DNA, 23 bp, Homo sapiens
gttttacaataaaatcttgaaaa

SEQ ID NO: 184195 - DNA, 16 bp, Homo sapiens
gttttactgcagcttt

SEQ ID NO: 184196 - DNA, 14 bp, Homo sapiens
gttttatcatgaca

SEQ ID NO: 184197 - DNA, 22 bp, Homo sapiens
gttttatcatgacatgttatat

SEQ ID NO: 184198 - DNA, 20 bp, Homo sapiens
gttttccaggtttaagctgt

SEQ ID NO: 184199 - DNA, 23 bp, Homo sapiens
gttttcgcacctaccatcaggga

SEQ ID NO: 184200 - DNA, 15 bp, Homo sapiens
gttttctgagaaaga

SEQ ID NO: 184201 - DNA, 17 bp, Homo sapiens
gttttctgagaaagact

SEQ ID NO: 184202 - DNA, 17 bp, Homo sapiens
gttttgaactaataaaa

SEQ ID NO: 184203 - DNA, 17 bp, Homo sapiens
gttttggtggttttagt

SEQ ID NO: 184204 - DNA, 15 bp, Homo sapiens
gttttgtattctctg

SEQ ID NO: 184205 - DNA, 14 bp, Homo sapiens
gtttttaagctgtt

SEQ ID NO: 184206 - DNA, 15 bp, Homo sapiens
gtttttaagctgttt

SEQ ID NO: 184207 - DNA, 19 bp, Homo sapiens
gtttttaagctgtttccat

SEQ ID NO: 184208 - DNA, 19 bp, Homo sapiens
gtttttccttgtatttaaa

SEQ ID NO: 184209 - DNA, 16 bp, Homo sapiens
gtttttgtcttaaaaa

SEQ ID NO: 184210 - DNA, 20 bp, Homo sapiens
gtttttttttcctgtccttc

SEQ ID NO: 184211 - DNA, 21 bp, Homo sapiens
taaaaaaaaacctgagcccca

SEQ ID NO: 184212 - DNA, 16 bp, Homo sapiens
taaaaactgactcctt

SEQ ID NO: 184213 - DNA, 23 bp, Homo sapiens
taaaaagaaaagataaagatgat

SEQ ID NO: 184214 - DNA, 19 bp, Homo sapiens
taaaaagcctgcaatttca

SEQ ID NO: 184215 - DNA, 19 bp, Homo sapiens
taaaaatatggaacttcta

SEQ ID NO: 184216 - DNA, 21 bp, Homo sapiens
taaaaatattgtgttgtgaat

SEQ ID NO: 184217 - DNA, 19 bp, Homo sapiens
taaaaatggtttaaatggt

SEQ ID NO: 184218 - DNA, 13 bp, Homo sapiens
taaaacattaaga

SEQ ID NO: 184219 - DNA, 16 bp, Homo sapiens
taaaacattaagaaaa

SEQ ID NO: 184220 - DNA, 13 bp, Homo sapiens
taaaacctttcaa

SEQ ID NO: 184221 - DNA, 14 bp, Homo sapiens
taaaacctttcaaa

SEQ ID NO: 184222 - DNA, 20 bp, Homo sapiens
taaaacttgatgtgttatct

SEQ ID NO: 184223 - DNA, 13 bp, Homo sapiens
taaaactttaatc

SEQ ID NO: 184224 - DNA, 21 bp, Homo sapiens
taaaagaaagcctcagagaat

SEQ ID NO: 184225 - DNA, 23 bp, Homo sapiens
taaaagaatattttaacttcctt

SEQ ID NO: 184226 - DNA, 14 bp, Homo sapiens
taaaagatgaaaat

SEQ ID NO: 184227 - DNA, 12 bp, Homo sapiens
taaaagttactt

SEQ ID NO: 184228 - DNA, 14 bp, Homo sapiens
taaaataaatatat

SEQ ID NO: 184229 - DNA, 21 bp, Homo sapiens
taaaataactagtgttgcttg

SEQ ID NO: 184230 - DNA, 21 bp, Homo sapiens
taaaatagcaacactctatat

SEQ ID NO: 184231 - DNA, 18 bp, Homo sapiens
taaaatagcttgtatagt

SEQ ID NO: 184232 - DNA, 14 bp, Homo sapiens
taaaatatggctat

SEQ ID NO: 184233 - DNA, 13 bp, Homo sapiens
taaaatattcctg

SEQ ID NO: 184234 - DNA, 12 bp, Homo sapiens
taaaatatttat

SEQ ID NO: 184235 - DNA, 18 bp, Homo sapiens
taaaatcatttctgcatc

SEQ ID NO: 184236 - DNA, 13 bp, Homo sapiens
taaaatctgtcac

SEQ ID NO: 184237 - DNA, 19 bp, Homo sapiens
taaaatcttggcacagaaa

SEQ ID NO: 184238 - DNA, 20 bp, Homo sapiens
taaaatcttggcacagaaac

SEQ ID NO: 184239 - DNA, 21 bp, Homo sapiens
taaaatgaccagtaattgtga

SEQ ID NO: 184240 - DNA, 15 bp, Homo sapiens
taaaatgattgtaaa

SEQ ID NO: 184241 - DNA, 16 bp, Homo sapiens
taaaatgattgtaaaa

SEQ ID NO: 184242 - DNA, 15 bp, Homo sapiens
taaaatgattttatc

SEQ ID NO: 184243 - DNA, 18 bp, Homo sapiens
taaaatgattttatctgt

SEQ ID NO: 184244 - DNA, 17 bp, Homo sapiens
taaaatgcctcagtgta

SEQ ID NO: 184245 - DNA, 22 bp, Homo sapiens
taaaatgttcacttttgacaaa

SEQ ID NO: 184246 - DNA, 19 bp, Homo sapiens
taaaatgttgaaaagtcaa

SEQ ID NO: 184247 - DNA, 23 bp, Homo sapiens
taaacaaaatagaagctgtagta

SEQ ID NO: 184248 - DNA, 18 bp, Homo sapiens
taaacacgcctgcaaacg

SEQ ID NO: 184249 - DNA, 18 bp, Homo sapiens
taaacaggagacaggaag

SEQ ID NO: 184250 - DNA, 20 bp, Homo sapiens
taaacataattcttgtatat

SEQ ID NO: 184251 - DNA, 22 bp, Homo sapiens
taaacattaatcaatcatctgt

SEQ ID NO: 184252 - DNA, 13 bp, Homo sapiens
taaacctaaaaaa

SEQ ID NO: 184253 - DNA, 14 bp, Homo sapiens
taaactgactttat

SEQ ID NO: 184254 - DNA, 15 bp, Homo sapiens
taaactgactttatc

SEQ ID NO: 184255 - DNA, 10 bp, Homo sapiens
taaactgcat

SEQ ID NO: 184256 - DNA, 14 bp, Homo sapiens
taaactgtgcacca

SEQ ID NO: 184257 - DNA, 20 bp, Homo sapiens
taaacttcatggtcatgggt

SEQ ID NO: 184258 - DNA, 14 bp, Homo sapiens
taaagaaggtttca

SEQ ID NO: 184259 - DNA, 21 bp, Homo sapiens
taaagacagggaagagcagaa

SEQ ID NO: 184260 - DNA, 23 bp, Homo sapiens
taaagatacagaactctttcaaa

SEQ ID NO: 184261 - DNA, 17 bp, Homo sapiens
taaagcaatatgcattt

SEQ ID NO: 184262 - DNA, 13 bp, Homo sapiens
taaagcagtggac

SEQ ID NO: 184263 - DNA, 20 bp, Homo sapiens
taaagctaaaatgattttat

SEQ ID NO: 184264 - DNA, 17 bp, Homo sapiens
taaagctcgaaaacaat

SEQ ID NO: 184265 - DNA, 18 bp, Homo sapiens
taaagctgcctgtagtta

SEQ ID NO: 184266 - DNA, 19 bp, Homo sapiens
taaaggcaccatctaatag

SEQ ID NO: 184267 - DNA, 20 bp, Homo sapiens
taaaggcctcttccttgctg

SEQ ID NO: 184268 - DNA, 13 bp, Homo sapiens
taaagtatgtaaa

SEQ ID NO: 184269 - DNA, 21 bp, Homo sapiens
taaagtatgtaaagtatgtaa

SEQ ID NO: 184270 - DNA, 15 bp, Homo sapiens
taaagtgatatttcc

SEQ ID NO: 184271 - DNA, 23 bp, Homo sapiens
taaagttctgtactcaaatgtag

SEQ ID NO: 184272 - DNA, 21 bp, Homo sapiens
taaataagaaacaactctttg

SEQ ID NO: 184273 - DNA, 12 bp, Homo sapiens
taaatatataaa

SEQ ID NO: 184274 - DNA, 13 bp, Homo sapiens
taaatatataaat

SEQ ID NO: 184275 - DNA, 17 bp, Homo sapiens
taaatatataaatatat

SEQ ID NO: 184276 - DNA, 11 bp, Homo sapiens
taaatatatat

SEQ ID NO: 184277 - DNA, 13 bp, Homo sapiens
taaatatatataa

SEQ ID NO: 184278 - DNA, 14 bp, Homo sapiens
taaatatatataaa

SEQ ID NO: 184279 - DNA, 21 bp, Homo sapiens
taaatatatatatatataaaa

SEQ ID NO: 184280 - DNA, 22 bp, Homo sapiens
taaatatatttaagataattat

SEQ ID NO: 184281 - DNA, 21 bp, Homo sapiens
taaatatgttagcaaagagtt

SEQ ID NO: 184282 - DNA, 10 bp, Homo sapiens
taaatattta

SEQ ID NO: 184283 - DNA, 22 bp, Homo sapiens
taaatattttttcttttctatt

SEQ ID NO: 184284 - DNA, 19 bp, Homo sapiens
taaatcagccgtgtaacca

SEQ ID NO: 184285 - DNA, 17 bp, Homo sapiens
taaatcctttactgtta

SEQ ID NO: 184286 - DNA, 16 bp, Homo sapiens
taaatgtgcattcttt

SEQ ID NO: 184287 - DNA, 17 bp, Homo sapiens
taaattcacaatagaaa

SEQ ID NO: 184288 - DNA, 15 bp, Homo sapiens
taaattgctgtgtat

SEQ ID NO: 184289 - DNA, 15 bp, Homo sapiens
taaattttaatttat

SEQ ID NO: 184290 - DNA, 16 bp, Homo sapiens
taaattttgagttcta

SEQ ID NO: 184291 - DNA, 20 bp, Homo sapiens
taacaaactacatgtaatcc

SEQ ID NO: 184292 - DNA, 18 bp, Homo sapiens
taacaagaaactcacccc

SEQ ID NO: 184293 - DNA, 13 bp, Homo sapiens
taacaatttcctt

SEQ ID NO: 184294 - DNA, 21 bp, Homo sapiens
taacaatttcctttatattta

SEQ ID NO: 184295 - DNA, 18 bp, Homo sapiens
taacaccatgattaacca

SEQ ID NO: 184296 - DNA, 16 bp, Homo sapiens
taacaggtctcctctt

SEQ ID NO: 184297 - DNA, 18 bp, Homo sapiens
taacagtcatttaaaaaa

SEQ ID NO: 184298 - DNA, 14 bp, Homo sapiens
taacatatttacta

SEQ ID NO: 184299 - DNA, 23 bp, Homo sapiens
taacatatttactaagccacaag

SEQ ID NO: 184300 - DNA, 15 bp, Homo sapiens
taacatgtaggaagt

SEQ ID NO: 184301 - DNA, 11 bp, Homo sapiens
taaccaaaggt

SEQ ID NO: 184302 - DNA, 18 bp, Homo sapiens
taaccaaaggtgaaggaa

SEQ ID NO: 184303 - DNA, 21 bp, Homo sapiens
taaccaaaggtgaaggaatat

SEQ ID NO: 184304 - DNA, 16 bp, Homo sapiens
taaccacttcagctga

SEQ ID NO: 184305 - DNA, 15 bp, Homo sapiens
taaccagctgtaaca

SEQ ID NO: 184306 - DNA, 13 bp, Homo sapiens
taacccctttcct

SEQ ID NO: 184307 - DNA, 23 bp, Homo sapiens
taacccgctcatcactggatgaa

SEQ ID NO: 184308 - DNA, 20 bp, Homo sapiens
taacctatatgatttatagt

SEQ ID NO: 184309 - DNA, 17 bp, Homo sapiens
taacctcttcagaggcc

SEQ ID NO: 184310 - DNA, 17 bp, Homo sapiens
taacgccctatttttgc

SEQ ID NO: 184311 - DNA, 20 bp, Homo sapiens
taacgccctatttttgcaat

SEQ ID NO: 184312 - DNA, 15 bp, Homo sapiens
taacgcgtcttcctg

SEQ ID NO: 184313 - DNA, 16 bp, Homo sapiens
taacgcgtcttcctga

SEQ ID NO: 184314 - DNA, 14 bp, Homo sapiens
taactaaactctct

SEQ ID NO: 184315 - DNA, 15 bp, Homo sapiens
taactagaatttatt

SEQ ID NO: 184316 - DNA, 17 bp, Homo sapiens
taactagaatttattca

SEQ ID NO: 184317 - DNA, 17 bp, Homo sapiens
taactagtcctttacta

SEQ ID NO: 184318 - DNA, 17 bp, Homo sapiens
taactcatcataaaata

SEQ ID NO: 184319 - DNA, 16 bp, Homo sapiens
taactccaccaaccca

SEQ ID NO: 184320 - DNA, 14 bp, Homo sapiens
taactgaaggagaa

SEQ ID NO: 184321 - DNA, 23 bp, Homo sapiens
taactgccatcaagatgagagaa

SEQ ID NO: 184322 - DNA, 15 bp, Homo sapiens
taacttaattgctat

SEQ ID NO: 184323 - DNA, 23 bp, Homo sapiens
taacttatatcatcagcatacct

SEQ ID NO: 184324 - DNA, 17 bp, Homo sapiens
taacttgtttccaatgt

SEQ ID NO: 184325 - DNA, 22 bp, Homo sapiens
taagaaaatattttgtctaaaa

SEQ ID NO: 184326 - DNA, 17 bp, Homo sapiens
taccaatgaaaaaatgt

SEQ ID NO: 184327 - DNA, 22 bp, Homo sapiens
taccagacggttcaccagcctc

SEQ ID NO: 184328 - DNA, 21 bp, Homo sapiens
taccagcctccgtatttcaga

SEQ ID NO: 184329 - DNA, 20 bp, Homo sapiens
taccaggccgccccagcctc

SEQ ID NO: 184330 - DNA, 15 bp, Homo sapiens
taccatgtgcctgat

SEQ ID NO: 184331 - DNA, 14 bp, Homo sapiens
tacccacctcagcc

SEQ ID NO: 184332 - DNA, 15 bp, Homo sapiens
taccgcgttgtaaaa

SEQ ID NO: 184333 - DNA, 20 bp, Homo sapiens
tacctaattagagcagatga

SEQ ID NO: 184334 - DNA, 22 bp, Homo sapiens
tacctcaacccccatttctatt

SEQ ID NO: 184335 - DNA, 13 bp, Homo sapiens
tacctcctgagaa

SEQ ID NO: 184336 - DNA, 21 bp, Homo sapiens
tacctctcttatagaatattt

SEQ ID NO: 184337 - DNA, 20 bp, Homo sapiens
tacctgaaaacactgtgcac

SEQ ID NO: 184338 - DNA, 21 bp, Homo sapiens
tacctgaaaacactgtgcaca

SEQ ID NO: 184339 - DNA, 13 bp, Homo sapiens
taccttggttccc

SEQ ID NO: 184340 - DNA, 22 bp, Homo sapiens
taccttggttcccccactgatc

SEQ ID NO: 184341 - DNA, 22 bp, Homo sapiens
tacgcagcgtgctttaaaaaat

SEQ ID NO: 184342 - DNA, 22 bp, Homo sapiens
tacgccaggggaaaatcagcct

SEQ ID NO: 184343 - DNA, 14 bp, Homo sapiens
tactaactaaactc

SEQ ID NO: 184344 - DNA, 18 bp, Homo sapiens
tactacacattcaataag

SEQ ID NO: 184345 - DNA, 21 bp, Homo sapiens
tgaactttctcttcatacttt

SEQ ID NO: 184346 - DNA, 23 bp, Homo sapiens
tgaagagaccaagactctgaaat

SEQ ID NO: 184347 - DNA, 15 bp, Homo sapiens
tgaagagatttttca

SEQ ID NO: 184348 - DNA, 12 bp, Homo sapiens
tgaagaggaaaa

SEQ ID NO: 184349 - DNA, 16 bp, Homo sapiens
tgaagaggaaaatgaa

SEQ ID NO: 184350 - DNA, 20 bp, Homo sapiens
tgaagaggaaaatgaataat

SEQ ID NO: 184351 - DNA, 17 bp, Homo sapiens
tgaagatgtagaggaga

SEQ ID NO: 184352 - DNA, 15 bp, Homo sapiens
tgaagattctcctgt

SEQ ID NO: 184353 - DNA, 16 bp, Homo sapiens
tgaagattctttccca

SEQ ID NO: 184354 - DNA, 21 bp, Homo sapiens
tgaagattctttcccaattca

SEQ ID NO: 184355 - DNA, 22 bp, Homo sapiens
tgaagcagatgcaaagaggcaa

SEQ ID NO: 184356 - DNA, 21 bp, Homo sapiens
tgaagccagccttcttccatc

SEQ ID NO: 184357 - DNA, 22 bp, Homo sapiens
tgaagctctggtgacaccagcc

SEQ ID NO: 184358 - DNA, 20 bp, Homo sapiens
tgaaggaataaattgctcct

SEQ ID NO: 184359 - DNA, 16 bp, Homo sapiens
tgaaggagagcccttc

SEQ ID NO: 184360 - DNA, 23 bp, Homo sapiens
tgaaggagccccattcctgggaa

SEQ ID NO: 184361 - DNA, 13 bp, Homo sapiens
tgaaggcttctct

SEQ ID NO: 184362 - DNA, 14 bp, Homo sapiens
tgaaggtttacaat

SEQ ID NO: 184363 - DNA, 13 bp, Homo sapiens
tgaagtaagcaaa

SEQ ID NO: 184364 - DNA, 23 bp, Homo sapiens
tgaagtacccgttcacatttttg

SEQ ID NO: 184365 - DNA, 15 bp, Homo sapiens
tgaagtagtttgtat

SEQ ID NO: 184366 - DNA, 16 bp, Homo sapiens
tgaagtcactgcacag

SEQ ID NO: 184367 - DNA, 16 bp, Homo sapiens
tgaagtcagatgtggt

SEQ ID NO: 184368 - DNA, 16 bp, Homo sapiens
tgaagtgtaggcagac

SEQ ID NO: 184369 - DNA, 13 bp, Homo sapiens
tgaagtttcacat

SEQ ID NO: 184370 - DNA, 14 bp, Homo sapiens
tgaagtttcacatg

SEQ ID NO: 184371 - DNA, 16 bp, Homo sapiens
tgaataaagacaccta

SEQ ID NO: 184372 - DNA, 16 bp, Homo sapiens
tgaataaataaatgta

SEQ ID NO: 184373 - DNA, 22 bp, Homo sapiens
tgaatataccccttagtgtttg

SEQ ID NO: 184374 - DNA, 18 bp, Homo sapiens
tgaatatcccctcccagt

SEQ ID NO: 184375 - DNA, 21 bp, Homo sapiens
tgaatcagaccctaccccacc

SEQ ID NO: 184376 - DNA, 22 bp, Homo sapiens
tgaatcagaccctaccccacca

SEQ ID NO: 184377 - DNA, 14 bp, Homo sapiens
tgaatccatgcttg

SEQ ID NO: 184378 - DNA, 15 bp, Homo sapiens
tgaatgcataaaatg

SEQ ID NO: 184379 - DNA, 18 bp, Homo sapiens
tgaatgctttttgaatgt

SEQ ID NO: 184380 - DNA, 14 bp, Homo sapiens
tgaatgttatttgt

SEQ ID NO: 184381 - DNA, 23 bp, Homo sapiens
tgaatgttatttgttattttcag

SEQ ID NO: 184382 - DNA, 19 bp, Homo sapiens
tgaatgtttacactctttg

SEQ ID NO: 184383 - DNA, 22 bp, Homo sapiens
tgaatgtttacactctttgtaa

SEQ ID NO: 184384 - DNA, 19 bp, Homo sapiens
tgaattagaaacataaata

SEQ ID NO: 184385 - DNA, 20 bp, Homo sapiens
tgaattcttggttgaggaaa

SEQ ID NO: 184386 - DNA, 19 bp, Homo sapiens
tgaattgtaactgttcttg

SEQ ID NO: 184387 - DNA, 23 bp, Homo sapiens
tgaattttctttttaataaaaag

SEQ ID NO: 184388 - DNA, 14 bp, Homo sapiens
tgacaaaaattcaa

SEQ ID NO: 184389 - DNA, 15 bp, Homo sapiens
tgacaaagaaaccca

SEQ ID NO: 184390 - DNA, 21 bp, Homo sapiens
tgacaaagagtagacatttct

SEQ ID NO: 184391 - DNA, 16 bp, Homo sapiens
tgacaaagcttggaag

SEQ ID NO: 184392 - DNA, 17 bp, Homo sapiens
tgacaaaggcaagcact

SEQ ID NO: 184393 - DNA, 14 bp, Homo sapiens
tgacaacagaagct

SEQ ID NO: 184394 - DNA, 14 bp, Homo sapiens
tgacaataatttca

SEQ ID NO: 184395 - DNA, 13 bp, Homo sapiens
tgacaccagcctt

SEQ ID NO: 184396 - DNA, 16 bp, Homo sapiens
tgacaccagcctttct

SEQ ID NO: 184397 - DNA, 21 bp, Homo sapiens
tgacaccggggtggtgggaac

SEQ ID NO: 184398 - DNA, 15 bp, Homo sapiens
tgacacctgctgaga

SEQ ID NO: 184399 - DNA, 14 bp, Homo sapiens
tgacactcccttgg

SEQ ID NO: 184400 - DNA, 17 bp, Homo sapiens
tgacacttaaaaatggt

SEQ ID NO: 184401 - DNA, 21 bp, Homo sapiens
tgacagagcaagactctgtct

SEQ ID NO: 184402 - DNA, 22 bp, Homo sapiens
tgacagagcaagtgagaccctg

SEQ ID NO: 184403 - DNA, 17 bp, Homo sapiens
tgacagctgtccctgtc

SEQ ID NO: 184404 - DNA, 20 bp, Homo sapiens
tgacagctgtccctgtcacc

SEQ ID NO: 184405 - DNA, 21 bp, Homo sapiens
tgacataacactataaaggtt

SEQ ID NO: 184406 - DNA, 21 bp, Homo sapiens
tgacatctcaggggccagagg

SEQ ID NO: 184407 - DNA, 22 bp, Homo sapiens
tgacatctcaggggccagagga

SEQ ID NO: 184408 - DNA, 18 bp, Homo sapiens
tgacatgttatatatttt

SEQ ID NO: 184409 - DNA, 19 bp, Homo sapiens
tgacatgttatatattttt

SEQ ID NO: 184410 - DNA, 22 bp, Homo sapiens
tgacattgtagagcttctggca

SEQ ID NO: 184411 - DNA, 15 bp, Homo sapiens
tgacatttatatatt

SEQ ID NO: 184412 - DNA, 16 bp, Homo sapiens
tgacatttatatattg

SEQ ID NO: 184413 - DNA, 22 bp, Homo sapiens
tgacatttgggagacatgtgac

SEQ ID NO: 184414 - DNA, 20 bp, Homo sapiens
tgaccaacatggagaaaccc

SEQ ID NO: 184415 - DNA, 14 bp, Homo sapiens
tgaccaagcaggaa

SEQ ID NO: 184416 - DNA, 16 bp, Homo sapiens
tgaccaagcaggaagc

SEQ ID NO: 184417 - DNA, 20 bp, Homo sapiens
tgaccacggacgtttccatc

SEQ ID NO: 184418 - DNA, 22 bp, Homo sapiens
tgaccacggacgtttccatcag

SEQ ID NO: 184419 - DNA, 23 bp, Homo sapiens
tgaccacggacgtttccatcagg

SEQ ID NO: 184420 - DNA, 17 bp, Homo sapiens
tgaccactgcagaagac

SEQ ID NO: 184421 - DNA, 21 bp, Homo sapiens
tgaccagcagatcccagctca

SEQ ID NO: 184422 - DNA, 21 bp, Homo sapiens
tgacccagccccttgagaaac

SEQ ID NO: 184423 - DNA, 23 bp, Homo sapiens
tgacccagccccttgagaaacct

SEQ ID NO: 184424 - DNA, 12 bp, Homo sapiens
tgacccagtccc

SEQ ID NO: 184425 - DNA, 16 bp, Homo sapiens
tgacccagtccctggg

SEQ ID NO: 184426 - DNA, 13 bp, Homo sapiens
tgacccagtgaga

SEQ ID NO: 184427 - DNA, 13 bp, Homo sapiens
tgaccccagagga

SEQ ID NO: 184428 - DNA, 20 bp, Homo sapiens
tgacccctcctcactggcca

SEQ ID NO: 184429 - DNA, 22 bp, Homo sapiens
tgacccctcctcactggccatc

SEQ ID NO: 184430 - DNA, 16 bp, Homo sapiens
tgaccctgatcagtct

SEQ ID NO: 184431 - DNA, 22 bp, Homo sapiens
tgacccttacagcctctgactt

SEQ ID NO: 184432 - DNA, 19 bp, Homo sapiens
tgaccgaaacagcgctggg

SEQ ID NO: 184433 - DNA, 19 bp, Homo sapiens
tgacctcaggcactagcct

SEQ ID NO: 184434 - DNA, 16 bp, Homo sapiens
tgacctcatgcatctc

SEQ ID NO: 184435 - DNA, 14 bp, Homo sapiens
tgacctgtgtcact

SEQ ID NO: 184436 - DNA, 20 bp, Homo sapiens
tgacgacaagtgctgaacag

SEQ ID NO: 184437 - DNA, 22 bp, Homo sapiens
tgactaaaaatattataactta

SEQ ID NO: 184438 - DNA, 16 bp, Homo sapiens
tgactatcaaactgaa

SEQ ID NO: 184439 - DNA, 22 bp, Homo sapiens
tgactatcaaactgaagccaga

SEQ ID NO: 184440 - DNA, 20 bp, Homo sapiens
tgactcaagtgtctcagtcc

SEQ ID NO: 184441 - DNA, 14 bp, Homo sapiens
tgactcacccaagc

SEQ ID NO: 184442 - DNA, 16 bp, Homo sapiens
tgactcagatgtctct

SEQ ID NO: 184443 - DNA, 21 bp, Homo sapiens
tgactcagcatacctgctggt

SEQ ID NO: 184444 - DNA, 18 bp, Homo sapiens
tgactcagggctcctggg

SEQ ID NO: 184445 - DNA, 13 bp, Homo sapiens
tgactcatcctct

SEQ ID NO: 184446 - DNA, 22 bp, Homo sapiens
tgactccttagagacatcaaaa

SEQ ID NO: 184447 - DNA, 14 bp, Homo sapiens
tgactccttgtggt

SEQ ID NO: 184448 - DNA, 21 bp, Homo sapiens
tgactccttgtggtttatgtc

SEQ ID NO: 184449 - DNA, 16 bp, Homo sapiens
tgactgccccaactcc

SEQ ID NO: 184450 - DNA, 23 bp, Homo sapiens
tgactggtgttatcaccgtgggc

SEQ ID NO: 184451 - DNA, 16 bp, Homo sapiens
tgactgtactcctccc

SEQ ID NO: 184452 - DNA, 17 bp, Homo sapiens
tgactgtactcctccca

SEQ ID NO: 184453 - DNA, 21 bp, Homo sapiens
tgactgttttctcttgagagg

SEQ ID NO: 184454 - DNA, 14 bp, Homo sapiens
tgacttctccaggt

SEQ ID NO: 184455 - DNA, 16 bp, Homo sapiens
tgacttctccaggtct

SEQ ID NO: 184456 - DNA, 13 bp, Homo sapiens
tgactttctcagc

SEQ ID NO: 184457 - DNA, 16 bp, Homo sapiens
tgagaaagactattca

SEQ ID NO: 184458 - DNA, 13 bp, Homo sapiens
tgagatgtgaaca

SEQ ID NO: 184459 - DNA, 18 bp, Homo sapiens
tgagatgtgaacacatca

SEQ ID NO: 184460 - DNA, 21 bp, Homo sapiens
tgagcagactggtgagcagac

SEQ ID NO: 184461 - DNA, 12 bp, Homo sapiens
tgagcagtggct

SEQ ID NO: 184462 - DNA, 13 bp, Homo sapiens
tgagcagtggctg

SEQ ID NO: 184463 - DNA, 15 bp, Homo sapiens
tgagcagtggctggt

SEQ ID NO: 184464 - DNA, 21 bp, Homo sapiens
tgagcattgtggctgtcagca

SEQ ID NO: 184465 - DNA, 22 bp, Homo sapiens
tgagcattgtggctgtcagcag

SEQ ID NO: 184466 - DNA, 23 bp, Homo sapiens
tgagcattgtggctgtcagcagg

SEQ ID NO: 184467 - DNA, 17 bp, Homo sapiens
tgagccccgcagacctc

SEQ ID NO: 184468 - DNA, 14 bp, Homo sapiens
tgagccctcagaac

SEQ ID NO: 184469 - DNA, 17 bp, Homo sapiens
tgagccctcagaaccct

SEQ ID NO: 184470 - DNA, 20 bp, Homo sapiens
tgagccgcatcttctccatc

SEQ ID NO: 184471 - DNA, 10 bp, Homo sapiens
tgagcctggc

SEQ ID NO: 184472 - DNA, 16 bp, Homo sapiens
tgagcctggcaagaat

SEQ ID NO: 184473 - DNA, 11 bp, Homo sapiens
tgagcctggcc

SEQ ID NO: 184474 - DNA, 12 bp, Homo sapiens
tgagcctggcca

SEQ ID NO: 184475 - DNA, 16 bp, Homo sapiens
tgagcctggccagcct

SEQ ID NO: 184476 - DNA, 13 bp, Homo sapiens
tgagcctggctct

SEQ ID NO: 184477 - DNA, 18 bp, Homo sapiens
tgagcctggctcttgtgc

SEQ ID NO: 184478 - DNA, 16 bp, Homo sapiens
tgagcgacagtgagac

SEQ ID NO: 184479 - DNA, 22 bp, Homo sapiens
tgagctcagacccccactctca

SEQ ID NO: 184480 - DNA, 19 bp, Homo sapiens
tgagctcaggagtttgaga

SEQ ID NO: 184481 - DNA, 22 bp, Homo sapiens
tgagctccccaccaccccagct

SEQ ID NO: 184482 - DNA, 14 bp, Homo sapiens
tgagctgagcaggg

SEQ ID NO: 184483 - DNA, 16 bp, Homo sapiens
tgagctgagcagggag

SEQ ID NO: 184484 - DNA, 19 bp, Homo sapiens
tgaggaaaggccagctggc

SEQ ID NO: 184485 - DNA, 12 bp, Homo sapiens
tgaggaggaagg

SEQ ID NO: 184486 - DNA, 21 bp, Homo sapiens
tgaggaggaaggagagaaggg

SEQ ID NO: 184487 - DNA, 18 bp, Homo sapiens
tgaggatgcagagtcagc

SEQ ID NO: 184488 - DNA, 12 bp, Homo sapiens
tgaggatgggaa

SEQ ID NO: 184489 - DNA, 17 bp, Homo sapiens
tgaggatgtcactcaga

SEQ ID NO: 184490 - DNA, 12 bp, Homo sapiens
tgaggcagacag

SEQ ID NO: 184491 - DNA, 13 bp, Homo sapiens
tgaggcagacagc

SEQ ID NO: 184492 - DNA, 14 bp, Homo sapiens
tgaggcagacagca

SEQ ID NO: 184493 - DNA, 24 bp, Homo sapiens
tgaggcagacagcagctcaggcac

SEQ ID NO: 184494 - DNA, 22 bp, Homo sapiens
tgaggcagggaagtccccaggc

SEQ ID NO: 184495 - DNA, 22 bp, Homo sapiens
tgaggccaaacgttttgaacta

SEQ ID NO: 184496 - DNA, 14 bp, Homo sapiens
tgaggccagggcag

SEQ ID NO: 184497 - DNA, 15 bp, Homo sapiens
tgaggccagggcaga

SEQ ID NO: 184498 - DNA, 16 bp, Homo sapiens
tgaggccagggcagag

SEQ ID NO: 184499 - DNA, 14 bp, Homo sapiens
tgaggcctggactt

SEQ ID NO: 184500 - DNA, 23 bp, Homo sapiens
tgaggcctggactttcctgcaac

SEQ ID NO: 184501 - DNA, 12 bp, Homo sapiens
tgaggctgtcct

SEQ ID NO: 184502 - DNA, 13 bp, Homo sapiens
tgagggcccagag

SEQ ID NO: 184503 - DNA, 21 bp, Homo sapiens
tgagggtgcttgttccctctc

SEQ ID NO: 184504 - DNA, 22 bp, Homo sapiens
tgaggtactgagagtgaacaaa

SEQ ID NO: 184505 - DNA, 17 bp, Homo sapiens
tgaggtgcagagtgccc

SEQ ID NO: 184506 - DNA, 21 bp, Homo sapiens
tgaggtgcagagtgcccagaa

SEQ ID NO: 184507 - DNA, 15 bp, Homo sapiens
tgaggtgctgggagg

SEQ ID NO: 184508 - DNA, 16 bp, Homo sapiens
tgaggtgctgggaggg

SEQ ID NO: 184509 - DNA, 15 bp, Homo sapiens
tgaggtggaagccct

SEQ ID NO: 184510 - DNA, 16 bp, Homo sapiens
tgaggtggaagccctc

SEQ ID NO: 184511 - DNA, 17 bp, Homo sapiens
tgaggtggaagccctcc

SEQ ID NO: 184512 - DNA, 20 bp, Homo sapiens
tgaggtggaagccctccttc

SEQ ID NO: 184513 - DNA, 21 bp, Homo sapiens
tgaggtgggaggatctcttga

SEQ ID NO: 184514 - DNA, 21 bp, Homo sapiens
tgagtcatgatctccctgccg

SEQ ID NO: 184515 - DNA, 15 bp, Homo sapiens
tgagtgaataaatgt

SEQ ID NO: 184516 - DNA, 16 bp, Homo sapiens
tgagtgagcctggctc

SEQ ID NO: 184517 - DNA, 19 bp, Homo sapiens
tgagtgagcctggctcttg

SEQ ID NO: 184518 - DNA, 12 bp, Homo sapiens
tgagtgctctga

SEQ ID NO: 184519 - DNA, 21 bp, Homo sapiens
tgagtgggggatcacagcctc

SEQ ID NO: 184520 - DNA, 16 bp, Homo sapiens
tgagttcaggtagctg

SEQ ID NO: 184521 - DNA, 20 bp, Homo sapiens
tgagttctacataagtaatt

SEQ ID NO: 184522 - DNA, 22 bp, Homo sapiens
tgagttctacataagtaattca

SEQ ID NO: 184523 - DNA, 16 bp, Homo sapiens
tgagtttaccttgtat

SEQ ID NO: 184524 - DNA, 18 bp, Homo sapiens
tgagtttcattctcctgc

SEQ ID NO: 184525 - DNA, 19 bp, Homo sapiens
tgagtttcattctcctgcc

SEQ ID NO: 184526 - DNA, 19 bp, Homo sapiens
tgagtttcctcaggctgct

SEQ ID NO: 184527 - DNA, 22 bp, Homo sapiens
tgagtttcctcaggctgctgga

SEQ ID NO: 184528 - DNA, 18 bp, Homo sapiens
tgagttttattgagaatt

SEQ ID NO: 184529 - DNA, 13 bp, Homo sapiens
tgagtttttgata

SEQ ID NO: 184530 - DNA, 20 bp, Homo sapiens
tgataaggatcagaacagca

SEQ ID NO: 184531 - DNA, 12 bp, Homo sapiens
tgataagtaaat

SEQ ID NO: 184532 - DNA, 21 bp, Homo sapiens
tgatatcatgcccctgtactc

SEQ ID NO: 184533 - DNA, 23 bp, Homo sapiens
tgatattttcaacgcagccctgc

SEQ ID NO: 184534 - DNA, 16 bp, Homo sapiens
tgatcaaattcatttt

SEQ ID NO: 184535 - DNA, 18 bp, Homo sapiens
tgatcactggcaatgaaa

SEQ ID NO: 184536 - DNA, 18 bp, Homo sapiens
tgatccagcctctcccct

SEQ ID NO: 184537 - DNA, 17 bp, Homo sapiens
tgatctagagccagtta

SEQ ID NO: 184538 - DNA, 17 bp, Homo sapiens
tgatctccctgccgcct

SEQ ID NO: 184539 - DNA, 13 bp, Homo sapiens
tgatctgtatata

SEQ ID NO: 184540 - DNA, 15 bp, Homo sapiens
tgatctgtatataca

SEQ ID NO: 184541 - DNA, 19 bp, Homo sapiens
tgatctgtatatacaataa

SEQ ID NO: 184542 - DNA, 22 bp, Homo sapiens
tgatctgtatatacaataacat

SEQ ID NO: 184543 - DNA, 15 bp, Homo sapiens
tgatctgtgggcaca

SEQ ID NO: 184544 - DNA, 20 bp, Homo sapiens
tgatcttctttataattcta

SEQ ID NO: 184545 - DNA, 21 bp, Homo sapiens
tgatcttggcttactgcagcc

SEQ ID NO: 184546 - DNA, 17 bp, Homo sapiens
tgatctttaaaatacac

SEQ ID NO: 184547 - DNA, 18 bp, Homo sapiens
tgatgaactcttaatcaa

SEQ ID NO: 184548 - DNA, 13 bp, Homo sapiens
tgatgaactttct

SEQ ID NO: 184549 - DNA, 15 bp, Homo sapiens
tgatgaactttctct

SEQ ID NO: 184550 - DNA, 14 bp, Homo sapiens
tgatgaatactgta

SEQ ID NO: 184551 - DNA, 14 bp, Homo sapiens
tgatgatctttaaa

SEQ ID NO: 184552 - DNA, 17 bp, Homo sapiens
tgatgatctttaaaata

SEQ ID NO: 184553 - DNA, 18 bp, Homo sapiens
tgatgcatgcactgttcc

SEQ ID NO: 184554 - DNA, 14 bp, Homo sapiens
tgatgcctccctgt

SEQ ID NO: 184555 - DNA, 15 bp, Homo sapiens
tgatgctggatgctc

SEQ ID NO: 184556 - DNA, 20 bp, Homo sapiens
tgatgctggatgctccttcc

SEQ ID NO: 184557 - DNA, 19 bp, Homo sapiens
tgatgggaaagcattgtaa

SEQ ID NO: 184558 - DNA, 15 bp, Homo sapiens
tgatggtgatgaaat

SEQ ID NO: 184559 - DNA, 16 bp, Homo sapiens
tgatggtgatgaaatg

SEQ ID NO: 184560 - DNA, 17 bp, Homo sapiens
tgatggtgatgaaatgt

SEQ ID NO: 184561 - DNA, 22 bp, Homo sapiens
tgatgtaatcttgaattgtaac

SEQ ID NO: 184562 - DNA, 18 bp, Homo sapiens
tgatgtaccatgaaacaa

SEQ ID NO: 184563 - DNA, 20 bp, Homo sapiens
tgatgtaccatgaaacaaag

SEQ ID NO: 184564 - DNA, 20 bp, Homo sapiens
tgatgtagggtaaggtgcct

SEQ ID NO: 184565 - DNA, 19 bp, Homo sapiens
tgatgtcccaacttgtaaa

SEQ ID NO: 184566 - DNA, 16 bp, Homo sapiens
tgatgtgttatctctt

SEQ ID NO: 184567 - DNA, 10 bp, Homo sapiens
tgatgttaac

SEQ ID NO: 184568 - DNA, 22 bp, Homo sapiens
tgatgttaaccagaataaagtt

SEQ ID NO: 184569 - DNA, 21 bp, Homo sapiens
tgattaattcaccttccagtg

SEQ ID NO: 184570 - DNA, 14 bp, Homo sapiens
tgattacacaaaac

SEQ ID NO: 184571 - DNA, 18 bp, Homo sapiens
tgattacaccagcctcgt

SEQ ID NO: 184572 - DNA, 14 bp, Homo sapiens
tgattaccagggac

SEQ ID NO: 184573 - DNA, 21 bp, Homo sapiens
tgattagaaggcaagtttcta

SEQ ID NO: 184574 - DNA, 17 bp, Homo sapiens
tgattagtaaagaaatg

SEQ ID NO: 184575 - DNA, 16 bp, Homo sapiens
tgattattcagtgtca

SEQ ID NO: 184576 - DNA, 18 bp, Homo sapiens
tgattattctgattccac

SEQ ID NO: 184577 - DNA, 13 bp, Homo sapiens
tgattcagctctg

SEQ ID NO: 184578 - DNA, 21 bp, Homo sapiens
tgattcagtgttaaatgtgat

SEQ ID NO: 184579 - DNA, 13 bp, Homo sapiens
tgattctgtgtgt

SEQ ID NO: 184580 - DNA, 17 bp, Homo sapiens
tgattgtaaaatagctt

SEQ ID NO: 184581 - DNA, 13 bp, Homo sapiens
tgatttcattcaa

SEQ ID NO: 184582 - DNA, 21 bp, Homo sapiens
tgatttcccctccaaggtatg

SEQ ID NO: 184583 - DNA, 13 bp, Homo sapiens
tgatttctattca

SEQ ID NO: 184584 - DNA, 20 bp, Homo sapiens
tgatttctattcaaggtggc

SEQ ID NO: 184585 - DNA, 15 bp, Homo sapiens
tgattttatctgtga

SEQ ID NO: 184586 - DNA, 15 bp, Homo sapiens
tgattttgaaaccat

SEQ ID NO: 184587 - DNA, 20 bp, Homo sapiens
ttacagagacagaaagcaga

SEQ ID NO: 184588 - DNA, 14 bp, Homo sapiens
ttacagcctctgac

SEQ ID NO: 184589 - DNA, 18 bp, Homo sapiens
ttacatctgttttaaatt

SEQ ID NO: 184590 - DNA, 14 bp, Homo sapiens
ttacatgacacagc

SEQ ID NO: 184591 - DNA, 22 bp, Homo sapiens
ttacatgcaatttattaaaatg

SEQ ID NO: 184592 - DNA, 22 bp, Homo sapiens
ttacatggttaaggtaaagtaa

SEQ ID NO: 184593 - DNA, 14 bp, Homo sapiens
ttacattaatgtta

SEQ ID NO: 184594 - DNA, 14 bp, Homo sapiens
ttacatttttacaa

SEQ ID NO: 184595 - DNA, 21 bp, Homo sapiens
ttacatttttacaataaataa

SEQ ID NO: 184596 - DNA, 15 bp, Homo sapiens
ttaccaactttctgt

SEQ ID NO: 184597 - DNA, 16 bp, Homo sapiens
ttaccaactttctgta

SEQ ID NO: 184598 - DNA, 21 bp, Homo sapiens
ttaccagacggttcaccagcc

SEQ ID NO: 184599 - DNA, 21 bp, Homo sapiens
ttaccagcctccgtatttcag

SEQ ID NO: 184600 - DNA, 24 bp, Homo sapiens
ttacccaaaaactaaatctctaat

SEQ ID NO: 184601 - DNA, 19 bp, Homo sapiens
ttacctcctgagaaaaaag

SEQ ID NO: 184602 - DNA, 21 bp, Homo sapiens
ttacctctgatacctcaaccc

SEQ ID NO: 184603 - DNA, 18 bp, Homo sapiens
ttacctgaaaacactgtg

SEQ ID NO: 184604 - DNA, 20 bp, Homo sapiens
ttacctgaaaacactgtgca

SEQ ID NO: 184605 - DNA, 14 bp, Homo sapiens
ttaccttacagaag

SEQ ID NO: 184606 - DNA, 15 bp, Homo sapiens
ttaccttattgcact

SEQ ID NO: 184607 - DNA, 20 bp, Homo sapiens
ttacggttttccaggtttaa

SEQ ID NO: 184608 - DNA, 22 bp, Homo sapiens
ttactaagccacaagaaatttg

SEQ ID NO: 184609 - DNA, 15 bp, Homo sapiens
ttactacagttgttt

SEQ ID NO: 184610 - DNA, 20 bp, Homo sapiens
ttactagggatccctcatct

SEQ ID NO: 184611 - DNA, 18 bp, Homo sapiens
ttactatgcctgtgtctt

SEQ ID NO: 184612 - DNA, 22 bp, Homo sapiens
ttactcagccctgggccccacc

SEQ ID NO: 184613 - DNA, 16 bp, Homo sapiens
ttactctccaacctgg

SEQ ID NO: 184614 - DNA, 14 bp, Homo sapiens
ttactgagcttctc

SEQ ID NO: 184615 - DNA, 21 bp, Homo sapiens
ttacttaaaccgccaaggctg

SEQ ID NO: 184616 - DNA, 19 bp, Homo sapiens
ttacttcactttaattctc

SEQ ID NO: 184617 - DNA, 13 bp, Homo sapiens
ttagaaacataaa

SEQ ID NO: 184618 - DNA, 20 bp, Homo sapiens
ttagaacaggcaagtgaaga

SEQ ID NO: 184619 - DNA, 15 bp, Homo sapiens
ttagacctcagcctg

SEQ ID NO: 184620 - DNA, 17 bp, Homo sapiens
ttagagtgtctttccac

SEQ ID NO: 184621 - DNA, 13 bp, Homo sapiens
ttagctgcagaac

SEQ ID NO: 184622 - DNA, 11 bp, Homo sapiens
ttaggaaataa

SEQ ID NO: 184623 - DNA, 19 bp, Homo sapiens
ttaggaaataaaacctttc

SEQ ID NO: 184624 - DNA, 15 bp, Homo sapiens
ttagggagagaagat

SEQ ID NO: 184625 - DNA, 19 bp, Homo sapiens
ttaggtgtgggggaagcac

SEQ ID NO: 184626 - DNA, 19 bp, Homo sapiens
ttaggtttttttgtatagt

SEQ ID NO: 184627 - DNA, 16 bp, Homo sapiens
ttagtatttgcatatt

SEQ ID NO: 184628 - DNA, 13 bp, Homo sapiens
ttagttatagttt

SEQ ID NO: 184629 - DNA, 16 bp, Homo sapiens
ttagttttgatgagtt

SEQ ID NO: 184630 - DNA, 18 bp, Homo sapiens
ttagtttttgtaatttat

SEQ ID NO: 184631 - DNA, 19 bp, Homo sapiens
ttagtttttgtaatttatt

SEQ ID NO: 184632 - DNA, 16 bp, Homo sapiens
ttataaaattaagcaa

SEQ ID NO: 184633 - DNA, 15 bp, Homo sapiens
ttataaatatattta

SEQ ID NO: 184634 - DNA, 18 bp, Homo sapiens
ttataactcatcataaaa

SEQ ID NO: 184635 - DNA, 15 bp, Homo sapiens
ttataataatgttaa

SEQ ID NO: 184636 - DNA, 15 bp, Homo sapiens
ttatacaatatcatc

SEQ ID NO: 184637 - DNA, 15 bp, Homo sapiens
ttatagaatatttat

SEQ ID NO: 184638 - DNA, 23 bp, Homo sapiens
ttatagaatatttattacctctg

SEQ ID NO: 184639 - DNA, 22 bp, Homo sapiens
ttatatattggtaacatccttt

SEQ ID NO: 184640 - DNA, 15 bp, Homo sapiens
ttatattaaaatatg

SEQ ID NO: 184641 - DNA, 13 bp, Homo sapiens
ttatatttttaaa

SEQ ID NO: 184642 - DNA, 19 bp, Homo sapiens
ttatcatgacatgttatat

SEQ ID NO: 184643 - DNA, 15 bp, Homo sapiens
ttatccctcacctgt

SEQ ID NO: 184644 - DNA, 17 bp, Homo sapiens
ttatccctcacctgtag

SEQ ID NO: 184645 - DNA, 20 bp, Homo sapiens
ttatccctcacctgtagcag

SEQ ID NO: 184646 - DNA, 12 bp, Homo sapiens
ttatctgtgaat

SEQ ID NO: 184647 - DNA, 17 bp, Homo sapiens
ttatcttgtctctgggc

SEQ ID NO: 184648 - DNA, 13 bp, Homo sapiens
ttatgagtttttg

SEQ ID NO: 184649 - DNA, 14 bp, Homo sapiens
ttatgctcagggtc

SEQ ID NO: 184650 - DNA, 17 bp, Homo sapiens
ttatggctataggtgct

SEQ ID NO: 184651 - DNA, 23 bp, Homo sapiens
ttatgggaaccccttcatcctct

SEQ ID NO: 184652 - DNA, 17 bp, Homo sapiens
ttatgtctatttaagcc

SEQ ID NO: 184653 - DNA, 20 bp, Homo sapiens
ttatgttatttatatattgg

SEQ ID NO: 184654 - DNA, 16 bp, Homo sapiens
ttattaaaatcttaaa

SEQ ID NO: 184655 - DNA, 14 bp, Homo sapiens
ttattaaaatgatt

SEQ ID NO: 184656 - DNA, 19 bp, Homo sapiens
ttattaaaatgattgtaaa

SEQ ID NO: 184657 - DNA, 12 bp, Homo sapiens
ttattacctctg

SEQ ID NO: 184658 - DNA, 21 bp, Homo sapiens
ttattagagattacctcctga

SEQ ID NO: 184659 - DNA, 20 bp, Homo sapiens
ttattagtaagaaaacatca

SEQ ID NO: 184660 - DNA, 15 bp, Homo sapiens
ttattagttaatata

SEQ ID NO: 184661 - DNA, 16 bp, Homo sapiens
ttattattttcacctg

SEQ ID NO: 184662 - DNA, 19 bp, Homo sapiens
ttattcaattcctctggga

SEQ ID NO: 184663 - DNA, 21 bp, Homo sapiens
tggccctgtccctcccacctc

SEQ ID NO: 184664 - DNA, 22 bp, Homo sapiens
tggccctgtccctcccacctct

SEQ ID NO: 184665 - DNA, 23 bp, Homo sapiens
tggccctgtccctcccacctctg

SEQ ID NO: 184666 - DNA, 23 bp, Homo sapiens
tggccgggcgcggtggctcacgc

SEQ ID NO: 184667 - DNA, 16 bp, Homo sapiens
tggcctaaaaatgcaa

SEQ ID NO: 184668 - DNA, 20 bp, Homo sapiens
tggcctattatattaaaata

SEQ ID NO: 184669 - DNA, 19 bp, Homo sapiens
tggcctcgggacacctgcc

SEQ ID NO: 184670 - DNA, 22 bp, Homo sapiens
tggcctcttgagcagtggctgg

SEQ ID NO: 184671 - DNA, 18 bp, Homo sapiens
tggccttgaaaccacctt

SEQ ID NO: 184672 - DNA, 21 bp, Homo sapiens
tggcggctactcagcagccct

SEQ ID NO: 184673 - DNA, 17 bp, Homo sapiens
tggctaatgtactgcat

SEQ ID NO: 184674 - DNA, 16 bp, Homo sapiens
tggctagtcagagaga

SEQ ID NO: 184675 - DNA, 15 bp, Homo sapiens
tggctataggtgcta

SEQ ID NO: 184676 - DNA, 22 bp, Homo sapiens
tggctcatattcctgcagcctg

SEQ ID NO: 184677 - DNA, 19 bp, Homo sapiens
tggctccgaacaccctcga

SEQ ID NO: 184678 - DNA, 16 bp, Homo sapiens
tggctcctcccggtgc

SEQ ID NO: 184679 - DNA, 12 bp, Homo sapiens
tggctctgctgg

SEQ ID NO: 184680 - DNA, 16 bp, Homo sapiens
tggctgactttgctct

SEQ ID NO: 184681 - DNA, 13 bp, Homo sapiens
tggctgctagcac

SEQ ID NO: 184682 - DNA, 13 bp, Homo sapiens
tggctggtccagg

SEQ ID NO: 184683 - DNA, 20 bp, Homo sapiens
tggctgtagaaggagacaga

SEQ ID NO: 184684 - DNA, 14 bp, Homo sapiens
tggctgtgcctctg

SEQ ID NO: 184685 - DNA, 15 bp, Homo sapiens
tggctgtgcctctgc

SEQ ID NO: 184686 - DNA, 18 bp, Homo sapiens
tggctgtgcctctgcctg

SEQ ID NO: 184687 - DNA, 19 bp, Homo sapiens
tgttttttgaaaacatggt

SEQ ID NO: 184688 - DNA, 19 bp, Homo sapiens
ttaaaaaaaacaaaaagaa

SEQ ID NO: 184689 - DNA, 16 bp, Homo sapiens
ttaaaaaatggaacat

SEQ ID NO: 184690 - DNA, 13 bp, Homo sapiens
ttaaaaatataaa

SEQ ID NO: 184691 - DNA, 20 bp, Homo sapiens
ttaaaaatatggaacttcta

SEQ ID NO: 184692 - DNA, 22 bp, Homo sapiens
ttaaaaatatggaacttctaat

SEQ ID NO: 184693 - DNA, 20 bp, Homo sapiens
ttaaaaatggtttaaatggt

SEQ ID NO: 184694 - DNA, 14 bp, Homo sapiens
ttaaaactttaatc

SEQ ID NO: 184695 - DNA, 22 bp, Homo sapiens
ttaaaagaatattttaacttcc

SEQ ID NO: 184696 - DNA, 16 bp, Homo sapiens
ttaaaatattcctgca

SEQ ID NO: 184697 - DNA, 12 bp, Homo sapiens
ttaaaatatttt

SEQ ID NO: 184698 - DNA, 13 bp, Homo sapiens
ttaaaatcctcaa

SEQ ID NO: 184699 - DNA, 18 bp, Homo sapiens
ttaaaatgattgtaaaat

SEQ ID NO: 184700 - DNA, 20 bp, Homo sapiens
ttaaacaaaatagaagctgt

SEQ ID NO: 184701 - DNA, 14 bp, Homo sapiens
ttaaacagcagtgt

SEQ ID NO: 184702 - DNA, 18 bp, Homo sapiens
ttaaacctctcttctacc

SEQ ID NO: 184703 - DNA, 14 bp, Homo sapiens
ttaaagctgcctgt

SEQ ID NO: 184704 - DNA, 18 bp, Homo sapiens
ttaaagctgcctgtagtt

SEQ ID NO: 184705 - DNA, 18 bp, Homo sapiens
ttaaaggcaccatctaat

SEQ ID NO: 184706 - DNA, 23 bp, Homo sapiens
ttaaagtatgttattgcataatt

SEQ ID NO: 184707 - DNA, 13 bp, Homo sapiens
ttaaatacagtct

SEQ ID NO: 184708 - DNA, 19 bp, Homo sapiens
ttaaatacgcactacatgt

SEQ ID NO: 184709 - DNA, 15 bp, Homo sapiens
ttaaattttgagttc

SEQ ID NO: 184710 - DNA, 16 bp, Homo sapiens
ttaacaattccaaagg

SEQ ID NO: 184711 - DNA, 15 bp, Homo sapiens
ttaacagtcatttaa

SEQ ID NO: 184712 - DNA, 16 bp, Homo sapiens
ttaacagtcatttaaa

SEQ ID NO: 184713 - DNA, 17 bp, Homo sapiens
ttaacagtcatttaaaa

SEQ ID NO: 184714 - DNA, 15 bp, Homo sapiens
ttaactagaatttat

SEQ ID NO: 184715 - DNA, 11 bp, Homo sapiens
ttaagaaaatc

SEQ ID NO: 184716 - DNA, 14 bp, Homo sapiens
ttaagaaaatcata

SEQ ID NO: 184717 - DNA, 22 bp, Homo sapiens
ttaagaaaatcatattgcttct

SEQ ID NO: 184718 - DNA, 14 bp, Homo sapiens
ttaagataattata

SEQ ID NO: 184719 - DNA, 14 bp, Homo sapiens
ttaagcactacata

SEQ ID NO: 184720 - DNA, 22 bp, Homo sapiens
ttaagcctcatatttaaagaca

SEQ ID NO: 184721 - DNA, 23 bp, Homo sapiens
ttaaggctgaggaaaggccagct

SEQ ID NO: 184722 - DNA, 20 bp, Homo sapiens
ttaagtattgcatctgtata

SEQ ID NO: 184723 - DNA, 19 bp, Homo sapiens
ttaagtatttatatattta

SEQ ID NO: 184724 - DNA, 20 bp, Homo sapiens
ttaataaaaaaacaatcatt

SEQ ID NO: 184725 - DNA, 17 bp, Homo sapiens
ttaataagtttcactga

SEQ ID NO: 184726 - DNA, 19 bp, Homo sapiens
ttaatatatcccagaaatt

SEQ ID NO: 184727 - DNA, 18 bp, Homo sapiens
ttaatatttaaacagcag

SEQ ID NO: 184728 - DNA, 12 bp, Homo sapiens
ttaatatttgct

SEQ ID NO: 184729 - DNA, 22 bp, Homo sapiens
ttaatctggtttatttttgttc

SEQ ID NO: 184730 - DNA, 16 bp, Homo sapiens
ttaatctgtatttccc

SEQ ID NO: 184731 - DNA, 18 bp, Homo sapiens
ttaatgaagaaagtggaa

SEQ ID NO: 184732 - DNA, 23 bp, Homo sapiens
ttaatgaagaaagtggaaaacaa

SEQ ID NO: 184733 - DNA, 17 bp, Homo sapiens
ttaattattattcttca

SEQ ID NO: 184734 - DNA, 14 bp, Homo sapiens
ttaattattgtaca

SEQ ID NO: 184735 - DNA, 22 bp, Homo sapiens
ttaattcagcactgatttcaca

SEQ ID NO: 184736 - DNA, 17 bp, Homo sapiens
ttaattccaattatatg

SEQ ID NO: 184737 - DNA, 20 bp, Homo sapiens
ttaatttatgagtttttgat

SEQ ID NO: 184738 - DNA, 17 bp, Homo sapiens
ttaatttttttaaccaa

SEQ ID NO: 184739 - DNA, 22 bp, Homo sapiens
ttaatttttttaaccaaaggtg

SEQ ID NO: 184740 - DNA, 18 bp, Homo sapiens
ttacaaagtgtgtattaa

SEQ ID NO: 184741 - DNA, 14 bp, Homo sapiens
ttacaagtgtatat

SEQ ID NO: 184742 - DNA, 16 bp, Homo sapiens
ttacaagtgtatatca

SEQ ID NO: 184743 - DNA, 18 bp, Homo sapiens
ttacacaaaacaaatgcc

SEQ ID NO: 184744 - DNA, 15 bp, Homo sapiens
ttacactctttgtaa

SEQ ID NO: 184745 - DNA, 20 bp, Homo sapiens
attatttgtgtaatagaaaa

SEQ ID NO: 184746 - DNA, 13 bp, Homo sapiens
attattttaaaca

SEQ ID NO: 184747 - DNA, 14 bp, Homo sapiens
attattttaaacaa

SEQ ID NO: 184748 - DNA, 15 bp, Homo sapiens
attattttaaacaaa

SEQ ID NO: 184749 - DNA, 16 bp, Homo sapiens
attcaaacagtctcag

SEQ ID NO: 184750 - DNA, 22 bp, Homo sapiens
attcaaacagtctcaggaaatc

SEQ ID NO: 184751 - DNA, 14 bp, Homo sapiens
attcaactcagact

SEQ ID NO: 184752 - DNA, 16 bp, Homo sapiens
attcaagttattgtac

SEQ ID NO: 184753 - DNA, 13 bp, Homo sapiens
attcaataagcat

SEQ ID NO: 184754 - DNA, 14 bp, Homo sapiens
attcaattcctctg

SEQ ID NO: 184755 - DNA, 17 bp, Homo sapiens
attcacatctaacctca

SEQ ID NO: 184756 - DNA, 14 bp, Homo sapiens
attcacccagacag

SEQ ID NO: 184757 - DNA, 15 bp, Homo sapiens
attcactgcccccag

SEQ ID NO: 184758 - DNA, 20 bp, Homo sapiens
attcactgcccccagctctt

SEQ ID NO: 184759 - DNA, 12 bp, Homo sapiens
attcagaaaaaa

SEQ ID NO: 184760 - DNA, 14 bp, Homo sapiens
attcagcactgatt

SEQ ID NO: 184761 - DNA, 19 bp, Homo sapiens
attcagcactgatttcaca

SEQ ID NO: 184762 - DNA, 21 bp, Homo sapiens
attcaggagagtagaacagat

SEQ ID NO: 184763 - DNA, 19 bp, Homo sapiens
attcagtgttaaatgtgat

SEQ ID NO: 184764 - DNA, 22 bp, Homo sapiens
attcatagcagcttattcacaa

SEQ ID NO: 184765 - DNA, 20 bp, Homo sapiens
attcatattttctttcaaaa

SEQ ID NO: 184766 - DNA, 13 bp, Homo sapiens
attcatttaaaat

SEQ ID NO: 184767 - DNA, 14 bp, Homo sapiens
attccaacagtgag

SEQ ID NO: 184768 - DNA, 16 bp, Homo sapiens
attccaaccccaactc

SEQ ID NO: 184769 - DNA, 17 bp, Homo sapiens
attccaaccccaactcc

SEQ ID NO: 184770 - DNA, 18 bp, Homo sapiens
attccagaatatctggga

SEQ ID NO: 184771 - DNA, 16 bp, Homo sapiens
attcccagagacagga

SEQ ID NO: 184772 - DNA, 19 bp, Homo sapiens
attcccagagacaggaaaa

SEQ ID NO: 184773 - DNA, 23 bp, Homo sapiens
attcccagagacaggaaaatcct

SEQ ID NO: 184774 - DNA, 17 bp, Homo sapiens
attccctagaaacttcc

SEQ ID NO: 184775 - DNA, 13 bp, Homo sapiens
attccctctctct

SEQ ID NO: 184776 - DNA, 19 bp, Homo sapiens
attccctctctctgactct

SEQ ID NO: 184777 - DNA, 22 bp, Homo sapiens
attccctctctctgactctcaa

SEQ ID NO: 184778 - DNA, 22 bp, Homo sapiens
caaccactggtctgtagggatt

SEQ ID NO: 184779 - DNA, 14 bp, Homo sapiens
caaccattccccat

SEQ ID NO: 184780 - DNA, 20 bp, Homo sapiens
caacctgaccaacatggaga

SEQ ID NO: 184781 - DNA, 21 bp, Homo sapiens
caacctgaccaacatggagaa

SEQ ID NO: 184782 - DNA, 23 bp, Homo sapiens
caacctgaccaacatggagaaac

SEQ ID NO: 184783 - DNA, 18 bp, Homo sapiens
caacctgctctcctcttg

SEQ ID NO: 184784 - DNA, 18 bp, Homo sapiens
caaccttagatgttctaa

SEQ ID NO: 184785 - DNA, 20 bp, Homo sapiens
caaccttctgtggctcacag

SEQ ID NO: 184786 - DNA, 12 bp, Homo sapiens
caacgaggaagc

SEQ ID NO: 184787 - DNA, 18 bp, Homo sapiens
caacgcagccctgctttg

SEQ ID NO: 184788 - DNA, 17 bp, Homo sapiens
caacgtggggcagcaca

SEQ ID NO: 184789 - DNA, 18 bp, Homo sapiens
caacgtggggcagcacag

SEQ ID NO: 184790 - DNA, 13 bp, Homo sapiens
caactaacaagaa

SEQ ID NO: 184791 - DNA, 22 bp, Homo sapiens
caactatgatatggtaaaagtt

SEQ ID NO: 184792 - DNA, 22 bp, Homo sapiens
caactatgatttggaaaataaa

SEQ ID NO: 184793 - DNA, 20 bp, Homo sapiens
caactatttttccaaaataa

SEQ ID NO: 184794 - DNA, 23 bp, Homo sapiens
caactcagtccctaaaaacacag

SEQ ID NO: 184795 - DNA, 17 bp, Homo sapiens
caactcctggaagctgt

SEQ ID NO: 184796 - DNA, 14 bp, Homo sapiens
caactctttgagaa

SEQ ID NO: 184797 - DNA, 15 bp, Homo sapiens
caactgaccagcctc

SEQ ID NO: 184798 - DNA, 13 bp, Homo sapiens
caactgaggcaga

SEQ ID NO: 184799 - DNA, 20 bp, Homo sapiens
caacttctttttattttctt

SEQ ID NO: 184800 - DNA, 16 bp, Homo sapiens
caacttgagggcccag

SEQ ID NO: 184801 - DNA, 16 bp, Homo sapiens
caactttctgtaaact

SEQ ID NO: 184802 - DNA, 16 bp, Homo sapiens
caagaaagctggtaaa

SEQ ID NO: 184803 - DNA, 21 bp, Homo sapiens
caagacttcagtatgttgtca

SEQ ID NO: 184804 - DNA, 17 bp, Homo sapiens
caagagcccccttgaca

SEQ ID NO: 184805 - DNA, 22 bp, Homo sapiens
caagagccttggtgtccacctg

SEQ ID NO: 184806 - DNA, 17 bp, Homo sapiens
caagagggacgcctggg

SEQ ID NO: 184807 - DNA, 19 bp, Homo sapiens
caagagggacgcctggggg

SEQ ID NO: 184808 - DNA, 17 bp, Homo sapiens
caagagggcactggtgg

SEQ ID NO: 184809 - DNA, 18 bp, Homo sapiens
caagagggcactggtggc

SEQ ID NO: 184810 - DNA, 19 bp, Homo sapiens
caagagggcactggtggcc

SEQ ID NO: 184811 - DNA, 20 bp, Homo sapiens
caagagggcactggtggccc

SEQ ID NO: 184812 - DNA, 22 bp, Homo sapiens
caagagtttatttccaaataaa

SEQ ID NO: 184813 - DNA, 15 bp, Homo sapiens
caagattcccagaga

SEQ ID NO: 184814 - DNA, 17 bp, Homo sapiens
caagattcccagagaca

SEQ ID NO: 184815 - DNA, 19 bp, Homo sapiens
caagattcccagagacagg

SEQ ID NO: 184816 - DNA, 23 bp, Homo sapiens
caagattcccagagacaggaaaa

SEQ ID NO: 184817 - DNA, 21 bp, Homo sapiens
caagattgcttaaaatagcaa

SEQ ID NO: 184818 - DNA, 20 bp, Homo sapiens
caagcacatctgcattttca

SEQ ID NO: 184819 - DNA, 17 bp, Homo sapiens
caagcagaggtggccag

SEQ ID NO: 184820 - DNA, 21 bp, Homo sapiens
caagcagattggagaaaccct

SEQ ID NO: 184821 - DNA, 22 bp, Homo sapiens
caagcagccaagctccttggga

SEQ ID NO: 184822 - DNA, 17 bp, Homo sapiens
caagcaggaaatgaaaa

SEQ ID NO: 184823 - DNA, 21 bp, Homo sapiens
caagccaagcagccaagctcc

SEQ ID NO: 184824 - DNA, 17 bp, Homo sapiens
caagcccagcactgctt

SEQ ID NO: 184825 - DNA, 12 bp, Homo sapiens
caagcccaggag

SEQ ID NO: 184826 - DNA, 14 bp, Homo sapiens
caagccgtggcttc

SEQ ID NO: 184827 - DNA, 15 bp, Homo sapiens
caagccgtggcttcc

SEQ ID NO: 184828 - DNA, 17 bp, Homo sapiens
caagccgtggcttcccg

SEQ ID NO: 184829 - DNA, 18 bp, Homo sapiens
caagccgtggcttcccgc

SEQ ID NO: 184830 - DNA, 20 bp, Homo sapiens
caagcgaggtcaacagagaa

SEQ ID NO: 184831 - DNA, 12 bp, Homo sapiens
caagctcacagt

SEQ ID NO: 184832 - DNA, 20 bp, Homo sapiens
caagctcacagttcctcgcc

SEQ ID NO: 184833 - DNA, 22 bp, Homo sapiens
caagctcacagttcctcgccct

SEQ ID NO: 184834 - DNA, 18 bp, Homo sapiens
caagctgcaccctcaggc

SEQ ID NO: 184835 - DNA, 22 bp, Homo sapiens
caagctgcaccctcaggcaggt

SEQ ID NO: 184836 - DNA, 19 bp, Homo sapiens
caagcttcagtttcctggt

SEQ ID NO: 184837 - DNA, 14 bp, Homo sapiens
caaggaaaggcctg

SEQ ID NO: 184838 - DNA, 15 bp, Homo sapiens
caaggactgcaggga

SEQ ID NO: 184839 - DNA, 13 bp, Homo sapiens
caaggaggaaaaa

SEQ ID NO: 184840 - DNA, 14 bp, Homo sapiens
caaggaggaaaaac

SEQ ID NO: 184841 - DNA, 12 bp, Homo sapiens
caaggagggaga

SEQ ID NO: 184842 - DNA, 22 bp, Homo sapiens
caaggccgctgttcacccacag

SEQ ID NO: 184843 - DNA, 16 bp, Homo sapiens
caaggcgtgaggatgg

SEQ ID NO: 184844 - DNA, 15 bp, Homo sapiens
caaggctctgagcaa

SEQ ID NO: 184845 - DNA, 21 bp, Homo sapiens
caaggctgggggaagaagctc

SEQ ID NO: 184846 - DNA, 20 bp, Homo sapiens
caagggctttgttttgcaca

SEQ ID NO: 184847 - DNA, 18 bp, Homo sapiens
caaggggcagtctggagg

SEQ ID NO: 184848 - DNA, 16 bp, Homo sapiens
caagggtctagggaga

SEQ ID NO: 184849 - DNA, 21 bp, Homo sapiens
caagggtgatgggaaagcatt

SEQ ID NO: 184850 - DNA, 12 bp, Homo sapiens
caaggtgggagg

SEQ ID NO: 184851 - DNA, 23 bp, Homo sapiens
caaggtgggaggattgcttgagc

SEQ ID NO: 184852 - DNA, 13 bp, Homo sapiens
caagtactgctgt

SEQ ID NO: 184853 - DNA, 14 bp, Homo sapiens
caagtactgctgta

SEQ ID NO: 184854 - DNA, 19 bp, Homo sapiens
caagtcaaccaatgtagaa

SEQ ID NO: 184855 - DNA, 23 bp, Homo sapiens
caagtcagtccaggatgctaaca

SEQ ID NO: 184856 - DNA, 19 bp, Homo sapiens
caagtctggatctgggacc

SEQ ID NO: 184857 - DNA, 19 bp, Homo sapiens
caagtgaaaaaggaggaag

SEQ ID NO: 184858 - DNA, 22 bp, Homo sapiens
caagtgaaaaaggaggaagaga

SEQ ID NO: 184859 - DNA, 14 bp, Homo sapiens
caagtgaagaaaag

SEQ ID NO: 184860 - DNA, 12 bp, Homo sapiens
caagtgaaggtt

SEQ ID NO: 184861 - DNA, 14 bp, Homo sapiens
caagtgaaggttta

SEQ ID NO: 184862 - DNA, 21 bp, Homo sapiens
caagtgaaggtttacaattta

SEQ ID NO: 184863 - DNA, 16 bp, Homo sapiens
caagtgacatctcttt

SEQ ID NO: 184864 - DNA, 17 bp, Homo sapiens
caagtgctgaacagtgg

SEQ ID NO: 184865 - DNA, 19 bp, Homo sapiens
caagtggctcccacaccct

SEQ ID NO: 184866 - DNA, 20 bp, Homo sapiens
caagtgtctcagtccacctg

SEQ ID NO: 184867 - DNA, 23 bp, Homo sapiens
caagtgtgtatgtgcgtgtgtgc

SEQ ID NO: 184868 - DNA, 20 bp, Homo sapiens
caagtgtgtgcacatgtgtg

SEQ ID NO: 184869 - DNA, 17 bp, Homo sapiens
caagtgtgtgcatgtgt

SEQ ID NO: 184870 - DNA, 11 bp, Homo sapiens
caagtgtgtgt

SEQ ID NO: 184871 - DNA, 17 bp, Homo sapiens
caagtgtgtgtgcgtgt

SEQ ID NO: 184872 - DNA, 14 bp, Homo sapiens
caagttaaataaat

SEQ ID NO: 184873 - DNA, 19 bp, Homo sapiens
caagttattgacaaactct

SEQ ID NO: 184874 - DNA, 17 bp, Homo sapiens
caagttgtggtgctgac

SEQ ID NO: 184875 - DNA, 13 bp, Homo sapiens
caagttttgtgta

SEQ ID NO: 184876 - DNA, 17 bp, Homo sapiens
caataaatgtgcttatg

SEQ ID NO: 184877 - DNA, 18 bp, Homo sapiens
caataaggtcaatgccag

SEQ ID NO: 184878 - DNA, 22 bp, Homo sapiens
caataatttcaggttttgtaaa

SEQ ID NO: 184879 - DNA, 17 bp, Homo sapiens
caatacagtacaggcag

SEQ ID NO: 184880 - DNA, 15 bp, Homo sapiens
caatacatgctgcta

SEQ ID NO: 184881 - DNA, 23 bp, Homo sapiens
caatagaaactcaccatgtaaaa

SEQ ID NO: 184882 - DNA, 21 bp, Homo sapiens
caatatcttttttttaataaa

SEQ ID NO: 184883 - DNA, 15 bp, Homo sapiens
caatatgtaaatagt

SEQ ID NO: 184884 - DNA, 21 bp, Homo sapiens
caatatgtaaatagtgcagaa

SEQ ID NO: 184885 - DNA, 13 bp, Homo sapiens
caatattataatt

SEQ ID NO: 184886 - DNA, 17 bp, Homo sapiens
caatattcgctgtgtca

SEQ ID NO: 184887 - DNA, 13 bp, Homo sapiens
caatatttattat

SEQ ID NO: 184888 - DNA, 18 bp, Homo sapiens
caatcagctccttcctgg

SEQ ID NO: 184889 - DNA, 17 bp, Homo sapiens
caatcatgaaatatgca

SEQ ID NO: 184890 - DNA, 17 bp, Homo sapiens
caatcccaccaaccctc

SEQ ID NO: 184891 - DNA, 21 bp, Homo sapiens
caatcccctcattcaggaaaa

SEQ ID NO: 184892 - DNA, 18 bp, Homo sapiens
caatcctgtgggtgaaga

SEQ ID NO: 184893 - DNA, 15 bp, Homo sapiens
caatctaaccacatc

SEQ ID NO: 184894 - DNA, 19 bp, Homo sapiens
caatgaaatgctctccttt

SEQ ID NO: 184895 - DNA, 21 bp, Homo sapiens
caatgaaatgctctcctttcc

SEQ ID NO: 184896 - DNA, 22 bp, Homo sapiens
caatgcacacaaaacaacccta

SEQ ID NO: 184897 - DNA, 15 bp, Homo sapiens
caatgggcactggga

SEQ ID NO: 184898 - DNA, 21 bp, Homo sapiens
caatgtcttgatgcatgcact

SEQ ID NO: 184899 - DNA, 17 bp, Homo sapiens
caatgtgataaaacccc

SEQ ID NO: 184900 - DNA, 13 bp, Homo sapiens
caatgtgccccca

SEQ ID NO: 184901 - DNA, 21 bp, Homo sapiens
caatgtggttgcaaggccgct

SEQ ID NO: 184902 - DNA, 13 bp, Homo sapiens
caatgttcatcat

SEQ ID NO: 184903 - DNA, 15 bp, Homo sapiens
caatgttcatcccat

SEQ ID NO: 184904 - DNA, 18 bp, Homo sapiens
caattaataaaaaatgga

SEQ ID NO: 184905 - DNA, 20 bp, Homo sapiens
caattcacatctaacctcat

SEQ ID NO: 184906 - DNA, 21 bp, Homo sapiens
caattcagtgctgtacttgat

SEQ ID NO: 184907 - DNA, 14 bp, Homo sapiens
caattgcatctccc

SEQ ID NO: 184908 - DNA, 22 bp, Homo sapiens
caattgggatggcgctaggcat

SEQ ID NO: 184909 - DNA, 20 bp, Homo sapiens
caatttcctttatatttagt

SEQ ID NO: 184910 - DNA, 21 bp, Homo sapiens
caatttctactttgaagtcat

SEQ ID NO: 184911 - DNA, 23 bp, Homo sapiens
caatttgtaattgcttacatttt

SEQ ID NO: 184912 - DNA, 22 bp, Homo sapiens
cacaaaataaccaatcctggac

SEQ ID NO: 184913 - DNA, 11 bp, Homo sapiens
cacaacagatt

SEQ ID NO: 184914 - DNA, 18 bp, Homo sapiens
cacaaccttctgtggctc

SEQ ID NO: 184915 - DNA, 20 bp, Homo sapiens
cacaacttgtttttggtttt

SEQ ID NO: 184916 - DNA, 21 bp, Homo sapiens
cacaagaaatgaaagcaggga

SEQ ID NO: 184917 - DNA, 23 bp, Homo sapiens
cacaagaaatgaaagcagggact

SEQ ID NO: 184918 - DNA, 20 bp, Homo sapiens
cacaagaaatttgatttcta

SEQ ID NO: 184919 - DNA, 15 bp, Homo sapiens
cacaagattcccaga

SEQ ID NO: 184920 - DNA, 17 bp, Homo sapiens
cacaagattcccagaga

SEQ ID NO: 184921 - DNA, 19 bp, Homo sapiens
cacaagattcccagagaca

SEQ ID NO: 184922 - DNA, 22 bp, Homo sapiens
cacaatgaaatgctctcctttc

SEQ ID NO: 184923 - DNA, 15 bp, Homo sapiens
cacacacacacacaa

SEQ ID NO: 184924 - DNA, 21 bp, Homo sapiens
cacacacaggcaactgaggca

SEQ ID NO: 184925 - DNA, 15 bp, Homo sapiens
cacacagctgcagag

SEQ ID NO: 184926 - DNA, 23 bp, Homo sapiens
cacacatataaacatcacacaca

SEQ ID NO: 184927 - DNA, 16 bp, Homo sapiens
cacacccactcagctc

SEQ ID NO: 184928 - DNA, 14 bp, Homo sapiens
cacacccagcctca

SEQ ID NO: 184929 - DNA, 19 bp, Homo sapiens
cacacccagcctcagtcct

SEQ ID NO: 184930 - DNA, 17 bp, Homo sapiens
cacaccctctcccagga

SEQ ID NO: 184931 - DNA, 20 bp, Homo sapiens
cacacgtctgaccctctcca

SEQ ID NO: 184932 - DNA, 17 bp, Homo sapiens
cacactgaggcagggaa

SEQ ID NO: 184933 - DNA, 16 bp, Homo sapiens
cacactgcaagagcct

SEQ ID NO: 184934 - DNA, 19 bp, Homo sapiens
cacactgcaagagccttgg

SEQ ID NO: 184935 - DNA, 21 bp, Homo sapiens
cacactgcaagagccttggtg

SEQ ID NO: 184936 - DNA, 21 bp, Homo sapiens
cacacttcaggctcttctcct

SEQ ID NO: 184937 - DNA, 13 bp, Homo sapiens
cacagaaacacaa

SEQ ID NO: 184938 - DNA, 21 bp, Homo sapiens
cacagaaacacaatattttgt

SEQ ID NO: 184939 - DNA, 22 bp, Homo sapiens
cacagaaagactgagctcaagg

SEQ ID NO: 184940 - DNA, 19 bp, Homo sapiens
cacagaagaggctggttct

SEQ ID NO: 184941 - DNA, 18 bp, Homo sapiens
cacagacattctgccagg

SEQ ID NO: 184942 - DNA, 21 bp, Homo sapiens
cacagcagttgaaaagactcc

SEQ ID NO: 184943 - DNA, 22 bp, Homo sapiens
cacagcagttgaaaagactcca

SEQ ID NO: 184944 - DNA, 14 bp, Homo sapiens
cacagcctcccctg

SEQ ID NO: 184945 - DNA, 17 bp, Homo sapiens
cacagcctcccctgcca

SEQ ID NO: 184946 - DNA, 20 bp, Homo sapiens
cacagcctcccctgccaggg

SEQ ID NO: 184947 - DNA, 11 bp, Homo sapiens
cacagcctctg

SEQ ID NO: 184948 - DNA, 14 bp, Homo sapiens
cacagcctctgacc

SEQ ID NO: 184949 - DNA, 16 bp, Homo sapiens
cacagcggcccctgca

SEQ ID NO: 184950 - DNA, 20 bp, Homo sapiens
cacagcggggccccagggct

SEQ ID NO: 184951 - DNA, 15 bp, Homo sapiens
cacagctcccacccc

SEQ ID NO: 184952 - DNA, 14 bp, Homo sapiens
cacagcttcccctc

SEQ ID NO: 184953 - DNA, 15 bp, Homo sapiens
cacagcttcccctct

SEQ ID NO: 184954 - DNA, 22 bp, Homo sapiens
cacagcttcccctctctcctcc

SEQ ID NO: 184955 - DNA, 17 bp, Homo sapiens
cacaggcaactgaggca

SEQ ID NO: 184956 - DNA, 21 bp, Homo sapiens
cacaggcccttcctctccact

SEQ ID NO: 184957 - DNA, 17 bp, Homo sapiens
cacagggacttgaagtt

SEQ ID NO: 184958 - DNA, 20 bp, Homo sapiens
cacagggcatgccccggcca

SEQ ID NO: 184959 - DNA, 19 bp, Homo sapiens
cacagtgcatctcagccca

SEQ ID NO: 184960 - DNA, 19 bp, Homo sapiens
cacagttttctgagaaaga

SEQ ID NO: 184961 - DNA, 15 bp, Homo sapiens
cacataccctccccc

SEQ ID NO: 184962 - DNA, 19 bp, Homo sapiens
cacatcacccttaccatgt

SEQ ID NO: 184963 - DNA, 12 bp, Homo sapiens
cacatctgtgtc

SEQ ID NO: 184964 - DNA, 18 bp, Homo sapiens
cacatgagctatttccat

SEQ ID NO: 184965 - DNA, 22 bp, Homo sapiens
cacatggtgctacgcctgcatg

SEQ ID NO: 184966 - DNA, 20 bp, Homo sapiens
cacatgtcagtaccttcaaa

SEQ ID NO: 184967 - DNA, 21 bp, Homo sapiens
cacatgtttagagttgcaatc

SEQ ID NO: 184968 - DNA, 22 bp, Homo sapiens
caccaacatcccattgccctgg

SEQ ID NO: 184969 - DNA, 14 bp, Homo sapiens
caccaactcttgca

SEQ ID NO: 184970 - DNA, 14 bp, Homo sapiens
caccaagctcacag

SEQ ID NO: 184971 - DNA, 15 bp, Homo sapiens
caccaagctcacagt

SEQ ID NO: 184972 - DNA, 19 bp, Homo sapiens
caccaagctcacagttcct

SEQ ID NO: 184973 - DNA, 14 bp, Homo sapiens
caccacacccagcc

SEQ ID NO: 184974 - DNA, 14 bp, Homo sapiens
caccaccccagctg

SEQ ID NO: 184975 - DNA, 14 bp, Homo sapiens
caccacctccctca

SEQ ID NO: 184976 - DNA, 13 bp, Homo sapiens
caccaccttccca

SEQ ID NO: 184977 - DNA, 16 bp, Homo sapiens
caccaccttcccagct

SEQ ID NO: 184978 - DNA, 22 bp, Homo sapiens
caccaccttcccagctctccct

SEQ ID NO: 184979 - DNA, 18 bp, Homo sapiens
caccacgatgtggccctg

SEQ ID NO: 184980 - DNA, 20 bp, Homo sapiens
caccacgatgtggccctggc

SEQ ID NO: 184981 - DNA, 19 bp, Homo sapiens
caccacgctggggtctggg

SEQ ID NO: 184982 - DNA, 15 bp, Homo sapiens
caccacgtccagctg

SEQ ID NO: 184983 - DNA, 21 bp, Homo sapiens
caccagagagggactgacacc

SEQ ID NO: 184984 - DNA, 14 bp, Homo sapiens
caccagcagcctgg

SEQ ID NO: 184985 - DNA, 22 bp, Homo sapiens
caccagcctttctcccaggcca

SEQ ID NO: 184986 - DNA, 21 bp, Homo sapiens
caccaggaatgttaaagtcag

SEQ ID NO: 184987 - DNA, 23 bp, Homo sapiens
caccaggcacgaacccacctgct

SEQ ID NO: 184988 - DNA, 13 bp, Homo sapiens
caccagtgtcccc

SEQ ID NO: 184989 - DNA, 21 bp, Homo sapiens
caccatcctgcagcctcctcc

SEQ ID NO: 184990 - DNA, 16 bp, Homo sapiens
caccatggccagccaa

SEQ ID NO: 184991 - DNA, 23 bp, Homo sapiens
caccatggggtcctaccaataga

SEQ ID NO: 184992 - DNA, 22 bp, Homo sapiens
caccatgtttgagctcagaccc

SEQ ID NO: 184993 - DNA, 23 bp, Homo sapiens
caccatgtttgagctcagacccc

SEQ ID NO: 184994 - DNA, 14 bp, Homo sapiens
cacccacccagcac

SEQ ID NO: 184995 - DNA, 13 bp, Homo sapiens
cacccactcagct

SEQ ID NO: 184996 - DNA, 17 bp, Homo sapiens
cacccagtctgttcccc

SEQ ID NO: 184997 - DNA, 23 bp, Homo sapiens
cacccagtgagcactcccaagtc

SEQ ID NO: 184998 - DNA, 18 bp, Homo sapiens
cacccatgtttctctggc

SEQ ID NO: 184999 - DNA, 18 bp, Homo sapiens
caccccaaagctttcctg

SEQ ID NO: 185000 - DNA, 13 bp, Homo sapiens
caccccaccccct

SEQ ID NO: 185001 - DNA, 14 bp, Homo sapiens
caccccacccttcc

SEQ ID NO: 185002 - DNA, 17 bp, Homo sapiens
caccccagggcctgagc

SEQ ID NO: 185003 - DNA, 22 bp, Homo sapiens
caccccatagtgaccggctgct

SEQ ID NO: 185004 - DNA, 12 bp, Homo sapiens
cacccccaaggg

SEQ ID NO: 185005 - DNA, 19 bp, Homo sapiens
cacccccaaggggcagtct

SEQ ID NO: 185006 - DNA, 17 bp, Homo sapiens
cacccccatctctccct

SEQ ID NO: 185007 - DNA, 13 bp, Homo sapiens
caccccccagaac

SEQ ID NO: 185008 - DNA, 18 bp, Homo sapiens
caccccccagaacctgtc

SEQ ID NO: 185009 - DNA, 20 bp, Homo sapiens
caccccccagaacctgtcct

SEQ ID NO: 185010 - DNA, 11 bp, Homo sapiens
caccccctccc

SEQ ID NO: 185011 - DNA, 18 bp, Homo sapiens
caccccctccccagggga

SEQ ID NO: 185012 - DNA, 17 bp, Homo sapiens
cacccccttcagtgccc

SEQ ID NO: 185013 - DNA, 20 bp, Homo sapiens
cacccccttcagtgcccacc

SEQ ID NO: 185014 - DNA, 21 bp, Homo sapiens
cacccccttcagtgcccacca

SEQ ID NO: 185015 - DNA, 22 bp, Homo sapiens
caccccgtctggggttcagccc

SEQ ID NO: 185016 - DNA, 12 bp, Homo sapiens
cacccctcactc

SEQ ID NO: 185017 - DNA, 15 bp, Homo sapiens
cacccctcccctgcc

SEQ ID NO: 185018 - DNA, 16 bp, Homo sapiens
cacccctgccctggga

SEQ ID NO: 185019 - DNA, 17 bp, Homo sapiens
cacccctgtcctcactg

SEQ ID NO: 185020 - DNA, 20 bp, Homo sapiens
cacccctgtcctcactgctc

SEQ ID NO: 185021 - DNA, 17 bp, Homo sapiens
caccctccacctcttca

SEQ ID NO: 185022 - DNA, 20 bp, Homo sapiens
caccctcccccgccactcct

SEQ ID NO: 185023 - DNA, 24 bp, Homo sapiens
caccctcgaagcgcgccactcgct

SEQ ID NO: 185024 - DNA, 13 bp, Homo sapiens
caccctgccttat

SEQ ID NO: 185025 - DNA, 23 bp, Homo sapiens
cacccttcccctccttctccctt

SEQ ID NO: 185026 - DNA, 21 bp, Homo sapiens
cacccttggaggctgtcttct

SEQ ID NO: 185027 - DNA, 15 bp, Homo sapiens
cacccttttccagct

SEQ ID NO: 185028 - DNA, 17 bp, Homo sapiens
cacccttttccagctgg

SEQ ID NO: 185029 - DNA, 17 bp, Homo sapiens
caccgacgcgtctcctg

SEQ ID NO: 185030 - DNA, 12 bp, Homo sapiens
caccgctgccta

SEQ ID NO: 185031 - DNA, 13 bp, Homo sapiens
caccgctgcctaa

SEQ ID NO: 185032 - DNA, 13 bp, Homo sapiens
caccgtgggctcc

SEQ ID NO: 185033 - DNA, 21 bp, Homo sapiens
caccgttggggattggggaag

SEQ ID NO: 185034 - DNA, 21 bp, Homo sapiens
cacctacatgaggtactgaga

SEQ ID NO: 185035 - DNA, 16 bp, Homo sapiens
cacctaggccactcct

SEQ ID NO: 185036 - DNA, 19 bp, Homo sapiens
cacctaggccactcctcca

SEQ ID NO: 185037 - DNA, 16 bp, Homo sapiens
cacctccacatcctcc

SEQ ID NO: 185038 - DNA, 13 bp, Homo sapiens
cacctcccatcct

SEQ ID NO: 185039 - DNA, 14 bp, Homo sapiens
cacctccccaggcc

SEQ ID NO: 185040 - DNA, 15 bp, Homo sapiens
cacctccccccactg

SEQ ID NO: 185041 - DNA, 22 bp, Homo sapiens
cacctccccccactgcaggccc

SEQ ID NO: 185042 - DNA, 20 bp, Homo sapiens
cacctcccctatccacccag

SEQ ID NO: 185043 - DNA, 13 bp, Homo sapiens
cacctctgcctca

SEQ ID NO: 185044 - DNA, 19 bp, Homo sapiens
cacctctgcggaccccagc

SEQ ID NO: 185045 - DNA, 20 bp, Homo sapiens
cacctctgcggaccccagct

SEQ ID NO: 185046 - DNA, 18 bp, Homo sapiens
cacctctgtgacctcagg

SEQ ID NO: 185047 - DNA, 20 bp, Homo sapiens
cacctctgtgacctcaggca

SEQ ID NO: 185048 - DNA, 14 bp, Homo sapiens
cacctcttcacccc

SEQ ID NO: 185049 - DNA, 20 bp, Homo sapiens
cacctcttcaccccccactc

SEQ ID NO: 185050 - DNA, 20 bp, Homo sapiens
cacctgagcaggacctctga

SEQ ID NO: 185051 - DNA, 11 bp, Homo sapiens
cacctgcacct

SEQ ID NO: 185052 - DNA, 13 bp, Homo sapiens
cacctgcacctcc

SEQ ID NO: 185053 - DNA, 18 bp, Homo sapiens
cacctgcccaacctgctc

SEQ ID NO: 185054 - DNA, 13 bp, Homo sapiens
cacctgcccagat

SEQ ID NO: 185055 - DNA, 13 bp, Homo sapiens
cacctgccgacct

SEQ ID NO: 185056 - DNA, 21 bp, Homo sapiens
cacctgccgacctcgtcctcc

SEQ ID NO: 185057 - DNA, 13 bp, Homo sapiens
cacctgctcccag

SEQ ID NO: 185058 - DNA, 19 bp, Homo sapiens
cacctgctcccaggccagt

SEQ ID NO: 185059 - DNA, 17 bp, Homo sapiens
cacctggcactgctgtg

SEQ ID NO: 185060 - DNA, 15 bp, Homo sapiens
cacctggccccatgt

SEQ ID NO: 185061 - DNA, 19 bp, Homo sapiens
cacctggggcagtcacctg

SEQ ID NO: 185062 - DNA, 23 bp, Homo sapiens
cacctggttccggaatcctgtcc

SEQ ID NO: 185063 - DNA, 15 bp, Homo sapiens
cacctgtctcagcct

SEQ ID NO: 185064 - DNA, 17 bp, Homo sapiens
cacctgtctcagcctcc

SEQ ID NO: 185065 - DNA, 18 bp, Homo sapiens
cacctgtctcagcctccc

SEQ ID NO: 185066 - DNA, 20 bp, Homo sapiens
cacctgtgagtttaaagcaa

SEQ ID NO: 185067 - DNA, 14 bp, Homo sapiens
cagaaggacctcct

SEQ ID NO: 185068 - DNA, 14 bp, Homo sapiens
cagaaggaggagga

SEQ ID NO: 185069 - DNA, 19 bp, Homo sapiens
cagaagtttctcagctccc

SEQ ID NO: 185070 - DNA, 19 bp, Homo sapiens
cagaagtttgtcaagtcaa

SEQ ID NO: 185071 - DNA, 15 bp, Homo sapiens
cagaattccttttct

SEQ ID NO: 185072 - DNA, 12 bp, Homo sapiens
cagacacacaca

SEQ ID NO: 185073 - DNA, 22 bp, Homo sapiens
cagacacggatctgagaatctt

SEQ ID NO: 185074 - DNA, 13 bp, Homo sapiens
cagacagcagctc

SEQ ID NO: 185075 - DNA, 18 bp, Homo sapiens
cagacagcagctcaggca

SEQ ID NO: 185076 - DNA, 19 bp, Homo sapiens
cagacagcagctcaggcac

SEQ ID NO: 185077 - DNA, 11 bp, Homo sapiens
cagacagctcc

SEQ ID NO: 185078 - DNA, 19 bp, Homo sapiens
cagacagctccctctgcct

SEQ ID NO: 185079 - DNA, 18 bp, Homo sapiens
cagacaggctcttagcag

SEQ ID NO: 185080 - DNA, 20 bp, Homo sapiens
cagacaggctcttagcagct

SEQ ID NO: 185081 - DNA, 22 bp, Homo sapiens
cagacaggctcttagcagcttc

SEQ ID NO: 185082 - DNA, 19 bp, Homo sapiens
cagacagtgttttctggga

SEQ ID NO: 185083 - DNA, 19 bp, Homo sapiens
cagacatagaattaacaca

SEQ ID NO: 185084 - DNA, 22 bp, Homo sapiens
cagacatccatgtttgtaaaac

SEQ ID NO: 185085 - DNA, 23 bp, Homo sapiens
cagacatccatgtttgtaaaact

SEQ ID NO: 185086 - DNA, 20 bp, Homo sapiens
cagaccacaaaacttttcta

SEQ ID NO: 185087 - DNA, 16 bp, Homo sapiens
cagaccataatgttac

SEQ ID NO: 185088 - DNA, 14 bp, Homo sapiens
cagaccccagcggc

SEQ ID NO: 185089 - DNA, 18 bp, Homo sapiens
cagacccctggcttttca

SEQ ID NO: 185090 - DNA, 21 bp, Homo sapiens
cagacccctggcttttcactg

SEQ ID NO: 185091 - DNA, 16 bp, Homo sapiens
cagaccctaccccacc

SEQ ID NO: 185092 - DNA, 22 bp, Homo sapiens
cagacctaggatttcatgattt

SEQ ID NO: 185093 - DNA, 12 bp, Homo sapiens
cagacctcccca

SEQ ID NO: 185094 - DNA, 19 bp, Homo sapiens
cagacctccccagccccta

SEQ ID NO: 185095 - DNA, 23 bp, Homo sapiens
cagacctccccagcccctagccc

SEQ ID NO: 185096 - DNA, 22 bp, Homo sapiens
cagacctgagctccccaccacc

SEQ ID NO: 185097 - DNA, 19 bp, Homo sapiens
cagaccttgttcacactct

SEQ ID NO: 185098 - DNA, 13 bp, Homo sapiens
cagaccttttatc

SEQ ID NO: 185099 - DNA, 16 bp, Homo sapiens
cagacgcctgaggaac

SEQ ID NO: 185100 - DNA, 17 bp, Homo sapiens
cagacggttcaccagcc

SEQ ID NO: 185101 - DNA, 20 bp, Homo sapiens
cagactgacaaatgtgtatc

SEQ ID NO: 185102 - DNA, 22 bp, Homo sapiens
cagactggcacagttttctgag

SEQ ID NO: 185103 - DNA, 20 bp, Homo sapiens
cagactggtgagcagactgg

SEQ ID NO: 185104 - DNA, 15 bp, Homo sapiens
cagacttcacactgc

SEQ ID NO: 185105 - DNA, 20 bp, Homo sapiens
cagactttacatgacacagc

SEQ ID NO: 185106 - DNA, 12 bp, Homo sapiens
agcctcagccat

SEQ ID NO: 185107 - DNA, 15 bp, Homo sapiens
agcctcagccattca

SEQ ID NO: 185108 - DNA, 16 bp, Homo sapiens
agcctcagtcctcccc

SEQ ID NO: 185109 - DNA, 14 bp, Homo sapiens
agcctcatatttaa

SEQ ID NO: 185110 - DNA, 17 bp, Homo sapiens
agcctcatatttaaaga

SEQ ID NO: 185111 - DNA, 19 bp, Homo sapiens
agcctcatatttaaagaca

SEQ ID NO: 185112 - DNA, 20 bp, Homo sapiens
agcctcatatttaaagacag

SEQ ID NO: 185113 - DNA, 14 bp, Homo sapiens
agcctcatccgagg

SEQ ID NO: 185114 - DNA, 18 bp, Homo sapiens
agcctcatccgaggcagg

SEQ ID NO: 185115 - DNA, 17 bp, Homo sapiens
agcctccatgctgcctc

SEQ ID NO: 185116 - DNA, 22 bp, Homo sapiens
agcctcccacgactgcccggca

SEQ ID NO: 185117 - DNA, 16 bp, Homo sapiens
agcctcccctgccagg

SEQ ID NO: 185118 - DNA, 17 bp, Homo sapiens
agcctcccctgccaggg

SEQ ID NO: 185119 - DNA, 22 bp, Homo sapiens
agcctcccctgccagggcaggg

SEQ ID NO: 185120 - DNA, 18 bp, Homo sapiens
agcctccgtatttcagac

SEQ ID NO: 185121 - DNA, 13 bp, Homo sapiens
agcctcctcctga

SEQ ID NO: 185122 - DNA, 16 bp, Homo sapiens
agcctcctcctgacca

SEQ ID NO: 185123 - DNA, 16 bp, Homo sapiens
agcctcgtcttcatta

SEQ ID NO: 185124 - DNA, 20 bp, Homo sapiens
agcctctccggcagaaggga

SEQ ID NO: 185125 - DNA, 17 bp, Homo sapiens
agcctctgacccctcct

SEQ ID NO: 185126 - DNA, 21 bp, Homo sapiens
agcctctgacttaagctgcct

SEQ ID NO: 185127 - DNA, 18 bp, Homo sapiens
agcctctgagcccctggg

SEQ ID NO: 185128 - DNA, 13 bp, Homo sapiens
agcctctgggtca

SEQ ID NO: 185129 - DNA, 22 bp, Homo sapiens
agcctcttaaagctgcctgtag

SEQ ID NO: 185130 - DNA, 21 bp, Homo sapiens
agcctgcaatttcatatgctg

SEQ ID NO: 185131 - DNA, 19 bp, Homo sapiens
agcctgcaggtgctgctgc

SEQ ID NO: 185132 - DNA, 14 bp, Homo sapiens
agcctgctccagct

SEQ ID NO: 185133 - DNA, 15 bp, Homo sapiens
agcctgctccagctg

SEQ ID NO: 185134 - DNA, 15 bp, Homo sapiens
agcctgctcccccac

SEQ ID NO: 185135 - DNA, 19 bp, Homo sapiens
agcctgctcccccaccccc

SEQ ID NO: 185136 - DNA, 14 bp, Homo sapiens
agcctgctttttaa

SEQ ID NO: 185137 - DNA, 11 bp, Homo sapiens
agcctggaggc

SEQ ID NO: 185138 - DNA, 17 bp, Homo sapiens
agcctggcacagggcag

SEQ ID NO: 185139 - DNA, 17 bp, Homo sapiens
agcctggccccatggtc

SEQ ID NO: 185140 - DNA, 11 bp, Homo sapiens
agcctggctct

SEQ ID NO: 185141 - DNA, 11 bp, Homo sapiens
agcctggtggg

SEQ ID NO: 185142 - DNA, 18 bp, Homo sapiens
agcctggtgggcctcctc

SEQ ID NO: 185143 - DNA, 17 bp, Homo sapiens
agcctgtaatcccagct

SEQ ID NO: 185144 - DNA, 19 bp, Homo sapiens
agcctgtcccatggacact

SEQ ID NO: 185145 - DNA, 15 bp, Homo sapiens
agcctgtctcttcca

SEQ ID NO: 185146 - DNA, 18 bp, Homo sapiens
agcctgtggcggtgcctg

SEQ ID NO: 185147 - DNA, 22 bp, Homo sapiens
agcctgtggcggtgcctgggtg

SEQ ID NO: 185148 - DNA, 18 bp, Homo sapiens
agccttgtaattctaaat

SEQ ID NO: 185149 - DNA, 21 bp, Homo sapiens
agcctttggctctggagacag

SEQ ID NO: 185150 - DNA, 12 bp, Homo sapiens
agcgaaactccg

SEQ ID NO: 185151 - DNA, 18 bp, Homo sapiens
agcgatggtctcagaaac

SEQ ID NO: 185152 - DNA, 18 bp, Homo sapiens
agcgcctgcccctcccag

SEQ ID NO: 185153 - DNA, 14 bp, Homo sapiens
agcggaaagcagct

SEQ ID NO: 185154 - DNA, 21 bp, Homo sapiens
agcggctgagtcatgatctcc

SEQ ID NO: 185155 - DNA, 21 bp, Homo sapiens
agcggggccccagggctaccc

SEQ ID NO: 185156 - DNA, 22 bp, Homo sapiens
agcggtctcaggctggtgggag

SEQ ID NO: 185157 - DNA, 15 bp, Homo sapiens
agcggtggccctgtc

SEQ ID NO: 185158 - DNA, 16 bp, Homo sapiens
agctaaaatgatttta

SEQ ID NO: 185159 - DNA, 15 bp, Homo sapiens
agctactcaggaggc

SEQ ID NO: 185160 - DNA, 16 bp, Homo sapiens
agctactgatttttgt

SEQ ID NO: 185161 - DNA, 17 bp, Homo sapiens
agctacttgggaggctg

SEQ ID NO: 185162 - DNA, 15 bp, Homo sapiens
agctagaaatatgat

SEQ ID NO: 185163 - DNA, 15 bp, Homo sapiens
agctagaagtgggcc

SEQ ID NO: 185164 - DNA, 24 bp, Homo sapiens
agctagaagtgggccaggacaggc

SEQ ID NO: 185165 - DNA, 19 bp, Homo sapiens
agctagtggcttcaaaata

SEQ ID NO: 185166 - DNA, 18 bp, Homo sapiens
agctagttcgtagctttc

SEQ ID NO: 185167 - DNA, 16 bp, Homo sapiens
agctatacctgtgcct

SEQ ID NO: 185168 - DNA, 20 bp, Homo sapiens
agctatgttatattgaaaaa

SEQ ID NO: 185169 - DNA, 13 bp, Homo sapiens
agctcaaaggcac

SEQ ID NO: 185170 - DNA, 16 bp, Homo sapiens
agctcaaaggcacagt

SEQ ID NO: 185171 - DNA, 20 bp, Homo sapiens
agctcacagttcctcgccct

SEQ ID NO: 185172 - DNA, 13 bp, Homo sapiens
agctcacgtcaca

SEQ ID NO: 185173 - DNA, 18 bp, Homo sapiens
agctcagacccccactct

SEQ ID NO: 185174 - DNA, 15 bp, Homo sapiens
agctcatattttgta

SEQ ID NO: 185175 - DNA, 23 bp, Homo sapiens
agctccactgtcaccctccacct

SEQ ID NO: 185176 - DNA, 21 bp, Homo sapiens
agctccatctccactccagat

SEQ ID NO: 185177 - DNA, 13 bp, Homo sapiens
agctcccacccca

SEQ ID NO: 185178 - DNA, 17 bp, Homo sapiens
agctcccaccccacccc

SEQ ID NO: 185179 - DNA, 20 bp, Homo sapiens
agctccccaccaccccagct

SEQ ID NO: 185180 - DNA, 22 bp, Homo sapiens
agctcccctcggagaagagctg

SEQ ID NO: 185181 - DNA, 13 bp, Homo sapiens
agctcctgtcctc

SEQ ID NO: 185182 - DNA, 16 bp, Homo sapiens
agctcctgtcctccca

SEQ ID NO: 185183 - DNA, 15 bp, Homo sapiens
agctccttcctggag

SEQ ID NO: 185184 - DNA, 12 bp, Homo sapiens
agctccttggga

SEQ ID NO: 185185 - DNA, 20 bp, Homo sapiens
agctccttgggaggccccac

SEQ ID NO: 185186 - DNA, 16 bp, Homo sapiens
agctcggtggacccag

SEQ ID NO: 185187 - DNA, 17 bp, Homo sapiens
agctcggtggacccagg

SEQ ID NO: 185188 - DNA, 19 bp, Homo sapiens
agctcggtggacccaggga

SEQ ID NO: 185189 - DNA, 15 bp, Homo sapiens
agctctacccagggc

SEQ ID NO: 185190 - DNA, 22 bp, Homo sapiens
agctctattaagatttccaagt

SEQ ID NO: 185191 - DNA, 18 bp, Homo sapiens
agctctccctctggccct

SEQ ID NO: 185192 - DNA, 19 bp, Homo sapiens
agctctccctctggccctg

SEQ ID NO: 185193 - DNA, 16 bp, Homo sapiens
agctctctcctccctt

SEQ ID NO: 185194 - DNA, 12 bp, Homo sapiens
agctctgcatta

SEQ ID NO: 185195 - DNA, 20 bp, Homo sapiens
agctctggtgacaccagcct

SEQ ID NO: 185196 - DNA, 23 bp, Homo sapiens
agctctgtatcaggacccagagg

SEQ ID NO: 185197 - DNA, 17 bp, Homo sapiens
agctcttctccccaggt

SEQ ID NO: 185198 - DNA, 20 bp, Homo sapiens
agctcttctgccggccctgg

SEQ ID NO: 185199 - DNA, 21 bp, Homo sapiens
agctcttctgccggccctggg

SEQ ID NO: 185200 - DNA, 22 bp, Homo sapiens
agctcttctgccggccctgggg

SEQ ID NO: 185201 - DNA, 22 bp, Homo sapiens
agctctttggcagtctatatgt

SEQ ID NO: 185202 - DNA, 12 bp, Homo sapiens
agctgaaatact

SEQ ID NO: 185203 - DNA, 16 bp, Homo sapiens
agctgaagattttgga

SEQ ID NO: 185204 - DNA, 16 bp, Homo sapiens
agctgacccagcccct

SEQ ID NO: 185205 - DNA, 15 bp, Homo sapiens
agctgacttttctgt

SEQ ID NO: 185206 - DNA, 21 bp, Homo sapiens
agctgacttttctgtccgagc

SEQ ID NO: 185207 - DNA, 14 bp, Homo sapiens
agctgagagacttt

SEQ ID NO: 185208 - DNA, 15 bp, Homo sapiens
agctgagagactttt

SEQ ID NO: 185209 - DNA, 15 bp, Homo sapiens
agctgagcaccaggg

SEQ ID NO: 185210 - DNA, 17 bp, Homo sapiens
agctgcaccctcaggca

SEQ ID NO: 185211 - DNA, 18 bp, Homo sapiens
agctgcaccctcaggcag

SEQ ID NO: 185212 - DNA, 18 bp, Homo sapiens
agctgcagagacagagag

SEQ ID NO: 185213 - DNA, 14 bp, Homo sapiens
agctgcctgtagtt

SEQ ID NO: 185214 - DNA, 18 bp, Homo sapiens
agctgcctgtagttagga

SEQ ID NO: 185215 - DNA, 22 bp, Homo sapiens
agctgcctgtagttaggaaata

SEQ ID NO: 185216 - DNA, 13 bp, Homo sapiens
agctgctcccctc

SEQ ID NO: 185217 - DNA, 14 bp, Homo sapiens
agctgctcccctcc

SEQ ID NO: 185218 - DNA, 19 bp, Homo sapiens
agctgctcccctccctcct

SEQ ID NO: 185219 - DNA, 14 bp, Homo sapiens
agctgctgaaacaa

SEQ ID NO: 185220 - DNA, 20 bp, Homo sapiens
agctgctgaaacaacaaata

SEQ ID NO: 185221 - DNA, 22 bp, Homo sapiens
agctggatctccattctctcag

SEQ ID NO: 185222 - DNA, 20 bp, Homo sapiens
agctggatgatggtcttcag

SEQ ID NO: 185223 - DNA, 14 bp, Homo sapiens
agttttctgagaaa

SEQ ID NO: 185224 - DNA, 18 bp, Homo sapiens
agttttctgagaaagact

SEQ ID NO: 185225 - DNA, 17 bp, Homo sapiens
agtttttcagaaagcat

SEQ ID NO: 185226 - DNA, 22 bp, Homo sapiens
ataaaaataaatttggttctaa

SEQ ID NO: 185227 - DNA, 23 bp, Homo sapiens
ataaaaatattgtgttgtgaatg

SEQ ID NO: 185228 - DNA, 15 bp, Homo sapiens
ataaaacctttcaaa

SEQ ID NO: 185229 - DNA, 22 bp, Homo sapiens
ataaaacctttcaaatttcaca

SEQ ID NO: 185230 - DNA, 17 bp, Homo sapiens
ataaaactttgctgcca

SEQ ID NO: 185231 - DNA, 15 bp, Homo sapiens
ataaaagcataaatg

SEQ ID NO: 185232 - DNA, 20 bp, Homo sapiens
ataaaagcataaatgcaaac

SEQ ID NO: 185233 - DNA, 14 bp, Homo sapiens
ataaaataaagtat

SEQ ID NO: 185234 - DNA, 13 bp, Homo sapiens
ataaaattatgcc

SEQ ID NO: 185235 - DNA, 13 bp, Homo sapiens
ataaacattgtat

SEQ ID NO: 185236 - DNA, 19 bp, Homo sapiens
ataaacctaaaaaagatat

SEQ ID NO: 185237 - DNA, 14 bp, Homo sapiens
ataaactatcagtt

SEQ ID NO: 185238 - DNA, 11 bp, Homo sapiens
ataaagatgat

SEQ ID NO: 185239 - DNA, 15 bp, Homo sapiens
ataaagatgctcttt

SEQ ID NO: 185240 - DNA, 16 bp, Homo sapiens
ataaaggttgacaata

SEQ ID NO: 185241 - DNA, 21 bp, Homo sapiens
ataaaggttgacaataaatgt

SEQ ID NO: 185242 - DNA, 14 bp, Homo sapiens
ataaagtaaagcta

SEQ ID NO: 185243 - DNA, 18 bp, Homo sapiens
ataaagttggtgacagat

SEQ ID NO: 185244 - DNA, 21 bp, Homo sapiens
ataaataatcggcccacagct

SEQ ID NO: 185245 - DNA, 16 bp, Homo sapiens
ataaatatatataaac

SEQ ID NO: 185246 - DNA, 22 bp, Homo sapiens
ataaatatatataaacctaaaa

SEQ ID NO: 185247 - DNA, 18 bp, Homo sapiens
ataaatatttttgccata

SEQ ID NO: 185248 - DNA, 23 bp, Homo sapiens
ataacactataaaggttgacaat

SEQ ID NO: 185249 - DNA, 16 bp, Homo sapiens
ataactagtgttgctt

SEQ ID NO: 185250 - DNA, 16 bp, Homo sapiens
ataactcatcataaaa

SEQ ID NO: 185251 - DNA, 18 bp, Homo sapiens
ataactcatcataaaata

SEQ ID NO: 185252 - DNA, 18 bp, Homo sapiens
ataactgaaggagaaggt

SEQ ID NO: 185253 - DNA, 16 bp, Homo sapiens
ataacttaaaaaaatg

SEQ ID NO: 185254 - DNA, 14 bp, Homo sapiens
atatattttttgta

SEQ ID NO: 185255 - DNA, 19 bp, Homo sapiens
atatcagttactcagccct

SEQ ID NO: 185256 - DNA, 20 bp, Homo sapiens
atatcagttactcagccctg

SEQ ID NO: 185257 - DNA, 14 bp, Homo sapiens
atatcatattggta

SEQ ID NO: 185258 - DNA, 21 bp, Homo sapiens
atatcatttattttttacatt

SEQ ID NO: 185259 - DNA, 17 bp, Homo sapiens
atatccctacatgtatt

SEQ ID NO: 185260 - DNA, 16 bp, Homo sapiens
atatcctttctaacaa

SEQ ID NO: 185261 - DNA, 16 bp, Homo sapiens
atatctgcttcagtgg

SEQ ID NO: 185262 - DNA, 13 bp, Homo sapiens
atatgatttatag

SEQ ID NO: 185263 - DNA, 14 bp, Homo sapiens
atatgatttatagt

SEQ ID NO: 185264 - DNA, 13 bp, Homo sapiens
atatgcaaagcac

SEQ ID NO: 185265 - DNA, 16 bp, Homo sapiens
atatgcaaagcactga

SEQ ID NO: 185266 - DNA, 17 bp, Homo sapiens
atatggcagagttgtaa

SEQ ID NO: 185267 - DNA, 20 bp, Homo sapiens
atatggcagagttgtaaata

SEQ ID NO: 185268 - DNA, 14 bp, Homo sapiens
atatgtaccatgta

SEQ ID NO: 185269 - DNA, 23 bp, Homo sapiens
atatgtacctaacgaagtatcct

SEQ ID NO: 185270 - DNA, 18 bp, Homo sapiens
atatgtgctggaattcta

SEQ ID NO: 185271 - DNA, 21 bp, Homo sapiens
atatgttttgtgggaacagat

SEQ ID NO: 185272 - DNA, 22 bp, Homo sapiens
atattaaggaagacaatgtgaa

SEQ ID NO: 185273 - DNA, 22 bp, Homo sapiens
atattctcacgggcagtagctg

SEQ ID NO: 185274 - DNA, 14 bp, Homo sapiens
atattcttatgtat

SEQ ID NO: 185275 - DNA, 15 bp, Homo sapiens
atattgatatgctta

SEQ ID NO: 185276 - DNA, 15 bp, Homo sapiens
atattgtcagatatt

SEQ ID NO: 185277 - DNA, 15 bp, Homo sapiens
atattgtcattcctg

SEQ ID NO: 185278 - DNA, 14 bp, Homo sapiens
atatttaaacagca

SEQ ID NO: 185279 - DNA, 14 bp, Homo sapiens
atatttaaagacag

SEQ ID NO: 185280 - DNA, 13 bp, Homo sapiens
atatttaatgata

SEQ ID NO: 185281 - DNA, 21 bp, Homo sapiens
atatttagttatagtttcaga

SEQ ID NO: 185282 - DNA, 11 bp, Homo sapiens
atatttataac

SEQ ID NO: 185283 - DNA, 21 bp, Homo sapiens
atatttataactcatcataaa

SEQ ID NO: 185284 - DNA, 23 bp, Homo sapiens
atatttataactcatcataaaat

SEQ ID NO: 185285 - DNA, 16 bp, Homo sapiens
atatttattacctctg

SEQ ID NO: 185286 - DNA, 15 bp, Homo sapiens
atatttcgaaagctg

SEQ ID NO: 185287 - DNA, 14 bp, Homo sapiens
atcaaaagaaagaa

SEQ ID NO: 185288 - DNA, 13 bp, Homo sapiens
atctgagaatctt

SEQ ID NO: 185289 - DNA, 17 bp, Homo sapiens
atctgcacccccctggg

SEQ ID NO: 185290 - DNA, 19 bp, Homo sapiens
atctgcacccccctgggct

SEQ ID NO: 185291 - DNA, 14 bp, Homo sapiens
atctgcagaaggaa

SEQ ID NO: 185292 - DNA, 17 bp, Homo sapiens
atctgcaggcagacacg

SEQ ID NO: 185293 - DNA, 14 bp, Homo sapiens
atctgcttcagtgg

SEQ ID NO: 185294 - DNA, 15 bp, Homo sapiens
atctggactcctctg

SEQ ID NO: 185295 - DNA, 20 bp, Homo sapiens
atctgggaccctttccttcc

SEQ ID NO: 185296 - DNA, 17 bp, Homo sapiens
atctgtataagtaagaa

SEQ ID NO: 185297 - DNA, 14 bp, Homo sapiens
atctgtgcccagag

SEQ ID NO: 185298 - DNA, 19 bp, Homo sapiens
atctgtgctcaggactcag

SEQ ID NO: 185299 - DNA, 12 bp, Homo sapiens
atctgtgtcttg

SEQ ID NO: 185300 - DNA, 21 bp, Homo sapiens
atctgttgtgtacgtggagag

SEQ ID NO: 185301 - DNA, 23 bp, Homo sapiens
atctgttgtgtacgtggagaggg

SEQ ID NO: 185302 - DNA, 14 bp, Homo sapiens
atctgttttaaatt

SEQ ID NO: 185303 - DNA, 16 bp, Homo sapiens
atcttaattattgtac

SEQ ID NO: 185304 - DNA, 19 bp, Homo sapiens
atcttccaactcaaactct

SEQ ID NO: 185305 - DNA, 19 bp, Homo sapiens
atcttgaccaagcaggaag

SEQ ID NO: 185306 - DNA, 21 bp, Homo sapiens
atcttgaccaagcaggaagct

SEQ ID NO: 185307 - DNA, 15 bp, Homo sapiens
atcttgtctctgggc

SEQ ID NO: 185308 - DNA, 15 bp, Homo sapiens
atctttaaaatacac

SEQ ID NO: 185309 - DNA, 11 bp, Homo sapiens
atcttttacat

SEQ ID NO: 185310 - DNA, 13 bp, Homo sapiens
atctttttctaac

SEQ ID NO: 185311 - DNA, 13 bp, Homo sapiens
atgaaaaatagca

SEQ ID NO: 185312 - DNA, 13 bp, Homo sapiens
atgaaaaattctc

SEQ ID NO: 185313 - DNA, 16 bp, Homo sapiens
atgaaaatgtcttgtg

SEQ ID NO: 185314 - DNA, 20 bp, Homo sapiens
atgaaagatggctgtgcctc

SEQ ID NO: 185315 - DNA, 15 bp, Homo sapiens
atgaaatatgcatct

SEQ ID NO: 185316 - DNA, 19 bp, Homo sapiens
atgaaattttctagacttt

SEQ ID NO: 185317 - DNA, 21 bp, Homo sapiens
atgaaattttctagactttct

SEQ ID NO: 185318 - DNA, 22 bp, Homo sapiens
atgaaattttctagactttctg

SEQ ID NO: 185319 - DNA, 15 bp, Homo sapiens
atgaacggtgagcat

SEQ ID NO: 185320 - DNA, 15 bp, Homo sapiens
atgaactgaagtttc

SEQ ID NO: 185321 - DNA, 16 bp, Homo sapiens
atgaactgaagtttca

SEQ ID NO: 185322 - DNA, 16 bp, Homo sapiens
atgaagagatttttca

SEQ ID NO: 185323 - DNA, 20 bp, Homo sapiens
atgaagagatttttcatgat

SEQ ID NO: 185324 - DNA, 22 bp, Homo sapiens
atgaagatatttttccattttt

SEQ ID NO: 185325 - DNA, 22 bp, Homo sapiens
atgaagattctcctgtgctaga

SEQ ID NO: 185326 - DNA, 21 bp, Homo sapiens
atgaaggttaggatttaacag

SEQ ID NO: 185327 - DNA, 23 bp, Homo sapiens
atgaagtgtgtttccttcagtgc

SEQ ID NO: 185328 - DNA, 22 bp, Homo sapiens
atgaatgtttacactctttgta

SEQ ID NO: 185329 - DNA, 15 bp, Homo sapiens
atgacaaaaattcaa

SEQ ID NO: 185330 - DNA, 19 bp, Homo sapiens
atgacaaaaattcaactca

SEQ ID NO: 185331 - DNA, 23 bp, Homo sapiens
atgacaaaaattcaactcagact

SEQ ID NO: 185332 - DNA, 18 bp, Homo sapiens
atgacatcaccacagttt

SEQ ID NO: 185333 - DNA, 16 bp, Homo sapiens
atgacatctcaggggc

SEQ ID NO: 185334 - DNA, 18 bp, Homo sapiens
atgacatctcaggggcca

SEQ ID NO: 185335 - DNA, 11 bp, Homo sapiens
atgacccctcc

SEQ ID NO: 185336 - DNA, 14 bp, Homo sapiens
atgacctggataac

SEQ ID NO: 185337 - DNA, 21 bp, Homo sapiens
atgagaatttgagtgctctga

SEQ ID NO: 185338 - DNA, 16 bp, Homo sapiens
atgagatattaaacca

SEQ ID NO: 185339 - DNA, 22 bp, Homo sapiens
atgagatctaggtgaggattga

SEQ ID NO: 185340 - DNA, 20 bp, Homo sapiens
atgagccgctgtgagcccct

SEQ ID NO: 185341 - DNA, 20 bp, Homo sapiens
atgagctatttccattccag

SEQ ID NO: 185342 - DNA, 23 bp, Homo sapiens
atgagctatttccattccagaat

SEQ ID NO: 185343 - DNA, 22 bp, Homo sapiens
atgagctcctcttcctggcttc

SEQ ID NO: 185344 - DNA, 22 bp, Homo sapiens
atgagctctacccagggcctgc

SEQ ID NO: 185345 - DNA, 12 bp, Homo sapiens
atgaggaatgta

SEQ ID NO: 185346 - DNA, 15 bp, Homo sapiens
atgaggaatgtatat

SEQ ID NO: 185347 - DNA, 14 bp, Homo sapiens
atgaggagttgctg

SEQ ID NO: 185348 - DNA, 18 bp, Homo sapiens
atgaggtactgagagtga

SEQ ID NO: 185349 - DNA, 14 bp, Homo sapiens
atgaggtgctggga

SEQ ID NO: 185350 - DNA, 19 bp, Homo sapiens
atgagttgttttcagactc

SEQ ID NO: 185351 - DNA, 23 bp, Homo sapiens
atgagttgttttcagactcagac

SEQ ID NO: 185352 - DNA, 13 bp, Homo sapiens
atgagtttttgat

SEQ ID NO: 185353 - DNA, 16 bp, Homo sapiens
atgatctactcagaaa

SEQ ID NO: 185354 - DNA, 14 bp, Homo sapiens
atgatctccctgcc

SEQ ID NO: 185355 - DNA, 15 bp, Homo sapiens
atgatctccctgccg

SEQ ID NO: 185356 - DNA, 15 bp, Homo sapiens
atgatcttctttata

SEQ ID NO: 185357 - DNA, 15 bp, Homo sapiens
atgatgatcctaggc

SEQ ID NO: 185358 - DNA, 21 bp, Homo sapiens
atgatgtagtgcctctttcat

SEQ ID NO: 185359 - DNA, 15 bp, Homo sapiens
atgatgtatttttgt

SEQ ID NO: 185360 - DNA, 16 bp, Homo sapiens
atgatgtatttttgta

SEQ ID NO: 185361 - DNA, 21 bp, Homo sapiens
atgattaaccacttcagctga

SEQ ID NO: 185362 - DNA, 23 bp, Homo sapiens
atgattctaatttttaagcaaaa

SEQ ID NO: 185363 - DNA, 13 bp, Homo sapiens
atgattggattat

SEQ ID NO: 185364 - DNA, 22 bp, Homo sapiens
atgattggattattcatttaaa

SEQ ID NO: 185365 - DNA, 13 bp, Homo sapiens
atgatttcattca

SEQ ID NO: 185366 - DNA, 23 bp, Homo sapiens
atgattttatttgacaaaatttg

SEQ ID NO: 185367 - DNA, 11 bp, Homo sapiens
atgatttttag

SEQ ID NO: 185368 - DNA, 21 bp, Homo sapiens
atgcaaaagttctgacttgac

SEQ ID NO: 185369 - DNA, 14 bp, Homo sapiens
atgcaaagaggcaa

SEQ ID NO: 185370 - DNA, 15 bp, Homo sapiens
atgcaaagaggcaag

SEQ ID NO: 185371 - DNA, 16 bp, Homo sapiens
atgcaaagaggcaaga

SEQ ID NO: 185372 - DNA, 14 bp, Homo sapiens
atgcaaagcactga

SEQ ID NO: 185373 - DNA, 23 bp, Homo sapiens
atgcaagctagtggcttcaaaat

SEQ ID NO: 185374 - DNA, 22 bp, Homo sapiens
atgcacgtgtgcacacacacca

SEQ ID NO: 185375 - DNA, 21 bp, Homo sapiens
atgcactgttccccctgtgca

SEQ ID NO: 185376 - DNA, 22 bp, Homo sapiens
atgcatctcactggatgcaaag

SEQ ID NO: 185377 - DNA, 19 bp, Homo sapiens
atgcatctccacctgctcc

SEQ ID NO: 185378 - DNA, 20 bp, Homo sapiens
atgcatggaaacctgaaaaa

SEQ ID NO: 185379 - DNA, 17 bp, Homo sapiens
atgccactaaattgaca

SEQ ID NO: 185380 - DNA, 22 bp, Homo sapiens
atgccagtaacgcgtcttcctg

SEQ ID NO: 185381 - DNA, 14 bp, Homo sapiens
atgccatcatctcc

SEQ ID NO: 185382 - DNA, 15 bp, Homo sapiens
atgccatcatctcct

SEQ ID NO: 185383 - DNA, 17 bp, Homo sapiens
atgccatttaaagctta

SEQ ID NO: 185384 - DNA, 15 bp, Homo sapiens
atgccccggccacct

SEQ ID NO: 185385 - DNA, 19 bp, Homo sapiens
atgccccggccacctctgc

SEQ ID NO: 185386 - DNA, 20 bp, Homo sapiens
atgccccggccacctctgcg

SEQ ID NO: 185387 - DNA, 20 bp, Homo sapiens
atgcccctgtactccagcct

SEQ ID NO: 185388 - DNA, 16 bp, Homo sapiens
atgcctcagtgtattt

SEQ ID NO: 185389 - DNA, 19 bp, Homo sapiens
atgcctcagtgtatttgta

SEQ ID NO: 185390 - DNA, 18 bp, Homo sapiens
atgcctctgccaaaggat

SEQ ID NO: 185391 - DNA, 19 bp, Homo sapiens
atgcctgccccaaacaaat

SEQ ID NO: 185392 - DNA, 16 bp, Homo sapiens
atgcctgcggagttgt

SEQ ID NO: 185393 - DNA, 19 bp, Homo sapiens
atgccttccagcaccctgc

SEQ ID NO: 185394 - DNA, 17 bp, Homo sapiens
atgcgggctgggcagct

SEQ ID NO: 185395 - DNA, 19 bp, Homo sapiens
atgcgggctgggcagctgt

SEQ ID NO: 185396 - DNA, 22 bp, Homo sapiens
atgctaaagaaaaagtcatcca

SEQ ID NO: 185397 - DNA, 17 bp, Homo sapiens
atgctaacatctaaaaa

SEQ ID NO: 185398 - DNA, 16 bp, Homo sapiens
atgctcaagtttttca

SEQ ID NO: 185399 - DNA, 20 bp, Homo sapiens
atgctcaagtttttcagaaa

SEQ ID NO: 185400 - DNA, 19 bp, Homo sapiens
atgctcctggcccactgca

SEQ ID NO: 185401 - DNA, 23 bp, Homo sapiens
atgctctctgcagccagcccagc

SEQ ID NO: 185402 - DNA, 19 bp, Homo sapiens
atgctgactgtactcctcc

SEQ ID NO: 185403 - DNA, 21 bp, Homo sapiens
atgctgactgtactcctccca

SEQ ID NO: 185404 - DNA, 19 bp, Homo sapiens
atgctgcctaggctgacct

SEQ ID NO: 185405 - DNA, 15 bp, Homo sapiens
atgctgcctccagaa

SEQ ID NO: 185406 - DNA, 16 bp, Homo sapiens
atgctgcgcccttccc

SEQ ID NO: 185407 - DNA, 19 bp, Homo sapiens
atgctgcgcccttccccag

SEQ ID NO: 185408 - DNA, 16 bp, Homo sapiens
atgctggagaagagag

SEQ ID NO: 185409 - DNA, 23 bp, Homo sapiens
atgctggagaagagaggagagga

SEQ ID NO: 185410 - DNA, 20 bp, Homo sapiens
atgctgtcaactatgatatg

SEQ ID NO: 185411 - DNA, 22 bp, Homo sapiens
atgctgtcaactatgatatggt

SEQ ID NO: 185412 - DNA, 17 bp, Homo sapiens
atgctgttgcctcatct

SEQ ID NO: 185413 - DNA, 17 bp, Homo sapiens
atgcttctgacttcata

SEQ ID NO: 185414 - DNA, 13 bp, Homo sapiens
atgcttgtgttat

SEQ ID NO: 185415 - DNA, 22 bp, Homo sapiens
atggaaactgttgccagagatg

SEQ ID NO: 185416 - DNA, 19 bp, Homo sapiens
atggaaccgcaggaagctg

SEQ ID NO: 185417 - DNA, 22 bp, Homo sapiens
atggaactcattcctgcctgtc

SEQ ID NO: 185418 - DNA, 18 bp, Homo sapiens
atggaacttctaatatat

SEQ ID NO: 185419 - DNA, 22 bp, Homo sapiens
atggaagcttccagtccaatct

SEQ ID NO: 185420 - DNA, 16 bp, Homo sapiens
atggaataactctgtg

SEQ ID NO: 185421 - DNA, 15 bp, Homo sapiens
atggaatacagtgtt

SEQ ID NO: 185422 - DNA, 22 bp, Homo sapiens
atggaatacagtgttattttct

SEQ ID NO: 185423 - DNA, 21 bp, Homo sapiens
atggaatgctgtgttaaataa

SEQ ID NO: 185424 - DNA, 13 bp, Homo sapiens
atggacactccag

SEQ ID NO: 185425 - DNA, 14 bp, Homo sapiens
atggacatgatctt

SEQ ID NO: 185426 - DNA, 22 bp, Homo sapiens
atggagaagcagaaatacatat

SEQ ID NO: 185427 - DNA, 20 bp, Homo sapiens
atggagactccatgagaagc

SEQ ID NO: 185428 - DNA, 21 bp, Homo sapiens
atggagactggtcctgtgtgc

SEQ ID NO: 185429 - DNA, 13 bp, Homo sapiens
atggagcccaggc

SEQ ID NO: 185430 - DNA, 15 bp, Homo sapiens
atggaggaggaggca

SEQ ID NO: 185431 - DNA, 19 bp, Homo sapiens
atggaggcacacagctgca

SEQ ID NO: 185432 - DNA, 16 bp, Homo sapiens
atggagggaataatac

SEQ ID NO: 185433 - DNA, 18 bp, Homo sapiens
atggataacctatatgat

SEQ ID NO: 185434 - DNA, 12 bp, Homo sapiens
atggatgtgctt

SEQ ID NO: 185435 - DNA, 14 bp, Homo sapiens
atggcaaaaatggc

SEQ ID NO: 185436 - DNA, 19 bp, Homo sapiens
atggcaaggactgcaggga

SEQ ID NO: 185437 - DNA, 13 bp, Homo sapiens
atggcacccagtg

SEQ ID NO: 185438 - DNA, 20 bp, Homo sapiens
atggcacttagctatcagaa

SEQ ID NO: 185439 - DNA, 20 bp, Homo sapiens
atggcagagttgtaaatata

SEQ ID NO: 185440 - DNA, 16 bp, Homo sapiens
atggccaggtggccac

SEQ ID NO: 185441 - DNA, 22 bp, Homo sapiens
atggccaggtggccactccaga

SEQ ID NO: 185442 - DNA, 20 bp, Homo sapiens
atggcctattatattaaaat

SEQ ID NO: 185443 - DNA, 21 bp, Homo sapiens
atggcctattatattaaaata

SEQ ID NO: 185444 - DNA, 20 bp, Homo sapiens
atggctagtatcaaaagaaa

SEQ ID NO: 185445 - DNA, 13 bp, Homo sapiens
atggctataaata

SEQ ID NO: 185446 - DNA, 21 bp, Homo sapiens
atggctataaatatataaaaa

SEQ ID NO: 185447 - DNA, 19 bp, Homo sapiens
atggctataggtgctacaa

SEQ ID NO: 185448 - DNA, 21 bp, Homo sapiens
atggctataggtgctacaaaa

SEQ ID NO: 185449 - DNA, 15 bp, Homo sapiens
atggctgtgcctctg

SEQ ID NO: 185450 - DNA, 16 bp, Homo sapiens
atggctgtgcctctgc

SEQ ID NO: 185451 - DNA, 16 bp, Homo sapiens
atggcttaatgtttat

SEQ ID NO: 185452 - DNA, 14 bp, Homo sapiens
atgggactgggagg

SEQ ID NO: 185453 - DNA, 23 bp, Homo sapiens
atgggattcagtgcttcttaaag

SEQ ID NO: 185454 - DNA, 14 bp, Homo sapiens
atgggcagagccca

SEQ ID NO: 185455 - DNA, 22 bp, Homo sapiens
atggggctgaacggggagaaaa

SEQ ID NO: 185456 - DNA, 20 bp, Homo sapiens
atgggggagtctgaagcaga

SEQ ID NO: 185457 - DNA, 16 bp, Homo sapiens
atgggttggtgcttct

SEQ ID NO: 185458 - DNA, 15 bp, Homo sapiens
atggtcttcagcctc

SEQ ID NO: 185459 - DNA, 20 bp, Homo sapiens
atggtgctacgcctgcatgt

SEQ ID NO: 185460 - DNA, 14 bp, Homo sapiens
atggtggagggcca

SEQ ID NO: 185461 - DNA, 16 bp, Homo sapiens
atggtggcgcgcacct

SEQ ID NO: 185462 - DNA, 20 bp, Homo sapiens
atgtaaacagtgcctgctga

SEQ ID NO: 185463 - DNA, 19 bp, Homo sapiens
atgtaaagaacataaataa

SEQ ID NO: 185464 - DNA, 18 bp, Homo sapiens
atgtaaagtatgtaaaca

SEQ ID NO: 185465 - DNA, 12 bp, Homo sapiens
atgtaaatagtg

SEQ ID NO: 185466 - DNA, 21 bp, Homo sapiens
atgtaagggaaactgccagca

SEQ ID NO: 185467 - DNA, 22 bp, Homo sapiens
atgtaagggaaactgccagcaa

SEQ ID NO: 185468 - DNA, 22 bp, Homo sapiens
atgtaataaggttgaacacttt

SEQ ID NO: 185469 - DNA, 19 bp, Homo sapiens
agcacctgccgacctcgtc

SEQ ID NO: 185470 - DNA, 18 bp, Homo sapiens
agcacgaaatgttatttt

SEQ ID NO: 185471 - DNA, 20 bp, Homo sapiens
agcactaaagcagtggacac

SEQ ID NO: 185472 - DNA, 23 bp, Homo sapiens
agcactaaagcagtggacaccag

SEQ ID NO: 185473 - DNA, 19 bp, Homo sapiens
agcactcccaagtctacag

SEQ ID NO: 185474 - DNA, 18 bp, Homo sapiens
agcactgatttcacaaca

SEQ ID NO: 185475 - DNA, 12 bp, Homo sapiens
agcactgtccct

SEQ ID NO: 185476 - DNA, 23 bp, Homo sapiens
agcactttgggaggccaaggtgg

SEQ ID NO: 185477 - DNA, 16 bp, Homo sapiens
agcactttgggaggct

SEQ ID NO: 185478 - DNA, 19 bp, Homo sapiens
agcagactggtgagcagac

SEQ ID NO: 185479 - DNA, 17 bp, Homo sapiens
agcagaggaaggagagg

SEQ ID NO: 185480 - DNA, 16 bp, Homo sapiens
agcagatcccagctca

SEQ ID NO: 185481 - DNA, 21 bp, Homo sapiens
agcagatggaatgctgtgtta

SEQ ID NO: 185482 - DNA, 21 bp, Homo sapiens
agcagattttaattttgaata

SEQ ID NO: 185483 - DNA, 20 bp, Homo sapiens
agcagccaagctccttggga

SEQ ID NO: 185484 - DNA, 13 bp, Homo sapiens
agcagccagctct

SEQ ID NO: 185485 - DNA, 16 bp, Homo sapiens
agcagccagctctcag

SEQ ID NO: 185486 - DNA, 19 bp, Homo sapiens
agcagccagctctcagcca

SEQ ID NO: 185487 - DNA, 18 bp, Homo sapiens
agcagccctcctcacccc

SEQ ID NO: 185488 - DNA, 23 bp, Homo sapiens
agcagccctcctcaccccgtctg

SEQ ID NO: 185489 - DNA, 16 bp, Homo sapiens
agcagcctggaccctg

SEQ ID NO: 185490 - DNA, 17 bp, Homo sapiens
agcagctatctctcagt

SEQ ID NO: 185491 - DNA, 16 bp, Homo sapiens
agcagctcaaaggcac

SEQ ID NO: 185492 - DNA, 13 bp, Homo sapiens
agcagctcaggca

SEQ ID NO: 185493 - DNA, 16 bp, Homo sapiens
agcagcttccagattg

SEQ ID NO: 185494 - DNA, 19 bp, Homo sapiens
agcagctttaaactcaggg

SEQ ID NO: 185495 - DNA, 15 bp, Homo sapiens
agcaggaaatgaaaa

SEQ ID NO: 185496 - DNA, 21 bp, Homo sapiens
agcaggaagcattcagagagc

SEQ ID NO: 185497 - DNA, 12 bp, Homo sapiens
agcaggaagctc

SEQ ID NO: 185498 - DNA, 14 bp, Homo sapiens
agcaggaagctcag

SEQ ID NO: 185499 - DNA, 23 bp, Homo sapiens
agcaggactgaattgtccccagt

SEQ ID NO: 185500 - DNA, 19 bp, Homo sapiens
agcaggagattgagaagga

SEQ ID NO: 185501 - DNA, 20 bp, Homo sapiens
agcaggagattgagaaggag

SEQ ID NO: 185502 - DNA, 23 bp, Homo sapiens
agcaggagattgagaaggagaga

SEQ ID NO: 185503 - DNA, 14 bp, Homo sapiens
agcaggaggccagg

SEQ ID NO: 185504 - DNA, 19 bp, Homo sapiens
agcaggctactgtcagctc

SEQ ID NO: 185505 - DNA, 20 bp, Homo sapiens
agcagggattaacctctgca

SEQ ID NO: 185506 - DNA, 22 bp, Homo sapiens
agcagggattaacctctgcact

SEQ ID NO: 185507 - DNA, 19 bp, Homo sapiens
agcagggcatggctgggaa

SEQ ID NO: 185508 - DNA, 21 bp, Homo sapiens
agcagtagaaataatatgcat

SEQ ID NO: 185509 - DNA, 20 bp, Homo sapiens
agcagtgaatgattcagtgt

SEQ ID NO: 185510 - DNA, 22 bp, Homo sapiens
agcagtgaatgattcagtgtta

SEQ ID NO: 185511 - DNA, 12 bp, Homo sapiens
agcagtggacac

SEQ ID NO: 185512 - DNA, 12 bp, Homo sapiens
agcagtggctgg

SEQ ID NO: 185513 - DNA, 13 bp, Homo sapiens
agcagtggctggt

SEQ ID NO: 185514 - DNA, 17 bp, Homo sapiens
agcagtggctggtccag

SEQ ID NO: 185515 - DNA, 19 bp, Homo sapiens
agcagtggctggtccaggg

SEQ ID NO: 185516 - DNA, 20 bp, Homo sapiens
agcagtgtcatcagaagata

SEQ ID NO: 185517 - DNA, 13 bp, Homo sapiens
agcagttgaaaag

SEQ ID NO: 185518 - DNA, 21 bp, Homo sapiens
agcagttgaaaagactccaaa

SEQ ID NO: 185519 - DNA, 23 bp, Homo sapiens
agcagttgagtcgtcatcacttt

SEQ ID NO: 185520 - DNA, 23 bp, Homo sapiens
agcataaaaattagccaagtgtg

SEQ ID NO: 185521 - DNA, 14 bp, Homo sapiens
agcataaatgcaaa

SEQ ID NO: 185522 - DNA, 23 bp, Homo sapiens
agcataagtttctgggacctcag

SEQ ID NO: 185523 - DNA, 17 bp, Homo sapiens
agcatacctttattgtg

SEQ ID NO: 185524 - DNA, 21 bp, Homo sapiens
agcatcattatttgcagagac

SEQ ID NO: 185525 - DNA, 16 bp, Homo sapiens
agcatgtgttgaaaaa

SEQ ID NO: 185526 - DNA, 20 bp, Homo sapiens
agcattctcactcctacctg

SEQ ID NO: 185527 - DNA, 17 bp, Homo sapiens
agcattgtaaatgtgct

SEQ ID NO: 185528 - DNA, 20 bp, Homo sapiens
agcattgtggctgtcagcag

SEQ ID NO: 185529 - DNA, 23 bp, Homo sapiens
agcattttagcaatttatacaat

SEQ ID NO: 185530 - DNA, 17 bp, Homo sapiens
agccaaatcaaaatatg

SEQ ID NO: 185531 - DNA, 15 bp, Homo sapiens
agccaacttttgcat

SEQ ID NO: 185532 - DNA, 21 bp, Homo sapiens
agccaagctagaattccctct

SEQ ID NO: 185533 - DNA, 15 bp, Homo sapiens
agccaagctccttgg

SEQ ID NO: 185534 - DNA, 19 bp, Homo sapiens
agccacaagaaatttgatt

SEQ ID NO: 185535 - DNA, 16 bp, Homo sapiens
agccaccaactcttgc

SEQ ID NO: 185536 - DNA, 17 bp, Homo sapiens
agccaccaactcttgca

SEQ ID NO: 185537 - DNA, 20 bp, Homo sapiens
agccacgttccttactgcag

SEQ ID NO: 185538 - DNA, 13 bp, Homo sapiens
agccactcctctg

SEQ ID NO: 185539 - DNA, 15 bp, Homo sapiens
agccactcctctgac

SEQ ID NO: 185540 - DNA, 19 bp, Homo sapiens
agccagaaataaagttggt

SEQ ID NO: 185541 - DNA, 21 bp, Homo sapiens
agccagaacgtggctctgctg

SEQ ID NO: 185542 - DNA, 12 bp, Homo sapiens
agccagaagctg

SEQ ID NO: 185543 - DNA, 14 bp, Homo sapiens
agccagaagctgag

SEQ ID NO: 185544 - DNA, 14 bp, Homo sapiens
agccagactggcac

SEQ ID NO: 185545 - DNA, 14 bp, Homo sapiens
agccagcagccagc

SEQ ID NO: 185546 - DNA, 16 bp, Homo sapiens
agccagcagccagctc

SEQ ID NO: 185547 - DNA, 16 bp, Homo sapiens
agccagcccagcccag

SEQ ID NO: 185548 - DNA, 13 bp, Homo sapiens
agccagccctccc

SEQ ID NO: 185549 - DNA, 18 bp, Homo sapiens
agccagccttcttccatc

SEQ ID NO: 185550 - DNA, 14 bp, Homo sapiens
agccagctctcagc

SEQ ID NO: 185551 - DNA, 21 bp, Homo sapiens
agccaggcaggtagccagggg

SEQ ID NO: 185552 - DNA, 23 bp, Homo sapiens
agccagggctatgggagcagctt

SEQ ID NO: 185553 - DNA, 22 bp, Homo sapiens
agccagggggactagcccctgt

SEQ ID NO: 185554 - DNA, 14 bp, Homo sapiens
agccattcactgcc

SEQ ID NO: 185555 - DNA, 12 bp, Homo sapiens
agcccagacaaa

SEQ ID NO: 185556 - DNA, 21 bp, Homo sapiens
agcccagcactgcttgaggaa

SEQ ID NO: 185557 - DNA, 13 bp, Homo sapiens
agcccaggagaga

SEQ ID NO: 185558 - DNA, 19 bp, Homo sapiens
agcccaggagagagaaagc

SEQ ID NO: 185559 - DNA, 12 bp, Homo sapiens
agcccaggagga

SEQ ID NO: 185560 - DNA, 17 bp, Homo sapiens
agcccaggaggactgcc

SEQ ID NO: 185561 - DNA, 22 bp, Homo sapiens
agcccagggagcggaaagcagc

SEQ ID NO: 185562 - DNA, 20 bp, Homo sapiens
agcccatccctgcctggtca

SEQ ID NO: 185563 - DNA, 18 bp, Homo sapiens
agcccatggcactctatg

SEQ ID NO: 185564 - DNA, 16 bp, Homo sapiens
agcccattctctctcc

SEQ ID NO: 185565 - DNA, 17 bp, Homo sapiens
agcccattctctctcct

SEQ ID NO: 185566 - DNA, 16 bp, Homo sapiens
agccccagagcagggt

SEQ ID NO: 185567 - DNA, 13 bp, Homo sapiens
agccccattcctg

SEQ ID NO: 185568 - DNA, 16 bp, Homo sapiens
agccccattcctggga

SEQ ID NO: 185569 - DNA, 18 bp, Homo sapiens
agcccccaggctgctgga

SEQ ID NO: 185570 - DNA, 16 bp, Homo sapiens
agccccgcagacctcc

SEQ ID NO: 185571 - DNA, 18 bp, Homo sapiens
agccccgcagacctcccc

SEQ ID NO: 185572 - DNA, 19 bp, Homo sapiens
agccccgcagacctcccca

SEQ ID NO: 185573 - DNA, 18 bp, Homo sapiens
agcccctagcccaggaga

SEQ ID NO: 185574 - DNA, 16 bp, Homo sapiens
agcccctcctctgcca

SEQ ID NO: 185575 - DNA, 22 bp, Homo sapiens
agcccctcctctgccacctccc

SEQ ID NO: 185576 - DNA, 14 bp, Homo sapiens
agcccctgtggaga

SEQ ID NO: 185577 - DNA, 15 bp, Homo sapiens
agccccttctcagaa

SEQ ID NO: 185578 - DNA, 14 bp, Homo sapiens
agcccggatgcttc

SEQ ID NO: 185579 - DNA, 21 bp, Homo sapiens
agcccggcgccaccatcctgc

SEQ ID NO: 185580 - DNA, 20 bp, Homo sapiens
agccctagggtggagagcca

SEQ ID NO: 185581 - DNA, 14 bp, Homo sapiens
agccctcaaagtga

SEQ ID NO: 185582 - DNA, 19 bp, Homo sapiens
agccctcagaacccttggc

SEQ ID NO: 185583 - DNA, 12 bp, Homo sapiens
agccctccctgc

SEQ ID NO: 185584 - DNA, 15 bp, Homo sapiens
agccctccctgtcct

SEQ ID NO: 185585 - DNA, 21 bp, Homo sapiens
agccctccctgtcctcctcgg

SEQ ID NO: 185586 - DNA, 13 bp, Homo sapiens
agccctcctcacc

SEQ ID NO: 185587 - DNA, 12 bp, Homo sapiens
agactccaaaga

SEQ ID NO: 185588 - DNA, 14 bp, Homo sapiens
agactccaaagaaa

SEQ ID NO: 185589 - DNA, 19 bp, Homo sapiens
agactctacccatattaca

SEQ ID NO: 185590 - DNA, 16 bp, Homo sapiens
agactctttggacact

SEQ ID NO: 185591 - DNA, 13 bp, Homo sapiens
agactgagctcaa

SEQ ID NO: 185592 - DNA, 12 bp, Homo sapiens
agactgggctga

SEQ ID NO: 185593 - DNA, 16 bp, Homo sapiens
agactgggctgaggga

SEQ ID NO: 185594 - DNA, 20 bp, Homo sapiens
agactgggctgagggagcct

SEQ ID NO: 185595 - DNA, 17 bp, Homo sapiens
agactggtcctgtgtgc

SEQ ID NO: 185596 - DNA, 23 bp, Homo sapiens
agactggtgagcagactggtggg

SEQ ID NO: 185597 - DNA, 21 bp, Homo sapiens
agacttcacactgcaagagcc

SEQ ID NO: 185598 - DNA, 19 bp, Homo sapiens
agacttcagtatgttgtca

SEQ ID NO: 185599 - DNA, 21 bp, Homo sapiens
agacttcagtatgttgtcaaa

SEQ ID NO: 185600 - DNA, 22 bp, Homo sapiens
agacttcagtatgttgtcaaag

SEQ ID NO: 185601 - DNA, 17 bp, Homo sapiens
agacttcatttttccta

SEQ ID NO: 185602 - DNA, 12 bp, Homo sapiens
agacttctgctt

SEQ ID NO: 185603 - DNA, 19 bp, Homo sapiens
agacttggtgtcctttccc

SEQ ID NO: 185604 - DNA, 18 bp, Homo sapiens
agacttgtatgaaagatg

SEQ ID NO: 185605 - DNA, 12 bp, Homo sapiens
agactttctgtt

SEQ ID NO: 185606 - DNA, 18 bp, Homo sapiens
agacttttaatcagacaa

SEQ ID NO: 185607 - DNA, 19 bp, Homo sapiens
agactttttttaaatagta

SEQ ID NO: 185608 - DNA, 13 bp, Homo sapiens
agagaaagccagg

SEQ ID NO: 185609 - DNA, 17 bp, Homo sapiens
agagaaagccaggcagg

SEQ ID NO: 185610 - DNA, 22 bp, Homo sapiens
agagaaagccaggcaggtagcc

SEQ ID NO: 185611 - DNA, 23 bp, Homo sapiens
agagaacctcacgcacctcccat

SEQ ID NO: 185612 - DNA, 20 bp, Homo sapiens
agagaacctggagttcctga

SEQ ID NO: 185613 - DNA, 13 bp, Homo sapiens
agagaaggcagga

SEQ ID NO: 185614 - DNA, 12 bp, Homo sapiens
agagaaggggag

SEQ ID NO: 185615 - DNA, 15 bp, Homo sapiens
agagaaggggaggag

SEQ ID NO: 185616 - DNA, 15 bp, Homo sapiens
agagacacctgcacc

SEQ ID NO: 185617 - DNA, 13 bp, Homo sapiens
agagacagagagg

SEQ ID NO: 185618 - DNA, 13 bp, Homo sapiens
agagacccaagga

SEQ ID NO: 185619 - DNA, 21 bp, Homo sapiens
agagacccaaggaggaaaaac

SEQ ID NO: 185620 - DNA, 21 bp, Homo sapiens
agagaccctctgccaccagag

SEQ ID NO: 185621 - DNA, 19 bp, Homo sapiens
acaaaatcgattggcttta

SEQ ID NO: 185622 - DNA, 21 bp, Homo sapiens
acaaagatgtttgtcagatat

SEQ ID NO: 185623 - DNA, 22 bp, Homo sapiens
acaaagatgtttgtcagatatg

SEQ ID NO: 185624 - DNA, 23 bp, Homo sapiens
acaaagcttggaagagcctgcag

SEQ ID NO: 185625 - DNA, 11 bp, Homo sapiens
acaaaggcaag

SEQ ID NO: 185626 - DNA, 16 bp, Homo sapiens
acaaagtgtgtattaa

SEQ ID NO: 185627 - DNA, 17 bp, Homo sapiens
acaaagtgtgtattaaa

SEQ ID NO: 185628 - DNA, 15 bp, Homo sapiens
acaaatataagaata

SEQ ID NO: 185629 - DNA, 17 bp, Homo sapiens
acaaatataagaataaa

SEQ ID NO: 185630 - DNA, 19 bp, Homo sapiens
acaaatataagaataaaat

SEQ ID NO: 185631 - DNA, 22 bp, Homo sapiens
acaaatcaagcttcagtttcct

SEQ ID NO: 185632 - DNA, 21 bp, Homo sapiens
acaaatctcaagcaaacagct

SEQ ID NO: 185633 - DNA, 15 bp, Homo sapiens
acaaatgccacacat

SEQ ID NO: 185634 - DNA, 22 bp, Homo sapiens
acaaatgtgtatcggatgcttt

SEQ ID NO: 185635 - DNA, 17 bp, Homo sapiens
acaaatttacagagaca

SEQ ID NO: 185636 - DNA, 18 bp, Homo sapiens
acaaatttacagagacag

SEQ ID NO: 185637 - DNA, 15 bp, Homo sapiens
acaacaacctggtca

SEQ ID NO: 185638 - DNA, 15 bp, Homo sapiens
acaaccactggtctg

SEQ ID NO: 185639 - DNA, 16 bp, Homo sapiens
acaactatttttccaa

SEQ ID NO: 185640 - DNA, 13 bp, Homo sapiens
acaagaaatgaaa

SEQ ID NO: 185641 - DNA, 17 bp, Homo sapiens
acaagacttcagtatgt

SEQ ID NO: 185642 - DNA, 18 bp, Homo sapiens
acaagagtttatttccaa

SEQ ID NO: 185643 - DNA, 13 bp, Homo sapiens
acaagctgcaccc

SEQ ID NO: 185644 - DNA, 15 bp, Homo sapiens
acaagtcctgtgaat

SEQ ID NO: 185645 - DNA, 19 bp, Homo sapiens
acaagtcctgtgaatttct

SEQ ID NO: 185646 - DNA, 20 bp, Homo sapiens
acaagtgtatatcagaaaag

SEQ ID NO: 185647 - DNA, 14 bp, Homo sapiens
acaataaataatct

SEQ ID NO: 185648 - DNA, 14 bp, Homo sapiens
acaataaatgtgca

SEQ ID NO: 185649 - DNA, 17 bp, Homo sapiens
acaatattttgtggctt

SEQ ID NO: 185650 - DNA, 17 bp, Homo sapiens
acaatggggatgttgtg

SEQ ID NO: 185651 - DNA, 19 bp, Homo sapiens
acaatgtgaaaagaaaaat

SEQ ID NO: 185652 - DNA, 16 bp, Homo sapiens
acaattccctgctgtc

SEQ ID NO: 185653 - DNA, 22 bp, Homo sapiens
acaattcctctactaacaatca

SEQ ID NO: 185654 - DNA, 15 bp, Homo sapiens
acaattctacattgt

SEQ ID NO: 185655 - DNA, 12 bp, Homo sapiens
acaattgtaata

SEQ ID NO: 185656 - DNA, 16 bp, Homo sapiens
acaatttcctttatat

SEQ ID NO: 185657 - DNA, 20 bp, Homo sapiens
acaatttcctttatatttag

SEQ ID NO: 185658 - DNA, 15 bp, Homo sapiens
acacaagtcctgtga

SEQ ID NO: 185659 - DNA, 17 bp, Homo sapiens
acacacaggcaactgag

SEQ ID NO: 185660 - DNA, 16 bp, Homo sapiens
acacactgaggcaggg

SEQ ID NO: 185661 - DNA, 18 bp, Homo sapiens
acacactgaggcagggaa

SEQ ID NO: 185662 - DNA, 19 bp, Homo sapiens
acacagccgattcacctga

SEQ ID NO: 185663 - DNA, 19 bp, Homo sapiens
acacagctgcagagacaga

SEQ ID NO: 185664 - DNA, 16 bp, Homo sapiens
acacaggcaactgagg

SEQ ID NO: 185665 - DNA, 20 bp, Homo sapiens
acacaggcaactgaggcaga

SEQ ID NO: 185666 - DNA, 21 bp, Homo sapiens
acacaggcaactgaggcagac

SEQ ID NO: 185667 - DNA, 15 bp, Homo sapiens
acacagggacttgaa

SEQ ID NO: 185668 - DNA, 18 bp, Homo sapiens
acacagggacttgaagtt

SEQ ID NO: 185669 - DNA, 19 bp, Homo sapiens
acacatccctaatgtgtgc

SEQ ID NO: 185670 - DNA, 15 bp, Homo sapiens
acaccaatattcata

SEQ ID NO: 185671 - DNA, 14 bp, Homo sapiens
acaccacacccagc

SEQ ID NO: 185672 - DNA, 17 bp, Homo sapiens
acaccacacccagcctc

SEQ ID NO: 185673 - DNA, 20 bp, Homo sapiens
acaccagcctttctcccagg

SEQ ID NO: 185674 - DNA, 15 bp, Homo sapiens
acacccactcagctc

SEQ ID NO: 185675 - DNA, 14 bp, Homo sapiens
acacccagcctcag

SEQ ID NO: 185676 - DNA, 16 bp, Homo sapiens
acacccagcctcagtc

SEQ ID NO: 185677 - DNA, 20 bp, Homo sapiens
acacccagcctcagtcctcc

SEQ ID NO: 185678 - DNA, 14 bp, Homo sapiens
acaccctcccccgc

SEQ ID NO: 185679 - DNA, 16 bp, Homo sapiens
acaccctcccccgcca

SEQ ID NO: 185680 - DNA, 13 bp, Homo sapiens
acaccctctccca

SEQ ID NO: 185681 - DNA, 17 bp, Homo sapiens
acaccctctcccaggac

SEQ ID NO: 185682 - DNA, 21 bp, Homo sapiens
acacctactctatcagagaaa

SEQ ID NO: 185683 - DNA, 21 bp, Homo sapiens
acacctctgcacaagctgcac

SEQ ID NO: 185684 - DNA, 12 bp, Homo sapiens
acacctgcacct

SEQ ID NO: 185685 - DNA, 17 bp, Homo sapiens
acacctgtagtcccagc

SEQ ID NO: 185686 - DNA, 14 bp, Homo sapiens
acacgagcaggcta

SEQ ID NO: 185687 - DNA, 19 bp, Homo sapiens
acacgagcaggctactgtc

SEQ ID NO: 185688 - DNA, 21 bp, Homo sapiens
acacggatctgagaatcttta

SEQ ID NO: 185689 - DNA, 19 bp, Homo sapiens
acactatggtatttgagtg

SEQ ID NO: 185690 - DNA, 18 bp, Homo sapiens
acactcaaatcaagaaac

SEQ ID NO: 185691 - DNA, 16 bp, Homo sapiens
acactcagttgttcaa

SEQ ID NO: 185692 - DNA, 14 bp, Homo sapiens
acactccagtgcca

SEQ ID NO: 185693 - DNA, 16 bp, Homo sapiens
acactccagtgccagc

SEQ ID NO: 185694 - DNA, 17 bp, Homo sapiens
acactcccctgcactgg

SEQ ID NO: 185695 - DNA, 14 bp, Homo sapiens
acactcccttgggc

SEQ ID NO: 185696 - DNA, 23 bp, Homo sapiens
acactgaaaaatctaagtgatat

SEQ ID NO: 185697 - DNA, 19 bp, Homo sapiens
acactgaagttaacagaga

SEQ ID NO: 185698 - DNA, 14 bp, Homo sapiens
acactgaggcaggg

SEQ ID NO: 185699 - DNA, 17 bp, Homo sapiens
acactgaggcagggaag

SEQ ID NO: 185700 - DNA, 21 bp, Homo sapiens
acactggctcatattcctgca

SEQ ID NO: 185701 - DNA, 16 bp, Homo sapiens
acactgggggagggga

SEQ ID NO: 185702 - DNA, 21 bp, Homo sapiens
acactgtgcacatctgtgtct

SEQ ID NO: 185703 - DNA, 21 bp, Homo sapiens
acacttacactttatgcacaa

SEQ ID NO: 185704 - DNA, 19 bp, Homo sapiens
acacttcaggctcttctcc

SEQ ID NO: 185705 - DNA, 21 bp, Homo sapiens
acacttccaccagcctgcact

SEQ ID NO: 185706 - DNA, 20 bp, Homo sapiens
acacttttcatgtgtgattt

SEQ ID NO: 185707 - DNA, 22 bp, Homo sapiens
acagaactatctcagcatcaga

SEQ ID NO: 185708 - DNA, 18 bp, Homo sapiens
acagaactctttcaaaac

SEQ ID NO: 185709 - DNA, 20 bp, Homo sapiens
acagaactctttcaaaacct

SEQ ID NO: 185710 - DNA, 22 bp, Homo sapiens
acagaagcagttgagtcgtcat

SEQ ID NO: 185711 - DNA, 14 bp, Homo sapiens
acagaagcttcaga

SEQ ID NO: 185712 - DNA, 15 bp, Homo sapiens
acagaattctgctac

SEQ ID NO: 185713 - DNA, 17 bp, Homo sapiens
acagaattctgctacct

SEQ ID NO: 185714 - DNA, 12 bp, Homo sapiens
acagacacacac

SEQ ID NO: 185715 - DNA, 11 bp, Homo sapiens
acagacaggag

SEQ ID NO: 185716 - DNA, 21 bp, Homo sapiens
acagacaggagaaatgcatcc

SEQ ID NO: 185717 - DNA, 15 bp, Homo sapiens
acagacaggctctta

SEQ ID NO: 185718 - DNA, 21 bp, Homo sapiens
acagagcaagtgagaccctgt

SEQ ID NO: 185719 - DNA, 20 bp, Homo sapiens
acagaggagggcgtgactca

SEQ ID NO: 185720 - DNA, 21 bp, Homo sapiens
cagagaattgctgattcttga

SEQ ID NO: 185721 - DNA, 15 bp, Homo sapiens
cagagacacctgcac

SEQ ID NO: 185722 - DNA, 16 bp, Homo sapiens
cagagacagagaggac

SEQ ID NO: 185723 - DNA, 22 bp, Homo sapiens
cagagacaggaagtcttcaggg

SEQ ID NO: 185724 - DNA, 13 bp, Homo sapiens
cagagaccgtcct

SEQ ID NO: 185725 - DNA, 20 bp, Homo sapiens
cagagactcagggccccagc

SEQ ID NO: 185726 - DNA, 21 bp, Homo sapiens
cagagagcggtctcaggctgg

SEQ ID NO: 185727 - DNA, 16 bp, Homo sapiens
cagagaggacgtgggc

SEQ ID NO: 185728 - DNA, 20 bp, Homo sapiens
cagagaggagtcagagagaa

SEQ ID NO: 185729 - DNA, 15 bp, Homo sapiens
cagagagggggccac

SEQ ID NO: 185730 - DNA, 19 bp, Homo sapiens
cagagaggtcaagcccagg

SEQ ID NO: 185731 - DNA, 18 bp, Homo sapiens
cagagagtggctcctccc

SEQ ID NO: 185732 - DNA, 22 bp, Homo sapiens
cagagatgggactgggagggcc

SEQ ID NO: 185733 - DNA, 22 bp, Homo sapiens
cagagccacccctaaagagata

SEQ ID NO: 185734 - DNA, 17 bp, Homo sapiens
cagagccatgctgggaa

SEQ ID NO: 185735 - DNA, 20 bp, Homo sapiens
cagagccgtggtcctttggg

SEQ ID NO: 185736 - DNA, 18 bp, Homo sapiens
cagagcttccctgactca

SEQ ID NO: 185737 - DNA, 23 bp, Homo sapiens
cagagcttccctgactcattctg

SEQ ID NO: 185738 - DNA, 20 bp, Homo sapiens
cagagcttcttccaggtgcc

SEQ ID NO: 185739 - DNA, 23 bp, Homo sapiens
cagagcttcttccaggtgcccag

SEQ ID NO: 185740 - DNA, 20 bp, Homo sapiens
cagaggaaggggccagaggc

SEQ ID NO: 185741 - DNA, 15 bp, Homo sapiens
cagaggatgagctct

SEQ ID NO: 185742 - DNA, 17 bp, Homo sapiens
cagaggatgagctctac

SEQ ID NO: 185743 - DNA, 23 bp, Homo sapiens
cagaggatgagctctacccaggg

SEQ ID NO: 185744 - DNA, 19 bp, Homo sapiens
cagaggccctcgctgccag

SEQ ID NO: 185745 - DNA, 14 bp, Homo sapiens
cagaggctggaggc

SEQ ID NO: 185746 - DNA, 17 bp, Homo sapiens
cagaggctggaggcagg

SEQ ID NO: 185747 - DNA, 16 bp, Homo sapiens
cagaggcttcttcaga

SEQ ID NO: 185748 - DNA, 17 bp, Homo sapiens
cagagggcagaggctgg

SEQ ID NO: 185749 - DNA, 19 bp, Homo sapiens
cagaggtggccagagctgg

SEQ ID NO: 185750 - DNA, 13 bp, Homo sapiens
cagagtcagcaga

SEQ ID NO: 185751 - DNA, 14 bp, Homo sapiens
cagagtcagcagaa

SEQ ID NO: 185752 - DNA, 15 bp, Homo sapiens
cagagtcagcagaac

SEQ ID NO: 185753 - DNA, 15 bp, Homo sapiens
cagagtcggaacgga

SEQ ID NO: 185754 - DNA, 14 bp, Homo sapiens
cagagtgagaccca

SEQ ID NO: 185755 - DNA, 13 bp, Homo sapiens
cagagtgcccaga

SEQ ID NO: 185756 - DNA, 14 bp, Homo sapiens
cagagtgcccagaa

SEQ ID NO: 185757 - DNA, 23 bp, Homo sapiens
cagagtgtggccttcggacaact

SEQ ID NO: 185758 - DNA, 19 bp, Homo sapiens
cagagtgtgggaagggaga

SEQ ID NO: 185759 - DNA, 20 bp, Homo sapiens
cagagtgtgggaagggagag

SEQ ID NO: 185760 - DNA, 23 bp, Homo sapiens
cagagttgtaaatatataaatat

SEQ ID NO: 185761 - DNA, 17 bp, Homo sapiens
cagataaccagctgtaa

SEQ ID NO: 185762 - DNA, 16 bp, Homo sapiens
cagataatcagcctct

SEQ ID NO: 185763 - DNA, 18 bp, Homo sapiens
cagataatcagcctctta

SEQ ID NO: 185764 - DNA, 20 bp, Homo sapiens
cagatattttttcagaaata

SEQ ID NO: 185765 - DNA, 15 bp, Homo sapiens
cagatcccagctcac

SEQ ID NO: 185766 - DNA, 17 bp, Homo sapiens
cagatgaatgccgtgga

SEQ ID NO: 185767 - DNA, 20 bp, Homo sapiens
cagatgacaaaaattcaact

SEQ ID NO: 185768 - DNA, 17 bp, Homo sapiens
cagatgcaaagaggcaa

SEQ ID NO: 185769 - DNA, 18 bp, Homo sapiens
cagatggaaccgcaggaa

SEQ ID NO: 185770 - DNA, 21 bp, Homo sapiens
cagatggaaccgcaggaagct

SEQ ID NO: 185771 - DNA, 21 bp, Homo sapiens
cagattccaggcgatgtgcaa

SEQ ID NO: 185772 - DNA, 19 bp, Homo sapiens
cagattttttacagctgcc

SEQ ID NO: 185773 - DNA, 22 bp, Homo sapiens
cagattttttacagctgcctgc

SEQ ID NO: 185774 - DNA, 14 bp, Homo sapiens
cagcaaaaagcaaa

SEQ ID NO: 185775 - DNA, 20 bp, Homo sapiens
cagcaaaaagcaaaatcatt

SEQ ID NO: 185776 - DNA, 22 bp, Homo sapiens
cagcaaaatgtgaatgggaaaa

SEQ ID NO: 185777 - DNA, 14 bp, Homo sapiens
cagcaaaccggggc

SEQ ID NO: 185778 - DNA, 19 bp, Homo sapiens
cagcaagggtgatgggaaa

SEQ ID NO: 185779 - DNA, 12 bp, Homo sapiens
cagcacagagag

SEQ ID NO: 185780 - DNA, 13 bp, Homo sapiens
cagcacagagagg

SEQ ID NO: 185781 - DNA, 16 bp, Homo sapiens
cagcactgcttgagga

SEQ ID NO: 185782 - DNA, 13 bp, Homo sapiens
cagcactgtccct

SEQ ID NO: 185783 - DNA, 20 bp, Homo sapiens
cagcactgtcccttgcctca

SEQ ID NO: 185784 - DNA, 15 bp, Homo sapiens
cagcagatcccagct

SEQ ID NO: 185785 - DNA, 16 bp, Homo sapiens
cagcagatcccagctc

SEQ ID NO: 185786 - DNA, 14 bp, Homo sapiens
cagcagccagctct

SEQ ID NO: 185787 - DNA, 23 bp, Homo sapiens
cagcagcccctgcacaaagccct

SEQ ID NO: 185788 - DNA, 11 bp, Homo sapiens
cagcagccctc

SEQ ID NO: 185789 - DNA, 14 bp, Homo sapiens
cagcagccctcctc

SEQ ID NO: 185790 - DNA, 17 bp, Homo sapiens
cagcagccctcctcacc

SEQ ID NO: 185791 - DNA, 15 bp, Homo sapiens
cagcagcctggaccc

SEQ ID NO: 185792 - DNA, 19 bp, Homo sapiens
cagcagcctggaccctgtg

SEQ ID NO: 185793 - DNA, 14 bp, Homo sapiens
cagcagctcaggca

SEQ ID NO: 185794 - DNA, 15 bp, Homo sapiens
cagcagctcaggcac

SEQ ID NO: 185795 - DNA, 19 bp, Homo sapiens
cagcagggctaccctgagc

SEQ ID NO: 185796 - DNA, 19 bp, Homo sapiens
cagcagtgtgaggccaggg

SEQ ID NO: 185797 - DNA, 22 bp, Homo sapiens
cagcagtgttccccatctgggt

SEQ ID NO: 185798 - DNA, 16 bp, Homo sapiens
cagccaaagcctcctc

SEQ ID NO: 185799 - DNA, 18 bp, Homo sapiens
cagccaaagcctcctcca

SEQ ID NO: 185800 - DNA, 21 bp, Homo sapiens
cagccaacgagtaatttattg

SEQ ID NO: 185801 - DNA, 15 bp, Homo sapiens
cagccacctctcttt

SEQ ID NO: 185802 - DNA, 22 bp, Homo sapiens
cagccagaacgtggctctgctg

SEQ ID NO: 185803 - DNA, 23 bp, Homo sapiens
cagccagaacgtggctctgctgg

SEQ ID NO: 185804 - DNA, 19 bp, Homo sapiens
cagccagcagccagctctc

SEQ ID NO: 185805 - DNA, 21 bp, Homo sapiens
cagccagctctcagccaacga

SEQ ID NO: 185806 - DNA, 16 bp, Homo sapiens
cagccagtgacctgag

SEQ ID NO: 185807 - DNA, 19 bp, Homo sapiens
cagccagtgacctgaggaa

SEQ ID NO: 185808 - DNA, 13 bp, Homo sapiens
cagcccagcccag

SEQ ID NO: 185809 - DNA, 15 bp, Homo sapiens
cagcccagcccagct

SEQ ID NO: 185810 - DNA, 20 bp, Homo sapiens
cagcccattctctctcctgt

SEQ ID NO: 185811 - DNA, 21 bp, Homo sapiens
cagcccattctctctcctgtc

SEQ ID NO: 185812 - DNA, 22 bp, Homo sapiens
cagcccattctctctcctgtcc

SEQ ID NO: 185813 - DNA, 23 bp, Homo sapiens
cagcccctagcccaggagagaga

SEQ ID NO: 185814 - DNA, 15 bp, Homo sapiens
cagcccctcctctgc

SEQ ID NO: 185815 - DNA, 19 bp, Homo sapiens
cagcccctcctctgccacc

SEQ ID NO: 185816 - DNA, 21 bp, Homo sapiens
cagcccctcctctgccacctc

SEQ ID NO: 185817 - DNA, 22 bp, Homo sapiens
cagcccctcctctgccacctcc

SEQ ID NO: 185818 - DNA, 20 bp, Homo sapiens
cagccccttctcagaatcta

SEQ ID NO: 185819 - DNA, 17 bp, Homo sapiens
cagccctcatcccgagc

SEQ ID NO: 185820 - DNA, 18 bp, Homo sapiens
cagccctccctgcccctc

SEQ ID NO: 185821 - DNA, 15 bp, Homo sapiens
cagccctccctgtcc

SEQ ID NO: 185822 - DNA, 16 bp, Homo sapiens
cagccctccctgtcct

SEQ ID NO: 185823 - DNA, 22 bp, Homo sapiens
cagccctccctgtcctcctcgg

SEQ ID NO: 185824 - DNA, 23 bp, Homo sapiens
cttgtttgattttagctgcagaa

SEQ ID NO: 185825 - DNA, 16 bp, Homo sapiens
cttgtttgctcacctg

SEQ ID NO: 185826 - DNA, 18 bp, Homo sapiens
cttgtttgctcacctggg

SEQ ID NO: 185827 - DNA, 20 bp, Homo sapiens
cttgtttgctcacctggggt

SEQ ID NO: 185828 - DNA, 20 bp, Homo sapiens
cttgttttttttttccactt

SEQ ID NO: 185829 - DNA, 21 bp, Homo sapiens
cttgttttttttttccactta

SEQ ID NO: 185830 - DNA, 16 bp, Homo sapiens
ctttaaactcagggac

SEQ ID NO: 185831 - DNA, 20 bp, Homo sapiens
ctttaagcactacataaact

SEQ ID NO: 185832 - DNA, 20 bp, Homo sapiens
ctttaatttttttaaccaaa

SEQ ID NO: 185833 - DNA, 21 bp, Homo sapiens
ctttaatttttttaaccaaag

SEQ ID NO: 185834 - DNA, 17 bp, Homo sapiens
ctttacatgacacagct

SEQ ID NO: 185835 - DNA, 22 bp, Homo sapiens
ctttagaatgagagtgtgaaat

SEQ ID NO: 185836 - DNA, 21 bp, Homo sapiens
ctttattttttaagtatttat

SEQ ID NO: 185837 - DNA, 20 bp, Homo sapiens
ctttcacaaaattttattcc

SEQ ID NO: 185838 - DNA, 15 bp, Homo sapiens
ctttcacacttccac

SEQ ID NO: 185839 - DNA, 16 bp, Homo sapiens
ctttcacacttccacc

SEQ ID NO: 185840 - DNA, 20 bp, Homo sapiens
ctttcacacttccaccagcc

SEQ ID NO: 185841 - DNA, 19 bp, Homo sapiens
ctttcatgtaaactgtgca

SEQ ID NO: 185842 - DNA, 21 bp, Homo sapiens
ctttccacggagccactcctc

SEQ ID NO: 185843 - DNA, 22 bp, Homo sapiens
ctttccacggagccactcctct

SEQ ID NO: 185844 - DNA, 22 bp, Homo sapiens
ctttcctgatggtacaggaaag

SEQ ID NO: 185845 - DNA, 21 bp, Homo sapiens
ctttcctgcaactcaaggact

SEQ ID NO: 185846 - DNA, 12 bp, Homo sapiens
ctttcctgcccc

SEQ ID NO: 185847 - DNA, 14 bp, Homo sapiens
ctttcctgccccag

SEQ ID NO: 185848 - DNA, 16 bp, Homo sapiens
ctttcctttccccagc

SEQ ID NO: 185849 - DNA, 17 bp, Homo sapiens
ctttcctttccccagcc

SEQ ID NO: 185850 - DNA, 20 bp, Homo sapiens
ctttcctttccccagcccag

SEQ ID NO: 185851 - DNA, 21 bp, Homo sapiens
ctttcctttccccagcccagg

SEQ ID NO: 185852 - DNA, 13 bp, Homo sapiens
ctttctcccaggc

SEQ ID NO: 185853 - DNA, 21 bp, Homo sapiens
ctttctcccaggccaggctcc

SEQ ID NO: 185854 - DNA, 13 bp, Homo sapiens
ctttctgtaaact

SEQ ID NO: 185855 - DNA, 15 bp, Homo sapiens
ctttctgttggtgta

SEQ ID NO: 185856 - DNA, 12 bp, Homo sapiens
ctttcttcctct

SEQ ID NO: 185857 - DNA, 14 bp, Homo sapiens
ctttcttcctctgc

SEQ ID NO: 185858 - DNA, 15 bp, Homo sapiens
ctttcttcctctgct

SEQ ID NO: 185859 - DNA, 16 bp, Homo sapiens
ctttcttctattttat

SEQ ID NO: 185860 - DNA, 21 bp, Homo sapiens
ctttcttttcgccgtggctgc

SEQ ID NO: 185861 - DNA, 20 bp, Homo sapiens
ctttgaagaggaaaatgaat

SEQ ID NO: 185862 - DNA, 23 bp, Homo sapiens
ctttgaatgctttttgaatgtta

SEQ ID NO: 185863 - DNA, 21 bp, Homo sapiens
ctttgactcttttgccattaa

SEQ ID NO: 185864 - DNA, 17 bp, Homo sapiens
ctttgagactgggtctc

SEQ ID NO: 185865 - DNA, 21 bp, Homo sapiens
ctttgagtgcagtcctgatca

SEQ ID NO: 185866 - DNA, 19 bp, Homo sapiens
ctttgagtttcctcaggct

SEQ ID NO: 185867 - DNA, 22 bp, Homo sapiens
ctttgagtttcctcaggctgct

SEQ ID NO: 185868 - DNA, 22 bp, Homo sapiens
ctttgatattttcaacgcagcc

SEQ ID NO: 185869 - DNA, 16 bp, Homo sapiens
ctttgcactgatatat

SEQ ID NO: 185870 - DNA, 14 bp, Homo sapiens
ctttgctctttctt

SEQ ID NO: 185871 - DNA, 21 bp, Homo sapiens
ctttgctgtgaggctgtcctg

SEQ ID NO: 185872 - DNA, 22 bp, Homo sapiens
ctttgctgtgaggctgtcctgt

SEQ ID NO: 185873 - DNA, 21 bp, Homo sapiens
ctttgtaatgtcaccaccttc

SEQ ID NO: 185874 - DNA, 19 bp, Homo sapiens
ctttgtgagagtgagctgt

SEQ ID NO: 185875 - DNA, 16 bp, Homo sapiens
ctttgttgcccaggct

SEQ ID NO: 185876 - DNA, 18 bp, Homo sapiens
ctttgtttgttgtcagct

SEQ ID NO: 185877 - DNA, 16 bp, Homo sapiens
ctttgtttttttttcc

SEQ ID NO: 185878 - DNA, 18 bp, Homo sapiens
cttttaaaacacttccat

SEQ ID NO: 185879 - DNA, 22 bp, Homo sapiens
cttttaaaggggcagaaaaact

SEQ ID NO: 185880 - DNA, 18 bp, Homo sapiens
cttttagttgtatctctt

SEQ ID NO: 185881 - DNA, 21 bp, Homo sapiens
cttttagttgtatctcttttg

SEQ ID NO: 185882 - DNA, 16 bp, Homo sapiens
cttttatagatggtca

SEQ ID NO: 185883 - DNA, 14 bp, Homo sapiens
cttttatagctatt

SEQ ID NO: 185884 - DNA, 19 bp, Homo sapiens
cttttatcacgatattatt

SEQ ID NO: 185885 - DNA, 18 bp, Homo sapiens
cttttatgttatttatat

SEQ ID NO: 185886 - DNA, 20 bp, Homo sapiens
cttttatgttatttatatat

SEQ ID NO: 185887 - DNA, 17 bp, Homo sapiens
cttttcactgctggctg

SEQ ID NO: 185888 - DNA, 18 bp, Homo sapiens
cttttcactgctggctgc

SEQ ID NO: 185889 - DNA, 14 bp, Homo sapiens
cttttccccggtcc

SEQ ID NO: 185890 - DNA, 20 bp, Homo sapiens
cttttccttggggcaggcag

SEQ ID NO: 185891 - DNA, 18 bp, Homo sapiens
cttttctggaatgtaatc

SEQ ID NO: 185892 - DNA, 18 bp, Homo sapiens
cttttctgtccgagcttt

SEQ ID NO: 185893 - DNA, 23 bp, Homo sapiens
cttttctgtccgagctttgaaaa

SEQ ID NO: 185894 - DNA, 22 bp, Homo sapiens
cttttgaagtagtttgtataac

SEQ ID NO: 185895 - DNA, 17 bp, Homo sapiens
cttttgtatgtaaatgt

SEQ ID NO: 185896 - DNA, 20 bp, Homo sapiens
cttttgtatgtaaatgtgca

SEQ ID NO: 185897 - DNA, 21 bp, Homo sapiens
cttttgtatgtaaatgtgcat

SEQ ID NO: 185898 - DNA, 20 bp, Homo sapiens
ctttttaccaagtttcaggt

SEQ ID NO: 185899 - DNA, 12 bp, Homo sapiens
ctttttgaagtg

SEQ ID NO: 185900 - DNA, 21 bp, Homo sapiens
ctttttgaagtgtaggcagac

SEQ ID NO: 185901 - DNA, 23 bp, Homo sapiens
ctttttgaagtgtaggcagacac

SEQ ID NO: 185902 - DNA, 13 bp, Homo sapiens
ctttttgctttcg

SEQ ID NO: 185903 - DNA, 15 bp, Homo sapiens
cttttttacacaaat

SEQ ID NO: 185904 - DNA, 22 bp, Homo sapiens
gaaaaaaaagtttcagagaagt

SEQ ID NO: 185905 - DNA, 16 bp, Homo sapiens
gaaaaaaatgactaaa

SEQ ID NO: 185906 - DNA, 18 bp, Homo sapiens
gaaaaacatctgaaagcc

SEQ ID NO: 185907 - DNA, 23 bp, Homo sapiens
gaaaaactctgggaaataagaga

SEQ ID NO: 185908 - DNA, 16 bp, Homo sapiens
gaaaaagaaaaaatat

SEQ ID NO: 185909 - DNA, 18 bp, Homo sapiens
gaaaaagtcatccaatct

SEQ ID NO: 185910 - DNA, 19 bp, Homo sapiens
gaaaaagtcatccaatcta

SEQ ID NO: 185911 - DNA, 16 bp, Homo sapiens
gaaaaatgagcctggc

SEQ ID NO: 185912 - DNA, 20 bp, Homo sapiens
gaaaaatgcccttaaatcat

SEQ ID NO: 185913 - DNA, 13 bp, Homo sapiens
gaaaaatgtgtaa

SEQ ID NO: 185914 - DNA, 21 bp, Homo sapiens
gaaaacactgtgcacatctgt

SEQ ID NO: 185915 - DNA, 18 bp, Homo sapiens
gaaaaccaagccgtggct

SEQ ID NO: 185916 - DNA, 21 bp, Homo sapiens
gaaaaccaagccgtggcttcc

SEQ ID NO: 185917 - DNA, 13 bp, Homo sapiens
gaaaacccagaga

SEQ ID NO: 185918 - DNA, 14 bp, Homo sapiens
gaaaacccagagag

SEQ ID NO: 185919 - DNA, 15 bp, Homo sapiens
gaaaacccagagagg

SEQ ID NO: 185920 - DNA, 18 bp, Homo sapiens
gaaaactgaaaatctaat

SEQ ID NO: 185921 - DNA, 16 bp, Homo sapiens
gaaaactgacagagga

SEQ ID NO: 185922 - DNA, 19 bp, Homo sapiens
gaaaactgcaacttgtaaa

SEQ ID NO: 185923 - DNA, 18 bp, Homo sapiens
gaaaagaaaaatgagcct

SEQ ID NO: 185924 - DNA, 16 bp, Homo sapiens
gaaaagaatacagaaa

SEQ ID NO: 185925 - DNA, 21 bp, Homo sapiens
gaaaagagatggcctgagaag

SEQ ID NO: 185926 - DNA, 13 bp, Homo sapiens
gaaaagataaaga

SEQ ID NO: 185927 - DNA, 16 bp, Homo sapiens
gaaaagtacatttaat

SEQ ID NO: 185928 - DNA, 13 bp, Homo sapiens
gaaaagtcaaact

SEQ ID NO: 185929 - DNA, 23 bp, Homo sapiens
gaaaataaatcaatgctataact

SEQ ID NO: 185930 - DNA, 18 bp, Homo sapiens
gaaaataatcattcttat

SEQ ID NO: 185931 - DNA, 17 bp, Homo sapiens
gaaaatattatgtgttt

SEQ ID NO: 185932 - DNA, 17 bp, Homo sapiens
gaaaatattttgtctaa

SEQ ID NO: 185933 - DNA, 20 bp, Homo sapiens
gaaaatattttgtctaaaat

SEQ ID NO: 185934 - DNA, 14 bp, Homo sapiens
gaaaatcctctggc

SEQ ID NO: 185935 - DNA, 15 bp, Homo sapiens
gaaaatcctctggct

SEQ ID NO: 185936 - DNA, 14 bp, Homo sapiens
gaaaatgtcttgtg

SEQ ID NO: 185937 - DNA, 18 bp, Homo sapiens
gaaaattaggatttcatg

SEQ ID NO: 185938 - DNA, 17 bp, Homo sapiens
gaaacaactctttgaga

SEQ ID NO: 185939 - DNA, 20 bp, Homo sapiens
gaaacacactgaggcaggga

SEQ ID NO: 185940 - DNA, 17 bp, Homo sapiens
gaaacaggagagaaagg

SEQ ID NO: 185941 - DNA, 18 bp, Homo sapiens
gaaacataaataaaatga

SEQ ID NO: 185942 - DNA, 22 bp, Homo sapiens
gaaacataaataaaatgaccag

SEQ ID NO: 185943 - DNA, 14 bp, Homo sapiens
gaaaccagggcctg

SEQ ID NO: 185944 - DNA, 14 bp, Homo sapiens
gaaaccctggacca

SEQ ID NO: 185945 - DNA, 21 bp, Homo sapiens
gaaaccctggaccagtggtct

SEQ ID NO: 185946 - DNA, 13 bp, Homo sapiens
gaaacctgaaaaa

SEQ ID NO: 185947 - DNA, 13 bp, Homo sapiens
gaaaccttaatat

SEQ ID NO: 185948 - DNA, 19 bp, Homo sapiens
gaaaccttattgtacctct

SEQ ID NO: 185949 - DNA, 20 bp, Homo sapiens
gaaaccttattgtacctctc

SEQ ID NO: 185950 - DNA, 22 bp, Homo sapiens
gaaactcagagtcggaacggag

SEQ ID NO: 185951 - DNA, 22 bp, Homo sapiens
gaaactccgtcttagaagtgga

SEQ ID NO: 185952 - DNA, 13 bp, Homo sapiens
gaaactgccagca

SEQ ID NO: 185953 - DNA, 23 bp, Homo sapiens
gaaactgttgccagagatggagg

SEQ ID NO: 185954 - DNA, 15 bp, Homo sapiens
gaaagactattcaaa

SEQ ID NO: 185955 - DNA, 22 bp, Homo sapiens
gaaagactattcaaacagtctc

SEQ ID NO: 185956 - DNA, 23 bp, Homo sapiens
gaaagactattcaaacagtctca

SEQ ID NO: 185957 - DNA, 14 bp, Homo sapiens
gaaagactgagctc

SEQ ID NO: 185958 - DNA, 21 bp, Homo sapiens
gaaagagcacttaagagaata

SEQ ID NO: 185959 - DNA, 21 bp, Homo sapiens
gaaagaggaatgaagtactca

SEQ ID NO: 185960 - DNA, 20 bp, Homo sapiens
gaaagaggcagcttgaaact

SEQ ID NO: 185961 - DNA, 20 bp, Homo sapiens
gaaagaggctgaggcctgga

SEQ ID NO: 185962 - DNA, 21 bp, Homo sapiens
gaaagaggctgaggcctggac

SEQ ID NO: 185963 - DNA, 23 bp, Homo sapiens
gaaagatggctgtgcctctgcct

SEQ ID NO: 185964 - DNA, 20 bp, Homo sapiens
gaaagcagctcaaaggcaca

SEQ ID NO: 185965 - DNA, 23 bp, Homo sapiens
gaaagcaggggctacaagaggga

SEQ ID NO: 185966 - DNA, 16 bp, Homo sapiens
gaaagctagagatatg

SEQ ID NO: 185967 - DNA, 14 bp, Homo sapiens
gaaaggagaggaaa

SEQ ID NO: 185968 - DNA, 14 bp, Homo sapiens
gaaaggccagctgg

SEQ ID NO: 185969 - DNA, 21 bp, Homo sapiens
gaaaggccagctggcagcaga

SEQ ID NO: 185970 - DNA, 16 bp, Homo sapiens
gaaaggtttacattgt

SEQ ID NO: 185971 - DNA, 17 bp, Homo sapiens
gaaagttccttatgtat

SEQ ID NO: 185972 - DNA, 18 bp, Homo sapiens
gaaataaaacctttcaaa

SEQ ID NO: 185973 - DNA, 11 bp, Homo sapiens
gaaataataaa

SEQ ID NO: 185974 - DNA, 14 bp, Homo sapiens
gaaataataaatct

SEQ ID NO: 185975 - DNA, 13 bp, Homo sapiens
gaaataatatgca

SEQ ID NO: 185976 - DNA, 15 bp, Homo sapiens
gaaataatatgcatt

SEQ ID NO: 185977 - DNA, 20 bp, Homo sapiens
gaaatatcagttactcagcc

SEQ ID NO: 185978 - DNA, 23 bp, Homo sapiens
gaaatatcagttactcagccctg

SEQ ID NO: 185979 - DNA, 16 bp, Homo sapiens
gaaatcaaatatgcaa

SEQ ID NO: 185980 - DNA, 18 bp, Homo sapiens
gaaatccctgtttaatat

SEQ ID NO: 185981 - DNA, 19 bp, Homo sapiens
gaaatccctgtttaatatt

SEQ ID NO: 185982 - DNA, 22 bp, Homo sapiens
gaaatccctgtttaatatttaa

SEQ ID NO: 185983 - DNA, 17 bp, Homo sapiens
gaaatgaaagcagggac

SEQ ID NO: 185984 - DNA, 21 bp, Homo sapiens
gaaatgttattttttaattat

SEQ ID NO: 185985 - DNA, 19 bp, Homo sapiens
gaaattagctgtgtgaaat

SEQ ID NO: 185986 - DNA, 21 bp, Homo sapiens
gaaattatgtatgtttacata

SEQ ID NO: 185987 - DNA, 15 bp, Homo sapiens
gaaatttgatttcta

SEQ ID NO: 185988 - DNA, 21 bp, Homo sapiens
gaaatttgatttctattcaag

SEQ ID NO: 185989 - DNA, 18 bp, Homo sapiens
gaacaaatttacagagac

SEQ ID NO: 185990 - DNA, 21 bp, Homo sapiens
gaacaagttgtttcattgact

SEQ ID NO: 185991 - DNA, 14 bp, Homo sapiens
gaacacactccatc

SEQ ID NO: 185992 - DNA, 16 bp, Homo sapiens
gaacactgggggaggg

SEQ ID NO: 185993 - DNA, 18 bp, Homo sapiens
gaacactgggggagggga

SEQ ID NO: 185994 - DNA, 18 bp, Homo sapiens
gaacagccgctcctgtct

SEQ ID NO: 185995 - DNA, 15 bp, Homo sapiens
gaacagctgtaatct

SEQ ID NO: 185996 - DNA, 23 bp, Homo sapiens
gaacatgaaaacagaaaacggtt

SEQ ID NO: 185997 - DNA, 15 bp, Homo sapiens
gaaccaacactaaca

SEQ ID NO: 185998 - DNA, 16 bp, Homo sapiens
gaaccatgaagacagg

SEQ ID NO: 185999 - DNA, 19 bp, Homo sapiens
gaacccacctgctgagaga

SEQ ID NO: 186000 - DNA, 17 bp, Homo sapiens
gaaccccaaggagggag

SEQ ID NO: 186001 - DNA, 19 bp, Homo sapiens
gaaccccgtcgaggggctc

SEQ ID NO: 186002 - DNA, 16 bp, Homo sapiens
gaacctcacgcacctc

SEQ ID NO: 186003 - DNA, 19 bp, Homo sapiens
gaacctcacgcacctccca

SEQ ID NO: 186004 - DNA, 15 bp, Homo sapiens
gaacctggagttcct

SEQ ID NO: 186005 - DNA, 19 bp, Homo sapiens
gaactaccttggttccccc

SEQ ID NO: 186006 - DNA, 14 bp, Homo sapiens
gaactggactcagg

SEQ ID NO: 186007 - DNA, 21 bp, Homo sapiens
gaactggactcaggatgccca

SEQ ID NO: 186008 - DNA, 16 bp, Homo sapiens
gaactgtccagagagc

SEQ ID NO: 186009 - DNA, 17 bp, Homo sapiens
gaacttgggccactgtg

SEQ ID NO: 186010 - DNA, 21 bp, Homo sapiens
gaactttctcttcatactttt

SEQ ID NO: 186011 - DNA, 14 bp, Homo sapiens
gaagaagctctctc

SEQ ID NO: 186012 - DNA, 18 bp, Homo sapiens
gaagaattgaacccagga

SEQ ID NO: 186013 - DNA, 20 bp, Homo sapiens
gaagaattgaacccaggagg

SEQ ID NO: 186014 - DNA, 23 bp, Homo sapiens
gaagaattgaacccaggaggtgg

SEQ ID NO: 186015 - DNA, 12 bp, Homo sapiens
gaagactgtggc

SEQ ID NO: 186016 - DNA, 12 bp, Homo sapiens
gaagagaaacca

SEQ ID NO: 186017 - DNA, 16 bp, Homo sapiens
gaagagagatcaaatg

SEQ ID NO: 186018 - DNA, 18 bp, Homo sapiens
gaagagatttttcatgat

SEQ ID NO: 186019 - DNA, 13 bp, Homo sapiens
gaagagctgttca

SEQ ID NO: 186020 - DNA, 15 bp, Homo sapiens
gaagagctgttcaca

SEQ ID NO: 186021 - DNA, 21 bp, Homo sapiens
gaagatgcagcaaaatgtgaa

SEQ ID NO: 186022 - DNA, 16 bp, Homo sapiens
gaagcaacagaaaaaa

SEQ ID NO: 186023 - DNA, 23 bp, Homo sapiens
gaagcagatgcaaagaggcaaga

SEQ ID NO: 186024 - DNA, 12 bp, Homo sapiens
gaagccagcctt

SEQ ID NO: 186025 - DNA, 20 bp, Homo sapiens
gaagccagccttcttccatc

SEQ ID NO: 186026 - DNA, 16 bp, Homo sapiens
gaagccctccttccac

SEQ ID NO: 186027 - DNA, 22 bp, Homo sapiens
gaagccctggatttcagaaaga

SEQ ID NO: 186028 - DNA, 14 bp, Homo sapiens
gaagccgctgctgg

SEQ ID NO: 186029 - DNA, 21 bp, Homo sapiens
gaagcctctgggtcagtggtc

SEQ ID NO: 186030 - DNA, 18 bp, Homo sapiens
gaagctccactgtcaccc

SEQ ID NO: 186031 - DNA, 23 bp, Homo sapiens
gaagctccactgtcaccctccac

SEQ ID NO: 186032 - DNA, 23 bp, Homo sapiens
gaagctgtagtagccctttctgt

SEQ ID NO: 186033 - DNA, 12 bp, Homo sapiens
gaagctgtgtcc

SEQ ID NO: 186034 - DNA, 22 bp, Homo sapiens
gaagctgtgtccttgcacctgc

SEQ ID NO: 186035 - DNA, 16 bp, Homo sapiens
gaagcttccagtccaa

SEQ ID NO: 186036 - DNA, 15 bp, Homo sapiens
gaaggaaaaatgtgt

SEQ ID NO: 186037 - DNA, 14 bp, Homo sapiens
gaaggaaaatgata

SEQ ID NO: 186038 - DNA, 19 bp, Homo sapiens
gaaggaatatatggcagag

SEQ ID NO: 186039 - DNA, 16 bp, Homo sapiens
gaaggagaaggaagga

SEQ ID NO: 186040 - DNA, 17 bp, Homo sapiens
gaaggagactcacctct

SEQ ID NO: 186041 - DNA, 20 bp, Homo sapiens
gaaggagactcacctctgcc

SEQ ID NO: 186042 - DNA, 22 bp, Homo sapiens
gaaggagactcacctctgcctc

SEQ ID NO: 186043 - DNA, 16 bp, Homo sapiens
gaaggagagaaagtgg

SEQ ID NO: 186044 - DNA, 15 bp, Homo sapiens
gaaggagagaagggg

SEQ ID NO: 186045 - DNA, 16 bp, Homo sapiens
gaaggagagaagggga

SEQ ID NO: 186046 - DNA, 20 bp, Homo sapiens
gaaggagagaaggggaggag

SEQ ID NO: 186047 - DNA, 21 bp, Homo sapiens
gaaggagccccattcctggga

SEQ ID NO: 186048 - DNA, 22 bp, Homo sapiens
gaaggagccccattcctgggaa

SEQ ID NO: 186049 - DNA, 19 bp, Homo sapiens
gaaggagggttagggaggg

SEQ ID NO: 186050 - DNA, 17 bp, Homo sapiens
gaaggctgtccttaccc

SEQ ID NO: 186051 - DNA, 17 bp, Homo sapiens
gaagggatggattccaa

SEQ ID NO: 186052 - DNA, 15 bp, Homo sapiens
gaaggggaggagggc

SEQ ID NO: 186053 - DNA, 14 bp, Homo sapiens
gaaggggccagagg

SEQ ID NO: 186054 - DNA, 14 bp, Homo sapiens
gaagggtccttccc

SEQ ID NO: 186055 - DNA, 19 bp, Homo sapiens
gaaggtgctggaggtggga

SEQ ID NO: 186056 - DNA, 20 bp, Homo sapiens
gaaggtgctggaggtgggag

SEQ ID NO: 186057 - DNA, 20 bp, Homo sapiens
gaaggttaggatttaacagt

SEQ ID NO: 186058 - DNA, 16 bp, Homo sapiens
gaagtcaaagcaagga

SEQ ID NO: 186059 - DNA, 18 bp, Homo sapiens
gaagtcataccaatgaaa

SEQ ID NO: 186060 - DNA, 17 bp, Homo sapiens
gaagtccccaggcccca

SEQ ID NO: 186061 - DNA, 16 bp, Homo sapiens
gaagtctaggagctgg

SEQ ID NO: 186062 - DNA, 16 bp, Homo sapiens
gaagtggaccaggaca

SEQ ID NO: 186063 - DNA, 18 bp, Homo sapiens
gaagtgggccaggacagg

SEQ ID NO: 186064 - DNA, 15 bp, Homo sapiens
gaagtggggacagag

SEQ ID NO: 186065 - DNA, 15 bp, Homo sapiens
gaagttaacagagac

SEQ ID NO: 186066 - DNA, 17 bp, Homo sapiens
gaagttgcagtgagctg

SEQ ID NO: 186067 - DNA, 15 bp, Homo sapiens
gaataaaatgttgaa

SEQ ID NO: 186068 - DNA, 21 bp, Homo sapiens
gaataaaatgttgaaaagtca

SEQ ID NO: 186069 - DNA, 23 bp, Homo sapiens
gaataaaatgttgaaaagtcaaa

SEQ ID NO: 186070 - DNA, 14 bp, Homo sapiens
gaataaagacacct

SEQ ID NO: 186071 - DNA, 14 bp, Homo sapiens
gaataaagttctga

SEQ ID NO: 186072 - DNA, 15 bp, Homo sapiens
gaataaattgctcct

SEQ ID NO: 186073 - DNA, 20 bp, Homo sapiens
gaatacagtgttattttctt

SEQ ID NO: 186074 - DNA, 15 bp, Homo sapiens
gaatagatgctgact

SEQ ID NO: 186075 - DNA, 21 bp, Homo sapiens
gaatataccccttagtgtttg

SEQ ID NO: 186076 - DNA, 20 bp, Homo sapiens
gaatatatggcagagttgta

SEQ ID NO: 186077 - DNA, 21 bp, Homo sapiens
gaatatatggcagagttgtaa

SEQ ID NO: 186078 - DNA, 12 bp, Homo sapiens
gaatatttatta

SEQ ID NO: 186079 - DNA, 13 bp, Homo sapiens
gaatatttattac

SEQ ID NO: 186080 - DNA, 17 bp, Homo sapiens
gaatatttattacctct

SEQ ID NO: 186081 - DNA, 19 bp, Homo sapiens
gaatatttattacctctga

SEQ ID NO: 186082 - DNA, 22 bp, Homo sapiens
gaatcagaccctaccccaccac

SEQ ID NO: 186083 - DNA, 19 bp, Homo sapiens
gaatcagacttcacactgc

SEQ ID NO: 186084 - DNA, 12 bp, Homo sapiens
gaatcagcttct

SEQ ID NO: 186085 - DNA, 17 bp, Homo sapiens
gaatcatgtcaggcctg

SEQ ID NO: 186086 - DNA, 14 bp, Homo sapiens
gaatccatgcttgg

SEQ ID NO: 186087 - DNA, 16 bp, Homo sapiens
gaatgaaaattgtatg

SEQ ID NO: 186088 - DNA, 15 bp, Homo sapiens
gaatgaatggctaag

SEQ ID NO: 186089 - DNA, 16 bp, Homo sapiens
gaatgacaacagaagc

SEQ ID NO: 186090 - DNA, 18 bp, Homo sapiens
gaatgaccttgttgcatg

SEQ ID NO: 186091 - DNA, 13 bp, Homo sapiens
gaatgaggaggaa

SEQ ID NO: 186092 - DNA, 17 bp, Homo sapiens
gaatgcccacaggcaaa

SEQ ID NO: 186093 - DNA, 21 bp, Homo sapiens
gaatgcggccgcattccctga

SEQ ID NO: 186094 - DNA, 13 bp, Homo sapiens
gaatgctgtgtta

SEQ ID NO: 186095 - DNA, 18 bp, Homo sapiens
gaatgcttctgacttcat

SEQ ID NO: 186096 - DNA, 21 bp, Homo sapiens
gaatgcttctgacttcataga

SEQ ID NO: 186097 - DNA, 22 bp, Homo sapiens
gaatgtctttgttggaaaagaa

SEQ ID NO: 186098 - DNA, 15 bp, Homo sapiens
gaatgttaagcagat

SEQ ID NO: 186099 - DNA, 21 bp, Homo sapiens
gaatgtttacactctttgtaa

SEQ ID NO: 186100 - DNA, 15 bp, Homo sapiens
gaattaacacatgat

SEQ ID NO: 186101 - DNA, 21 bp, Homo sapiens
gaattaatatccctacatgta

SEQ ID NO: 186102 - DNA, 21 bp, Homo sapiens
gaattacatgtaaaacattat

SEQ ID NO: 186103 - DNA, 17 bp, Homo sapiens
gaattcggtgtgcacca

SEQ ID NO: 186104 - DNA, 18 bp, Homo sapiens
gaattcttgaaggaaaat

SEQ ID NO: 186105 - DNA, 19 bp, Homo sapiens
gaattcttggttgaggaaa

SEQ ID NO: 186106 - DNA, 20 bp, Homo sapiens
gaattcttggttgaggaaac

SEQ ID NO: 186107 - DNA, 16 bp, Homo sapiens
gaattgacccacaaga

SEQ ID NO: 186108 - DNA, 17 bp, Homo sapiens
gaattgcttgaacctgg

SEQ ID NO: 186109 - DNA, 22 bp, Homo sapiens
gaattggaccatcctatttaac

SEQ ID NO: 186110 - DNA, 14 bp, Homo sapiens
gaattgtccccagt

SEQ ID NO: 186111 - DNA, 13 bp, Homo sapiens
gaatttattcaat

SEQ ID NO: 186112 - DNA, 19 bp, Homo sapiens
gaatttcttcactgttgaa

SEQ ID NO: 186113 - DNA, 16 bp, Homo sapiens
gacaaaaacagcctca

SEQ ID NO: 186114 - DNA, 18 bp, Homo sapiens
gacaaaaacagcctcaca

SEQ ID NO: 186115 - DNA, 21 bp, Homo sapiens
gacaaaaatgaactgaagttt

SEQ ID NO: 186116 - DNA, 15 bp, Homo sapiens
gactgcccggcaggg

SEQ ID NO: 186117 - DNA, 19 bp, Homo sapiens
gactgctccccagccctgg

SEQ ID NO: 186118 - DNA, 20 bp, Homo sapiens
gactgctccccagccctggc

SEQ ID NO: 186119 - DNA, 14 bp, Homo sapiens
gactgggctgaggg

SEQ ID NO: 186120 - DNA, 21 bp, Homo sapiens
gactgggctgagggagcctgg

SEQ ID NO: 186121 - DNA, 16 bp, Homo sapiens
gactggggatgtggga

SEQ ID NO: 186122 - DNA, 17 bp, Homo sapiens
gactggggatgtgggag

SEQ ID NO: 186123 - DNA, 23 bp, Homo sapiens
gactgggtctcgctttgttgccc

SEQ ID NO: 186124 - DNA, 17 bp, Homo sapiens
gactggtgagcagactg

SEQ ID NO: 186125 - DNA, 22 bp, Homo sapiens
gactggtgttatcaccgtgggc

SEQ ID NO: 186126 - DNA, 23 bp, Homo sapiens
gactgtctcaagagggcactggt

SEQ ID NO: 186127 - DNA, 15 bp, Homo sapiens
gactgtggctgctag

SEQ ID NO: 186128 - DNA, 19 bp, Homo sapiens
gacttaaaatattcctgca

SEQ ID NO: 186129 - DNA, 13 bp, Homo sapiens
gacttcacactgc

SEQ ID NO: 186130 - DNA, 14 bp, Homo sapiens
gacttcacactgca

SEQ ID NO: 186131 - DNA, 16 bp, Homo sapiens
gacttcacactgcaag

SEQ ID NO: 186132 - DNA, 19 bp, Homo sapiens
gacttcagtatgttgtcaa

SEQ ID NO: 186133 - DNA, 16 bp, Homo sapiens
gacttcatttttccta

SEQ ID NO: 186134 - DNA, 16 bp, Homo sapiens
gacttctaagtaaaac

SEQ ID NO: 186135 - DNA, 12 bp, Homo sapiens
gacttgaagttg

SEQ ID NO: 186136 - DNA, 13 bp, Homo sapiens
gacttgaagttgt

SEQ ID NO: 186137 - DNA, 12 bp, Homo sapiens
gactttcaggta

SEQ ID NO: 186138 - DNA, 21 bp, Homo sapiens
gactttgcagccggcacaggg

SEQ ID NO: 186139 - DNA, 23 bp, Homo sapiens
gacttttctgtccgagctttgaa

SEQ ID NO: 186140 - DNA, 13 bp, Homo sapiens
gagaaaagacatg

SEQ ID NO: 186141 - DNA, 17 bp, Homo sapiens
gagaaacaataaagaga

SEQ ID NO: 186142 - DNA, 18 bp, Homo sapiens
gagaaagactattcaaac

SEQ ID NO: 186143 - DNA, 15 bp, Homo sapiens
gagaaagccaggcag

SEQ ID NO: 186144 - DNA, 20 bp, Homo sapiens
gagaaagccaggcaggtagc

SEQ ID NO: 186145 - DNA, 19 bp, Homo sapiens
gagaacctggagttcctga

SEQ ID NO: 186146 - DNA, 13 bp, Homo sapiens
gagaagagctgtt

SEQ ID NO: 186147 - DNA, 22 bp, Homo sapiens
gagaagagctgttcacagccag

SEQ ID NO: 186148 - DNA, 23 bp, Homo sapiens
gagaagcaagaaagaaacccgac

SEQ ID NO: 186149 - DNA, 16 bp, Homo sapiens
gagaagcggctggcag

SEQ ID NO: 186150 - DNA, 15 bp, Homo sapiens
gagaaggagagaaag

SEQ ID NO: 186151 - DNA, 23 bp, Homo sapiens
gagaaggcaggaatgtgtggcag

SEQ ID NO: 186152 - DNA, 21 bp, Homo sapiens
gagaatattttaagtattgca

SEQ ID NO: 186153 - DNA, 17 bp, Homo sapiens
gagacaagaaatccctg

SEQ ID NO: 186154 - DNA, 18 bp, Homo sapiens
gagacacctgcacctccc

SEQ ID NO: 186155 - DNA, 18 bp, Homo sapiens
gagacagctctgcatact

SEQ ID NO: 186156 - DNA, 19 bp, Homo sapiens
gagacaggaaaatcctctg

SEQ ID NO: 186157 - DNA, 21 bp, Homo sapiens
gagacaggaaaatcctctggc

SEQ ID NO: 186158 - DNA, 13 bp, Homo sapiens
gagacatgtgaca

SEQ ID NO: 186159 - DNA, 14 bp, Homo sapiens
gagacatgtgacat

SEQ ID NO: 186160 - DNA, 16 bp, Homo sapiens
gagaccaacctgacca

SEQ ID NO: 186161 - DNA, 23 bp, Homo sapiens
gagaccaagactctgaaatctca

SEQ ID NO: 186162 - DNA, 13 bp, Homo sapiens
gagaccgtcctca

SEQ ID NO: 186163 - DNA, 16 bp, Homo sapiens
gagaccgtcctcaccc

SEQ ID NO: 186164 - DNA, 13 bp, Homo sapiens
gagacctcagcca

SEQ ID NO: 186165 - DNA, 17 bp, Homo sapiens
gagactcagggccccag

SEQ ID NO: 186166 - DNA, 18 bp, Homo sapiens
gagactccgtctcaagga

SEQ ID NO: 186167 - DNA, 14 bp, Homo sapiens
gagactgggctgag

SEQ ID NO: 186168 - DNA, 20 bp, Homo sapiens
gagactgggctgagggagcc

SEQ ID NO: 186169 - DNA, 16 bp, Homo sapiens
gagactggggggcttg

SEQ ID NO: 186170 - DNA, 22 bp, Homo sapiens
gagacttttaatcagacaaagt

SEQ ID NO: 186171 - DNA, 19 bp, Homo sapiens
gagagaaagccaggcaggt

SEQ ID NO: 186172 - DNA, 15 bp, Homo sapiens
gagagaaagtgggtg

SEQ ID NO: 186173 - DNA, 12 bp, Homo sapiens
gagagaagggga

SEQ ID NO: 186174 - DNA, 16 bp, Homo sapiens
gagagaaggggaggag

SEQ ID NO: 186175 - DNA, 15 bp, Homo sapiens
gagagagaaagccag

SEQ ID NO: 186176 - DNA, 18 bp, Homo sapiens
gagagagaaagccaggca

SEQ ID NO: 186177 - DNA, 13 bp, Homo sapiens
gagagagagaggt

SEQ ID NO: 186178 - DNA, 17 bp, Homo sapiens
gagagcaactctgagat

SEQ ID NO: 186179 - DNA, 21 bp, Homo sapiens
gagagcagctttaaactcagg

SEQ ID NO: 186180 - DNA, 23 bp, Homo sapiens
gagagcagctttaaactcaggga

SEQ ID NO: 186181 - DNA, 11 bp, Homo sapiens
gagagccagcc

SEQ ID NO: 186182 - DNA, 12 bp, Homo sapiens
gagagccagccc

SEQ ID NO: 186183 - DNA, 20 bp, Homo sapiens
gagagccagccctccctgtc

SEQ ID NO: 186184 - DNA, 16 bp, Homo sapiens
gagagcccttcatttg

SEQ ID NO: 186185 - DNA, 22 bp, Homo sapiens
gagagcctgctcccccaccccc

SEQ ID NO: 186186 - DNA, 11 bp, Homo sapiens
gagaggagaga

SEQ ID NO: 186187 - DNA, 18 bp, Homo sapiens
gagaggagaggagagagg

SEQ ID NO: 186188 - DNA, 12 bp, Homo sapiens
gagaggcagaga

SEQ ID NO: 186189 - DNA, 18 bp, Homo sapiens
gagagggtctggagaagc

SEQ ID NO: 186190 - DNA, 24 bp, Homo sapiens
gagaggtcaagcccaggaggactg

SEQ ID NO: 186191 - DNA, 17 bp, Homo sapiens
gagaggtcttttttaaa

SEQ ID NO: 186192 - DNA, 18 bp, Homo sapiens
gagagtagccgagagcct

SEQ ID NO: 186193 - DNA, 22 bp, Homo sapiens
gagagtagccgagagcctgctc

SEQ ID NO: 186194 - DNA, 14 bp, Homo sapiens
gagatcagcctggg

SEQ ID NO: 186195 - DNA, 16 bp, Homo sapiens
gagatcagcctgggca

SEQ ID NO: 186196 - DNA, 16 bp, Homo sapiens
gagatcatcctttcca

SEQ ID NO: 186197 - DNA, 15 bp, Homo sapiens
gagatgcctccaccg

SEQ ID NO: 186198 - DNA, 21 bp, Homo sapiens
gagatgctggagaagagagga

SEQ ID NO: 186199 - DNA, 19 bp, Homo sapiens
gagatgggactgggagggc

SEQ ID NO: 186200 - DNA, 15 bp, Homo sapiens
gagattatgttcttt

SEQ ID NO: 186201 - DNA, 20 bp, Homo sapiens
gagattgagaaggagagaaa

SEQ ID NO: 186202 - DNA, 21 bp, Homo sapiens
gagattgcaccactgcactcc

SEQ ID NO: 186203 - DNA, 13 bp, Homo sapiens
gagcaaagctgat

SEQ ID NO: 186204 - DNA, 20 bp, Homo sapiens
gagcaaagtgaagacactgg

SEQ ID NO: 186205 - DNA, 12 bp, Homo sapiens
gagcaagactct

SEQ ID NO: 186206 - DNA, 13 bp, Homo sapiens
gagcacactgtag

SEQ ID NO: 186207 - DNA, 15 bp, Homo sapiens
gagcaccaggcacga

SEQ ID NO: 186208 - DNA, 14 bp, Homo sapiens
gagcacctccacat

SEQ ID NO: 186209 - DNA, 15 bp, Homo sapiens
gagcactcccaagtc

SEQ ID NO: 186210 - DNA, 13 bp, Homo sapiens
gagcactgggttg

SEQ ID NO: 186211 - DNA, 15 bp, Homo sapiens
gagcagactggtggg

SEQ ID NO: 186212 - DNA, 17 bp, Homo sapiens
gagcagctttaaactca

SEQ ID NO: 186213 - DNA, 23 bp, Homo sapiens
gagcaggaagcattcagagagca

SEQ ID NO: 186214 - DNA, 22 bp, Homo sapiens
gagcaggacctctgaaaccctg

SEQ ID NO: 186215 - DNA, 23 bp, Homo sapiens
gagcagtggctggtccagggcta

SEQ ID NO: 186216 - DNA, 15 bp, Homo sapiens
gagccactcctctga

SEQ ID NO: 186217 - DNA, 12 bp, Homo sapiens
gagccagccctc

SEQ ID NO: 186218 - DNA, 13 bp, Homo sapiens
gagccagccctcc

SEQ ID NO: 186219 - DNA, 19 bp, Homo sapiens
gagccagccctccctgtcc

SEQ ID NO: 186220 - DNA, 14 bp, Homo sapiens
gagcccagctctga

SEQ ID NO: 186221 - DNA, 13 bp, Homo sapiens
gagcccaggcggg

SEQ ID NO: 186222 - DNA, 15 bp, Homo sapiens
gagcccaggcgggag

SEQ ID NO: 186223 - DNA, 17 bp, Homo sapiens
gagccccaggcctctgt

SEQ ID NO: 186224 - DNA, 18 bp, Homo sapiens
gagccccaggcctctgtg

SEQ ID NO: 186225 - DNA, 18 bp, Homo sapiens
gagccccattcctgggaa

SEQ ID NO: 186226 - DNA, 12 bp, Homo sapiens
gagcccctggtc

SEQ ID NO: 186227 - DNA, 13 bp, Homo sapiens
gagcccctggtcc

SEQ ID NO: 186228 - DNA, 17 bp, Homo sapiens
gagcccggatgcttctc

SEQ ID NO: 186229 - DNA, 21 bp, Homo sapiens
gagccctcaaagtgaggggaa

SEQ ID NO: 186230 - DNA, 15 bp, Homo sapiens
gagccctcagaaccc

SEQ ID NO: 186231 - DNA, 22 bp, Homo sapiens
gagccctgtggatgagccctca

SEQ ID NO: 186232 - DNA, 21 bp, Homo sapiens
gagccgggtctgcctcttctg

SEQ ID NO: 186233 - DNA, 17 bp, Homo sapiens
gagccgtggtcctttgg

SEQ ID NO: 186234 - DNA, 13 bp, Homo sapiens
gagcctgctcccc

SEQ ID NO: 186235 - DNA, 23 bp, Homo sapiens
gagcctggctcttgtgctggatg

SEQ ID NO: 186236 - DNA, 21 bp, Homo sapiens
gagcgaggagatgctccttgg

SEQ ID NO: 186237 - DNA, 22 bp, Homo sapiens
gagcgcctgcccctcccagaac

SEQ ID NO: 186238 - DNA, 15 bp, Homo sapiens
gagcggaaagcagct

SEQ ID NO: 186239 - DNA, 14 bp, Homo sapiens
gagcggtctcaggc

SEQ ID NO: 186240 - DNA, 22 bp, Homo sapiens
gagcggtctcaggctggtggga

SEQ ID NO: 186241 - DNA, 23 bp, Homo sapiens
gagcggtggccctgtccctccca

SEQ ID NO: 186242 - DNA, 14 bp, Homo sapiens
gagctagcgctgcc

SEQ ID NO: 186243 - DNA, 13 bp, Homo sapiens
gagctatttccat

SEQ ID NO: 186244 - DNA, 21 bp, Homo sapiens
gagctatttccattccagaat

SEQ ID NO: 186245 - DNA, 20 bp, Homo sapiens
gagctcagacccccactctc

SEQ ID NO: 186246 - DNA, 17 bp, Homo sapiens
gagctgggaggaaaaga

SEQ ID NO: 186247 - DNA, 12 bp, Homo sapiens
gagctggggaag

SEQ ID NO: 186248 - DNA, 17 bp, Homo sapiens
gagctgttcacagccag

SEQ ID NO: 186249 - DNA, 22 bp, Homo sapiens
gagctgttcacagccagactgg

SEQ ID NO: 186250 - DNA, 19 bp, Homo sapiens
gagcttcatggcagaaggc

SEQ ID NO: 186251 - DNA, 14 bp, Homo sapiens
gagcttctggcact

SEQ ID NO: 186252 - DNA, 22 bp, Homo sapiens
gagcttcttccaggtgcccagc

SEQ ID NO: 186253 - DNA, 23 bp, Homo sapiens
gaggaaaaccaagccgtggcttc

SEQ ID NO: 186254 - DNA, 23 bp, Homo sapiens
gaggaaaggccagctggcagcag

SEQ ID NO: 186255 - DNA, 16 bp, Homo sapiens
gaggaactgtccagag

SEQ ID NO: 186256 - DNA, 18 bp, Homo sapiens
gaggaactgtccagagag

SEQ ID NO: 186257 - DNA, 17 bp, Homo sapiens
gaggaagagaaaaaata

SEQ ID NO: 186258 - DNA, 19 bp, Homo sapiens
gaggaagccctaagacgtc

SEQ ID NO: 186259 - DNA, 22 bp, Homo sapiens
gaggaatcatgtcaggcctgtg

SEQ ID NO: 186260 - DNA, 14 bp, Homo sapiens
gaggaatggacaga

SEQ ID NO: 186261 - DNA, 14 bp, Homo sapiens
gaggaatgtatatg

SEQ ID NO: 186262 - DNA, 15 bp, Homo sapiens
gaggacgtgggcggc

SEQ ID NO: 186263 - DNA, 23 bp, Homo sapiens
gaggactgttgacatccaagctt

SEQ ID NO: 186264 - DNA, 15 bp, Homo sapiens
gacaaaccagaagca

SEQ ID NO: 186265 - DNA, 13 bp, Homo sapiens
gacaaaggcaagc

SEQ ID NO: 186266 - DNA, 12 bp, Homo sapiens
gacaacagaagc

SEQ ID NO: 186267 - DNA, 15 bp, Homo sapiens
gacaacgaggaagcc

SEQ ID NO: 186268 - DNA, 16 bp, Homo sapiens
gacaacgaggaagccc

SEQ ID NO: 186269 - DNA, 16 bp, Homo sapiens
gacaagacttcagtat

SEQ ID NO: 186270 - DNA, 20 bp, Homo sapiens
gacaagacttcagtatgttg

SEQ ID NO: 186271 - DNA, 24 bp, Homo sapiens
gacaagacttcagtatgttgtcaa

SEQ ID NO: 186272 - DNA, 13 bp, Homo sapiens
gacaataatttca

SEQ ID NO: 186273 - DNA, 19 bp, Homo sapiens
gacaataatttcaggtttt

SEQ ID NO: 186274 - DNA, 20 bp, Homo sapiens
gacaatcatgaaatatgcat

SEQ ID NO: 186275 - DNA, 20 bp, Homo sapiens
gacaatgtgaaaagaaaaat

SEQ ID NO: 186276 - DNA, 12 bp, Homo sapiens
gacacacacaca

SEQ ID NO: 186277 - DNA, 18 bp, Homo sapiens
gacacagggacttgaagt

SEQ ID NO: 186278 - DNA, 19 bp, Homo sapiens
gacacagggacttgaagtt

SEQ ID NO: 186279 - DNA, 20 bp, Homo sapiens
gacacagggacttgaagttg

SEQ ID NO: 186280 - DNA, 21 bp, Homo sapiens
gacacagggacttgaagttgt

SEQ ID NO: 186281 - DNA, 20 bp, Homo sapiens
gacaccacacccagcctcag

SEQ ID NO: 186282 - DNA, 19 bp, Homo sapiens
gacacccatgtttctctgg

SEQ ID NO: 186283 - DNA, 19 bp, Homo sapiens
gacacctgcacctcccccc

SEQ ID NO: 186284 - DNA, 19 bp, Homo sapiens
gacactccagtgccagcaa

SEQ ID NO: 186285 - DNA, 15 bp, Homo sapiens
gacactcccttgggc

SEQ ID NO: 186286 - DNA, 15 bp, Homo sapiens
gacagacacacacac

SEQ ID NO: 186287 - DNA, 14 bp, Homo sapiens
gacagacaggctct

SEQ ID NO: 186288 - DNA, 17 bp, Homo sapiens
gacagagacacctgcac

SEQ ID NO: 186289 - DNA, 22 bp, Homo sapiens
gacagagacacctgcacctccc

SEQ ID NO: 186290 - DNA, 15 bp, Homo sapiens
gacagaggatgagct

SEQ ID NO: 186291 - DNA, 19 bp, Homo sapiens
gacagatctctgctttgga

SEQ ID NO: 186292 - DNA, 16 bp, Homo sapiens
gacagcagctcaggca

SEQ ID NO: 186293 - DNA, 20 bp, Homo sapiens
gacagccccagagcagggtg

SEQ ID NO: 186294 - DNA, 11 bp, Homo sapiens
gacagcctccc

SEQ ID NO: 186295 - DNA, 16 bp, Homo sapiens
gacagcctcccacccc

SEQ ID NO: 186296 - DNA, 12 bp, Homo sapiens
gacagcctggca

SEQ ID NO: 186297 - DNA, 19 bp, Homo sapiens
gacagcctggcacagggca

SEQ ID NO: 186298 - DNA, 14 bp, Homo sapiens
gacagctgtccctg

SEQ ID NO: 186299 - DNA, 15 bp, Homo sapiens
gacagctgtccctgt

SEQ ID NO: 186300 - DNA, 16 bp, Homo sapiens
gacagctgtccctgtc

SEQ ID NO: 186301 - DNA, 18 bp, Homo sapiens
gacaggaaaatcctctgg

SEQ ID NO: 186302 - DNA, 19 bp, Homo sapiens
gacaggaaaatcctctggc

SEQ ID NO: 186303 - DNA, 20 bp, Homo sapiens
gacaggacgggcttgggctt

SEQ ID NO: 186304 - DNA, 11 bp, Homo sapiens
gacaggagaaa

SEQ ID NO: 186305 - DNA, 12 bp, Homo sapiens
gacaggagaaat

SEQ ID NO: 186306 - DNA, 23 bp, Homo sapiens
gacaggatgggggctggcctctg

SEQ ID NO: 186307 - DNA, 18 bp, Homo sapiens
gacaggctcttagcagct

SEQ ID NO: 186308 - DNA, 22 bp, Homo sapiens
gacagggcatggccaggtggcc

SEQ ID NO: 186309 - DNA, 20 bp, Homo sapiens
gacagggtttggctgtgtct

SEQ ID NO: 186310 - DNA, 21 bp, Homo sapiens
gacagggtttggctgtgtcta

SEQ ID NO: 186311 - DNA, 23 bp, Homo sapiens
gacagggtttggctgtgtctaaa

SEQ ID NO: 186312 - DNA, 16 bp, Homo sapiens
gacataatttcactga

SEQ ID NO: 186313 - DNA, 13 bp, Homo sapiens
gacatattcattt

SEQ ID NO: 186314 - DNA, 14 bp, Homo sapiens
gacatcaacagata

SEQ ID NO: 186315 - DNA, 16 bp, Homo sapiens
gacatccaagcttcct

SEQ ID NO: 186316 - DNA, 13 bp, Homo sapiens
gacatctcagggg

SEQ ID NO: 186317 - DNA, 17 bp, Homo sapiens
gacatctcaggggccag

SEQ ID NO: 186318 - DNA, 19 bp, Homo sapiens
gacatcttagtatttgcat

SEQ ID NO: 186319 - DNA, 14 bp, Homo sapiens
gacatgatcttctt

SEQ ID NO: 186320 - DNA, 15 bp, Homo sapiens
gacatgcgggctggg

SEQ ID NO: 186321 - DNA, 16 bp, Homo sapiens
gacatggggaggaagg

SEQ ID NO: 186322 - DNA, 16 bp, Homo sapiens
gacatgtgacatttat

SEQ ID NO: 186323 - DNA, 18 bp, Homo sapiens
gacatgtttttgttttct

SEQ ID NO: 186324 - DNA, 22 bp, Homo sapiens
gacatttgggagacatgtgaca

SEQ ID NO: 186325 - DNA, 23 bp, Homo sapiens
gacatttgggagacatgtgacat

SEQ ID NO: 186326 - DNA, 16 bp, Homo sapiens
gaccaacatggagaaa

SEQ ID NO: 186327 - DNA, 13 bp, Homo sapiens
gaccaacctgacc

SEQ ID NO: 186328 - DNA, 12 bp, Homo sapiens
gaccaagcagga

SEQ ID NO: 186329 - DNA, 17 bp, Homo sapiens
gaccaagcaggaagctc

SEQ ID NO: 186330 - DNA, 18 bp, Homo sapiens
gaccacaaaacttttcta

SEQ ID NO: 186331 - DNA, 14 bp, Homo sapiens
gaccacctgcccaa

SEQ ID NO: 186332 - DNA, 21 bp, Homo sapiens
gaccacgctttctagctgttg

SEQ ID NO: 186333 - DNA, 16 bp, Homo sapiens
gaccactgcagaagac

SEQ ID NO: 186334 - DNA, 18 bp, Homo sapiens
gaccagcagatcccagct

SEQ ID NO: 186335 - DNA, 20 bp, Homo sapiens
gaccagcagatcccagctca

SEQ ID NO: 186336 - DNA, 20 bp, Homo sapiens
gaccagcctccatgctgcct

SEQ ID NO: 186337 - DNA, 22 bp, Homo sapiens
gaccagcctccatgctgcctcc

SEQ ID NO: 186338 - DNA, 23 bp, Homo sapiens
gaccaggcatcctccacaatagc

SEQ ID NO: 186339 - DNA, 18 bp, Homo sapiens
gaccagtcaacctgggca

SEQ ID NO: 186340 - DNA, 15 bp, Homo sapiens
gaccagtctgaccct

SEQ ID NO: 186341 - DNA, 14 bp, Homo sapiens
gacccaaggaggaa

SEQ ID NO: 186342 - DNA, 15 bp, Homo sapiens
gacccacaagaaatg

SEQ ID NO: 186343 - DNA, 23 bp, Homo sapiens
gacccacttcacacacaggcaac

SEQ ID NO: 186344 - DNA, 23 bp, Homo sapiens
gacccagccccttgagaaacctt

SEQ ID NO: 186345 - DNA, 12 bp, Homo sapiens
gacccagtgaga

SEQ ID NO: 186346 - DNA, 12 bp, Homo sapiens
gaccccagagga

SEQ ID NO: 186347 - DNA, 18 bp, Homo sapiens
gaccccagctgtgagcct

SEQ ID NO: 186348 - DNA, 12 bp, Homo sapiens
gacccccaacca

SEQ ID NO: 186349 - DNA, 21 bp, Homo sapiens
gacccccaaccaagtggctcc

SEQ ID NO: 186350 - DNA, 13 bp, Homo sapiens
gacccctcctcac

SEQ ID NO: 186351 - DNA, 14 bp, Homo sapiens
gacccctcctcact

SEQ ID NO: 186352 - DNA, 22 bp, Homo sapiens
gacccctggcttttcactgctg

SEQ ID NO: 186353 - DNA, 18 bp, Homo sapiens
gacccggaggggcctggc

SEQ ID NO: 186354 - DNA, 20 bp, Homo sapiens
gacccggaggggcctggcag

SEQ ID NO: 186355 - DNA, 16 bp, Homo sapiens
gaccctaaatcttgac

SEQ ID NO: 186356 - DNA, 18 bp, Homo sapiens
gaccctcgtggccttccc

SEQ ID NO: 186357 - DNA, 17 bp, Homo sapiens
gaccctctccaccccat

SEQ ID NO: 186358 - DNA, 14 bp, Homo sapiens
gaccctctgccacc

SEQ ID NO: 186359 - DNA, 20 bp, Homo sapiens
gaccctctgccaccagagac

SEQ ID NO: 186360 - DNA, 23 bp, Homo sapiens
gaccctgtctcaaaaaaagaaaa

SEQ ID NO: 186361 - DNA, 23 bp, Homo sapiens
gaccctttccttccttccctggc

SEQ ID NO: 186362 - DNA, 15 bp, Homo sapiens
gaccggtacagaaag

SEQ ID NO: 186363 - DNA, 21 bp, Homo sapiens
gacctagggatgttctggccc

SEQ ID NO: 186364 - DNA, 12 bp, Homo sapiens
gacctcagcctg

SEQ ID NO: 186365 - DNA, 14 bp, Homo sapiens
gacctcagcctgtg

SEQ ID NO: 186366 - DNA, 18 bp, Homo sapiens
gacctcaggcactagcct

SEQ ID NO: 186367 - DNA, 17 bp, Homo sapiens
gacctcatgcatctcca

SEQ ID NO: 186368 - DNA, 21 bp, Homo sapiens
gacctcatgcatctccacctg

SEQ ID NO: 186369 - DNA, 22 bp, Homo sapiens
gacctcatgcatctccacctgc

SEQ ID NO: 186370 - DNA, 13 bp, Homo sapiens
gacctccccagcc

SEQ ID NO: 186371 - DNA, 14 bp, Homo sapiens
gacctccccagccc

SEQ ID NO: 186372 - DNA, 16 bp, Homo sapiens
gacctcgtcctccccc

SEQ ID NO: 186373 - DNA, 14 bp, Homo sapiens
gacctgaggaagcg

SEQ ID NO: 186374 - DNA, 12 bp, Homo sapiens
gacctgcctgta

SEQ ID NO: 186375 - DNA, 22 bp, Homo sapiens
gacctggtgctgcctctacctg

SEQ ID NO: 186376 - DNA, 12 bp, Homo sapiens
gacctgtaatca

SEQ ID NO: 186377 - DNA, 17 bp, Homo sapiens
gaccttgaactcctggg

SEQ ID NO: 186378 - DNA, 15 bp, Homo sapiens
gaccttgttcacact

SEQ ID NO: 186379 - DNA, 20 bp, Homo sapiens
gaccttgttgcatgatgtat

SEQ ID NO: 186380 - DNA, 21 bp, Homo sapiens
gacctttgtcatctttcttct

SEQ ID NO: 186381 - DNA, 19 bp, Homo sapiens
gacgcagcaggaggccagg

SEQ ID NO: 186382 - DNA, 13 bp, Homo sapiens
gacgcctgagctc

SEQ ID NO: 186383 - DNA, 14 bp, Homo sapiens
gacgcgtctcctgt

SEQ ID NO: 186384 - DNA, 21 bp, Homo sapiens
gacggaagcctttttccccaa

SEQ ID NO: 186385 - DNA, 19 bp, Homo sapiens
gacggcacccacccagcac

SEQ ID NO: 186386 - DNA, 15 bp, Homo sapiens
gacggttcaccagcc

SEQ ID NO: 186387 - DNA, 19 bp, Homo sapiens
gacggttcaccagcctctc

SEQ ID NO: 186388 - DNA, 12 bp, Homo sapiens
gacgtccctcca

SEQ ID NO: 186389 - DNA, 18 bp, Homo sapiens
gacgtcccttttttctct

SEQ ID NO: 186390 - DNA, 18 bp, Homo sapiens
gacgtcctgccacctggg

SEQ ID NO: 186391 - DNA, 21 bp, Homo sapiens
gacgtcctgccacctggggca

SEQ ID NO: 186392 - DNA, 17 bp, Homo sapiens
gactactcccccaggtg

SEQ ID NO: 186393 - DNA, 15 bp, Homo sapiens
gactattcaaacagt

SEQ ID NO: 186394 - DNA, 14 bp, Homo sapiens
gactcacctctgcc

SEQ ID NO: 186395 - DNA, 17 bp, Homo sapiens
gactcagaagcctctgg

SEQ ID NO: 186396 - DNA, 16 bp, Homo sapiens
gactcagactccattt

SEQ ID NO: 186397 - DNA, 17 bp, Homo sapiens
gactcaggatgcccagg

SEQ ID NO: 186398 - DNA, 18 bp, Homo sapiens
gactcaggatgcccaggg

SEQ ID NO: 186399 - DNA, 15 bp, Homo sapiens
gactcagggccccag

SEQ ID NO: 186400 - DNA, 17 bp, Homo sapiens
gactcagggccccagca

SEQ ID NO: 186401 - DNA, 18 bp, Homo sapiens
gactcagggccccagcac

SEQ ID NO: 186402 - DNA, 13 bp, Homo sapiens
gactcagggctcc

SEQ ID NO: 186403 - DNA, 13 bp, Homo sapiens
gactcattctgaa

SEQ ID NO: 186404 - DNA, 14 bp, Homo sapiens
gactccacccatcc

SEQ ID NO: 186405 - DNA, 14 bp, Homo sapiens
gactctcaaatctt

SEQ ID NO: 186406 - DNA, 12 bp, Homo sapiens
gactctgcctcc

SEQ ID NO: 186407 - DNA, 9 bp, Homo sapiens
gactcttgt

SEQ ID NO: 186408 - DNA, 14 bp, Homo sapiens
gactcttgttttca

SEQ ID NO: 186409 - DNA, 19 bp, Homo sapiens
gactcttgttttcagtttc

SEQ ID NO: 186410 - DNA, 22 bp, Homo sapiens
gactctttttagggccaggcag

SEQ ID NO: 186411 - DNA, 15 bp, Homo sapiens
gactgagcagactgg

SEQ ID NO: 186412 - DNA, 17 bp, Homo sapiens
gactgccccgtgcagac

SEQ ID NO: 186413 - DNA, 16 bp, Homo sapiens
gagtatctgggaactg

SEQ ID NO: 186414 - DNA, 20 bp, Homo sapiens
gagtcaatcccctcattcag

SEQ ID NO: 186415 - DNA, 14 bp, Homo sapiens
gagtcaccaggaat

SEQ ID NO: 186416 - DNA, 12 bp, Homo sapiens
gagtcactgcct

SEQ ID NO: 186417 - DNA, 17 bp, Homo sapiens
gagtcagggacccctgc

SEQ ID NO: 186418 - DNA, 16 bp, Homo sapiens
gagtcatgatctccct

SEQ ID NO: 186419 - DNA, 19 bp, Homo sapiens
gagtcatgatctccctgcc

SEQ ID NO: 186420 - DNA, 20 bp, Homo sapiens
gagtccaacgtggggcagca

SEQ ID NO: 186421 - DNA, 19 bp, Homo sapiens
gagtcgtcatcacttttca

SEQ ID NO: 186422 - DNA, 14 bp, Homo sapiens
gagtctcttctcca

SEQ ID NO: 186423 - DNA, 17 bp, Homo sapiens
gagtctcttctccactg

SEQ ID NO: 186424 - DNA, 15 bp, Homo sapiens
gagtctgaagcagat

SEQ ID NO: 186425 - DNA, 19 bp, Homo sapiens
gagtgaacaaatttacaga

SEQ ID NO: 186426 - DNA, 23 bp, Homo sapiens
gagtgaacaaatttacagagaca

SEQ ID NO: 186427 - DNA, 14 bp, Homo sapiens
gagtgaataaatgt

SEQ ID NO: 186428 - DNA, 15 bp, Homo sapiens
gagtgaataaatgtc

SEQ ID NO: 186429 - DNA, 16 bp, Homo sapiens
gagtgcaacagtagca

SEQ ID NO: 186430 - DNA, 14 bp, Homo sapiens
gagtgcagtcctga

SEQ ID NO: 186431 - DNA, 23 bp, Homo sapiens
gagtgtcctaggagtatcctcat

SEQ ID NO: 186432 - DNA, 15 bp, Homo sapiens
gagtgtctttccacg

SEQ ID NO: 186433 - DNA, 19 bp, Homo sapiens
gagtgtctttccacggagc

SEQ ID NO: 186434 - DNA, 21 bp, Homo sapiens
gagtgtctttccacggagcca

SEQ ID NO: 186435 - DNA, 12 bp, Homo sapiens
gagtgtgggaag

SEQ ID NO: 186436 - DNA, 19 bp, Homo sapiens
gagtgtgtgcatgtgtgtg

SEQ ID NO: 186437 - DNA, 17 bp, Homo sapiens
gagttacattaatgtta

SEQ ID NO: 186438 - DNA, 16 bp, Homo sapiens
gagttagaggccagcc

SEQ ID NO: 186439 - DNA, 18 bp, Homo sapiens
gagttagaggccagcctg

SEQ ID NO: 186440 - DNA, 16 bp, Homo sapiens
gagttgattcagctct

SEQ ID NO: 186441 - DNA, 18 bp, Homo sapiens
gagttgattcagctctgc

SEQ ID NO: 186442 - DNA, 15 bp, Homo sapiens
gagttgtaaatatat

SEQ ID NO: 186443 - DNA, 22 bp, Homo sapiens
gagttgttttcagactcagact

SEQ ID NO: 186444 - DNA, 21 bp, Homo sapiens
gagtttagtgatctgaacaga

SEQ ID NO: 186445 - DNA, 20 bp, Homo sapiens
gagtttcctcaggctgctgg

SEQ ID NO: 186446 - DNA, 12 bp, Homo sapiens
gataaagatgat

SEQ ID NO: 186447 - DNA, 13 bp, Homo sapiens
gataaagatgatc

SEQ ID NO: 186448 - DNA, 22 bp, Homo sapiens
gataaatagtttatgattccac

SEQ ID NO: 186449 - DNA, 15 bp, Homo sapiens
gataaccagctgtaa

SEQ ID NO: 186450 - DNA, 21 bp, Homo sapiens
gataactgcaattttaattga

SEQ ID NO: 186451 - DNA, 16 bp, Homo sapiens
gataatcagcctctta

SEQ ID NO: 186452 - DNA, 21 bp, Homo sapiens
gataatcagtgtgtctaaatt

SEQ ID NO: 186453 - DNA, 14 bp, Homo sapiens
gataattataatat

SEQ ID NO: 186454 - DNA, 20 bp, Homo sapiens
gatacactgaagttaacaga

SEQ ID NO: 186455 - DNA, 12 bp, Homo sapiens
gatagagggggg

SEQ ID NO: 186456 - DNA, 19 bp, Homo sapiens
gatagcactgagcaaagca

SEQ ID NO: 186457 - DNA, 13 bp, Homo sapiens
gatagcagggcat

SEQ ID NO: 186458 - DNA, 15 bp, Homo sapiens
gatagtaacaatgaa

SEQ ID NO: 186459 - DNA, 15 bp, Homo sapiens
gatatataagtgtac

SEQ ID NO: 186460 - DNA, 13 bp, Homo sapiens
gatatatatcata

SEQ ID NO: 186461 - DNA, 20 bp, Homo sapiens
gatatatcatgagtgaataa

SEQ ID NO: 186462 - DNA, 21 bp, Homo sapiens
gatatatcatgagtgaataaa

SEQ ID NO: 186463 - DNA, 21 bp, Homo sapiens
gatatattaaaaatataaaac

SEQ ID NO: 186464 - DNA, 22 bp, Homo sapiens
gatatattaaaaatataaaact

SEQ ID NO: 186465 - DNA, 22 bp, Homo sapiens
gatatccctatgctgcctaggc

SEQ ID NO: 186466 - DNA, 19 bp, Homo sapiens
gatatgtaaacataattct

SEQ ID NO: 186467 - DNA, 20 bp, Homo sapiens
gatatgtacctaacgaagta

SEQ ID NO: 186468 - DNA, 19 bp, Homo sapiens
gatatttatggggggagaa

SEQ ID NO: 186469 - DNA, 19 bp, Homo sapiens
gatattttcaacgcagccc

SEQ ID NO: 186470 - DNA, 21 bp, Homo sapiens
gatattttcaacgcagccctg

SEQ ID NO: 186471 - DNA, 21 bp, Homo sapiens
gatattttttcagaaatatgt

SEQ ID NO: 186472 - DNA, 13 bp, Homo sapiens
gatcacagaggct

SEQ ID NO: 186473 - DNA, 24 bp, Homo sapiens
gatccctgtgttgtctctagagca

SEQ ID NO: 186474 - DNA, 18 bp, Homo sapiens
gatcctaggcatttgctg

SEQ ID NO: 186475 - DNA, 23 bp, Homo sapiens
gatcgtgccgttactctccaacc

SEQ ID NO: 186476 - DNA, 21 bp, Homo sapiens
gatctaaggatgtcacagggc

SEQ ID NO: 186477 - DNA, 18 bp, Homo sapiens
gatctccctgccgcctca

SEQ ID NO: 186478 - DNA, 16 bp, Homo sapiens
gatctcttgagcctgg

SEQ ID NO: 186479 - DNA, 18 bp, Homo sapiens
gatctgagaatctttatt

SEQ ID NO: 186480 - DNA, 18 bp, Homo sapiens
gatctggggctctgggat

SEQ ID NO: 186481 - DNA, 15 bp, Homo sapiens
gatctgtatatacaa

SEQ ID NO: 186482 - DNA, 19 bp, Homo sapiens
gatcttctttataattcta

SEQ ID NO: 186483 - DNA, 14 bp, Homo sapiens
gatctttaaaatac

SEQ ID NO: 186484 - DNA, 15 bp, Homo sapiens
gatgaatgccgtgga

SEQ ID NO: 186485 - DNA, 20 bp, Homo sapiens
gatgacaaaaattcaactca

SEQ ID NO: 186486 - DNA, 21 bp, Homo sapiens
gatgagcatttagggcaagga

SEQ ID NO: 186487 - DNA, 16 bp, Homo sapiens
gatgaggtgctgggag

SEQ ID NO: 186488 - DNA, 19 bp, Homo sapiens
gatgaggtgctgggaggga

SEQ ID NO: 186489 - DNA, 14 bp, Homo sapiens
gatgatcctaggca

SEQ ID NO: 186490 - DNA, 21 bp, Homo sapiens
gatgatctactcagaaatttt

SEQ ID NO: 186491 - DNA, 17 bp, Homo sapiens
gatgcagcaaaatgtga

SEQ ID NO: 186492 - DNA, 15 bp, Homo sapiens
gatgcccactgagga

SEQ ID NO: 186493 - DNA, 16 bp, Homo sapiens
gatgcctccaccgctg

SEQ ID NO: 186494 - DNA, 14 bp, Homo sapiens
gatgctccttgggc

SEQ ID NO: 186495 - DNA, 16 bp, Homo sapiens
gatgctccttgggccc

SEQ ID NO: 186496 - DNA, 17 bp, Homo sapiens
gatgctgactgtactcc

SEQ ID NO: 186497 - DNA, 14 bp, Homo sapiens
gatgctggagaaga

SEQ ID NO: 186498 - DNA, 20 bp, Homo sapiens
gatgctggagaagagaggag

SEQ ID NO: 186499 - DNA, 17 bp, Homo sapiens
gatggaaccgcaggaag

SEQ ID NO: 186500 - DNA, 19 bp, Homo sapiens
gatggaaccgcaggaagct

SEQ ID NO: 186501 - DNA, 20 bp, Homo sapiens
gatggaaccgcaggaagctg

SEQ ID NO: 186502 - DNA, 21 bp, Homo sapiens
gcccagacacagaagaggctg

SEQ ID NO: 186503 - DNA, 18 bp, Homo sapiens
gcccagagatgcctccac

SEQ ID NO: 186504 - DNA, 22 bp, Homo sapiens
gcccagagatgggactgggagg

SEQ ID NO: 186505 - DNA, 15 bp, Homo sapiens
gcccagagcaggaag

SEQ ID NO: 186506 - DNA, 18 bp, Homo sapiens
gcccagagcaggaagcat

SEQ ID NO: 186507 - DNA, 21 bp, Homo sapiens
gcccagcactgcttgaggaaa

SEQ ID NO: 186508 - DNA, 19 bp, Homo sapiens
gcccagctatacctgtgcc

SEQ ID NO: 186509 - DNA, 11 bp, Homo sapiens
gcccagctccc

SEQ ID NO: 186510 - DNA, 17 bp, Homo sapiens
gcccagctggtgggaag

SEQ ID NO: 186511 - DNA, 15 bp, Homo sapiens
gcccaggagagagaa

SEQ ID NO: 186512 - DNA, 16 bp, Homo sapiens
gcccaggagagagaaa

SEQ ID NO: 186513 - DNA, 20 bp, Homo sapiens
gcccaggagagagaaagcca

SEQ ID NO: 186514 - DNA, 19 bp, Homo sapiens
gcccaggagagccagccct

SEQ ID NO: 186515 - DNA, 16 bp, Homo sapiens
gcccagggagcggaaa

SEQ ID NO: 186516 - DNA, 21 bp, Homo sapiens
gcccagggagcggaaagcagc

SEQ ID NO: 186517 - DNA, 23 bp, Homo sapiens
gcccagggagcggaaagcagctc

SEQ ID NO: 186518 - DNA, 16 bp, Homo sapiens
gcccagggctcagcct

SEQ ID NO: 186519 - DNA, 23 bp, Homo sapiens
gcccagggtggacttagaaagca

SEQ ID NO: 186520 - DNA, 18 bp, Homo sapiens
gcccatccctgcctggtc

SEQ ID NO: 186521 - DNA, 22 bp, Homo sapiens
gcccatctatgtcccttgctgt

SEQ ID NO: 186522 - DNA, 18 bp, Homo sapiens
gcccatctgggaaaatac

SEQ ID NO: 186523 - DNA, 14 bp, Homo sapiens
gcccatgtgtgagt

SEQ ID NO: 186524 - DNA, 14 bp, Homo sapiens
gcccattctctctc

SEQ ID NO: 186525 - DNA, 17 bp, Homo sapiens
gcccattctctctcctg

SEQ ID NO: 186526 - DNA, 11 bp, Homo sapiens
gccccaaaagg

SEQ ID NO: 186527 - DNA, 18 bp, Homo sapiens
gccccaaacaaatatgca

SEQ ID NO: 186528 - DNA, 19 bp, Homo sapiens
gccccaaacaaatatgcaa

SEQ ID NO: 186529 - DNA, 14 bp, Homo sapiens
gccccaactcctgg

SEQ ID NO: 186530 - DNA, 17 bp, Homo sapiens
gccccaactcctggaag

SEQ ID NO: 186531 - DNA, 22 bp, Homo sapiens
gccccaactcctggaagctgtg

SEQ ID NO: 186532 - DNA, 11 bp, Homo sapiens
gccccaccacc

SEQ ID NO: 186533 - DNA, 14 bp, Homo sapiens
gccccaccacctag

SEQ ID NO: 186534 - DNA, 14 bp, Homo sapiens
gccccagtgccaag

SEQ ID NO: 186535 - DNA, 12 bp, Homo sapiens
gccccattcctg

SEQ ID NO: 186536 - DNA, 15 bp, Homo sapiens
gcccccaaataagaa

SEQ ID NO: 186537 - DNA, 14 bp, Homo sapiens
gcccccaagcctgc

SEQ ID NO: 186538 - DNA, 16 bp, Homo sapiens
gcccccaggctgctgg

SEQ ID NO: 186539 - DNA, 16 bp, Homo sapiens
gcccccaggtgccagt

SEQ ID NO: 186540 - DNA, 18 bp, Homo sapiens
gccccgcagacctcccca

SEQ ID NO: 186541 - DNA, 14 bp, Homo sapiens
gccccgcttgtcca

SEQ ID NO: 186542 - DNA, 14 bp, Homo sapiens
gccccggccacctc

SEQ ID NO: 186543 - DNA, 15 bp, Homo sapiens
gccccggccacctct

SEQ ID NO: 186544 - DNA, 19 bp, Homo sapiens
gccccgtgcagactggagg

SEQ ID NO: 186545 - DNA, 20 bp, Homo sapiens
gccccgtgcagactggaggg

SEQ ID NO: 186546 - DNA, 15 bp, Homo sapiens
gcccctagcccagga

SEQ ID NO: 186547 - DNA, 18 bp, Homo sapiens
gcccctagcccaggagag

SEQ ID NO: 186548 - DNA, 12 bp, Homo sapiens
gcccctcctctg

SEQ ID NO: 186549 - DNA, 19 bp, Homo sapiens
gcccctgcactccagcctg

SEQ ID NO: 186550 - DNA, 19 bp, Homo sapiens
gcccctggacaagcagagg

SEQ ID NO: 186551 - DNA, 18 bp, Homo sapiens
gcccctgtggagactggg

SEQ ID NO: 186552 - DNA, 17 bp, Homo sapiens
gccccttccccctccaa

SEQ ID NO: 186553 - DNA, 18 bp, Homo sapiens
gccccttctcagaatcta

SEQ ID NO: 186554 - DNA, 20 bp, Homo sapiens
gccccttgctctcccctgcc

SEQ ID NO: 186555 - DNA, 12 bp, Homo sapiens
gcccgacagcct

SEQ ID NO: 186556 - DNA, 14 bp, Homo sapiens
gcccgacagcctgg

SEQ ID NO: 186557 - DNA, 16 bp, Homo sapiens
gcccgacagcctggca

SEQ ID NO: 186558 - DNA, 21 bp, Homo sapiens
gcccggcgcggtggctcacgc

SEQ ID NO: 186559 - DNA, 17 bp, Homo sapiens
gcccgtcttcagcctag

SEQ ID NO: 186560 - DNA, 13 bp, Homo sapiens
gccctagagcaca

SEQ ID NO: 186561 - DNA, 13 bp, Homo sapiens
gccctagctccac

SEQ ID NO: 186562 - DNA, 18 bp, Homo sapiens
gccctcagaacccttggc

SEQ ID NO: 186563 - DNA, 22 bp, Homo sapiens
gccctcaggtcagggtgaggat

SEQ ID NO: 186564 - DNA, 21 bp, Homo sapiens
gccctcccctcccctgctgca

SEQ ID NO: 186565 - DNA, 16 bp, Homo sapiens
gccctccctgtcctcc

SEQ ID NO: 186566 - DNA, 18 bp, Homo sapiens
gccctccctgtcctcctc

SEQ ID NO: 186567 - DNA, 15 bp, Homo sapiens
gccctcgctgccagc

SEQ ID NO: 186568 - DNA, 18 bp, Homo sapiens
gccctcgggcgagtcact

SEQ ID NO: 186569 - DNA, 14 bp, Homo sapiens
gccctgcaaaagga

SEQ ID NO: 186570 - DNA, 16 bp, Homo sapiens
gccctgcacctgtgca

SEQ ID NO: 186571 - DNA, 17 bp, Homo sapiens
gccctgcacctgtgcag

SEQ ID NO: 186572 - DNA, 22 bp, Homo sapiens
gccctgctgccgcctcccagcc

SEQ ID NO: 186573 - DNA, 18 bp, Homo sapiens
gccctgctttgggctgcc

SEQ ID NO: 186574 - DNA, 19 bp, Homo sapiens
gccctgctttgggctgccc

SEQ ID NO: 186575 - DNA, 22 bp, Homo sapiens
gccctgctttgggctgccctgg

SEQ ID NO: 186576 - DNA, 13 bp, Homo sapiens
gccctggccagag

SEQ ID NO: 186577 - DNA, 14 bp, Homo sapiens
gccctggccagagg

SEQ ID NO: 186578 - DNA, 12 bp, Homo sapiens
gccctggcctgc

SEQ ID NO: 186579 - DNA, 13 bp, Homo sapiens
gccctggcctgct

SEQ ID NO: 186580 - DNA, 16 bp, Homo sapiens
gccctggcctgctggg

SEQ ID NO: 186581 - DNA, 17 bp, Homo sapiens
gccctgggccacactga

SEQ ID NO: 186582 - DNA, 15 bp, Homo sapiens
gccctgggccccacc

SEQ ID NO: 186583 - DNA, 22 bp, Homo sapiens
gccctgggccccaccacctagg

SEQ ID NO: 186584 - DNA, 15 bp, Homo sapiens
gccctggtgctgcca

SEQ ID NO: 186585 - DNA, 15 bp, Homo sapiens
gccctgtccctccca

SEQ ID NO: 186586 - DNA, 16 bp, Homo sapiens
gccctgtccctcccac

SEQ ID NO: 186587 - DNA, 18 bp, Homo sapiens
gccctgtccctcccacct

SEQ ID NO: 186588 - DNA, 21 bp, Homo sapiens
gccctgtggatgagccctcag

SEQ ID NO: 186589 - DNA, 14 bp, Homo sapiens
gccctgttaaaaga

SEQ ID NO: 186590 - DNA, 15 bp, Homo sapiens
gcccttatctgtgct

SEQ ID NO: 186591 - DNA, 19 bp, Homo sapiens
gcccttatctgtgctcagg

SEQ ID NO: 186592 - DNA, 16 bp, Homo sapiens
gcccttggaggccagc

SEQ ID NO: 186593 - DNA, 12 bp, Homo sapiens
gccctttctgtg

SEQ ID NO: 186594 - DNA, 19 bp, Homo sapiens
gccgaagaagggtccttcc

SEQ ID NO: 186595 - DNA, 22 bp, Homo sapiens
gccgaagaagggtccttccctc

SEQ ID NO: 186596 - DNA, 12 bp, Homo sapiens
gccgacctcagc

SEQ ID NO: 186597 - DNA, 13 bp, Homo sapiens
gccgacctcgtcc

SEQ ID NO: 186598 - DNA, 19 bp, Homo sapiens
gccgacctcgtcctccccc

SEQ ID NO: 186599 - DNA, 20 bp, Homo sapiens
gccgacctcgtcctccccct

SEQ ID NO: 186600 - DNA, 21 bp, Homo sapiens
gccgacctcgtcctccccctg

SEQ ID NO: 186601 - DNA, 12 bp, Homo sapiens
gctaactggaag

SEQ ID NO: 186602 - DNA, 13 bp, Homo sapiens
gctaactggaagc

SEQ ID NO: 186603 - DNA, 18 bp, Homo sapiens
gctaacttggagccccag

SEQ ID NO: 186604 - DNA, 22 bp, Homo sapiens
gctaatcagcattctcactcct

SEQ ID NO: 186605 - DNA, 21 bp, Homo sapiens
gctaatgaagggaaaggatat

SEQ ID NO: 186606 - DNA, 19 bp, Homo sapiens
gctacaaaaacacagcaag

SEQ ID NO: 186607 - DNA, 15 bp, Homo sapiens
gctacaacttcagca

SEQ ID NO: 186608 - DNA, 17 bp, Homo sapiens
gctacacccttttccag

SEQ ID NO: 186609 - DNA, 20 bp, Homo sapiens
gctaccctgagctgaggcag

SEQ ID NO: 186610 - DNA, 17 bp, Homo sapiens
gctactcagcagccctc

SEQ ID NO: 186611 - DNA, 21 bp, Homo sapiens
gctactcagcagccctcctca

SEQ ID NO: 186612 - DNA, 15 bp, Homo sapiens
gctactcaggaggct

SEQ ID NO: 186613 - DNA, 16 bp, Homo sapiens
gctactgatttttgtg

SEQ ID NO: 186614 - DNA, 17 bp, Homo sapiens
gctactgatttttgtga

SEQ ID NO: 186615 - DNA, 18 bp, Homo sapiens
gctagaaatatgatttta

SEQ ID NO: 186616 - DNA, 20 bp, Homo sapiens
gctagagatatggcagcgaa

SEQ ID NO: 186617 - DNA, 20 bp, Homo sapiens
gctagcgctgccgcacccca

SEQ ID NO: 186618 - DNA, 16 bp, Homo sapiens
gctagtatcaaaagaa

SEQ ID NO: 186619 - DNA, 14 bp, Homo sapiens
gctagtcagagaga

SEQ ID NO: 186620 - DNA, 13 bp, Homo sapiens
gctataaatatat

SEQ ID NO: 186621 - DNA, 17 bp, Homo sapiens
gctatacctgtgcctcg

SEQ ID NO: 186622 - DNA, 20 bp, Homo sapiens
gctatcctgccaaaatcatt

SEQ ID NO: 186623 - DNA, 15 bp, Homo sapiens
gctattactgtctgg

SEQ ID NO: 186624 - DNA, 17 bp, Homo sapiens
gctatttccattccaga

SEQ ID NO: 186625 - DNA, 20 bp, Homo sapiens
gctcaaaatttgaagaatga

SEQ ID NO: 186626 - DNA, 20 bp, Homo sapiens
gctcaaggaaaggcctgaaa

SEQ ID NO: 186627 - DNA, 14 bp, Homo sapiens
gctcacacatgaga

SEQ ID NO: 186628 - DNA, 13 bp, Homo sapiens
gctcacagttcct

SEQ ID NO: 186629 - DNA, 19 bp, Homo sapiens
gctcacagttcctcgccct

SEQ ID NO: 186630 - DNA, 21 bp, Homo sapiens
gctcacagttcctcgccctgg

SEQ ID NO: 186631 - DNA, 16 bp, Homo sapiens
gctcacccccttctcc

SEQ ID NO: 186632 - DNA, 18 bp, Homo sapiens
gctcacccccttctccat

SEQ ID NO: 186633 - DNA, 22 bp, Homo sapiens
gctcacgcctgtaatcccagca

SEQ ID NO: 186634 - DNA, 15 bp, Homo sapiens
gctcacgtcacactt

SEQ ID NO: 186635 - DNA, 16 bp, Homo sapiens
gctcactcggcaccct

SEQ ID NO: 186636 - DNA, 23 bp, Homo sapiens
gctcagacccccactctcattcc

SEQ ID NO: 186637 - DNA, 15 bp, Homo sapiens
gctcagccctccctg

SEQ ID NO: 186638 - DNA, 13 bp, Homo sapiens
gctcaggagtttg

SEQ ID NO: 186639 - DNA, 18 bp, Homo sapiens
gctcaggggcgtgtggct

SEQ ID NO: 186640 - DNA, 20 bp, Homo sapiens
gctcatattcctgcagcctg

SEQ ID NO: 186641 - DNA, 22 bp, Homo sapiens
gctcatattcctgcagcctgga

SEQ ID NO: 186642 - DNA, 18 bp, Homo sapiens
gctcatattttgtatata

SEQ ID NO: 186643 - DNA, 16 bp, Homo sapiens
gctccacaccctctcc

SEQ ID NO: 186644 - DNA, 19 bp, Homo sapiens
gctccacaccctctcccag

SEQ ID NO: 186645 - DNA, 21 bp, Homo sapiens
gctccacaccctctcccagga

SEQ ID NO: 186646 - DNA, 20 bp, Homo sapiens
gctccagagggcactctgct

SEQ ID NO: 186647 - DNA, 21 bp, Homo sapiens
gctccagctgttcagctggtt

SEQ ID NO: 186648 - DNA, 14 bp, Homo sapiens
gctccatctccact

SEQ ID NO: 186649 - DNA, 21 bp, Homo sapiens
gctcccacaggcccttcctct

SEQ ID NO: 186650 - DNA, 16 bp, Homo sapiens
gctccccagccctggc

SEQ ID NO: 186651 - DNA, 18 bp, Homo sapiens
gctccccagccctggctc

SEQ ID NO: 186652 - DNA, 19 bp, Homo sapiens
gctccccagccctggctct

SEQ ID NO: 186653 - DNA, 21 bp, Homo sapiens
gctccccagccctggctctgc

SEQ ID NO: 186654 - DNA, 20 bp, Homo sapiens
gctcccccaccccctcccca

SEQ ID NO: 186655 - DNA, 15 bp, Homo sapiens
gctcccctcggagaa

SEQ ID NO: 186656 - DNA, 18 bp, Homo sapiens
gctcccctcggagaagag

SEQ ID NO: 186657 - DNA, 15 bp, Homo sapiens
gctccctgaagccag

SEQ ID NO: 186658 - DNA, 22 bp, Homo sapiens
gctcctccagggccacgtgcca

SEQ ID NO: 186659 - DNA, 16 bp, Homo sapiens
gctcctcccggtgccc

SEQ ID NO: 186660 - DNA, 16 bp, Homo sapiens
gctcctgtctgccagc

SEQ ID NO: 186661 - DNA, 21 bp, Homo sapiens
gctcctgtctgccagccagca

SEQ ID NO: 186662 - DNA, 14 bp, Homo sapiens
gctccttcctggag

SEQ ID NO: 186663 - DNA, 22 bp, Homo sapiens
gctccttgggaggccccactgg

SEQ ID NO: 186664 - DNA, 11 bp, Homo sapiens
gctccttgggc

SEQ ID NO: 186665 - DNA, 20 bp, Homo sapiens
gctcgagcagtcctgcctca

SEQ ID NO: 186666 - DNA, 14 bp, Homo sapiens
gctcgattttgtat

SEQ ID NO: 186667 - DNA, 15 bp, Homo sapiens
gctctacccagggcc

SEQ ID NO: 186668 - DNA, 18 bp, Homo sapiens
gctctacccagggcctgc

SEQ ID NO: 186669 - DNA, 13 bp, Homo sapiens
gctctccacctca

SEQ ID NO: 186670 - DNA, 15 bp, Homo sapiens
gctctccacctcagc

SEQ ID NO: 186671 - DNA, 16 bp, Homo sapiens
gctctccacctcagcc

SEQ ID NO: 186672 - DNA, 19 bp, Homo sapiens
gctctcccctgccctgctg

SEQ ID NO: 186673 - DNA, 15 bp, Homo sapiens
gctctccctctggcc

SEQ ID NO: 186674 - DNA, 17 bp, Homo sapiens
gctctccctctggccct

SEQ ID NO: 186675 - DNA, 19 bp, Homo sapiens
gctctccctctggccctgc

SEQ ID NO: 186676 - DNA, 20 bp, Homo sapiens
gctctccctctggccctgcc

SEQ ID NO: 186677 - DNA, 19 bp, Homo sapiens
gctctcctcttgccactgc

SEQ ID NO: 186678 - DNA, 22 bp, Homo sapiens
gctctcctcttgccactgcctc

SEQ ID NO: 186679 - DNA, 18 bp, Homo sapiens
gctctctgcagccagccc

SEQ ID NO: 186680 - DNA, 19 bp, Homo sapiens
gctctctgcagccagccca

SEQ ID NO: 186681 - DNA, 22 bp, Homo sapiens
gctctctgcagccagcccagcc

SEQ ID NO: 186682 - DNA, 20 bp, Homo sapiens
gctctgagcaaatgtggctc

SEQ ID NO: 186683 - DNA, 15 bp, Homo sapiens
gctctgcccatcctg

SEQ ID NO: 186684 - DNA, 13 bp, Homo sapiens
gctctgccctgcc

SEQ ID NO: 186685 - DNA, 17 bp, Homo sapiens
gctctgcgtgtcacctg

SEQ ID NO: 186686 - DNA, 15 bp, Homo sapiens
gctctggaagagagg

SEQ ID NO: 186687 - DNA, 14 bp, Homo sapiens
gctctggagacagc

SEQ ID NO: 186688 - DNA, 18 bp, Homo sapiens
gctctggagacagcccca

SEQ ID NO: 186689 - DNA, 19 bp, Homo sapiens
gctctggagacagccccag

SEQ ID NO: 186690 - DNA, 14 bp, Homo sapiens
gctctggagagaaa

SEQ ID NO: 186691 - DNA, 20 bp, Homo sapiens
gctctggtgacaccagcctt

SEQ ID NO: 186692 - DNA, 18 bp, Homo sapiens
gctctgtatcaggaccca

SEQ ID NO: 186693 - DNA, 19 bp, Homo sapiens
gctctgtatcaggacccag

SEQ ID NO: 186694 - DNA, 17 bp, Homo sapiens
gctcttagcagcttcca

SEQ ID NO: 186695 - DNA, 13 bp, Homo sapiens
gctcttctccttt

SEQ ID NO: 186696 - DNA, 21 bp, Homo sapiens
gctcttctcctttcacaacct

SEQ ID NO: 186697 - DNA, 22 bp, Homo sapiens
gctcttgtgctggatggagccc

SEQ ID NO: 186698 - DNA, 16 bp, Homo sapiens
gctctttctctgccag

SEQ ID NO: 186699 - DNA, 21 bp, Homo sapiens
gctctttctctgccagtgaca

SEQ ID NO: 186700 - DNA, 17 bp, Homo sapiens
gctgaaacaggagagaa

SEQ ID NO: 186701 - DNA, 18 bp, Homo sapiens
gctgaaacaggagagaaa

SEQ ID NO: 186702 - DNA, 22 bp, Homo sapiens
gctgaatacagaggcaactgca

SEQ ID NO: 186703 - DNA, 17 bp, Homo sapiens
gctgacccagtccctgg

SEQ ID NO: 186704 - DNA, 19 bp, Homo sapiens
gctgacccagtccctgggg

SEQ ID NO: 186705 - DNA, 14 bp, Homo sapiens
gctgacctccacag

SEQ ID NO: 186706 - DNA, 17 bp, Homo sapiens
gctgacctccacagctt

SEQ ID NO: 186707 - DNA, 18 bp, Homo sapiens
gctgactttgctctttct

SEQ ID NO: 186708 - DNA, 14 bp, Homo sapiens
gctgagagaacctc

SEQ ID NO: 186709 - DNA, 17 bp, Homo sapiens
gctgagagacccaagga

SEQ ID NO: 186710 - DNA, 17 bp, Homo sapiens
gctgaggaaaggccagc

SEQ ID NO: 186711 - DNA, 13 bp, Homo sapiens
gctgaggcagcag

SEQ ID NO: 186712 - DNA, 14 bp, Homo sapiens
gctgaggtgggagg

SEQ ID NO: 186713 - DNA, 15 bp, Homo sapiens
gctgaggtgggagga

SEQ ID NO: 186714 - DNA, 23 bp, Homo sapiens
gctgagtgggggatcacagcctc

SEQ ID NO: 186715 - DNA, 17 bp, Homo sapiens
gctgcaaaagtgagggc

SEQ ID NO: 186716 - DNA, 11 bp, Homo sapiens
gctgcaggggc

SEQ ID NO: 186717 - DNA, 21 bp, Homo sapiens
gctgcaggggctctggagaga

SEQ ID NO: 186718 - DNA, 22 bp, Homo sapiens
gctgcaggggctctggagagaa

SEQ ID NO: 186719 - DNA, 18 bp, Homo sapiens
gctgcagtatgaaaataa

SEQ ID NO: 186720 - DNA, 17 bp, Homo sapiens
gctgccacacttcaggc

SEQ ID NO: 186721 - DNA, 21 bp, Homo sapiens
gctgccacacttcaggctctt

SEQ ID NO: 186722 - DNA, 17 bp, Homo sapiens
gctgccagctctgtatc

SEQ ID NO: 186723 - DNA, 17 bp, Homo sapiens
gctgcccacacacccca

SEQ ID NO: 186724 - DNA, 18 bp, Homo sapiens
gctgccccatcagtgctc

SEQ ID NO: 186725 - DNA, 16 bp, Homo sapiens
gctgcccgtcttcagc

SEQ ID NO: 186726 - DNA, 15 bp, Homo sapiens
gctgccctaggctcc

SEQ ID NO: 186727 - DNA, 16 bp, Homo sapiens
gctgccctaggctccg

SEQ ID NO: 186728 - DNA, 18 bp, Homo sapiens
gctgccctggtgctgcca

SEQ ID NO: 186729 - DNA, 20 bp, Homo sapiens
gctgccctggtgctgccaca

SEQ ID NO: 186730 - DNA, 20 bp, Homo sapiens
gctgccgcctcccagcctgg

SEQ ID NO: 186731 - DNA, 18 bp, Homo sapiens
gctgcctaagtggctgct

SEQ ID NO: 186732 - DNA, 18 bp, Homo sapiens
gctgcctctcggtggcca

SEQ ID NO: 186733 - DNA, 13 bp, Homo sapiens
gctgcctgcccac

SEQ ID NO: 186734 - DNA, 15 bp, Homo sapiens
gctgcctgcccacac

SEQ ID NO: 186735 - DNA, 17 bp, Homo sapiens
gctgcctgcccacacag

SEQ ID NO: 186736 - DNA, 22 bp, Homo sapiens
gctgcctgcccgtaaacacgcc

SEQ ID NO: 186737 - DNA, 13 bp, Homo sapiens
gctgcctgtagtt

SEQ ID NO: 186738 - DNA, 16 bp, Homo sapiens
gctgcctgtagttagg

SEQ ID NO: 186739 - DNA, 14 bp, Homo sapiens
gctgcggcaccctt

SEQ ID NO: 186740 - DNA, 12 bp, Homo sapiens
gctgctcccctc

SEQ ID NO: 186741 - DNA, 11 bp, Homo sapiens
gctgctcctcc

SEQ ID NO: 186742 - DNA, 15 bp, Homo sapiens
gctgctcctccaggg

SEQ ID NO: 186743 - DNA, 21 bp, Homo sapiens
gctgctgcgtggcatagccca

SEQ ID NO: 186744 - DNA, 20 bp, Homo sapiens
gctgctgctaatcttcaggg

SEQ ID NO: 186745 - DNA, 14 bp, Homo sapiens
gctgctggaggaaa

SEQ ID NO: 186746 - DNA, 22 bp, Homo sapiens
gctgctggaggaaaactgagac

SEQ ID NO: 186747 - DNA, 22 bp, Homo sapiens
gctgcttttccctaagccaagg

SEQ ID NO: 186748 - DNA, 16 bp, Homo sapiens
gctgtgagcccctggt

SEQ ID NO: 186749 - DNA, 14 bp, Homo sapiens
gctgtgagccttgg

SEQ ID NO: 186750 - DNA, 17 bp, Homo sapiens
gctgtgagccttggctg

SEQ ID NO: 186751 - DNA, 16 bp, Homo sapiens
gctgtgaggcccctgg

SEQ ID NO: 186752 - DNA, 15 bp, Homo sapiens
gctgtgcctctgcct

SEQ ID NO: 186753 - DNA, 14 bp, Homo sapiens
gctgtgggcaggtg

SEQ ID NO: 186754 - DNA, 14 bp, Homo sapiens
gctgtgtatctgat

SEQ ID NO: 186755 - DNA, 23 bp, Homo sapiens
gctgtgtccttgcacctgcatcc

SEQ ID NO: 186756 - DNA, 16 bp, Homo sapiens
gctgtgtctaaactgc

SEQ ID NO: 186757 - DNA, 14 bp, Homo sapiens
gctgttcagctggt

SEQ ID NO: 186758 - DNA, 12 bp, Homo sapiens
gctgttgagctg

SEQ ID NO: 186759 - DNA, 15 bp, Homo sapiens
gctgttgcctcatct

SEQ ID NO: 186760 - DNA, 16 bp, Homo sapiens
gctgttggcagtgagt

SEQ ID NO: 186761 - DNA, 22 bp, Homo sapiens
gctgttggcagtgagtgagcct

SEQ ID NO: 186762 - DNA, 13 bp, Homo sapiens
gctgtttccatag

SEQ ID NO: 186763 - DNA, 19 bp, Homo sapiens
gcttacaattccctgctgt

SEQ ID NO: 186764 - DNA, 18 bp, Homo sapiens
gcttacatttttacaata

SEQ ID NO: 186765 - DNA, 21 bp, Homo sapiens
gcttactacatgtgggagctt

SEQ ID NO: 186766 - DNA, 16 bp, Homo sapiens
gcttagacctcagcct

SEQ ID NO: 186767 - DNA, 17 bp, Homo sapiens
gcttagacctcagcctg

SEQ ID NO: 186768 - DNA, 18 bp, Homo sapiens
gcttagacctcagcctgt

SEQ ID NO: 186769 - DNA, 13 bp, Homo sapiens
gcttatctcaggg

SEQ ID NO: 186770 - DNA, 20 bp, Homo sapiens
gcttcacggaagagccttgc

SEQ ID NO: 186771 - DNA, 17 bp, Homo sapiens
gcttcatggcagaaggc

SEQ ID NO: 186772 - DNA, 20 bp, Homo sapiens
gcttccatttgtgtgtgtgc

SEQ ID NO: 186773 - DNA, 16 bp, Homo sapiens
gcttcccccatagcca

SEQ ID NO: 186774 - DNA, 18 bp, Homo sapiens
gcttcccctctctcctcc

SEQ ID NO: 186775 - DNA, 15 bp, Homo sapiens
gcttcccgctcagcc

SEQ ID NO: 186776 - DNA, 19 bp, Homo sapiens
gcttcgaggcccagcgacc

SEQ ID NO: 186777 - DNA, 17 bp, Homo sapiens
gcttctcactgccatgc

SEQ ID NO: 186778 - DNA, 14 bp, Homo sapiens
gcttctcctgaccc

SEQ ID NO: 186779 - DNA, 14 bp, Homo sapiens
gcttcttaaatgag

SEQ ID NO: 186780 - DNA, 21 bp, Homo sapiens
gcttcttaatataactgcctt

SEQ ID NO: 186781 - DNA, 19 bp, Homo sapiens
gcttcttccaggtgcccag

SEQ ID NO: 186782 - DNA, 20 bp, Homo sapiens
gcttcttctcctatgtgtaa

SEQ ID NO: 186783 - DNA, 13 bp, Homo sapiens
gcttgaaagaaaa

SEQ ID NO: 186784 - DNA, 14 bp, Homo sapiens
gcttgagctcagga

SEQ ID NO: 186785 - DNA, 16 bp, Homo sapiens
gcttggagcagagggg

SEQ ID NO: 186786 - DNA, 14 bp, Homo sapiens
gcttgggacaaatc

SEQ ID NO: 186787 - DNA, 19 bp, Homo sapiens
gcttgggtgtaacaggtct

SEQ ID NO: 186788 - DNA, 16 bp, Homo sapiens
gcttgtcccctcctca

SEQ ID NO: 186789 - DNA, 22 bp, Homo sapiens
gcttgtcccctcctcactccct

SEQ ID NO: 186790 - DNA, 18 bp, Homo sapiens
gcttgttccctctccctg

SEQ ID NO: 186791 - DNA, 21 bp, Homo sapiens
gcttgtttgctcacctggggt

SEQ ID NO: 186792 - DNA, 16 bp, Homo sapiens
gctttaaacacccttc

SEQ ID NO: 186793 - DNA, 16 bp, Homo sapiens
gctttaaactcaggga

SEQ ID NO: 186794 - DNA, 12 bp, Homo sapiens
gctttacatgca

SEQ ID NO: 186795 - DNA, 12 bp, Homo sapiens
gctttcatgtaa

SEQ ID NO: 186796 - DNA, 14 bp, Homo sapiens
gctttcctgcccca

SEQ ID NO: 186797 - DNA, 15 bp, Homo sapiens
gctttgtaggtgtct

SEQ ID NO: 186798 - DNA, 21 bp, Homo sapiens
gctttgtttgttgtcagctga

SEQ ID NO: 186799 - DNA, 14 bp, Homo sapiens
gctttgttttgcac

SEQ ID NO: 186800 - DNA, 23 bp, Homo sapiens
gcttttcactgctggctgcctta

SEQ ID NO: 186801 - DNA, 19 bp, Homo sapiens
gcttttccctaagccaagg

SEQ ID NO: 186802 - DNA, 21 bp, Homo sapiens
gcttttccttggggcaggcag

SEQ ID NO: 186803 - DNA, 22 bp, Homo sapiens
gcttttccttggggcaggcagt

SEQ ID NO: 186804 - DNA, 21 bp, Homo sapiens
gcttttgctggtcactgccat

SEQ ID NO: 186805 - DNA, 15 bp, Homo sapiens
gctttttaatattga

SEQ ID NO: 186806 - DNA, 21 bp, Homo sapiens
ggaaaaacatctgaaagccac

SEQ ID NO: 186807 - DNA, 21 bp, Homo sapiens
ggaaaaccaagccgtggcttc

SEQ ID NO: 186808 - DNA, 16 bp, Homo sapiens
ggaaaactgacagagg

SEQ ID NO: 186809 - DNA, 18 bp, Homo sapiens
ggaaaagaatacagaaag

SEQ ID NO: 186810 - DNA, 15 bp, Homo sapiens
ggaaaagtacattta

SEQ ID NO: 186811 - DNA, 14 bp, Homo sapiens
ggaaaataaattat

SEQ ID NO: 186812 - DNA, 16 bp, Homo sapiens
ggaaaggatattttct

SEQ ID NO: 186813 - DNA, 19 bp, Homo sapiens
ggaaataaaacctttcaaa

SEQ ID NO: 186814 - DNA, 22 bp, Homo sapiens
ggaaataaaacctttcaaattt

SEQ ID NO: 186815 - DNA, 17 bp, Homo sapiens
ggaaatgtcaacaagta

SEQ ID NO: 186816 - DNA, 15 bp, Homo sapiens
ggaacagacaggaga

SEQ ID NO: 186817 - DNA, 22 bp, Homo sapiens
ggaactagagggatacactgaa

SEQ ID NO: 186818 - DNA, 14 bp, Homo sapiens
ggaagacaatgtga

SEQ ID NO: 186819 - DNA, 16 bp, Homo sapiens
ggaagacaatgtgaaa

SEQ ID NO: 186820 - DNA, 22 bp, Homo sapiens
ggaagacatggggaggaaggac

SEQ ID NO: 186821 - DNA, 16 bp, Homo sapiens
ggaagccctccttcca

SEQ ID NO: 186822 - DNA, 17 bp, Homo sapiens
ggaagccctccttccac

SEQ ID NO: 186823 - DNA, 23 bp, Homo sapiens
ggaagccctggatttcagaaaga

SEQ ID NO: 186824 - DNA, 17 bp, Homo sapiens
ggaagctgtgtccttgc

SEQ ID NO: 186825 - DNA, 21 bp, Homo sapiens
ggaagctgtgtccttgcacct

SEQ ID NO: 186826 - DNA, 19 bp, Homo sapiens
ggaagcttcttaaatgaga

SEQ ID NO: 186827 - DNA, 22 bp, Homo sapiens
ggaaggagactcacctctgcct

SEQ ID NO: 186828 - DNA, 15 bp, Homo sapiens
ggaaggggccagagg

SEQ ID NO: 186829 - DNA, 21 bp, Homo sapiens
ggaaggggcccgtgggagtca

SEQ ID NO: 186830 - DNA, 21 bp, Homo sapiens
ggaagtccccaggccccagga

SEQ ID NO: 186831 - DNA, 23 bp, Homo sapiens
ggaagtccccaggccccaggaag

SEQ ID NO: 186832 - DNA, 13 bp, Homo sapiens
ggaataataccta

SEQ ID NO: 186833 - DNA, 21 bp, Homo sapiens
ggaatcagacttcacactgca

SEQ ID NO: 186834 - DNA, 14 bp, Homo sapiens
ggaatcagcttcta

SEQ ID NO: 186835 - DNA, 15 bp, Homo sapiens
ggaatcatgtcaggc

SEQ ID NO: 186836 - DNA, 21 bp, Homo sapiens
ggaatcatgtcaggcctgtgt

SEQ ID NO: 186837 - DNA, 19 bp, Homo sapiens
ggaatcctgtcctcagctt

SEQ ID NO: 186838 - DNA, 23 bp, Homo sapiens
ggaatgcggccgcattccctgag

SEQ ID NO: 186839 - DNA, 23 bp, Homo sapiens
ggaatttctcccagtcatttaat

SEQ ID NO: 186840 - DNA, 15 bp, Homo sapiens
ggacaacgaggaagc

SEQ ID NO: 186841 - DNA, 16 bp, Homo sapiens
ggacaacgaggaagcc

SEQ ID NO: 186842 - DNA, 17 bp, Homo sapiens
ggacactcaaaagctgg

SEQ ID NO: 186843 - DNA, 18 bp, Homo sapiens
ggacagagacacctgcac

SEQ ID NO: 186844 - DNA, 21 bp, Homo sapiens
ggacagagacacctgcacctc

SEQ ID NO: 186845 - DNA, 21 bp, Homo sapiens
ggacagcctgtggcggtgcct

SEQ ID NO: 186846 - DNA, 23 bp, Homo sapiens
ggacagcctgtggcggtgcctgg

SEQ ID NO: 186847 - DNA, 20 bp, Homo sapiens
ggacaggatgacctggataa

SEQ ID NO: 186848 - DNA, 22 bp, Homo sapiens
ggacaggcccggcgcggtggct

SEQ ID NO: 186849 - DNA, 14 bp, Homo sapiens
ggacatattcattt

SEQ ID NO: 186850 - DNA, 19 bp, Homo sapiens
ggaccagtcaacctgggca

SEQ ID NO: 186851 - DNA, 16 bp, Homo sapiens
ggacccaatgcacaca

SEQ ID NO: 186852 - DNA, 19 bp, Homo sapiens
ggacccatcacgcctgtgc

SEQ ID NO: 186853 - DNA, 11 bp, Homo sapiens
ggaccccagct

SEQ ID NO: 186854 - DNA, 17 bp, Homo sapiens
ggaccctttccttcctt

SEQ ID NO: 186855 - DNA, 22 bp, Homo sapiens
ggacgtcctgccacctggggca

SEQ ID NO: 186856 - DNA, 18 bp, Homo sapiens
ggactcagaagcctctgg

SEQ ID NO: 186857 - DNA, 18 bp, Homo sapiens
ggactcaggatgcccagg

SEQ ID NO: 186858 - DNA, 13 bp, Homo sapiens
gccgagaagcaag

SEQ ID NO: 186859 - DNA, 14 bp, Homo sapiens
gccgagaagcaaga

SEQ ID NO: 186860 - DNA, 15 bp, Homo sapiens
gccgagagcctgctc

SEQ ID NO: 186861 - DNA, 19 bp, Homo sapiens
gccgagagcctgctccccc

SEQ ID NO: 186862 - DNA, 17 bp, Homo sapiens
gccgagattgcaccact

SEQ ID NO: 186863 - DNA, 13 bp, Homo sapiens
gccgcaccccaga

SEQ ID NO: 186864 - DNA, 15 bp, Homo sapiens
gccgcaccccagagt

SEQ ID NO: 186865 - DNA, 15 bp, Homo sapiens
gccgcctcccagcct

SEQ ID NO: 186866 - DNA, 16 bp, Homo sapiens
gccgcctcccagcctg

SEQ ID NO: 186867 - DNA, 19 bp, Homo sapiens
gccgctcctgtctgccagc

SEQ ID NO: 186868 - DNA, 22 bp, Homo sapiens
gccgctcctgtctgccagccag

SEQ ID NO: 186869 - DNA, 23 bp, Homo sapiens
gccgctcctgtctgccagccagc

SEQ ID NO: 186870 - DNA, 17 bp, Homo sapiens
gccgctgagcgaggaga

SEQ ID NO: 186871 - DNA, 13 bp, Homo sapiens
gccggcacagggt

SEQ ID NO: 186872 - DNA, 12 bp, Homo sapiens
gccggccctggg

SEQ ID NO: 186873 - DNA, 13 bp, Homo sapiens
gccggccctgggg

SEQ ID NO: 186874 - DNA, 21 bp, Homo sapiens
gccgggcgcggtggctcacgc

SEQ ID NO: 186875 - DNA, 20 bp, Homo sapiens
gccgggcgtggtggtgagtg

SEQ ID NO: 186876 - DNA, 17 bp, Homo sapiens
gccgtgccttcagctct

SEQ ID NO: 186877 - DNA, 14 bp, Homo sapiens
gccgtggctgcggc

SEQ ID NO: 186878 - DNA, 15 bp, Homo sapiens
gccgtggcttcccgc

SEQ ID NO: 186879 - DNA, 19 bp, Homo sapiens
gccgtggcttcccgctcag

SEQ ID NO: 186880 - DNA, 16 bp, Homo sapiens
gcctaagtggctgctg

SEQ ID NO: 186881 - DNA, 22 bp, Homo sapiens
gcctaccggcaatttccggcca

SEQ ID NO: 186882 - DNA, 16 bp, Homo sapiens
gcctagccgacctcag

SEQ ID NO: 186883 - DNA, 18 bp, Homo sapiens
gcctagccgacctcagcc

SEQ ID NO: 186884 - DNA, 22 bp, Homo sapiens
gcctagtgaaggcttctctctg

SEQ ID NO: 186885 - DNA, 23 bp, Homo sapiens
gcctagtgaaggcttctctctgt

SEQ ID NO: 186886 - DNA, 18 bp, Homo sapiens
gcctagtggggtctccct

SEQ ID NO: 186887 - DNA, 22 bp, Homo sapiens
gcctatgtgcatgcagcatcta

SEQ ID NO: 186888 - DNA, 21 bp, Homo sapiens
gcctcaatgtgaatcagaccc

SEQ ID NO: 186889 - DNA, 16 bp, Homo sapiens
gcctcagccattcact

SEQ ID NO: 186890 - DNA, 22 bp, Homo sapiens
gcctcagtcctcccctcacagc

SEQ ID NO: 186891 - DNA, 14 bp, Homo sapiens
gcctcagtgtattt

SEQ ID NO: 186892 - DNA, 13 bp, Homo sapiens
gcctcatatttaa

SEQ ID NO: 186893 - DNA, 15 bp, Homo sapiens
gcctcatatttaaag

SEQ ID NO: 186894 - DNA, 16 bp, Homo sapiens
gcctcatccgaggcag

SEQ ID NO: 186895 - DNA, 14 bp, Homo sapiens
gcctcccagcctgg

SEQ ID NO: 186896 - DNA, 14 bp, Homo sapiens
gcctcccctgccag

SEQ ID NO: 186897 - DNA, 17 bp, Homo sapiens
gcctcccctgccagggc

SEQ ID NO: 186898 - DNA, 14 bp, Homo sapiens
gcctccctcaaccc

SEQ ID NO: 186899 - DNA, 20 bp, Homo sapiens
gcctccctgttgaagctctg

SEQ ID NO: 186900 - DNA, 13 bp, Homo sapiens
gcctcctctgtcc

SEQ ID NO: 186901 - DNA, 17 bp, Homo sapiens
gcctcggagcctcatcc

SEQ ID NO: 186902 - DNA, 20 bp, Homo sapiens
gcctcggcttttctcagctg

SEQ ID NO: 186903 - DNA, 21 bp, Homo sapiens
gcctcgggacacctgccctgc

SEQ ID NO: 186904 - DNA, 15 bp, Homo sapiens
gcctctccctggccc

SEQ ID NO: 186905 - DNA, 17 bp, Homo sapiens
gcctctggattgtggga

SEQ ID NO: 186906 - DNA, 14 bp, Homo sapiens
gcctctgggactgg

SEQ ID NO: 186907 - DNA, 12 bp, Homo sapiens
gcctctgggtca

SEQ ID NO: 186908 - DNA, 21 bp, Homo sapiens
gcctctgtgtccttccctgca

SEQ ID NO: 186909 - DNA, 22 bp, Homo sapiens
gcctcttaaagctgcctgtagt

SEQ ID NO: 186910 - DNA, 23 bp, Homo sapiens
gcctcttaaagctgcctgtagtt

SEQ ID NO: 186911 - DNA, 22 bp, Homo sapiens
gcctcttcctccctcattccac

SEQ ID NO: 186912 - DNA, 12 bp, Homo sapiens
gcctcttctcta

SEQ ID NO: 186913 - DNA, 18 bp, Homo sapiens
gcctcttgagcagtggct

SEQ ID NO: 186914 - DNA, 19 bp, Homo sapiens
gcctcttgagcagtggctg

SEQ ID NO: 186915 - DNA, 20 bp, Homo sapiens
gcctcttgcggtcccttctt

SEQ ID NO: 186916 - DNA, 16 bp, Homo sapiens
gcctctttcatccact

SEQ ID NO: 186917 - DNA, 20 bp, Homo sapiens
gcctgacaaccactggtctg

SEQ ID NO: 186918 - DNA, 21 bp, Homo sapiens
gcctgacaaccactggtctgt

SEQ ID NO: 186919 - DNA, 17 bp, Homo sapiens
gcctgagcctggccagc

SEQ ID NO: 186920 - DNA, 14 bp, Homo sapiens
gcctgagctcactc

SEQ ID NO: 186921 - DNA, 17 bp, Homo sapiens
gcctgagctcactcggc

SEQ ID NO: 186922 - DNA, 23 bp, Homo sapiens
gcctgagctcactcggcaccctg

SEQ ID NO: 186923 - DNA, 10 bp, Homo sapiens
gcctgaggga

SEQ ID NO: 186924 - DNA, 18 bp, Homo sapiens
gcctgcaaacgctgcctg

SEQ ID NO: 186925 - DNA, 20 bp, Homo sapiens
gcctgcaaacgctgcctgcc

SEQ ID NO: 186926 - DNA, 16 bp, Homo sapiens
gcctgcaggacctgcc

SEQ ID NO: 186927 - DNA, 17 bp, Homo sapiens
gcctgcaggacctgcct

SEQ ID NO: 186928 - DNA, 21 bp, Homo sapiens
gcctgcaggacctgcctgtag

SEQ ID NO: 186929 - DNA, 22 bp, Homo sapiens
gcctgcaggacctgcctgtagc

SEQ ID NO: 186930 - DNA, 19 bp, Homo sapiens
gcctgcaggtgctgctgcg

SEQ ID NO: 186931 - DNA, 16 bp, Homo sapiens
gcctgcatgtaaacac

SEQ ID NO: 186932 - DNA, 23 bp, Homo sapiens
gcctgccccaaacaaatatgcaa

SEQ ID NO: 186933 - DNA, 21 bp, Homo sapiens
gcctgccggtaaacacgcctg

SEQ ID NO: 186934 - DNA, 13 bp, Homo sapiens
gcctgctccccca

SEQ ID NO: 186935 - DNA, 17 bp, Homo sapiens
gcctgctcccccacccc

SEQ ID NO: 186936 - DNA, 21 bp, Homo sapiens
gcctgctgggctctccacctc

SEQ ID NO: 186937 - DNA, 14 bp, Homo sapiens
gcctggaccctgtg

SEQ ID NO: 186938 - DNA, 13 bp, Homo sapiens
gcctggcacaggg

SEQ ID NO: 186939 - DNA, 14 bp, Homo sapiens
gcctggcacagggc

SEQ ID NO: 186940 - DNA, 21 bp, Homo sapiens
gcctggcagccgtgccttcag

SEQ ID NO: 186941 - DNA, 21 bp, Homo sapiens
gcctggccagcctacaatggg

SEQ ID NO: 186942 - DNA, 16 bp, Homo sapiens
gcctggccccatggtc

SEQ ID NO: 186943 - DNA, 18 bp, Homo sapiens
gcctggcccccagctgtg

SEQ ID NO: 186944 - DNA, 10 bp, Homo sapiens
gcctggctct

SEQ ID NO: 186945 - DNA, 19 bp, Homo sapiens
gcctggctcttgtgctgga

SEQ ID NO: 186946 - DNA, 23 bp, Homo sapiens
gcctgggctcccttgtgcgtggg

SEQ ID NO: 186947 - DNA, 16 bp, Homo sapiens
gcctgggtggggctgc

SEQ ID NO: 186948 - DNA, 20 bp, Homo sapiens
gcctgggtggggctgctcct

SEQ ID NO: 186949 - DNA, 13 bp, Homo sapiens
gcctggtgggcct

SEQ ID NO: 186950 - DNA, 15 bp, Homo sapiens
gcctggtgggcctcc

SEQ ID NO: 186951 - DNA, 16 bp, Homo sapiens
gcctgtaatcccagca

SEQ ID NO: 186952 - DNA, 17 bp, Homo sapiens
gcctgtaatcccagcac

SEQ ID NO: 186953 - DNA, 16 bp, Homo sapiens
gcctgtaatcccagct

SEQ ID NO: 186954 - DNA, 19 bp, Homo sapiens
gcctgtagcccactctgct

SEQ ID NO: 186955 - DNA, 16 bp, Homo sapiens
gcctgtagttaggaaa

SEQ ID NO: 186956 - DNA, 19 bp, Homo sapiens
gcctgtagttaggaaataa

SEQ ID NO: 186957 - DNA, 14 bp, Homo sapiens
gcctgtgctgcccg

SEQ ID NO: 186958 - DNA, 23 bp, Homo sapiens
gcctgtgctgcccgtcttcagcc

SEQ ID NO: 186959 - DNA, 19 bp, Homo sapiens
gcctgtggcggtgcctggg

SEQ ID NO: 186960 - DNA, 19 bp, Homo sapiens
gcctgttcccattcttgca

SEQ ID NO: 186961 - DNA, 12 bp, Homo sapiens
gccttaaaactt

SEQ ID NO: 186962 - DNA, 14 bp, Homo sapiens
gccttacctcctgc

SEQ ID NO: 186963 - DNA, 15 bp, Homo sapiens
gccttacctcctgcc

SEQ ID NO: 186964 - DNA, 17 bp, Homo sapiens
gccttacctcctgccca

SEQ ID NO: 186965 - DNA, 18 bp, Homo sapiens
gccttacctcctgcccag

SEQ ID NO: 186966 - DNA, 20 bp, Homo sapiens
gccttacctcctgcccagga

SEQ ID NO: 186967 - DNA, 22 bp, Homo sapiens
gccttatcttgcaccccaaagc

SEQ ID NO: 186968 - DNA, 16 bp, Homo sapiens
gccttcagctctacag

SEQ ID NO: 186969 - DNA, 16 bp, Homo sapiens
gccttccccttgccca

SEQ ID NO: 186970 - DNA, 13 bp, Homo sapiens
gccttcctcctgg

SEQ ID NO: 186971 - DNA, 16 bp, Homo sapiens
gccttcctcctgggcc

SEQ ID NO: 186972 - DNA, 22 bp, Homo sapiens
gccttcgatacaccgggcctgg

SEQ ID NO: 186973 - DNA, 23 bp, Homo sapiens
gccttcttattctcactccacca

SEQ ID NO: 186974 - DNA, 15 bp, Homo sapiens
gccttgcccagagat

SEQ ID NO: 186975 - DNA, 16 bp, Homo sapiens
gccttgcccagagatg

SEQ ID NO: 186976 - DNA, 22 bp, Homo sapiens
gccttgcccagagatgcctcca

SEQ ID NO: 186977 - DNA, 14 bp, Homo sapiens
gccttgctggacgg

SEQ ID NO: 186978 - DNA, 17 bp, Homo sapiens
gccttgtaattctaaat

SEQ ID NO: 186979 - DNA, 22 bp, Homo sapiens
gcctttctcccaggccaggctc

SEQ ID NO: 186980 - DNA, 17 bp, Homo sapiens
gcctttgatcaggtggg

SEQ ID NO: 186981 - DNA, 15 bp, Homo sapiens
gcctttgcctccccg

SEQ ID NO: 186982 - DNA, 15 bp, Homo sapiens
gcctttggctctgga

SEQ ID NO: 186983 - DNA, 16 bp, Homo sapiens
gcctttggctctggag

SEQ ID NO: 186984 - DNA, 13 bp, Homo sapiens
gcctttggcttca

SEQ ID NO: 186985 - DNA, 16 bp, Homo sapiens
gcgacatagcccatcc

SEQ ID NO: 186986 - DNA, 21 bp, Homo sapiens
gcgactctatagactctagga

SEQ ID NO: 186987 - DNA, 23 bp, Homo sapiens
gcgaggtcaacagagaaggcagg

SEQ ID NO: 186988 - DNA, 13 bp, Homo sapiens
gcgcaagcctgta

SEQ ID NO: 186989 - DNA, 14 bp, Homo sapiens
gcgccaccatcctg

SEQ ID NO: 186990 - DNA, 16 bp, Homo sapiens
gcgcctgcccctccca

SEQ ID NO: 186991 - DNA, 17 bp, Homo sapiens
gcgcctgcccctcccag

SEQ ID NO: 186992 - DNA, 16 bp, Homo sapiens
gcggccgcattccctg

SEQ ID NO: 186993 - DNA, 19 bp, Homo sapiens
gcggccgcattccctgagt

SEQ ID NO: 186994 - DNA, 19 bp, Homo sapiens
gcggctactcagcagccct

SEQ ID NO: 186995 - DNA, 23 bp, Homo sapiens
gcggctgagtcatgatctccctg

SEQ ID NO: 186996 - DNA, 19 bp, Homo sapiens
gcgggaccggtacagaaag

SEQ ID NO: 186997 - DNA, 16 bp, Homo sapiens
gcgggctgggcagctg

SEQ ID NO: 186998 - DNA, 20 bp, Homo sapiens
gcggtctcaggctggtggga

SEQ ID NO: 186999 - DNA, 15 bp, Homo sapiens
gcggtggccctgtcc

SEQ ID NO: 187000 - DNA, 14 bp, Homo sapiens
gcgtcctcctctgt

SEQ ID NO: 187001 - DNA, 13 bp, Homo sapiens
gcgtgtggctcac

SEQ ID NO: 187002 - DNA, 18 bp, Homo sapiens
gcgtgtgtccatgtgtgt

SEQ ID NO: 187003 - DNA, 19 bp, Homo sapiens
gcgttgtaaaatatagctg

SEQ ID NO: 187004 - DNA, 20 bp, Homo sapiens
gcgttgtaaaatatagctgt

SEQ ID NO: 187005 - DNA, 19 bp, Homo sapiens
gctaaatcctttactgtta

SEQ ID NO: 187006 - DNA, 12 bp, Homo sapiens
gcaggggctctg

SEQ ID NO: 187007 - DNA, 13 bp, Homo sapiens
gcaggggctctgg

SEQ ID NO: 187008 - DNA, 14 bp, Homo sapiens
gcaggggctctgga

SEQ ID NO: 187009 - DNA, 18 bp, Homo sapiens
gcaggggctctggagaga

SEQ ID NO: 187010 - DNA, 19 bp, Homo sapiens
gcagggtcctagaaattcc

SEQ ID NO: 187011 - DNA, 14 bp, Homo sapiens
gcaggtaccactga

SEQ ID NO: 187012 - DNA, 16 bp, Homo sapiens
gcaggtgggagcttga

SEQ ID NO: 187013 - DNA, 23 bp, Homo sapiens
gcagtacctataaagtaaagcta

SEQ ID NO: 187014 - DNA, 19 bp, Homo sapiens
gcagtagaaataatatgca

SEQ ID NO: 187015 - DNA, 15 bp, Homo sapiens
gcagtatgaaaataa

SEQ ID NO: 187016 - DNA, 22 bp, Homo sapiens
gcagtcatcttgaccaagcagg

SEQ ID NO: 187017 - DNA, 23 bp, Homo sapiens
gcagtcatcttgaccaagcagga

SEQ ID NO: 187018 - DNA, 19 bp, Homo sapiens
gcagtcctgatcagagccg

SEQ ID NO: 187019 - DNA, 18 bp, Homo sapiens
gcagtcctgcctcagcct

SEQ ID NO: 187020 - DNA, 16 bp, Homo sapiens
gcagtctacccacctc

SEQ ID NO: 187021 - DNA, 14 bp, Homo sapiens
gcagtctggagggg

SEQ ID NO: 187022 - DNA, 20 bp, Homo sapiens
gcagtgagaaaaagctcctg

SEQ ID NO: 187023 - DNA, 23 bp, Homo sapiens
gcagtgagaaaaagctcctgtcc

SEQ ID NO: 187024 - DNA, 20 bp, Homo sapiens
gcagtgagccaagattgcgc

SEQ ID NO: 187025 - DNA, 17 bp, Homo sapiens
gcagtgagtgagcctgg

SEQ ID NO: 187026 - DNA, 20 bp, Homo sapiens
gcagtgagtgagcctggctc

SEQ ID NO: 187027 - DNA, 21 bp, Homo sapiens
gcagtgagtgagcctggctct

SEQ ID NO: 187028 - DNA, 15 bp, Homo sapiens
gcagtggctggtcca

SEQ ID NO: 187029 - DNA, 21 bp, Homo sapiens
gcagtgggacagggcatggcc

SEQ ID NO: 187030 - DNA, 19 bp, Homo sapiens
gcagtgtgaggccagggca

SEQ ID NO: 187031 - DNA, 20 bp, Homo sapiens
gcagtgttccccatctgggt

SEQ ID NO: 187032 - DNA, 15 bp, Homo sapiens
gcagttgaaaagact

SEQ ID NO: 187033 - DNA, 16 bp, Homo sapiens
gcagttgaaaagactc

SEQ ID NO: 187034 - DNA, 19 bp, Homo sapiens
gcagttgaaaagactccaa

SEQ ID NO: 187035 - DNA, 14 bp, Homo sapiens
gcagtttgggaggt

SEQ ID NO: 187036 - DNA, 17 bp, Homo sapiens
gcataacaattcctcta

SEQ ID NO: 187037 - DNA, 20 bp, Homo sapiens
gcatacctttattgtgatct

SEQ ID NO: 187038 - DNA, 16 bp, Homo sapiens
gcatactaataaagta

SEQ ID NO: 187039 - DNA, 20 bp, Homo sapiens
gcatagtattccattgtgtg

SEQ ID NO: 187040 - DNA, 22 bp, Homo sapiens
gcatagtattccattgtgtgag

SEQ ID NO: 187041 - DNA, 16 bp, Homo sapiens
gcatattcttatgtat

SEQ ID NO: 187042 - DNA, 12 bp, Homo sapiens
gcatcagctgct

SEQ ID NO: 187043 - DNA, 22 bp, Homo sapiens
gcatcagctgctgaaacaacaa

SEQ ID NO: 187044 - DNA, 23 bp, Homo sapiens
gcatcagctgctgaaacaacaaa

SEQ ID NO: 187045 - DNA, 18 bp, Homo sapiens
gcatccattcctcaggga

SEQ ID NO: 187046 - DNA, 20 bp, Homo sapiens
gcatctccacctgctcccag

SEQ ID NO: 187047 - DNA, 11 bp, Homo sapiens
gcatctgtata

SEQ ID NO: 187048 - DNA, 22 bp, Homo sapiens
gcatctgtataagtaagaaaat

SEQ ID NO: 187049 - DNA, 14 bp, Homo sapiens
gcatgccccggcca

SEQ ID NO: 187050 - DNA, 16 bp, Homo sapiens
gcatgccttccagcac

SEQ ID NO: 187051 - DNA, 14 bp, Homo sapiens
gcatgctctctgca

SEQ ID NO: 187052 - DNA, 15 bp, Homo sapiens
gcatgctctctgcag

SEQ ID NO: 187053 - DNA, 17 bp, Homo sapiens
gcatgctctctgcagcc

SEQ ID NO: 187054 - DNA, 23 bp, Homo sapiens
gcatgctctctgcagccagccca

SEQ ID NO: 187055 - DNA, 17 bp, Homo sapiens
gcatggccagcagcttg

SEQ ID NO: 187056 - DNA, 17 bp, Homo sapiens
gcatggccaggtggcca

SEQ ID NO: 187057 - DNA, 14 bp, Homo sapiens
gcatgtaggagaat

SEQ ID NO: 187058 - DNA, 15 bp, Homo sapiens
gcatgtaggagaatc

SEQ ID NO: 187059 - DNA, 16 bp, Homo sapiens
gcattacatttccaaa

SEQ ID NO: 187060 - DNA, 23 bp, Homo sapiens
gcattaccgcgttgtaaaatata

SEQ ID NO: 187061 - DNA, 14 bp, Homo sapiens
gcattattgcatta

SEQ ID NO: 187062 - DNA, 17 bp, Homo sapiens
gcattgatggggaagga

SEQ ID NO: 187063 - DNA, 16 bp, Homo sapiens
gcattgtggctgtcag

SEQ ID NO: 187064 - DNA, 13 bp, Homo sapiens
gcatttgctgaat

SEQ ID NO: 187065 - DNA, 17 bp, Homo sapiens
gcatttgctgaatacag

SEQ ID NO: 187066 - DNA, 15 bp, Homo sapiens
gccaaatatgtcctg

SEQ ID NO: 187067 - DNA, 15 bp, Homo sapiens
gccaacttgagggcc

SEQ ID NO: 187068 - DNA, 23 bp, Homo sapiens
gccaagacttggcaacagaagca

SEQ ID NO: 187069 - DNA, 14 bp, Homo sapiens
gccaagcagccaag

SEQ ID NO: 187070 - DNA, 13 bp, Homo sapiens
gccaagctagaat

SEQ ID NO: 187071 - DNA, 16 bp, Homo sapiens
gccaagctccttggga

SEQ ID NO: 187072 - DNA, 21 bp, Homo sapiens
gccaaggctgggggaagaagc

SEQ ID NO: 187073 - DNA, 15 bp, Homo sapiens
gccaaggtgggagga

SEQ ID NO: 187074 - DNA, 21 bp, Homo sapiens
gccaatggagactgtctcaag

SEQ ID NO: 187075 - DNA, 23 bp, Homo sapiens
gccacacatcacccttaccatgt

SEQ ID NO: 187076 - DNA, 22 bp, Homo sapiens
gccacaccctcccccgccactc

SEQ ID NO: 187077 - DNA, 22 bp, Homo sapiens
gccacacttcaggctcttctcc

SEQ ID NO: 187078 - DNA, 21 bp, Homo sapiens
gccacagcctcccctgccagg

SEQ ID NO: 187079 - DNA, 15 bp, Homo sapiens
gccacatgggaggct

SEQ ID NO: 187080 - DNA, 22 bp, Homo sapiens
gccaccaactcttgcaggtctc

SEQ ID NO: 187081 - DNA, 12 bp, Homo sapiens
gccaccagagac

SEQ ID NO: 187082 - DNA, 19 bp, Homo sapiens
gccaccagagaccgtcctc

SEQ ID NO: 187083 - DNA, 22 bp, Homo sapiens
gccaccagagaccgtcctcacc

SEQ ID NO: 187084 - DNA, 23 bp, Homo sapiens
gccaccagagaccgtcctcaccc

SEQ ID NO: 187085 - DNA, 16 bp, Homo sapiens
gccaccatgcccagct

SEQ ID NO: 187086 - DNA, 17 bp, Homo sapiens
gccaccatggccagcca

SEQ ID NO: 187087 - DNA, 15 bp, Homo sapiens
gccacccctccttcc

SEQ ID NO: 187088 - DNA, 15 bp, Homo sapiens
gccacctcccctatc

SEQ ID NO: 187089 - DNA, 21 bp, Homo sapiens
gccacctctgcggaccccagc

SEQ ID NO: 187090 - DNA, 16 bp, Homo sapiens
gccacctggggcagtc

SEQ ID NO: 187091 - DNA, 17 bp, Homo sapiens
gccacctggggcagtca

SEQ ID NO: 187092 - DNA, 17 bp, Homo sapiens
gccacgtgccaggcccg

SEQ ID NO: 187093 - DNA, 16 bp, Homo sapiens
gccacgttccttactg

SEQ ID NO: 187094 - DNA, 20 bp, Homo sapiens
gccactccagacccctggct

SEQ ID NO: 187095 - DNA, 21 bp, Homo sapiens
gccactccagacccctggctt

SEQ ID NO: 187096 - DNA, 12 bp, Homo sapiens
gccactctgcct

SEQ ID NO: 187097 - DNA, 21 bp, Homo sapiens
gccactctgcctctgcctgca

SEQ ID NO: 187098 - DNA, 22 bp, Homo sapiens
gccactctgcctctgcctgcat

SEQ ID NO: 187099 - DNA, 13 bp, Homo sapiens
gccactgcctctt

SEQ ID NO: 187100 - DNA, 19 bp, Homo sapiens
ggactcaggatgcccaggg

SEQ ID NO: 187101 - DNA, 12 bp, Homo sapiens
ggactcctctgt

SEQ ID NO: 187102 - DNA, 15 bp, Homo sapiens
ggactcctctgtcca

SEQ ID NO: 187103 - DNA, 17 bp, Homo sapiens
ggactctcagtctctga

SEQ ID NO: 187104 - DNA, 16 bp, Homo sapiens
ggactgacacccatgt

SEQ ID NO: 187105 - DNA, 21 bp, Homo sapiens
ggactgccagtccccctgccc

SEQ ID NO: 187106 - DNA, 18 bp, Homo sapiens
ggactgccccgtgcagac

SEQ ID NO: 187107 - DNA, 21 bp, Homo sapiens
ggactgccccgtgcagactgg

SEQ ID NO: 187108 - DNA, 12 bp, Homo sapiens
ggacttgaagtt

SEQ ID NO: 187109 - DNA, 21 bp, Homo sapiens
ggactttcttttcgccgtggc

SEQ ID NO: 187110 - DNA, 13 bp, Homo sapiens
ggagaaaacactt

SEQ ID NO: 187111 - DNA, 19 bp, Homo sapiens
ggagaaacccttgaaaaga

SEQ ID NO: 187112 - DNA, 13 bp, Homo sapiens
ggagaaactggaa

SEQ ID NO: 187113 - DNA, 20 bp, Homo sapiens
ggagaaatgcatccattcct

SEQ ID NO: 187114 - DNA, 13 bp, Homo sapiens
ggagaactagaga

SEQ ID NO: 187115 - DNA, 23 bp, Homo sapiens
ggagaagagctgttcacagccag

SEQ ID NO: 187116 - DNA, 19 bp, Homo sapiens
ggagaagcagtgagccgca

SEQ ID NO: 187117 - DNA, 19 bp, Homo sapiens
ggagaatcacttgaacccg

SEQ ID NO: 187118 - DNA, 15 bp, Homo sapiens
ggagacaagaaatcc

SEQ ID NO: 187119 - DNA, 18 bp, Homo sapiens
ggagacaagaaatccctg

SEQ ID NO: 187120 - DNA, 11 bp, Homo sapiens
ggagacagggt

SEQ ID NO: 187121 - DNA, 19 bp, Homo sapiens
ggagacatgtgacatttat

SEQ ID NO: 187122 - DNA, 9 bp, Homo sapiens
ggagactca

SEQ ID NO: 187123 - DNA, 21 bp, Homo sapiens
ggagactcacctctgcctcaa

SEQ ID NO: 187124 - DNA, 21 bp, Homo sapiens
ggagactccatgagaagccgt

SEQ ID NO: 187125 - DNA, 17 bp, Homo sapiens
ggagactgggctgaggg

SEQ ID NO: 187126 - DNA, 21 bp, Homo sapiens
ggagagaaggggaggagggcg

SEQ ID NO: 187127 - DNA, 11 bp, Homo sapiens
ggagagagaaa

SEQ ID NO: 187128 - DNA, 17 bp, Homo sapiens
ggagagagaaagccagg

SEQ ID NO: 187129 - DNA, 14 bp, Homo sapiens
ggagagagactcca

SEQ ID NO: 187130 - DNA, 22 bp, Homo sapiens
ggagagccaccaagagggacgc

SEQ ID NO: 187131 - DNA, 11 bp, Homo sapiens
ggagagccagc

SEQ ID NO: 187132 - DNA, 16 bp, Homo sapiens
ggagagcgcctgcccc

SEQ ID NO: 187133 - DNA, 20 bp, Homo sapiens
ggagagcgcctgcccctccc

SEQ ID NO: 187134 - DNA, 22 bp, Homo sapiens
ggagagcgcctgcccctcccag

SEQ ID NO: 187135 - DNA, 19 bp, Homo sapiens
ggccacatgggaggctcac

SEQ ID NO: 187136 - DNA, 16 bp, Homo sapiens
ggccacgtgccaggcc

SEQ ID NO: 187137 - DNA, 13 bp, Homo sapiens
ggccactcctcca

SEQ ID NO: 187138 - DNA, 16 bp, Homo sapiens
ggccactctgcctctg

SEQ ID NO: 187139 - DNA, 11 bp, Homo sapiens
ggccactgtga

SEQ ID NO: 187140 - DNA, 17 bp, Homo sapiens
ggccagagctgggaggc

SEQ ID NO: 187141 - DNA, 22 bp, Homo sapiens
ggccagaggaactgtccagaga

SEQ ID NO: 187142 - DNA, 12 bp, Homo sapiens
ggccagcagctt

SEQ ID NO: 187143 - DNA, 16 bp, Homo sapiens
ggccagctggcagcag

SEQ ID NO: 187144 - DNA, 17 bp, Homo sapiens
ggccagctggcagcaga

SEQ ID NO: 187145 - DNA, 13 bp, Homo sapiens
ggccaggactgag

SEQ ID NO: 187146 - DNA, 16 bp, Homo sapiens
ggccaggctccttcct

SEQ ID NO: 187147 - DNA, 13 bp, Homo sapiens
ggccagggcagag

SEQ ID NO: 187148 - DNA, 14 bp, Homo sapiens
ggccaggtgcacag

SEQ ID NO: 187149 - DNA, 19 bp, Homo sapiens
ggccaggtggccactccag

SEQ ID NO: 187150 - DNA, 13 bp, Homo sapiens
ggcccacagctcc

SEQ ID NO: 187151 - DNA, 17 bp, Homo sapiens
ggcccacagctcccacc

SEQ ID NO: 187152 - DNA, 18 bp, Homo sapiens
ggcccacagctcccaccc

SEQ ID NO: 187153 - DNA, 16 bp, Homo sapiens
ggcccagcgacctcgg

SEQ ID NO: 187154 - DNA, 15 bp, Homo sapiens
ggccccaccacctag

SEQ ID NO: 187155 - DNA, 15 bp, Homo sapiens
ggccccaggaagccg

SEQ ID NO: 187156 - DNA, 22 bp, Homo sapiens
ggccccaggcattgccaagggc

SEQ ID NO: 187157 - DNA, 21 bp, Homo sapiens
ggccccgcttgtccagcgcct

SEQ ID NO: 187158 - DNA, 16 bp, Homo sapiens
ggcccgacagcctggc

SEQ ID NO: 187159 - DNA, 22 bp, Homo sapiens
ggccctcacccctgccctggga

SEQ ID NO: 187160 - DNA, 21 bp, Homo sapiens
ggccctctctgctctgcgtgt

SEQ ID NO: 187161 - DNA, 21 bp, Homo sapiens
ggccctgagctcggtggaccc

SEQ ID NO: 187162 - DNA, 22 bp, Homo sapiens
ggccctgcaaaaggactctcag

SEQ ID NO: 187163 - DNA, 18 bp, Homo sapiens
ggccctgcacctgtgcag

SEQ ID NO: 187164 - DNA, 14 bp, Homo sapiens
ggccctgccttctt

SEQ ID NO: 187165 - DNA, 20 bp, Homo sapiens
gtctccctctcctgcctact

SEQ ID NO: 187166 - DNA, 22 bp, Homo sapiens
gtctccctctcctgcctactca

SEQ ID NO: 187167 - DNA, 18 bp, Homo sapiens
gtctcctttcaccccagg

SEQ ID NO: 187168 - DNA, 16 bp, Homo sapiens
gtctctgctggcccag

SEQ ID NO: 187169 - DNA, 17 bp, Homo sapiens
gtctgaagtcactgcac

SEQ ID NO: 187170 - DNA, 19 bp, Homo sapiens
gtctgaagtcactgcacag

SEQ ID NO: 187171 - DNA, 14 bp, Homo sapiens
gtctgaccctctcc

SEQ ID NO: 187172 - DNA, 18 bp, Homo sapiens
gtctgccagccagcagcc

SEQ ID NO: 187173 - DNA, 19 bp, Homo sapiens
gtctgctctttctctgcca

SEQ ID NO: 187174 - DNA, 17 bp, Homo sapiens
gtctgctgaataataaa

SEQ ID NO: 187175 - DNA, 19 bp, Homo sapiens
gtctgctgaataataaact

SEQ ID NO: 187176 - DNA, 17 bp, Homo sapiens
gtctggagaagcagtga

SEQ ID NO: 187177 - DNA, 19 bp, Homo sapiens
gtctggagaagcagtgagc

SEQ ID NO: 187178 - DNA, 10 bp, Homo sapiens
gtctggaggg

SEQ ID NO: 187179 - DNA, 22 bp, Homo sapiens
gtctggatctgggaccctttcc

SEQ ID NO: 187180 - DNA, 18 bp, Homo sapiens
gtctggggttcagcccct

SEQ ID NO: 187181 - DNA, 16 bp, Homo sapiens
gtctggttttaacaat

SEQ ID NO: 187182 - DNA, 21 bp, Homo sapiens
gtctggttttaacaatttcct

SEQ ID NO: 187183 - DNA, 21 bp, Homo sapiens
gtctgtgaattggaccatcct

SEQ ID NO: 187184 - DNA, 20 bp, Homo sapiens
gtctgtgtgatgaactttct

SEQ ID NO: 187185 - DNA, 12 bp, Homo sapiens
gtcttaaaataa

SEQ ID NO: 187186 - DNA, 22 bp, Homo sapiens
gtcttaaaataacttatatcat

SEQ ID NO: 187187 - DNA, 14 bp, Homo sapiens
gtcttaattaaaag

SEQ ID NO: 187188 - DNA, 22 bp, Homo sapiens
gtcttaattaaaagaatatttt

SEQ ID NO: 187189 - DNA, 20 bp, Homo sapiens
gtcttcctgcattcacccag

SEQ ID NO: 187190 - DNA, 22 bp, Homo sapiens
gtcttctcaggctctgccctgc

SEQ ID NO: 187191 - DNA, 22 bp, Homo sapiens
gtcttgttttttttttccactt

SEQ ID NO: 187192 - DNA, 20 bp, Homo sapiens
gtctttccattggatctcat

SEQ ID NO: 187193 - DNA, 20 bp, Homo sapiens
gtctttgtaatgtcaccacc

SEQ ID NO: 187194 - DNA, 17 bp, Homo sapiens
gtgaaataccagtgtgg

SEQ ID NO: 187195 - DNA, 21 bp, Homo sapiens
gtgaaatttattagttaatat

SEQ ID NO: 187196 - DNA, 13 bp, Homo sapiens
gtgaacacatcag

SEQ ID NO: 187197 - DNA, 16 bp, Homo sapiens
gtgaacgatttagaaa

SEQ ID NO: 187198 - DNA, 16 bp, Homo sapiens
gtgaagtgaatgaaac

SEQ ID NO: 187199 - DNA, 14 bp, Homo sapiens
gtgaagtttacatt

SEQ ID NO: 187200 - DNA, 13 bp, Homo sapiens
gtgaataaatgtc

SEQ ID NO: 187201 - DNA, 14 bp, Homo sapiens
gtgaatcagagcac

SEQ ID NO: 187202 - DNA, 18 bp, Homo sapiens
gtgaattcttgaaggaaa

SEQ ID NO: 187203 - DNA, 18 bp, Homo sapiens
gtgacagtggattgcatt

SEQ ID NO: 187204 - DNA, 12 bp, Homo sapiens
gtgacctcaggc

SEQ ID NO: 187205 - DNA, 16 bp, Homo sapiens
gtgacctgaggaagcg

SEQ ID NO: 187206 - DNA, 22 bp, Homo sapiens
gtgactctttttagggccaggc

SEQ ID NO: 187207 - DNA, 20 bp, Homo sapiens
gtgactgccccaactcctgg

SEQ ID NO: 187208 - DNA, 15 bp, Homo sapiens
gtgacttctccaggt

SEQ ID NO: 187209 - DNA, 23 bp, Homo sapiens
gtgacttgtgtcccatgatccct

SEQ ID NO: 187210 - DNA, 17 bp, Homo sapiens
gtgagaaaaagctcctg

SEQ ID NO: 187211 - DNA, 20 bp, Homo sapiens
gtgagacccagccctcatcc

SEQ ID NO: 187212 - DNA, 22 bp, Homo sapiens
gtgagaccctgtctcaaaaaaa

SEQ ID NO: 187213 - DNA, 16 bp, Homo sapiens
gtgagcactcccaagt

SEQ ID NO: 187214 - DNA, 14 bp, Homo sapiens
gtgagcccctggtc

SEQ ID NO: 187215 - DNA, 13 bp, Homo sapiens
gtgagcctggctc

SEQ ID NO: 187216 - DNA, 14 bp, Homo sapiens
gtgagcctggctct

SEQ ID NO: 187217 - DNA, 17 bp, Homo sapiens
gtgaggccagggcagag

SEQ ID NO: 187218 - DNA, 13 bp, Homo sapiens
gtgaggcccctgg

SEQ ID NO: 187219 - DNA, 14 bp, Homo sapiens
gtgaggctgtcctg

SEQ ID NO: 187220 - DNA, 16 bp, Homo sapiens
gtgaggctgtcctgta

SEQ ID NO: 187221 - DNA, 22 bp, Homo sapiens
gtgagggcttgtcattaccaga

SEQ ID NO: 187222 - DNA, 18 bp, Homo sapiens
gtgagggtcagagaggag

SEQ ID NO: 187223 - DNA, 18 bp, Homo sapiens
gtgagtgagcctggctct

SEQ ID NO: 187224 - DNA, 22 bp, Homo sapiens
gtgagtgtgtccaagtgtgtgt

SEQ ID NO: 187225 - DNA, 13 bp, Homo sapiens
gtgagtgtgtgca

SEQ ID NO: 187226 - DNA, 15 bp, Homo sapiens
gtgagtgtgtgcaag

SEQ ID NO: 187227 - DNA, 20 bp, Homo sapiens
gtgatcagaccataatgtta

SEQ ID NO: 187228 - DNA, 14 bp, Homo sapiens
gtgatgaactttct

SEQ ID NO: 187229 - DNA, 16 bp, Homo sapiens
gtgatggttcccctgt

SEQ ID NO: 187230 - DNA, 17 bp, Homo sapiens
gtgattaccagggactg

SEQ ID NO: 187231 - DNA, 20 bp, Homo sapiens
gtgattcacagtgtgaatct

SEQ ID NO: 187232 - DNA, 23 bp, Homo sapiens
gtgatttagaactgtatgtcaga

SEQ ID NO: 187233 - DNA, 22 bp, Homo sapiens
gtgcaaagttccctacttcctg

SEQ ID NO: 187234 - DNA, 17 bp, Homo sapiens
gtgcaagtgtctgtgtg

SEQ ID NO: 187235 - DNA, 18 bp, Homo sapiens
gtgcaagtgtctgtgtgc

SEQ ID NO: 187236 - DNA, 14 bp, Homo sapiens
gtgcaagtgtgtgc

SEQ ID NO: 187237 - DNA, 15 bp, Homo sapiens
gtgcaagtgtgtgca

SEQ ID NO: 187238 - DNA, 15 bp, Homo sapiens
gtgcacccactctgc

SEQ ID NO: 187239 - DNA, 18 bp, Homo sapiens
gtgcagagtgcccagaac

SEQ ID NO: 187240 - DNA, 18 bp, Homo sapiens
gtgcagccgctgagcgag

SEQ ID NO: 187241 - DNA, 22 bp, Homo sapiens
gtgcagctcaaggaaaggcctg

SEQ ID NO: 187242 - DNA, 15 bp, Homo sapiens
gtgcatctcagccca

SEQ ID NO: 187243 - DNA, 15 bp, Homo sapiens
gtgcatgctctctgc

SEQ ID NO: 187244 - DNA, 13 bp, Homo sapiens
gtgcatgtgtgtg

SEQ ID NO: 187245 - DNA, 15 bp, Homo sapiens
gtgcatgtgtgtgct

SEQ ID NO: 187246 - DNA, 23 bp, Homo sapiens
gtgcattcttttaaaagacaaga

SEQ ID NO: 187247 - DNA, 18 bp, Homo sapiens
gtgccaagcacagtgcct

SEQ ID NO: 187248 - DNA, 19 bp, Homo sapiens
gtgccaagcacagtgcctg

SEQ ID NO: 187249 - DNA, 17 bp, Homo sapiens
gtgccaggcccggggct

SEQ ID NO: 187250 - DNA, 19 bp, Homo sapiens
gtgccaggcccggggctgg

SEQ ID NO: 187251 - DNA, 23 bp, Homo sapiens
gtgccatagagtttaacacaagt

SEQ ID NO: 187252 - DNA, 23 bp, Homo sapiens
gtgcccaagaatagatgctgact

SEQ ID NO: 187253 - DNA, 20 bp, Homo sapiens
gtgcccagagatgggactgg

SEQ ID NO: 187254 - DNA, 21 bp, Homo sapiens
gtgcccagctatacctgtgcc

SEQ ID NO: 187255 - DNA, 22 bp, Homo sapiens
gtgccgttactctccaacctgg

SEQ ID NO: 187256 - DNA, 15 bp, Homo sapiens
gtgcctctgcctgtc

SEQ ID NO: 187257 - DNA, 13 bp, Homo sapiens
gtgcctctgggac

SEQ ID NO: 187258 - DNA, 23 bp, Homo sapiens
gtgcctgatccagcctctcccct

SEQ ID NO: 187259 - DNA, 21 bp, Homo sapiens
gtgcctgggtggggctgctcc

SEQ ID NO: 187260 - DNA, 22 bp, Homo sapiens
gtgcctgggtggggctgctcct

SEQ ID NO: 187261 - DNA, 16 bp, Homo sapiens
gtgcctgtgaggcagg

SEQ ID NO: 187262 - DNA, 13 bp, Homo sapiens
gtgcgtgtgtgca

SEQ ID NO: 187263 - DNA, 21 bp, Homo sapiens
gtgctacaaaaacacagcaag

SEQ ID NO: 187264 - DNA, 21 bp, Homo sapiens
gtgctacacccttttccagct

SEQ ID NO: 187265 - DNA, 18 bp, Homo sapiens
gtgctcaggactcagaag

SEQ ID NO: 187266 - DNA, 12 bp, Homo sapiens
gtgctgccacac

SEQ ID NO: 187267 - DNA, 12 bp, Homo sapiens
gtgctgcctcta

SEQ ID NO: 187268 - DNA, 21 bp, Homo sapiens
gtgctggaggtgggagcagga

SEQ ID NO: 187269 - DNA, 18 bp, Homo sapiens
gtgctggatggagcccag

SEQ ID NO: 187270 - DNA, 19 bp, Homo sapiens
gtgctggatggagcccagg

SEQ ID NO: 187271 - DNA, 20 bp, Homo sapiens
gtgctggatggagcccaggc

SEQ ID NO: 187272 - DNA, 15 bp, Homo sapiens
gtgctgggagggata

SEQ ID NO: 187273 - DNA, 21 bp, Homo sapiens
gtgcttgtttgctcacctggg

SEQ ID NO: 187274 - DNA, 13 bp, Homo sapiens
gtggaagccctcc

SEQ ID NO: 187275 - DNA, 14 bp, Homo sapiens
gtggaagccctcct

SEQ ID NO: 187276 - DNA, 13 bp, Homo sapiens
gtggaatataaag

SEQ ID NO: 187277 - DNA, 21 bp, Homo sapiens
gtggacaccaggagtccctgg

SEQ ID NO: 187278 - DNA, 22 bp, Homo sapiens
gtggacccagggatgacatgtc

SEQ ID NO: 187279 - DNA, 20 bp, Homo sapiens
gtggacttagaaagcagggg

SEQ ID NO: 187280 - DNA, 20 bp, Homo sapiens
gtggagaagcggctggcagc

SEQ ID NO: 187281 - DNA, 19 bp, Homo sapiens
gtggagactggggggcttg

SEQ ID NO: 187282 - DNA, 20 bp, Homo sapiens
gtggagactggggggcttga

SEQ ID NO: 187283 - DNA, 22 bp, Homo sapiens
gtggaggttaaggctgaggaaa

SEQ ID NO: 187284 - DNA, 23 bp, Homo sapiens
gtggaggttgcagtgagccaaga

SEQ ID NO: 187285 - DNA, 19 bp, Homo sapiens
gtggaggttgcagtgagct

SEQ ID NO: 187286 - DNA, 14 bp, Homo sapiens
gtggatcacagagg

SEQ ID NO: 187287 - DNA, 19 bp, Homo sapiens
gtggattgcacgtggcctc

SEQ ID NO: 187288 - DNA, 21 bp, Homo sapiens
gtggcaagctgtgacttctcc

SEQ ID NO: 187289 - DNA, 23 bp, Homo sapiens
gtggcagataatcagcctcttaa

SEQ ID NO: 187290 - DNA, 17 bp, Homo sapiens
gtggcatagcccagaca

SEQ ID NO: 187291 - DNA, 22 bp, Homo sapiens
gtggcatcaccttaggcaggga

SEQ ID NO: 187292 - DNA, 19 bp, Homo sapiens
gtggccaaattatttgtgt

SEQ ID NO: 187293 - DNA, 17 bp, Homo sapiens
gtggccagagctgggag

SEQ ID NO: 187294 - DNA, 17 bp, Homo sapiens
gtggccctggcctgctg

SEQ ID NO: 187295 - DNA, 24 bp, Homo sapiens
gtggcctctgccccgtctcatgag

SEQ ID NO: 187296 - DNA, 20 bp, Homo sapiens
gtggcctcttgagcagtggc

SEQ ID NO: 187297 - DNA, 17 bp, Homo sapiens
gtggccttccccagcct

SEQ ID NO: 187298 - DNA, 20 bp, Homo sapiens
gtggccttccccagcctctt

SEQ ID NO: 187299 - DNA, 13 bp, Homo sapiens
gtggcggtgcctg

SEQ ID NO: 187300 - DNA, 14 bp, Homo sapiens
gtggctcacgcctg

SEQ ID NO: 187301 - DNA, 17 bp, Homo sapiens
gtggctgacccagtccc

SEQ ID NO: 187302 - DNA, 16 bp, Homo sapiens
gtggctgcccacacac

SEQ ID NO: 187303 - DNA, 18 bp, Homo sapiens
gtggctgcggcacccttg

SEQ ID NO: 187304 - DNA, 17 bp, Homo sapiens
gtggctgctagcacttg

SEQ ID NO: 187305 - DNA, 19 bp, Homo sapiens
gtggctgctagcacttgga

SEQ ID NO: 187306 - DNA, 15 bp, Homo sapiens
gtggctggtccaggg

SEQ ID NO: 187307 - DNA, 15 bp, Homo sapiens
gtggctgtcagcagg

SEQ ID NO: 187308 - DNA, 19 bp, Homo sapiens
gtggctgtcagcaggaagc

SEQ ID NO: 187309 - DNA, 14 bp, Homo sapiens
gtgggaagggagag

SEQ ID NO: 187310 - DNA, 12 bp, Homo sapiens
gtgggagcagga

SEQ ID NO: 187311 - DNA, 14 bp, Homo sapiens
gtgggagcaggaga

SEQ ID NO: 187312 - DNA, 19 bp, Homo sapiens
gtgggagggagcagacagg

SEQ ID NO: 187313 - DNA, 15 bp, Homo sapiens
gtgggagtcatctca

SEQ ID NO: 187314 - DNA, 14 bp, Homo sapiens
gtgggatggaggag

SEQ ID NO: 187315 - DNA, 23 bp, Homo sapiens
gtgggcacgctgtgggcaggtgg

SEQ ID NO: 187316 - DNA, 16 bp, Homo sapiens
gtgggcggcagagagg

SEQ ID NO: 187317 - DNA, 16 bp, Homo sapiens
gtggggctgctcctcc

SEQ ID NO: 187318 - DNA, 17 bp, Homo sapiens
gtggggctgctcctcca

SEQ ID NO: 187319 - DNA, 14 bp, Homo sapiens
gtggggtctccctc

SEQ ID NO: 187320 - DNA, 19 bp, Homo sapiens
gtggggtctccctctcctg

SEQ ID NO: 187321 - DNA, 20 bp, Homo sapiens
gtgggtccatgggcagagcc

SEQ ID NO: 187322 - DNA, 21 bp, Homo sapiens
gtgggtcttcagggggccagg

SEQ ID NO: 187323 - DNA, 15 bp, Homo sapiens
gtgggtgagatgctg

SEQ ID NO: 187324 - DNA, 20 bp, Homo sapiens
gtgggtgagatgctggagaa

SEQ ID NO: 187325 - DNA, 16 bp, Homo sapiens
gtgggttttcttccca

SEQ ID NO: 187326 - DNA, 17 bp, Homo sapiens
gtggtagagtgtgcctg

SEQ ID NO: 187327 - DNA, 18 bp, Homo sapiens
gtggtgggacagggaccc

SEQ ID NO: 187328 - DNA, 12 bp, Homo sapiens
gtgtacatatgt

SEQ ID NO: 187329 - DNA, 15 bp, Homo sapiens
gtgtacatatgtgct

SEQ ID NO: 187330 - DNA, 13 bp, Homo sapiens
gtgtaggcagaca

SEQ ID NO: 187331 - DNA, 22 bp, Homo sapiens
gtgtatcccccccctgtatagt

SEQ ID NO: 187332 - DNA, 16 bp, Homo sapiens
gtgtatgtgcgtgtgt

SEQ ID NO: 187333 - DNA, 18 bp, Homo sapiens
gtgtatgtgcgtgtgtgc

SEQ ID NO: 187334 - DNA, 16 bp, Homo sapiens
gtgtattaaaaaaaac

SEQ ID NO: 187335 - DNA, 14 bp, Homo sapiens
gtgtcacctgtgct

SEQ ID NO: 187336 - DNA, 18 bp, Homo sapiens
gtgtcataccaggccgcc

SEQ ID NO: 187337 - DNA, 15 bp, Homo sapiens
gtgtccatgtgtgtg

SEQ ID NO: 187338 - DNA, 17 bp, Homo sapiens
gtgtccttgcacctgca

SEQ ID NO: 187339 - DNA, 16 bp, Homo sapiens
gtgtcctttccctcca

SEQ ID NO: 187340 - DNA, 17 bp, Homo sapiens
gtgtcctttccctccac

SEQ ID NO: 187341 - DNA, 21 bp, Homo sapiens
gtgtgaaaggaagctccactg

SEQ ID NO: 187342 - DNA, 12 bp, Homo sapiens
gtgtgaggccag

SEQ ID NO: 187343 - DNA, 15 bp, Homo sapiens
gtgtgaggccagggc

SEQ ID NO: 187344 - DNA, 17 bp, Homo sapiens
gtgtgaggccagggcag

SEQ ID NO: 187345 - DNA, 11 bp, Homo sapiens
gtgtgagtgtg

SEQ ID NO: 187346 - DNA, 14 bp, Homo sapiens
gtgtgatcgtctga

SEQ ID NO: 187347 - DNA, 17 bp, Homo sapiens
gtgtgatgaactttctc

SEQ ID NO: 187348 - DNA, 22 bp, Homo sapiens
gtgtgatgaactttctcttcat

SEQ ID NO: 187349 - DNA, 22 bp, Homo sapiens
gtgtgcacacacaccacacata

SEQ ID NO: 187350 - DNA, 22 bp, Homo sapiens
gtgtgcaccttaccaactttct

SEQ ID NO: 187351 - DNA, 12 bp, Homo sapiens
gtgtgcatgtgt

SEQ ID NO: 187352 - DNA, 13 bp, Homo sapiens
gtgtgggaaggga

SEQ ID NO: 187353 - DNA, 16 bp, Homo sapiens
gtgtggtagagtgtgc

SEQ ID NO: 187354 - DNA, 14 bp, Homo sapiens
gtgtgtattaaaaa

SEQ ID NO: 187355 - DNA, 16 bp, Homo sapiens
gtgtgtccccctctgt

SEQ ID NO: 187356 - DNA, 17 bp, Homo sapiens
gtgtgtccccctctgtc

SEQ ID NO: 187357 - DNA, 14 bp, Homo sapiens
gtgtgtttgtgatt

SEQ ID NO: 187358 - DNA, 23 bp, Homo sapiens
gtgttccccttccactgagggca

SEQ ID NO: 187359 - DNA, 14 bp, Homo sapiens
gttaaaagatgaaa

SEQ ID NO: 187360 - DNA, 23 bp, Homo sapiens
gttaaaggctcgattttgtatct

SEQ ID NO: 187361 - DNA, 23 bp, Homo sapiens
gttaacagagacagataactctc

SEQ ID NO: 187362 - DNA, 16 bp, Homo sapiens
gttaaggctgaggaaa

SEQ ID NO: 187363 - DNA, 19 bp, Homo sapiens
gttaattccaattatatga

SEQ ID NO: 187364 - DNA, 13 bp, Homo sapiens
gttacattaatgt

SEQ ID NO: 187365 - DNA, 22 bp, Homo sapiens
gttacctgaaaacactgtgcac

SEQ ID NO: 187366 - DNA, 16 bp, Homo sapiens
gttactaactaaactc

SEQ ID NO: 187367 - DNA, 12 bp, Homo sapiens
gttactcagccc

SEQ ID NO: 187368 - DNA, 15 bp, Homo sapiens
gttactcagccctgg

SEQ ID NO: 187369 - DNA, 16 bp, Homo sapiens
gttactcagccctggg

SEQ ID NO: 187370 - DNA, 22 bp, Homo sapiens
gttactctccaacctggacaac

SEQ ID NO: 187371 - DNA, 22 bp, Homo sapiens
gttagagtccaacgtggggcag

SEQ ID NO: 187372 - DNA, 16 bp, Homo sapiens
gttaggaaataaaacc

SEQ ID NO: 187373 - DNA, 19 bp, Homo sapiens
gttaggaaataaaaccttt

SEQ ID NO: 187374 - DNA, 17 bp, Homo sapiens
gttatatattttttgta

SEQ ID NO: 187375 - DNA, 19 bp, Homo sapiens
gttatattgaaaaaataga

SEQ ID NO: 187376 - DNA, 20 bp, Homo sapiens
gttatcaccgtgggctccct

SEQ ID NO: 187377 - DNA, 23 bp, Homo sapiens
gttatggaaactgttgccagaga

SEQ ID NO: 187378 - DNA, 11 bp, Homo sapiens
gttatttaaat

SEQ ID NO: 187379 - DNA, 14 bp, Homo sapiens
gttatttcttacag

SEQ ID NO: 187380 - DNA, 18 bp, Homo sapiens
gttatttgttattttcag

SEQ ID NO: 187381 - DNA, 14 bp, Homo sapiens
gttattttcagtat

SEQ ID NO: 187382 - DNA, 13 bp, Homo sapiens
gttattttgcaac

SEQ ID NO: 187383 - DNA, 19 bp, Homo sapiens
gttatttttacattctgaa

SEQ ID NO: 187384 - DNA, 14 bp, Homo sapiens
gttcaaaaagtcta

SEQ ID NO: 187385 - DNA, 12 bp, Homo sapiens
gttcaaagccag

SEQ ID NO: 187386 - DNA, 18 bp, Homo sapiens
gttcagcactgtcccttg

SEQ ID NO: 187387 - DNA, 16 bp, Homo sapiens
gttcagcccctcctct

SEQ ID NO: 187388 - DNA, 22 bp, Homo sapiens
gttcagcccctcctctgccacc

SEQ ID NO: 187389 - DNA, 13 bp, Homo sapiens
gttcagctactcc

SEQ ID NO: 187390 - DNA, 15 bp, Homo sapiens
gttcagctgccccac

SEQ ID NO: 187391 - DNA, 16 bp, Homo sapiens
gttcatgccaccatgg

SEQ ID NO: 187392 - DNA, 15 bp, Homo sapiens
gttcccctgttcact

SEQ ID NO: 187393 - DNA, 20 bp, Homo sapiens
gttccctacttcctgtgact

SEQ ID NO: 187394 - DNA, 21 bp, Homo sapiens
gttccctgaaaacccagagag

SEQ ID NO: 187395 - DNA, 17 bp, Homo sapiens
gttctaagtctttccat

SEQ ID NO: 187396 - DNA, 18 bp, Homo sapiens
gttctgctcatcattctc

SEQ ID NO: 187397 - DNA, 23 bp, Homo sapiens
gttctgctcatcattctctgtct

SEQ ID NO: 187398 - DNA, 14 bp, Homo sapiens
gttcttcgaggtgg

SEQ ID NO: 187399 - DNA, 18 bp, Homo sapiens
gttctttcttcctctgct

SEQ ID NO: 187400 - DNA, 19 bp, Homo sapiens
gttctttcttcctctgctg

SEQ ID NO: 187401 - DNA, 17 bp, Homo sapiens
gttgaaaagactccaaa

SEQ ID NO: 187402 - DNA, 18 bp, Homo sapiens
gttgacagttcatatgta

SEQ ID NO: 187403 - DNA, 14 bp, Homo sapiens
gttgactttcaggt

SEQ ID NO: 187404 - DNA, 20 bp, Homo sapiens
gttgaggtggaagccctcct

SEQ ID NO: 187405 - DNA, 16 bp, Homo sapiens
gttgcaaggccgctgt

SEQ ID NO: 187406 - DNA, 19 bp, Homo sapiens
gttgcacttggcctctgga

SEQ ID NO: 187407 - DNA, 18 bp, Homo sapiens
gttgccaaacagccacac

SEQ ID NO: 187408 - DNA, 21 bp, Homo sapiens
gttgccaaatatgtcctgggg

SEQ ID NO: 187409 - DNA, 17 bp, Homo sapiens
gttgccagagatggagg

SEQ ID NO: 187410 - DNA, 20 bp, Homo sapiens
gttggaaaagaatacagaaa

SEQ ID NO: 187411 - DNA, 22 bp, Homo sapiens
gttggaaaagaatacagaaaga

SEQ ID NO: 187412 - DNA, 18 bp, Homo sapiens
gttggcaaaaaggcagga

SEQ ID NO: 187413 - DNA, 22 bp, Homo sapiens
gttggcagtgagtgagcctggc

SEQ ID NO: 187414 - DNA, 18 bp, Homo sapiens
gttgggatactgcagggc

SEQ ID NO: 187415 - DNA, 21 bp, Homo sapiens
gttgggatactgcagggccag

SEQ ID NO: 187416 - DNA, 13 bp, Homo sapiens
gttggtagtttct

SEQ ID NO: 187417 - DNA, 16 bp, Homo sapiens
gttggtcggtgggttg

SEQ ID NO: 187418 - DNA, 16 bp, Homo sapiens
gttgtaaatatataaa

SEQ ID NO: 187419 - DNA, 18 bp, Homo sapiens
gttgtaaatatataaata

SEQ ID NO: 187420 - DNA, 17 bp, Homo sapiens
gttgtgcaaattaacag

SEQ ID NO: 187421 - DNA, 21 bp, Homo sapiens
gtttaagtgactgatggctaa

SEQ ID NO: 187422 - DNA, 12 bp, Homo sapiens
gtttaagtgttg

SEQ ID NO: 187423 - DNA, 12 bp, Homo sapiens
gtttaatattta

SEQ ID NO: 187424 - DNA, 16 bp, Homo sapiens
gtttacaagtgtatat

SEQ ID NO: 187425 - DNA, 23 bp, Homo sapiens
gtttacaagtgtatatcagaaaa

SEQ ID NO: 187426 - DNA, 15 bp, Homo sapiens
gtttacaatttacaa

SEQ ID NO: 187427 - DNA, 16 bp, Homo sapiens
gtttacactctttgta

SEQ ID NO: 187428 - DNA, 23 bp, Homo sapiens
gtttattaacaaattatgttaca

SEQ ID NO: 187429 - DNA, 21 bp, Homo sapiens
gtttatttccaaataaaatga

SEQ ID NO: 187430 - DNA, 14 bp, Homo sapiens
gtttatttcttaaa

SEQ ID NO: 187431 - DNA, 23 bp, Homo sapiens
gtttcaaaataaaaaccaagaag

SEQ ID NO: 187432 - DNA, 23 bp, Homo sapiens
gtttcaaccaagtcatgtgcatt

SEQ ID NO: 187433 - DNA, 17 bp, Homo sapiens
gtttcaattgcatctcc

SEQ ID NO: 187434 - DNA, 15 bp, Homo sapiens
gtttcattctcctgc

SEQ ID NO: 187435 - DNA, 13 bp, Homo sapiens
gtttctctgctgt

SEQ ID NO: 187436 - DNA, 21 bp, Homo sapiens
gtttcttttgtatgtaaatgt

SEQ ID NO: 187437 - DNA, 17 bp, Homo sapiens
gtttgagatcagcctgg

SEQ ID NO: 187438 - DNA, 18 bp, Homo sapiens
gtttgagatcagcctggg

SEQ ID NO: 187439 - DNA, 19 bp, Homo sapiens
gtttgcagaaaagcacctg

SEQ ID NO: 187440 - DNA, 18 bp, Homo sapiens
gtttgccttctactttta

SEQ ID NO: 187441 - DNA, 23 bp, Homo sapiens
gtttggctgtgtctaaactgcat

SEQ ID NO: 187442 - DNA, 16 bp, Homo sapiens
gtttgtataacttctt

SEQ ID NO: 187443 - DNA, 15 bp, Homo sapiens
gtttgtctgtcttca

SEQ ID NO: 187444 - DNA, 22 bp, Homo sapiens
gttttaaatacgcactacatgt

SEQ ID NO: 187445 - DNA, 22 bp, Homo sapiens
gttttaacaatttcctttatat

SEQ ID NO: 187446 - DNA, 18 bp, Homo sapiens
gttttactgcagctttgt

SEQ ID NO: 187447 - DNA, 20 bp, Homo sapiens
gttttagctccttgactcct

SEQ ID NO: 187448 - DNA, 21 bp, Homo sapiens
gttttagctccttgactcctt

SEQ ID NO: 187449 - DNA, 19 bp, Homo sapiens
gttttatatttttatagac

SEQ ID NO: 187450 - DNA, 14 bp, Homo sapiens
gttttcagactcag

SEQ ID NO: 187451 - DNA, 16 bp, Homo sapiens
gttttcagtttgtata

SEQ ID NO: 187452 - DNA, 22 bp, Homo sapiens
gttttcataataaaactttaaa

SEQ ID NO: 187453 - DNA, 16 bp, Homo sapiens
gttttcattatctcaa

SEQ ID NO: 187454 - DNA, 23 bp, Homo sapiens
gttttctgagaaagactattcaa

SEQ ID NO: 187455 - DNA, 20 bp, Homo sapiens
gttttcttcccatcactgga

SEQ ID NO: 187456 - DNA, 14 bp, Homo sapiens
gttttgacattttt

SEQ ID NO: 187457 - DNA, 16 bp, Homo sapiens
gttttgacggatgatt

SEQ ID NO: 187458 - DNA, 23 bp, Homo sapiens
gttttgaggtttccttcagacag

SEQ ID NO: 187459 - DNA, 20 bp, Homo sapiens
tcactggggtcctggggcct

SEQ ID NO: 187460 - DNA, 18 bp, Homo sapiens
tcactgttgaaaattatt

SEQ ID NO: 187461 - DNA, 17 bp, Homo sapiens
tcacttgtgcagtgttg

SEQ ID NO: 187462 - DNA, 18 bp, Homo sapiens
tcactttaattctcatgt

SEQ ID NO: 187463 - DNA, 22 bp, Homo sapiens
tcactttaattctcatgtgatc

SEQ ID NO: 187464 - DNA, 14 bp, Homo sapiens
tcactttctagatt

SEQ ID NO: 187465 - DNA, 14 bp, Homo sapiens
tcacttttcagtga

SEQ ID NO: 187466 - DNA, 16 bp, Homo sapiens
tcacttttcagtgatg

SEQ ID NO: 187467 - DNA, 17 bp, Homo sapiens
tcagaaaaaaataaatg

SEQ ID NO: 187468 - DNA, 14 bp, Homo sapiens
tcagaaaagggaag

SEQ ID NO: 187469 - DNA, 16 bp, Homo sapiens
tcagaacccttggctt

SEQ ID NO: 187470 - DNA, 19 bp, Homo sapiens
tcagaaggagaaggaagga

SEQ ID NO: 187471 - DNA, 17 bp, Homo sapiens
tcagaagtttggcaata

SEQ ID NO: 187472 - DNA, 14 bp, Homo sapiens
tcagaatctaccca

SEQ ID NO: 187473 - DNA, 15 bp, Homo sapiens
tcagaccataatgtt

SEQ ID NO: 187474 - DNA, 23 bp, Homo sapiens
tcagaccataatgttacattatt

SEQ ID NO: 187475 - DNA, 13 bp, Homo sapiens
tcagaccccagcg

SEQ ID NO: 187476 - DNA, 14 bp, Homo sapiens
tcagacccccactc

SEQ ID NO: 187477 - DNA, 13 bp, Homo sapiens
tcagaccctaccc

SEQ ID NO: 187478 - DNA, 17 bp, Homo sapiens
tcagacgcctgaggaac

SEQ ID NO: 187479 - DNA, 20 bp, Homo sapiens
tcagagacaggaagtcttca

SEQ ID NO: 187480 - DNA, 17 bp, Homo sapiens
tcagagactcagggccc

SEQ ID NO: 187481 - DNA, 14 bp, Homo sapiens
tcagagagagtgtt

SEQ ID NO: 187482 - DNA, 21 bp, Homo sapiens
tcagagccacccctaaagaga

SEQ ID NO: 187483 - DNA, 20 bp, Homo sapiens
tcagagccgtggtcctttgg

SEQ ID NO: 187484 - DNA, 22 bp, Homo sapiens
tcagaggccctcgctgccagct

SEQ ID NO: 187485 - DNA, 20 bp, Homo sapiens
tcagatggaaccgcaggaag

SEQ ID NO: 187486 - DNA, 22 bp, Homo sapiens
tcagatggaaccgcaggaagct

SEQ ID NO: 187487 - DNA, 12 bp, Homo sapiens
tcagatttgaac

SEQ ID NO: 187488 - DNA, 13 bp, Homo sapiens
tcagcaaaaagca

SEQ ID NO: 187489 - DNA, 14 bp, Homo sapiens
tcagcaaaaagcaa

SEQ ID NO: 187490 - DNA, 20 bp, Homo sapiens
tcagcactgatttcacaaca

SEQ ID NO: 187491 - DNA, 12 bp, Homo sapiens
tcagcactgtcc

SEQ ID NO: 187492 - DNA, 21 bp, Homo sapiens
tcagccatgaggagttgctgt

SEQ ID NO: 187493 - DNA, 23 bp, Homo sapiens
tcagccatgaggagttgctgttt

SEQ ID NO: 187494 - DNA, 13 bp, Homo sapiens
tcagcccctcctc

SEQ ID NO: 187495 - DNA, 17 bp, Homo sapiens
tcagcccctcctctgcc

SEQ ID NO: 187496 - DNA, 13 bp, Homo sapiens
tcagccctccctg

SEQ ID NO: 187497 - DNA, 14 bp, Homo sapiens
tcagccctccctgc

SEQ ID NO: 187498 - DNA, 12 bp, Homo sapiens
tcagccctgggc

SEQ ID NO: 187499 - DNA, 19 bp, Homo sapiens
tcagcctagccgacctcag

SEQ ID NO: 187500 - DNA, 21 bp, Homo sapiens
tcagcctagccgacctcagcc

SEQ ID NO: 187501 - DNA, 14 bp, Homo sapiens
tcagcctcctgtgt

SEQ ID NO: 187502 - DNA, 22 bp, Homo sapiens
tcagcctcttaaagctgcctgt

SEQ ID NO: 187503 - DNA, 18 bp, Homo sapiens
tcagcctgtctcttccat

SEQ ID NO: 187504 - DNA, 22 bp, Homo sapiens
tcagccttccccttgcccaggg

SEQ ID NO: 187505 - DNA, 22 bp, Homo sapiens
tcagccttggataatgctgttg

SEQ ID NO: 187506 - DNA, 18 bp, Homo sapiens
tcagctcagcgccagcct

SEQ ID NO: 187507 - DNA, 21 bp, Homo sapiens
tcagctcccctcggagaagag

SEQ ID NO: 187508 - DNA, 15 bp, Homo sapiens
tcagctgaacctggg

SEQ ID NO: 187509 - DNA, 20 bp, Homo sapiens
tcagcttctatccttgactt

SEQ ID NO: 187510 - DNA, 15 bp, Homo sapiens
tcagcttgctgccct

SEQ ID NO: 187511 - DNA, 20 bp, Homo sapiens
tcagctttttgtcttttctg

SEQ ID NO: 187512 - DNA, 20 bp, Homo sapiens
tcaggaaaactgacagagga

SEQ ID NO: 187513 - DNA, 22 bp, Homo sapiens
tcaggaaaggaatcatttctat

SEQ ID NO: 187514 - DNA, 16 bp, Homo sapiens
tcaggaaggatgagca

SEQ ID NO: 187515 - DNA, 18 bp, Homo sapiens
tcaggaaggatgagcatt

SEQ ID NO: 187516 - DNA, 20 bp, Homo sapiens
tcaggaaggatgagcattta

SEQ ID NO: 187517 - DNA, 16 bp, Homo sapiens
tcaggacccagaggaa

SEQ ID NO: 187518 - DNA, 14 bp, Homo sapiens
tcaggaccttttga

SEQ ID NO: 187519 - DNA, 22 bp, Homo sapiens
tcaggagagtagaacagataat

SEQ ID NO: 187520 - DNA, 13 bp, Homo sapiens
tcaggaggctgag

SEQ ID NO: 187521 - DNA, 20 bp, Homo sapiens
tcaggagttagaggccagcc

SEQ ID NO: 187522 - DNA, 12 bp, Homo sapiens
tcaggagttcct

SEQ ID NO: 187523 - DNA, 20 bp, Homo sapiens
tcaggatcaaaccccgacca

SEQ ID NO: 187524 - DNA, 22 bp, Homo sapiens
tcaggatgcccagggccactct

SEQ ID NO: 187525 - DNA, 18 bp, Homo sapiens
tcaggcaggtgggatgga

SEQ ID NO: 187526 - DNA, 17 bp, Homo sapiens
tcaggccacggcagcct

SEQ ID NO: 187527 - DNA, 13 bp, Homo sapiens
tcaggctctgccc

SEQ ID NO: 187528 - DNA, 16 bp, Homo sapiens
tcaggctgctggagga

SEQ ID NO: 187529 - DNA, 17 bp, Homo sapiens
tcaggctgctggaggaa

SEQ ID NO: 187530 - DNA, 16 bp, Homo sapiens
tcaggctggtgggagg

SEQ ID NO: 187531 - DNA, 17 bp, Homo sapiens
tcaggctggtgggaggg

SEQ ID NO: 187532 - DNA, 21 bp, Homo sapiens
tcagggacagagacacctgca

SEQ ID NO: 187533 - DNA, 23 bp, Homo sapiens
tcagggacagagacacctgcacc

SEQ ID NO: 187534 - DNA, 12 bp, Homo sapiens
tcagggacccct

SEQ ID NO: 187535 - DNA, 20 bp, Homo sapiens
tcagggattttttttttaaa

SEQ ID NO: 187536 - DNA, 22 bp, Homo sapiens
tcagggcactgctgctgccttt

SEQ ID NO: 187537 - DNA, 14 bp, Homo sapiens
tcagggccccagca

SEQ ID NO: 187538 - DNA, 14 bp, Homo sapiens
tcagggctcctggg

SEQ ID NO: 187539 - DNA, 12 bp, Homo sapiens
tcaggggccaga

SEQ ID NO: 187540 - DNA, 12 bp, Homo sapiens
tcagggggccag

SEQ ID NO: 187541 - DNA, 13 bp, Homo sapiens
tcagggggccagg

SEQ ID NO: 187542 - DNA, 15 bp, Homo sapiens
tcagggttctcctct

SEQ ID NO: 187543 - DNA, 13 bp, Homo sapiens
tcaggtagctgcc

SEQ ID NO: 187544 - DNA, 17 bp, Homo sapiens
tcaggtattaagaaaat

SEQ ID NO: 187545 - DNA, 12 bp, Homo sapiens
tcaggtccctgc

SEQ ID NO: 187546 - DNA, 19 bp, Homo sapiens
tcaggtctcccacgtggga

SEQ ID NO: 187547 - DNA, 21 bp, Homo sapiens
tcaggtctcccacgtgggaga

SEQ ID NO: 187548 - DNA, 21 bp, Homo sapiens
tcaggtgagaagcagaggaag

SEQ ID NO: 187549 - DNA, 14 bp, Homo sapiens
tcaggtgttgccaa

SEQ ID NO: 187550 - DNA, 14 bp, Homo sapiens
tcaggttccatccc

SEQ ID NO: 187551 - DNA, 22 bp, Homo sapiens
tcaggttgtctgaagtcactgc

SEQ ID NO: 187552 - DNA, 13 bp, Homo sapiens
tcaggttttgtaa

SEQ ID NO: 187553 - DNA, 20 bp, Homo sapiens
tcagtatgttgtcaaagaga

SEQ ID NO: 187554 - DNA, 19 bp, Homo sapiens
tcagtattttggagaaatt

SEQ ID NO: 187555 - DNA, 18 bp, Homo sapiens
tcagtccccgtgaaggag

SEQ ID NO: 187556 - DNA, 18 bp, Homo sapiens
tcagtcctcccctcacag

SEQ ID NO: 187557 - DNA, 22 bp, Homo sapiens
tcagtcctcccctcacagcctc

SEQ ID NO: 187558 - DNA, 13 bp, Homo sapiens
tcagtctctgagc

SEQ ID NO: 187559 - DNA, 17 bp, Homo sapiens
tcagtctctgagcagtg

SEQ ID NO: 187560 - DNA, 12 bp, Homo sapiens
tcagtgctccct

SEQ ID NO: 187561 - DNA, 19 bp, Homo sapiens
tcagtgctccctcacatgt

SEQ ID NO: 187562 - DNA, 15 bp, Homo sapiens
tcagtgcttcgcaga

SEQ ID NO: 187563 - DNA, 22 bp, Homo sapiens
tcagtgggaacgtgactgcccc

SEQ ID NO: 187564 - DNA, 23 bp, Homo sapiens
tcagtgggaacgtgactgcccca

SEQ ID NO: 187565 - DNA, 13 bp, Homo sapiens
tcagtgggagaaa

SEQ ID NO: 187566 - DNA, 16 bp, Homo sapiens
tcagtgggagaaaaca

SEQ ID NO: 187567 - DNA, 15 bp, Homo sapiens
tcagtgtatttgtat

SEQ ID NO: 187568 - DNA, 16 bp, Homo sapiens
tcagtgtatttgtatt

SEQ ID NO: 187569 - DNA, 15 bp, Homo sapiens
tcagtgttaaatgtg

SEQ ID NO: 187570 - DNA, 14 bp, Homo sapiens
tcagttactcagcc

SEQ ID NO: 187571 - DNA, 16 bp, Homo sapiens
tcagttactcagccct

SEQ ID NO: 187572 - DNA, 17 bp, Homo sapiens
tcagttactcagccctg

SEQ ID NO: 187573 - DNA, 16 bp, Homo sapiens
tcagttttatcatttt

SEQ ID NO: 187574 - DNA, 19 bp, Homo sapiens
tcagttttatcattttcaa

SEQ ID NO: 187575 - DNA, 22 bp, Homo sapiens
tcataaaaagcctgcaatttca

SEQ ID NO: 187576 - DNA, 15 bp, Homo sapiens
tcataagtatttcaa

SEQ ID NO: 187577 - DNA, 18 bp, Homo sapiens
tcatacctatcatcttaa

SEQ ID NO: 187578 - DNA, 13 bp, Homo sapiens
tcatactgaagat

SEQ ID NO: 187579 - DNA, 18 bp, Homo sapiens
tcatagcagattttaatt

SEQ ID NO: 187580 - DNA, 11 bp, Homo sapiens
tcatagcagct

SEQ ID NO: 187581 - DNA, 18 bp, Homo sapiens
tcatataagattcatatt

SEQ ID NO: 187582 - DNA, 15 bp, Homo sapiens
tcatataataaatgt

SEQ ID NO: 187583 - DNA, 16 bp, Homo sapiens
tcatataataaatgta

SEQ ID NO: 187584 - DNA, 21 bp, Homo sapiens
tcatatgtaccatgtacatga

SEQ ID NO: 187585 - DNA, 16 bp, Homo sapiens
tcatatttacttctta

SEQ ID NO: 187586 - DNA, 22 bp, Homo sapiens
tcatatttacttcttatacatt

SEQ ID NO: 187587 - DNA, 15 bp, Homo sapiens
tcatattttctttca

SEQ ID NO: 187588 - DNA, 15 bp, Homo sapiens
tcatattttgtatat

SEQ ID NO: 187589 - DNA, 15 bp, Homo sapiens
tcatcactggatgaa

SEQ ID NO: 187590 - DNA, 22 bp, Homo sapiens
tcatcactggatgaagattctc

SEQ ID NO: 187591 - DNA, 14 bp, Homo sapiens
tcatcataaaataa

SEQ ID NO: 187592 - DNA, 14 bp, Homo sapiens
tcatcattctctgt

SEQ ID NO: 187593 - DNA, 22 bp, Homo sapiens
tcatcattctctgtctcatcca

SEQ ID NO: 187594 - DNA, 22 bp, Homo sapiens
tcatccaatctaaccacatcaa

SEQ ID NO: 187595 - DNA, 22 bp, Homo sapiens
tcatccactagtgcaaatcata

SEQ ID NO: 187596 - DNA, 11 bp, Homo sapiens
tcatccatcat

SEQ ID NO: 187597 - DNA, 12 bp, Homo sapiens
tcatccatcatc

SEQ ID NO: 187598 - DNA, 15 bp, Homo sapiens
tcatccatcatcatg

SEQ ID NO: 187599 - DNA, 16 bp, Homo sapiens
tcatccatcatcatgt

SEQ ID NO: 187600 - DNA, 18 bp, Homo sapiens
tcatcccattctgcgtca

SEQ ID NO: 187601 - DNA, 23 bp, Homo sapiens
tcatcccgagcacctccacatcc

SEQ ID NO: 187602 - DNA, 21 bp, Homo sapiens
tcatccctatgggattcagtg

SEQ ID NO: 187603 - DNA, 17 bp, Homo sapiens
tcatcctttccagcatg

SEQ ID NO: 187604 - DNA, 21 bp, Homo sapiens
tcatctcctgccttcctcctg

SEQ ID NO: 187605 - DNA, 18 bp, Homo sapiens
tcatctgtccctccggga

SEQ ID NO: 187606 - DNA, 17 bp, Homo sapiens
tcatctgtttttctttt

SEQ ID NO: 187607 - DNA, 19 bp, Homo sapiens
tcatcttgaccaagcagga

SEQ ID NO: 187608 - DNA, 11 bp, Homo sapiens
tcatgaaaatt

SEQ ID NO: 187609 - DNA, 14 bp, Homo sapiens
tcatgaaatatgca

SEQ ID NO: 187610 - DNA, 19 bp, Homo sapiens
tcatgaagatatttttcca

SEQ ID NO: 187611 - DNA, 21 bp, Homo sapiens
tcatgacatgttatatatttt

SEQ ID NO: 187612 - DNA, 13 bp, Homo sapiens
tcatgatctccct

SEQ ID NO: 187613 - DNA, 16 bp, Homo sapiens
tcatgatctccctgcc

SEQ ID NO: 187614 - DNA, 18 bp, Homo sapiens
tcatgatctccctgccgc

SEQ ID NO: 187615 - DNA, 19 bp, Homo sapiens
tcatgatctccctgccgcc

SEQ ID NO: 187616 - DNA, 22 bp, Homo sapiens
tcatgatctccctgccgcctca

SEQ ID NO: 187617 - DNA, 23 bp, Homo sapiens
tcatgatttcatttcaactgttt

SEQ ID NO: 187618 - DNA, 14 bp, Homo sapiens
tcatgattttgaaa

SEQ ID NO: 187619 - DNA, 16 bp, Homo sapiens
tcatgcatctccacct

SEQ ID NO: 187620 - DNA, 20 bp, Homo sapiens
tcatgcatctccacctgctc

SEQ ID NO: 187621 - DNA, 22 bp, Homo sapiens
tcatgccaccatggccagccaa

SEQ ID NO: 187622 - DNA, 13 bp, Homo sapiens
gtttttaagctgt

SEQ ID NO: 187623 - DNA, 21 bp, Homo sapiens
gtttttaagggtttgtggaaa

SEQ ID NO: 187624 - DNA, 16 bp, Homo sapiens
gtttttatggggctga

SEQ ID NO: 187625 - DNA, 18 bp, Homo sapiens
gtttttatggggctgaac

SEQ ID NO: 187626 - DNA, 18 bp, Homo sapiens
gtttttctaggcctgggg

SEQ ID NO: 187627 - DNA, 16 bp, Homo sapiens
gtttttctgggtggcc

SEQ ID NO: 187628 - DNA, 18 bp, Homo sapiens
gtttttggtttttaaaac

SEQ ID NO: 187629 - DNA, 12 bp, Homo sapiens
gttttttgaaaa

SEQ ID NO: 187630 - DNA, 21 bp, Homo sapiens
taaaaaaacaatcatttgctt

SEQ ID NO: 187631 - DNA, 23 bp, Homo sapiens
taaaaaactgctgactgttttct

SEQ ID NO: 187632 - DNA, 15 bp, Homo sapiens
taaaaaacttgtaaa

SEQ ID NO: 187633 - DNA, 14 bp, Homo sapiens
taaaaaccaagaag

SEQ ID NO: 187634 - DNA, 17 bp, Homo sapiens
taaaaactgactcctta

SEQ ID NO: 187635 - DNA, 16 bp, Homo sapiens
taaaaagtcaatgttt

SEQ ID NO: 187636 - DNA, 14 bp, Homo sapiens
taaaaagtcttcac

SEQ ID NO: 187637 - DNA, 17 bp, Homo sapiens
taaaaagtcttcactct

SEQ ID NO: 187638 - DNA, 17 bp, Homo sapiens
taaaaataaatttggtt

SEQ ID NO: 187639 - DNA, 10 bp, Homo sapiens
taaaaatata

SEQ ID NO: 187640 - DNA, 14 bp, Homo sapiens
taaaaatataaaac

SEQ ID NO: 187641 - DNA, 15 bp, Homo sapiens
taaaaatataaaact

SEQ ID NO: 187642 - DNA, 11 bp, Homo sapiens
taaaaatgcaa

SEQ ID NO: 187643 - DNA, 18 bp, Homo sapiens
taaaaatggtttaaatgg

SEQ ID NO: 187644 - DNA, 22 bp, Homo sapiens
taaaaattgttaatttttccta

SEQ ID NO: 187645 - DNA, 19 bp, Homo sapiens
taaaacacttccataatct

SEQ ID NO: 187646 - DNA, 14 bp, Homo sapiens
taaaacattaagaa

SEQ ID NO: 187647 - DNA, 13 bp, Homo sapiens
taaaaccacagca

SEQ ID NO: 187648 - DNA, 11 bp, Homo sapiens
taaaacctttc

SEQ ID NO: 187649 - DNA, 16 bp, Homo sapiens
taaaacctttcaaatt

SEQ ID NO: 187650 - DNA, 20 bp, Homo sapiens
taaaacctttcaaatttcac

SEQ ID NO: 187651 - DNA, 15 bp, Homo sapiens
taaaactttcctcgc

SEQ ID NO: 187652 - DNA, 13 bp, Homo sapiens
taaaagaatattt

SEQ ID NO: 187653 - DNA, 15 bp, Homo sapiens
taaaagcataaatgc

SEQ ID NO: 187654 - DNA, 13 bp, Homo sapiens
taaaataaagtat

SEQ ID NO: 187655 - DNA, 24 bp, Homo sapiens
taaaataactagtgttgcttggac

SEQ ID NO: 187656 - DNA, 15 bp, Homo sapiens
taaaataatgggatt

SEQ ID NO: 187657 - DNA, 21 bp, Homo sapiens
taaaatacacactcaaatcaa

SEQ ID NO: 187658 - DNA, 14 bp, Homo sapiens
taaaatagcttgta

SEQ ID NO: 187659 - DNA, 18 bp, Homo sapiens
taaaatatagctgtacaa

SEQ ID NO: 187660 - DNA, 19 bp, Homo sapiens
taaaatatagctgtacaaa

SEQ ID NO: 187661 - DNA, 14 bp, Homo sapiens
taaaatctgtcacg

SEQ ID NO: 187662 - DNA, 16 bp, Homo sapiens
taaaatcttgaaaatg

SEQ ID NO: 187663 - DNA, 14 bp, Homo sapiens
taaaatgattgtaa

SEQ ID NO: 187664 - DNA, 17 bp, Homo sapiens
taaaatgattgtaaaat

SEQ ID NO: 187665 - DNA, 20 bp, Homo sapiens
taaaatgattgtaaaatagc

SEQ ID NO: 187666 - DNA, 22 bp, Homo sapiens
taaaatgattgtaaaatagctt

SEQ ID NO: 187667 - DNA, 13 bp, Homo sapiens
taaaatgtgaagt

SEQ ID NO: 187668 - DNA, 14 bp, Homo sapiens
taaaatgttgaaaa

SEQ ID NO: 187669 - DNA, 17 bp, Homo sapiens
taaaatgttgaaaagtc

SEQ ID NO: 187670 - DNA, 18 bp, Homo sapiens
taaaatgttgaaaagtca

SEQ ID NO: 187671 - DNA, 18 bp, Homo sapiens
taaacacccttcacatac

SEQ ID NO: 187672 - DNA, 13 bp, Homo sapiens
taaacagcagtgt

SEQ ID NO: 187673 - DNA, 12 bp, Homo sapiens
taaacagtgcct

SEQ ID NO: 187674 - DNA, 19 bp, Homo sapiens
taaaccaaggctagaacca

SEQ ID NO: 187675 - DNA, 22 bp, Homo sapiens
taaaccaccagtgcccaaagtc

SEQ ID NO: 187676 - DNA, 13 bp, Homo sapiens
taaactatcagtt

SEQ ID NO: 187677 - DNA, 19 bp, Homo sapiens
taaactcagggacagagcc

SEQ ID NO: 187678 - DNA, 22 bp, Homo sapiens
taaactctaaacattaatcaat

SEQ ID NO: 187679 - DNA, 18 bp, Homo sapiens
taaactctctttgggaat

SEQ ID NO: 187680 - DNA, 16 bp, Homo sapiens
taaactgactttatcc

SEQ ID NO: 187681 - DNA, 16 bp, Homo sapiens
taaactgcattagaaa

SEQ ID NO: 187682 - DNA, 22 bp, Homo sapiens
taaacttggtttttaaaaaact

SEQ ID NO: 187683 - DNA, 20 bp, Homo sapiens
taaactttacccaaaaacta

SEQ ID NO: 187684 - DNA, 17 bp, Homo sapiens
taaagaaaaagtcatcc

SEQ ID NO: 187685 - DNA, 18 bp, Homo sapiens
taaagagttagtttgagt

SEQ ID NO: 187686 - DNA, 12 bp, Homo sapiens
taaagagttctt

SEQ ID NO: 187687 - DNA, 11 bp, Homo sapiens
taaagatgatc

SEQ ID NO: 187688 - DNA, 21 bp, Homo sapiens
taaagatgatctactcagaaa

SEQ ID NO: 187689 - DNA, 15 bp, Homo sapiens
taaagcaatatgcat

SEQ ID NO: 187690 - DNA, 23 bp, Homo sapiens
taaagctaaaatgattttatctg

SEQ ID NO: 187691 - DNA, 16 bp, Homo sapiens
taaagctgcctgtagt

SEQ ID NO: 187692 - DNA, 17 bp, Homo sapiens
taaagctgcctgtagtt

SEQ ID NO: 187693 - DNA, 22 bp, Homo sapiens
taaaggctcgattttgtatctg

SEQ ID NO: 187694 - DNA, 20 bp, Homo sapiens
taaaggttgacaataaatgt

SEQ ID NO: 187695 - DNA, 14 bp, Homo sapiens
taaagtaaagctaa

SEQ ID NO: 187696 - DNA, 19 bp, Homo sapiens
taaagtatatatagaatct

SEQ ID NO: 187697 - DNA, 19 bp, Homo sapiens
taaagtatggtattgaaac

SEQ ID NO: 187698 - DNA, 15 bp, Homo sapiens
taaagtatgtaaaca

SEQ ID NO: 187699 - DNA, 16 bp, Homo sapiens
taaagtgataatttct

SEQ ID NO: 187700 - DNA, 15 bp, Homo sapiens
taaataaaatgacca

SEQ ID NO: 187701 - DNA, 13 bp, Homo sapiens
taaatacagtctt

SEQ ID NO: 187702 - DNA, 22 bp, Homo sapiens
taaatacagtcttccatttgca

SEQ ID NO: 187703 - DNA, 18 bp, Homo sapiens
taaatagagtatatgcac

SEQ ID NO: 187704 - DNA, 19 bp, Homo sapiens
taaatagtaaaaataaaat

SEQ ID NO: 187705 - DNA, 14 bp, Homo sapiens
taaatatataaaaa

SEQ ID NO: 187706 - DNA, 15 bp, Homo sapiens
taaatatataaatat

SEQ ID NO: 187707 - DNA, 18 bp, Homo sapiens
taaatatatataaaccta

SEQ ID NO: 187708 - DNA, 19 bp, Homo sapiens
taaatatatataaacctaa

SEQ ID NO: 187709 - DNA, 17 bp, Homo sapiens
taaatatatttaagata

SEQ ID NO: 187710 - DNA, 18 bp, Homo sapiens
taaatctctaatatggca

SEQ ID NO: 187711 - DNA, 13 bp, Homo sapiens
taaatgaatgttt

SEQ ID NO: 187712 - DNA, 17 bp, Homo sapiens
taaatgctttatgcaaa

SEQ ID NO: 187713 - DNA, 20 bp, Homo sapiens
taaatgtctagttgtaacac

SEQ ID NO: 187714 - DNA, 19 bp, Homo sapiens
taaatgtgatgaatactgt

SEQ ID NO: 187715 - DNA, 11 bp, Homo sapiens
taaattatttt

SEQ ID NO: 187716 - DNA, 15 bp, Homo sapiens
taaattgctccttga

SEQ ID NO: 187717 - DNA, 17 bp, Homo sapiens
taaatttatttcaaaaa

SEQ ID NO: 187718 - DNA, 14 bp, Homo sapiens
taaatttgaatgtt

SEQ ID NO: 187719 - DNA, 22 bp, Homo sapiens
taaatttgaatgttaagcagat

SEQ ID NO: 187720 - DNA, 18 bp, Homo sapiens
taaattttgagttctaca

SEQ ID NO: 187721 - DNA, 22 bp, Homo sapiens
taacaactatgatttggaaaat

SEQ ID NO: 187722 - DNA, 15 bp, Homo sapiens
taacaatttccttta

SEQ ID NO: 187723 - DNA, 12 bp, Homo sapiens
taacagctgtgg

SEQ ID NO: 187724 - DNA, 14 bp, Homo sapiens
taacaggtctcctc

SEQ ID NO: 187725 - DNA, 18 bp, Homo sapiens
taacaggtctcctcttaa

SEQ ID NO: 187726 - DNA, 14 bp, Homo sapiens
taacagtcatttaa

SEQ ID NO: 187727 - DNA, 23 bp, Homo sapiens
taacatcctttctattgaaaaat

SEQ ID NO: 187728 - DNA, 14 bp, Homo sapiens
taacatctaaaaat

SEQ ID NO: 187729 - DNA, 23 bp, Homo sapiens
taacatggacatgatcttcttta

SEQ ID NO: 187730 - DNA, 14 bp, Homo sapiens
taacccaactctcc

SEQ ID NO: 187731 - DNA, 16 bp, Homo sapiens
taacccctttcctgcg

SEQ ID NO: 187732 - DNA, 18 bp, Homo sapiens
taacctcatcttcttcac

SEQ ID NO: 187733 - DNA, 17 bp, Homo sapiens
taacgcgtcttcctgag

SEQ ID NO: 187734 - DNA, 17 bp, Homo sapiens
taactactccggagaca

SEQ ID NO: 187735 - DNA, 14 bp, Homo sapiens
taactcatcataaa

SEQ ID NO: 187736 - DNA, 14 bp, Homo sapiens
taactccagtgaag

SEQ ID NO: 187737 - DNA, 15 bp, Homo sapiens
taactgaaggagaag

SEQ ID NO: 187738 - DNA, 16 bp, Homo sapiens
taactgaaggagaagg

SEQ ID NO: 187739 - DNA, 18 bp, Homo sapiens
taactgccttaaaacttt

SEQ ID NO: 187740 - DNA, 22 bp, Homo sapiens
taactggaagcatgtaggagaa

SEQ ID NO: 187741 - DNA, 18 bp, Homo sapiens
taactgtgaagtttacat

SEQ ID NO: 187742 - DNA, 18 bp, Homo sapiens
taacttaaaaaaatgaca

SEQ ID NO: 187743 - DNA, 16 bp, Homo sapiens
taacttaaaatatttt

SEQ ID NO: 187744 - DNA, 17 bp, Homo sapiens
taacttccaatttacat

SEQ ID NO: 187745 - DNA, 20 bp, Homo sapiens
taagaaaaaataacacacat

SEQ ID NO: 187746 - DNA, 17 bp, Homo sapiens
taagaaaatattttgtc

SEQ ID NO: 187747 - DNA, 20 bp, Homo sapiens
taagaaacacactgaggcag

SEQ ID NO: 187748 - DNA, 21 bp, Homo sapiens
taagaaacacactgaggcagg

SEQ ID NO: 187749 - DNA, 23 bp, Homo sapiens
taagaaacacactgaggcaggga

SEQ ID NO: 187750 - DNA, 19 bp, Homo sapiens
taagaaatcaaagagagaa

SEQ ID NO: 187751 - DNA, 13 bp, Homo sapiens
taagaagtgaaaa

SEQ ID NO: 187752 - DNA, 17 bp, Homo sapiens
taagaataaaatgttga

SEQ ID NO: 187753 - DNA, 19 bp, Homo sapiens
taagacagtcccatcaaaa

SEQ ID NO: 187754 - DNA, 18 bp, Homo sapiens
taagagaaagaaaatgaa

SEQ ID NO: 187755 - DNA, 19 bp, Homo sapiens
taagagaatattttaagta

SEQ ID NO: 187756 - DNA, 21 bp, Homo sapiens
taagagtagaaactgcaggga

SEQ ID NO: 187757 - DNA, 15 bp, Homo sapiens
taagatatttttcat

SEQ ID NO: 187758 - DNA, 19 bp, Homo sapiens
taagatatttttcatgatt

SEQ ID NO: 187759 - DNA, 13 bp, Homo sapiens
taagcactacata

SEQ ID NO: 187760 - DNA, 22 bp, Homo sapiens
taagcactacataaactgactt

SEQ ID NO: 187761 - DNA, 17 bp, Homo sapiens
taagcagaccactgata

SEQ ID NO: 187762 - DNA, 21 bp, Homo sapiens
taagcagatttaacaattcca

SEQ ID NO: 187763 - DNA, 14 bp, Homo sapiens
taagccaagggcct

SEQ ID NO: 187764 - DNA, 13 bp, Homo sapiens
taagccagacatc

SEQ ID NO: 187765 - DNA, 21 bp, Homo sapiens
taagccagacatcaacagata

SEQ ID NO: 187766 - DNA, 22 bp, Homo sapiens
taagctgttactgtcttcagta

SEQ ID NO: 187767 - DNA, 16 bp, Homo sapiens
taagctgtttccatag

SEQ ID NO: 187768 - DNA, 17 bp, Homo sapiens
taaggatactttacatg

SEQ ID NO: 187769 - DNA, 19 bp, Homo sapiens
taaggccattattgtactt

SEQ ID NO: 187770 - DNA, 13 bp, Homo sapiens
taaggctgaggaa

SEQ ID NO: 187771 - DNA, 14 bp, Homo sapiens
tattgtacctctct

SEQ ID NO: 187772 - DNA, 17 bp, Homo sapiens
tattgtgtgttatttaa

SEQ ID NO: 187773 - DNA, 19 bp, Homo sapiens
tattgtgtgttatttaaat

SEQ ID NO: 187774 - DNA, 17 bp, Homo sapiens
tattgtttaaaatcatt

SEQ ID NO: 187775 - DNA, 18 bp, Homo sapiens
tatttaagcctcatattt

SEQ ID NO: 187776 - DNA, 19 bp, Homo sapiens
tatttaatgataagtaaat

SEQ ID NO: 187777 - DNA, 21 bp, Homo sapiens
tatttacatgaattgcatttt

SEQ ID NO: 187778 - DNA, 21 bp, Homo sapiens
tatttactgagcttctctgtg

SEQ ID NO: 187779 - DNA, 19 bp, Homo sapiens
tatttagattgttaaaata

SEQ ID NO: 187780 - DNA, 19 bp, Homo sapiens
tatttataacaacctaaat

SEQ ID NO: 187781 - DNA, 22 bp, Homo sapiens
tatttataactcatcataaaat

SEQ ID NO: 187782 - DNA, 17 bp, Homo sapiens
tatttatctctatttaa

SEQ ID NO: 187783 - DNA, 20 bp, Homo sapiens
tatttatgcctctgtattta

SEQ ID NO: 187784 - DNA, 21 bp, Homo sapiens
tatttatgtctatttaagcct

SEQ ID NO: 187785 - DNA, 14 bp, Homo sapiens
tatttatttattta

SEQ ID NO: 187786 - DNA, 12 bp, Homo sapiens
tcccagaaatta

SEQ ID NO: 187787 - DNA, 17 bp, Homo sapiens
tcccagagacaggaaaa

SEQ ID NO: 187788 - DNA, 16 bp, Homo sapiens
tcccagatacttgggg

SEQ ID NO: 187789 - DNA, 18 bp, Homo sapiens
tcccagatacttgggggg

SEQ ID NO: 187790 - DNA, 19 bp, Homo sapiens
tcccagcactttgggaggc

SEQ ID NO: 187791 - DNA, 23 bp, Homo sapiens
tcccagcactttgggaggccaag

SEQ ID NO: 187792 - DNA, 15 bp, Homo sapiens
tcccagctactcagg

SEQ ID NO: 187793 - DNA, 17 bp, Homo sapiens
tcccagctactcaggag

SEQ ID NO: 187794 - DNA, 17 bp, Homo sapiens
tcccagctacttgggag

SEQ ID NO: 187795 - DNA, 19 bp, Homo sapiens
tcccagctacttgggaggc

SEQ ID NO: 187796 - DNA, 16 bp, Homo sapiens
tcccagctctccctct

SEQ ID NO: 187797 - DNA, 21 bp, Homo sapiens
tcccaggacaccacacccagc

SEQ ID NO: 187798 - DNA, 23 bp, Homo sapiens
tcccaggacaccacacccagcct

SEQ ID NO: 187799 - DNA, 15 bp, Homo sapiens
tcccaggccaggctc

SEQ ID NO: 187800 - DNA, 22 bp, Homo sapiens
tcccagtcatttaataaatgtg

SEQ ID NO: 187801 - DNA, 17 bp, Homo sapiens
tgaggaatgtatatgtt

SEQ ID NO: 187802 - DNA, 20 bp, Homo sapiens
tgaggatgggaaggagggag

SEQ ID NO: 187803 - DNA, 14 bp, Homo sapiens
tgaggcaagagaat

SEQ ID NO: 187804 - DNA, 13 bp, Homo sapiens
tgaggcagaagaa

SEQ ID NO: 187805 - DNA, 18 bp, Homo sapiens
tgaggcagaagaattgaa

SEQ ID NO: 187806 - DNA, 16 bp, Homo sapiens
tgaggcagacagcagc

SEQ ID NO: 187807 - DNA, 13 bp, Homo sapiens
tgaggcagggaag

SEQ ID NO: 187808 - DNA, 13 bp, Homo sapiens
tgaggccagggca

SEQ ID NO: 187809 - DNA, 17 bp, Homo sapiens
tgaggcctggactttcc

SEQ ID NO: 187810 - DNA, 19 bp, Homo sapiens
tgaggcctggactttcctg

SEQ ID NO: 187811 - DNA, 14 bp, Homo sapiens
tgagggcccagagc

SEQ ID NO: 187812 - DNA, 20 bp, Homo sapiens
tgaggggtctccaggaggag

SEQ ID NO: 187813 - DNA, 22 bp, Homo sapiens
tgagggtcagagaggagtcaga

SEQ ID NO: 187814 - DNA, 20 bp, Homo sapiens
tgaggtgcagagtgcccaga

SEQ ID NO: 187815 - DNA, 22 bp, Homo sapiens
tgaggtggaagccctccttcca

SEQ ID NO: 187816 - DNA, 12 bp, Homo sapiens
tgaggtgggagg

SEQ ID NO: 187817 - DNA, 21 bp, Homo sapiens
tgaggtttccttcagacagat

SEQ ID NO: 187818 - DNA, 21 bp, Homo sapiens
tgagtatctcctcgcaagctg

SEQ ID NO: 187819 - DNA, 13 bp, Homo sapiens
tgagtcaccagga

SEQ ID NO: 187820 - DNA, 22 bp, Homo sapiens
tgagtcatgatctccctgccgc

SEQ ID NO: 187821 - DNA, 13 bp, Homo sapiens
tgagtccagaagt

SEQ ID NO: 187822 - DNA, 17 bp, Homo sapiens
tgagtgagcctggctct

SEQ ID NO: 187823 - DNA, 23 bp, Homo sapiens
tgagtgggggatcacagcctctg

SEQ ID NO: 187824 - DNA, 21 bp, Homo sapiens
tgagtgggtgaataatacagt

SEQ ID NO: 187825 - DNA, 11 bp, Homo sapiens
tgagtgtacca

SEQ ID NO: 187826 - DNA, 16 bp, Homo sapiens
tgagttgattcagctc

SEQ ID NO: 187827 - DNA, 19 bp, Homo sapiens
tgagttgattcagctctgc

SEQ ID NO: 187828 - DNA, 19 bp, Homo sapiens
tgataactgcaattttaat

SEQ ID NO: 187829 - DNA, 16 bp, Homo sapiens
tgataaggatcagaac

SEQ ID NO: 187830 - DNA, 19 bp, Homo sapiens
tgatacgcaacataattaa

SEQ ID NO: 187831 - DNA, 13 bp, Homo sapiens
tgatagctttatt

SEQ ID NO: 187832 - DNA, 19 bp, Homo sapiens
tgatataaatcagattctt

SEQ ID NO: 187833 - DNA, 19 bp, Homo sapiens
tgatatataagtgtacata

SEQ ID NO: 187834 - DNA, 22 bp, Homo sapiens
tgatatataagtgtacatatgt

SEQ ID NO: 187835 - DNA, 19 bp, Homo sapiens
tgatatttccccatggttt

SEQ ID NO: 187836 - DNA, 19 bp, Homo sapiens
tgatattttcaacgcagcc

SEQ ID NO: 187837 - DNA, 21 bp, Homo sapiens
tgatattttcaacgcagccct

SEQ ID NO: 187838 - DNA, 15 bp, Homo sapiens
tgatcaaattcattt

SEQ ID NO: 187839 - DNA, 21 bp, Homo sapiens
tgatcagagccgtggtccttt

SEQ ID NO: 187840 - DNA, 19 bp, Homo sapiens
tgatccagcctctcccctg

SEQ ID NO: 187841 - DNA, 20 bp, Homo sapiens
tgatccttttatgttattta

SEQ ID NO: 187842 - DNA, 17 bp, Homo sapiens
tgatcgcctttcccagg

SEQ ID NO: 187843 - DNA, 13 bp, Homo sapiens
tgatctccctgcc

SEQ ID NO: 187844 - DNA, 15 bp, Homo sapiens
tgatctccctgccgc

SEQ ID NO: 187845 - DNA, 14 bp, Homo sapiens
tgatgaactttctc

SEQ ID NO: 187846 - DNA, 20 bp, Homo sapiens
tgatgatcctaggcatttgc

SEQ ID NO: 187847 - DNA, 19 bp, Homo sapiens
tgatgggagagtagatggt

SEQ ID NO: 187848 - DNA, 14 bp, Homo sapiens
tgatggttcccctg

SEQ ID NO: 187849 - DNA, 13 bp, Homo sapiens
tgatgtattctag

SEQ ID NO: 187850 - DNA, 14 bp, Homo sapiens
tgatgtgtttattt

SEQ ID NO: 187851 - DNA, 17 bp, Homo sapiens
tgatgttgagggaacag

SEQ ID NO: 187852 - DNA, 20 bp, Homo sapiens
tgattaaccacttcagctga

SEQ ID NO: 187853 - DNA, 17 bp, Homo sapiens
tgattacacaaaacaaa

SEQ ID NO: 187854 - DNA, 13 bp, Homo sapiens
tgattacacagtt

SEQ ID NO: 187855 - DNA, 14 bp, Homo sapiens
tgattacacagttg

SEQ ID NO: 187856 - DNA, 16 bp, Homo sapiens
tgattaccagggactg

SEQ ID NO: 187857 - DNA, 16 bp, Homo sapiens
tgattagtaaagaaat

SEQ ID NO: 187858 - DNA, 14 bp, Homo sapiens
tgattattcagtgt

SEQ ID NO: 187859 - DNA, 12 bp, Homo sapiens
tgattcacagtg

SEQ ID NO: 187860 - DNA, 12 bp, Homo sapiens
tgattcagtgtt

SEQ ID NO: 187861 - DNA, 24 bp, Homo sapiens
tgattcagtgttaaatgtgatgaa

SEQ ID NO: 187862 - DNA, 22 bp, Homo sapiens
tgattccttgatggagatattt

SEQ ID NO: 187863 - DNA, 17 bp, Homo sapiens
tgattcctttgaagagg

SEQ ID NO: 187864 - DNA, 21 bp, Homo sapiens
tgattcctttgaagaggaaaa

SEQ ID NO: 187865 - DNA, 15 bp, Homo sapiens
tgattctgtgtgttt

SEQ ID NO: 187866 - DNA, 15 bp, Homo sapiens
tgattggattattca

SEQ ID NO: 187867 - DNA, 18 bp, Homo sapiens
tgattggattattcattt

SEQ ID NO: 187868 - DNA, 19 bp, Homo sapiens
tgattggattattcattta

SEQ ID NO: 187869 - DNA, 14 bp, Homo sapiens
tgattgtaaaatag

SEQ ID NO: 187870 - DNA, 23 bp, Homo sapiens
tgattgtaaaatagcttgtatag

SEQ ID NO: 187871 - DNA, 16 bp, Homo sapiens
tgattgtttgctctga

SEQ ID NO: 187872 - DNA, 16 bp, Homo sapiens
tgatttatagtttgta

SEQ ID NO: 187873 - DNA, 22 bp, Homo sapiens
tgatttatagtttgtacatgca

SEQ ID NO: 187874 - DNA, 13 bp, Homo sapiens
tgatttatgcatg

SEQ ID NO: 187875 - DNA, 22 bp, Homo sapiens
tgatttatgcatggaaacctga

SEQ ID NO: 187876 - DNA, 16 bp, Homo sapiens
tgatttcacaacagat

SEQ ID NO: 187877 - DNA, 15 bp, Homo sapiens
tgatttcattaatac

SEQ ID NO: 187878 - DNA, 17 bp, Homo sapiens
tgatttcatttcaactg

SEQ ID NO: 187879 - DNA, 18 bp, Homo sapiens
tgattttagctgcagaac

SEQ ID NO: 187880 - DNA, 13 bp, Homo sapiens
tgattttcattgc

SEQ ID NO: 187881 - DNA, 15 bp, Homo sapiens
tgattttcattgctg

SEQ ID NO: 187882 - DNA, 15 bp, Homo sapiens
tgattttgaaatcat

SEQ ID NO: 187883 - DNA, 22 bp, Homo sapiens
tgcaaaaggactctcaggacca

SEQ ID NO: 187884 - DNA, 22 bp, Homo sapiens
tgcaaaaggttcactaaagcag

SEQ ID NO: 187885 - DNA, 18 bp, Homo sapiens
tgcaaaatgaggaatgta

SEQ ID NO: 187886 - DNA, 15 bp, Homo sapiens
tgcaaacgctgcctg

SEQ ID NO: 187887 - DNA, 16 bp, Homo sapiens
tgcaaacgctgcctgc

SEQ ID NO: 187888 - DNA, 16 bp, Homo sapiens
tgcaaagaaaatcaga

SEQ ID NO: 187889 - DNA, 20 bp, Homo sapiens
tgcaaagcactgacttctaa

SEQ ID NO: 187890 - DNA, 18 bp, Homo sapiens
tgcaaatgtcatcagaac

SEQ ID NO: 187891 - DNA, 13 bp, Homo sapiens
tgcaacagtagca

SEQ ID NO: 187892 - DNA, 19 bp, Homo sapiens
tgcaacctcgctggactct

SEQ ID NO: 187893 - DNA, 17 bp, Homo sapiens
tgcaactcaaggacttt

SEQ ID NO: 187894 - DNA, 16 bp, Homo sapiens
tgcaacttgtaaatgt

SEQ ID NO: 187895 - DNA, 14 bp, Homo sapiens
tgcaagagccttgg

SEQ ID NO: 187896 - DNA, 24 bp, Homo sapiens
tgcaaggccgctgttcacccacag

SEQ ID NO: 187897 - DNA, 20 bp, Homo sapiens
tgcaagggctccccactgcc

SEQ ID NO: 187898 - DNA, 15 bp, Homo sapiens
tgcaagtactgctgt

SEQ ID NO: 187899 - DNA, 15 bp, Homo sapiens
tgcaagtatgtgagt

SEQ ID NO: 187900 - DNA, 22 bp, Homo sapiens
tgcaagtatgtgagtgtgtcca

SEQ ID NO: 187901 - DNA, 16 bp, Homo sapiens
tgcaagtgacatctct

SEQ ID NO: 187902 - DNA, 17 bp, Homo sapiens
tgcaagtgtctgtgtgc

SEQ ID NO: 187903 - DNA, 14 bp, Homo sapiens
tgcaagtgtgtgca

SEQ ID NO: 187904 - DNA, 21 bp, Homo sapiens
tgcaagtgtgtgcacatgtgt

SEQ ID NO: 187905 - DNA, 15 bp, Homo sapiens
tgcaatttattaaaa

SEQ ID NO: 187906 - DNA, 14 bp, Homo sapiens
tgcaatttcatatg

SEQ ID NO: 187907 - DNA, 15 bp, Homo sapiens
tgcacaaagcccttc

SEQ ID NO: 187908 - DNA, 21 bp, Homo sapiens
tgcacaagctgcaccctcagg

SEQ ID NO: 187909 - DNA, 15 bp, Homo sapiens
tgcacatacttgaga

SEQ ID NO: 187910 - DNA, 14 bp, Homo sapiens
tgcaccactgcact

SEQ ID NO: 187911 - DNA, 23 bp, Homo sapiens
tgcaccagggttgaccccagagg

SEQ ID NO: 187912 - DNA, 16 bp, Homo sapiens
tgcaccatcccttttt

SEQ ID NO: 187913 - DNA, 23 bp, Homo sapiens
tgcaccatccctttttgaagtgt

SEQ ID NO: 187914 - DNA, 21 bp, Homo sapiens
tgcacccactctgctttgact

SEQ ID NO: 187915 - DNA, 21 bp, Homo sapiens
tgcaccccaaagctttcctgc

SEQ ID NO: 187916 - DNA, 22 bp, Homo sapiens
tgcaccccaaagctttcctgcc

SEQ ID NO: 187917 - DNA, 23 bp, Homo sapiens
tgcaccccaaagctttcctgccc

SEQ ID NO: 187918 - DNA, 14 bp, Homo sapiens
tgcacctcccccca

SEQ ID NO: 187919 - DNA, 18 bp, Homo sapiens
tgcacctccccccactgc

SEQ ID NO: 187920 - DNA, 15 bp, Homo sapiens
tgcacgcccatgtgt

SEQ ID NO: 187921 - DNA, 19 bp, Homo sapiens
tgcacgcccatgtgtgagt

SEQ ID NO: 187922 - DNA, 22 bp, Homo sapiens
tgcacgcccatgtgtgagtgtg

SEQ ID NO: 187923 - DNA, 22 bp, Homo sapiens
tgcacgtagtagggtcaggcca

SEQ ID NO: 187924 - DNA, 18 bp, Homo sapiens
tgcactccagcctgggca

SEQ ID NO: 187925 - DNA, 15 bp, Homo sapiens
tgcactggagtccag

SEQ ID NO: 187926 - DNA, 20 bp, Homo sapiens
tgcactggagtccagtctct

SEQ ID NO: 187927 - DNA, 21 bp, Homo sapiens
tgcactggagtccagtctctt

SEQ ID NO: 187928 - DNA, 20 bp, Homo sapiens
tgcactgttccccctgtgca

SEQ ID NO: 187929 - DNA, 21 bp, Homo sapiens
tgcactgttccccctgtgcag

SEQ ID NO: 187930 - DNA, 17 bp, Homo sapiens
tgcacttggcctctgga

SEQ ID NO: 187931 - DNA, 20 bp, Homo sapiens
tgcagaaaagcacctgccga

SEQ ID NO: 187932 - DNA, 21 bp, Homo sapiens
tgcagaaaagcacctgccgac

SEQ ID NO: 187933 - DNA, 22 bp, Homo sapiens
tgcagaaaagcacctgccgacc

SEQ ID NO: 187934 - DNA, 15 bp, Homo sapiens
tgcagaaggaaaaat

SEQ ID NO: 187935 - DNA, 16 bp, Homo sapiens
tgcagaaggaaaaatg

SEQ ID NO: 187936 - DNA, 19 bp, Homo sapiens
tgcagaaggaaaaatgtgt

SEQ ID NO: 187937 - DNA, 24 bp, Homo sapiens
tgcagagacagagaggacgtgggc

SEQ ID NO: 187938 - DNA, 16 bp, Homo sapiens
tgcagataaacagtag

SEQ ID NO: 187939 - DNA, 15 bp, Homo sapiens
tgcagcatatgagga

SEQ ID NO: 187940 - DNA, 13 bp, Homo sapiens
tgcagccagccca

SEQ ID NO: 187941 - DNA, 19 bp, Homo sapiens
tgcagccggcacagggtct

SEQ ID NO: 187942 - DNA, 15 bp, Homo sapiens
tgcagcctcctcctg

SEQ ID NO: 187943 - DNA, 17 bp, Homo sapiens
tgcagcctcctcctgac

SEQ ID NO: 187944 - DNA, 14 bp, Homo sapiens
tgcagcctggaggc

SEQ ID NO: 187945 - DNA, 23 bp, Homo sapiens
tgcagcctttgcctccccggctc

SEQ ID NO: 187946 - DNA, 16 bp, Homo sapiens
tgcaggacctcaggtg

SEQ ID NO: 187947 - DNA, 16 bp, Homo sapiens
tgcaggacctgcctgt

SEQ ID NO: 187948 - DNA, 18 bp, Homo sapiens
tgcaggacctgcctgtag

SEQ ID NO: 187949 - DNA, 12 bp, Homo sapiens
tgcaggcagaca

SEQ ID NO: 187950 - DNA, 15 bp, Homo sapiens
tgcagggaaaattat

SEQ ID NO: 187951 - DNA, 12 bp, Homo sapiens
tgcagggccagg

SEQ ID NO: 187952 - DNA, 13 bp, Homo sapiens
tgcagggccagga

SEQ ID NO: 187953 - DNA, 15 bp, Homo sapiens
tgcagggccaggact

SEQ ID NO: 187954 - DNA, 14 bp, Homo sapiens
tgcaggggctctgg

SEQ ID NO: 187955 - DNA, 19 bp, Homo sapiens
tgcaggggctctggagaga

SEQ ID NO: 187956 - DNA, 14 bp, Homo sapiens
tgcaggtgctgctg

SEQ ID NO: 187957 - DNA, 22 bp, Homo sapiens
tgcagtcctgatcagagccgtg

SEQ ID NO: 187958 - DNA, 19 bp, Homo sapiens
tgcagtgagccgagattgt

SEQ ID NO: 187959 - DNA, 13 bp, Homo sapiens
tgcatactcatta

SEQ ID NO: 187960 - DNA, 19 bp, Homo sapiens
tgcatagaggtaccagcaa

SEQ ID NO: 187961 - DNA, 21 bp, Homo sapiens
tgcatagtattccattgtgtg

SEQ ID NO: 187962 - DNA, 20 bp, Homo sapiens
tgcatccattcctcagggac

SEQ ID NO: 187963 - DNA, 19 bp, Homo sapiens
tgcatccgtagttccctga

SEQ ID NO: 187964 - DNA, 13 bp, Homo sapiens
tgcatctcagccc

SEQ ID NO: 187965 - DNA, 13 bp, Homo sapiens
tgcatctcccaga

SEQ ID NO: 187966 - DNA, 11 bp, Homo sapiens
tgcatctgtat

SEQ ID NO: 187967 - DNA, 20 bp, Homo sapiens
tgcatctgtataagtaagaa

SEQ ID NO: 187968 - DNA, 23 bp, Homo sapiens
tgcatctgtataagtaagaaaat

SEQ ID NO: 187969 - DNA, 18 bp, Homo sapiens
tgcatgctctctgcagcc

SEQ ID NO: 187970 - DNA, 19 bp, Homo sapiens
tgcatggaaacctgaaaaa

SEQ ID NO: 187971 - DNA, 13 bp, Homo sapiens
tgcatgtgtgtgc

SEQ ID NO: 187972 - DNA, 23 bp, Homo sapiens
tgcattagaaattagctgtgtga

SEQ ID NO: 187973 - DNA, 20 bp, Homo sapiens
tgcattcacccagacagctc

SEQ ID NO: 187974 - DNA, 12 bp, Homo sapiens
tgcattctagta

SEQ ID NO: 187975 - DNA, 21 bp, Homo sapiens
tgcattctgccgtgtgccctc

SEQ ID NO: 187976 - DNA, 24 bp, Homo sapiens
tgcatttaaatacagtcttccatt

SEQ ID NO: 187977 - DNA, 23 bp, Homo sapiens
tgccaaacaaaaaggttctcagg

SEQ ID NO: 187978 - DNA, 18 bp, Homo sapiens
tgccaaagggaaatatca

SEQ ID NO: 187979 - DNA, 18 bp, Homo sapiens
tgccaaatatgtcctggg

SEQ ID NO: 187980 - DNA, 19 bp, Homo sapiens
tgccaagcacagtgcctgc

SEQ ID NO: 187981 - DNA, 21 bp, Homo sapiens
tgccaagggctttgttttgca

SEQ ID NO: 187982 - DNA, 14 bp, Homo sapiens
tgccacaccctccc

SEQ ID NO: 187983 - DNA, 22 bp, Homo sapiens
tgccacaccctcccccgccact

SEQ ID NO: 187984 - DNA, 12 bp, Homo sapiens
tgccacacttca

SEQ ID NO: 187985 - DNA, 15 bp, Homo sapiens
tgccacacttcaggc

SEQ ID NO: 187986 - DNA, 14 bp, Homo sapiens
tgccaccagagacc

SEQ ID NO: 187987 - DNA, 22 bp, Homo sapiens
tgccaccagagaccgtcctcac

SEQ ID NO: 187988 - DNA, 18 bp, Homo sapiens
tgccacctcccctatcca

SEQ ID NO: 187989 - DNA, 16 bp, Homo sapiens
tgccacctggggcagt

SEQ ID NO: 187990 - DNA, 17 bp, Homo sapiens
tgccacctggggcagtc

SEQ ID NO: 187991 - DNA, 19 bp, Homo sapiens
tgccacctggggcagtcac

SEQ ID NO: 187992 - DNA, 16 bp, Homo sapiens
tgccactaaattgaca

SEQ ID NO: 187993 - DNA, 20 bp, Homo sapiens
tgccactgcctcttcctccc

SEQ ID NO: 187994 - DNA, 12 bp, Homo sapiens
tgccagacatgt

SEQ ID NO: 187995 - DNA, 11 bp, Homo sapiens
tgccagccagc

SEQ ID NO: 187996 - DNA, 16 bp, Homo sapiens
tgccagccagcagcca

SEQ ID NO: 187997 - DNA, 22 bp, Homo sapiens
tgccagccagcagccagctctc

SEQ ID NO: 187998 - DNA, 20 bp, Homo sapiens
tgccaggaccagtcaacctg

SEQ ID NO: 187999 - DNA, 14 bp, Homo sapiens
tgccaggcatggtg

SEQ ID NO: 188000 - DNA, 11 bp, Homo sapiens
tgccaggcccg

SEQ ID NO: 188001 - DNA, 23 bp, Homo sapiens
tgccagtaacgcgtcttcctgag

SEQ ID NO: 188002 - DNA, 22 bp, Homo sapiens
tgccagtgacagacaggctctt

SEQ ID NO: 188003 - DNA, 12 bp, Homo sapiens
tgccataaaaca

SEQ ID NO: 188004 - DNA, 18 bp, Homo sapiens
tgccatagagtttaacac

SEQ ID NO: 188005 - DNA, 15 bp, Homo sapiens
tgccatcatctcctg

SEQ ID NO: 188006 - DNA, 16 bp, Homo sapiens
tgccatctgtgggcac

SEQ ID NO: 188007 - DNA, 22 bp, Homo sapiens
tgcccaagaatagatgctgact

SEQ ID NO: 188008 - DNA, 17 bp, Homo sapiens
tgcccaccaacatccca

SEQ ID NO: 188009 - DNA, 19 bp, Homo sapiens
tgcccagagatgcctccac

SEQ ID NO: 188010 - DNA, 16 bp, Homo sapiens
tgcccagatcccagaa

SEQ ID NO: 188011 - DNA, 17 bp, Homo sapiens
tgcccaggagagccagc

SEQ ID NO: 188012 - DNA, 18 bp, Homo sapiens
tgcccaggagagccagcc

SEQ ID NO: 188013 - DNA, 22 bp, Homo sapiens
tgcccaggagagccagccctcc

SEQ ID NO: 188014 - DNA, 23 bp, Homo sapiens
tgcccaggagagccagccctccc

SEQ ID NO: 188015 - DNA, 15 bp, Homo sapiens
tgcccaggcctgcct

SEQ ID NO: 188016 - DNA, 11 bp, Homo sapiens
tgcccagggct

SEQ ID NO: 188017 - DNA, 19 bp, Homo sapiens
tgcccagggctcagcctgg

SEQ ID NO: 188018 - DNA, 20 bp, Homo sapiens
tgcccagggctcagcctggt

SEQ ID NO: 188019 - DNA, 19 bp, Homo sapiens
tgcccatctgggaaaatac

SEQ ID NO: 188020 - DNA, 16 bp, Homo sapiens
tgccccaactcctgga

SEQ ID NO: 188021 - DNA, 19 bp, Homo sapiens
tgccccacctttattaaaa

SEQ ID NO: 188022 - DNA, 21 bp, Homo sapiens
tgccccacctttattaaaatc

SEQ ID NO: 188023 - DNA, 14 bp, Homo sapiens
tgccccaggcctga

SEQ ID NO: 188024 - DNA, 16 bp, Homo sapiens
tgccccatcagtgctc

SEQ ID NO: 188025 - DNA, 18 bp, Homo sapiens
tgccccccttgccagaca

SEQ ID NO: 188026 - DNA, 15 bp, Homo sapiens
tgccccgcctccccg

SEQ ID NO: 188027 - DNA, 13 bp, Homo sapiens
tgccccggccacc

SEQ ID NO: 188028 - DNA, 18 bp, Homo sapiens
tgccccggccacctctgc

SEQ ID NO: 188029 - DNA, 23 bp, Homo sapiens
tgccccggccacctctgcggacc

SEQ ID NO: 188030 - DNA, 15 bp, Homo sapiens
tgcccctcccttcaa

SEQ ID NO: 188031 - DNA, 16 bp, Homo sapiens
tgcccctcccttcaac

SEQ ID NO: 188032 - DNA, 14 bp, Homo sapiens
tgcccctggctctg

SEQ ID NO: 188033 - DNA, 18 bp, Homo sapiens
tgcccgtcttcagcctag

SEQ ID NO: 188034 - DNA, 17 bp, Homo sapiens
tgccctagagcacactg

SEQ ID NO: 188035 - DNA, 23 bp, Homo sapiens
tgccctagagcacactgtagcat

SEQ ID NO: 188036 - DNA, 19 bp, Homo sapiens
tgccctcgggcgagtcact

SEQ ID NO: 188037 - DNA, 22 bp, Homo sapiens
tgccctcgggcgagtcactgcc

SEQ ID NO: 188038 - DNA, 16 bp, Homo sapiens
tgccctgcccccacga

SEQ ID NO: 188039 - DNA, 23 bp, Homo sapiens
tgccctgctgccgcctcccagcc

SEQ ID NO: 188040 - DNA, 20 bp, Homo sapiens
tgccctggtgctgccacact

SEQ ID NO: 188041 - DNA, 17 bp, Homo sapiens
tgcccttggaggccagc

SEQ ID NO: 188042 - DNA, 16 bp, Homo sapiens
tgcccttgtcccactc

SEQ ID NO: 188043 - DNA, 14 bp, Homo sapiens
tgccgacctcgtcc

SEQ ID NO: 188044 - DNA, 17 bp, Homo sapiens
tgccgacctcgtcctcc

SEQ ID NO: 188045 - DNA, 22 bp, Homo sapiens
tgccgacctcgtcctccccctg

SEQ ID NO: 188046 - DNA, 20 bp, Homo sapiens
tgccgcaagtctgcagcccg

SEQ ID NO: 188047 - DNA, 14 bp, Homo sapiens
tgccgcctcccagc

SEQ ID NO: 188048 - DNA, 17 bp, Homo sapiens
tgccgcctcccagcctg

SEQ ID NO: 188049 - DNA, 14 bp, Homo sapiens
tgccggccctgggg

SEQ ID NO: 188050 - DNA, 14 bp, Homo sapiens
tgccgggttttata

SEQ ID NO: 188051 - DNA, 14 bp, Homo sapiens
tgcctaagtggctg

SEQ ID NO: 188052 - DNA, 13 bp, Homo sapiens
tgcctcaatgcca

SEQ ID NO: 188053 - DNA, 18 bp, Homo sapiens
tgcctccaccccccagaa

SEQ ID NO: 188054 - DNA, 11 bp, Homo sapiens
tgcctccaccg

SEQ ID NO: 188055 - DNA, 17 bp, Homo sapiens
tgcctccaccgctgcct

SEQ ID NO: 188056 - DNA, 18 bp, Homo sapiens
tgcctccccggctcgagc

SEQ ID NO: 188057 - DNA, 20 bp, Homo sapiens
tgcctcctccttcccaaagg

SEQ ID NO: 188058 - DNA, 14 bp, Homo sapiens
tgcctcctcttcaa

SEQ ID NO: 188059 - DNA, 16 bp, Homo sapiens
tgcctcctcttcaact

SEQ ID NO: 188060 - DNA, 20 bp, Homo sapiens
tgcctcggcttttctcagct

SEQ ID NO: 188061 - DNA, 15 bp, Homo sapiens
tgcctctacctgaca

SEQ ID NO: 188062 - DNA, 17 bp, Homo sapiens
tgcctctacctgacact

SEQ ID NO: 188063 - DNA, 22 bp, Homo sapiens
tgcctctgccaaaggatgtgat

SEQ ID NO: 188064 - DNA, 16 bp, Homo sapiens
tgcctctgcctgcatt

SEQ ID NO: 188065 - DNA, 13 bp, Homo sapiens
tgcctctgcctgt

SEQ ID NO: 188066 - DNA, 14 bp, Homo sapiens
tgcctctgcctgtc

SEQ ID NO: 188067 - DNA, 14 bp, Homo sapiens
tgcctctgggactg

SEQ ID NO: 188068 - DNA, 15 bp, Homo sapiens
tgcctcttagacttc

SEQ ID NO: 188069 - DNA, 13 bp, Homo sapiens
tgcctcttcctcc

SEQ ID NO: 188070 - DNA, 15 bp, Homo sapiens
tgcctctttcatcca

SEQ ID NO: 188071 - DNA, 17 bp, Homo sapiens
tgcctctttcatccact

SEQ ID NO: 188072 - DNA, 18 bp, Homo sapiens
tgcctgatccagcctctc

SEQ ID NO: 188073 - DNA, 15 bp, Homo sapiens
tgcctgcatgtattt

SEQ ID NO: 188074 - DNA, 10 bp, Homo sapiens
tgcctgctga

SEQ ID NO: 188075 - DNA, 21 bp, Homo sapiens
tgcctggacatttgccttgct

SEQ ID NO: 188076 - DNA, 15 bp, Homo sapiens
tgcctgtagttagga

SEQ ID NO: 188077 - DNA, 17 bp, Homo sapiens
tgcctgtagttaggaaa

SEQ ID NO: 188078 - DNA, 19 bp, Homo sapiens
tgcctgtagttaggaaata

SEQ ID NO: 188079 - DNA, 23 bp, Homo sapiens
tgcctgtagttaggaaataaaac

SEQ ID NO: 188080 - DNA, 15 bp, Homo sapiens
tgccttaaaacttta

SEQ ID NO: 188081 - DNA, 23 bp, Homo sapiens
tgccttaataagaatggttgcct

SEQ ID NO: 188082 - DNA, 18 bp, Homo sapiens
tgccttacctcctgccca

SEQ ID NO: 188083 - DNA, 20 bp, Homo sapiens
tgccttacctcctgcccagg

SEQ ID NO: 188084 - DNA, 21 bp, Homo sapiens
tgccttacctcctgcccagga

SEQ ID NO: 188085 - DNA, 14 bp, Homo sapiens
tgccttagaacctt

SEQ ID NO: 188086 - DNA, 17 bp, Homo sapiens
tgccttagaacctttct

SEQ ID NO: 188087 - DNA, 17 bp, Homo sapiens
tgccttcagctctacag

SEQ ID NO: 188088 - DNA, 19 bp, Homo sapiens
tgccttcctcctgggccct

SEQ ID NO: 188089 - DNA, 21 bp, Homo sapiens
tgccttcttcggggaactcct

SEQ ID NO: 188090 - DNA, 22 bp, Homo sapiens
tgccttcttcggggaactcctg

SEQ ID NO: 188091 - DNA, 18 bp, Homo sapiens
tgcctttgagtttcctca

SEQ ID NO: 188092 - DNA, 21 bp, Homo sapiens
tgcctttgagtttcctcaggc

SEQ ID NO: 188093 - DNA, 22 bp, Homo sapiens
tgcctttgagtttcctcaggct

SEQ ID NO: 188094 - DNA, 22 bp, Homo sapiens
tgcgagtgtgtgcatgtgtgtg

SEQ ID NO: 188095 - DNA, 21 bp, Homo sapiens
tgcgccattgcactccagcct

SEQ ID NO: 188096 - DNA, 18 bp, Homo sapiens
tgcgcttttgctggtcac

SEQ ID NO: 188097 - DNA, 14 bp, Homo sapiens
tgcggaccccagct

SEQ ID NO: 188098 - DNA, 18 bp, Homo sapiens
tgcggccgcattccctga

SEQ ID NO: 188099 - DNA, 17 bp, Homo sapiens
tgcggcctttggcttca

SEQ ID NO: 188100 - DNA, 19 bp, Homo sapiens
tgcggcctttggcttcacg

SEQ ID NO: 188101 - DNA, 21 bp, Homo sapiens
tgcgggaccggtacagaaagg

SEQ ID NO: 188102 - DNA, 15 bp, Homo sapiens
tgcgggctgggcagc

SEQ ID NO: 188103 - DNA, 16 bp, Homo sapiens
tgcgggctgggcagct

SEQ ID NO: 188104 - DNA, 17 bp, Homo sapiens
tgcgggctgggcagctg

SEQ ID NO: 188105 - DNA, 19 bp, Homo sapiens
tgcgtggcatagcccagac

SEQ ID NO: 188106 - DNA, 15 bp, Homo sapiens
tgctacaaaaacaca

SEQ ID NO: 188107 - DNA, 13 bp, Homo sapiens
tgctacaacttca

SEQ ID NO: 188108 - DNA, 14 bp, Homo sapiens
tgctacctcactgg

SEQ ID NO: 188109 - DNA, 13 bp, Homo sapiens
tgctacgcctgca

SEQ ID NO: 188110 - DNA, 20 bp, Homo sapiens
tgctatcctgccaaaatcat

SEQ ID NO: 188111 - DNA, 18 bp, Homo sapiens
tgctatggggagaaaaga

SEQ ID NO: 188112 - DNA, 22 bp, Homo sapiens
tgctatggggagaaaagacatg

SEQ ID NO: 188113 - DNA, 20 bp, Homo sapiens
tgctatgttttgacattttt

SEQ ID NO: 188114 - DNA, 14 bp, Homo sapiens
tgctcaaaatttga

SEQ ID NO: 188115 - DNA, 21 bp, Homo sapiens
tgctcaaaatttgaagaatga

SEQ ID NO: 188116 - DNA, 13 bp, Homo sapiens
tgctcacctgggg

SEQ ID NO: 188117 - DNA, 23 bp, Homo sapiens
tgctcacctggggtgtgggaggc

SEQ ID NO: 188118 - DNA, 14 bp, Homo sapiens
tgctcagggctgac

SEQ ID NO: 188119 - DNA, 16 bp, Homo sapiens
tgctcagggtcaattt

SEQ ID NO: 188120 - DNA, 19 bp, Homo sapiens
tgctcatcattctctgtct

SEQ ID NO: 188121 - DNA, 17 bp, Homo sapiens
tgctccccagccctggc

SEQ ID NO: 188122 - DNA, 21 bp, Homo sapiens
tgctcccccaccccctcccca

SEQ ID NO: 188123 - DNA, 17 bp, Homo sapiens
tgctccctgaagccagc

SEQ ID NO: 188124 - DNA, 19 bp, Homo sapiens
tgctccctgaagccagcct

SEQ ID NO: 188125 - DNA, 21 bp, Homo sapiens
tgctcctccagggccacgtgc

SEQ ID NO: 188126 - DNA, 19 bp, Homo sapiens
tgctcctggcccactgcat

SEQ ID NO: 188127 - DNA, 19 bp, Homo sapiens
tgctccttccaacaggagc

SEQ ID NO: 188128 - DNA, 14 bp, Homo sapiens
tgctccttgggccc

SEQ ID NO: 188129 - DNA, 14 bp, Homo sapiens
tgctctcccctgcc

SEQ ID NO: 188130 - DNA, 18 bp, Homo sapiens
tgctctcctcttgccact

SEQ ID NO: 188131 - DNA, 22 bp, Homo sapiens
tgctctcctcttgccactgcct

SEQ ID NO: 188132 - DNA, 17 bp, Homo sapiens
tgctctctgcagccagc

SEQ ID NO: 188133 - DNA, 23 bp, Homo sapiens
tgctctgcgtgtcacctgtgctt

SEQ ID NO: 188134 - DNA, 13 bp, Homo sapiens
tgctctttctctg

SEQ ID NO: 188135 - DNA, 14 bp, Homo sapiens
tgctctttctctgc

SEQ ID NO: 188136 - DNA, 16 bp, Homo sapiens
tgctctttctctgcca

SEQ ID NO: 188137 - DNA, 22 bp, Homo sapiens
tgctctttctctgccagtgaca

SEQ ID NO: 188138 - DNA, 15 bp, Homo sapiens
tgctgaaacaggaga

SEQ ID NO: 188139 - DNA, 23 bp, Homo sapiens
tgctgaaggaataaattgctcct

SEQ ID NO: 188140 - DNA, 15 bp, Homo sapiens
tgctgacagctgacc

SEQ ID NO: 188141 - DNA, 16 bp, Homo sapiens
tgctgacctccacagc

SEQ ID NO: 188142 - DNA, 21 bp, Homo sapiens
tgctgactgtactcctcccag

SEQ ID NO: 188143 - DNA, 16 bp, Homo sapiens
tgctgactgttttctc

SEQ ID NO: 188144 - DNA, 18 bp, Homo sapiens
tgctgagagacccaagga

SEQ ID NO: 188145 - DNA, 21 bp, Homo sapiens
tgctgagagacccaaggagga

SEQ ID NO: 188146 - DNA, 14 bp, Homo sapiens
tgctgagggaccag

SEQ ID NO: 188147 - DNA, 16 bp, Homo sapiens
tgctgagggaccagcc

SEQ ID NO: 188148 - DNA, 21 bp, Homo sapiens
tgctgatgaactcttaatcaa

SEQ ID NO: 188149 - DNA, 16 bp, Homo sapiens
tgctgccacacttcag

SEQ ID NO: 188150 - DNA, 19 bp, Homo sapiens
tgctgccccatcagtgctc

SEQ ID NO: 188151 - DNA, 21 bp, Homo sapiens
tgctgccgcctcccagcctgg

SEQ ID NO: 188152 - DNA, 19 bp, Homo sapiens
tgctgcttgaggcaactca

SEQ ID NO: 188153 - DNA, 20 bp, Homo sapiens
tgctgcttttccttggggca

SEQ ID NO: 188154 - DNA, 13 bp, Homo sapiens
tgctggagaagag

SEQ ID NO: 188155 - DNA, 14 bp, Homo sapiens
tgctggagctctgc

SEQ ID NO: 188156 - DNA, 18 bp, Homo sapiens
tgctggaggtgggagcag

SEQ ID NO: 188157 - DNA, 23 bp, Homo sapiens
tgctggaggtgggagcaggagat

SEQ ID NO: 188158 - DNA, 20 bp, Homo sapiens
tgctggatggagcccaggcg

SEQ ID NO: 188159 - DNA, 20 bp, Homo sapiens
tgctggcacatttccccaga

SEQ ID NO: 188160 - DNA, 16 bp, Homo sapiens
tgctgggtaaactgtg

SEQ ID NO: 188161 - DNA, 20 bp, Homo sapiens
tgctgtaaataaatgcttta

SEQ ID NO: 188162 - DNA, 17 bp, Homo sapiens
tgctgtctaacctgtga

SEQ ID NO: 188163 - DNA, 17 bp, Homo sapiens
tgctgtgaggctgtcct

SEQ ID NO: 188164 - DNA, 16 bp, Homo sapiens
tgctgtggtgtgtccc

SEQ ID NO: 188165 - DNA, 15 bp, Homo sapiens
tgctgtgtatctgat

SEQ ID NO: 188166 - DNA, 18 bp, Homo sapiens
tgctgtgttaaataaacc

SEQ ID NO: 188167 - DNA, 12 bp, Homo sapiens
tgctgtttcctt

SEQ ID NO: 188168 - DNA, 14 bp, Homo sapiens
tgctgtttcctttt

SEQ ID NO: 188169 - DNA, 18 bp, Homo sapiens
tgcttacaattccctgct

SEQ ID NO: 188170 - DNA, 21 bp, Homo sapiens
tgcttacaattccctgctgtc

SEQ ID NO: 188171 - DNA, 17 bp, Homo sapiens
tgcttacatttttacaa

SEQ ID NO: 188172 - DNA, 13 bp, Homo sapiens
tgcttatacactt

SEQ ID NO: 188173 - DNA, 15 bp, Homo sapiens
tgcttcaattaataa

SEQ ID NO: 188174 - DNA, 23 bp, Homo sapiens
tgcttcaattaataaaaaatgga

SEQ ID NO: 188175 - DNA, 12 bp, Homo sapiens
tgcttctcactg

SEQ ID NO: 188176 - DNA, 21 bp, Homo sapiens
tgcttgaaagaaaatatgcat

SEQ ID NO: 188177 - DNA, 17 bp, Homo sapiens
tgcttgaacccaggaga

SEQ ID NO: 188178 - DNA, 12 bp, Homo sapiens
tgcttgtgttaa

SEQ ID NO: 188179 - DNA, 12 bp, Homo sapiens
tgcttgtgttat

SEQ ID NO: 188180 - DNA, 13 bp, Homo sapiens
tgctttggaaatc

SEQ ID NO: 188181 - DNA, 18 bp, Homo sapiens
tgctttgggctgccctgg

SEQ ID NO: 188182 - DNA, 17 bp, Homo sapiens
tgctttttaagtgttaa

SEQ ID NO: 188183 - DNA, 14 bp, Homo sapiens
tggaaaagaataca

SEQ ID NO: 188184 - DNA, 17 bp, Homo sapiens
tggaaacctgaaaaaaa

SEQ ID NO: 188185 - DNA, 16 bp, Homo sapiens
tggaaagaatctaata

SEQ ID NO: 188186 - DNA, 19 bp, Homo sapiens
tggaaaggagaggaaagaa

SEQ ID NO: 188187 - DNA, 23 bp, Homo sapiens
tggaaaggagaggaaagaactca

SEQ ID NO: 188188 - DNA, 17 bp, Homo sapiens
tggaaccgcaggaagct

SEQ ID NO: 188189 - DNA, 14 bp, Homo sapiens
tggaactctcgagc

SEQ ID NO: 188190 - DNA, 14 bp, Homo sapiens
tggaacttctaata

SEQ ID NO: 188191 - DNA, 15 bp, Homo sapiens
tggaacttctaatat

SEQ ID NO: 188192 - DNA, 16 bp, Homo sapiens
tggaacttctaatata

SEQ ID NO: 188193 - DNA, 16 bp, Homo sapiens
tggaagattttaaatt

SEQ ID NO: 188194 - DNA, 19 bp, Homo sapiens
tggaagcatgtaggagaat

SEQ ID NO: 188195 - DNA, 13 bp, Homo sapiens
tggaagccctcct

SEQ ID NO: 188196 - DNA, 16 bp, Homo sapiens
tggaagccctccttcc

SEQ ID NO: 188197 - DNA, 15 bp, Homo sapiens
tggaagctgtgtcct

SEQ ID NO: 188198 - DNA, 21 bp, Homo sapiens
tggaaggtgctgttatccatg

SEQ ID NO: 188199 - DNA, 22 bp, Homo sapiens
tggaatacagtgttattttctt

SEQ ID NO: 188200 - DNA, 22 bp, Homo sapiens
tggaatttctcccagtcattta

SEQ ID NO: 188201 - DNA, 13 bp, Homo sapiens
tggaccaggacag

SEQ ID NO: 188202 - DNA, 13 bp, Homo sapiens
tggaccagtggtc

SEQ ID NO: 188203 - DNA, 13 bp, Homo sapiens
tggactcctctgt

SEQ ID NO: 188204 - DNA, 15 bp, Homo sapiens
tggactcctctgtcc

SEQ ID NO: 188205 - DNA, 20 bp, Homo sapiens
tggactctcagtctctgagc

SEQ ID NO: 188206 - DNA, 22 bp, Homo sapiens
tggactctcagtctctgagcag

SEQ ID NO: 188207 - DNA, 13 bp, Homo sapiens
tggactgggaggt

SEQ ID NO: 188208 - DNA, 15 bp, Homo sapiens
tggacttagaaagca

SEQ ID NO: 188209 - DNA, 16 bp, Homo sapiens
tggacttagaaagcag

SEQ ID NO: 188210 - DNA, 14 bp, Homo sapiens
tggactttcctgca

SEQ ID NO: 188211 - DNA, 19 bp, Homo sapiens
tggactttcctgcaactca

SEQ ID NO: 188212 - DNA, 16 bp, Homo sapiens
tggagaaaccctgtct

SEQ ID NO: 188213 - DNA, 17 bp, Homo sapiens
tggagaaacccttgaaa

SEQ ID NO: 188214 - DNA, 17 bp, Homo sapiens
tggagaaactgtagtct

SEQ ID NO: 188215 - DNA, 17 bp, Homo sapiens
tggagaaattatttaat

SEQ ID NO: 188216 - DNA, 19 bp, Homo sapiens
tggagaaattatttaataa

SEQ ID NO: 188217 - DNA, 15 bp, Homo sapiens
tggagaactcctagg

SEQ ID NO: 188218 - DNA, 12 bp, Homo sapiens
tggagaagagag

SEQ ID NO: 188219 - DNA, 14 bp, Homo sapiens
tggagaagagagga

SEQ ID NO: 188220 - DNA, 13 bp, Homo sapiens
tggagaagcagtg

SEQ ID NO: 188221 - DNA, 22 bp, Homo sapiens
tggagaagcggctggcagccca

SEQ ID NO: 188222 - DNA, 12 bp, Homo sapiens
tggagacagccc

SEQ ID NO: 188223 - DNA, 20 bp, Homo sapiens
tggagactggggggcttgaa

SEQ ID NO: 188224 - DNA, 22 bp, Homo sapiens
tggagagaaacaataaagagat

SEQ ID NO: 188225 - DNA, 21 bp, Homo sapiens
tggagagggatgaggtgctgg

SEQ ID NO: 188226 - DNA, 19 bp, Homo sapiens
tggagatatttatgggggg

SEQ ID NO: 188227 - DNA, 16 bp, Homo sapiens
tggagcagaggggctg

SEQ ID NO: 188228 - DNA, 17 bp, Homo sapiens
tggagccaatggagact

SEQ ID NO: 188229 - DNA, 13 bp, Homo sapiens
tggagcccaggcg

SEQ ID NO: 188230 - DNA, 16 bp, Homo sapiens
tggagcccaggcggga

SEQ ID NO: 188231 - DNA, 18 bp, Homo sapiens
tggagcccaggcgggagc

SEQ ID NO: 188232 - DNA, 22 bp, Homo sapiens
tggagcccaggcgggagcggtg

SEQ ID NO: 188233 - DNA, 15 bp, Homo sapiens
tggagcccagggagc

SEQ ID NO: 188234 - DNA, 18 bp, Homo sapiens
tggaggaagagggacaga

SEQ ID NO: 188235 - DNA, 17 bp, Homo sapiens
ttatctgtgaattcaga

SEQ ID NO: 188236 - DNA, 16 bp, Homo sapiens
ttatcttgtctctggg

SEQ ID NO: 188237 - DNA, 14 bp, Homo sapiens
ttatgaatgaaaaa

SEQ ID NO: 188238 - DNA, 21 bp, Homo sapiens
ttatgagtttttgatagcttt

SEQ ID NO: 188239 - DNA, 22 bp, Homo sapiens
ttatggaagattttaaattcac

SEQ ID NO: 188240 - DNA, 18 bp, Homo sapiens
ttatggctataggtgcta

SEQ ID NO: 188241 - DNA, 21 bp, Homo sapiens
ttatgtatatttaaaagaaag

SEQ ID NO: 188242 - DNA, 21 bp, Homo sapiens
ttatgtctgctgaataataaa

SEQ ID NO: 188243 - DNA, 18 bp, Homo sapiens
ttatgtgccgtgttattg

SEQ ID NO: 188244 - DNA, 21 bp, Homo sapiens
ttattaaaatgattgtaaaat

SEQ ID NO: 188245 - DNA, 18 bp, Homo sapiens
ttattcaattcctctggg

SEQ ID NO: 188246 - DNA, 12 bp, Homo sapiens
ttattcatttaa

SEQ ID NO: 188247 - DNA, 13 bp, Homo sapiens
ttattcatttaaa

SEQ ID NO: 188248 - DNA, 18 bp, Homo sapiens
ttattcatttaaaatgat

SEQ ID NO: 188249 - DNA, 20 bp, Homo sapiens
ttattcatttaaaatgatta

SEQ ID NO: 188250 - DNA, 14 bp, Homo sapiens
ttattcatttgagt

SEQ ID NO: 188251 - DNA, 17 bp, Homo sapiens
ttattctcactccacca

SEQ ID NO: 188252 - DNA, 13 bp, Homo sapiens
ttattctttttaa

SEQ ID NO: 188253 - DNA, 18 bp, Homo sapiens
ttattgagaaagagcact

SEQ ID NO: 188254 - DNA, 17 bp, Homo sapiens
ttattgtacctctctta

SEQ ID NO: 188255 - DNA, 12 bp, Homo sapiens
ttattgtacttg

SEQ ID NO: 188256 - DNA, 14 bp, Homo sapiens
ttattgtataaact

SEQ ID NO: 188257 - DNA, 21 bp, Homo sapiens
ttattgtataaactatcagtt

SEQ ID NO: 188258 - DNA, 12 bp, Homo sapiens
ttatttaaatga

SEQ ID NO: 188259 - DNA, 17 bp, Homo sapiens
ttatttactgagcttct

SEQ ID NO: 188260 - DNA, 21 bp, Homo sapiens
ttatttactgagcttctctgt

SEQ ID NO: 188261 - DNA, 14 bp, Homo sapiens
ttatttgacaaaat

SEQ ID NO: 188262 - DNA, 11 bp, Homo sapiens
ttatttgcata

SEQ ID NO: 188263 - DNA, 16 bp, Homo sapiens
ttatttgtgtaataga

SEQ ID NO: 188264 - DNA, 21 bp, Homo sapiens
ttatttgtgtaatagaaaact

SEQ ID NO: 188265 - DNA, 16 bp, Homo sapiens
ttattttaaacaaaat

SEQ ID NO: 188266 - DNA, 18 bp, Homo sapiens
ttatttttacattctgaa

SEQ ID NO: 188267 - DNA, 18 bp, Homo sapiens
ttattttttaagtattta

SEQ ID NO: 188268 - DNA, 14 bp, Homo sapiens
ttattttttacatt

SEQ ID NO: 188269 - DNA, 14 bp, Homo sapiens
ttcaaaataaaaac

SEQ ID NO: 188270 - DNA, 21 bp, Homo sapiens
ttcaaagccagcgtcctcctc

SEQ ID NO: 188271 - DNA, 23 bp, Homo sapiens
ttcaaagccagcgtcctcctctg

SEQ ID NO: 188272 - DNA, 13 bp, Homo sapiens
ttcaaatttcaca

SEQ ID NO: 188273 - DNA, 15 bp, Homo sapiens
ttcaaccattcccca

SEQ ID NO: 188274 - DNA, 19 bp, Homo sapiens
ttcaacgcagccctgcttt

SEQ ID NO: 188275 - DNA, 13 bp, Homo sapiens
ttcaactcagact

SEQ ID NO: 188276 - DNA, 17 bp, Homo sapiens
ttcaactgaccagcctc

SEQ ID NO: 188277 - DNA, 22 bp, Homo sapiens
ttcaagtgcatgctctctgcag

SEQ ID NO: 188278 - DNA, 14 bp, Homo sapiens
ttcaagttattgta

SEQ ID NO: 188279 - DNA, 12 bp, Homo sapiens
ttcaattcctct

SEQ ID NO: 188280 - DNA, 22 bp, Homo sapiens
ttcacaagacccaaaaggcaga

SEQ ID NO: 188281 - DNA, 21 bp, Homo sapiens
ttcacacacaggcaactgagg

SEQ ID NO: 188282 - DNA, 14 bp, Homo sapiens
ttcacactctcaca

SEQ ID NO: 188283 - DNA, 22 bp, Homo sapiens
ttcacactctcacatgtttaga

SEQ ID NO: 188284 - DNA, 12 bp, Homo sapiens
ttcacacttcca

SEQ ID NO: 188285 - DNA, 23 bp, Homo sapiens
ttcacagttggctggatgaaatt

SEQ ID NO: 188286 - DNA, 17 bp, Homo sapiens
ttcacatagagatcatc

SEQ ID NO: 188287 - DNA, 19 bp, Homo sapiens
ttcacatagagatcatcct

SEQ ID NO: 188288 - DNA, 19 bp, Homo sapiens
ttcacatctaacctcatct

SEQ ID NO: 188289 - DNA, 19 bp, Homo sapiens
ttcacatgagctatttcca

SEQ ID NO: 188290 - DNA, 17 bp, Homo sapiens
ttcaccccagggcctga

SEQ ID NO: 188291 - DNA, 17 bp, Homo sapiens
ttcaccccccactcacc

SEQ ID NO: 188292 - DNA, 19 bp, Homo sapiens
ttcacctgtttttaagctg

SEQ ID NO: 188293 - DNA, 23 bp, Homo sapiens
ttcacctgtttttaagctgtttc

SEQ ID NO: 188294 - DNA, 22 bp, Homo sapiens
ttcaccttgggatgatgcctca

SEQ ID NO: 188295 - DNA, 17 bp, Homo sapiens
ttcacggaagagccttg

SEQ ID NO: 188296 - DNA, 13 bp, Homo sapiens
ttcactaaagcag

SEQ ID NO: 188297 - DNA, 13 bp, Homo sapiens
ttcactgccccca

SEQ ID NO: 188298 - DNA, 16 bp, Homo sapiens
ttcactgctggctgcc

SEQ ID NO: 188299 - DNA, 16 bp, Homo sapiens
ttcactggagttacat

SEQ ID NO: 188300 - DNA, 13 bp, Homo sapiens
ttcactttaattc

SEQ ID NO: 188301 - DNA, 19 bp, Homo sapiens
ttcagaaagcattacattt

SEQ ID NO: 188302 - DNA, 12 bp, Homo sapiens
ttcagactcaga

SEQ ID NO: 188303 - DNA, 13 bp, Homo sapiens
ttcagactcagac

SEQ ID NO: 188304 - DNA, 14 bp, Homo sapiens
ttcagactcagact

SEQ ID NO: 188305 - DNA, 21 bp, Homo sapiens
ttcagagactcagggccccag

SEQ ID NO: 188306 - DNA, 13 bp, Homo sapiens
ttcagcactgtcc

SEQ ID NO: 188307 - DNA, 20 bp, Homo sapiens
ttcagcactgtcccttgcct

SEQ ID NO: 188308 - DNA, 21 bp, Homo sapiens
ttcagcactgtcccttgcctc

SEQ ID NO: 188309 - DNA, 20 bp, Homo sapiens
ttcagcccctcctctgccac

SEQ ID NO: 188310 - DNA, 20 bp, Homo sapiens
ttcagcctagccgacctcag

SEQ ID NO: 188311 - DNA, 23 bp, Homo sapiens
ttcagcctagccgacctcagcct

SEQ ID NO: 188312 - DNA, 13 bp, Homo sapiens
ttcagctgcccca

SEQ ID NO: 188313 - DNA, 21 bp, Homo sapiens
ttcagctggttgaggtttcaa

SEQ ID NO: 188314 - DNA, 19 bp, Homo sapiens
ttcaggtagctgcccctgg

SEQ ID NO: 188315 - DNA, 21 bp, Homo sapiens
ttcagtattttggagaaatta

SEQ ID NO: 188316 - DNA, 12 bp, Homo sapiens
ttcagtgttaaa

SEQ ID NO: 188317 - DNA, 16 bp, Homo sapiens
ttcagttgatcactgg

SEQ ID NO: 188318 - DNA, 18 bp, Homo sapiens
ttcagttgatcactggca

SEQ ID NO: 188319 - DNA, 13 bp, Homo sapiens
ttcagtttgtata

SEQ ID NO: 188320 - DNA, 17 bp, Homo sapiens
ttcataagtatttcaaa

SEQ ID NO: 188321 - DNA, 19 bp, Homo sapiens
ttcatcccatgatgtagtg

SEQ ID NO: 188322 - DNA, 20 bp, Homo sapiens
ttcatcttccaactcaaact

SEQ ID NO: 188323 - DNA, 23 bp, Homo sapiens
ttcatgatttcatttcaactgtt

SEQ ID NO: 188324 - DNA, 17 bp, Homo sapiens
ttcatgattttgaaatc

SEQ ID NO: 188325 - DNA, 14 bp, Homo sapiens
ttcatgtaaactgt

SEQ ID NO: 188326 - DNA, 18 bp, Homo sapiens
ttcatgtaaactgtgcac

SEQ ID NO: 188327 - DNA, 22 bp, Homo sapiens
ttcatgttgcacacccactcag

SEQ ID NO: 188328 - DNA, 15 bp, Homo sapiens
ttcattctcctgcct

SEQ ID NO: 188329 - DNA, 13 bp, Homo sapiens
ttcattcttgaaa

SEQ ID NO: 188330 - DNA, 16 bp, Homo sapiens
ttcattgactatcaaa

SEQ ID NO: 188331 - DNA, 16 bp, Homo sapiens
ttcatttaaaatgatt

SEQ ID NO: 188332 - DNA, 19 bp, Homo sapiens
ttcatttagtcatgtgacc

SEQ ID NO: 188333 - DNA, 13 bp, Homo sapiens
ttcatttttccta

SEQ ID NO: 188334 - DNA, 22 bp, Homo sapiens
ttccaatttacatactctgctt

SEQ ID NO: 188335 - DNA, 12 bp, Homo sapiens
ttccaccagcct

SEQ ID NO: 188336 - DNA, 15 bp, Homo sapiens
ttccaccttcccatg

SEQ ID NO: 188337 - DNA, 22 bp, Homo sapiens
ttccacggagccactcctctga

SEQ ID NO: 188338 - DNA, 20 bp, Homo sapiens
ttccagagagtggctcctcc

SEQ ID NO: 188339 - DNA, 18 bp, Homo sapiens
ttccagctggatgagaat

SEQ ID NO: 188340 - DNA, 18 bp, Homo sapiens
ttccaggtttaagctgtt

SEQ ID NO: 188341 - DNA, 23 bp, Homo sapiens
ttccataatctggactcctctgt

SEQ ID NO: 188342 - DNA, 19 bp, Homo sapiens
ttccatcaggttccatccc

SEQ ID NO: 188343 - DNA, 14 bp, Homo sapiens
ttccatcatgtccc

SEQ ID NO: 188344 - DNA, 16 bp, Homo sapiens
ttccatcatgtcccca

SEQ ID NO: 188345 - DNA, 17 bp, Homo sapiens
ttccatcatgtccccaa

SEQ ID NO: 188346 - DNA, 17 bp, Homo sapiens
ttccatttgcaagggaa

SEQ ID NO: 188347 - DNA, 19 bp, Homo sapiens
ttcccaaaggactccaccc

SEQ ID NO: 188348 - DNA, 18 bp, Homo sapiens
ttcccacaggacatttct

SEQ ID NO: 188349 - DNA, 22 bp, Homo sapiens
ttcccagagacaggaaaatcct

SEQ ID NO: 188350 - DNA, 22 bp, Homo sapiens
ttcccagggaagtgctctgata

SEQ ID NO: 188351 - DNA, 12 bp, Homo sapiens
ttcccaggtgct

SEQ ID NO: 188352 - DNA, 18 bp, Homo sapiens
ttccccaaccacttcatt

SEQ ID NO: 188353 - DNA, 23 bp, Homo sapiens
ttccccactgacagcctcccacc

SEQ ID NO: 188354 - DNA, 12 bp, Homo sapiens
ttccccagccca

SEQ ID NO: 188355 - DNA, 11 bp, Homo sapiens
ttccccatggg

SEQ ID NO: 188356 - DNA, 17 bp, Homo sapiens
ttccccggtcccttgag

SEQ ID NO: 188357 - DNA, 20 bp, Homo sapiens
tggaggttgcagtgagctga

SEQ ID NO: 188358 - DNA, 17 bp, Homo sapiens
tggagttacattaatgt

SEQ ID NO: 188359 - DNA, 20 bp, Homo sapiens
tggagttacattaatgttaa

SEQ ID NO: 188360 - DNA, 16 bp, Homo sapiens
tggagttcctgaacct

SEQ ID NO: 188361 - DNA, 23 bp, Homo sapiens
tggatcacagaggcttcttcaga

SEQ ID NO: 188362 - DNA, 18 bp, Homo sapiens
tggatctcattggaccct

SEQ ID NO: 188363 - DNA, 19 bp, Homo sapiens
tggatctgggaccctttcc

SEQ ID NO: 188364 - DNA, 21 bp, Homo sapiens
tggatctgggaccctttcctt

SEQ ID NO: 188365 - DNA, 23 bp, Homo sapiens
tggatctgggaccctttccttcc

SEQ ID NO: 188366 - DNA, 14 bp, Homo sapiens
tggatgaaattttc

SEQ ID NO: 188367 - DNA, 15 bp, Homo sapiens
tggatgaaattttct

SEQ ID NO: 188368 - DNA, 17 bp, Homo sapiens
tggatgaaattttctag

SEQ ID NO: 188369 - DNA, 16 bp, Homo sapiens
tggattattcatttaa

SEQ ID NO: 188370 - DNA, 17 bp, Homo sapiens
tggattattcatttaaa

SEQ ID NO: 188371 - DNA, 18 bp, Homo sapiens
tggattattcatttaaaa

SEQ ID NO: 188372 - DNA, 17 bp, Homo sapiens
tggattggtgtaaaagg

SEQ ID NO: 188373 - DNA, 15 bp, Homo sapiens
tggcaacagaagcag

SEQ ID NO: 188374 - DNA, 13 bp, Homo sapiens
tggcaagagcccc

SEQ ID NO: 188375 - DNA, 23 bp, Homo sapiens
tggcagaaagcaaatgtgacctg

SEQ ID NO: 188376 - DNA, 13 bp, Homo sapiens
tggcagagcttct

SEQ ID NO: 188377 - DNA, 20 bp, Homo sapiens
tggcagagttgtaaatatat

SEQ ID NO: 188378 - DNA, 20 bp, Homo sapiens
tggcagcagagtgtggcctt

SEQ ID NO: 188379 - DNA, 16 bp, Homo sapiens
tggcagccgtgccttc

SEQ ID NO: 188380 - DNA, 22 bp, Homo sapiens
tggcagccgtgccttcagctct

SEQ ID NO: 188381 - DNA, 16 bp, Homo sapiens
tggcagggtgggatgg

SEQ ID NO: 188382 - DNA, 19 bp, Homo sapiens
tggcagtctatatgtttgt

SEQ ID NO: 188383 - DNA, 21 bp, Homo sapiens
tggcagtgagtgagcctggct

SEQ ID NO: 188384 - DNA, 23 bp, Homo sapiens
tggcagtgagtgagcctggctct

SEQ ID NO: 188385 - DNA, 17 bp, Homo sapiens
tggcatagcccagacac

SEQ ID NO: 188386 - DNA, 23 bp, Homo sapiens
tggcatcaccttaggcagggaag

SEQ ID NO: 188387 - DNA, 16 bp, Homo sapiens
tggccaaattatttgt

SEQ ID NO: 188388 - DNA, 17 bp, Homo sapiens
tggccactccagacccc

SEQ ID NO: 188389 - DNA, 14 bp, Homo sapiens
tggccagagctggg

SEQ ID NO: 188390 - DNA, 18 bp, Homo sapiens
tggccagagctgggaggc

SEQ ID NO: 188391 - DNA, 20 bp, Homo sapiens
tggccagagctgggaggcat

SEQ ID NO: 188392 - DNA, 14 bp, Homo sapiens
tggccagaggcttg

SEQ ID NO: 188393 - DNA, 12 bp, Homo sapiens
tggccagcagct

SEQ ID NO: 188394 - DNA, 14 bp, Homo sapiens
tggccagcagcttg

SEQ ID NO: 188395 - DNA, 13 bp, Homo sapiens
tggccagcctaca

SEQ ID NO: 188396 - DNA, 16 bp, Homo sapiens
tggccaggtggccact

SEQ ID NO: 188397 - DNA, 13 bp, Homo sapiens
tggcccactgcat

SEQ ID NO: 188398 - DNA, 14 bp, Homo sapiens
tggcccactgcatc

SEQ ID NO: 188399 - DNA, 14 bp, Homo sapiens
tggcccgacagcct

SEQ ID NO: 188400 - DNA, 17 bp, Homo sapiens
tggcccgacagcctggc

SEQ ID NO: 188401 - DNA, 18 bp, Homo sapiens
tggccctcacccctgccc

SEQ ID NO: 188402 - DNA, 14 bp, Homo sapiens
tggccctcagtttc

SEQ ID NO: 188403 - DNA, 15 bp, Homo sapiens
tggccctgcaaaagg

SEQ ID NO: 188404 - DNA, 18 bp, Homo sapiens
tggccctggcctgctggg

SEQ ID NO: 188405 - DNA, 17 bp, Homo sapiens
tggccctgtccctccca

SEQ ID NO: 188406 - DNA, 15 bp, Homo sapiens
tggcctcccctgctg

SEQ ID NO: 188407 - DNA, 17 bp, Homo sapiens
tggcctcttgagcagtg

SEQ ID NO: 188408 - DNA, 19 bp, Homo sapiens
tggcctcttgagcagtggc

SEQ ID NO: 188409 - DNA, 17 bp, Homo sapiens
tggcctgggagagctgg

SEQ ID NO: 188410 - DNA, 18 bp, Homo sapiens
tggccttccatttatatg

SEQ ID NO: 188411 - DNA, 17 bp, Homo sapiens
tggccttccccagcctc

SEQ ID NO: 188412 - DNA, 18 bp, Homo sapiens
tggccttccccagcctct

SEQ ID NO: 188413 - DNA, 23 bp, Homo sapiens
tggcggctactcagcagccctcc

SEQ ID NO: 188414 - DNA, 13 bp, Homo sapiens
tggcggtgcctgg

SEQ ID NO: 188415 - DNA, 16 bp, Homo sapiens
tggctcacgtgtgtga

SEQ ID NO: 188416 - DNA, 19 bp, Homo sapiens
tggctctgaccgaaacagc

SEQ ID NO: 188417 - DNA, 23 bp, Homo sapiens
tggctctgcaatgggcactggga

SEQ ID NO: 188418 - DNA, 14 bp, Homo sapiens
tggctctggagaca

SEQ ID NO: 188419 - DNA, 15 bp, Homo sapiens
tggctgacccagtcc

SEQ ID NO: 188420 - DNA, 16 bp, Homo sapiens
tggctgacccagtccc

SEQ ID NO: 188421 - DNA, 17 bp, Homo sapiens
tggctgtcagcaggaag

SEQ ID NO: 188422 - DNA, 17 bp, Homo sapiens
tggctgtgcctctgcct

SEQ ID NO: 188423 - DNA, 20 bp, Homo sapiens
tggcttactacatgtgggag

SEQ ID NO: 188424 - DNA, 17 bp, Homo sapiens
tggcttgtaactccacc

SEQ ID NO: 188425 - DNA, 21 bp, Homo sapiens
tggcttttcactgctggctgc

SEQ ID NO: 188426 - DNA, 18 bp, Homo sapiens
tgggaaagcattgtaaat

SEQ ID NO: 188427 - DNA, 20 bp, Homo sapiens
tgggaacccaagtccaagca

SEQ ID NO: 188428 - DNA, 20 bp, Homo sapiens
tgggaaccccttcatcctct

SEQ ID NO: 188429 - DNA, 18 bp, Homo sapiens
tgggaagacgcctgagct

SEQ ID NO: 188430 - DNA, 19 bp, Homo sapiens
tgggaagacgcctgagctc

SEQ ID NO: 188431 - DNA, 12 bp, Homo sapiens
tgggaaggaggg

SEQ ID NO: 188432 - DNA, 10 bp, Homo sapiens
tgggaatgtt

SEQ ID NO: 188433 - DNA, 16 bp, Homo sapiens
tgggaatgtttgtctc

SEQ ID NO: 188434 - DNA, 22 bp, Homo sapiens
tgggaatgtttgtctcatccca

SEQ ID NO: 188435 - DNA, 19 bp, Homo sapiens
tgggacaaatcaagcttca

SEQ ID NO: 188436 - DNA, 13 bp, Homo sapiens
tgggaccctttcc

SEQ ID NO: 188437 - DNA, 14 bp, Homo sapiens
tgggaccctttcct

SEQ ID NO: 188438 - DNA, 12 bp, Homo sapiens
tgggactgggag

SEQ ID NO: 188439 - DNA, 13 bp, Homo sapiens
tgggactgggagg

SEQ ID NO: 188440 - DNA, 15 bp, Homo sapiens
tgggagacatgtgac

SEQ ID NO: 188441 - DNA, 18 bp, Homo sapiens
tgggagacctgtaatcat

SEQ ID NO: 188442 - DNA, 18 bp, Homo sapiens
tgggagactgctgagtca

SEQ ID NO: 188443 - DNA, 14 bp, Homo sapiens
tgggagcaggagat

SEQ ID NO: 188444 - DNA, 18 bp, Homo sapiens
tgggagccgggtctgcct

SEQ ID NO: 188445 - DNA, 18 bp, Homo sapiens
tgggaggatctcttgagc

SEQ ID NO: 188446 - DNA, 18 bp, Homo sapiens
tgggaggattgcttgagc

SEQ ID NO: 188447 - DNA, 22 bp, Homo sapiens
tgggaggattgcttgagctcag

SEQ ID NO: 188448 - DNA, 18 bp, Homo sapiens
tgggaggcatggccctgg

SEQ ID NO: 188449 - DNA, 14 bp, Homo sapiens
tgggaggccaagga

SEQ ID NO: 188450 - DNA, 19 bp, Homo sapiens
tgggaggccaaggtgggag

SEQ ID NO: 188451 - DNA, 22 bp, Homo sapiens
tgggaggctcacccccttctcc

SEQ ID NO: 188452 - DNA, 18 bp, Homo sapiens
tgggagggcagcagggct

SEQ ID NO: 188453 - DNA, 12 bp, Homo sapiens
tgggagggccca

SEQ ID NO: 188454 - DNA, 19 bp, Homo sapiens
tgggaggtcaaggctgcag

SEQ ID NO: 188455 - DNA, 13 bp, Homo sapiens
tgggaggtcgagg

SEQ ID NO: 188456 - DNA, 20 bp, Homo sapiens
tgggaggtggaggttgcagt

SEQ ID NO: 188457 - DNA, 22 bp, Homo sapiens
tgggagttgatcgcctttccca

SEQ ID NO: 188458 - DNA, 16 bp, Homo sapiens
tgggatactgcagggc

SEQ ID NO: 188459 - DNA, 16 bp, Homo sapiens
tgggatgttcagcact

SEQ ID NO: 188460 - DNA, 20 bp, Homo sapiens
tgggatgttcagcactgtcc

SEQ ID NO: 188461 - DNA, 22 bp, Homo sapiens
tgggatgttcagcactgtccct

SEQ ID NO: 188462 - DNA, 16 bp, Homo sapiens
tgggattgagtctgtg

SEQ ID NO: 188463 - DNA, 21 bp, Homo sapiens
tgggcacgctgtgggcaggtg

SEQ ID NO: 188464 - DNA, 13 bp, Homo sapiens
tgggcagagccca

SEQ ID NO: 188465 - DNA, 18 bp, Homo sapiens
tgggcattgatggggaag

SEQ ID NO: 188466 - DNA, 23 bp, Homo sapiens
tgggcattgatggggaaggaggc

SEQ ID NO: 188467 - DNA, 18 bp, Homo sapiens
tgggccccaccacctagg

SEQ ID NO: 188468 - DNA, 13 bp, Homo sapiens
tgggccctctctg

SEQ ID NO: 188469 - DNA, 18 bp, Homo sapiens
tgggcctcctctgtccag

SEQ ID NO: 188470 - DNA, 19 bp, Homo sapiens
tgggcggcagagaggactg

SEQ ID NO: 188471 - DNA, 15 bp, Homo sapiens
tgggctctccacctc

SEQ ID NO: 188472 - DNA, 17 bp, Homo sapiens
tgggctctccacctcag

SEQ ID NO: 188473 - DNA, 20 bp, Homo sapiens
tgggctctccacctcagcct

SEQ ID NO: 188474 - DNA, 11 bp, Homo sapiens
tgggctgaggg

SEQ ID NO: 188475 - DNA, 16 bp, Homo sapiens
tgggctgagggagcct

SEQ ID NO: 188476 - DNA, 13 bp, Homo sapiens
tgggctgccctgg

SEQ ID NO: 188477 - DNA, 14 bp, Homo sapiens
tgggctgccctggt

SEQ ID NO: 188478 - DNA, 19 bp, Homo sapiens
tgggcttccatttgtgtgt

SEQ ID NO: 188479 - DNA, 13 bp, Homo sapiens
tggggaaggaggc

SEQ ID NO: 188480 - DNA, 21 bp, Homo sapiens
tggggacgtcctgccacctgg

SEQ ID NO: 188481 - DNA, 21 bp, Homo sapiens
tggggagactgggctgaggga

SEQ ID NO: 188482 - DNA, 19 bp, Homo sapiens
tggggagtaggacatacca

SEQ ID NO: 188483 - DNA, 14 bp, Homo sapiens
tggggatgtgggag

SEQ ID NO: 188484 - DNA, 15 bp, Homo sapiens
tggggatgtgggagg

SEQ ID NO: 188485 - DNA, 14 bp, Homo sapiens
tggggctgctcctc

SEQ ID NO: 188486 - DNA, 14 bp, Homo sapiens
tgggggaagccctg

SEQ ID NO: 188487 - DNA, 20 bp, Homo sapiens
tgggggatcacagcctctga

SEQ ID NO: 188488 - DNA, 13 bp, Homo sapiens
tgttgtgaatgtt

SEQ ID NO: 188489 - DNA, 14 bp, Homo sapiens
tgttgtgatgtatt

SEQ ID NO: 188490 - DNA, 11 bp, Homo sapiens
tgttgttttgt

SEQ ID NO: 188491 - DNA, 20 bp, Homo sapiens
tgttgttttgttttaaatac

SEQ ID NO: 188492 - DNA, 17 bp, Homo sapiens
tgtttaaaatcatttct

SEQ ID NO: 188493 - DNA, 12 bp, Homo sapiens
tgtttacatatc

SEQ ID NO: 188494 - DNA, 19 bp, Homo sapiens
tgtttactagggatccctc

SEQ ID NO: 188495 - DNA, 16 bp, Homo sapiens
tgtttagagttgcaat

SEQ ID NO: 188496 - DNA, 17 bp, Homo sapiens
tgtttagagttgcaatc

SEQ ID NO: 188497 - DNA, 19 bp, Homo sapiens
tgtttagtaaactcaataa

SEQ ID NO: 188498 - DNA, 15 bp, Homo sapiens
tgtttatacagctca

SEQ ID NO: 188499 - DNA, 13 bp, Homo sapiens
tgtttattcctga

SEQ ID NO: 188500 - DNA, 22 bp, Homo sapiens
tgtttccaatgtttagcaaata

SEQ ID NO: 188501 - DNA, 12 bp, Homo sapiens
tgtttccttcag

SEQ ID NO: 188502 - DNA, 11 bp, Homo sapiens
tgtttcctttt

SEQ ID NO: 188503 - DNA, 13 bp, Homo sapiens
tgtttctctgctg

SEQ ID NO: 188504 - DNA, 14 bp, Homo sapiens
tgtttctctgctgt

SEQ ID NO: 188505 - DNA, 15 bp, Homo sapiens
tgtttctctgctgtt

SEQ ID NO: 188506 - DNA, 19 bp, Homo sapiens
tcctcggatcaccgagagt

SEQ ID NO: 188507 - DNA, 17 bp, Homo sapiens
tcctctactaacaatca

SEQ ID NO: 188508 - DNA, 18 bp, Homo sapiens
tcctctactaacaatcag

SEQ ID NO: 188509 - DNA, 18 bp, Homo sapiens
tcctctcactaaacttta

SEQ ID NO: 188510 - DNA, 13 bp, Homo sapiens
tcctctccactgc

SEQ ID NO: 188511 - DNA, 19 bp, Homo sapiens
tcctctcccctctaaggcc

SEQ ID NO: 188512 - DNA, 18 bp, Homo sapiens
tcctctgactcagggctc

SEQ ID NO: 188513 - DNA, 12 bp, Homo sapiens
tcctctgccacc

SEQ ID NO: 188514 - DNA, 22 bp, Homo sapiens
tcctctgccacctcccctatcc

SEQ ID NO: 188515 - DNA, 23 bp, Homo sapiens
tcctctgccacctcccctatcca

SEQ ID NO: 188516 - DNA, 13 bp, Homo sapiens
ttagttaatatat

SEQ ID NO: 188517 - DNA, 15 bp, Homo sapiens
ttagttatagtttca

SEQ ID NO: 188518 - DNA, 18 bp, Homo sapiens
ttagttatagtttcagat

SEQ ID NO: 188519 - DNA, 20 bp, Homo sapiens
ttagttgtatctcttttgaa

SEQ ID NO: 188520 - DNA, 16 bp, Homo sapiens
ttataactcatcataa

SEQ ID NO: 188521 - DNA, 19 bp, Homo sapiens
ttataactcatcataaaat

SEQ ID NO: 188522 - DNA, 13 bp, Homo sapiens
ttataacttaaaa

SEQ ID NO: 188523 - DNA, 15 bp, Homo sapiens
ttataacttaaaaaa

SEQ ID NO: 188524 - DNA, 14 bp, Homo sapiens
ttataagcagattt

SEQ ID NO: 188525 - DNA, 14 bp, Homo sapiens
ttataattttccta

SEQ ID NO: 188526 - DNA, 15 bp, Homo sapiens
ttatagttgtaacta

SEQ ID NO: 188527 - DNA, 18 bp, Homo sapiens
ttatataggttgtgcaaa

SEQ ID NO: 188528 - DNA, 14 bp, Homo sapiens
ttatatatgtattt

SEQ ID NO: 188529 - DNA, 17 bp, Homo sapiens
ttatatatgtatttata

SEQ ID NO: 188530 - DNA, 15 bp, Homo sapiens
ttatatatttataac

SEQ ID NO: 188531 - DNA, 16 bp, Homo sapiens
ttatatgtcaaagcag

SEQ ID NO: 188532 - DNA, 17 bp, Homo sapiens
ttatatttagttatagt

SEQ ID NO: 188533 - DNA, 15 bp, Homo sapiens
ttatatttttataga

SEQ ID NO: 188534 - DNA, 18 bp, Homo sapiens
ttatcaccgtgggctccc

SEQ ID NO: 188535 - DNA, 12 bp, Homo sapiens
ttatcattttca

SEQ ID NO: 188536 - DNA, 19 bp, Homo sapiens
ttatcctaaaacaaatagt

SEQ ID NO: 188537 - DNA, 11 bp, Homo sapiens
ttatctcaaaa

SEQ ID NO: 188538 - DNA, 19 bp, Homo sapiens
ttatctctatttaatattt

SEQ ID NO: 188539 - DNA, 18 bp, Homo sapiens
aaattttctagactttct

SEQ ID NO: 188540 - DNA, 12 bp, Homo sapiens
aacaaaatagaa

SEQ ID NO: 188541 - DNA, 11 bp, Homo sapiens
aacaaagccag

SEQ ID NO: 188542 - DNA, 12 bp, Homo sapiens
aacaaagccaga

SEQ ID NO: 188543 - DNA, 21 bp, Homo sapiens
aacaagaagccacagacctag

SEQ ID NO: 188544 - DNA, 14 bp, Homo sapiens
aacaataaagagat

SEQ ID NO: 188545 - DNA, 20 bp, Homo sapiens
aacaatttcctttatattta

SEQ ID NO: 188546 - DNA, 18 bp, Homo sapiens
aacacagcaagggtgatg

SEQ ID NO: 188547 - DNA, 20 bp, Homo sapiens
aacacagcaagggtgatggg

SEQ ID NO: 188548 - DNA, 16 bp, Homo sapiens
aacacatcagcttgcc

SEQ ID NO: 188549 - DNA, 20 bp, Homo sapiens
aacacatttgattctgtgtg

SEQ ID NO: 188550 - DNA, 15 bp, Homo sapiens
aacacgagcaggcta

SEQ ID NO: 188551 - DNA, 15 bp, Homo sapiens
aacactataaaggtt

SEQ ID NO: 188552 - DNA, 16 bp, Homo sapiens
aacactgggggagggg

SEQ ID NO: 188553 - DNA, 17 bp, Homo sapiens
aacactgggggagggga

SEQ ID NO: 188554 - DNA, 11 bp, Homo sapiens
aacacttccat

SEQ ID NO: 188555 - DNA, 11 bp, Homo sapiens
aacagacagga

SEQ ID NO: 188556 - DNA, 14 bp, Homo sapiens
aacagacaggagaa

SEQ ID NO: 188557 - DNA, 16 bp, Homo sapiens
aacagataaatagttt

SEQ ID NO: 188558 - DNA, 17 bp, Homo sapiens
aacagatgtttcttttg

SEQ ID NO: 188559 - DNA, 17 bp, Homo sapiens
aacagcagaggttcttt

SEQ ID NO: 188560 - DNA, 11 bp, Homo sapiens
aacagcagtgt

SEQ ID NO: 188561 - DNA, 13 bp, Homo sapiens
aacagcgctgggt

SEQ ID NO: 188562 - DNA, 19 bp, Homo sapiens
aacaggagctgggatccta

SEQ ID NO: 188563 - DNA, 14 bp, Homo sapiens
aacaggcaagtgaa

SEQ ID NO: 188564 - DNA, 18 bp, Homo sapiens
aacaggctactctcctcg

SEQ ID NO: 188565 - DNA, 17 bp, Homo sapiens
aacaggtctcctcttaa

SEQ ID NO: 188566 - DNA, 14 bp, Homo sapiens
aacagtaaatgtgc

SEQ ID NO: 188567 - DNA, 17 bp, Homo sapiens
aacagtcaaaacagaga

SEQ ID NO: 188568 - DNA, 14 bp, Homo sapiens
aacagtcatttaaa

SEQ ID NO: 188569 - DNA, 14 bp, Homo sapiens
aacagtctcaggaa

SEQ ID NO: 188570 - DNA, 14 bp, Homo sapiens
aacataaaatacaa

SEQ ID NO: 188571 - DNA, 14 bp, Homo sapiens
aacataaataaaat

SEQ ID NO: 188572 - DNA, 18 bp, Homo sapiens
aacataattcttgtatat

SEQ ID NO: 188573 - DNA, 13 bp, Homo sapiens
aacatataatgtt

SEQ ID NO: 188574 - DNA, 21 bp, Homo sapiens
aacatataatgttgttattta

SEQ ID NO: 188575 - DNA, 22 bp, Homo sapiens
aacatataatgttgttatttaa

SEQ ID NO: 188576 - DNA, 13 bp, Homo sapiens
aacatcacacaca

SEQ ID NO: 188577 - DNA, 16 bp, Homo sapiens
aacatctgaaagccac

SEQ ID NO: 188578 - DNA, 19 bp, Homo sapiens
aacatgcaattttgcattt

SEQ ID NO: 188579 - DNA, 16 bp, Homo sapiens
aacattaagaaaatca

SEQ ID NO: 188580 - DNA, 20 bp, Homo sapiens
aaccaaaggtgaaggaatat

SEQ ID NO: 188581 - DNA, 23 bp, Homo sapiens
aaccaaaggtgaaggaatatatg

SEQ ID NO: 188582 - DNA, 17 bp, Homo sapiens
aaccagaagcaacagaa

SEQ ID NO: 188583 - DNA, 21 bp, Homo sapiens
aaccagaagcaacagaaaaaa

SEQ ID NO: 188584 - DNA, 22 bp, Homo sapiens
aaccagaagcaacagaaaaaat

SEQ ID NO: 188585 - DNA, 22 bp, Homo sapiens
aaccagctgtaacacagctgag

SEQ ID NO: 188586 - DNA, 15 bp, Homo sapiens
aaccatgaagacagg

SEQ ID NO: 188587 - DNA, 23 bp, Homo sapiens
aaccatgtcagcaaaaagcaaaa

SEQ ID NO: 188588 - DNA, 14 bp, Homo sapiens
aacccacctgctga

SEQ ID NO: 188589 - DNA, 17 bp, Homo sapiens
aacccatcagaaggaga

SEQ ID NO: 188590 - DNA, 16 bp, Homo sapiens
aaccccaactccagta

SEQ ID NO: 188591 - DNA, 22 bp, Homo sapiens
aaccccgtcgaggggctctcag

SEQ ID NO: 188592 - DNA, 14 bp, Homo sapiens
aacctaaaaaagat

SEQ ID NO: 188593 - DNA, 15 bp, Homo sapiens
aacctaaaaaagata

SEQ ID NO: 188594 - DNA, 16 bp, Homo sapiens
aacctaaaaaagatat

SEQ ID NO: 188595 - DNA, 20 bp, Homo sapiens
aacctactttcatactgaag

SEQ ID NO: 188596 - DNA, 14 bp, Homo sapiens
aacctcattcccca

SEQ ID NO: 188597 - DNA, 21 bp, Homo sapiens
aacctcattgacaagaactga

SEQ ID NO: 188598 - DNA, 14 bp, Homo sapiens
aacctcgctggact

SEQ ID NO: 188599 - DNA, 18 bp, Homo sapiens
aacctcttcagaggccct

SEQ ID NO: 188600 - DNA, 11 bp, Homo sapiens
aacctgaaaaa

SEQ ID NO: 188601 - DNA, 21 bp, Homo sapiens
aacctgaaaaaaagtttacaa

SEQ ID NO: 188602 - DNA, 23 bp, Homo sapiens
aacctggtcacaggactctgcct

SEQ ID NO: 188603 - DNA, 15 bp, Homo sapiens
aacctgtccttgcac

SEQ ID NO: 188604 - DNA, 17 bp, Homo sapiens
aaccttccatctcgcca

SEQ ID NO: 188605 - DNA, 19 bp, Homo sapiens
aaccttccatctcgccacc

SEQ ID NO: 188606 - DNA, 16 bp, Homo sapiens
aacgagtcaatcccct

SEQ ID NO: 188607 - DNA, 12 bp, Homo sapiens
aacgcagccctg

SEQ ID NO: 188608 - DNA, 19 bp, Homo sapiens
aacggagagcgcctgcccc

SEQ ID NO: 188609 - DNA, 12 bp, Homo sapiens
aacgtgaaaatg

SEQ ID NO: 188610 - DNA, 17 bp, Homo sapiens
aacgtggctctgctggc

SEQ ID NO: 188611 - DNA, 14 bp, Homo sapiens
aactaataaaagca

SEQ ID NO: 188612 - DNA, 20 bp, Homo sapiens
aactagactcccaagctgga

SEQ ID NO: 188613 - DNA, 23 bp, Homo sapiens
aactagactcccaagctggacta

SEQ ID NO: 188614 - DNA, 15 bp, Homo sapiens
aactagccaccaact

SEQ ID NO: 188615 - DNA, 18 bp, Homo sapiens
aactatgatatggtaaaa

SEQ ID NO: 188616 - DNA, 16 bp, Homo sapiens
aactatgatttggaaa

SEQ ID NO: 188617 - DNA, 21 bp, Homo sapiens
aactatgatttggaaaataaa

SEQ ID NO: 188618 - DNA, 19 bp, Homo sapiens
aactcaaaacttaacatat

SEQ ID NO: 188619 - DNA, 15 bp, Homo sapiens
aactcaccatgtaaa

SEQ ID NO: 188620 - DNA, 14 bp, Homo sapiens
aactcatcataaaa

SEQ ID NO: 188621 - DNA, 18 bp, Homo sapiens
aactcatcataaaataaa

SEQ ID NO: 188622 - DNA, 21 bp, Homo sapiens
aactcattcctgcctgtctcc

SEQ ID NO: 188623 - DNA, 19 bp, Homo sapiens
aactctctttgggaatgtt

SEQ ID NO: 188624 - DNA, 22 bp, Homo sapiens
aactctgctgtctaacctgtga

SEQ ID NO: 188625 - DNA, 21 bp, Homo sapiens
aactcttcaatctcttgcact

SEQ ID NO: 188626 - DNA, 12 bp, Homo sapiens
aactgaaaagac

SEQ ID NO: 188627 - DNA, 13 bp, Homo sapiens
aactgaaggagaa

SEQ ID NO: 188628 - DNA, 19 bp, Homo sapiens
aactgaccagcctccatgc

SEQ ID NO: 188629 - DNA, 20 bp, Homo sapiens
aactgagatgtgaacacatc

SEQ ID NO: 188630 - DNA, 19 bp, Homo sapiens
aactgcactgtcaagatga

SEQ ID NO: 188631 - DNA, 16 bp, Homo sapiens
aactgcattggctttg

SEQ ID NO: 188632 - DNA, 17 bp, Homo sapiens
aactgccttaaaacttt

SEQ ID NO: 188633 - DNA, 21 bp, Homo sapiens
aactgctgactgttttctctt

SEQ ID NO: 188634 - DNA, 20 bp, Homo sapiens
aactggaagcatgtaggaga

SEQ ID NO: 188635 - DNA, 15 bp, Homo sapiens
aactggactcaggat

SEQ ID NO: 188636 - DNA, 22 bp, Homo sapiens
aactggactcaggatgcccagg

SEQ ID NO: 188637 - DNA, 15 bp, Homo sapiens
aactgttgccagaga

SEQ ID NO: 188638 - DNA, 17 bp, Homo sapiens
aactgttgccagagatg

SEQ ID NO: 188639 - DNA, 13 bp, Homo sapiens
aacttaaaatatt

SEQ ID NO: 188640 - DNA, 14 bp, Homo sapiens
aacttaaaatattt

SEQ ID NO: 188641 - DNA, 19 bp, Homo sapiens
aacttaaattttaatttat

SEQ ID NO: 188642 - DNA, 16 bp, Homo sapiens
aacttaggtggcaagc

SEQ ID NO: 188643 - DNA, 18 bp, Homo sapiens
aacttcagcagtacctat

SEQ ID NO: 188644 - DNA, 21 bp, Homo sapiens
aacttcaggataataaagtgt

SEQ ID NO: 188645 - DNA, 22 bp, Homo sapiens
aacttccttggactcattttaa

SEQ ID NO: 188646 - DNA, 14 bp, Homo sapiens
aacttctaatatat

SEQ ID NO: 188647 - DNA, 19 bp, Homo sapiens
aacttgagggcccagagca

SEQ ID NO: 188648 - DNA, 20 bp, Homo sapiens
aacttgagggcccagagcag

SEQ ID NO: 188649 - DNA, 22 bp, Homo sapiens
aacttgctgcagtatgaaaata

SEQ ID NO: 188650 - DNA, 20 bp, Homo sapiens
aactttacccaaaaactaaa

SEQ ID NO: 188651 - DNA, 15 bp, Homo sapiens
aactttctgtaaact

SEQ ID NO: 188652 - DNA, 13 bp, Homo sapiens
aagaaaaagaaaa

SEQ ID NO: 188653 - DNA, 18 bp, Homo sapiens
aagaaaaagaaaaagaaa

SEQ ID NO: 188654 - DNA, 14 bp, Homo sapiens
aagaaaacaacttc

SEQ ID NO: 188655 - DNA, 11 bp, Homo sapiens
aagaaaagata

SEQ ID NO: 188656 - DNA, 15 bp, Homo sapiens
aagaaaagataaaga

SEQ ID NO: 188657 - DNA, 11 bp, Homo sapiens
aagaaaatatt

SEQ ID NO: 188658 - DNA, 15 bp, Homo sapiens
aagaaaatattttgt

SEQ ID NO: 188659 - DNA, 23 bp, Homo sapiens
aagaaaatcagatggagcatgaa

SEQ ID NO: 188660 - DNA, 20 bp, Homo sapiens
aagaaaatcatattgcttct

SEQ ID NO: 188661 - DNA, 19 bp, Homo sapiens
aagaaacaactctttgaga

SEQ ID NO: 188662 - DNA, 11 bp, Homo sapiens
aagaaacccaa

SEQ ID NO: 188663 - DNA, 16 bp, Homo sapiens
aagaaacccgacagag

SEQ ID NO: 188664 - DNA, 14 bp, Homo sapiens
aagaaagaaaatca

SEQ ID NO: 188665 - DNA, 13 bp, Homo sapiens
aagaaatccctgt

SEQ ID NO: 188666 - DNA, 23 bp, Homo sapiens
aagaaatccctgtttaatattta

SEQ ID NO: 188667 - DNA, 19 bp, Homo sapiens
aagaacaccctatattttg

SEQ ID NO: 188668 - DNA, 21 bp, Homo sapiens
aagaacaccctatattttgca

SEQ ID NO: 188669 - DNA, 23 bp, Homo sapiens
aagaaggtttcagaaagaagtgg

SEQ ID NO: 188670 - DNA, 21 bp, Homo sapiens
aagaataaaatgttgaaaagt

SEQ ID NO: 188671 - DNA, 14 bp, Homo sapiens
aagaatacagaaag

SEQ ID NO: 188672 - DNA, 16 bp, Homo sapiens
aagaattgaacccagg

SEQ ID NO: 188673 - DNA, 16 bp, Homo sapiens
aagaattgaagcagga

SEQ ID NO: 188674 - DNA, 22 bp, Homo sapiens
aagaattttcagaccccagcgg

SEQ ID NO: 188675 - DNA, 20 bp, Homo sapiens
aagacaatgtgaaaagaaaa

SEQ ID NO: 188676 - DNA, 13 bp, Homo sapiens
aagacagaagcct

SEQ ID NO: 188677 - DNA, 19 bp, Homo sapiens
aagacatggggaggaagga

SEQ ID NO: 188678 - DNA, 17 bp, Homo sapiens
aagaccacaaaaattga

SEQ ID NO: 188679 - DNA, 13 bp, Homo sapiens
aagacccaaaagg

SEQ ID NO: 188680 - DNA, 16 bp, Homo sapiens
aagactaatttaaaaa

SEQ ID NO: 188681 - DNA, 16 bp, Homo sapiens
aagactccaaagaaat

SEQ ID NO: 188682 - DNA, 17 bp, Homo sapiens
aagactccaaagaaatg

SEQ ID NO: 188683 - DNA, 22 bp, Homo sapiens
aagactctaccagactgtgtat

SEQ ID NO: 188684 - DNA, 18 bp, Homo sapiens
aagactgtggctgctagc

SEQ ID NO: 188685 - DNA, 20 bp, Homo sapiens
aagacttcagtatgttgtca

SEQ ID NO: 188686 - DNA, 16 bp, Homo sapiens
aagacttggcaacaga

SEQ ID NO: 188687 - DNA, 17 bp, Homo sapiens
aagacttggcaacagaa

SEQ ID NO: 188688 - DNA, 19 bp, Homo sapiens
aggagggggcaggctgagg

SEQ ID NO: 188689 - DNA, 20 bp, Homo sapiens
aggatgtggaaacctccttc

SEQ ID NO: 188690 - DNA, 16 bp, Homo sapiens
aggcacatgtcagcaa

SEQ ID NO: 188691 - DNA, 22 bp, Homo sapiens
agggacgaagaagagccacagt

SEQ ID NO: 188692 - DNA, 16 bp, Homo sapiens
agggactacctctgtg

SEQ ID NO: 188693 - DNA, 18 bp, Homo sapiens
agggactacctctgtgcc

SEQ ID NO: 188694 - DNA, 20 bp, Homo sapiens
agggtcgtgggaaaggggag

SEQ ID NO: 188695 - DNA, 22 bp, Homo sapiens
agggtcgtgggaaaggggagta

SEQ ID NO: 188696 - DNA, 17 bp, Homo sapiens
agtaggtgggggaacac

SEQ ID NO: 188697 - DNA, 20 bp, Homo sapiens
agtaggtgggggaacactga

SEQ ID NO: 188698 - DNA, 16 bp, Homo sapiens
agtgagggagatccca

SEQ ID NO: 188699 - DNA, 21 bp, Homo sapiens
ataactaacaaccaaagacta

SEQ ID NO: 188700 - DNA, 19 bp, Homo sapiens
atacaaaggcttattaatt

SEQ ID NO: 188701 - DNA, 18 bp, Homo sapiens
atagaatggtatcaataa

SEQ ID NO: 188702 - DNA, 20 bp, Homo sapiens
aaaaatgttctattttaatt

SEQ ID NO: 188703 - DNA, 20 bp, Homo sapiens
aaaggctatgattgtctttg

SEQ ID NO: 188704 - DNA, 19 bp, Homo sapiens
aacactgagaaagaggcag

SEQ ID NO: 188705 - DNA, 15 bp, Homo sapiens
aagaggcagggacct

SEQ ID NO: 188706 - DNA, 21 bp, Homo sapiens
aagcacgtggtaaaacacttg

SEQ ID NO: 188707 - DNA, 18 bp, Homo sapiens
aagggactacctctgtgc

SEQ ID NO: 188708 - DNA, 22 bp, Homo sapiens
aaggggagtaggtgggggaaca

SEQ ID NO: 188709 - DNA, 18 bp, Homo sapiens
aagtcagctcttctccat

SEQ ID NO: 188710 - DNA, 14 bp, Homo sapiens
acaaagggcccaga

SEQ ID NO: 188711 - DNA, 19 bp, Homo sapiens
acactgagaaagaggcagg

SEQ ID NO: 188712 - DNA, 21 bp, Homo sapiens
acattaaattgataacatgga

SEQ ID NO: 188713 - DNA, 14 bp, Homo sapiens
accaagctgctgtg

SEQ ID NO: 188714 - DNA, 21 bp, Homo sapiens
accagggatgatgcaacatcc

SEQ ID NO: 188715 - DNA, 23 bp, Homo sapiens
acccaaccacatcccactcacaa

SEQ ID NO: 188716 - DNA, 21 bp, Homo sapiens
acctaaagggactacctctgt

SEQ ID NO: 188717 - DNA, 11 bp, Homo sapiens
acctctgtgcc

SEQ ID NO: 188718 - DNA, 15 bp, Homo sapiens
actacctctgtgcct

SEQ ID NO: 188719 - DNA, 15 bp, Homo sapiens
actggagccatgggc

SEQ ID NO: 188720 - DNA, 13 bp, Homo sapiens
agaagagccacag

SEQ ID NO: 188721 - DNA, 22 bp, Homo sapiens
agaagagccacagtgagggaga

SEQ ID NO: 188722 - DNA, 18 bp, Homo sapiens
agacagtatataactaac

SEQ ID NO: 188723 - DNA, 23 bp, Homo sapiens
agactcctgactgtctcccggga

SEQ ID NO: 188724 - DNA, 19 bp, Homo sapiens
agaggagggggcaggctga

SEQ ID NO: 188725 - DNA, 20 bp, Homo sapiens
agaggagggggcaggctgag

SEQ ID NO: 188726 - DNA, 16 bp, Homo sapiens
agaggcagggacctaa

SEQ ID NO: 188727 - DNA, 21 bp, Homo sapiens
agatcaccagtgtgtggcttt

SEQ ID NO: 188728 - DNA, 15 bp, Homo sapiens
agatgttcacccaac

SEQ ID NO: 188729 - DNA, 20 bp, Homo sapiens
agccacagtgagggagatcc

SEQ ID NO: 188730 - DNA, 22 bp, Homo sapiens
agccatgggcacaaagggccca

SEQ ID NO: 188731 - DNA, 13 bp, Homo sapiens
agcctacaggcct

SEQ ID NO: 188732 - DNA, 14 bp, Homo sapiens
agcctacaggcctc

SEQ ID NO: 188733 - DNA, 21 bp, Homo sapiens
agctccttgagggcaagagcc

SEQ ID NO: 188734 - DNA, 14 bp, Homo sapiens
agctcttctccatc

SEQ ID NO: 188735 - DNA, 14 bp, Homo sapiens
aggaagcagccaag

SEQ ID NO: 188736 - DNA, 20 bp, Homo sapiens
aggactttatagatcagcca

SEQ ID NO: 188737 - DNA, 21 bp, Homo sapiens
aggactttatagatcagccag

SEQ ID NO: 188738 - DNA, 16 bp, Homo sapiens
ctaacaaccaaagact

SEQ ID NO: 188739 - DNA, 17 bp, Homo sapiens
ctaagtgtttcataaat

SEQ ID NO: 188740 - DNA, 12 bp, Homo sapiens
ctacctctgtgc

SEQ ID NO: 188741 - DNA, 13 bp, Homo sapiens
ctacctctgtgcc

SEQ ID NO: 188742 - DNA, 17 bp, Homo sapiens
ctacctctgtgccttgc

SEQ ID NO: 188743 - DNA, 23 bp, Homo sapiens
ctcaccccagactcctgactgtc

SEQ ID NO: 188744 - DNA, 17 bp, Homo sapiens
ctccctagttccttcat

SEQ ID NO: 188745 - DNA, 22 bp, Homo sapiens
ctccttgagggcaagagccaca

SEQ ID NO: 188746 - DNA, 14 bp, Homo sapiens
ctcctttctggctt

SEQ ID NO: 188747 - DNA, 15 bp, Homo sapiens
ctctggtaacctctt

SEQ ID NO: 188748 - DNA, 11 bp, Homo sapiens
ctgagaaagag

SEQ ID NO: 188749 - DNA, 15 bp, Homo sapiens
ctgagaaagaggcag

SEQ ID NO: 188750 - DNA, 15 bp, Homo sapiens
ctgagggtcgtggga

SEQ ID NO: 188751 - DNA, 16 bp, Homo sapiens
ctgagggtcgtgggaa

SEQ ID NO: 188752 - DNA, 19 bp, Homo sapiens
ctgcctggaagagcagccc

SEQ ID NO: 188753 - DNA, 22 bp, Homo sapiens
ctgtcatatgctctgatttatc

SEQ ID NO: 188754 - DNA, 15 bp, Homo sapiens
cttatcgaaactcat

SEQ ID NO: 188755 - DNA, 23 bp, Homo sapiens
cttatctaatcatgaaactccct

SEQ ID NO: 188756 - DNA, 16 bp, Homo sapiens
cttcaggacactcact

SEQ ID NO: 188757 - DNA, 19 bp, Homo sapiens
cttccacgtactgcagcct

SEQ ID NO: 188758 - DNA, 20 bp, Homo sapiens
cttccacgtactgcagcctc

SEQ ID NO: 188759 - DNA, 18 bp, Homo sapiens
cttgagggcaagagccac

SEQ ID NO: 188760 - DNA, 15 bp, Homo sapiens
ctttatagatcagcc

SEQ ID NO: 188761 - DNA, 14 bp, Homo sapiens
ctttcagagcctcc

SEQ ID NO: 188762 - DNA, 11 bp, Homo sapiens
gaaaatcatat

SEQ ID NO: 188763 - DNA, 14 bp, Homo sapiens
gaaagaggcaggga

SEQ ID NO: 188764 - DNA, 20 bp, Homo sapiens
gaaaggggagtaggtggggg

SEQ ID NO: 188765 - DNA, 21 bp, Homo sapiens
gaaaggggagtaggtggggga

SEQ ID NO: 188766 - DNA, 22 bp, Homo sapiens
gaacactgagaaagaggcaggg

SEQ ID NO: 188767 - DNA, 15 bp, Homo sapiens
gaacgtcttatctaa

SEQ ID NO: 188768 - DNA, 17 bp, Homo sapiens
gaactggagccatgggc

SEQ ID NO: 188769 - DNA, 18 bp, Homo sapiens
gaactggagccatgggca

SEQ ID NO: 188770 - DNA, 12 bp, Homo sapiens
gaagagccacag

SEQ ID NO: 188771 - DNA, 14 bp, Homo sapiens
gaatctagaggagg

SEQ ID NO: 188772 - DNA, 21 bp, Homo sapiens
gacctcaccaagctgctgtgg

SEQ ID NO: 188773 - DNA, 19 bp, Homo sapiens
gactttatagatcagccag

SEQ ID NO: 188774 - DNA, 21 bp, Homo sapiens
gagatcaccagtgtgtggctt

SEQ ID NO: 188775 - DNA, 19 bp, Homo sapiens
gagatcccatccccttgtc

SEQ ID NO: 188776 - DNA, 15 bp, Homo sapiens
gagatccttatcgaa

SEQ ID NO: 188777 - DNA, 17 bp, Homo sapiens
gagccatgggcacaaag

SEQ ID NO: 188778 - DNA, 18 bp, Homo sapiens
gagccatgggcacaaagg

SEQ ID NO: 188779 - DNA, 12 bp, Homo sapiens
gaggcagggacc

SEQ ID NO: 188780 - DNA, 16 bp, Homo sapiens
gaggcagggacctaaa

SEQ ID NO: 188781 - DNA, 22 bp, Homo sapiens
gaggcagggacctaaagggact

SEQ ID NO: 188782 - DNA, 11 bp, Homo sapiens
gaggccttcca

SEQ ID NO: 188783 - DNA, 16 bp, Homo sapiens
gagggtcgtgggaaag

SEQ ID NO: 188784 - DNA, 17 bp, Homo sapiens
gagggtcgtgggaaagg

SEQ ID NO: 188785 - DNA, 18 bp, Homo sapiens
gagggtcgtgggaaaggg

SEQ ID NO: 188786 - DNA, 21 bp, Homo sapiens
gcaagtcctaagcctgttagc

SEQ ID NO: 188787 - DNA, 22 bp, Homo sapiens
gcaggctgagggtcgtgggaaa

SEQ ID NO: 188788 - DNA, 17 bp, Homo sapiens
gcatgctggtgagccaa

SEQ ID NO: 188789 - DNA, 17 bp, Homo sapiens
gcctggaagagcagccc

SEQ ID NO: 188790 - DNA, 16 bp, Homo sapiens
gcctgggtccagggga

SEQ ID NO: 188791 - DNA, 17 bp, Homo sapiens
gcctttcttctctccag

SEQ ID NO: 188792 - DNA, 21 bp, Homo sapiens
gcgaatctagaggagggggca

SEQ ID NO: 188793 - DNA, 19 bp, Homo sapiens
gctgagggtcgtgggaaag

SEQ ID NO: 188794 - DNA, 22 bp, Homo sapiens
gctgagggtcgtgggaaagggg

SEQ ID NO: 188795 - DNA, 22 bp, Homo sapiens
gcttcattcaagtcagctcttc

SEQ ID NO: 188796 - DNA, 14 bp, Homo sapiens
gctttggaagccat

SEQ ID NO: 188797 - DNA, 13 bp, Homo sapiens
ggacctcaccaag

SEQ ID NO: 188798 - DNA, 20 bp, Homo sapiens
ggacgaagaagagccacagt

SEQ ID NO: 188799 - DNA, 16 bp, Homo sapiens
ggagaggttgtctgtg

SEQ ID NO: 188800 - DNA, 15 bp, Homo sapiens
ggagggggcaggctg

SEQ ID NO: 188801 - DNA, 18 bp, Homo sapiens
ggagggggcaggctgagg

SEQ ID NO: 188802 - DNA, 15 bp, Homo sapiens
ggcaggctgagggtc

SEQ ID NO: 188803 - DNA, 16 bp, Homo sapiens
ggcagggacctaaagg

SEQ ID NO: 188804 - DNA, 20 bp, Homo sapiens
ggcagggacctaaagggact

SEQ ID NO: 188805 - DNA, 17 bp, Homo sapiens
ggctgagggtcgtggga

SEQ ID NO: 188806 - DNA, 17 bp, Homo sapiens
gggacgaagaagagcca

SEQ ID NO: 188807 - DNA, 17 bp, Homo sapiens
gggcacaaagggcccag

SEQ ID NO: 188808 - DNA, 21 bp, Homo sapiens
gggcaggctgagggtcgtggg

SEQ ID NO: 188809 - DNA, 18 bp, Homo sapiens
ggggaacactgagaaaga

SEQ ID NO: 188810 - DNA, 14 bp, Homo sapiens
ggggcaggctgagg

SEQ ID NO: 188811 - DNA, 19 bp, Homo sapiens
gggggaacactgagaaaga

SEQ ID NO: 188812 - DNA, 20 bp, Homo sapiens
gggtcgtgggaaaggggagt

SEQ ID NO: 188813 - DNA, 13 bp, Homo sapiens
ggtaaaacacttg

SEQ ID NO: 188814 - DNA, 20 bp, Homo sapiens
gtgccttgccacattaaatt

SEQ ID NO: 188815 - DNA, 17 bp, Homo sapiens
gttcccctttgcttcat

SEQ ID NO: 188816 - DNA, 16 bp, Homo sapiens
gtttacttgtttcaga

SEQ ID NO: 188817 - DNA, 20 bp, Homo sapiens
taaagggactacctctgtgc

SEQ ID NO: 188818 - DNA, 22 bp, Homo sapiens
taaagggactacctctgtgcct

SEQ ID NO: 188819 - DNA, 15 bp, Homo sapiens
taacaaccaaagact

SEQ ID NO: 188820 - DNA, 14 bp, Homo sapiens
tgagggtcgtggga

SEQ ID NO: 188821 - DNA, 22 bp, Homo sapiens
tgagggtcgtgggaaaggggag

SEQ ID NO: 188822 - DNA, 19 bp, Homo sapiens
tgattttaagaatccaaac

SEQ ID NO: 188823 - DNA, 15 bp, Homo sapiens
tgccacattaaattg

SEQ ID NO: 188824 - DNA, 20 bp, Homo sapiens
tgcctggaagagcagcccta

SEQ ID NO: 188825 - DNA, 18 bp, Homo sapiens
tgctgtccggtggagatc

SEQ ID NO: 188826 - DNA, 18 bp, Homo sapiens
tggaactaggttttaata

SEQ ID NO: 188827 - DNA, 20 bp, Homo sapiens
tggaactaggttttaataat

SEQ ID NO: 188828 - DNA, 17 bp, Homo sapiens
tggctttcagagcctcc

SEQ ID NO: 188829 - DNA, 24 bp, Homo sapiens
tgggacctccaccgttggtgttca

SEQ ID NO: 188830 - DNA, 18 bp, Homo sapiens
tgggggaacactgagaaa

SEQ ID NO: 188831 - DNA, 14 bp, Homo sapiens
tggtaaaacacttg

SEQ ID NO: 188832 - DNA, 20 bp, Homo sapiens
tgtaggagaggttgtctgtg

SEQ ID NO: 188833 - DNA, 17 bp, Homo sapiens
tgtcactgacacacacg

SEQ ID NO: 188834 - DNA, 17 bp, Homo sapiens
tgtggctttcagagcct

SEQ ID NO: 188835 - DNA, 12 bp, Homo sapiens
ttaaaactcctg

SEQ ID NO: 188836 - DNA, 18 bp, Homo sapiens
ttatctaatcatgaaact

SEQ ID NO: 188837 - DNA, 18 bp, Homo sapiens
ttatctgagtcaactcct

SEQ ID NO: 188838 - DNA, 16 bp, Homo sapiens
ttatcttaaaactcct

SEQ ID NO: 188839 - DNA, 14 bp, Homo sapiens
ttgccacattaaat

SEQ ID NO: 188840 - DNA, 15 bp, Homo sapiens
tttacttgtttcaga

SEQ ID NO: 188841 - DNA, 18 bp, Homo sapiens
tttgctcagcttctccaa

SEQ ID NO: 188842 - DNA, 13 bp, Homo sapiens
ccatgttggctag

SEQ ID NO: 188843 - DNA, 17 bp, Homo sapiens
cccatgtctacacagat

SEQ ID NO: 188844 - DNA, 19 bp, Homo sapiens
ccgaaggaaaagggctttc

SEQ ID NO: 188845 - DNA, 23 bp, Homo sapiens
cctaaagggactacctctgtgcc

SEQ ID NO: 188846 - DNA, 16 bp, Homo sapiens
ccttatcgaaactcat

SEQ ID NO: 188847 - DNA, 17 bp, Homo sapiens
ccttgccacattaaatt

SEQ ID NO: 188848 - DNA, 15 bp, Homo sapiens
cgaagaagagccaca

SEQ ID NO: 188849 - DNA, 19 bp, Homo sapiens
cgcccccaccctgagcgcc

SEQ ID NO: 188850 - DNA, 17 bp, Homo sapiens
cgcctgggtccagggga

SEQ ID NO: 188851 - DNA, 12 bp, Homo sapiens
ctacaggcctca

SEQ ID NO: 188852 - DNA, 13 bp, Homo sapiens
gctttcagagcct

SEQ ID NO: 188853 - DNA, 18 bp, Homo sapiens
ggaacactgagaaagagg

SEQ ID NO: 188854 - DNA, 19 bp, Homo sapiens
ggacgaagaagagccacag

SEQ ID NO: 188855 - DNA, 17 bp, Homo sapiens
ggaggccttccagggac

SEQ ID NO: 188856 - DNA, 18 bp, Homo sapiens
ggcagggacctaaaggga

SEQ ID NO: 188857 - DNA, 21 bp, Homo sapiens
ggctgagggtcgtgggaaagg

SEQ ID NO: 188858 - DNA, 19 bp, Homo sapiens
gggacgaagaagagccaca

SEQ ID NO: 188859 - DNA, 20 bp, Homo sapiens
gggacgaagaagagccacag

SEQ ID NO: 188860 - DNA, 21 bp, Homo sapiens
gggacgaagaagagccacagt

SEQ ID NO: 188861 - DNA, 13 bp, Homo sapiens
gggtcgtgggaaa

SEQ ID NO: 188862 - DNA, 19 bp, Homo sapiens
gggtcgtgggaaaggggag

SEQ ID NO: 188863 - DNA, 16 bp, Homo sapiens
gtcactgacacacacg

SEQ ID NO: 188864 - DNA, 18 bp, Homo sapiens
gtccaggggaggccttcc

SEQ ID NO: 188865 - DNA, 16 bp, Homo sapiens
gtgggaaaggggagta

SEQ ID NO: 188866 - DNA, 21 bp, Homo sapiens
gtgggggaacactgagaaaga

SEQ ID NO: 188867 - DNA, 14 bp, Homo sapiens
gttcagtaccacat

SEQ ID NO: 188868 - DNA, 18 bp, Homo sapiens
taaagggactacctctgt

SEQ ID NO: 188869 - DNA, 15 bp, Homo sapiens
tacaggcctcacaca

SEQ ID NO: 188870 - DNA, 12 bp, Homo sapiens
tacctctgtgcc

SEQ ID NO: 188871 - DNA, 12 bp, Homo sapiens
tactgcagcctc

SEQ ID NO: 188872 - DNA, 23 bp, Homo sapiens
taggttttaataattttttaatt

SEQ ID NO: 188873 - DNA, 13 bp, Homo sapiens
tatagatcagcca

SEQ ID NO: 188874 - DNA, 19 bp, Homo sapiens
tatcaattaccacaccatc

SEQ ID NO: 188875 - DNA, 16 bp, Homo sapiens
tatcctatctctccaa

SEQ ID NO: 188876 - DNA, 13 bp, Homo sapiens
tcaattaccacac

SEQ ID NO: 188877 - DNA, 18 bp, Homo sapiens
tcaccagtgtgtggcttt

SEQ ID NO: 188878 - DNA, 14 bp, Homo sapiens
tcactgctcacact

SEQ ID NO: 188879 - DNA, 21 bp, Homo sapiens
tcagagcctcctttctggctt

SEQ ID NO: 188880 - DNA, 14 bp, Homo sapiens
tcatatatatacat

SEQ ID NO: 188881 - DNA, 20 bp, Homo sapiens
tcatgtaacttccctgaaaa

SEQ ID NO: 188882 - DNA, 15 bp, Homo sapiens
tccacgtactgcagc

SEQ ID NO: 188883 - DNA, 17 bp, Homo sapiens
tccacgtactgcagcct

SEQ ID NO: 188884 - DNA, 18 bp, Homo sapiens
tccacgtactgcagcctc

SEQ ID NO: 188885 - DNA, 20 bp, Homo sapiens
tcccaattcatcctcactca

SEQ ID NO: 188886 - DNA, 20 bp, Homo sapiens
tccccttgtctgaactggag

SEQ ID NO: 188887 - DNA, 22 bp, Homo sapiens
tccctgtttcttccacagtgcc

SEQ ID NO: 188888 - DNA, 18 bp, Homo sapiens
tctaatcatgaaactccc

SEQ ID NO: 188889 - DNA, 23 bp, Homo sapiens
tctagaggagggggcaggctgag

SEQ ID NO: 188890 - DNA, 23 bp, Homo sapiens
tctgtatttgaatcagcctacag

SEQ ID NO: 188891 - DNA, 15 bp, Homo sapiens
tcttaaataaacctt

SEQ ID NO: 188892 - DNA, 22 bp, Homo sapiens
tgaccaaccttttcccaaccat

SEQ ID NO: 188893 - DNA, 17 bp, Homo sapiens
tgaggcacatgtcagca

SEQ ID NO: 188894 - DNA, 14 bp, Homo sapiens
tgataacatggaaa

SEQ ID NO: 188895 - DNA, 20 bp, Homo sapiens
tgatgatttagagtgctgtc

SEQ ID NO: 188896 - DNA, 19 bp, Homo sapiens
tgcctggaagagcagccct

SEQ ID NO: 188897 - DNA, 14 bp, Homo sapiens
tgctctgatttatc

SEQ ID NO: 188898 - DNA, 15 bp, Homo sapiens
tggacctcaccaagc

SEQ ID NO: 188899 - DNA, 13 bp, Homo sapiens
tggctttggaagc

SEQ ID NO: 188900 - DNA, 19 bp, Homo sapiens
tgggcacaaagggcccaga

SEQ ID NO: 188901 - DNA, 21 bp, Homo sapiens
tgggggaacactgagaaagag

SEQ ID NO: 188902 - DNA, 22 bp, Homo sapiens
tgggtatcaccactggagatca

SEQ ID NO: 188903 - DNA, 17 bp, Homo sapiens
tgtgtggctttcagagc

SEQ ID NO: 188904 - DNA, 20 bp, Homo sapiens
tgtgtggctttcagagcctc

SEQ ID NO: 188905 - DNA, 21 bp, Homo sapiens
tgttagcatgctggtgagcca

SEQ ID NO: 188906 - DNA, 14 bp, Homo sapiens
ttaaacctatactc

SEQ ID NO: 188907 - DNA, 17 bp, Homo sapiens
ttaaacctatactcact

SEQ ID NO: 188908 - DNA, 14 bp, Homo sapiens
ttatcgaaactcat

SEQ ID NO: 188909 - DNA, 22 bp, Homo sapiens
ttatctaatcatgaaactccct

SEQ ID NO: 188910 - DNA, 20 bp, Homo sapiens
ttatcttcaggacactcact

SEQ ID NO: 188911 - DNA, 12 bp, Homo sapiens
ttattaatttga

SEQ ID NO: 188912 - DNA, 15 bp, Homo sapiens
ttctccatcctacca

SEQ ID NO: 188913 - DNA, 22 bp, Homo sapiens
ttgactagaaaatttaaaacat

SEQ ID NO: 188914 - DNA, 20 bp, Homo sapiens
ttgtctttgttcttctacca

SEQ ID NO: 188915 - DNA, 12 bp, Homo sapiens
ttttttaattga

SEQ ID NO: 188916 - DNA, 16 bp, Homo sapiens
atcagcctacaggcct

SEQ ID NO: 188917 - DNA, 16 bp, Homo sapiens
atcctatctctccaac

SEQ ID NO: 188918 - DNA, 18 bp, Homo sapiens
atgatttagagtgctgtc

SEQ ID NO: 188919 - DNA, 14 bp, Homo sapiens
atgctggtgagcca

SEQ ID NO: 188920 - DNA, 18 bp, Homo sapiens
atgggcacaaagggccca

SEQ ID NO: 188921 - DNA, 20 bp, Homo sapiens
atgggcacaaagggcccaga

SEQ ID NO: 188922 - DNA, 13 bp, Homo sapiens
atggttaactaat

SEQ ID NO: 188923 - DNA, 12 bp, Homo sapiens
attatcttaaaa

SEQ ID NO: 188924 - DNA, 21 bp, Homo sapiens
attgagctggacctcaccaag

SEQ ID NO: 188925 - DNA, 13 bp, Homo sapiens
atttaaaacatta

SEQ ID NO: 188926 - DNA, 14 bp, Homo sapiens
atttgaatcagcct

SEQ ID NO: 188927 - DNA, 15 bp, Homo sapiens
atttttcacttcaaa

SEQ ID NO: 188928 - DNA, 21 bp, Homo sapiens
cacatgtcagcaagtcctaag

SEQ ID NO: 188929 - DNA, 13 bp, Homo sapiens
cactgctcacact

SEQ ID NO: 188930 - DNA, 14 bp, Homo sapiens
cagcctacaggcct

SEQ ID NO: 188931 - DNA, 22 bp, Homo sapiens
cagctgcctggaagagcagccc

SEQ ID NO: 188932 - DNA, 15 bp, Homo sapiens
cagggacctaaaggg

SEQ ID NO: 188933 - DNA, 20 bp, Homo sapiens
cagggacctaaagggactac

SEQ ID NO: 188934 - DNA, 23 bp, Homo sapiens
cagtgcctttcttctctccagtg

SEQ ID NO: 188935 - DNA, 21 bp, Homo sapiens
cagtgtgtggctttcagagcc

SEQ ID NO: 188936 - DNA, 22 bp, Homo sapiens
cagtgtgtggctttcagagcct

SEQ ID NO: 188937 - DNA, 23 bp, Homo sapiens
catcctaccacaatgcagtgcct

SEQ ID NO: 188938 - DNA, 15 bp, Homo sapiens
catgcatacactctc

SEQ ID NO: 188939 - DNA, 16 bp, Homo sapiens
ccacagaagtgctttc

SEQ ID NO: 188940 - DNA, 22 bp, Homo sapiens
ccacatcccactcacaacagct

SEQ ID NO: 188941 - DNA, 16 bp, Homo sapiens
ccacgtactgcagcct

SEQ ID NO: 188942 - DNA, 20 bp, Homo sapiens
ccactcacaacagctgcctg

SEQ ID NO: 188943 - DNA, 21 bp, Homo sapiens
ccagactcctgactgtctccc

SEQ ID NO: 188944 - DNA, 23 bp, Homo sapiens
ccagggacgaagaagagccacag

SEQ ID NO: 188945 - DNA, 21 bp, Homo sapiens
ccagtgtgtggctttcagagc

SEQ ID NO: 188946 - DNA, 21 bp, Homo sapiens
ccatgggcacaaagggcccag

SEQ ID NO: 188947 - DNA, 13 bp, Homo sapiens
cctaaagggacta

SEQ ID NO: 188948 - DNA, 13 bp, Homo sapiens
cctacaccattcc

SEQ ID NO: 188949 - DNA, 23 bp, Homo sapiens
cctctgtatttgaatcagcctac

SEQ ID NO: 188950 - DNA, 13 bp, Homo sapiens
cctgactgtctcc

SEQ ID NO: 188951 - DNA, 17 bp, Homo sapiens
cctgagcgcctgggtcc

SEQ ID NO: 188952 - DNA, 23 bp, Homo sapiens
cctgggtccaggggaggccttcc

SEQ ID NO: 188953 - DNA, 17 bp, Homo sapiens
ccttgagggcaagagcc

SEQ ID NO: 188954 - DNA, 17 bp, Homo sapiens
ccttgtctgaactggag

SEQ ID NO: 188955 - DNA, 18 bp, Homo sapiens
cgctagaggaagcagcca

SEQ ID NO: 188956 - DNA, 15 bp, Homo sapiens
cgtactgcagcctcc

SEQ ID NO: 188957 - DNA, 22 bp, Homo sapiens
ctaaagggactacctctgtgcc

SEQ ID NO: 188958 - DNA, 23 bp, Homo sapiens
ctaagcgctagaggaagcagcca

SEQ ID NO: 188959 - DNA, 16 bp, Homo sapiens
ctacaggcctcacaca

SEQ ID NO: 188960 - DNA, 15 bp, Homo sapiens
ctagaggagggggca

SEQ ID NO: 188961 - DNA, 16 bp, Homo sapiens
ctagaggagggggcag

SEQ ID NO: 188962 - DNA, 22 bp, Homo sapiens
ctagaggagggggcaggctgag

SEQ ID NO: 188963 - DNA, 17 bp, Homo sapiens
ctcacaacagctgcctg

SEQ ID NO: 188964 - DNA, 14 bp, Homo sapiens
ctcagctttctaag

SEQ ID NO: 188965 - DNA, 17 bp, Homo sapiens
ctcaggctgaccacttt

SEQ ID NO: 188966 - DNA, 18 bp, Homo sapiens
ctcattttaggcaaatat

SEQ ID NO: 188967 - DNA, 21 bp, Homo sapiens
ctccagagagtatctgaggca

SEQ ID NO: 188968 - DNA, 13 bp, Homo sapiens
ctcccaattcatc

SEQ ID NO: 188969 - DNA, 17 bp, Homo sapiens
ctctcaaagcaaataat

SEQ ID NO: 188970 - DNA, 17 bp, Homo sapiens
ctgagggtcgtgggaaa

SEQ ID NO: 188971 - DNA, 18 bp, Homo sapiens
ctgagggtcgtgggaaag

SEQ ID NO: 188972 - DNA, 19 bp, Homo sapiens
ctgagggtcgtgggaaagg

SEQ ID NO: 188973 - DNA, 22 bp, Homo sapiens
ctgagggtcgtgggaaagggga

SEQ ID NO: 188974 - DNA, 21 bp, Homo sapiens
ctgatgatttagagtgctgtc

SEQ ID NO: 188975 - DNA, 20 bp, Homo sapiens
ctgcgaatctagaggagggg

SEQ ID NO: 188976 - DNA, 16 bp, Homo sapiens
ctggaagagcagccct

SEQ ID NO: 188977 - DNA, 14 bp, Homo sapiens
ctggtgagccaagc

SEQ ID NO: 188978 - DNA, 18 bp, Homo sapiens
ctgtatttgaatcagcct

SEQ ID NO: 188979 - DNA, 12 bp, Homo sapiens
cttaaaactcct

SEQ ID NO: 188980 - DNA, 23 bp, Homo sapiens
cttagttcaagtcctgcctctta

SEQ ID NO: 188981 - DNA, 19 bp, Homo sapiens
cttcaggacactcactaca

SEQ ID NO: 188982 - DNA, 11 bp, Homo sapiens
ctttcagagcc

SEQ ID NO: 188983 - DNA, 18 bp, Homo sapiens
ctttctcaataagcctca

SEQ ID NO: 188984 - DNA, 12 bp, Homo sapiens
ctttgcttcatt

SEQ ID NO: 188985 - DNA, 23 bp, Homo sapiens
ctttgcttcattcaagtcagctc

SEQ ID NO: 188986 - DNA, 14 bp, Homo sapiens
gaacactgagaaag

SEQ ID NO: 188987 - DNA, 12 bp, Homo sapiens
gaagagcagccc

SEQ ID NO: 188988 - DNA, 13 bp, Homo sapiens
gaagagccacagt

SEQ ID NO: 188989 - DNA, 18 bp, Homo sapiens
gacctaaagggactacct

SEQ ID NO: 188990 - DNA, 16 bp, Homo sapiens
gacgaagaagagccac

SEQ ID NO: 188991 - DNA, 19 bp, Homo sapiens
gactacctctgtgccttgc

SEQ ID NO: 188992 - DNA, 20 bp, Homo sapiens
gactagaaaatttaaaacat

SEQ ID NO: 188993 - DNA, 17 bp, Homo sapiens
gagaggttgtctgtggc

SEQ ID NO: 188994 - DNA, 14 bp, Homo sapiens
gaggagggggcagg

SEQ ID NO: 188995 - DNA, 23 bp, Homo sapiens
gcaggctgagggtcgtgggaaag

SEQ ID NO: 188996 - DNA, 17 bp, Homo sapiens
gccagtgaccaaccttt

SEQ ID NO: 188997 - DNA, 21 bp, Homo sapiens
gccatgggcacaaagggccca

SEQ ID NO: 188998 - DNA, 19 bp, Homo sapiens
gcctcttaaataaaccttt

SEQ ID NO: 188999 - DNA, 15 bp, Homo sapiens
gcctggaagagcagc

SEQ ID NO: 189000 - DNA, 17 bp, Homo sapiens
gcgaatctagaggaggg

SEQ ID NO: 189001 - DNA, 14 bp, Homo sapiens
gctgagggtcgtgg

SEQ ID NO: 189002 - DNA, 21 bp, Homo sapiens
gtcagcaagtcctaagcctgt

SEQ ID NO: 189003 - DNA, 23 bp, Homo sapiens
gtgctttcttctcccaattcatc

SEQ ID NO: 189004 - DNA, 17 bp, Homo sapiens
gtggctttcagagcctc

SEQ ID NO: 189005 - DNA, 19 bp, Homo sapiens
gtgtggctttcagagcctc

SEQ ID NO: 189006 - DNA, 19 bp, Homo sapiens
gttcttctaccacccacca

SEQ ID NO: 189007 - DNA, 21 bp, Homo sapiens
taaaaatgttctattttaatt

SEQ ID NO: 189008 - DNA, 11 bp, Homo sapiens
taaaacacttg

SEQ ID NO: 189009 - DNA, 17 bp, Homo sapiens
taaagggactacctctg

SEQ ID NO: 189010 - DNA, 23 bp, Homo sapiens
taagaagcacgtggtaaaacact

SEQ ID NO: 189011 - DNA, 16 bp, Homo sapiens
taataattttttaatt

SEQ ID NO: 189012 - DNA, 14 bp, Homo sapiens
taatacaaaggctt

SEQ ID NO: 189013 - DNA, 23 bp, Homo sapiens
taattataccgctatcattccaa

SEQ ID NO: 189014 - DNA, 15 bp, Homo sapiens
taatttgactagaaa

SEQ ID NO: 189015 - DNA, 16 bp, Homo sapiens
taatttgactagaaaa

SEQ ID NO: 189016 - DNA, 13 bp, Homo sapiens
tacaaaaattcct

SEQ ID NO: 189017 - DNA, 23 bp, Homo sapiens
tacaatgaaaaggactttataga

SEQ ID NO: 189018 - DNA, 21 bp, Homo sapiens
tacactctcaaagcaaataat

SEQ ID NO: 189019 - DNA, 14 bp, Homo sapiens
tacatgcatacact

SEQ ID NO: 189020 - DNA, 21 bp, Homo sapiens
tacatgcatacactctcaaag

SEQ ID NO: 189021 - DNA, 18 bp, Homo sapiens
taccacaatgcagtgcct

SEQ ID NO: 189022 - DNA, 17 bp, Homo sapiens
taccttgcatctcacag

SEQ ID NO: 189023 - DNA, 21 bp, Homo sapiens
tactctgaaattgtaactaaa

SEQ ID NO: 189024 - DNA, 15 bp, Homo sapiens
tacttgtttcagagt

SEQ ID NO: 189025 - DNA, 21 bp, Homo sapiens
tatctgaggcacatgtcagca

SEQ ID NO: 189026 - DNA, 19 bp, Homo sapiens
tcaagtcctgcctcttaaa

SEQ ID NO: 189027 - DNA, 20 bp, Homo sapiens
tcagccagtgaccaaccttt

SEQ ID NO: 189028 - DNA, 19 bp, Homo sapiens
tcagcctacaggcctcaca

SEQ ID NO: 189029 - DNA, 22 bp, Homo sapiens
tcccactcacaacagctgcctg

SEQ ID NO: 189030 - DNA, 24 bp, Homo sapiens
tcccctttgcttcattcaagtcag

SEQ ID NO: 189031 - DNA, 22 bp, Homo sapiens
tctagaggagggggcaggctga

SEQ ID NO: 189032 - DNA, 12 bp, Homo sapiens
tctattttaatt

SEQ ID NO: 189033 - DNA, 15 bp, Homo sapiens
tctccagtgcacctg

SEQ ID NO: 189034 - DNA, 13 bp, Homo sapiens
tctctccagtgca

SEQ ID NO: 189035 - DNA, 14 bp, Homo sapiens
tctgaactggagcc

SEQ ID NO: 189036 - DNA, 12 bp, Homo sapiens
tcttaaaactcc

SEQ ID NO: 189037 - DNA, 20 bp, Homo sapiens
tcttacttattatcttcagg

SEQ ID NO: 189038 - DNA, 14 bp, Homo sapiens
tcttctaccaccca

SEQ ID NO: 189039 - DNA, 19 bp, Homo sapiens
tcttctccatcctaccaca

SEQ ID NO: 189040 - DNA, 17 bp, Homo sapiens
tgagaaagaggcaggga

SEQ ID NO: 189041 - DNA, 16 bp, Homo sapiens
tgagggtcgtgggaaa

SEQ ID NO: 189042 - DNA, 22 bp, Homo sapiens
tgatttatctgagtcaactcct

SEQ ID NO: 189043 - DNA, 22 bp, Homo sapiens
tgccacattaaattgataacat

SEQ ID NO: 189044 - DNA, 23 bp, Homo sapiens
aaattgagctggacctcaccaag

SEQ ID NO: 189045 - DNA, 19 bp, Homo sapiens
aaattgataacatggaaat

SEQ ID NO: 189046 - DNA, 14 bp, Homo sapiens
aacactgagaaaga

SEQ ID NO: 189047 - DNA, 22 bp, Homo sapiens
aaccatacaaaaattccttttc

SEQ ID NO: 189048 - DNA, 11 bp, Homo sapiens
aagagccacag

SEQ ID NO: 189049 - DNA, 15 bp, Homo sapiens
aagggactacctctg

SEQ ID NO: 189050 - DNA, 19 bp, Homo sapiens
aagggactacctctgtgcc

SEQ ID NO: 189051 - DNA, 16 bp, Homo sapiens
aaggggagtaggtggg

SEQ ID NO: 189052 - DNA, 19 bp, Homo sapiens
aagtactaagcgctagagg

SEQ ID NO: 189053 - DNA, 14 bp, Homo sapiens
aagtcggttagtgg

SEQ ID NO: 189054 - DNA, 13 bp, Homo sapiens
aagtgctttcttc

SEQ ID NO: 189055 - DNA, 23 bp, Homo sapiens
aagtgtttcataaatttgagagt

SEQ ID NO: 189056 - DNA, 22 bp, Homo sapiens
aataatttttcacttcaaaaca

SEQ ID NO: 189057 - DNA, 17 bp, Homo sapiens
aatcagcctacaggcct

SEQ ID NO: 189058 - DNA, 15 bp, Homo sapiens
aatctagaggagggg

SEQ ID NO: 189059 - DNA, 14 bp, Homo sapiens
acaacagctgcctg

SEQ ID NO: 189060 - DNA, 14 bp, Homo sapiens
acaatgtgtctgag

SEQ ID NO: 189061 - DNA, 14 bp, Homo sapiens
acacaatgtgtctg

SEQ ID NO: 189062 - DNA, 19 bp, Homo sapiens
accattgtctcagagcagg

SEQ ID NO: 189063 - DNA, 22 bp, Homo sapiens
actaaagttagaaagttgattt

SEQ ID NO: 189064 - DNA, 14 bp, Homo sapiens
actccatgttggct

SEQ ID NO: 189065 - DNA, 13 bp, Homo sapiens
actgacacacacg

SEQ ID NO: 189066 - DNA, 16 bp, Homo sapiens
acttattatcttcagg

SEQ ID NO: 189067 - DNA, 20 bp, Homo sapiens
agagcctcctttctggcttt

SEQ ID NO: 189068 - DNA, 14 bp, Homo sapiens
agaggttgtctgtg

SEQ ID NO: 189069 - DNA, 21 bp, Homo sapiens
agagtgctgtccggtggagat

SEQ ID NO: 189070 - DNA, 22 bp, Homo sapiens
agccacagtgagggagatccca

SEQ ID NO: 189071 - DNA, 16 bp, Homo sapiens
agcctcctttctggct

SEQ ID NO: 189072 - DNA, 15 bp, Homo sapiens
agctggacctcacca

SEQ ID NO: 189073 - DNA, 12 bp, Homo sapiens
agcttctccaac

SEQ ID NO: 189074 - DNA, 21 bp, Homo sapiens
aggctgagggtcgtgggaaag

SEQ ID NO: 189075 - DNA, 23 bp, Homo sapiens
aggctgagggtcgtgggaaaggg

SEQ ID NO: 189076 - DNA, 23 bp, Homo sapiens
aggcttccacgtactgcagcctc

SEQ ID NO: 189077 - DNA, 15 bp, Homo sapiens
agggggcaggctgag

SEQ ID NO: 189078 - DNA, 21 bp, Homo sapiens
agtgtgtggctttcagagcct

SEQ ID NO: 189079 - DNA, 20 bp, Homo sapiens
atatgctctgatttatctga

SEQ ID NO: 189080 - DNA, 20 bp, Homo sapiens
atcatatatatacatacatg

SEQ ID NO: 189081 - DNA, 18 bp, Homo sapiens
atcccactcacaacagct

SEQ ID NO: 189082 - DNA, 17 bp, Homo sapiens
atgacaggatgtttgct

SEQ ID NO: 189083 - DNA, 17 bp, Homo sapiens
atgcagtgcctttcttc

SEQ ID NO: 189084 - DNA, 17 bp, Homo sapiens
atgcatacactctcaaa

SEQ ID NO: 189085 - DNA, 23 bp, Homo sapiens
atggtatcaataaatagaccatt

SEQ ID NO: 189086 - DNA, 22 bp, Homo sapiens
atgtttgctcagcttctccaac

SEQ ID NO: 189087 - DNA, 15 bp, Homo sapiens
attactctgaaattg

SEQ ID NO: 189088 - DNA, 19 bp, Homo sapiens
attatcaattaccacacca

SEQ ID NO: 189089 - DNA, 14 bp, Homo sapiens
attgtctcagagca

SEQ ID NO: 189090 - DNA, 19 bp, Homo sapiens
atttatctgagtcaactcc

SEQ ID NO: 189091 - DNA, 12 bp, Homo sapiens
caaagggcccag

SEQ ID NO: 189092 - DNA, 14 bp, Homo sapiens
caaagggcccagat

SEQ ID NO: 189093 - DNA, 14 bp, Homo sapiens
caaattatcttaaa

SEQ ID NO: 189094 - DNA, 16 bp, Homo sapiens
caataaatagaccatt

SEQ ID NO: 189095 - DNA, 16 bp, Homo sapiens
caatgcagtgcctttc

SEQ ID NO: 189096 - DNA, 18 bp, Homo sapiens
caattcatcctcactcag

SEQ ID NO: 189097 - DNA, 22 bp, Homo sapiens
cacaatgcagtgcctttcttct

SEQ ID NO: 189098 - DNA, 21 bp, Homo sapiens
cacacaaattatcttaaaact

SEQ ID NO: 189099 - DNA, 18 bp, Homo sapiens
cacacaatgtgtctgaga

SEQ ID NO: 189100 - DNA, 19 bp, Homo sapiens
cacagaagtgctttcttct

SEQ ID NO: 189101 - DNA, 19 bp, Homo sapiens
cacagtgagggagatccca

SEQ ID NO: 189102 - DNA, 18 bp, Homo sapiens
cacatgggtgaacactca

SEQ ID NO: 189103 - DNA, 23 bp, Homo sapiens
caccagtgtgtggctttcagagc

SEQ ID NO: 189104 - DNA, 19 bp, Homo sapiens
cactgagaaagaggcaggg

SEQ ID NO: 189105 - DNA, 14 bp, Homo sapiens
cagattgtcagctc

SEQ ID NO: 189106 - DNA, 22 bp, Homo sapiens
cagccaagtcggttagtggaag

SEQ ID NO: 189107 - DNA, 18 bp, Homo sapiens
cagggacctaaagggact

SEQ ID NO: 189108 - DNA, 23 bp, Homo sapiens
catcccactcacaacagctgcct

SEQ ID NO: 189109 - DNA, 21 bp, Homo sapiens
catgggcacaaagggcccaga

SEQ ID NO: 189110 - DNA, 16 bp, Homo sapiens
cattcaagtcagctct

SEQ ID NO: 189111 - DNA, 17 bp, Homo sapiens
cattcaagtcagctctt

SEQ ID NO: 189112 - DNA, 14 bp, Homo sapiens
cattgtctcagagc

SEQ ID NO: 189113 - DNA, 13 bp, Homo sapiens
ccacgtactgcag

SEQ ID NO: 189114 - DNA, 16 bp, Homo sapiens
ccagaatttaaaccta

SEQ ID NO: 189115 - DNA, 18 bp, Homo sapiens
ccagaccattgtctcaga

SEQ ID NO: 189116 - DNA, 18 bp, Homo sapiens
ccagggacgaagaagagc

SEQ ID NO: 189117 - DNA, 16 bp, Homo sapiens
ccagtgaccaaccttt

SEQ ID NO: 189118 - DNA, 13 bp, Homo sapiens
tcttaaaactcct

SEQ ID NO: 189119 - DNA, 21 bp, Homo sapiens
tcttgtccccaacaccccaca

SEQ ID NO: 189120 - DNA, 18 bp, Homo sapiens
tgagctggacctcaccaa

SEQ ID NO: 189121 - DNA, 14 bp, Homo sapiens
tgagggagatccca

SEQ ID NO: 189122 - DNA, 16 bp, Homo sapiens
tgataacatggaaatg

SEQ ID NO: 189123 - DNA, 18 bp, Homo sapiens
tgcctggaagagcagccc

SEQ ID NO: 189124 - DNA, 19 bp, Homo sapiens
tgcgaatctagaggagggg

SEQ ID NO: 189125 - DNA, 17 bp, Homo sapiens
tgctcagcttctccaac

SEQ ID NO: 189126 - DNA, 20 bp, Homo sapiens
tgctcagcttctccaacaat

SEQ ID NO: 189127 - DNA, 23 bp, Homo sapiens
tggagatcaccagtgtgtggctt

SEQ ID NO: 189128 - DNA, 16 bp, Homo sapiens
tggcaaccagaccatt

SEQ ID NO: 189129 - DNA, 13 bp, Homo sapiens
tgggaaaggggag

SEQ ID NO: 189130 - DNA, 20 bp, Homo sapiens
tgggcacaaagggcccagat

SEQ ID NO: 189131 - DNA, 19 bp, Homo sapiens
tgggggaacactgagaaag

SEQ ID NO: 189132 - DNA, 22 bp, Homo sapiens
tgggggaacactgagaaagagg

SEQ ID NO: 189133 - DNA, 21 bp, Homo sapiens
tgggtatcaccactggagatc

SEQ ID NO: 189134 - DNA, 14 bp, Homo sapiens
tgttggctagcctc

SEQ ID NO: 189135 - DNA, 20 bp, Homo sapiens
tgtttgctcagcttctccaa

SEQ ID NO: 189136 - DNA, 23 bp, Homo sapiens
ttctcccaattcatcctcactca

SEQ ID NO: 189137 - DNA, 17 bp, Homo sapiens
ttgataacatggaaatg

SEQ ID NO: 189138 - DNA, 13 bp, Homo sapiens
ttgtctcagagca

SEQ ID NO: 189139 - DNA, 17 bp, Homo sapiens
tttacttgtttcagagt

SEQ ID NO: 189140 - DNA, 16 bp, Homo sapiens
tttatcctatctctcc

SEQ ID NO: 189141 - DNA, 13 bp, Homo sapiens
tttcagagcctcc

SEQ ID NO: 189142 - DNA, 14 bp, Homo sapiens
tttcataaatttga

SEQ ID NO: 189143 - DNA, 10 bp, Homo sapiens
aaaggggagt

SEQ ID NO: 189144 - DNA, 15 bp, Homo sapiens
aacactgagaaagag

SEQ ID NO: 189145 - DNA, 18 bp, Homo sapiens
aacgttaagaattgttaa

SEQ ID NO: 189146 - DNA, 14 bp, Homo sapiens
aagaagagccacag

SEQ ID NO: 189147 - DNA, 19 bp, Homo sapiens
aagaggcagggacctaaag

SEQ ID NO: 189148 - DNA, 22 bp, Homo sapiens
aagcgctagaggaagcagccaa

SEQ ID NO: 189149 - DNA, 20 bp, Homo sapiens
aagggactacctctgtgcct

SEQ ID NO: 189150 - DNA, 21 bp, Homo sapiens
aatacccatgtctacacagat

SEQ ID NO: 189151 - DNA, 21 bp, Homo sapiens
aattaccacaccatctcccat

SEQ ID NO: 189152 - DNA, 15 bp, Homo sapiens
aattgaatcactgct

SEQ ID NO: 189153 - DNA, 18 bp, Homo sapiens
acacaaattatcttaaaa

SEQ ID NO: 189154 - DNA, 22 bp, Homo sapiens
acacacaaattatcttaaaact

SEQ ID NO: 189155 - DNA, 12 bp, Homo sapiens
acactgagaaag

SEQ ID NO: 189156 - DNA, 19 bp, Homo sapiens
acaggcctcacacacaatg

SEQ ID NO: 189157 - DNA, 18 bp, Homo sapiens
acagtgagggagatccca

SEQ ID NO: 189158 - DNA, 20 bp, Homo sapiens
acatcccactcacaacagct

SEQ ID NO: 189159 - DNA, 23 bp, Homo sapiens
accagtgtgtggctttcagagcc

SEQ ID NO: 189160 - DNA, 16 bp, Homo sapiens
acccaccagttgaatt

SEQ ID NO: 189161 - DNA, 21 bp, Homo sapiens
acctctgtatttgaatcagcc

SEQ ID NO: 189162 - DNA, 22 bp, Homo sapiens
acctctgtatttgaatcagcct

SEQ ID NO: 189163 - DNA, 17 bp, Homo sapiens
acgaagaagagccacag

SEQ ID NO: 189164 - DNA, 18 bp, Homo sapiens
acgaagaagagccacagt

SEQ ID NO: 189165 - DNA, 17 bp, Homo sapiens
actcacaacagctgcct

SEQ ID NO: 189166 - DNA, 20 bp, Homo sapiens
actccatgttggctagcctc

SEQ ID NO: 189167 - DNA, 14 bp, Homo sapiens
actcctttctcatc

SEQ ID NO: 189168 - DNA, 15 bp, Homo sapiens
actgagaaagaggca

SEQ ID NO: 189169 - DNA, 19 bp, Homo sapiens
actgagaaagaggcaggga

SEQ ID NO: 189170 - DNA, 12 bp, Homo sapiens
agaaagttgatt

SEQ ID NO: 189171 - DNA, 14 bp, Homo sapiens
agaagagccacagt

SEQ ID NO: 189172 - DNA, 18 bp, Homo sapiens
agagcaggtgctggctct

SEQ ID NO: 189173 - DNA, 15 bp, Homo sapiens
agcagtttgaaattg

SEQ ID NO: 189174 - DNA, 23 bp, Homo sapiens
agccatgggcacaaagggcccag

SEQ ID NO: 189175 - DNA, 19 bp, Homo sapiens
agcgctagaggaagcagcc

SEQ ID NO: 189176 - DNA, 20 bp, Homo sapiens
agcgctagaggaagcagcca

SEQ ID NO: 189177 - DNA, 22 bp, Homo sapiens
agctccttgagggcaagagcca

SEQ ID NO: 189178 - DNA, 18 bp, Homo sapiens
aggagggggcaggctgag

SEQ ID NO: 189179 - DNA, 22 bp, Homo sapiens
aggcagggacctaaagggacta

SEQ ID NO: 189180 - DNA, 16 bp, Homo sapiens
aggctgagggtcgtgg

SEQ ID NO: 189181 - DNA, 21 bp, Homo sapiens
agggacgaagaagagccacag

SEQ ID NO: 189182 - DNA, 15 bp, Homo sapiens
aggggaggccttcca

SEQ ID NO: 189183 - DNA, 21 bp, Homo sapiens
aggggagtaggtgggggaaca

SEQ ID NO: 189184 - DNA, 21 bp, Homo sapiens
agggtcgtgggaaaggggagt

SEQ ID NO: 189185 - DNA, 23 bp, Homo sapiens
aggtgggggaacactgagaaaga

SEQ ID NO: 189186 - DNA, 21 bp, Homo sapiens
atcctaccacaatgcagtgcc

SEQ ID NO: 189187 - DNA, 20 bp, Homo sapiens
atctagaggagggggcaggc

SEQ ID NO: 189188 - DNA, 17 bp, Homo sapiens
atcttgtccccaacacc

SEQ ID NO: 189189 - DNA, 15 bp, Homo sapiens
attgggtatcaccac

SEQ ID NO: 189190 - DNA, 12 bp, Homo sapiens
attgtctcagag

SEQ ID NO: 189191 - DNA, 14 bp, Homo sapiens
attgttaaaggcta

SEQ ID NO: 189192 - DNA, 21 bp, Homo sapiens
caaaacagtattgacttgtat

SEQ ID NO: 189193 - DNA, 20 bp, Homo sapiens
caaataatttttcacttcaa

SEQ ID NO: 189194 - DNA, 21 bp, Homo sapiens
caaccagaccattgtctcaga

SEQ ID NO: 189195 - DNA, 19 bp, Homo sapiens
caaccagattgtcagctcc

SEQ ID NO: 189196 - DNA, 20 bp, Homo sapiens
caaccagattgtcagctcct

SEQ ID NO: 189197 - DNA, 13 bp, Homo sapiens
caagagccacagt

SEQ ID NO: 189198 - DNA, 14 bp, Homo sapiens
caagctgctgtggc

SEQ ID NO: 189199 - DNA, 15 bp, Homo sapiens
cacaaagggcccaga

SEQ ID NO: 189200 - DNA, 16 bp, Homo sapiens
cacaaagggcccagat

SEQ ID NO: 189201 - DNA, 15 bp, Homo sapiens
cacaaattatcttaa

SEQ ID NO: 189202 - DNA, 12 bp, Homo sapiens
cacacacgttat

SEQ ID NO: 189203 - DNA, 21 bp, Homo sapiens
caccagtgtgtggctttcaga

SEQ ID NO: 189204 - DNA, 22 bp, Homo sapiens
cacccaccagttgaatttcatc

SEQ ID NO: 189205 - DNA, 17 bp, Homo sapiens
cactcacaacagctgcc

SEQ ID NO: 189206 - DNA, 17 bp, Homo sapiens
cactgagaaagaggcag

SEQ ID NO: 189207 - DNA, 23 bp, Homo sapiens
cagactcctgactgtctcccggg

SEQ ID NO: 189208 - DNA, 16 bp, Homo sapiens
cagcctacaggcctca

SEQ ID NO: 189209 - DNA, 21 bp, Homo sapiens
caggctgagggtcgtgggaaa

SEQ ID NO: 189210 - DNA, 21 bp, Homo sapiens
cagggacctaaagggactacc

SEQ ID NO: 189211 - DNA, 22 bp, Homo sapiens
cagggacgaagaagagccacag

SEQ ID NO: 189212 - DNA, 23 bp, Homo sapiens
cagggacgaagaagagccacagt

SEQ ID NO: 189213 - DNA, 20 bp, Homo sapiens
cagtgaattgtgtaggagag

SEQ ID NO: 189214 - DNA, 14 bp, Homo sapiens
cagttgaatttcat

SEQ ID NO: 189215 - DNA, 21 bp, Homo sapiens
catcctaccacaatgcagtgc

SEQ ID NO: 189216 - DNA, 19 bp, Homo sapiens
catcttgcccgctcaggct

SEQ ID NO: 189217 - DNA, 20 bp, Homo sapiens
catcttgcccgctcaggctg

SEQ ID NO: 189218 - DNA, 19 bp, Homo sapiens
catgggcacaaagggccca

SEQ ID NO: 189219 - DNA, 13 bp, Homo sapiens
cattaaattgata

SEQ ID NO: 189220 - DNA, 21 bp, Homo sapiens
ccagaccattgtctcagagca

SEQ ID NO: 189221 - DNA, 20 bp, Homo sapiens
ccagactcctgactgtctcc

SEQ ID NO: 189222 - DNA, 20 bp, Homo sapiens
ccagggacgaagaagagcca

SEQ ID NO: 189223 - DNA, 16 bp, Homo sapiens
ccagtgtgtggctttc

SEQ ID NO: 189224 - DNA, 18 bp, Homo sapiens
ccagtgtgtggctttcag

SEQ ID NO: 189225 - DNA, 20 bp, Homo sapiens
ctacaggcctcacacacaat

SEQ ID NO: 189226 - DNA, 14 bp, Homo sapiens
ctacctctgtgcct

SEQ ID NO: 189227 - DNA, 16 bp, Homo sapiens
ctagaggaagcagcca

SEQ ID NO: 189228 - DNA, 18 bp, Homo sapiens
ctagaggagggggcaggc

SEQ ID NO: 189229 - DNA, 12 bp, Homo sapiens
ctccaacaataa

SEQ ID NO: 189230 - DNA, 22 bp, Homo sapiens
ctctgtatttgaatcagcctac

SEQ ID NO: 189231 - DNA, 22 bp, Homo sapiens
ctgagcgcctgggtccagggga

SEQ ID NO: 189232 - DNA, 23 bp, Homo sapiens
ctgagggtcgtgggaaaggggag

SEQ ID NO: 189233 - DNA, 11 bp, Homo sapiens
ctgcagcctcc

SEQ ID NO: 189234 - DNA, 21 bp, Homo sapiens
ctgcgaatctagaggaggggg

SEQ ID NO: 189235 - DNA, 13 bp, Homo sapiens
ctggacctcacca

SEQ ID NO: 189236 - DNA, 15 bp, Homo sapiens
ctggagatcaccagt

SEQ ID NO: 189237 - DNA, 15 bp, Homo sapiens
ctggagccatgggca

SEQ ID NO: 189238 - DNA, 21 bp, Homo sapiens
cttcattcaagtcagctcttc

SEQ ID NO: 189239 - DNA, 19 bp, Homo sapiens
cttccagggacgaagaaga

SEQ ID NO: 189240 - DNA, 21 bp, Homo sapiens
cttccaggggaggttcagtga

SEQ ID NO: 189241 - DNA, 14 bp, Homo sapiens
cttctctccagtgc

SEQ ID NO: 189242 - DNA, 19 bp, Homo sapiens
cttgccacattaaattgat

SEQ ID NO: 189243 - DNA, 17 bp, Homo sapiens
cttgcccgctcaggctg

SEQ ID NO: 189244 - DNA, 22 bp, Homo sapiens
gaaagaggcagggacctaaagg

SEQ ID NO: 189245 - DNA, 15 bp, Homo sapiens
gaaaggggagtaggt

SEQ ID NO: 189246 - DNA, 19 bp, Homo sapiens
gaaaggggagtaggtgggg

SEQ ID NO: 189247 - DNA, 14 bp, Homo sapiens
gaagaagagccaca

SEQ ID NO: 189248 - DNA, 15 bp, Homo sapiens
gaagaagagccacag

SEQ ID NO: 189249 - DNA, 16 bp, Homo sapiens
gaatctagaggagggg

SEQ ID NO: 189250 - DNA, 18 bp, Homo sapiens
gacaggatgtttgctcag

SEQ ID NO: 189251 - DNA, 16 bp, Homo sapiens
gaccattgtctcagag

SEQ ID NO: 189252 - DNA, 18 bp, Homo sapiens
gagcctcctttctggctt

SEQ ID NO: 189253 - DNA, 17 bp, Homo sapiens
gagctggacctcaccaa

SEQ ID NO: 189254 - DNA, 19 bp, Homo sapiens
gagggtcgtgggaaagggg

SEQ ID NO: 189255 - DNA, 20 bp, Homo sapiens
gcagggacctaaagggacta

SEQ ID NO: 189256 - DNA, 21 bp, Homo sapiens
gcctgttagcatgctggtgag

SEQ ID NO: 189257 - DNA, 16 bp, Homo sapiens
gcgaatctagaggagg

SEQ ID NO: 189258 - DNA, 11 bp, Homo sapiens
gctgagggtcg

SEQ ID NO: 189259 - DNA, 20 bp, Homo sapiens
gctgcctggaagagcagccc

SEQ ID NO: 189260 - DNA, 19 bp, Homo sapiens
gctgcgaatctagaggagg

SEQ ID NO: 189261 - DNA, 21 bp, Homo sapiens
gctgcgaatctagaggagggg

SEQ ID NO: 189262 - DNA, 20 bp, Homo sapiens
gctgctgtggccatcaacct

SEQ ID NO: 189263 - DNA, 11 bp, Homo sapiens
ggaaaggggag

SEQ ID NO: 189264 - DNA, 15 bp, Homo sapiens
ggaacactgagaaag

SEQ ID NO: 189265 - DNA, 17 bp, Homo sapiens
ggcacaaagggcccaga

SEQ ID NO: 189266 - DNA, 12 bp, Homo sapiens
ggcaggctgagg

SEQ ID NO: 189267 - DNA, 14 bp, Homo sapiens
ggcagggacctaaa

SEQ ID NO: 189268 - DNA, 15 bp, Homo sapiens
ggctgagggtcgtgg

SEQ ID NO: 189269 - DNA, 20 bp, Homo sapiens
ggctgcgaatctagaggagg

SEQ ID NO: 189270 - DNA, 17 bp, Homo sapiens
gggaacactgagaaaga

SEQ ID NO: 189271 - DNA, 21 bp, Homo sapiens
gggaacactgagaaagaggca

SEQ ID NO: 189272 - DNA, 18 bp, Homo sapiens
gggactacctctgtgcct

SEQ ID NO: 189273 - DNA, 17 bp, Homo sapiens
ggggaacactgagaaag

SEQ ID NO: 189274 - DNA, 22 bp, Homo sapiens
gggggaacactgagaaagaggc

SEQ ID NO: 189275 - DNA, 22 bp, Homo sapiens
ggtcgtgggaaaggggagtagg

SEQ ID NO: 189276 - DNA, 13 bp, Homo sapiens
gtactgcagcctc

SEQ ID NO: 189277 - DNA, 15 bp, Homo sapiens
gtatttgaatcagcc

SEQ ID NO: 189278 - DNA, 15 bp, Homo sapiens
gtcgtgggaaagggg

SEQ ID NO: 189279 - DNA, 18 bp, Homo sapiens
gtcgtgggaaaggggagt

SEQ ID NO: 189280 - DNA, 20 bp, Homo sapiens
gtgggggaacactgagaaag

SEQ ID NO: 189281 - DNA, 16 bp, Homo sapiens
gtgtctgagagattca

SEQ ID NO: 189282 - DNA, 22 bp, Homo sapiens
gtgtttatcctatctctccaac

SEQ ID NO: 189283 - DNA, 19 bp, Homo sapiens
taaagggactacctctgtg

SEQ ID NO: 189284 - DNA, 21 bp, Homo sapiens
taaagggactacctctgtgcc

SEQ ID NO: 189285 - DNA, 17 bp, Homo sapiens
taaatagaccattaatc

SEQ ID NO: 189286 - DNA, 21 bp, Homo sapiens
taaattgataacatggaaatg

SEQ ID NO: 189287 - DNA, 20 bp, Homo sapiens
taacttccctgaaaaatcta

SEQ ID NO: 189288 - DNA, 21 bp, Homo sapiens
taacttccctgaaaaatctaa

SEQ ID NO: 189289 - DNA, 17 bp, Homo sapiens
taatttttcacttcaaa

SEQ ID NO: 189290 - DNA, 18 bp, Homo sapiens
tacaaaggcttattaatt

SEQ ID NO: 189291 - DNA, 13 bp, Homo sapiens
tacctctgtgcct

SEQ ID NO: 189292 - DNA, 14 bp, Homo sapiens
tacttgtttcagag

SEQ ID NO: 189293 - DNA, 17 bp, Homo sapiens
tagaaaatttaaaacat

SEQ ID NO: 189294 - DNA, 19 bp, Homo sapiens
tatcaataaatagaccatt

SEQ ID NO: 189295 - DNA, 13 bp, Homo sapiens
tatctaatcatga

SEQ ID NO: 189296 - DNA, 23 bp, Homo sapiens
tcaccagtgtgtggctttcagag

SEQ ID NO: 189297 - DNA, 19 bp, Homo sapiens
tcagagcaggtgctggctc

SEQ ID NO: 189298 - DNA, 22 bp, Homo sapiens
tccaaaggaggatggcatataa

SEQ ID NO: 189299 - DNA, 21 bp, Homo sapiens
tccagggacgaagaagagcca

SEQ ID NO: 189300 - DNA, 23 bp, Homo sapiens
tcctgactgtctcccgggactac

SEQ ID NO: 189301 - DNA, 13 bp, Homo sapiens
tcgtgggaaaggg

SEQ ID NO: 189302 - DNA, 15 bp, Homo sapiens
tcgtgggaaagggga

SEQ ID NO: 189303 - DNA, 18 bp, Homo sapiens
tctaagtgtttcataaat

SEQ ID NO: 189304 - DNA, 13 bp, Homo sapiens
tctagaggagggg

SEQ ID NO: 189305 - DNA, 15 bp, Homo sapiens
tctgaactggagcca

SEQ ID NO: 189306 - DNA, 20 bp, Homo sapiens
tctgaactggagccatgggc

SEQ ID NO: 189307 - DNA, 16 bp, Homo sapiens
tctgagtcaactcctt

SEQ ID NO: 189308 - DNA, 16 bp, Homo sapiens
tcttctcccaattcat

SEQ ID NO: 189309 - DNA, 17 bp, Homo sapiens
tcttgcccgctcaggct

SEQ ID NO: 189310 - DNA, 11 bp, Homo sapiens
tgaatttcatc

SEQ ID NO: 189311 - DNA, 20 bp, Homo sapiens
tgaggcacatgtcagcaagt

SEQ ID NO: 189312 - DNA, 23 bp, Homo sapiens
ccagtgtgtggctttcagagcct

SEQ ID NO: 189313 - DNA, 17 bp, Homo sapiens
ccagttagcctctgcag

SEQ ID NO: 189314 - DNA, 13 bp, Homo sapiens
ccatcaacctctg

SEQ ID NO: 189315 - DNA, 19 bp, Homo sapiens
ccatcttgcccgctcaggc

SEQ ID NO: 189316 - DNA, 21 bp, Homo sapiens
ccatcttgcccgctcaggctg

SEQ ID NO: 189317 - DNA, 13 bp, Homo sapiens
cccgctcaggctg

SEQ ID NO: 189318 - DNA, 20 bp, Homo sapiens
ccgctcaggctgaccacttt

SEQ ID NO: 189319 - DNA, 23 bp, Homo sapiens
cctcacacacaatgtgtctgaga

SEQ ID NO: 189320 - DNA, 17 bp, Homo sapiens
cctcttaaataaacctt

SEQ ID NO: 189321 - DNA, 18 bp, Homo sapiens
cctcttaaataaaccttt

SEQ ID NO: 189322 - DNA, 14 bp, Homo sapiens
cctgcctcttaaat

SEQ ID NO: 189323 - DNA, 16 bp, Homo sapiens
cctggaagagcagccc

SEQ ID NO: 189324 - DNA, 17 bp, Homo sapiens
cctggaagagcagccct

SEQ ID NO: 189325 - DNA, 18 bp, Homo sapiens
ccttgccacattaaattg

SEQ ID NO: 189326 - DNA, 14 bp, Homo sapiens
cgtactgcagcctc

SEQ ID NO: 189327 - DNA, 13 bp, Homo sapiens
cgtgggaaagggg

SEQ ID NO: 189328 - DNA, 15 bp, Homo sapiens
cgtgggaaaggggag

SEQ ID NO: 189329 - DNA, 20 bp, Homo sapiens
cgtgggaaaggggagtaggt

SEQ ID NO: 189330 - DNA, 19 bp, Homo sapiens
ctaaagggactacctctgt

SEQ ID NO: 189331 - DNA, 21 bp, Homo sapiens
ctaaagggactacctctgtgc

SEQ ID NO: 189332 - DNA, 22 bp, Homo sapiens
taagcgctagaggaagcagcca

SEQ ID NO: 189333 - DNA, 20 bp, Homo sapiens
tacatgcatacactctcaaa

SEQ ID NO: 189334 - DNA, 19 bp, Homo sapiens
tacccatgtctacacagat

SEQ ID NO: 189335 - DNA, 17 bp, Homo sapiens
tactgcagcctccagag

SEQ ID NO: 189336 - DNA, 22 bp, Homo sapiens
tagaaaatttaaaacattactc

SEQ ID NO: 189337 - DNA, 15 bp, Homo sapiens
tagaggaagcagcca

SEQ ID NO: 189338 - DNA, 16 bp, Homo sapiens
tagaggagggggcagg

SEQ ID NO: 189339 - DNA, 21 bp, Homo sapiens
tatcatatatatacatacatg

SEQ ID NO: 189340 - DNA, 14 bp, Homo sapiens
tatcattccaaagg

SEQ ID NO: 189341 - DNA, 14 bp, Homo sapiens
tcaagtcagctctt

SEQ ID NO: 189342 - DNA, 20 bp, Homo sapiens
tcaagtcctgcctcttaaat

SEQ ID NO: 189343 - DNA, 22 bp, Homo sapiens
tcaataagcctcagctttctaa

SEQ ID NO: 189344 - DNA, 23 bp, Homo sapiens
tcacaggtagacagtatataact

SEQ ID NO: 189345 - DNA, 22 bp, Homo sapiens
tcagctcttctccatcctacca

SEQ ID NO: 189346 - DNA, 17 bp, Homo sapiens
tcccactcacaacagct

SEQ ID NO: 189347 - DNA, 17 bp, Homo sapiens
tccttatcgaaactcat

SEQ ID NO: 189348 - DNA, 13 bp, Homo sapiens
tcctttctggctt

SEQ ID NO: 189349 - DNA, 19 bp, Homo sapiens
tcgtgggaaaggggagtag

SEQ ID NO: 189350 - DNA, 18 bp, Homo sapiens
tgctggtgagccaagcag

SEQ ID NO: 189351 - DNA, 15 bp, Homo sapiens
tggctttcagagcct

SEQ ID NO: 189352 - DNA, 20 bp, Homo sapiens
tgggaaaggggagtaggtgg

SEQ ID NO: 189353 - DNA, 23 bp, Homo sapiens
tgtctacacagatgttcacccaa

SEQ ID NO: 189354 - DNA, 22 bp, Homo sapiens
tgttcccctttgcttcattcaa

SEQ ID NO: 189355 - DNA, 18 bp, Homo sapiens
ttacttattatcttcagg

SEQ ID NO: 189356 - DNA, 22 bp, Homo sapiens
ttcagagcctcctttctggctt

SEQ ID NO: 189357 - DNA, 18 bp, Homo sapiens
ttcaggacactcactaca

SEQ ID NO: 189358 - DNA, 19 bp, Homo sapiens
ttccacgtactgcagcctc

SEQ ID NO: 189359 - DNA, 18 bp, Homo sapiens
ttgccacattaaattgat

SEQ ID NO: 189360 - DNA, 20 bp, Homo sapiens
ttgtataccttgtaatttga

SEQ ID NO: 189361 - DNA, 18 bp, Homo sapiens
tttaaacctatactcact

SEQ ID NO: 189362 - DNA, 24 bp, Homo sapiens
aaacacttgcggatattctggact

SEQ ID NO: 189363 - DNA, 12 bp, Homo sapiens
aaagaggcaggg

SEQ ID NO: 189364 - DNA, 21 bp, Homo sapiens
aacattactctgaaattgtaa

SEQ ID NO: 189365 - DNA, 15 bp, Homo sapiens
aagaagagccacagt

SEQ ID NO: 189366 - DNA, 23 bp, Homo sapiens
aaggaggatggcatataatacaa

SEQ ID NO: 189367 - DNA, 22 bp, Homo sapiens
aattgaatcactgctcacactg

SEQ ID NO: 189368 - DNA, 18 bp, Homo sapiens
acaaaggcttattaattt

SEQ ID NO: 189369 - DNA, 15 bp, Homo sapiens
acaaattatcttaaa

SEQ ID NO: 189370 - DNA, 20 bp, Homo sapiens
acactctcaaagcaaataat

SEQ ID NO: 189371 - DNA, 13 bp, Homo sapiens
acattaaattgat

SEQ ID NO: 189372 - DNA, 17 bp, Homo sapiens
accacaatgcagtgcct

SEQ ID NO: 189373 - DNA, 14 bp, Homo sapiens
accattgtctcaga

SEQ ID NO: 189374 - DNA, 15 bp, Homo sapiens
accattgtctcagag

SEQ ID NO: 189375 - DNA, 18 bp, Homo sapiens
accattgtctcagagcag

SEQ ID NO: 189376 - DNA, 17 bp, Homo sapiens
acctcaccaagctgctg

SEQ ID NO: 189377 - DNA, 15 bp, Homo sapiens
acctctgtgccttgc

SEQ ID NO: 189378 - DNA, 15 bp, Homo sapiens
acgaagaagagccac

SEQ ID NO: 189379 - DNA, 20 bp, Homo sapiens
acgtactgcagcctccagag

SEQ ID NO: 189380 - DNA, 18 bp, Homo sapiens
actaacaaccaaagacta

SEQ ID NO: 189381 - DNA, 14 bp, Homo sapiens
actacctctgtgcc

SEQ ID NO: 189382 - DNA, 12 bp, Homo sapiens
actgagaaagag

SEQ ID NO: 189383 - DNA, 14 bp, Homo sapiens
agaaagaggcaggg

SEQ ID NO: 189384 - DNA, 11 bp, Homo sapiens
agaagagccac

SEQ ID NO: 189385 - DNA, 16 bp, Homo sapiens
agaggagggggcaggc

SEQ ID NO: 189386 - DNA, 23 bp, Homo sapiens
agaggagggggcaggctgagggt

SEQ ID NO: 189387 - DNA, 17 bp, Homo sapiens
agcacgtggtaaaacac

SEQ ID NO: 189388 - DNA, 20 bp, Homo sapiens
agctgcctggaagagcagcc

SEQ ID NO: 189389 - DNA, 21 bp, Homo sapiens
agctgcctggaagagcagccc

SEQ ID NO: 189390 - DNA, 16 bp, Homo sapiens
agctggacctcaccaa

SEQ ID NO: 189391 - DNA, 18 bp, Homo sapiens
aggcagggacctaaaggg

SEQ ID NO: 189392 - DNA, 17 bp, Homo sapiens
agggacgaagaagagcc

SEQ ID NO: 189393 - DNA, 17 bp, Homo sapiens
agggactacctctgtgc

SEQ ID NO: 189394 - DNA, 15 bp, Homo sapiens
agggtcgtgggaaag

SEQ ID NO: 189395 - DNA, 17 bp, Homo sapiens
agggtcgtgggaaaggg

SEQ ID NO: 189396 - DNA, 21 bp, Homo sapiens
aggtgggggaacactgagaaa

SEQ ID NO: 189397 - DNA, 12 bp, Homo sapiens
aggttgtctgtg

SEQ ID NO: 189398 - DNA, 13 bp, Homo sapiens
atataactaacaa

SEQ ID NO: 189399 - DNA, 16 bp, Homo sapiens
atcactgctcacactg

SEQ ID NO: 189400 - DNA, 13 bp, Homo sapiens
atcagccagtgac

SEQ ID NO: 189401 - DNA, 22 bp, Homo sapiens
atcctaccacaatgcagtgcct

SEQ ID NO: 189402 - DNA, 21 bp, Homo sapiens
atcctatctctccaaccagat

SEQ ID NO: 189403 - DNA, 19 bp, Homo sapiens
atcttgcccgctcaggctg

SEQ ID NO: 189404 - DNA, 14 bp, Homo sapiens
atcttgtccccaac

SEQ ID NO: 189405 - DNA, 17 bp, Homo sapiens
attgataacatggaaat

SEQ ID NO: 189406 - DNA, 23 bp, Homo sapiens
atttgaatcagcctacaggcctc

SEQ ID NO: 189407 - DNA, 18 bp, Homo sapiens
caagtcctgcctcttaaa

SEQ ID NO: 189408 - DNA, 13 bp, Homo sapiens
cacaaagggccca

SEQ ID NO: 189409 - DNA, 13 bp, Homo sapiens
cacattaaattga

SEQ ID NO: 189410 - DNA, 13 bp, Homo sapiens
caccaagctgctg

SEQ ID NO: 189411 - DNA, 18 bp, Homo sapiens
cacgtggtaaaacacttg

SEQ ID NO: 189412 - DNA, 12 bp, Homo sapiens
cactgagaaaga

SEQ ID NO: 189413 - DNA, 13 bp, Homo sapiens
cactgagaaagag

SEQ ID NO: 189414 - DNA, 22 bp, Homo sapiens
cacttgcggatattctggactg

SEQ ID NO: 189415 - DNA, 17 bp, Homo sapiens
cagaccattgtctcaga

SEQ ID NO: 189416 - DNA, 20 bp, Homo sapiens
cagagcctcctttctggctt

SEQ ID NO: 189417 - DNA, 12 bp, Homo sapiens
cagcctccagag

SEQ ID NO: 189418 - DNA, 21 bp, Homo sapiens
caggatggcaaccagaccatt

SEQ ID NO: 189419 - DNA, 22 bp, Homo sapiens
caggctgagggtcgtgggaaag

SEQ ID NO: 189420 - DNA, 19 bp, Homo sapiens
cagggacgaagaagagcca

SEQ ID NO: 189421 - DNA, 12 bp, Homo sapiens
cagtaccacatg

SEQ ID NO: 189422 - DNA, 17 bp, Homo sapiens
cagtgcacctgtcatat

SEQ ID NO: 189423 - DNA, 18 bp, Homo sapiens
catcttgcccgctcaggc

SEQ ID NO: 189424 - DNA, 14 bp, Homo sapiens
ccaaaggaggatgg

SEQ ID NO: 189425 - DNA, 20 bp, Homo sapiens
ccacagtgcctaataatact

SEQ ID NO: 189426 - DNA, 17 bp, Homo sapiens
ccacgtactgcagcctc

SEQ ID NO: 189427 - DNA, 14 bp, Homo sapiens
ccactcacaacagc

SEQ ID NO: 189428 - DNA, 19 bp, Homo sapiens
ccagggacgaagaagagcc

SEQ ID NO: 189429 - DNA, 21 bp, Homo sapiens
ccagggacgaagaagagccac

SEQ ID NO: 189430 - DNA, 22 bp, Homo sapiens
ccagtgtgtggctttcagagcc

SEQ ID NO: 189431 - DNA, 22 bp, Homo sapiens
ccagttagcctctgcaggatgt

SEQ ID NO: 189432 - DNA, 15 bp, Homo sapiens
ccattgtctcagagc

SEQ ID NO: 189433 - DNA, 15 bp, Homo sapiens
ccgaaaatcatataa

SEQ ID NO: 189434 - DNA, 15 bp, Homo sapiens
cctcctttctggctt

SEQ ID NO: 189435 - DNA, 21 bp, Homo sapiens
cctgcctcttaaataaacctt

SEQ ID NO: 189436 - DNA, 12 bp, Homo sapiens
cctgtttcttcc

SEQ ID NO: 189437 - DNA, 22 bp, Homo sapiens
cgaaaatcatataatcttacaa

SEQ ID NO: 189438 - DNA, 16 bp, Homo sapiens
cgaagaagagccacag

SEQ ID NO: 189439 - DNA, 17 bp, Homo sapiens
cgaagaagagccacagt

SEQ ID NO: 189440 - DNA, 18 bp, Homo sapiens
cgaagaagagccacagtg

SEQ ID NO: 189441 - DNA, 23 bp, Homo sapiens
cgaaggaaaagggctttctcaat

SEQ ID NO: 189442 - DNA, 16 bp, Homo sapiens
cgaatctagaggaggg

SEQ ID NO: 189443 - DNA, 17 bp, Homo sapiens
cgaatctagaggagggg

SEQ ID NO: 189444 - DNA, 16 bp, Homo sapiens
cgtgggaaaggggagt

SEQ ID NO: 189445 - DNA, 23 bp, Homo sapiens
ctaaagggactacctctgtgcct

SEQ ID NO: 189446 - DNA, 14 bp, Homo sapiens
ctaatcatgaaact

SEQ ID NO: 189447 - DNA, 13 bp, Homo sapiens
ctagaggaggggg

SEQ ID NO: 189448 - DNA, 20 bp, Homo sapiens
ctagaggagggggcaggctg

SEQ ID NO: 189449 - DNA, 16 bp, Homo sapiens
ctccatcctaccacaa

SEQ ID NO: 189450 - DNA, 23 bp, Homo sapiens
ctctgtgccttgccacattaaat

SEQ ID NO: 189451 - DNA, 20 bp, Homo sapiens
ctgactgtctcccgggacta

SEQ ID NO: 189452 - DNA, 17 bp, Homo sapiens
ctgagaaagaggcaggg

SEQ ID NO: 189453 - DNA, 15 bp, Homo sapiens
ctgagcgcctgggtc

SEQ ID NO: 189454 - DNA, 21 bp, Homo sapiens
ctgagggtcgtgggaaagggg

SEQ ID NO: 189455 - DNA, 19 bp, Homo sapiens
ctgcctcttaaataaacct

SEQ ID NO: 189456 - DNA, 20 bp, Homo sapiens
ctgcctggaagagcagccct

SEQ ID NO: 189457 - DNA, 18 bp, Homo sapiens
ctgcgaatctagaggagg

SEQ ID NO: 189458 - DNA, 21 bp, Homo sapiens
ctggagccatgggcacaaagg

SEQ ID NO: 189459 - DNA, 23 bp, Homo sapiens
ctgtgccttgccacattaaattg

SEQ ID NO: 189460 - DNA, 18 bp, Homo sapiens
cttacttattatcttcag

SEQ ID NO: 189461 - DNA, 22 bp, Homo sapiens
cttccagggacgaagaagagcc

SEQ ID NO: 189462 - DNA, 15 bp, Homo sapiens
cttctcccaattcat

SEQ ID NO: 189463 - DNA, 12 bp, Homo sapiens
ctttcagagcct

SEQ ID NO: 189464 - DNA, 13 bp, Homo sapiens
ctttcagagcctc

SEQ ID NO: 189465 - DNA, 14 bp, Homo sapiens
cttttcccaaccat

SEQ ID NO: 189466 - DNA, 15 bp, Homo sapiens
gaacactgagaaaga

SEQ ID NO: 189467 - DNA, 19 bp, Homo sapiens
gaagcacgtggtaaaacac

SEQ ID NO: 189468 - DNA, 18 bp, Homo sapiens
gaatcagcctacaggcct

SEQ ID NO: 189469 - DNA, 14 bp, Homo sapiens
gacagtatataact

SEQ ID NO: 189470 - DNA, 18 bp, Homo sapiens
gacgaagaagagccacag

SEQ ID NO: 189471 - DNA, 14 bp, Homo sapiens
gactacctctgtgc

SEQ ID NO: 189472 - DNA, 16 bp, Homo sapiens
gactacctctgtgcct

SEQ ID NO: 189473 - DNA, 22 bp, Homo sapiens
gactacctctgtgccttgccac

SEQ ID NO: 189474 - DNA, 19 bp, Homo sapiens
gaggagggggcaggctgag

SEQ ID NO: 189475 - DNA, 17 bp, Homo sapiens
gaggcacatgtcagcaa

SEQ ID NO: 189476 - DNA, 18 bp, Homo sapiens
gaggcagggacctaaagg

SEQ ID NO: 189477 - DNA, 22 bp, Homo sapiens
gagggtcgtgggaaaggggagt

SEQ ID NO: 189478 - DNA, 18 bp, Homo sapiens
gatcagccagtgaccaac

SEQ ID NO: 189479 - DNA, 18 bp, Homo sapiens
gatggcaaccagaccatt

SEQ ID NO: 189480 - DNA, 16 bp, Homo sapiens
gcacaaagggcccaga

SEQ ID NO: 189481 - DNA, 18 bp, Homo sapiens
gcacgtggtaaaacactt

SEQ ID NO: 189482 - DNA, 22 bp, Homo sapiens
gcccagattaaagtctttatcc

SEQ ID NO: 189483 - DNA, 18 bp, Homo sapiens
gctagaggaagcagccaa

SEQ ID NO: 189484 - DNA, 16 bp, Homo sapiens
gctgagggtcgtggga

SEQ ID NO: 189485 - DNA, 23 bp, Homo sapiens
gctgcgaatctagaggagggggc

SEQ ID NO: 189486 - DNA, 17 bp, Homo sapiens
gctggacctcaccaagc

SEQ ID NO: 189487 - DNA, 21 bp, Homo sapiens
gcttccacgtactgcagcctc

SEQ ID NO: 189488 - DNA, 20 bp, Homo sapiens
ggactttatagatcagccag

SEQ ID NO: 189489 - DNA, 18 bp, Homo sapiens
ggctgagggtcgtgggaa

SEQ ID NO: 189490 - DNA, 15 bp, Homo sapiens
gggaacactgagaaa

SEQ ID NO: 189491 - DNA, 16 bp, Homo sapiens
gggaacactgagaaag

SEQ ID NO: 189492 - DNA, 15 bp, Homo sapiens
gggcacaaagggccc

SEQ ID NO: 189493 - DNA, 16 bp, Homo sapiens
gggcacaaagggccca

SEQ ID NO: 189494 - DNA, 12 bp, Homo sapiens
gggcaggctgag

SEQ ID NO: 189495 - DNA, 15 bp, Homo sapiens
ggtcgtgggaaaggg

SEQ ID NO: 189496 - DNA, 16 bp, Homo sapiens
ggtcgtgggaaagggg

SEQ ID NO: 189497 - DNA, 19 bp, Homo sapiens
ggtcgtgggaaaggggagt

SEQ ID NO: 189498 - DNA, 18 bp, Homo sapiens
gtagacagtatataacta

SEQ ID NO: 189499 - DNA, 16 bp, Homo sapiens
gtattgtgattatcaa

SEQ ID NO: 189500 - DNA, 23 bp, Homo sapiens
aaatactacctgtcccctatgcc

SEQ ID NO: 189501 - DNA, 17 bp, Homo sapiens
aacaacacctcctcctg

SEQ ID NO: 189502 - DNA, 14 bp, Homo sapiens
aacagcccttcctt

SEQ ID NO: 189503 - DNA, 22 bp, Homo sapiens
aaccacagtgccaccaagctca

SEQ ID NO: 189504 - DNA, 20 bp, Homo sapiens
aaccccacaagcaccactct

SEQ ID NO: 189505 - DNA, 18 bp, Homo sapiens
aaccttctgccctcctgc

SEQ ID NO: 189506 - DNA, 20 bp, Homo sapiens
aagctcacacctgtccttct

SEQ ID NO: 189507 - DNA, 18 bp, Homo sapiens
aaggaaaatactacctgt

SEQ ID NO: 189508 - DNA, 13 bp, Homo sapiens
aaggaaggaaaat

SEQ ID NO: 189509 - DNA, 13 bp, Homo sapiens
aattgacttcctc

SEQ ID NO: 189510 - DNA, 14 bp, Homo sapiens
acaagcaccactct

SEQ ID NO: 189511 - DNA, 16 bp, Homo sapiens
acaagcagggcactct

SEQ ID NO: 189512 - DNA, 13 bp, Homo sapiens
acacctcctcctg

SEQ ID NO: 189513 - DNA, 21 bp, Homo sapiens
acacctcctcctgctgctcac

SEQ ID NO: 189514 - DNA, 16 bp, Homo sapiens
acacctgtccttctca

SEQ ID NO: 189515 - DNA, 14 bp, Homo sapiens
acagccagaggaac

SEQ ID NO: 189516 - DNA, 14 bp, Homo sapiens
acagcccttccttg

SEQ ID NO: 189517 - DNA, 19 bp, Homo sapiens
acagcccttccttggggaa

SEQ ID NO: 189518 - DNA, 20 bp, Homo sapiens
acagcccttccttggggaaa

SEQ ID NO: 189519 - DNA, 15 bp, Homo sapiens
acatccacatgctct

SEQ ID NO: 189520 - DNA, 23 bp, Homo sapiens
accactctgggcacaagcagggc

SEQ ID NO: 189521 - DNA, 17 bp, Homo sapiens
accagcactccatcact

SEQ ID NO: 189522 - DNA, 15 bp, Homo sapiens
accaggtgctcagcc

SEQ ID NO: 189523 - DNA, 13 bp, Homo sapiens
acccacatatctt

SEQ ID NO: 189524 - DNA, 23 bp, Homo sapiens
acccagggcccccaaagagcaag

SEQ ID NO: 189525 - DNA, 13 bp, Homo sapiens
accgcatcctcac

SEQ ID NO: 189526 - DNA, 20 bp, Homo sapiens
acctggggtgctgcctctca

SEQ ID NO: 189527 - DNA, 18 bp, Homo sapiens
accttctgccctcctgcc

SEQ ID NO: 189528 - DNA, 18 bp, Homo sapiens
acgtgtgtgtcagctggt

SEQ ID NO: 189529 - DNA, 14 bp, Homo sapiens
actcagccccttcc

SEQ ID NO: 189530 - DNA, 17 bp, Homo sapiens
actcagccccttcccgg

SEQ ID NO: 189531 - DNA, 13 bp, Homo sapiens
actcccgctgagc

SEQ ID NO: 189532 - DNA, 20 bp, Homo sapiens
actctgggcacaagcagggc

SEQ ID NO: 189533 - DNA, 15 bp, Homo sapiens
actctgttcccctcc

SEQ ID NO: 189534 - DNA, 19 bp, Homo sapiens
actctgttcccctccccct

SEQ ID NO: 189535 - DNA, 14 bp, Homo sapiens
actgccccagctcc

SEQ ID NO: 189536 - DNA, 18 bp, Homo sapiens
acttcctccaatccccac

SEQ ID NO: 189537 - DNA, 20 bp, Homo sapiens
acttcgtttctggggcaact

SEQ ID NO: 189538 - DNA, 22 bp, Homo sapiens
acttgggaatcattctggctta

SEQ ID NO: 189539 - DNA, 18 bp, Homo sapiens
agacaaacagcccttcct

SEQ ID NO: 189540 - DNA, 20 bp, Homo sapiens
agacaaacagcccttccttg

SEQ ID NO: 189541 - DNA, 13 bp, Homo sapiens
agatctggggagt

SEQ ID NO: 189542 - DNA, 18 bp, Homo sapiens
agcaccactctgggcaca

SEQ ID NO: 189543 - DNA, 22 bp, Homo sapiens
agccattctctacccatcctta

SEQ ID NO: 189544 - DNA, 14 bp, Homo sapiens
agcccactctactg

SEQ ID NO: 189545 - DNA, 21 bp, Homo sapiens
agcccactctactgccccagc

SEQ ID NO: 189546 - DNA, 21 bp, Homo sapiens
agcgtctgggcaagaggaaaa

SEQ ID NO: 189547 - DNA, 13 bp, Homo sapiens
agctcacacctgt

SEQ ID NO: 189548 - DNA, 15 bp, Homo sapiens
agctcacacctgtcc

SEQ ID NO: 189549 - DNA, 13 bp, Homo sapiens
agctcacactcat

SEQ ID NO: 189550 - DNA, 14 bp, Homo sapiens
agctcacactcatc

SEQ ID NO: 189551 - DNA, 23 bp, Homo sapiens
agctgctaattggcagcacccac

SEQ ID NO: 189552 - DNA, 20 bp, Homo sapiens
aggaaaatgccctgtcccta

SEQ ID NO: 189553 - DNA, 14 bp, Homo sapiens
aggctggcatctcc

SEQ ID NO: 189554 - DNA, 14 bp, Homo sapiens
actctactgcccca

SEQ ID NO: 189555 - DNA, 13 bp, Homo sapiens
acttcagcagggg

SEQ ID NO: 189556 - DNA, 15 bp, Homo sapiens
acttcagcaggggat

SEQ ID NO: 189557 - DNA, 20 bp, Homo sapiens
acttcctccaatccccactc

SEQ ID NO: 189558 - DNA, 19 bp, Homo sapiens
acttggggatttctggtca

SEQ ID NO: 189559 - DNA, 17 bp, Homo sapiens
agacaaacagcccttcc

SEQ ID NO: 189560 - DNA, 21 bp, Homo sapiens
agacaaacagcccttccttgg

SEQ ID NO: 189561 - DNA, 14 bp, Homo sapiens
agagggtggcatca

SEQ ID NO: 189562 - DNA, 12 bp, Homo sapiens
agcaagaaggag

SEQ ID NO: 189563 - DNA, 13 bp, Homo sapiens
agcaccactctgg

SEQ ID NO: 189564 - DNA, 16 bp, Homo sapiens
agcaccactctgggca

SEQ ID NO: 189565 - DNA, 15 bp, Homo sapiens
agcacccactcagcc

SEQ ID NO: 189566 - DNA, 22 bp, Homo sapiens
agcactccatcactgagagccc

SEQ ID NO: 189567 - DNA, 20 bp, Homo sapiens
agccagaggaaccagcactc

SEQ ID NO: 189568 - DNA, 13 bp, Homo sapiens
agccccttcccgg

SEQ ID NO: 189569 - DNA, 17 bp, Homo sapiens
agcccttccttggggaa

SEQ ID NO: 189570 - DNA, 16 bp, Homo sapiens
agctcacacctgtcct

SEQ ID NO: 189571 - DNA, 16 bp, Homo sapiens
agctcacactcatcca

SEQ ID NO: 189572 - DNA, 20 bp, Homo sapiens
agctccgtttctaccaccgc

SEQ ID NO: 189573 - DNA, 20 bp, Homo sapiens
agctgggggcgcagaggaca

SEQ ID NO: 189574 - DNA, 17 bp, Homo sapiens
agcttcgtcagctccag

SEQ ID NO: 189575 - DNA, 20 bp, Homo sapiens
agcttcgtcagctccagcgt

SEQ ID NO: 189576 - DNA, 21 bp, Homo sapiens
aggagacaaacagcccttcct

SEQ ID NO: 189577 - DNA, 24 bp, Homo sapiens
aggagctgctcaggcttggcggag

SEQ ID NO: 189578 - DNA, 17 bp, Homo sapiens
aggcccgcactgggggc

SEQ ID NO: 189579 - DNA, 11 bp, Homo sapiens
aggctggcatc

SEQ ID NO: 189580 - DNA, 21 bp, Homo sapiens
aggggcctccaaccttctgcc

SEQ ID NO: 189581 - DNA, 15 bp, Homo sapiens
aggtcaaggaaggaa

SEQ ID NO: 189582 - DNA, 17 bp, Homo sapiens
aggtgctcagcccaggc

SEQ ID NO: 189583 - DNA, 23 bp, Homo sapiens
agtgtgaggagagggtggcatca

SEQ ID NO: 189584 - DNA, 15 bp, Homo sapiens
atcaggagctgctca

SEQ ID NO: 189585 - DNA, 16 bp, Homo sapiens
atccacatgctctgca

SEQ ID NO: 189586 - DNA, 15 bp, Homo sapiens
atcctcactgggctc

SEQ ID NO: 189587 - DNA, 15 bp, Homo sapiens
atctcccccaccctg

SEQ ID NO: 189588 - DNA, 21 bp, Homo sapiens
atctcccccaccctgtgcccc

SEQ ID NO: 189589 - DNA, 12 bp, Homo sapiens
atcttacagcca

SEQ ID NO: 189590 - DNA, 14 bp, Homo sapiens
atgtcactcagccc

SEQ ID NO: 189591 - DNA, 18 bp, Homo sapiens
atgtcactcagccccttc

SEQ ID NO: 189592 - DNA, 21 bp, Homo sapiens
attctgacatccacatgctct

SEQ ID NO: 189593 - DNA, 23 bp, Homo sapiens
atttctgccacgtggtggcccag

SEQ ID NO: 189594 - DNA, 19 bp, Homo sapiens
attttctttcccagaagcg

SEQ ID NO: 189595 - DNA, 16 bp, Homo sapiens
caaaagatctggggag

SEQ ID NO: 189596 - DNA, 16 bp, Homo sapiens
caaaagctcagggccc

SEQ ID NO: 189597 - DNA, 13 bp, Homo sapiens
caacaaccacagt

SEQ ID NO: 189598 - DNA, 17 bp, Homo sapiens
caacaaccacagtgcca

SEQ ID NO: 189599 - DNA, 12 bp, Homo sapiens
caacacctcctc

SEQ ID NO: 189600 - DNA, 13 bp, Homo sapiens
caacacctcctcc

SEQ ID NO: 189601 - DNA, 24 bp, Homo sapiens
caacacctcctcctgctgctcact

SEQ ID NO: 189602 - DNA, 15 bp, Homo sapiens
caacagcccagcaag

SEQ ID NO: 189603 - DNA, 21 bp, Homo sapiens
caacagcccagcaagaaggag

SEQ ID NO: 189604 - DNA, 14 bp, Homo sapiens
caaccacagtgcca

SEQ ID NO: 189605 - DNA, 22 bp, Homo sapiens
caaccccacaagcaccactctg

SEQ ID NO: 189606 - DNA, 12 bp, Homo sapiens
caaccttctgcc

SEQ ID NO: 189607 - DNA, 15 bp, Homo sapiens
caaccttctgccctc

SEQ ID NO: 189608 - DNA, 18 bp, Homo sapiens
caaccttctgccctcctg

SEQ ID NO: 189609 - DNA, 20 bp, Homo sapiens
caaccttctgccctcctgcc

SEQ ID NO: 189610 - DNA, 13 bp, Homo sapiens
caagcaccactct

SEQ ID NO: 189611 - DNA, 23 bp, Homo sapiens
caagcgtctgggcaagaggaaaa

SEQ ID NO: 189612 - DNA, 15 bp, Homo sapiens
caagctcacacctgt

SEQ ID NO: 189613 - DNA, 16 bp, Homo sapiens
caagctcacacctgtc

SEQ ID NO: 189614 - DNA, 12 bp, Homo sapiens
caaggaaggaaa

SEQ ID NO: 189615 - DNA, 18 bp, Homo sapiens
caaggggcctccaacctt

SEQ ID NO: 189616 - DNA, 12 bp, Homo sapiens
caatccccactc

SEQ ID NO: 189617 - DNA, 17 bp, Homo sapiens
cacaacttcagcagggg

SEQ ID NO: 189618 - DNA, 19 bp, Homo sapiens
cacaacttcagcaggggat

SEQ ID NO: 189619 - DNA, 23 bp, Homo sapiens
cacaagcaccactctgggcacaa

SEQ ID NO: 189620 - DNA, 14 bp, Homo sapiens
cacacctgtccttc

SEQ ID NO: 189621 - DNA, 17 bp, Homo sapiens
cacacctgtccttctca

SEQ ID NO: 189622 - DNA, 12 bp, Homo sapiens
cacactcatcca

SEQ ID NO: 189623 - DNA, 14 bp, Homo sapiens
cacatgctctgcag

SEQ ID NO: 189624 - DNA, 17 bp, Homo sapiens
caccaagctcacacctg

SEQ ID NO: 189625 - DNA, 14 bp, Homo sapiens
caccactctgggca

SEQ ID NO: 189626 - DNA, 15 bp, Homo sapiens
caccactctgggcac

SEQ ID NO: 189627 - DNA, 21 bp, Homo sapiens
cacccacatatcttacagcca

SEQ ID NO: 189628 - DNA, 15 bp, Homo sapiens
cacccactcagccat

SEQ ID NO: 189629 - DNA, 17 bp, Homo sapiens
caccgcatcctcactgg

SEQ ID NO: 189630 - DNA, 13 bp, Homo sapiens
cacctcctcctgc

SEQ ID NO: 189631 - DNA, 21 bp, Homo sapiens
cacctggggtgctgcctctca

SEQ ID NO: 189632 - DNA, 20 bp, Homo sapiens
cacctgtccttctcaggctg

SEQ ID NO: 189633 - DNA, 20 bp, Homo sapiens
caccttaaaggtcaaggaag

SEQ ID NO: 189634 - DNA, 19 bp, Homo sapiens
cactcagccattctctacc

SEQ ID NO: 189635 - DNA, 18 bp, Homo sapiens
cactccatcactgagagc

SEQ ID NO: 189636 - DNA, 21 bp, Homo sapiens
cactctgggcacaagcagggc

SEQ ID NO: 189637 - DNA, 16 bp, Homo sapiens
cactctgttcccctcc

SEQ ID NO: 189638 - DNA, 19 bp, Homo sapiens
cactctgttcccctccccc

SEQ ID NO: 189639 - DNA, 16 bp, Homo sapiens
cagcacccactcagcc

SEQ ID NO: 189640 - DNA, 19 bp, Homo sapiens
cagcactccatcactgaga

SEQ ID NO: 189641 - DNA, 13 bp, Homo sapiens
cagccagaggaac

SEQ ID NO: 189642 - DNA, 23 bp, Homo sapiens
cagccagaggaaccagcactcca

SEQ ID NO: 189643 - DNA, 15 bp, Homo sapiens
cagcccagcaagaag

SEQ ID NO: 189644 - DNA, 10 bp, Homo sapiens
cagcccttcc

SEQ ID NO: 189645 - DNA, 16 bp, Homo sapiens
cagcccttccttgggg

SEQ ID NO: 189646 - DNA, 17 bp, Homo sapiens
cagcccttccttgggga

SEQ ID NO: 189647 - DNA, 18 bp, Homo sapiens
cagcccttccttggggaa

SEQ ID NO: 189648 - DNA, 16 bp, Homo sapiens
cagcttcgtcagctcc

SEQ ID NO: 189649 - DNA, 13 bp, Homo sapiens
caggagctgctca

SEQ ID NO: 189650 - DNA, 21 bp, Homo sapiens
cagggcactctgttcccctcc

SEQ ID NO: 189651 - DNA, 23 bp, Homo sapiens
caggtagaccaggtgctcagccc

SEQ ID NO: 189652 - DNA, 15 bp, Homo sapiens
cagtcctggccccct

SEQ ID NO: 189653 - DNA, 13 bp, Homo sapiens
cagtgccaccaag

SEQ ID NO: 189654 - DNA, 22 bp, Homo sapiens
cagtgccaccaagctcacacct

SEQ ID NO: 189655 - DNA, 23 bp, Homo sapiens
cagtgccaccaagctcacacctg

SEQ ID NO: 189656 - DNA, 11 bp, Homo sapiens
catcacctggg

SEQ ID NO: 189657 - DNA, 16 bp, Homo sapiens
catcaggagctgctca

SEQ ID NO: 189658 - DNA, 23 bp, Homo sapiens
catccacacttaagccctcgtgc

SEQ ID NO: 189659 - DNA, 17 bp, Homo sapiens
catcccaacagcccagc

SEQ ID NO: 189660 - DNA, 22 bp, Homo sapiens
catcctcactgggctcactgca

SEQ ID NO: 189661 - DNA, 16 bp, Homo sapiens
catctcccccaccctg

SEQ ID NO: 189662 - DNA, 19 bp, Homo sapiens
catctcccccaccctgtgc

SEQ ID NO: 189663 - DNA, 22 bp, Homo sapiens
catcttcatcccaacagcccag

SEQ ID NO: 189664 - DNA, 22 bp, Homo sapiens
catgctgaacaaggggcctcca

SEQ ID NO: 189665 - DNA, 12 bp, Homo sapiens
cattctggctta

SEQ ID NO: 189666 - DNA, 22 bp, Homo sapiens
cattctggcttaaacaacacct

SEQ ID NO: 189667 - DNA, 18 bp, Homo sapiens
ccaacagcccagcaagaa

SEQ ID NO: 189668 - DNA, 16 bp, Homo sapiens
ccaagctcacacctgt

SEQ ID NO: 189669 - DNA, 23 bp, Homo sapiens
ccaagctcacacctgtccttctc

SEQ ID NO: 189670 - DNA, 13 bp, Homo sapiens
ccaatccccactc

SEQ ID NO: 189671 - DNA, 17 bp, Homo sapiens
ccaatccccactcctcc

SEQ ID NO: 189672 - DNA, 13 bp, Homo sapiens
ccacaagcaccac

SEQ ID NO: 189673 - DNA, 15 bp, Homo sapiens
ccacacttaagccct

SEQ ID NO: 189674 - DNA, 16 bp, Homo sapiens
ccacacttaagccctc

SEQ ID NO: 189675 - DNA, 15 bp, Homo sapiens
ccacagtgccaccaa

SEQ ID NO: 189676 - DNA, 17 bp, Homo sapiens
ccacatcgggctcacct

SEQ ID NO: 189677 - DNA, 19 bp, Homo sapiens
ccaccaagctcacacctgt

SEQ ID NO: 189678 - DNA, 16 bp, Homo sapiens
ccaccgcatcctcact

SEQ ID NO: 189679 - DNA, 23 bp, Homo sapiens
ccaccgcatcctcactgggctca

SEQ ID NO: 189680 - DNA, 18 bp, Homo sapiens
ccacgtggtggcccagct

SEQ ID NO: 189681 - DNA, 21 bp, Homo sapiens
ccacgtggtggcccagctcct

SEQ ID NO: 189682 - DNA, 12 bp, Homo sapiens
ccactcagccat

SEQ ID NO: 189683 - DNA, 14 bp, Homo sapiens
ccactctactgccc

SEQ ID NO: 189684 - DNA, 15 bp, Homo sapiens
ccactctactgcccc

SEQ ID NO: 189685 - DNA, 14 bp, Homo sapiens
ccagcactccatca

SEQ ID NO: 189686 - DNA, 21 bp, Homo sapiens
ccagctccgtttctaccaccg

SEQ ID NO: 189687 - DNA, 23 bp, Homo sapiens
ccagctccgtttctaccaccgca

SEQ ID NO: 189688 - DNA, 15 bp, Homo sapiens
ccagctcctcaccca

SEQ ID NO: 189689 - DNA, 16 bp, Homo sapiens
ccagcttcgtcagctc

SEQ ID NO: 189690 - DNA, 21 bp, Homo sapiens
ccagggtgacatacagaaggg

SEQ ID NO: 189691 - DNA, 14 bp, Homo sapiens
ccaggtgctcagcc

SEQ ID NO: 189692 - DNA, 14 bp, Homo sapiens
ccatcttcatccca

SEQ ID NO: 189693 - DNA, 20 bp, Homo sapiens
ccatcttcatcccaacagcc

SEQ ID NO: 189694 - DNA, 14 bp, Homo sapiens
cccaccctgtgccc

SEQ ID NO: 189695 - DNA, 12 bp, Homo sapiens
cccactcctccg

SEQ ID NO: 189696 - DNA, 17 bp, Homo sapiens
cccactctactgcccca

SEQ ID NO: 189697 - DNA, 16 bp, Homo sapiens
cccagctcctcaccca

SEQ ID NO: 189698 - DNA, 19 bp, Homo sapiens
cccagcttcgtcagctcca

SEQ ID NO: 189699 - DNA, 20 bp, Homo sapiens
cccaggagacaaacagccct

SEQ ID NO: 189700 - DNA, 23 bp, Homo sapiens
cccaggcacaacttcagcagggg

SEQ ID NO: 189701 - DNA, 20 bp, Homo sapiens
cccagggcccccaaagagca

SEQ ID NO: 189702 - DNA, 12 bp, Homo sapiens
cccccaccctgt

SEQ ID NO: 189703 - DNA, 17 bp, Homo sapiens
cccccatcttcatccca

SEQ ID NO: 189704 - DNA, 19 bp, Homo sapiens
cccctatgccactaagcca

SEQ ID NO: 189705 - DNA, 14 bp, Homo sapiens
cccgctgagcccac

SEQ ID NO: 189706 - DNA, 23 bp, Homo sapiens
cccgctgagcccactctactgcc

SEQ ID NO: 189707 - DNA, 21 bp, Homo sapiens
ccctgtgccccttttcatggt

SEQ ID NO: 189708 - DNA, 13 bp, Homo sapiens
ccgcactgggggc

SEQ ID NO: 189709 - DNA, 23 bp, Homo sapiens
ccgcccgcttccctccttcatga

SEQ ID NO: 189710 - DNA, 13 bp, Homo sapiens
ccgcttccctcct

SEQ ID NO: 189711 - DNA, 18 bp, Homo sapiens
ccgcttccctccttcatg

SEQ ID NO: 189712 - DNA, 14 bp, Homo sapiens
cctcactgggctca

SEQ ID NO: 189713 - DNA, 11 bp, Homo sapiens
cctccaacctt

SEQ ID NO: 189714 - DNA, 12 bp, Homo sapiens
cctgctgctcac

SEQ ID NO: 189715 - DNA, 15 bp, Homo sapiens
cctgtcccctatgcc

SEQ ID NO: 189716 - DNA, 16 bp, Homo sapiens
cctgtcccctatgcca

SEQ ID NO: 189717 - DNA, 17 bp, Homo sapiens
cctgtccttctcaggct

SEQ ID NO: 189718 - DNA, 13 bp, Homo sapiens
ccttccttgggga

SEQ ID NO: 189719 - DNA, 19 bp, Homo sapiens
ccttctcaggctggcatct

SEQ ID NO: 189720 - DNA, 15 bp, Homo sapiens
cgatgtcactcagcc

SEQ ID NO: 189721 - DNA, 12 bp, Homo sapiens
cgcactgggggc

SEQ ID NO: 189722 - DNA, 21 bp, Homo sapiens
cgctgagcccactctactgcc

SEQ ID NO: 189723 - DNA, 14 bp, Homo sapiens
cgcttccctccttc

SEQ ID NO: 189724 - DNA, 12 bp, Homo sapiens
cgggctcacctt

SEQ ID NO: 189725 - DNA, 21 bp, Homo sapiens
cggtccgcccgcttccctcct

SEQ ID NO: 189726 - DNA, 13 bp, Homo sapiens
cgtcagctccagc

SEQ ID NO: 189727 - DNA, 18 bp, Homo sapiens
cgtctgggcaagaggaaa

SEQ ID NO: 189728 - DNA, 13 bp, Homo sapiens
cgtttctaccacc

SEQ ID NO: 189729 - DNA, 23 bp, Homo sapiens
ctaattggcagcacccactcagc

SEQ ID NO: 189730 - DNA, 15 bp, Homo sapiens
ctactgccccagctc

SEQ ID NO: 189731 - DNA, 15 bp, Homo sapiens
ctaggtgtctgggat

SEQ ID NO: 189732 - DNA, 17 bp, Homo sapiens
ctcacacatttctgcca

SEQ ID NO: 189733 - DNA, 14 bp, Homo sapiens
ctcacccagggccc

SEQ ID NO: 189734 - DNA, 13 bp, Homo sapiens
ctcactcccgctg

SEQ ID NO: 189735 - DNA, 19 bp, Homo sapiens
ctcactcccgctgagccca

SEQ ID NO: 189736 - DNA, 20 bp, Homo sapiens
ctcagccattctctacccat

SEQ ID NO: 189737 - DNA, 15 bp, Homo sapiens
ctcagccccttcccg

SEQ ID NO: 189738 - DNA, 14 bp, Homo sapiens
ctcaggctggcatc

SEQ ID NO: 189739 - DNA, 14 bp, Homo sapiens
ctccaaccttctgc

SEQ ID NO: 189740 - DNA, 18 bp, Homo sapiens
ctccaaccttctgccctc

SEQ ID NO: 189741 - DNA, 16 bp, Homo sapiens
ctccaatccccactcc

SEQ ID NO: 189742 - DNA, 18 bp, Homo sapiens
ctccaatccccactcctc

SEQ ID NO: 189743 - DNA, 15 bp, Homo sapiens
ctccgtttctaccac

SEQ ID NO: 189744 - DNA, 16 bp, Homo sapiens
ctccgtttctaccacc

SEQ ID NO: 189745 - DNA, 13 bp, Homo sapiens
ctcctccgagacc

SEQ ID NO: 189746 - DNA, 14 bp, Homo sapiens
ctctactgccccag

SEQ ID NO: 189747 - DNA, 13 bp, Homo sapiens
ctctgtccagctt

SEQ ID NO: 189748 - DNA, 18 bp, Homo sapiens
ctctgttcccctccccct

SEQ ID NO: 189749 - DNA, 19 bp, Homo sapiens
ctgaacaaggggcctccaa

SEQ ID NO: 189750 - DNA, 20 bp, Homo sapiens
ctgagcccactctactgccc

SEQ ID NO: 189751 - DNA, 15 bp, Homo sapiens
ctgcaggcatgctga

SEQ ID NO: 189752 - DNA, 17 bp, Homo sapiens
ctgcagtcctggccccc

SEQ ID NO: 189753 - DNA, 21 bp, Homo sapiens
ctgccacgtggtggcccagct

SEQ ID NO: 189754 - DNA, 12 bp, Homo sapiens
ctgccctcctgc

SEQ ID NO: 189755 - DNA, 15 bp, Homo sapiens
ctggaagtcctggcc

SEQ ID NO: 189756 - DNA, 15 bp, Homo sapiens
ctggcatctccccca

SEQ ID NO: 189757 - DNA, 18 bp, Homo sapiens
ctggcatctcccccaccc

SEQ ID NO: 189758 - DNA, 20 bp, Homo sapiens
ctggcatctcccccaccctg

SEQ ID NO: 189759 - DNA, 18 bp, Homo sapiens
ctggccggccgcccacat

SEQ ID NO: 189760 - DNA, 21 bp, Homo sapiens
ctggcttaaacaacacctcct

SEQ ID NO: 189761 - DNA, 22 bp, Homo sapiens
ctggcttaaacaacacctcctc

SEQ ID NO: 189762 - DNA, 22 bp, Homo sapiens
ctgggatcggggtggggacagg

SEQ ID NO: 189763 - DNA, 21 bp, Homo sapiens
ctgggggcaattgacttcctc

SEQ ID NO: 189764 - DNA, 18 bp, Homo sapiens
ctggtcaaccccacaagc

SEQ ID NO: 189765 - DNA, 15 bp, Homo sapiens
ctgtcccctatgcca

SEQ ID NO: 189766 - DNA, 16 bp, Homo sapiens
ctgtccctagctcaca

SEQ ID NO: 189767 - DNA, 17 bp, Homo sapiens
ctgtccctagctcacac

SEQ ID NO: 189768 - DNA, 17 bp, Homo sapiens
ctgtccttctcaggctg

SEQ ID NO: 189769 - DNA, 19 bp, Homo sapiens
ctgtgccccttttcatggt

SEQ ID NO: 189770 - DNA, 18 bp, Homo sapiens
cttaaacaacacctcctc

SEQ ID NO: 189771 - DNA, 20 bp, Homo sapiens
cttaagccctcgtgcacaca

SEQ ID NO: 189772 - DNA, 15 bp, Homo sapiens
cttacagccagagga

SEQ ID NO: 189773 - DNA, 16 bp, Homo sapiens
cttacagccagaggaa

SEQ ID NO: 189774 - DNA, 20 bp, Homo sapiens
cttagtacatgctctgtcca

SEQ ID NO: 189775 - DNA, 18 bp, Homo sapiens
cttcccggtccgcccgct

SEQ ID NO: 189776 - DNA, 15 bp, Homo sapiens
cttccctccttcatg

SEQ ID NO: 189777 - DNA, 18 bp, Homo sapiens
cttcctccaatccccact

SEQ ID NO: 189778 - DNA, 17 bp, Homo sapiens
cttctcaggctggcatc

SEQ ID NO: 189779 - DNA, 14 bp, Homo sapiens
cttctgccctcctg

SEQ ID NO: 189780 - DNA, 16 bp, Homo sapiens
cttctgccctcctgcc

SEQ ID NO: 189781 - DNA, 20 bp, Homo sapiens
cttgggaatcattctggctt

SEQ ID NO: 189782 - DNA, 19 bp, Homo sapiens
cttttcatggtaccaggcc

SEQ ID NO: 189783 - DNA, 17 bp, Homo sapiens
gaaaatactacctgtcc

SEQ ID NO: 189784 - DNA, 14 bp, Homo sapiens
gaaggaggagacag

SEQ ID NO: 189785 - DNA, 17 bp, Homo sapiens
gacaaacagcccttcct

SEQ ID NO: 189786 - DNA, 16 bp, Homo sapiens
gaccaggtgctcagcc

SEQ ID NO: 189787 - DNA, 19 bp, Homo sapiens
gaccaggtgctcagcccag

SEQ ID NO: 189788 - DNA, 20 bp, Homo sapiens
gacttcctccaatccccact

SEQ ID NO: 189789 - DNA, 17 bp, Homo sapiens
gagacaaacagcccttc

SEQ ID NO: 189790 - DNA, 18 bp, Homo sapiens
gagacaaacagcccttcc

SEQ ID NO: 189791 - DNA, 18 bp, Homo sapiens
gagcccactctactgccc

SEQ ID NO: 189792 - DNA, 24 bp, Homo sapiens
gagcccactctactgccccagctc

SEQ ID NO: 189793 - DNA, 12 bp, Homo sapiens
gatctggggagt

SEQ ID NO: 189794 - DNA, 13 bp, Homo sapiens
gatctggggagtg

SEQ ID NO: 189795 - DNA, 14 bp, Homo sapiens
gatggcgctagggg

SEQ ID NO: 189796 - DNA, 15 bp, Homo sapiens
gatgtcactcagccc

SEQ ID NO: 189797 - DNA, 13 bp, Homo sapiens
gcaactgagagct

SEQ ID NO: 189798 - DNA, 19 bp, Homo sapiens
gcaactgagagctgagcgc

SEQ ID NO: 189799 - DNA, 11 bp, Homo sapiens
gcaagaaggag

SEQ ID NO: 189800 - DNA, 18 bp, Homo sapiens
gcacaacttcagcagggg

SEQ ID NO: 189801 - DNA, 19 bp, Homo sapiens
gcacaagcagggcactctg

SEQ ID NO: 189802 - DNA, 15 bp, Homo sapiens
gcaccactctgggca

SEQ ID NO: 189803 - DNA, 13 bp, Homo sapiens
gcacccactcagc

SEQ ID NO: 189804 - DNA, 21 bp, Homo sapiens
gcactctgttcccctccccct

SEQ ID NO: 189805 - DNA, 19 bp, Homo sapiens
gcagcacccactcagccat

SEQ ID NO: 189806 - DNA, 17 bp, Homo sapiens
gcatcaggagctgctca

SEQ ID NO: 189807 - DNA, 12 bp, Homo sapiens
gcatcctcactg

SEQ ID NO: 189808 - DNA, 18 bp, Homo sapiens
gcatctcccccaccctgt

SEQ ID NO: 189809 - DNA, 21 bp, Homo sapiens
gcatctcccccaccctgtgcc

SEQ ID NO: 189810 - DNA, 23 bp, Homo sapiens
gcatgggcgatgtcactcagccc

SEQ ID NO: 189811 - DNA, 19 bp, Homo sapiens
gccaaaagatctggggagt

SEQ ID NO: 189812 - DNA, 19 bp, Homo sapiens
gccaacaaccacagtgcca

SEQ ID NO: 189813 - DNA, 16 bp, Homo sapiens
gccaacgtgtgtgtca

SEQ ID NO: 189814 - DNA, 19 bp, Homo sapiens
gccaccaagctcacacctg

SEQ ID NO: 189815 - DNA, 20 bp, Homo sapiens
gccaccaagctcacacctgt

SEQ ID NO: 189816 - DNA, 19 bp, Homo sapiens
gccacgtggtggcccagct

SEQ ID NO: 189817 - DNA, 14 bp, Homo sapiens
gccactaagccaac

SEQ ID NO: 189818 - DNA, 19 bp, Homo sapiens
gcccagcttcgtcagctcc

SEQ ID NO: 189819 - DNA, 20 bp, Homo sapiens
gcccagcttcgtcagctcca

SEQ ID NO: 189820 - DNA, 20 bp, Homo sapiens
gccctgtccctagctcacac

SEQ ID NO: 189821 - DNA, 16 bp, Homo sapiens
gcctccaaccttctgc

SEQ ID NO: 189822 - DNA, 17 bp, Homo sapiens
gcctccaaccttctgcc

SEQ ID NO: 189823 - DNA, 22 bp, Homo sapiens
gcctctcacacatttctgccac

SEQ ID NO: 189824 - DNA, 16 bp, Homo sapiens
gcgcagaggacatcac

SEQ ID NO: 189825 - DNA, 18 bp, Homo sapiens
gcgtctgggcaagaggaa

SEQ ID NO: 189826 - DNA, 15 bp, Homo sapiens
gctcacacctgtcct

SEQ ID NO: 189827 - DNA, 17 bp, Homo sapiens
gctcacacctgtccttc

SEQ ID NO: 189828 - DNA, 17 bp, Homo sapiens
gctggcatctcccccac

SEQ ID NO: 189829 - DNA, 14 bp, Homo sapiens
gcttccctccttca

SEQ ID NO: 189830 - DNA, 15 bp, Homo sapiens
ggaaaatactacctg

SEQ ID NO: 189831 - DNA, 12 bp, Homo sapiens
ggacatcacctg

SEQ ID NO: 189832 - DNA, 20 bp, Homo sapiens
ggagacaaacagcccttcct

SEQ ID NO: 189833 - DNA, 21 bp, Homo sapiens
ggagacaaacagcccttcctt

SEQ ID NO: 189834 - DNA, 22 bp, Homo sapiens
ggagacagagagctcctccctg

SEQ ID NO: 189835 - DNA, 13 bp, Homo sapiens
ggagcggcatggg

SEQ ID NO: 189836 - DNA, 15 bp, Homo sapiens
ggcaagaggaaaatg

SEQ ID NO: 189837 - DNA, 20 bp, Homo sapiens
ggcaattgacttcctccaat

SEQ ID NO: 189838 - DNA, 17 bp, Homo sapiens
ggcacaacttcagcagg

SEQ ID NO: 189839 - DNA, 22 bp, Homo sapiens
tggcgctaggggacttggggat

SEQ ID NO: 189840 - DNA, 14 bp, Homo sapiens
tgggcaagaggaaa

SEQ ID NO: 189841 - DNA, 16 bp, Homo sapiens
tgggcacaagcagggc

SEQ ID NO: 189842 - DNA, 17 bp, Homo sapiens
tgggcacaagcagggca

SEQ ID NO: 189843 - DNA, 16 bp, Homo sapiens
tgggcgatgtcactca

SEQ ID NO: 189844 - DNA, 14 bp, Homo sapiens
tggggaaacttggg

SEQ ID NO: 189845 - DNA, 15 bp, Homo sapiens
tggggatttctggtc

SEQ ID NO: 189846 - DNA, 15 bp, Homo sapiens
tgtcactcagcccct

SEQ ID NO: 189847 - DNA, 18 bp, Homo sapiens
tgtcagctggtagctggg

SEQ ID NO: 189848 - DNA, 15 bp, Homo sapiens
tgttcccctccccct

SEQ ID NO: 189849 - DNA, 19 bp, Homo sapiens
ttaaacaacacctcctcct

SEQ ID NO: 189850 - DNA, 18 bp, Homo sapiens
ttcatcccaacagcccag

SEQ ID NO: 189851 - DNA, 21 bp, Homo sapiens
ttcatcccaacagcccagcaa

SEQ ID NO: 189852 - DNA, 18 bp, Homo sapiens
ttcctccaatccccactc

SEQ ID NO: 189853 - DNA, 22 bp, Homo sapiens
ttctaccaccgcatcctcactg

SEQ ID NO: 189854 - DNA, 21 bp, Homo sapiens
ttggcagcacccactcagcca

SEQ ID NO: 189855 - DNA, 20 bp, Homo sapiens
tttctaccaccgcatcctca

SEQ ID NO: 189856 - DNA, 20 bp, Homo sapiens
tttgcttaccaaaagctcag

SEQ ID NO: 189857 - DNA, 23 bp, Homo sapiens
tttgcttaccaaaagctcagggc

SEQ ID NO: 189858 - DNA, 19 bp, Homo sapiens
cgctaggggacttggggat

SEQ ID NO: 189859 - DNA, 15 bp, Homo sapiens
cgcttccctccttca

SEQ ID NO: 189860 - DNA, 17 bp, Homo sapiens
cggagggagcggcatgg

SEQ ID NO: 189861 - DNA, 19 bp, Homo sapiens
cggtccgcccgcttccctc

SEQ ID NO: 189862 - DNA, 17 bp, Homo sapiens
ctaattggcagcaccca

SEQ ID NO: 189863 - DNA, 20 bp, Homo sapiens
ctaccaccgcatcctcactg

SEQ ID NO: 189864 - DNA, 21 bp, Homo sapiens
ctaccaccgcatcctcactgg

SEQ ID NO: 189865 - DNA, 21 bp, Homo sapiens
ctacctgtcccctatgccact

SEQ ID NO: 189866 - DNA, 14 bp, Homo sapiens
ctaggggacttggg

SEQ ID NO: 189867 - DNA, 12 bp, Homo sapiens
ctcacacctgtc

SEQ ID NO: 189868 - DNA, 14 bp, Homo sapiens
ctcacacctgtcct

SEQ ID NO: 189869 - DNA, 15 bp, Homo sapiens
ctcacacctgtcctt

SEQ ID NO: 189870 - DNA, 16 bp, Homo sapiens
ctcacacctgtccttc

SEQ ID NO: 189871 - DNA, 23 bp, Homo sapiens
ctcacactcatccacacttaagc

SEQ ID NO: 189872 - DNA, 14 bp, Homo sapiens
ctcactgggctcac

SEQ ID NO: 189873 - DNA, 20 bp, Homo sapiens
ctcactgggctcactgcagg

SEQ ID NO: 189874 - DNA, 17 bp, Homo sapiens
ctcagccccttcccggt

SEQ ID NO: 189875 - DNA, 15 bp, Homo sapiens
ctcaggctggcatct

SEQ ID NO: 189876 - DNA, 20 bp, Homo sapiens
ctcaggctggcatctccccc

SEQ ID NO: 189877 - DNA, 21 bp, Homo sapiens
ctcaggctggcatctccccca

SEQ ID NO: 189878 - DNA, 17 bp, Homo sapiens
ctcaggcttggcggagg

SEQ ID NO: 189879 - DNA, 15 bp, Homo sapiens
ctcatccacacttaa

SEQ ID NO: 189880 - DNA, 15 bp, Homo sapiens
ctccaaccttctgcc

SEQ ID NO: 189881 - DNA, 17 bp, Homo sapiens
ctccaaccttctgccct

SEQ ID NO: 189882 - DNA, 21 bp, Homo sapiens
ctccaaccttctgccctcctg

SEQ ID NO: 189883 - DNA, 15 bp, Homo sapiens
ctccatcactgagag

SEQ ID NO: 189884 - DNA, 19 bp, Homo sapiens
ctccgagacccaggagaca

SEQ ID NO: 189885 - DNA, 22 bp, Homo sapiens
ctccgtttctaccaccgcatcc

SEQ ID NO: 189886 - DNA, 15 bp, Homo sapiens
ctcctcacccagggc

SEQ ID NO: 189887 - DNA, 16 bp, Homo sapiens
ctcctccgagacccag

SEQ ID NO: 189888 - DNA, 18 bp, Homo sapiens
ctcctccgagacccagga

SEQ ID NO: 189889 - DNA, 15 bp, Homo sapiens
ctcctcctgctgctc

SEQ ID NO: 189890 - DNA, 21 bp, Homo sapiens
ctcctgccaaaagatctgggg

SEQ ID NO: 189891 - DNA, 22 bp, Homo sapiens
ctcctgccaaaagatctgggga

SEQ ID NO: 189892 - DNA, 23 bp, Homo sapiens
ctcctgccaaaagatctggggag

SEQ ID NO: 189893 - DNA, 18 bp, Homo sapiens
ctcctgctgctcactccc

SEQ ID NO: 189894 - DNA, 19 bp, Homo sapiens
ctctcacacatttctgcca

SEQ ID NO: 189895 - DNA, 18 bp, Homo sapiens
tgccaaaagatctgggga

SEQ ID NO: 189896 - DNA, 19 bp, Homo sapiens
tgccaaaagatctggggag

SEQ ID NO: 189897 - DNA, 15 bp, Homo sapiens
tgccaccaagctcac

SEQ ID NO: 189898 - DNA, 21 bp, Homo sapiens
tgcccagcttcgtcagctcca

SEQ ID NO: 189899 - DNA, 18 bp, Homo sapiens
tgccctgtccctagctca

SEQ ID NO: 189900 - DNA, 19 bp, Homo sapiens
tgccctgtccctagctcac

SEQ ID NO: 189901 - DNA, 18 bp, Homo sapiens
tgctaggtgtctgggatc

SEQ ID NO: 189902 - DNA, 14 bp, Homo sapiens
tgctctgtccagct

SEQ ID NO: 189903 - DNA, 23 bp, Homo sapiens
tgctgaacaaggggcctccaacc

SEQ ID NO: 189904 - DNA, 23 bp, Homo sapiens
tgctgctcactcccgctgagccc

SEQ ID NO: 189905 - DNA, 13 bp, Homo sapiens
tggcatcaggagc

SEQ ID NO: 189906 - DNA, 14 bp, Homo sapiens
tggcatctccccca

SEQ ID NO: 189907 - DNA, 19 bp, Homo sapiens
tggcatctcccccaccctg

SEQ ID NO: 189908 - DNA, 13 bp, Homo sapiens
tggcccagctcct

SEQ ID NO: 189909 - DNA, 17 bp, Homo sapiens
tggccggccgcccacat

SEQ ID NO: 189910 - DNA, 17 bp, Homo sapiens
tggcgctaggggacttg

SEQ ID NO: 189911 - DNA, 21 bp, Homo sapiens
tggcgctaggggacttgggga

SEQ ID NO: 189912 - DNA, 13 bp, Homo sapiens
tggtggcccagct

SEQ ID NO: 189913 - DNA, 19 bp, Homo sapiens
tgtcactcagccccttccc

SEQ ID NO: 189914 - DNA, 14 bp, Homo sapiens
tgtccctagctcac

SEQ ID NO: 189915 - DNA, 21 bp, Homo sapiens
tgtccttctcaggctggcatc

SEQ ID NO: 189916 - DNA, 13 bp, Homo sapiens
tgtgaggagaggg

SEQ ID NO: 189917 - DNA, 17 bp, Homo sapiens
ttaaacaacacctcctc

SEQ ID NO: 189918 - DNA, 21 bp, Homo sapiens
ttaaacaacacctcctcctgc

SEQ ID NO: 189919 - DNA, 15 bp, Homo sapiens
ttaccaaaagctcag

SEQ ID NO: 189920 - DNA, 23 bp, Homo sapiens
ttctcaggctggcatctccccca

SEQ ID NO: 189921 - DNA, 12 bp, Homo sapiens
ttggcggaggga

SEQ ID NO: 189922 - DNA, 16 bp, Homo sapiens
tttctggtcaacccca

SEQ ID NO: 189923 - DNA, 17 bp, Homo sapiens
ggcggagggagcggcat

SEQ ID NO: 189924 - DNA, 11 bp, Homo sapiens
ggctggcatct

SEQ ID NO: 189925 - DNA, 17 bp, Homo sapiens
ggctggcatctccccca

SEQ ID NO: 189926 - DNA, 21 bp, Homo sapiens
ggcttaaacaacacctcctcc

SEQ ID NO: 189927 - DNA, 18 bp, Homo sapiens
gggaatcattctggctta

SEQ ID NO: 189928 - DNA, 22 bp, Homo sapiens
gggacttggggatttctggtca

SEQ ID NO: 189929 - DNA, 14 bp, Homo sapiens
gggatttctggtca

SEQ ID NO: 189930 - DNA, 18 bp, Homo sapiens
gggcaattgacttcctcc

SEQ ID NO: 189931 - DNA, 22 bp, Homo sapiens
gggcactctgttcccctccccc

SEQ ID NO: 189932 - DNA, 19 bp, Homo sapiens
gggcctccaaccttctgcc

SEQ ID NO: 189933 - DNA, 13 bp, Homo sapiens
ggtaccaggcccg

SEQ ID NO: 189934 - DNA, 18 bp, Homo sapiens
ggtgctcagcccaggcac

SEQ ID NO: 189935 - DNA, 11 bp, Homo sapiens
gtcactcagcc

SEQ ID NO: 189936 - DNA, 19 bp, Homo sapiens
gtcactcagccccttcccg

SEQ ID NO: 189937 - DNA, 22 bp, Homo sapiens
gtcccctatgccactaagccaa

SEQ ID NO: 189938 - DNA, 17 bp, Homo sapiens
gtccgcccgcttccctc

SEQ ID NO: 189939 - DNA, 20 bp, Homo sapiens
gtccgcccgcttccctcctt

SEQ ID NO: 189940 - DNA, 22 bp, Homo sapiens
gtctgggatcggggtggggaca

SEQ ID NO: 189941 - DNA, 17 bp, Homo sapiens
gtctgggcaagaggaaa

SEQ ID NO: 189942 - DNA, 18 bp, Homo sapiens
gtgccaccaagctcacac

SEQ ID NO: 189943 - DNA, 15 bp, Homo sapiens
gtgccaggccaaaga

SEQ ID NO: 189944 - DNA, 20 bp, Homo sapiens
gtggcatcaggagctgctca

SEQ ID NO: 189945 - DNA, 22 bp, Homo sapiens
gtggcatcaggagctgctcagg

SEQ ID NO: 189946 - DNA, 21 bp, Homo sapiens
gttgtctgtggacccccccag

SEQ ID NO: 189947 - DNA, 14 bp, Homo sapiens
taaacaacacctcc

SEQ ID NO: 189948 - DNA, 17 bp, Homo sapiens
taattggcagcacccac

SEQ ID NO: 189949 - DNA, 21 bp, Homo sapiens
tacagccagaggaaccagcac

SEQ ID NO: 189950 - DNA, 16 bp, Homo sapiens
taccaccgcatcctca

SEQ ID NO: 189951 - DNA, 13 bp, Homo sapiens
tactacctgtccc

SEQ ID NO: 189952 - DNA, 11 bp, Homo sapiens
tagctcacact

SEQ ID NO: 189953 - DNA, 19 bp, Homo sapiens
tagctgggggcgcagagga

SEQ ID NO: 189954 - DNA, 15 bp, Homo sapiens
taggggacttgggga

SEQ ID NO: 189955 - DNA, 16 bp, Homo sapiens
taggggacttggggat

SEQ ID NO: 189956 - DNA, 18 bp, Homo sapiens
tatcttacagccagagga

SEQ ID NO: 189957 - DNA, 20 bp, Homo sapiens
tattcccccatcttcatccc

SEQ ID NO: 189958 - DNA, 17 bp, Homo sapiens
tcacacctgtccttctc

SEQ ID NO: 189959 - DNA, 18 bp, Homo sapiens
tcacacctgtccttctca

SEQ ID NO: 189960 - DNA, 12 bp, Homo sapiens
tcacactcatcc

SEQ ID NO: 189961 - DNA, 13 bp, Homo sapiens
tcacactcatcca

SEQ ID NO: 189962 - DNA, 15 bp, Homo sapiens
tcacactcatccaca

SEQ ID NO: 189963 - DNA, 15 bp, Homo sapiens
tcactcagccccttc

SEQ ID NO: 189964 - DNA, 22 bp, Homo sapiens
tcactcccgctgagcccactct

SEQ ID NO: 189965 - DNA, 14 bp, Homo sapiens
tcaggctggcatct

SEQ ID NO: 189966 - DNA, 21 bp, Homo sapiens
tcaggctggcatctcccccac

SEQ ID NO: 189967 - DNA, 14 bp, Homo sapiens
tcatcccaacagcc

SEQ ID NO: 189968 - DNA, 18 bp, Homo sapiens
tcatcccaacagcccagc

SEQ ID NO: 189969 - DNA, 23 bp, Homo sapiens
cgatgtcactcagccccttcccg

SEQ ID NO: 189970 - DNA, 17 bp, Homo sapiens
cgcagaggacatcacct

SEQ ID NO: 189971 - DNA, 13 bp, Homo sapiens
cgcatcctcactg

SEQ ID NO: 189972 - DNA, 19 bp, Homo sapiens
cgcatcctcactgggctca

SEQ ID NO: 189973 - DNA, 18 bp, Homo sapiens
cgcccacatcgggctcac

SEQ ID NO: 189974 - DNA, 19 bp, Homo sapiens
cgcccacatcgggctcacc

SEQ ID NO: 189975 - DNA, 20 bp, Homo sapiens
cgcccacatcgggctcacct

SEQ ID NO: 189976 - DNA, 12 bp, Homo sapiens
cggcatgggcga

SEQ ID NO: 189977 - DNA, 22 bp, Homo sapiens
cgggctcaccttaaaggtcaag

SEQ ID NO: 189978 - DNA, 18 bp, Homo sapiens
cggtccgcccgcttccct

SEQ ID NO: 189979 - DNA, 24 bp, Homo sapiens
ctaccaccgcatcctcactgggct

SEQ ID NO: 189980 - DNA, 16 bp, Homo sapiens
ctactgccccagctcc

SEQ ID NO: 189981 - DNA, 17 bp, Homo sapiens
ctagctcacactcatcc

SEQ ID NO: 189982 - DNA, 15 bp, Homo sapiens
ctatgccactaagcc

SEQ ID NO: 189983 - DNA, 18 bp, Homo sapiens
ctcacacctgtccttctc

SEQ ID NO: 189984 - DNA, 19 bp, Homo sapiens
ctcacacctgtccttctca

SEQ ID NO: 189985 - DNA, 14 bp, Homo sapiens
ctcacactcatcca

SEQ ID NO: 189986 - DNA, 21 bp, Homo sapiens
ctcactgcaggcatgctgaac

SEQ ID NO: 189987 - DNA, 17 bp, Homo sapiens
ctcactgggctcactgc

SEQ ID NO: 189988 - DNA, 13 bp, Homo sapiens
ctcagcccaggca

SEQ ID NO: 189989 - DNA, 14 bp, Homo sapiens
ctcagccccttccc

SEQ ID NO: 189990 - DNA, 15 bp, Homo sapiens
ctcagggccctgtgc

SEQ ID NO: 189991 - DNA, 16 bp, Homo sapiens
ctcagggccctgtgcc

SEQ ID NO: 189992 - DNA, 19 bp, Homo sapiens
ctccaaccttctgccctcc

SEQ ID NO: 189993 - DNA, 22 bp, Homo sapiens
ctccaaccttctgccctcctgc

SEQ ID NO: 189994 - DNA, 15 bp, Homo sapiens
ctccaatccccactc

SEQ ID NO: 189995 - DNA, 14 bp, Homo sapiens
ctcccccaccctgt

SEQ ID NO: 189996 - DNA, 15 bp, Homo sapiens
ctcccccaccctgtg

SEQ ID NO: 189997 - DNA, 18 bp, Homo sapiens
ctcccccttaagccaaca

SEQ ID NO: 189998 - DNA, 17 bp, Homo sapiens
ctcccgctgagcccact

SEQ ID NO: 189999 - DNA, 19 bp, Homo sapiens
ctcctcctgctgctcactc

SEQ ID NO: 190000 - DNA, 14 bp, Homo sapiens
ctcctgccaaaaga

SEQ ID NO: 190001 - DNA, 10 bp, Homo sapiens
ctcctgctgc

SEQ ID NO: 190002 - DNA, 13 bp, Homo sapiens
ctcctgctgctca

SEQ ID NO: 190003 - DNA, 14 bp, Homo sapiens
ctcctgctgctcac

SEQ ID NO: 190004 - DNA, 17 bp, Homo sapiens
ctctgcagtcctggccc

SEQ ID NO: 190005 - DNA, 19 bp, Homo sapiens
ctctgcagtcctggccccc

SEQ ID NO: 190006 - DNA, 18 bp, Homo sapiens
ctctgggcacaagcaggg

SEQ ID NO: 190007 - DNA, 19 bp, Homo sapiens
ctctgggcacaagcagggc

SEQ ID NO: 190008 - DNA, 19 bp, Homo sapiens
ctgccaaaagatctgggga

SEQ ID NO: 190009 - DNA, 13 bp, Homo sapiens
ctgccccagctcc

SEQ ID NO: 190010 - DNA, 13 bp, Homo sapiens
ctgccctcctgcc

SEQ ID NO: 190011 - DNA, 14 bp, Homo sapiens
ctgccctcctgcca

SEQ ID NO: 190012 - DNA, 13 bp, Homo sapiens
ctgcctctcacac

SEQ ID NO: 190013 - DNA, 23 bp, Homo sapiens
ctgctcactcccgctgagcccac

SEQ ID NO: 190014 - DNA, 15 bp, Homo sapiens
ctgctgctcactccc

SEQ ID NO: 190015 - DNA, 14 bp, Homo sapiens
ctggaagtcctggc

SEQ ID NO: 190016 - DNA, 14 bp, Homo sapiens
ctggcatctccccc

SEQ ID NO: 190017 - DNA, 17 bp, Homo sapiens
ctggcatctcccccacc

SEQ ID NO: 190018 - DNA, 17 bp, Homo sapiens
ctggcttaaacaacacc

SEQ ID NO: 190019 - DNA, 21 bp, Homo sapiens
ctgggatcggggtggggacag

SEQ ID NO: 190020 - DNA, 20 bp, Homo sapiens
ctgggcacaagcagggcact

SEQ ID NO: 190021 - DNA, 20 bp, Homo sapiens
ctggggagtgtgaggagagg

SEQ ID NO: 190022 - DNA, 14 bp, Homo sapiens
ctggtcaaccccac

SEQ ID NO: 190023 - DNA, 15 bp, Homo sapiens
ctgtccctagctcac

SEQ ID NO: 190024 - DNA, 22 bp, Homo sapiens
ctgtccctagctcacactcatc

SEQ ID NO: 190025 - DNA, 16 bp, Homo sapiens
ctgtccttctcaggct

SEQ ID NO: 190026 - DNA, 22 bp, Homo sapiens
ctgtccttctcaggctggcatc

SEQ ID NO: 190027 - DNA, 22 bp, Homo sapiens
ctgtgccccttttcatggtacc

SEQ ID NO: 190028 - DNA, 15 bp, Homo sapiens
ctgttcccctccccc

SEQ ID NO: 190029 - DNA, 21 bp, Homo sapiens
cttaaacaacacctcctcctg

SEQ ID NO: 190030 - DNA, 15 bp, Homo sapiens
cttaccaaaagctca

SEQ ID NO: 190031 - DNA, 19 bp, Homo sapiens
cttaccaaaagctcagggc

SEQ ID NO: 190032 - DNA, 15 bp, Homo sapiens
cttagtacatgctct

SEQ ID NO: 190033 - DNA, 16 bp, Homo sapiens
cttagtacatgctctg

SEQ ID NO: 190034 - DNA, 12 bp, Homo sapiens
cttcagcagggg

SEQ ID NO: 190035 - DNA, 22 bp, Homo sapiens
cttcatcccaacagcccagcaa

SEQ ID NO: 190036 - DNA, 23 bp, Homo sapiens
cttcccggtccgcccgcttccct

SEQ ID NO: 190037 - DNA, 13 bp, Homo sapiens
cttccctccttca

SEQ ID NO: 190038 - DNA, 13 bp, Homo sapiens
cttccttggggaa

SEQ ID NO: 190039 - DNA, 21 bp, Homo sapiens
cttccttggggaaacttggga

SEQ ID NO: 190040 - DNA, 13 bp, Homo sapiens
cttcgtcagctcc

SEQ ID NO: 190041 - DNA, 21 bp, Homo sapiens
cttctgccctcctgccaaaag

SEQ ID NO: 190042 - DNA, 13 bp, Homo sapiens
cttggcggaggga

SEQ ID NO: 190043 - DNA, 19 bp, Homo sapiens
ctttcccagaagcgccctg

SEQ ID NO: 190044 - DNA, 15 bp, Homo sapiens
gaaaatgccctgtcc

SEQ ID NO: 190045 - DNA, 20 bp, Homo sapiens
gaaacttgggaatcattctg

SEQ ID NO: 190046 - DNA, 23 bp, Homo sapiens
gaaccagcactccatcactgaga

SEQ ID NO: 190047 - DNA, 21 bp, Homo sapiens
gaaggaaaatactacctgtcc

SEQ ID NO: 190048 - DNA, 19 bp, Homo sapiens
gacaaacagcccttccttg

SEQ ID NO: 190049 - DNA, 22 bp, Homo sapiens
gacccaggagacaaacagccct

SEQ ID NO: 190050 - DNA, 23 bp, Homo sapiens
gacttcctccaatccccactcct

SEQ ID NO: 190051 - DNA, 20 bp, Homo sapiens
gagacaaacagcccttcctt

SEQ ID NO: 190052 - DNA, 14 bp, Homo sapiens
gagacccaggagac

SEQ ID NO: 190053 - DNA, 15 bp, Homo sapiens
gagagggtggcatca

SEQ ID NO: 190054 - DNA, 20 bp, Homo sapiens
gagcccactctactgcccca

SEQ ID NO: 190055 - DNA, 20 bp, Homo sapiens
gatgtcactcagccccttcc

SEQ ID NO: 190056 - DNA, 22 bp, Homo sapiens
gcaactgagagctgagcgcttt

SEQ ID NO: 190057 - DNA, 13 bp, Homo sapiens
gcacaagcagggc

SEQ ID NO: 190058 - DNA, 14 bp, Homo sapiens
gcagcacccactca

SEQ ID NO: 190059 - DNA, 15 bp, Homo sapiens
gcagcacccactcag

SEQ ID NO: 190060 - DNA, 15 bp, Homo sapiens
gcatcctcactgggc

SEQ ID NO: 190061 - DNA, 17 bp, Homo sapiens
gcatcctcactgggctc

SEQ ID NO: 190062 - DNA, 22 bp, Homo sapiens
gcatcctcactgggctcactgc

SEQ ID NO: 190063 - DNA, 18 bp, Homo sapiens
gccaaaagatctggggag

SEQ ID NO: 190064 - DNA, 22 bp, Homo sapiens
gccaacaaccacagtgccacca

SEQ ID NO: 190065 - DNA, 22 bp, Homo sapiens
gccaacgtgtgtgtcagctggt

SEQ ID NO: 190066 - DNA, 16 bp, Homo sapiens
gccaccaagctcacac

SEQ ID NO: 190067 - DNA, 20 bp, Homo sapiens
gccacgtggtggcccagctc

SEQ ID NO: 190068 - DNA, 16 bp, Homo sapiens
gccaggccaaagatcc

SEQ ID NO: 190069 - DNA, 22 bp, Homo sapiens
gcccactctactgccccagctc

SEQ ID NO: 190070 - DNA, 13 bp, Homo sapiens
gcccagctcctca

SEQ ID NO: 190071 - DNA, 17 bp, Homo sapiens
gcccagctcctcaccca

SEQ ID NO: 190072 - DNA, 23 bp, Homo sapiens
gcccagcttcgtcagctccagcg

SEQ ID NO: 190073 - DNA, 22 bp, Homo sapiens
gcccaggcacaacttcagcagg

SEQ ID NO: 190074 - DNA, 13 bp, Homo sapiens
gcccgcactgggg

SEQ ID NO: 190075 - DNA, 15 bp, Homo sapiens
gcccgcttccctcct

SEQ ID NO: 190076 - DNA, 17 bp, Homo sapiens
gcccgcttccctccttc

SEQ ID NO: 190077 - DNA, 16 bp, Homo sapiens
ttggggaaacttggga

SEQ ID NO: 190078 - DNA, 21 bp, Homo sapiens
tttccattaaagtctgttgtt

SEQ ID NO: 190079 - DNA, 19 bp, Homo sapiens
tttctggggcaactgagag

SEQ ID NO: 190080 - DNA, 11 bp, Homo sapiens
tttctggtcaa

SEQ ID NO: 190081 - DNA, 17 bp, Homo sapiens
tttgcttaccaaaagct

SEQ ID NO: 190082 - DNA, 19 bp, Homo sapiens
tttgcttaccaaaagctca

SEQ ID NO: 190083 - DNA, 13 bp, Homo sapiens
caatccccactcc

SEQ ID NO: 190084 - DNA, 16 bp, Homo sapiens
caatccccactcctcc

SEQ ID NO: 190085 - DNA, 14 bp, Homo sapiens
caattgacttcctc

SEQ ID NO: 190086 - DNA, 15 bp, Homo sapiens
cacaagcaccactct

SEQ ID NO: 190087 - DNA, 13 bp, Homo sapiens
cacaagcagggca

SEQ ID NO: 190088 - DNA, 14 bp, Homo sapiens
cacaagcagggcac

SEQ ID NO: 190089 - DNA, 23 bp, Homo sapiens
cacacttaagccctcgtgcacac

SEQ ID NO: 190090 - DNA, 14 bp, Homo sapiens
cacatcgggctcac

SEQ ID NO: 190091 - DNA, 22 bp, Homo sapiens
cacatgctctgcagtcctggcc

SEQ ID NO: 190092 - DNA, 13 bp, Homo sapiens
cacatttctgcca

SEQ ID NO: 190093 - DNA, 18 bp, Homo sapiens
caccaagctcacacctgt

SEQ ID NO: 190094 - DNA, 15 bp, Homo sapiens
caccctgtgcccctt

SEQ ID NO: 190095 - DNA, 23 bp, Homo sapiens
caccgcatcctcactgggctcac

SEQ ID NO: 190096 - DNA, 12 bp, Homo sapiens
cacctcctcctg

SEQ ID NO: 190097 - DNA, 20 bp, Homo sapiens
cacctcctcctgctgctcac

SEQ ID NO: 190098 - DNA, 22 bp, Homo sapiens
cacctcctcctgctgctcactc

SEQ ID NO: 190099 - DNA, 14 bp, Homo sapiens
cacctgtccttctc

SEQ ID NO: 190100 - DNA, 19 bp, Homo sapiens
cacctgtccttctcaggct

SEQ ID NO: 190101 - DNA, 23 bp, Homo sapiens
cacctgtccttctcaggctggca

SEQ ID NO: 190102 - DNA, 23 bp, Homo sapiens
caccttaaaggtcaaggaaggaa

SEQ ID NO: 190103 - DNA, 18 bp, Homo sapiens
cacgtggtggcccagctc

SEQ ID NO: 190104 - DNA, 17 bp, Homo sapiens
cactcagccccttcccg

SEQ ID NO: 190105 - DNA, 13 bp, Homo sapiens
cactccatcactg

SEQ ID NO: 190106 - DNA, 16 bp, Homo sapiens
cactccatcactgaga

SEQ ID NO: 190107 - DNA, 14 bp, Homo sapiens
cactcccgctgagc

SEQ ID NO: 190108 - DNA, 16 bp, Homo sapiens
cactctactgccccag

SEQ ID NO: 190109 - DNA, 17 bp, Homo sapiens
cactctactgccccagc

SEQ ID NO: 190110 - DNA, 12 bp, Homo sapiens
cactctgggcac

SEQ ID NO: 190111 - DNA, 17 bp, Homo sapiens
cactctgttcccctccc

SEQ ID NO: 190112 - DNA, 18 bp, Homo sapiens
cactgggctcactgcagg

SEQ ID NO: 190113 - DNA, 20 bp, Homo sapiens
cactgggctcactgcaggca

SEQ ID NO: 190114 - DNA, 17 bp, Homo sapiens
cagagagctcctccctg

SEQ ID NO: 190115 - DNA, 19 bp, Homo sapiens
cagaggaaccagcactcca

SEQ ID NO: 190116 - DNA, 16 bp, Homo sapiens
cagaggacatcacctg

SEQ ID NO: 190117 - DNA, 20 bp, Homo sapiens
cagatgtacacccacccaca

SEQ ID NO: 190118 - DNA, 15 bp, Homo sapiens
cagcacccactcagc

SEQ ID NO: 190119 - DNA, 17 bp, Homo sapiens
cagcacccactcagcca

SEQ ID NO: 190120 - DNA, 11 bp, Homo sapiens
cagcactccat

SEQ ID NO: 190121 - DNA, 17 bp, Homo sapiens
cagccattctctaccca

SEQ ID NO: 190122 - DNA, 21 bp, Homo sapiens
cagccattctctacccatcct

SEQ ID NO: 190123 - DNA, 17 bp, Homo sapiens
cagcccagcaagaagga

SEQ ID NO: 190124 - DNA, 12 bp, Homo sapiens
cagcccttcctt

SEQ ID NO: 190125 - DNA, 14 bp, Homo sapiens
cagcccttccttgg

SEQ ID NO: 190126 - DNA, 15 bp, Homo sapiens
cagcccttccttggg

SEQ ID NO: 190127 - DNA, 19 bp, Homo sapiens
cagctccgtttctaccacc

SEQ ID NO: 190128 - DNA, 15 bp, Homo sapiens
cagctcctcacccag

SEQ ID NO: 190129 - DNA, 19 bp, Homo sapiens
cagcttcgtcagctccagc

SEQ ID NO: 190130 - DNA, 13 bp, Homo sapiens
caggcacaacttc

SEQ ID NO: 190131 - DNA, 19 bp, Homo sapiens
caggcacaacttcagcagg

SEQ ID NO: 190132 - DNA, 13 bp, Homo sapiens
caggcccgcactg

SEQ ID NO: 190133 - DNA, 16 bp, Homo sapiens
caggctggcatctccc

SEQ ID NO: 190134 - DNA, 18 bp, Homo sapiens
caggctggcatctccccc

SEQ ID NO: 190135 - DNA, 20 bp, Homo sapiens
caggctggcatctcccccac

SEQ ID NO: 190136 - DNA, 23 bp, Homo sapiens
caggctggcatctcccccaccct

SEQ ID NO: 190137 - DNA, 16 bp, Homo sapiens
caggcttggcggaggg

SEQ ID NO: 190138 - DNA, 19 bp, Homo sapiens
caggtagaccaggtgctca

SEQ ID NO: 190139 - DNA, 20 bp, Homo sapiens
caggtgctcagcccaggcac

SEQ ID NO: 190140 - DNA, 14 bp, Homo sapiens
cagtcctggccccc

SEQ ID NO: 190141 - DNA, 14 bp, Homo sapiens
catatcttacagcc

SEQ ID NO: 190142 - DNA, 19 bp, Homo sapiens
catatcttacagccagagg

SEQ ID NO: 190143 - DNA, 17 bp, Homo sapiens
catcaggagctgctcag

SEQ ID NO: 190144 - DNA, 16 bp, Homo sapiens
catccacatgctctgc

SEQ ID NO: 190145 - DNA, 18 bp, Homo sapiens
catccttagtacatgctc

SEQ ID NO: 190146 - DNA, 17 bp, Homo sapiens
catctcccccaccctgt

SEQ ID NO: 190147 - DNA, 23 bp, Homo sapiens
catggtaccaggcccgcactggg

SEQ ID NO: 190148 - DNA, 17 bp, Homo sapiens
cattctgacatccacat

SEQ ID NO: 190149 - DNA, 11 bp, Homo sapiens
cattctggctt

SEQ ID NO: 190150 - DNA, 17 bp, Homo sapiens
ccaaaagctcagggccc

SEQ ID NO: 190151 - DNA, 14 bp, Homo sapiens
ccaaccttctgccc

SEQ ID NO: 190152 - DNA, 17 bp, Homo sapiens
ccaaccttctgccctcc

SEQ ID NO: 190153 - DNA, 18 bp, Homo sapiens
ccaaccttctgccctcct

SEQ ID NO: 190154 - DNA, 19 bp, Homo sapiens
ccaaccttctgccctcctg

SEQ ID NO: 190155 - DNA, 20 bp, Homo sapiens
ccaaccttctgccctcctgc

SEQ ID NO: 190156 - DNA, 22 bp, Homo sapiens
ccaaccttctgccctcctgcca

SEQ ID NO: 190157 - DNA, 18 bp, Homo sapiens
ccaatccccactcctccg

SEQ ID NO: 190158 - DNA, 18 bp, Homo sapiens
ccacaagcaccactctgg

SEQ ID NO: 190159 - DNA, 19 bp, Homo sapiens
ccacagtgccaccaagctc

SEQ ID NO: 190160 - DNA, 15 bp, Homo sapiens
ccacatatcttacag

SEQ ID NO: 190161 - DNA, 19 bp, Homo sapiens
ccacatatcttacagccag

SEQ ID NO: 190162 - DNA, 18 bp, Homo sapiens
ccacatgctctgcagtcc

SEQ ID NO: 190163 - DNA, 20 bp, Homo sapiens
ccacgtggtggcccagctcc

SEQ ID NO: 190164 - DNA, 24 bp, Homo sapiens
ccactcctccgagacccaggagac

SEQ ID NO: 190165 - DNA, 13 bp, Homo sapiens
ccactctgggcac

SEQ ID NO: 190166 - DNA, 13 bp, Homo sapiens
ccagcactccatc

SEQ ID NO: 190167 - DNA, 16 bp, Homo sapiens
ccagctcctcacccag

SEQ ID NO: 190168 - DNA, 22 bp, Homo sapiens
ccaggcacaacttcagcagggg

SEQ ID NO: 190169 - DNA, 15 bp, Homo sapiens
ccaggcccgcactgg

SEQ ID NO: 190170 - DNA, 20 bp, Homo sapiens
ccagggcccccaaagagcaa

SEQ ID NO: 190171 - DNA, 15 bp, Homo sapiens
ccaggtgctcagccc

SEQ ID NO: 190172 - DNA, 21 bp, Homo sapiens
ccaggtgctcagcccaggcac

SEQ ID NO: 190173 - DNA, 12 bp, Homo sapiens
cccaacagccca

SEQ ID NO: 190174 - DNA, 13 bp, Homo sapiens
cccaacagcccag

SEQ ID NO: 190175 - DNA, 16 bp, Homo sapiens
cccacatatcttacag

SEQ ID NO: 190176 - DNA, 20 bp, Homo sapiens
cccaccctgtgccccttttc

SEQ ID NO: 190177 - DNA, 22 bp, Homo sapiens
cccagacccccattctgacatc

SEQ ID NO: 190178 - DNA, 20 bp, Homo sapiens
cccagctccgtttctaccac

SEQ ID NO: 190179 - DNA, 22 bp, Homo sapiens
cccaggagacaaacagcccttc

SEQ ID NO: 190180 - DNA, 23 bp, Homo sapiens
cccaggagacaaacagcccttcc

SEQ ID NO: 190181 - DNA, 16 bp, Homo sapiens
ccccagctccgtttct

SEQ ID NO: 190182 - DNA, 18 bp, Homo sapiens
cccctcccccttaagcca

SEQ ID NO: 190183 - DNA, 13 bp, Homo sapiens
cccgctgagccca

SEQ ID NO: 190184 - DNA, 16 bp, Homo sapiens
cccgctgagcccactc

SEQ ID NO: 190185 - DNA, 14 bp, Homo sapiens
ccctagctcacact

SEQ ID NO: 190186 - DNA, 20 bp, Homo sapiens
ccctagctcacactcatcca

SEQ ID NO: 190187 - DNA, 16 bp, Homo sapiens
ccctgtccctagctca

SEQ ID NO: 190188 - DNA, 18 bp, Homo sapiens
ccctgtccctagctcaca

SEQ ID NO: 190189 - DNA, 20 bp, Homo sapiens
cccttcccggtccgcccgct

SEQ ID NO: 190190 - DNA, 14 bp, Homo sapiens
ccgcatcctcactg

SEQ ID NO: 190191 - DNA, 21 bp, Homo sapiens
ccgcccacatcgggctcacct

SEQ ID NO: 190192 - DNA, 14 bp, Homo sapiens
ccgctgagcccact

SEQ ID NO: 190193 - DNA, 21 bp, Homo sapiens
caagaggaaaatgccctgtcc

SEQ ID NO: 190194 - DNA, 14 bp, Homo sapiens
caagcaccactctg

SEQ ID NO: 190195 - DNA, 15 bp, Homo sapiens
caagcagggcactct

SEQ ID NO: 190196 - DNA, 22 bp, Homo sapiens
caagcgtctgggcaagaggaaa

SEQ ID NO: 190197 - DNA, 21 bp, Homo sapiens
caagctcacacctgtccttct

SEQ ID NO: 190198 - DNA, 19 bp, Homo sapiens
caaggggcctccaaccttc

SEQ ID NO: 190199 - DNA, 14 bp, Homo sapiens
caatccccactcct

SEQ ID NO: 190200 - DNA, 15 bp, Homo sapiens
caattgacttcctcc

SEQ ID NO: 190201 - DNA, 17 bp, Homo sapiens
caattgacttcctccaa

SEQ ID NO: 190202 - DNA, 13 bp, Homo sapiens
cacaacttcagca

SEQ ID NO: 190203 - DNA, 21 bp, Homo sapiens
cacaagcaccactctgggcac

SEQ ID NO: 190204 - DNA, 22 bp, Homo sapiens
cacaagcaccactctgggcaca

SEQ ID NO: 190205 - DNA, 12 bp, Homo sapiens
cacaagcagggc

SEQ ID NO: 190206 - DNA, 15 bp, Homo sapiens
cacacatttctgcca

SEQ ID NO: 190207 - DNA, 18 bp, Homo sapiens
cacagtgccaccaagctc

SEQ ID NO: 190208 - DNA, 19 bp, Homo sapiens
cacagtgccaccaagctca

SEQ ID NO: 190209 - DNA, 23 bp, Homo sapiens
cacagtgccaccaagctcacacc

SEQ ID NO: 190210 - DNA, 16 bp, Homo sapiens
cacatcgggctcacct

SEQ ID NO: 190211 - DNA, 17 bp, Homo sapiens
cacccacccacatatct

SEQ ID NO: 190212 - DNA, 12 bp, Homo sapiens
cacccactcagc

SEQ ID NO: 190213 - DNA, 13 bp, Homo sapiens
cacccactcagcc

SEQ ID NO: 190214 - DNA, 14 bp, Homo sapiens
cacccactcagcca

SEQ ID NO: 190215 - DNA, 19 bp, Homo sapiens
cacccactcagccattctc

SEQ ID NO: 190216 - DNA, 22 bp, Homo sapiens
caccgcatcctcactgggctca

SEQ ID NO: 190217 - DNA, 14 bp, Homo sapiens
cacctcctcctgct

SEQ ID NO: 190218 - DNA, 13 bp, Homo sapiens
tcatggtaccagg

SEQ ID NO: 190219 - DNA, 12 bp, Homo sapiens
tcattctggctt

SEQ ID NO: 190220 - DNA, 19 bp, Homo sapiens
tcattctggcttaaacaac

SEQ ID NO: 190221 - DNA, 20 bp, Homo sapiens
tccaaccttctgccctcctg

SEQ ID NO: 190222 - DNA, 16 bp, Homo sapiens
tccaatccccactcct

SEQ ID NO: 190223 - DNA, 19 bp, Homo sapiens
tccaatccccactcctccg

SEQ ID NO: 190224 - DNA, 16 bp, Homo sapiens
tcccaacagcccagca

SEQ ID NO: 190225 - DNA, 13 bp, Homo sapiens
tccccactcctcc

SEQ ID NO: 190226 - DNA, 21 bp, Homo sapiens
tccccactcctccgagaccca

SEQ ID NO: 190227 - DNA, 15 bp, Homo sapiens
tcccccaccctgtgc

SEQ ID NO: 190228 - DNA, 16 bp, Homo sapiens
tcccccaccctgtgcc

SEQ ID NO: 190229 - DNA, 18 bp, Homo sapiens
tcccccatcttcatccca

SEQ ID NO: 190230 - DNA, 18 bp, Homo sapiens
tcccccttaagccaacaa

SEQ ID NO: 190231 - DNA, 17 bp, Homo sapiens
tcccctatgccactaag

SEQ ID NO: 190232 - DNA, 17 bp, Homo sapiens
tccctagctcacactca

SEQ ID NO: 190233 - DNA, 19 bp, Homo sapiens
tccctagctcacactcatc

SEQ ID NO: 190234 - DNA, 22 bp, Homo sapiens
tccctagctcacactcatccac

SEQ ID NO: 190235 - DNA, 13 bp, Homo sapiens
tccctccttcatg

SEQ ID NO: 190236 - DNA, 14 bp, Homo sapiens
tccgagacccagga

SEQ ID NO: 190237 - DNA, 22 bp, Homo sapiens
tccgagacccaggagacaaaca

SEQ ID NO: 190238 - DNA, 24 bp, Homo sapiens
tccgtttctaccaccgcatcctca

SEQ ID NO: 190239 - DNA, 15 bp, Homo sapiens
tcctcactgggctca

SEQ ID NO: 190240 - DNA, 16 bp, Homo sapiens
tcctcactgggctcac

SEQ ID NO: 190241 - DNA, 21 bp, Homo sapiens
tcctccaatccccactcctcc

SEQ ID NO: 190242 - DNA, 14 bp, Homo sapiens
tcctccgagaccca

SEQ ID NO: 190243 - DNA, 16 bp, Homo sapiens
tcctcctgctgctcac

SEQ ID NO: 190244 - DNA, 20 bp, Homo sapiens
tcctgccaaaagatctgggg

SEQ ID NO: 190245 - DNA, 13 bp, Homo sapiens
tcctgctgctcac

SEQ ID NO: 190246 - DNA, 16 bp, Homo sapiens
tcctgctgctcactcc

SEQ ID NO: 190247 - DNA, 12 bp, Homo sapiens
tcctggccccct

SEQ ID NO: 190248 - DNA, 20 bp, Homo sapiens
tctcaggctggcatctcccc

SEQ ID NO: 190249 - DNA, 17 bp, Homo sapiens
tctcccccaccctgtgc

SEQ ID NO: 190250 - DNA, 18 bp, Homo sapiens
tctgacatccacatgctc

SEQ ID NO: 190251 - DNA, 21 bp, Homo sapiens
tctggcttaaacaacacctcc

SEQ ID NO: 190252 - DNA, 20 bp, Homo sapiens
tctgggatcggggtggggac

SEQ ID NO: 190253 - DNA, 17 bp, Homo sapiens
tctgggcaagaggaaaa

SEQ ID NO: 190254 - DNA, 18 bp, Homo sapiens
tctgggcacaagcagggc

SEQ ID NO: 190255 - DNA, 15 bp, Homo sapiens
tgacatacagaaggg

SEQ ID NO: 190256 - DNA, 17 bp, Homo sapiens
tgacttcctccaatccc

SEQ ID NO: 190257 - DNA, 19 bp, Homo sapiens
tgcaggcatgctgaacaag

SEQ ID NO: 190258 - DNA, 16 bp, Homo sapiens
ctctgcagtcctggcc

SEQ ID NO: 190259 - DNA, 21 bp, Homo sapiens
ctctgcagtcctggccccctc

SEQ ID NO: 190260 - DNA, 17 bp, Homo sapiens
ctgaacaaggggcctcc

SEQ ID NO: 190261 - DNA, 18 bp, Homo sapiens
ctgacatccacatgctct

SEQ ID NO: 190262 - DNA, 13 bp, Homo sapiens
ctgagcccactct

SEQ ID NO: 190263 - DNA, 19 bp, Homo sapiens
ctgagcccactctactgcc

SEQ ID NO: 190264 - DNA, 23 bp, Homo sapiens
ctgagcccactctactgccccag

SEQ ID NO: 190265 - DNA, 18 bp, Homo sapiens
ctgagcgctttgcttacc

SEQ ID NO: 190266 - DNA, 11 bp, Homo sapiens
ctgctgctcac

SEQ ID NO: 190267 - DNA, 20 bp, Homo sapiens
ctggcttaaacaacacctcc

SEQ ID NO: 190268 - DNA, 15 bp, Homo sapiens
ctgggcaagaggaaa

SEQ ID NO: 190269 - DNA, 17 bp, Homo sapiens
ctgggcacaagcagggc

SEQ ID NO: 190270 - DNA, 18 bp, Homo sapiens
ctgggcacaagcagggca

SEQ ID NO: 190271 - DNA, 16 bp, Homo sapiens
ctgggctcactgcagg

SEQ ID NO: 190272 - DNA, 17 bp, Homo sapiens
ctggggcaactgagagc

SEQ ID NO: 190273 - DNA, 22 bp, Homo sapiens
cttaaacaacacctcctcctgc

SEQ ID NO: 190274 - DNA, 23 bp, Homo sapiens
cttcatcccaacagcccagcaag

SEQ ID NO: 190275 - DNA, 16 bp, Homo sapiens
cttccctccttcatga

SEQ ID NO: 190276 - DNA, 17 bp, Homo sapiens
cttcctccaatccccac

SEQ ID NO: 190277 - DNA, 22 bp, Homo sapiens
cttcctccaatccccactcctc

SEQ ID NO: 190278 - DNA, 13 bp, Homo sapiens
cttctgccctcct

SEQ ID NO: 190279 - DNA, 15 bp, Homo sapiens
cttctgccctcctgc

SEQ ID NO: 190280 - DNA, 17 bp, Homo sapiens
cttggggaaacttggga

SEQ ID NO: 190281 - DNA, 18 bp, Homo sapiens
gaccaggtgctcagccca

SEQ ID NO: 190282 - DNA, 22 bp, Homo sapiens
gacccccattctgacatccaca

SEQ ID NO: 190283 - DNA, 14 bp, Homo sapiens
gcaccactctgggc

SEQ ID NO: 190284 - DNA, 17 bp, Homo sapiens
gcaccactctgggcaca

SEQ ID NO: 190285 - DNA, 15 bp, Homo sapiens
gcacccactcagcca

SEQ ID NO: 190286 - DNA, 19 bp, Homo sapiens
gcactccatcactgagagc

SEQ ID NO: 190287 - DNA, 16 bp, Homo sapiens
gcactctgttcccctc

SEQ ID NO: 190288 - DNA, 17 bp, Homo sapiens
gcactctgttcccctcc

SEQ ID NO: 190289 - DNA, 22 bp, Homo sapiens
gcactctgttcccctccccctt

SEQ ID NO: 190290 - DNA, 16 bp, Homo sapiens
gcagcacccactcagc

SEQ ID NO: 190291 - DNA, 18 bp, Homo sapiens
gcagcacccactcagcca

SEQ ID NO: 190292 - DNA, 22 bp, Homo sapiens
gcagggcactctgttcccctcc

SEQ ID NO: 190293 - DNA, 21 bp, Homo sapiens
gcatcaggagctgctcaggct

SEQ ID NO: 190294 - DNA, 18 bp, Homo sapiens
gcatcctcactgggctca

SEQ ID NO: 190295 - DNA, 13 bp, Homo sapiens
gcatctcccccac

SEQ ID NO: 190296 - DNA, 12 bp, Homo sapiens
gccaccaagctc

SEQ ID NO: 190297 - DNA, 13 bp, Homo sapiens
gccaccaagctca

SEQ ID NO: 190298 - DNA, 15 bp, Homo sapiens
gccaccaagctcaca

SEQ ID NO: 190299 - DNA, 22 bp, Homo sapiens
gccacgtggtggcccagctcct

SEQ ID NO: 190300 - DNA, 17 bp, Homo sapiens
gccattctctacccatc

SEQ ID NO: 190301 - DNA, 23 bp, Homo sapiens
gcccactctactgccccagctcc

SEQ ID NO: 190302 - DNA, 18 bp, Homo sapiens
gcccagcttcgtcagctc

SEQ ID NO: 190303 - DNA, 22 bp, Homo sapiens
gccccttcccggtccgcccgct

SEQ ID NO: 190304 - DNA, 17 bp, Homo sapiens
gcccgacttcgtttctg

SEQ ID NO: 190305 - DNA, 14 bp, Homo sapiens
gcccgcactggggg

SEQ ID NO: 190306 - DNA, 13 bp, Homo sapiens
gcccgcttccctc

SEQ ID NO: 190307 - DNA, 13 bp, Homo sapiens
gccctgtccctag

SEQ ID NO: 190308 - DNA, 17 bp, Homo sapiens
gccctgtccctagctca

SEQ ID NO: 190309 - DNA, 18 bp, Homo sapiens
gccctgtccctagctcac

SEQ ID NO: 190310 - DNA, 12 bp, Homo sapiens
gccctgtgccag

SEQ ID NO: 190311 - DNA, 16 bp, Homo sapiens
gcccttccttggggaa

SEQ ID NO: 190312 - DNA, 19 bp, Homo sapiens
gcctccaaccttctgccct

SEQ ID NO: 190313 - DNA, 12 bp, Homo sapiens
gcctctcacaca

SEQ ID NO: 190314 - DNA, 23 bp, Homo sapiens
gcgctttgcttaccaaaagctca

SEQ ID NO: 190315 - DNA, 15 bp, Homo sapiens
gcggagggagcggca

SEQ ID NO: 190316 - DNA, 13 bp, Homo sapiens
gcggcatgggcga

SEQ ID NO: 190317 - DNA, 18 bp, Homo sapiens
gctaggtgtctgggatcg

SEQ ID NO: 190318 - DNA, 12 bp, Homo sapiens
gctcacacctgt

SEQ ID NO: 190319 - DNA, 18 bp, Homo sapiens
gctcaccttaaaggtcaa

SEQ ID NO: 190320 - DNA, 21 bp, Homo sapiens
gctcactcccgctgagcccac

SEQ ID NO: 190321 - DNA, 15 bp, Homo sapiens
gctcactgcaggcat

SEQ ID NO: 190322 - DNA, 21 bp, Homo sapiens
gctcaggcttggcggagggag

SEQ ID NO: 190323 - DNA, 11 bp, Homo sapiens
gctcagggccc

SEQ ID NO: 190324 - DNA, 12 bp, Homo sapiens
gctccagcgttt

SEQ ID NO: 190325 - DNA, 18 bp, Homo sapiens
gctcctcacccagggccc

SEQ ID NO: 190326 - DNA, 20 bp, Homo sapiens
gctgagcccactctactgcc

SEQ ID NO: 190327 - DNA, 20 bp, Homo sapiens
gctgctcactcccgctgagc

SEQ ID NO: 190328 - DNA, 16 bp, Homo sapiens
gcttaaacaacacctc

SEQ ID NO: 190329 - DNA, 21 bp, Homo sapiens
gcttaaacaacacctcctcct

SEQ ID NO: 190330 - DNA, 22 bp, Homo sapiens
gcttaaacaacacctcctcctg

SEQ ID NO: 190331 - DNA, 23 bp, Homo sapiens
gcttaaacaacacctcctcctgc

SEQ ID NO: 190332 - DNA, 16 bp, Homo sapiens
gcttaccaaaagctca

SEQ ID NO: 190333 - DNA, 22 bp, Homo sapiens
gcttaccaaaagctcagggccc

SEQ ID NO: 190334 - DNA, 12 bp, Homo sapiens
gcttccctcctt

SEQ ID NO: 190335 - DNA, 16 bp, Homo sapiens
gcttccctccttcatg

SEQ ID NO: 190336 - DNA, 15 bp, Homo sapiens
gcttcgtcagctcca

SEQ ID NO: 190337 - DNA, 16 bp, Homo sapiens
gcttcgtcagctccag

SEQ ID NO: 190338 - DNA, 13 bp, Homo sapiens
gcttggcggaggg

SEQ ID NO: 190339 - DNA, 17 bp, Homo sapiens
ggatcggggtggggaca

SEQ ID NO: 190340 - DNA, 14 bp, Homo sapiens
ggcacaagcagggc

SEQ ID NO: 190341 - DNA, 18 bp, Homo sapiens
ggcactctgttcccctcc

SEQ ID NO: 190342 - DNA, 20 bp, Homo sapiens
ggcactctgttcccctcccc

SEQ ID NO: 190343 - DNA, 22 bp, Homo sapiens
ggcactctgttcccctccccct

SEQ ID NO: 190344 - DNA, 16 bp, Homo sapiens
ggcagcacccactcag

SEQ ID NO: 190345 - DNA, 17 bp, Homo sapiens
ggcagcacccactcagc

SEQ ID NO: 190346 - DNA, 15 bp, Homo sapiens
ggcccagctcctcac

SEQ ID NO: 190347 - DNA, 19 bp, Homo sapiens
ggcctccaaccttctgccc

SEQ ID NO: 190348 - DNA, 23 bp, Homo sapiens
ggcctccaaccttctgccctcct

SEQ ID NO: 190349 - DNA, 23 bp, Homo sapiens
ctcccgctgagcccactctactg

SEQ ID NO: 190350 - DNA, 13 bp, Homo sapiens
ctccgtttctacc

SEQ ID NO: 190351 - DNA, 17 bp, Homo sapiens
ctcctcacccagggccc

SEQ ID NO: 190352 - DNA, 14 bp, Homo sapiens
ctcctcctgctgct

SEQ ID NO: 190353 - DNA, 17 bp, Homo sapiens
ctcctcctgctgctcac

SEQ ID NO: 190354 - DNA, 21 bp, Homo sapiens
ctcctcctgctgctcactccc

SEQ ID NO: 190355 - DNA, 17 bp, Homo sapiens
ctcctgctgctcactcc

SEQ ID NO: 190356 - DNA, 18 bp, Homo sapiens
ctcgtcattttctttccc

SEQ ID NO: 190357 - DNA, 13 bp, Homo sapiens
ctctactgcccca

SEQ ID NO: 190358 - DNA, 14 bp, Homo sapiens
ctctgttcccctcc

SEQ ID NO: 190359 - DNA, 22 bp, Homo sapiens
ctgccacgtggtggcccagctc

SEQ ID NO: 190360 - DNA, 14 bp, Homo sapiens
ctgccccagctccg

SEQ ID NO: 190361 - DNA, 16 bp, Homo sapiens
ctgccctcctgccaaa

SEQ ID NO: 190362 - DNA, 14 bp, Homo sapiens
ctgcctctcacaca

SEQ ID NO: 190363 - DNA, 20 bp, Homo sapiens
ctgctcactcccgctgagcc

SEQ ID NO: 190364 - DNA, 22 bp, Homo sapiens
ctgctcactcccgctgagccca

SEQ ID NO: 190365 - DNA, 21 bp, Homo sapiens
ctggcatctcccccaccctgt

SEQ ID NO: 190366 - DNA, 19 bp, Homo sapiens
ctggcttaaacaacacctc

SEQ ID NO: 190367 - DNA, 23 bp, Homo sapiens
ctggcttaaacaacacctcctcc

SEQ ID NO: 190368 - DNA, 14 bp, Homo sapiens
ctgggcaagaggaa

SEQ ID NO: 190369 - DNA, 16 bp, Homo sapiens
ctgggcaagaggaaaa

SEQ ID NO: 190370 - DNA, 19 bp, Homo sapiens
ctgggcacaagcagggcac

SEQ ID NO: 190371 - DNA, 19 bp, Homo sapiens
ctgggctcactgcaggcat

SEQ ID NO: 190372 - DNA, 15 bp, Homo sapiens
ctggtcaaccccaca

SEQ ID NO: 190373 - DNA, 21 bp, Homo sapiens
ctggtcaaccccacaagcacc

SEQ ID NO: 190374 - DNA, 15 bp, Homo sapiens
ctgtccagctttccc

SEQ ID NO: 190375 - DNA, 18 bp, Homo sapiens
ctgtccctagctcacact

SEQ ID NO: 190376 - DNA, 20 bp, Homo sapiens
ctgtccctagctcacactca

SEQ ID NO: 190377 - DNA, 23 bp, Homo sapiens
ctgtccttctcaggctggcatct

SEQ ID NO: 190378 - DNA, 16 bp, Homo sapiens
ctgttcccctccccct

SEQ ID NO: 190379 - DNA, 20 bp, Homo sapiens
cttaaaggtcaaggaaggaa

SEQ ID NO: 190380 - DNA, 13 bp, Homo sapiens
cttaagccaacaa

SEQ ID NO: 190381 - DNA, 14 bp, Homo sapiens
cttacagccagagg

SEQ ID NO: 190382 - DNA, 21 bp, Homo sapiens
cttaccaaaagctcagggccc

SEQ ID NO: 190383 - DNA, 22 bp, Homo sapiens
cttcccggtccgcccgcttccc

SEQ ID NO: 190384 - DNA, 19 bp, Homo sapiens
cttcctccaatccccactc

SEQ ID NO: 190385 - DNA, 15 bp, Homo sapiens
cttctcaggctggca

SEQ ID NO: 190386 - DNA, 19 bp, Homo sapiens
cttgggaatcattctggct

SEQ ID NO: 190387 - DNA, 11 bp, Homo sapiens
cttggggaaac

SEQ ID NO: 190388 - DNA, 16 bp, Homo sapiens
cttggggatttctggt

SEQ ID NO: 190389 - DNA, 22 bp, Homo sapiens
ctttgcttaccaaaagctcagg

SEQ ID NO: 190390 - DNA, 23 bp, Homo sapiens
gaaaatgccctgtccctagctca

SEQ ID NO: 190391 - DNA, 18 bp, Homo sapiens
gaaggaaaatactacctg

SEQ ID NO: 190392 - DNA, 13 bp, Homo sapiens
gaatcattctggc

SEQ ID NO: 190393 - DNA, 14 bp, Homo sapiens
gaatcattctggct

SEQ ID NO: 190394 - DNA, 16 bp, Homo sapiens
gacaaacagcccttcc

SEQ ID NO: 190395 - DNA, 15 bp, Homo sapiens
gaccaggtgctcagc

SEQ ID NO: 190396 - DNA, 21 bp, Homo sapiens
gacttcctccaatccccactc

SEQ ID NO: 190397 - DNA, 22 bp, Homo sapiens
gacttcctccaatccccactcc

SEQ ID NO: 190398 - DNA, 19 bp, Homo sapiens
gacttggggatttctggtc

SEQ ID NO: 190399 - DNA, 20 bp, Homo sapiens
gacttggggatttctggtca

SEQ ID NO: 190400 - DNA, 19 bp, Homo sapiens
gagacaaacagcccttcct

SEQ ID NO: 190401 - DNA, 21 bp, Homo sapiens
gagacagagagctcctccctg

SEQ ID NO: 190402 - DNA, 23 bp, Homo sapiens
gagagggtggcatcaggagctgc

SEQ ID NO: 190403 - DNA, 22 bp, Homo sapiens
gaggaaaatgccctgtccctag

SEQ ID NO: 190404 - DNA, 14 bp, Homo sapiens
gaggacatcacctg

SEQ ID NO: 190405 - DNA, 17 bp, Homo sapiens
gagtgtgaggagagggt

SEQ ID NO: 190406 - DNA, 21 bp, Homo sapiens
gagtgtgaggagagggtggca

SEQ ID NO: 190407 - DNA, 16 bp, Homo sapiens
gatgtcactcagcccc

SEQ ID NO: 190408 - DNA, 18 bp, Homo sapiens
gatgtcactcagcccctt

SEQ ID NO: 190409 - DNA, 14 bp, Homo sapiens
gcaattgacttcct

SEQ ID NO: 190410 - DNA, 13 bp, Homo sapiens
gcaccactctggg

SEQ ID NO: 190411 - DNA, 17 bp, Homo sapiens
gcagcacccactcagcc

SEQ ID NO: 190412 - DNA, 18 bp, Homo sapiens
gcagggcactctgttccc

SEQ ID NO: 190413 - DNA, 14 bp, Homo sapiens
gcagtcctggcccc

SEQ ID NO: 190414 - DNA, 21 bp, Homo sapiens
gcatcctcactgggctcactg

SEQ ID NO: 190415 - DNA, 12 bp, Homo sapiens
gcatctccccca

SEQ ID NO: 190416 - DNA, 20 bp, Homo sapiens
gcatctcccccaccctgtgc

SEQ ID NO: 190417 - DNA, 17 bp, Homo sapiens
gccaccaagctcacacc

SEQ ID NO: 190418 - DNA, 21 bp, Homo sapiens
gccacgtggtggcccagctcc

SEQ ID NO: 190419 - DNA, 23 bp, Homo sapiens
gccagaggaaccagcactccatc

SEQ ID NO: 190420 - DNA, 16 bp, Homo sapiens
gcccacatcgggctca

SEQ ID NO: 190421 - DNA, 18 bp, Homo sapiens
gcccacatcgggctcacc

SEQ ID NO: 190422 - DNA, 19 bp, Homo sapiens
gcccacatcgggctcacct

SEQ ID NO: 190423 - DNA, 20 bp, Homo sapiens
gcccacatcgggctcacctt

SEQ ID NO: 190424 - DNA, 15 bp, Homo sapiens
gcccactctactgcc

SEQ ID NO: 190425 - DNA, 16 bp, Homo sapiens
gcccactctactgccc

SEQ ID NO: 190426 - DNA, 19 bp, Homo sapiens
gcccactctactgccccag

SEQ ID NO: 190427 - DNA, 15 bp, Homo sapiens
gcccagctcctcacc

SEQ ID NO: 190428 - DNA, 17 bp, Homo sapiens
gcccaggcacaacttca

SEQ ID NO: 190429 - DNA, 20 bp, Homo sapiens
gcccaggcacaacttcagca

SEQ ID NO: 190430 - DNA, 22 bp, Homo sapiens
gccccagctccgtttctaccac

SEQ ID NO: 190431 - DNA, 22 bp, Homo sapiens
gccctcctgccaaaagatctgg

SEQ ID NO: 190432 - DNA, 22 bp, Homo sapiens
gccctgtatttattcccccatc

SEQ ID NO: 190433 - DNA, 15 bp, Homo sapiens
gccctgtccctagct

SEQ ID NO: 190434 - DNA, 19 bp, Homo sapiens
gccctgtccctagctcaca

SEQ ID NO: 190435 - DNA, 17 bp, Homo sapiens
gccctgtgccaggccaa

SEQ ID NO: 190436 - DNA, 22 bp, Homo sapiens
gccgcccacatcgggctcacct

SEQ ID NO: 190437 - DNA, 15 bp, Homo sapiens
gccggccgcccacat

SEQ ID NO: 190438 - DNA, 15 bp, Homo sapiens
gcctccaaccttctg

SEQ ID NO: 190439 - DNA, 18 bp, Homo sapiens
gcctccaaccttctgccc

SEQ ID NO: 190440 - DNA, 13 bp, Homo sapiens
gcctctcacacat

SEQ ID NO: 190441 - DNA, 18 bp, Homo sapiens
gcgctaggggacttgggg

SEQ ID NO: 190442 - DNA, 14 bp, Homo sapiens
gcggagggagcggc

SEQ ID NO: 190443 - DNA, 17 bp, Homo sapiens
gctaggggacttgggga

SEQ ID NO: 190444 - DNA, 16 bp, Homo sapiens
gctaggtgtctgggat

SEQ ID NO: 190445 - DNA, 18 bp, Homo sapiens
gctcacacctgtccttct

SEQ ID NO: 190446 - DNA, 12 bp, Homo sapiens
gctcacactcat

SEQ ID NO: 190447 - DNA, 20 bp, Homo sapiens
gctcactgcaggcatgctga

SEQ ID NO: 190448 - DNA, 18 bp, Homo sapiens
gctcagggccctgtgcca

SEQ ID NO: 190449 - DNA, 14 bp, Homo sapiens
gctgagcccactct

SEQ ID NO: 190450 - DNA, 20 bp, Homo sapiens
gctggcatctcccccaccct

SEQ ID NO: 190451 - DNA, 18 bp, Homo sapiens
gcttaccaaaagctcagg

SEQ ID NO: 190452 - DNA, 13 bp, Homo sapiens
gcttccctccttc

SEQ ID NO: 190453 - DNA, 13 bp, Homo sapiens
ggagagggtggca

SEQ ID NO: 190454 - DNA, 16 bp, Homo sapiens
ggagagggtggcatca

SEQ ID NO: 190455 - DNA, 19 bp, Homo sapiens
ggatcggggtggggacagg

SEQ ID NO: 190456 - DNA, 16 bp, Homo sapiens
ggcaattgacttcctc

SEQ ID NO: 190457 - DNA, 13 bp, Homo sapiens
ggcacaagcaggg

SEQ ID NO: 190458 - DNA, 19 bp, Homo sapiens
ggcatctcccccaccctgt

SEQ ID NO: 190459 - DNA, 23 bp, Homo sapiens
ggcatctcccccaccctgtgccc

SEQ ID NO: 190460 - DNA, 20 bp, Homo sapiens
ggcccagctcctcacccagg

SEQ ID NO: 190461 - DNA, 16 bp, Homo sapiens
ggcccgcactgggggc

SEQ ID NO: 190462 - DNA, 23 bp, Homo sapiens
ggcgatgtcactcagccccttcc

SEQ ID NO: 190463 - DNA, 20 bp, Homo sapiens
ggctcaccttaaaggtcaag

SEQ ID NO: 190464 - DNA, 22 bp, Homo sapiens
ggcttaaacaacacctcctcct

SEQ ID NO: 190465 - DNA, 19 bp, Homo sapiens
gggcactctgttcccctcc

SEQ ID NO: 190466 - DNA, 14 bp, Homo sapiens
gggcgcagaggaca

SEQ ID NO: 190467 - DNA, 19 bp, Homo sapiens
gggctcaccttaaaggtca

SEQ ID NO: 190468 - DNA, 20 bp, Homo sapiens
gggctcaccttaaaggtcaa

SEQ ID NO: 190469 - DNA, 15 bp, Homo sapiens
ggggcgcagaggaca

SEQ ID NO: 190470 - DNA, 20 bp, Homo sapiens
gggggcaattgacttcctcc

SEQ ID NO: 190471 - DNA, 13 bp, Homo sapiens
gggtggggacagg

SEQ ID NO: 190472 - DNA, 15 bp, Homo sapiens
ggtcaaggaaggaaa

SEQ ID NO: 190473 - DNA, 21 bp, Homo sapiens
ggtggcatcaggagctgctca

SEQ ID NO: 190474 - DNA, 21 bp, Homo sapiens
gtaccaggcccgcactggggg

SEQ ID NO: 190475 - DNA, 20 bp, Homo sapiens
gtcagctggtagctgggggc

SEQ ID NO: 190476 - DNA, 16 bp, Homo sapiens
gtccctagctcacact

SEQ ID NO: 190477 - DNA, 23 bp, Homo sapiens
gtgccaccaagctcacacctgtc

SEQ ID NO: 190478 - DNA, 18 bp, Homo sapiens
gtgctcagcccaggcaca

SEQ ID NO: 190479 - DNA, 21 bp, Homo sapiens
gtggcatcaggagctgctcag

SEQ ID NO: 190480 - DNA, 13 bp, Homo sapiens
gtggcccagctcc

SEQ ID NO: 190481 - DNA, 22 bp, Homo sapiens
gtgtgaggagagggtggcatca

SEQ ID NO: 190482 - DNA, 11 bp, Homo sapiens
taaacaacacc

SEQ ID NO: 190483 - DNA, 18 bp, Homo sapiens
taaacaacacctcctcct

SEQ ID NO: 190484 - DNA, 20 bp, Homo sapiens
taaaggtcaaggaaggaaaa

SEQ ID NO: 190485 - DNA, 19 bp, Homo sapiens
taagccaacaaccacagtg

SEQ ID NO: 190486 - DNA, 22 bp, Homo sapiens
taattggcagcacccactcagc

SEQ ID NO: 190487 - DNA, 13 bp, Homo sapiens
tacacccacccac

SEQ ID NO: 190488 - DNA, 15 bp, Homo sapiens
taccaaaagctcagg

SEQ ID NO: 190489 - DNA, 19 bp, Homo sapiens
taccaggcccgcactgggg

SEQ ID NO: 190490 - DNA, 15 bp, Homo sapiens
tagaccaggtgctca

SEQ ID NO: 190491 - DNA, 21 bp, Homo sapiens
tcaaccccacaagcaccactc

SEQ ID NO: 190492 - DNA, 22 bp, Homo sapiens
tcacacctgtccttctcaggct

SEQ ID NO: 190493 - DNA, 18 bp, Homo sapiens
tcacactcatccacactt

SEQ ID NO: 190494 - DNA, 21 bp, Homo sapiens
tcacctggggtgctgcctctc

SEQ ID NO: 190495 - DNA, 16 bp, Homo sapiens
tcactcagccccttcc

SEQ ID NO: 190496 - DNA, 17 bp, Homo sapiens
tcactcagccccttccc

SEQ ID NO: 190497 - DNA, 13 bp, Homo sapiens
tcagccccttccc

SEQ ID NO: 190498 - DNA, 20 bp, Homo sapiens
tcaggagctgctcaggcttg

SEQ ID NO: 190499 - DNA, 17 bp, Homo sapiens
tcatccacacttaagcc

SEQ ID NO: 190500 - DNA, 17 bp, Homo sapiens
tccaaccttctgccctc

SEQ ID NO: 190501 - DNA, 18 bp, Homo sapiens
tccaaccttctgccctcc

SEQ ID NO: 190502 - DNA, 21 bp, Homo sapiens
tccaaccttctgccctcctgc

SEQ ID NO: 190503 - DNA, 23 bp, Homo sapiens
tccaaccttctgccctcctgcca

SEQ ID NO: 190504 - DNA, 12 bp, Homo sapiens
tccacatgctct

SEQ ID NO: 190505 - DNA, 13 bp, Homo sapiens
tccagctttcccc

SEQ ID NO: 190506 - DNA, 13 bp, Homo sapiens
tcccaacagccca

SEQ ID NO: 190507 - DNA, 23 bp, Homo sapiens
tcccaacagcccagcaagaagga

SEQ ID NO: 190508 - DNA, 12 bp, Homo sapiens
tccccactcctc

SEQ ID NO: 190509 - DNA, 19 bp, Homo sapiens
tcccccatcttcatcccaa

SEQ ID NO: 190510 - DNA, 20 bp, Homo sapiens
tccctagctcacactcatcc

SEQ ID NO: 190511 - DNA, 14 bp, Homo sapiens
tccctccttcatga

SEQ ID NO: 190512 - DNA, 23 bp, Homo sapiens
tccgcccgcttccctccttcatg

SEQ ID NO: 190513 - DNA, 20 bp, Homo sapiens
tcctcacccagggcccccaa

SEQ ID NO: 190514 - DNA, 20 bp, Homo sapiens
tcctcactgggctcactgca

SEQ ID NO: 190515 - DNA, 14 bp, Homo sapiens
tcctccaatcccca

SEQ ID NO: 190516 - DNA, 15 bp, Homo sapiens
tcctccaatccccac

SEQ ID NO: 190517 - DNA, 13 bp, Homo sapiens
tcctcctgctgct

SEQ ID NO: 190518 - DNA, 12 bp, Homo sapiens
tcctgctgctca

SEQ ID NO: 190519 - DNA, 17 bp, Homo sapiens
tcctggccccctcgtca

SEQ ID NO: 190520 - DNA, 21 bp, Homo sapiens
tcctggccggccgcccacatc

SEQ ID NO: 190521 - DNA, 22 bp, Homo sapiens
tccttctcaggctggcatctcc

SEQ ID NO: 190522 - DNA, 19 bp, Homo sapiens
tccttggggaaacttggga

SEQ ID NO: 190523 - DNA, 15 bp, Homo sapiens
tctcacacatttctg

SEQ ID NO: 190524 - DNA, 16 bp, Homo sapiens
tctcaggctggcatct

SEQ ID NO: 190525 - DNA, 14 bp, Homo sapiens
tctcccccaccctg

SEQ ID NO: 190526 - DNA, 15 bp, Homo sapiens
tctcccccaccctgt

SEQ ID NO: 190527 - DNA, 15 bp, Homo sapiens
tctgccctcctgcca

SEQ ID NO: 190528 - DNA, 17 bp, Homo sapiens
tctgggcacaagcaggg

SEQ ID NO: 190529 - DNA, 19 bp, Homo sapiens
tctgggcacaagcagggca

SEQ ID NO: 190530 - DNA, 14 bp, Homo sapiens
tctggggagtgtga

SEQ ID NO: 190531 - DNA, 17 bp, Homo sapiens
tctgttcccctccccct

SEQ ID NO: 190532 - DNA, 17 bp, Homo sapiens
tcttacagccagaggaa

SEQ ID NO: 190533 - DNA, 21 bp, Homo sapiens
tgaacaaggggcctccaacct

SEQ ID NO: 190534 - DNA, 22 bp, Homo sapiens
tgccacgtggtggcccagctcc

SEQ ID NO: 190535 - DNA, 18 bp, Homo sapiens
tgcccagcttcgtcagct

SEQ ID NO: 190536 - DNA, 20 bp, Homo sapiens
tgcccagcttcgtcagctcc

SEQ ID NO: 190537 - DNA, 23 bp, Homo sapiens
tgcccagcttcgtcagctccagc

SEQ ID NO: 190538 - DNA, 12 bp, Homo sapiens
tgccccagctcc

SEQ ID NO: 190539 - DNA, 14 bp, Homo sapiens
tgccctcctgccaa

SEQ ID NO: 190540 - DNA, 13 bp, Homo sapiens
tgcctctcacaca

SEQ ID NO: 190541 - DNA, 16 bp, Homo sapiens
tgctaggtgtctggga

SEQ ID NO: 190542 - DNA, 14 bp, Homo sapiens
tgctcagcccaggc

SEQ ID NO: 190543 - DNA, 18 bp, Homo sapiens
tgctcagcccaggcacaa

SEQ ID NO: 190544 - DNA, 17 bp, Homo sapiens
tgctctgtccagctttc

SEQ ID NO: 190545 - DNA, 17 bp, Homo sapiens
tggcagcacccactcag

SEQ ID NO: 190546 - DNA, 18 bp, Homo sapiens
tggcatcaggagctgctc

SEQ ID NO: 190547 - DNA, 17 bp, Homo sapiens
tggcatctcccccaccc

SEQ ID NO: 190548 - DNA, 23 bp, Homo sapiens
tggcggagggagcggcatgggcg

SEQ ID NO: 190549 - DNA, 19 bp, Homo sapiens
tgggcacaagcagggcact

SEQ ID NO: 190550 - DNA, 22 bp, Homo sapiens
tgggcacaagcagggcactctg

SEQ ID NO: 190551 - DNA, 19 bp, Homo sapiens
tgggctcactgcaggcatg

SEQ ID NO: 190552 - DNA, 17 bp, Homo sapiens
tggggaaacttgggaat

SEQ ID NO: 190553 - DNA, 17 bp, Homo sapiens
tgggggcgcagaggaca

SEQ ID NO: 190554 - DNA, 14 bp, Homo sapiens
tggtaccaggcccg

SEQ ID NO: 190555 - DNA, 22 bp, Homo sapiens
tggtaccaggcccgcactgggg

SEQ ID NO: 190556 - DNA, 16 bp, Homo sapiens
tgtcactcagcccctt

SEQ ID NO: 190557 - DNA, 16 bp, Homo sapiens
tgtcccctatgccact

SEQ ID NO: 190558 - DNA, 15 bp, Homo sapiens
tgtccctagctcaca

SEQ ID NO: 190559 - DNA, 12 bp, Homo sapiens
tgtctgggatcg

SEQ ID NO: 190560 - DNA, 22 bp, Homo sapiens
tgtctgggatcggggtggggac

SEQ ID NO: 190561 - DNA, 16 bp, Homo sapiens
tgtgtcagctggtagc

SEQ ID NO: 190562 - DNA, 15 bp, Homo sapiens
ttacagccagaggaa

SEQ ID NO: 190563 - DNA, 13 bp, Homo sapiens
ttagtacatgctc

SEQ ID NO: 190564 - DNA, 21 bp, Homo sapiens
ttcagatgtacacccacccac

SEQ ID NO: 190565 - DNA, 11 bp, Homo sapiens
ttcagcagggg

SEQ ID NO: 190566 - DNA, 13 bp, Homo sapiens
ttcccctccccct

SEQ ID NO: 190567 - DNA, 17 bp, Homo sapiens
ttctcaggctggcatct

SEQ ID NO: 190568 - DNA, 15 bp, Homo sapiens
ttctgacatccacat

SEQ ID NO: 190569 - DNA, 20 bp, Homo sapiens
ttctggcttaaacaacacct

SEQ ID NO: 190570 - DNA, 19 bp, Homo sapiens
ttgcttaccaaaagctcag

SEQ ID NO: 190571 - DNA, 20 bp, Homo sapiens
tttctggggcaactgagagc

SEQ ID NO: 190572 - DNA, 20 bp, Homo sapiens
aggctggcatctcccccacc

SEQ ID NO: 190573 - DNA, 14 bp, Homo sapiens
agggcactctgttc

SEQ ID NO: 190574 - DNA, 19 bp, Homo sapiens
agggcactctgttcccctc

SEQ ID NO: 190575 - DNA, 20 bp, Homo sapiens
agggcactctgttcccctcc

SEQ ID NO: 190576 - DNA, 22 bp, Homo sapiens
agggcactctgttcccctcccc

SEQ ID NO: 190577 - DNA, 23 bp, Homo sapiens
agggccctgtgccaggccaaaga

SEQ ID NO: 190578 - DNA, 15 bp, Homo sapiens
aggggacttggggat

SEQ ID NO: 190579 - DNA, 12 bp, Homo sapiens
agggtggcatca

SEQ ID NO: 190580 - DNA, 15 bp, Homo sapiens
agtcctggccccctc

SEQ ID NO: 190581 - DNA, 21 bp, Homo sapiens
agtgccaccaagctcacacct

SEQ ID NO: 190582 - DNA, 19 bp, Homo sapiens
atcacctggggtgctgcct

SEQ ID NO: 190583 - DNA, 16 bp, Homo sapiens
atcctcactgggctca

SEQ ID NO: 190584 - DNA, 20 bp, Homo sapiens
atcctcactgggctcactgc

SEQ ID NO: 190585 - DNA, 15 bp, Homo sapiens
atcggggtggggaca

SEQ ID NO: 190586 - DNA, 13 bp, Homo sapiens
atcttacagccag

SEQ ID NO: 190587 - DNA, 19 bp, Homo sapiens
atcttacagccagaggaac

SEQ ID NO: 190588 - DNA, 18 bp, Homo sapiens
atcttcatcccaacagcc

SEQ ID NO: 190589 - DNA, 19 bp, Homo sapiens
atgccctgtccctagctca

SEQ ID NO: 190590 - DNA, 15 bp, Homo sapiens
atgctctgtccagct

SEQ ID NO: 190591 - DNA, 23 bp, Homo sapiens
atggcgctaggggacttggggat

SEQ ID NO: 190592 - DNA, 22 bp, Homo sapiens
atgtcactcagccccttcccgg

SEQ ID NO: 190593 - DNA, 23 bp, Homo sapiens
attgacttcctccaatccccact

SEQ ID NO: 190594 - DNA, 15 bp, Homo sapiens
caaaagatctgggga

SEQ ID NO: 190595 - DNA, 21 bp, Homo sapiens
caaaagctcagggccctgtgc

SEQ ID NO: 190596 - DNA, 23 bp, Homo sapiens
caaaagctcagggccctgtgcca

SEQ ID NO: 190597 - DNA, 15 bp, Homo sapiens
caaacagcccttcct

SEQ ID NO: 190598 - DNA, 16 bp, Homo sapiens
caaacagcccttcctt

SEQ ID NO: 190599 - DNA, 16 bp, Homo sapiens
caacacctcctcctgc

SEQ ID NO: 190600 - DNA, 17 bp, Homo sapiens
caacacctcctcctgct

SEQ ID NO: 190601 - DNA, 20 bp, Homo sapiens
caacacctcctcctgctgct

SEQ ID NO: 190602 - DNA, 23 bp, Homo sapiens
caacacctcctcctgctgctcac

SEQ ID NO: 190603 - DNA, 14 bp, Homo sapiens
caaccccacaagca

SEQ ID NO: 190604 - DNA, 21 bp, Homo sapiens
caaccccacaagcaccactct

SEQ ID NO: 190605 - DNA, 16 bp, Homo sapiens
caaccttctgccctcc

SEQ ID NO: 190606 - DNA, 19 bp, Homo sapiens
caaccttctgccctcctgc

SEQ ID NO: 190607 - DNA, 20 bp, Homo sapiens
caagcaccactctgggcaca

SEQ ID NO: 190608 - DNA, 16 bp, Homo sapiens
caagcgtctgggcaag

SEQ ID NO: 190609 - DNA, 19 bp, Homo sapiens
caagcgtctgggcaagagg

SEQ ID NO: 190610 - DNA, 14 bp, Homo sapiens
caagctcacacctg

SEQ ID NO: 190611 - DNA, 22 bp, Homo sapiens
caaggggcctccaaccttctgc

SEQ ID NO: 190612 - DNA, 18 bp, Homo sapiens
cacaacttcagcagggga

SEQ ID NO: 190613 - DNA, 17 bp, Homo sapiens
cacaagcaccactctgg

SEQ ID NO: 190614 - DNA, 19 bp, Homo sapiens
cacacatttctgccacgtg

SEQ ID NO: 190615 - DNA, 12 bp, Homo sapiens
cacacctgtcct

SEQ ID NO: 190616 - DNA, 13 bp, Homo sapiens
cacagtgccacca

SEQ ID NO: 190617 - DNA, 17 bp, Homo sapiens
cacatatcttacagcca

SEQ ID NO: 190618 - DNA, 19 bp, Homo sapiens
caccaagctcacacctgtc

SEQ ID NO: 190619 - DNA, 23 bp, Homo sapiens
caccaagctcacacctgtccttc

SEQ ID NO: 190620 - DNA, 16 bp, Homo sapiens
caccactctgggcaca

SEQ ID NO: 190621 - DNA, 17 bp, Homo sapiens
caccctgtgcccctttt

SEQ ID NO: 190622 - DNA, 16 bp, Homo sapiens
caccgcatcctcactg

SEQ ID NO: 190623 - DNA, 19 bp, Homo sapiens
caccgcatcctcactgggc

SEQ ID NO: 190624 - DNA, 16 bp, Homo sapiens
cacctcctcctgctgc

SEQ ID NO: 190625 - DNA, 18 bp, Homo sapiens
cacctcctcctgctgctc

SEQ ID NO: 190626 - DNA, 17 bp, Homo sapiens
cacctggggtgctgcct

SEQ ID NO: 190627 - DNA, 15 bp, Homo sapiens
cacctgtccttctca

SEQ ID NO: 190628 - DNA, 19 bp, Homo sapiens
cacgtggtggcccagctcc

SEQ ID NO: 190629 - DNA, 18 bp, Homo sapiens
cactcagccattctctac

SEQ ID NO: 190630 - DNA, 18 bp, Homo sapiens
cactcagccccttcccgg

SEQ ID NO: 190631 - DNA, 19 bp, Homo sapiens
cactcctccgagacccagg

SEQ ID NO: 190632 - DNA, 13 bp, Homo sapiens
cactctactgccc

SEQ ID NO: 190633 - DNA, 19 bp, Homo sapiens
cactctactgccccagctc

SEQ ID NO: 190634 - DNA, 20 bp, Homo sapiens
cactctgggcacaagcaggg

SEQ ID NO: 190635 - DNA, 16 bp, Homo sapiens
cactgggctcactgca

SEQ ID NO: 190636 - DNA, 22 bp, Homo sapiens
cagcactccatcactgagagcc

SEQ ID NO: 190637 - DNA, 12 bp, Homo sapiens
cagccagaggaa

SEQ ID NO: 190638 - DNA, 20 bp, Homo sapiens
cagccagaggaaccagcact

SEQ ID NO: 190639 - DNA, 16 bp, Homo sapiens
cagccattctctaccc

SEQ ID NO: 190640 - DNA, 14 bp, Homo sapiens
cagccccttcccgg

SEQ ID NO: 190641 - DNA, 17 bp, Homo sapiens
cagccccttcccggtcc

SEQ ID NO: 190642 - DNA, 14 bp, Homo sapiens
cagctcctcaccca

SEQ ID NO: 190643 - DNA, 20 bp, Homo sapiens
cagctcctcacccagggccc

SEQ ID NO: 190644 - DNA, 18 bp, Homo sapiens
cagcttcgtcagctccag

SEQ ID NO: 190645 - DNA, 17 bp, Homo sapiens
caggagacaaacagccc

SEQ ID NO: 190646 - DNA, 22 bp, Homo sapiens
caggcacaacttcagcagggga

SEQ ID NO: 190647 - DNA, 23 bp, Homo sapiens
caggcatgctgaacaaggggcct

SEQ ID NO: 190648 - DNA, 15 bp, Homo sapiens
caggcccgcactggg

SEQ ID NO: 190649 - DNA, 17 bp, Homo sapiens
caggcccgcactggggg

SEQ ID NO: 190650 - DNA, 21 bp, Homo sapiens
caggctggcatctcccccacc

SEQ ID NO: 190651 - DNA, 22 bp, Homo sapiens
caggcttggcggagggagcggc

SEQ ID NO: 190652 - DNA, 22 bp, Homo sapiens
cagggcactctgttcccctccc

SEQ ID NO: 190653 - DNA, 20 bp, Homo sapiens
cagggccctgtgccaggcca

SEQ ID NO: 190654 - DNA, 19 bp, Homo sapiens
caggtgctcagcccaggca

SEQ ID NO: 190655 - DNA, 12 bp, Homo sapiens
cagtgccaccaa

SEQ ID NO: 190656 - DNA, 20 bp, Homo sapiens
catcaggagctgctcaggct

SEQ ID NO: 190657 - DNA, 17 bp, Homo sapiens
catccacacttaagccc

SEQ ID NO: 190658 - DNA, 17 bp, Homo sapiens
catccacatgctctgca

SEQ ID NO: 190659 - DNA, 16 bp, Homo sapiens
catcccaacagcccag

SEQ ID NO: 190660 - DNA, 15 bp, Homo sapiens
catctcccccaccct

SEQ ID NO: 190661 - DNA, 20 bp, Homo sapiens
catctcccccaccctgtgcc

SEQ ID NO: 190662 - DNA, 21 bp, Homo sapiens
catctcccccaccctgtgccc

SEQ ID NO: 190663 - DNA, 13 bp, Homo sapiens
catcttcatccca

SEQ ID NO: 190664 - DNA, 20 bp, Homo sapiens
catgctctgcagtcctggcc

SEQ ID NO: 190665 - DNA, 15 bp, Homo sapiens
cattctctacccatc

SEQ ID NO: 190666 - DNA, 17 bp, Homo sapiens
ccaaaagatctggggag

SEQ ID NO: 190667 - DNA, 15 bp, Homo sapiens
ccaacagcccagcaa

SEQ ID NO: 190668 - DNA, 23 bp, Homo sapiens
ccaaccttctgccctcctgccaa

SEQ ID NO: 190669 - DNA, 19 bp, Homo sapiens
ccaagctcacacctgtcct

SEQ ID NO: 190670 - DNA, 15 bp, Homo sapiens
ccaatccccactcct

SEQ ID NO: 190671 - DNA, 20 bp, Homo sapiens
ccacaagcaccactctgggc

SEQ ID NO: 190672 - DNA, 23 bp, Homo sapiens
ccacaagcaccactctgggcaca

SEQ ID NO: 190673 - DNA, 21 bp, Homo sapiens
ccacatatcttacagccagag

SEQ ID NO: 190674 - DNA, 15 bp, Homo sapiens
ccaccaagctcacac

SEQ ID NO: 190675 - DNA, 22 bp, Homo sapiens
ccacccacatatcttacagcca

SEQ ID NO: 190676 - DNA, 12 bp, Homo sapiens
ccaccctgtgcc

SEQ ID NO: 190677 - DNA, 18 bp, Homo sapiens
ccaccgcatcctcactgg

SEQ ID NO: 190678 - DNA, 22 bp, Homo sapiens
ccaccgcatcctcactgggctc

SEQ ID NO: 190679 - DNA, 14 bp, Homo sapiens
ccactcagccattc

SEQ ID NO: 190680 - DNA, 14 bp, Homo sapiens
ccactctgggcaca

SEQ ID NO: 190681 - DNA, 22 bp, Homo sapiens
ccactctgggcacaagcagggc

SEQ ID NO: 190682 - DNA, 22 bp, Homo sapiens
ccagcactccatcactgagagc

SEQ ID NO: 190683 - DNA, 22 bp, Homo sapiens
ccagctcctcacccagggcccc

SEQ ID NO: 190684 - DNA, 17 bp, Homo sapiens
ccagcttcgtcagctcc

SEQ ID NO: 190685 - DNA, 18 bp, Homo sapiens
ccaggagacaaacagccc

SEQ ID NO: 190686 - DNA, 22 bp, Homo sapiens
ccaggccaaagatccccccaga

SEQ ID NO: 190687 - DNA, 17 bp, Homo sapiens
ccaggcccgcactgggg

SEQ ID NO: 190688 - DNA, 16 bp, Homo sapiens
ccaggtgctcagccca

SEQ ID NO: 190689 - DNA, 19 bp, Homo sapiens
ccaggtgctcagcccaggc

SEQ ID NO: 190690 - DNA, 19 bp, Homo sapiens
ccatcactgagagcccgac

SEQ ID NO: 190691 - DNA, 20 bp, Homo sapiens
ccatccttagtacatgctct

SEQ ID NO: 190692 - DNA, 16 bp, Homo sapiens
cccacaagcaccactc

SEQ ID NO: 190693 - DNA, 22 bp, Homo sapiens
cccacaagcaccactctgggca

SEQ ID NO: 190694 - DNA, 17 bp, Homo sapiens
cccacatcgggctcacc

SEQ ID NO: 190695 - DNA, 18 bp, Homo sapiens
cccacatcgggctcacct

SEQ ID NO: 190696 - DNA, 12 bp, Homo sapiens
cccactcagcca

SEQ ID NO: 190697 - DNA, 14 bp, Homo sapiens
cccactctactgcc

SEQ ID NO: 190698 - DNA, 22 bp, Homo sapiens
cccactctactgccccagctcc

SEQ ID NO: 190699 - DNA, 14 bp, Homo sapiens
cccagcaagaagga

SEQ ID NO: 190700 - DNA, 13 bp, Homo sapiens
cccagctcctcac

SEQ ID NO: 190701 - DNA, 18 bp, Homo sapiens
cccagctcctcacccagg

SEQ ID NO: 190702 - DNA, 13 bp, Homo sapiens
ccccacaagcacc

SEQ ID NO: 190703 - DNA, 16 bp, Homo sapiens
ccccacaagcaccact

SEQ ID NO: 190704 - DNA, 18 bp, Homo sapiens
ccccacaagcaccactct

SEQ ID NO: 190705 - DNA, 20 bp, Homo sapiens
ccccacaagcaccactctgg

SEQ ID NO: 190706 - DNA, 13 bp, Homo sapiens
ccccaccctgtgc

SEQ ID NO: 190707 - DNA, 23 bp, Homo sapiens
ccccagggtgacatacagaaggg

SEQ ID NO: 190708 - DNA, 15 bp, Homo sapiens
cccccaccctgtgcc

SEQ ID NO: 190709 - DNA, 17 bp, Homo sapiens
cccctatgccactaagc

SEQ ID NO: 190710 - DNA, 15 bp, Homo sapiens
ccctagctcacactc

SEQ ID NO: 190711 - DNA, 18 bp, Homo sapiens
ccctatgccactaagcca

SEQ ID NO: 190712 - DNA, 19 bp, Homo sapiens
ccctcccccttaagccaac

SEQ ID NO: 190713 - DNA, 22 bp, Homo sapiens
ccctgtatttattcccccatct

SEQ ID NO: 190714 - DNA, 17 bp, Homo sapiens
ccctgtccctagctcac

SEQ ID NO: 190715 - DNA, 13 bp, Homo sapiens
ccctgtgcccctt

SEQ ID NO: 190716 - DNA, 13 bp, Homo sapiens
cccttaagccaac

SEQ ID NO: 190717 - DNA, 15 bp, Homo sapiens
cccttccttggggaa

SEQ ID NO: 190718 - DNA, 22 bp, Homo sapiens
cccttttcatggtaccaggccc

SEQ ID NO: 190719 - DNA, 23 bp, Homo sapiens
cccttttcatggtaccaggcccg

SEQ ID NO: 190720 - DNA, 13 bp, Homo sapiens
ccgcatcctcact

SEQ ID NO: 190721 - DNA, 15 bp, Homo sapiens
ccgcatcctcactgg

SEQ ID NO: 190722 - DNA, 16 bp, Homo sapiens
ccgctgagcccactct

SEQ ID NO: 190723 - DNA, 23 bp, Homo sapiens
ccgctgagcccactctactgccc

SEQ ID NO: 190724 - DNA, 16 bp, Homo sapiens
ccgcttccctccttca

SEQ ID NO: 190725 - DNA, 18 bp, Homo sapiens
ccggtccgcccgcttccc

SEQ ID NO: 190726 - DNA, 18 bp, Homo sapiens
cctagctcacactcatcc

SEQ ID NO: 190727 - DNA, 15 bp, Homo sapiens
cctccaaccttctgc

SEQ ID NO: 190728 - DNA, 16 bp, Homo sapiens
cctccaaccttctgcc

SEQ ID NO: 190729 - DNA, 21 bp, Homo sapiens
cctccaaccttctgccctcct

SEQ ID NO: 190730 - DNA, 13 bp, Homo sapiens
cctcctcctgctg

SEQ ID NO: 190731 - DNA, 12 bp, Homo sapiens
cctcctgccaaa

SEQ ID NO: 190732 - DNA, 15 bp, Homo sapiens
cctcgtgcacacaca

SEQ ID NO: 190733 - DNA, 21 bp, Homo sapiens
cctctcacacatttctgccac

SEQ ID NO: 190734 - DNA, 18 bp, Homo sapiens
cctgctgctcactcccgc

SEQ ID NO: 190735 - DNA, 14 bp, Homo sapiens
cctgtccctagctc

SEQ ID NO: 190736 - DNA, 19 bp, Homo sapiens
cctgtccctagctcacact

SEQ ID NO: 190737 - DNA, 21 bp, Homo sapiens
cctgtccctagctcacactca

SEQ ID NO: 190738 - DNA, 22 bp, Homo sapiens
cctgtccctagctcacactcat

SEQ ID NO: 190739 - DNA, 22 bp, Homo sapiens
ccttagtacatgctctgtccag

SEQ ID NO: 190740 - DNA, 19 bp, Homo sapiens
ccttcccggtccgcccgct

SEQ ID NO: 190741 - DNA, 14 bp, Homo sapiens
ccttctgccctcct

SEQ ID NO: 190742 - DNA, 16 bp, Homo sapiens
ccttctgccctcctgc

SEQ ID NO: 190743 - DNA, 18 bp, Homo sapiens
ccttctgccctcctgcca

SEQ ID NO: 190744 - DNA, 14 bp, Homo sapiens
cgatgtcactcagc

SEQ ID NO: 190745 - DNA, 16 bp, Homo sapiens
cgatgtcactcagccc

SEQ ID NO: 190746 - DNA, 21 bp, Homo sapiens
cgcccgcttccctccttcatg

SEQ ID NO: 190747 - DNA, 22 bp, Homo sapiens
cggtccgcccgcttccctcctt

SEQ ID NO: 190748 - DNA, 21 bp, Homo sapiens
cgtcattttctttcccagaag

SEQ ID NO: 190749 - DNA, 22 bp, Homo sapiens
cgtttctggggcaactgagagc

SEQ ID NO: 190750 - DNA, 21 bp, Homo sapiens
ctaattggcagcacccactca

SEQ ID NO: 190751 - DNA, 22 bp, Homo sapiens
ctaattggcagcacccactcag

SEQ ID NO: 190752 - DNA, 16 bp, Homo sapiens
ctaccaccgcatcctc

SEQ ID NO: 190753 - DNA, 17 bp, Homo sapiens
ctacctgtcccctatgc

SEQ ID NO: 190754 - DNA, 19 bp, Homo sapiens
ctacctgtcccctatgcca

SEQ ID NO: 190755 - DNA, 12 bp, Homo sapiens
ctagctcacact

SEQ ID NO: 190756 - DNA, 14 bp, Homo sapiens
ctagctcacactca

SEQ ID NO: 190757 - DNA, 16 bp, Homo sapiens
ctagctcacactcatc

SEQ ID NO: 190758 - DNA, 22 bp, Homo sapiens
ctagctcacactcatccacact

SEQ ID NO: 190759 - DNA, 17 bp, Homo sapiens
ctaggggacttggggat

SEQ ID NO: 190760 - DNA, 23 bp, Homo sapiens
ctcactcccgctgagcccactct

SEQ ID NO: 190761 - DNA, 15 bp, Homo sapiens
ctcactgcaggcatg

SEQ ID NO: 190762 - DNA, 13 bp, Homo sapiens
ctcactgggctca

SEQ ID NO: 190763 - DNA, 23 bp, Homo sapiens
ctcagccattctctacccatcct

SEQ ID NO: 190764 - DNA, 15 bp, Homo sapiens
ctcagcccaggcaca

SEQ ID NO: 190765 - DNA, 19 bp, Homo sapiens
ctcaggcttggcggaggga

SEQ ID NO: 190766 - DNA, 20 bp, Homo sapiens
ctccaaccttctgccctcct

SEQ ID NO: 190767 - DNA, 15 bp, Homo sapiens
ctccagcgtttgcct

SEQ ID NO: 190768 - DNA, 16 bp, Homo sapiens
ctccatcactgagagc

SEQ ID NO: 190769 - DNA, 13 bp, Homo sapiens
ctcccccaccctg

SEQ ID NO: 190770 - DNA, 16 bp, Homo sapiens
ctcccccaccctgtgc

SEQ ID NO: 190771 - DNA, 20 bp, Homo sapiens
ctcccccaccctgtgcccct

SEQ ID NO: 190772 - DNA, 19 bp, Homo sapiens
ctcccgctgagcccactct

SEQ ID NO: 190773 - DNA, 15 bp, Homo sapiens
aaatactacctgtcc

SEQ ID NO: 190774 - DNA, 22 bp, Homo sapiens
aaatactacctgtcccctatgc

SEQ ID NO: 190775 - DNA, 13 bp, Homo sapiens
aaatgccctgtcc

SEQ ID NO: 190776 - DNA, 15 bp, Homo sapiens
aacaacacctcctcc

SEQ ID NO: 190777 - DNA, 13 bp, Homo sapiens
aacacctcctcct

SEQ ID NO: 190778 - DNA, 20 bp, Homo sapiens
aacagcccagcaagaaggag

SEQ ID NO: 190779 - DNA, 12 bp, Homo sapiens
aacagcccttcc

SEQ ID NO: 190780 - DNA, 20 bp, Homo sapiens
aacagcccttccttggggaa

SEQ ID NO: 190781 - DNA, 13 bp, Homo sapiens
aaccacagtgcca

SEQ ID NO: 190782 - DNA, 14 bp, Homo sapiens
aactgagagctgag

SEQ ID NO: 190783 - DNA, 15 bp, Homo sapiens
aagctcacacctgtc

SEQ ID NO: 190784 - DNA, 14 bp, Homo sapiens
aattgacttcctcc

SEQ ID NO: 190785 - DNA, 16 bp, Homo sapiens
acaaacagcccttcct

SEQ ID NO: 190786 - DNA, 14 bp, Homo sapiens
acacccacccacat

SEQ ID NO: 190787 - DNA, 15 bp, Homo sapiens
acacctcctcctgct

SEQ ID NO: 190788 - DNA, 20 bp, Homo sapiens
acacctcctcctgctgctca

SEQ ID NO: 190789 - DNA, 23 bp, Homo sapiens
acacctcctcctgctgctcactc

SEQ ID NO: 190790 - DNA, 14 bp, Homo sapiens
acacctgtccttct

SEQ ID NO: 190791 - DNA, 19 bp, Homo sapiens
acagccagaggaaccagca

SEQ ID NO: 190792 - DNA, 12 bp, Homo sapiens
acagcccttcct

SEQ ID NO: 190793 - DNA, 18 bp, Homo sapiens
acagcccttccttgggga

SEQ ID NO: 190794 - DNA, 17 bp, Homo sapiens
acatatcttacagccag

SEQ ID NO: 190795 - DNA, 14 bp, Homo sapiens
acatcgggctcacc

SEQ ID NO: 190796 - DNA, 14 bp, Homo sapiens
accaaaagctcagg

SEQ ID NO: 190797 - DNA, 15 bp, Homo sapiens
accactctgggcaca

SEQ ID NO: 190798 - DNA, 21 bp, Homo sapiens
accccacaagcaccactctgg

SEQ ID NO: 190799 - DNA, 11 bp, Homo sapiens
acccccccagg

SEQ ID NO: 190800 - DNA, 19 bp, Homo sapiens
accgcatcctcactgggct

SEQ ID NO: 190801 - DNA, 21 bp, Homo sapiens
accgcatcctcactgggctca

SEQ ID NO: 190802 - DNA, 16 bp, Homo sapiens
acctcctcctgctgct

SEQ ID NO: 190803 - DNA, 16 bp, Homo sapiens
acctggggtgctgcct

SEQ ID NO: 190804 - DNA, 15 bp, Homo sapiens
accttctgccctcct

SEQ ID NO: 190805 - DNA, 16 bp, Homo sapiens
acgtggtggcccagct

SEQ ID NO: 190806 - DNA, 19 bp, Homo sapiens
actacctgtcccctatgcc

SEQ ID NO: 190807 - DNA, 16 bp, Homo sapiens
actcagccccttcccg

SEQ ID NO: 190808 - DNA, 21 bp, Homo sapiens
actcatccacacttaagccct

SEQ ID NO: 190809 - DNA, 14 bp, Homo sapiens
actcccgctgagcc

SEQ ID NO: 190810 - DNA, 21 bp, Homo sapiens
actcccgctgagcccactcta

SEQ ID NO: 190811 - DNA, 18 bp, Homo sapiens
actcctccgagacccagg

SEQ ID NO: 190812 - DNA, 13 bp, Homo sapiens
actctactgcccc

SEQ ID NO: 190813 - DNA, 19 bp, Homo sapiens
ggcacaacttcagcagggg

SEQ ID NO: 190814 - DNA, 21 bp, Homo sapiens
ggcacaacttcagcaggggat

SEQ ID NO: 190815 - DNA, 19 bp, Homo sapiens
ggcatcaggagctgctcag

SEQ ID NO: 190816 - DNA, 13 bp, Homo sapiens
ggcatctccccca

SEQ ID NO: 190817 - DNA, 22 bp, Homo sapiens
ggccgcccacatcgggctcacc

SEQ ID NO: 190818 - DNA, 16 bp, Homo sapiens
ggcctccaaccttctg

SEQ ID NO: 190819 - DNA, 21 bp, Homo sapiens
ggcgctaggggacttggggat

SEQ ID NO: 190820 - DNA, 18 bp, Homo sapiens
ggctcaccttaaaggtca

SEQ ID NO: 190821 - DNA, 14 bp, Homo sapiens
ggctcactgcaggc

SEQ ID NO: 190822 - DNA, 22 bp, Homo sapiens
ggctggcatctcccccaccctg

SEQ ID NO: 190823 - DNA, 18 bp, Homo sapiens
ggcttaaacaacacctcc

SEQ ID NO: 190824 - DNA, 20 bp, Homo sapiens
ggcttaaacaacacctcctc

SEQ ID NO: 190825 - DNA, 12 bp, Homo sapiens
gggacttgggga

SEQ ID NO: 190826 - DNA, 19 bp, Homo sapiens
gggagcggcatgggcgatg

SEQ ID NO: 190827 - DNA, 18 bp, Homo sapiens
gggatcggggtggggaca

SEQ ID NO: 190828 - DNA, 13 bp, Homo sapiens
gggcaagaggaaa

SEQ ID NO: 190829 - DNA, 15 bp, Homo sapiens
gggcacaagcagggc

SEQ ID NO: 190830 - DNA, 23 bp, Homo sapiens
gggcactctgttcccctccccct

SEQ ID NO: 190831 - DNA, 13 bp, Homo sapiens
gggcccccaaaga

SEQ ID NO: 190832 - DNA, 22 bp, Homo sapiens
gggccctgtgccaggccaaaga

SEQ ID NO: 190833 - DNA, 19 bp, Homo sapiens
gggcgatgtcactcagccc

SEQ ID NO: 190834 - DNA, 18 bp, Homo sapiens
gggtggcatcaggagctg

SEQ ID NO: 190835 - DNA, 18 bp, Homo sapiens
ggtcaaggaaggaaaata

SEQ ID NO: 190836 - DNA, 14 bp, Homo sapiens
ggtgctcagcccag

SEQ ID NO: 190837 - DNA, 22 bp, Homo sapiens
ggtgctcagcccaggcacaact

SEQ ID NO: 190838 - DNA, 15 bp, Homo sapiens
ggtgctgcctctcac

SEQ ID NO: 190839 - DNA, 18 bp, Homo sapiens
gtaccaggcccgcactgg

SEQ ID NO: 190840 - DNA, 23 bp, Homo sapiens
gtaccaggcccgcactgggggca

SEQ ID NO: 190841 - DNA, 19 bp, Homo sapiens
gtagaccaggtgctcagcc

SEQ ID NO: 190842 - DNA, 23 bp, Homo sapiens
gtcaaggaaggaaaatactacct

SEQ ID NO: 190843 - DNA, 17 bp, Homo sapiens
gtcactcagccccttcc

SEQ ID NO: 190844 - DNA, 14 bp, Homo sapiens
gtccctagctcaca

SEQ ID NO: 190845 - DNA, 15 bp, Homo sapiens
gtgccaccaagctca

SEQ ID NO: 190846 - DNA, 23 bp, Homo sapiens
gtgcccagcttcgtcagctccag

SEQ ID NO: 190847 - DNA, 14 bp, Homo sapiens
gtgctcagcccagg

SEQ ID NO: 190848 - DNA, 13 bp, Homo sapiens
gttcccctccccc

SEQ ID NO: 190849 - DNA, 21 bp, Homo sapiens
gtttctggggcaactgagagc

SEQ ID NO: 190850 - DNA, 18 bp, Homo sapiens
taaaggtcaaggaaggaa

SEQ ID NO: 190851 - DNA, 21 bp, Homo sapiens
taattggcagcacccactcag

SEQ ID NO: 190852 - DNA, 15 bp, Homo sapiens
tacagccagaggaac

SEQ ID NO: 190853 - DNA, 22 bp, Homo sapiens
tacagccagaggaaccagcact

SEQ ID NO: 190854 - DNA, 19 bp, Homo sapiens
tacatgctctgtccagctt

SEQ ID NO: 190855 - DNA, 19 bp, Homo sapiens
taccaccgcatcctcactg

SEQ ID NO: 190856 - DNA, 17 bp, Homo sapiens
tacctgtcccctatgcc

SEQ ID NO: 190857 - DNA, 20 bp, Homo sapiens
tacctgtcccctatgccact

SEQ ID NO: 190858 - DNA, 15 bp, Homo sapiens
tatcttacagccaga

SEQ ID NO: 190859 - DNA, 17 bp, Homo sapiens
tatgccactaagccaac

SEQ ID NO: 190860 - DNA, 23 bp, Homo sapiens
tcaaccccacaagcaccactctg

SEQ ID NO: 190861 - DNA, 14 bp, Homo sapiens
tcaaggaaggaaaa

SEQ ID NO: 190862 - DNA, 16 bp, Homo sapiens
tcacccagggccccca

SEQ ID NO: 190863 - DNA, 22 bp, Homo sapiens
tcacctggggtgctgcctctca

SEQ ID NO: 190864 - DNA, 21 bp, Homo sapiens
tcactcccgctgagcccactc

SEQ ID NO: 190865 - DNA, 23 bp, Homo sapiens
tcactcccgctgagcccactcta

SEQ ID NO: 190866 - DNA, 17 bp, Homo sapiens
tcactgggctcactgca

SEQ ID NO: 190867 - DNA, 10 bp, Homo sapiens
tcagcagggg

SEQ ID NO: 190868 - DNA, 23 bp, Homo sapiens
tcagctggtagctgggggcgcag

SEQ ID NO: 190869 - DNA, 15 bp, Homo sapiens
tcaggagctgctcag

SEQ ID NO: 190870 - DNA, 22 bp, Homo sapiens
tcaggctggcatctcccccacc

SEQ ID NO: 190871 - DNA, 19 bp, Homo sapiens
tcatcccaacagcccagca

SEQ ID NO: 190872 - DNA, 13 bp, Homo sapiens
tccaaccttctgc

SEQ ID NO: 190873 - DNA, 16 bp, Homo sapiens
tccaaccttctgccct

SEQ ID NO: 190874 - DNA, 14 bp, Homo sapiens
tccaatccccactc

SEQ ID NO: 190875 - DNA, 15 bp, Homo sapiens
tccaatccccactcc

SEQ ID NO: 190876 - DNA, 16 bp, Homo sapiens
tccacatgctctgcag

SEQ ID NO: 190877 - DNA, 13 bp, Homo sapiens
tccatcactgaga

SEQ ID NO: 190878 - DNA, 14 bp, Homo sapiens
tccccactcctccg

SEQ ID NO: 190879 - DNA, 15 bp, Homo sapiens
tcccccatcttcatc

SEQ ID NO: 190880 - DNA, 12 bp, Homo sapiens
tcccctccccct

SEQ ID NO: 190881 - DNA, 14 bp, Homo sapiens
tccctagctcacac

SEQ ID NO: 190882 - DNA, 13 bp, Homo sapiens
tcctcactgggct

SEQ ID NO: 190883 - DNA, 16 bp, Homo sapiens
tcctccaatccccact

SEQ ID NO: 190884 - DNA, 20 bp, Homo sapiens
tcctccaatccccactcctc

SEQ ID NO: 190885 - DNA, 15 bp, Homo sapiens
tcctcctgctgctca

SEQ ID NO: 190886 - DNA, 17 bp, Homo sapiens
tcctcctgctgctcact

SEQ ID NO: 190887 - DNA, 21 bp, Homo sapiens
tcctgccaaaagatctgggga

SEQ ID NO: 190888 - DNA, 23 bp, Homo sapiens
tcctgccaaaagatctggggagt

SEQ ID NO: 190889 - DNA, 15 bp, Homo sapiens
tctcaggctggcatc

SEQ ID NO: 190890 - DNA, 20 bp, Homo sapiens
tctgcagtcctggccccctc

SEQ ID NO: 190891 - DNA, 22 bp, Homo sapiens
tctgccacgtggtggcccagct

SEQ ID NO: 190892 - DNA, 16 bp, Homo sapiens
tctgggcacaagcagg

SEQ ID NO: 190893 - DNA, 21 bp, Homo sapiens
tctggggcaactgagagctga

SEQ ID NO: 190894 - DNA, 18 bp, Homo sapiens
tgagcccactctactgcc

SEQ ID NO: 190895 - DNA, 22 bp, Homo sapiens
tgagcccactctactgccccag

SEQ ID NO: 190896 - DNA, 19 bp, Homo sapiens
tgccaccaagctcacacct

SEQ ID NO: 190897 - DNA, 20 bp, Homo sapiens
tgccaccaagctcacacctg

SEQ ID NO: 190898 - DNA, 21 bp, Homo sapiens
tgccaccaagctcacacctgt

SEQ ID NO: 190899 - DNA, 22 bp, Homo sapiens
tgccaccaagctcacacctgtc

SEQ ID NO: 190900 - DNA, 13 bp, Homo sapiens
tgccctcctgcca

SEQ ID NO: 190901 - DNA, 16 bp, Homo sapiens
tgccctgtccctagct

SEQ ID NO: 190902 - DNA, 21 bp, Homo sapiens
tgccctgtccctagctcacac

SEQ ID NO: 190903 - DNA, 12 bp, Homo sapiens
tgcctctcacac

SEQ ID NO: 190904 - DNA, 17 bp, Homo sapiens
tgctaggtgtctgggat

SEQ ID NO: 190905 - DNA, 17 bp, Homo sapiens
tgctcagcccaggcaca

SEQ ID NO: 190906 - DNA, 16 bp, Homo sapiens
tgctgcctctcacaca

SEQ ID NO: 190907 - DNA, 11 bp, Homo sapiens
tgctgctcact

SEQ ID NO: 190908 - DNA, 23 bp, Homo sapiens
tgcttaccaaaagctcagggccc

SEQ ID NO: 190909 - DNA, 19 bp, Homo sapiens
tggcagcacccactcagcc

SEQ ID NO: 190910 - DNA, 19 bp, Homo sapiens
tggcatcaggagctgctca

SEQ ID NO: 190911 - DNA, 16 bp, Homo sapiens
tggcatctcccccacc

SEQ ID NO: 190912 - DNA, 21 bp, Homo sapiens
tggcatctcccccaccctgtg

SEQ ID NO: 190913 - DNA, 16 bp, Homo sapiens
tggcccagctcctcac

SEQ ID NO: 190914 - DNA, 15 bp, Homo sapiens
aaacagcccttcctt

SEQ ID NO: 190915 - DNA, 21 bp, Homo sapiens
aaacagcccttccttggggaa

SEQ ID NO: 190916 - DNA, 12 bp, Homo sapiens
aacaacacctcc

SEQ ID NO: 190917 - DNA, 15 bp, Homo sapiens
aacacctcctcctgc

SEQ ID NO: 190918 - DNA, 13 bp, Homo sapiens
aaccagcactcca

SEQ ID NO: 190919 - DNA, 19 bp, Homo sapiens
aacttgggaatcattctgg

SEQ ID NO: 190920 - DNA, 11 bp, Homo sapiens
aagaggaaaat

SEQ ID NO: 190921 - DNA, 18 bp, Homo sapiens
aagctcacacctgtcctt

SEQ ID NO: 190922 - DNA, 19 bp, Homo sapiens
aagctcagggccctgtgcc

SEQ ID NO: 190923 - DNA, 12 bp, Homo sapiens
aatccccactcc

SEQ ID NO: 190924 - DNA, 12 bp, Homo sapiens
aatgccctgtcc

SEQ ID NO: 190925 - DNA, 22 bp, Homo sapiens
aatgccctgtccctagctcaca

SEQ ID NO: 190926 - DNA, 19 bp, Homo sapiens
aattggcagcacccactca

SEQ ID NO: 190927 - DNA, 15 bp, Homo sapiens
acaaacagcccttcc

SEQ ID NO: 190928 - DNA, 19 bp, Homo sapiens
acaacacctcctcctgctg

SEQ ID NO: 190929 - DNA, 13 bp, Homo sapiens
acaaggggcctcc

SEQ ID NO: 190930 - DNA, 19 bp, Homo sapiens
acacctcctcctgctgctc

SEQ ID NO: 190931 - DNA, 15 bp, Homo sapiens
acacctgtccttctc

SEQ ID NO: 190932 - DNA, 21 bp, Homo sapiens
acactcatccacacttaagcc

SEQ ID NO: 190933 - DNA, 22 bp, Homo sapiens
accaagctcacacctgtccttc

SEQ ID NO: 190934 - DNA, 16 bp, Homo sapiens
accaggtgctcagccc

SEQ ID NO: 190935 - DNA, 21 bp, Homo sapiens
acccacatatcttacagccag

SEQ ID NO: 190936 - DNA, 19 bp, Homo sapiens
acccactcagccattctct

SEQ ID NO: 190937 - DNA, 21 bp, Homo sapiens
acccaggagacaaacagccct

SEQ ID NO: 190938 - DNA, 14 bp, Homo sapiens
acccagggccccca

SEQ ID NO: 190939 - DNA, 14 bp, Homo sapiens
accctgtgcccctt

SEQ ID NO: 190940 - DNA, 15 bp, Homo sapiens
accgcatcctcactg

SEQ ID NO: 190941 - DNA, 16 bp, Homo sapiens
accgcatcctcactgg

SEQ ID NO: 190942 - DNA, 22 bp, Homo sapiens
accgcatcctcactgggctcac

SEQ ID NO: 190943 - DNA, 12 bp, Homo sapiens
acctcctcctgc

SEQ ID NO: 190944 - DNA, 13 bp, Homo sapiens
acctcctcctgct

SEQ ID NO: 190945 - DNA, 21 bp, Homo sapiens
acctcctcctgctgctcactc

SEQ ID NO: 190946 - DNA, 13 bp, Homo sapiens
acctgtccttctc

SEQ ID NO: 190947 - DNA, 13 bp, Homo sapiens
accttaaaggtca

SEQ ID NO: 190948 - DNA, 11 bp, Homo sapiens
accttctgccc

SEQ ID NO: 190949 - DNA, 17 bp, Homo sapiens
accttctgccctcctgc

SEQ ID NO: 190950 - DNA, 19 bp, Homo sapiens
acgtggtggcccagctcct

SEQ ID NO: 190951 - DNA, 12 bp, Homo sapiens
actcatccacac

SEQ ID NO: 190952 - DNA, 15 bp, Homo sapiens
actcccgctgagccc

SEQ ID NO: 190953 - DNA, 15 bp, Homo sapiens
actctgggcacaagc

SEQ ID NO: 190954 - DNA, 22 bp, Homo sapiens
actctgggcacaagcagggcac

SEQ ID NO: 190955 - DNA, 16 bp, Homo sapiens
actctgttcccctccc

SEQ ID NO: 190956 - DNA, 17 bp, Homo sapiens
actctgttcccctcccc

SEQ ID NO: 190957 - DNA, 18 bp, Homo sapiens
actctgttcccctccccc

SEQ ID NO: 190958 - DNA, 15 bp, Homo sapiens
actgccccagctccg

SEQ ID NO: 190959 - DNA, 13 bp, Homo sapiens
actgggctcactg

SEQ ID NO: 190960 - DNA, 15 bp, Homo sapiens
actgggctcactgca

SEQ ID NO: 190961 - DNA, 21 bp, Homo sapiens
acttcagcaggggatggcgct

SEQ ID NO: 190962 - DNA, 21 bp, Homo sapiens
acttcctccaatccccactcc

SEQ ID NO: 190963 - DNA, 23 bp, Homo sapiens
acttcctccaatccccactcctc

SEQ ID NO: 190964 - DNA, 18 bp, Homo sapiens
agaccaggtgctcagccc

SEQ ID NO: 190965 - DNA, 22 bp, Homo sapiens
agaccaggtgctcagcccaggc

SEQ ID NO: 190966 - DNA, 12 bp, Homo sapiens
agaggacatcac

SEQ ID NO: 190967 - DNA, 12 bp, Homo sapiens
agatctggggag

SEQ ID NO: 190968 - DNA, 18 bp, Homo sapiens
agcaagcgtctgggcaag

SEQ ID NO: 190969 - DNA, 14 bp, Homo sapiens
agcaccactctggg

SEQ ID NO: 190970 - DNA, 17 bp, Homo sapiens
agcaccactctgggcac

SEQ ID NO: 190971 - DNA, 19 bp, Homo sapiens
agcaccactctgggcacaa

SEQ ID NO: 190972 - DNA, 14 bp, Homo sapiens
agcacccactcagc

SEQ ID NO: 190973 - DNA, 17 bp, Homo sapiens
agcactccatcactgag

SEQ ID NO: 190974 - DNA, 23 bp, Homo sapiens
agcagggcactctgttcccctcc

SEQ ID NO: 190975 - DNA, 21 bp, Homo sapiens
agcaggggatggcgctagggg

SEQ ID NO: 190976 - DNA, 11 bp, Homo sapiens
agccaacaacc

SEQ ID NO: 190977 - DNA, 20 bp, Homo sapiens
agccaacaaccacagtgcca

SEQ ID NO: 190978 - DNA, 11 bp, Homo sapiens
agcccttcctt

SEQ ID NO: 190979 - DNA, 16 bp, Homo sapiens
agcccttccttgggga

SEQ ID NO: 190980 - DNA, 16 bp, Homo sapiens
agcgctttgcttacca

SEQ ID NO: 190981 - DNA, 22 bp, Homo sapiens
agcgctttgcttaccaaaagct

SEQ ID NO: 190982 - DNA, 19 bp, Homo sapiens
agcgtctgggcaagaggaa

SEQ ID NO: 190983 - DNA, 20 bp, Homo sapiens
agctcctcacccagggcccc

SEQ ID NO: 190984 - DNA, 21 bp, Homo sapiens
agctcctcacccagggccccc

SEQ ID NO: 190985 - DNA, 22 bp, Homo sapiens
agctcctcacccagggccccca

SEQ ID NO: 190986 - DNA, 23 bp, Homo sapiens
agctcctcacccagggcccccaa

SEQ ID NO: 190987 - DNA, 15 bp, Homo sapiens
agctgggggcgcaga

SEQ ID NO: 190988 - DNA, 20 bp, Homo sapiens
aggagacaaacagcccttcc

SEQ ID NO: 190989 - DNA, 15 bp, Homo sapiens
aggagagggtggcat

SEQ ID NO: 190990 - DNA, 12 bp, Homo sapiens
aggctggcatct

SEQ ID NO: 190991 - DNA, 22 bp, Homo sapiens
aggctggcatctcccccaccct

SEQ ID NO: 190992 - DNA, 16 bp, Homo sapiens
aggcttggcggaggga

SEQ ID NO: 190993 - DNA, 16 bp, Homo sapiens
aggtcaaggaaggaaa

SEQ ID NO: 190994 - DNA, 17 bp, Homo sapiens
aggtcaaggaaggaaaa

SEQ ID NO: 190995 - DNA, 23 bp, Homo sapiens
agtgccaccaagctcacacctgt

SEQ ID NO: 190996 - DNA, 15 bp, Homo sapiens
atatcttacagccag

SEQ ID NO: 190997 - DNA, 19 bp, Homo sapiens
atccacatgctctgcagtc

SEQ ID NO: 190998 - DNA, 15 bp, Homo sapiens
atcccaacagcccag

SEQ ID NO: 190999 - DNA, 13 bp, Homo sapiens
atccccactcctc

SEQ ID NO: 191000 - DNA, 17 bp, Homo sapiens
atctcccccaccctgtg

SEQ ID NO: 191001 - DNA, 20 bp, Homo sapiens
atcttcatcccaacagccca

SEQ ID NO: 191002 - DNA, 21 bp, Homo sapiens
atcttcatcccaacagcccag

SEQ ID NO: 191003 - DNA, 17 bp, Homo sapiens
atgccctgtccctagct

SEQ ID NO: 191004 - DNA, 21 bp, Homo sapiens
atgccctgtccctagctcaca

SEQ ID NO: 191005 - DNA, 12 bp, Homo sapiens
atgctctgtcca

SEQ ID NO: 191006 - DNA, 14 bp, Homo sapiens
attgacttcctcca

SEQ ID NO: 191007 - DNA, 12 bp, Homo sapiens
caaaagctcagg

SEQ ID NO: 191008 - DNA, 14 bp, Homo sapiens
caaaagctcagggc

SEQ ID NO: 191009 - DNA, 21 bp, Homo sapiens
caaacagcccttccttgggga

SEQ ID NO: 191010 - DNA, 20 bp, Homo sapiens
caacagcccagcaagaagga

SEQ ID NO: 191011 - DNA, 16 bp, Homo sapiens
caaccacagtgccacc

SEQ ID NO: 191012 - DNA, 17 bp, Homo sapiens
caaccttctgccctcct

SEQ ID NO: 191013 - DNA, 18 bp, Homo sapiens
caactgagagctgagcgc

SEQ ID NO: 191014 - DNA, 17 bp, Homo sapiens
cacctcctcctgctgct

SEQ ID NO: 191015 - DNA, 19 bp, Homo sapiens
cacctcctcctgctgctca

SEQ ID NO: 191016 - DNA, 22 bp, Homo sapiens
cacctggggtgctgcctctcac

SEQ ID NO: 191017 - DNA, 16 bp, Homo sapiens
cactcagccccttccc

SEQ ID NO: 191018 - DNA, 21 bp, Homo sapiens
cactcccgctgagcccactct

SEQ ID NO: 191019 - DNA, 15 bp, Homo sapiens
cactctactgcccca

SEQ ID NO: 191020 - DNA, 20 bp, Homo sapiens
cactctgttcccctccccct

SEQ ID NO: 191021 - DNA, 23 bp, Homo sapiens
cagaggaaccagcactccatcac

SEQ ID NO: 191022 - DNA, 13 bp, Homo sapiens
cagcacccactca

SEQ ID NO: 191023 - DNA, 14 bp, Homo sapiens
cagcacccactcag

SEQ ID NO: 191024 - DNA, 13 bp, Homo sapiens
cagcaggggatgg

SEQ ID NO: 191025 - DNA, 13 bp, Homo sapiens
cagccccttcccg

SEQ ID NO: 191026 - DNA, 13 bp, Homo sapiens
cagcccttccttg

SEQ ID NO: 191027 - DNA, 16 bp, Homo sapiens
cagctcctcacccagg

SEQ ID NO: 191028 - DNA, 22 bp, Homo sapiens
cagctcctcacccagggccccc

SEQ ID NO: 191029 - DNA, 22 bp, Homo sapiens
cagctggtagctgggggcgcag

SEQ ID NO: 191030 - DNA, 22 bp, Homo sapiens
caggagacaaacagcccttcct

SEQ ID NO: 191031 - DNA, 23 bp, Homo sapiens
caggagacaaacagcccttcctt

SEQ ID NO: 191032 - DNA, 21 bp, Homo sapiens
caggcacaacttcagcagggg

SEQ ID NO: 191033 - DNA, 13 bp, Homo sapiens
caggctggcatct

SEQ ID NO: 191034 - DNA, 19 bp, Homo sapiens
caggctggcatctccccca

SEQ ID NO: 191035 - DNA, 13 bp, Homo sapiens
caggcttggcgga

SEQ ID NO: 191036 - DNA, 17 bp, Homo sapiens
cagggcactctgttccc

SEQ ID NO: 191037 - DNA, 22 bp, Homo sapiens
cagggccctgtgccaggccaaa

SEQ ID NO: 191038 - DNA, 11 bp, Homo sapiens
cagggtgacat

SEQ ID NO: 191039 - DNA, 21 bp, Homo sapiens
caggtgctcagcccaggcaca

SEQ ID NO: 191040 - DNA, 17 bp, Homo sapiens
cagtcctggccccctcg

SEQ ID NO: 191041 - DNA, 16 bp, Homo sapiens
cagtgccaccaagctc

SEQ ID NO: 191042 - DNA, 17 bp, Homo sapiens
cagtgccaccaagctca

SEQ ID NO: 191043 - DNA, 19 bp, Homo sapiens
cagtgccaccaagctcaca

SEQ ID NO: 191044 - DNA, 17 bp, Homo sapiens
catatcttacagccaga

SEQ ID NO: 191045 - DNA, 18 bp, Homo sapiens
catcaggagctgctcagg

SEQ ID NO: 191046 - DNA, 18 bp, Homo sapiens
catcccaacagcccagca

SEQ ID NO: 191047 - DNA, 17 bp, Homo sapiens
catcctcactgggctca

SEQ ID NO: 191048 - DNA, 15 bp, Homo sapiens
catcgggctcacctt

SEQ ID NO: 191049 - DNA, 17 bp, Homo sapiens
catcgggctcaccttaa

SEQ ID NO: 191050 - DNA, 13 bp, Homo sapiens
catctcccccacc

SEQ ID NO: 191051 - DNA, 16 bp, Homo sapiens
catgctctgtccagct

SEQ ID NO: 191052 - DNA, 15 bp, Homo sapiens
cattctgacatccac

SEQ ID NO: 191053 - DNA, 23 bp, Homo sapiens
cattctgacatccacatgctctg

SEQ ID NO: 191054 - DNA, 16 bp, Homo sapiens
ccaaaagatctgggga

SEQ ID NO: 191055 - DNA, 14 bp, Homo sapiens
ccaacagcccagca

SEQ ID NO: 191056 - DNA, 16 bp, Homo sapiens
ccaatccccactcctc

SEQ ID NO: 191057 - DNA, 20 bp, Homo sapiens
ccacatgctctgcagtcctg

SEQ ID NO: 191058 - DNA, 18 bp, Homo sapiens
ccacccacatatcttaca

SEQ ID NO: 191059 - DNA, 17 bp, Homo sapiens
ccaccgcatcctcactg

SEQ ID NO: 191060 - DNA, 17 bp, Homo sapiens
ccactctactgccccag

SEQ ID NO: 191061 - DNA, 19 bp, Homo sapiens
ccactctactgccccagct

SEQ ID NO: 191062 - DNA, 20 bp, Homo sapiens
ccagaggaaccagcactcca

SEQ ID NO: 191063 - DNA, 16 bp, Homo sapiens
ccagcactccatcact

SEQ ID NO: 191064 - DNA, 19 bp, Homo sapiens
ccagcactccatcactgag

SEQ ID NO: 191065 - DNA, 19 bp, Homo sapiens
ccagctccgtttctaccac

SEQ ID NO: 191066 - DNA, 21 bp, Homo sapiens
ccaggcacaacttcagcaggg

SEQ ID NO: 191067 - DNA, 14 bp, Homo sapiens
ccaggcccgcactg

SEQ ID NO: 191068 - DNA, 20 bp, Homo sapiens
ccaggtgctcagcccaggca

SEQ ID NO: 191069 - DNA, 19 bp, Homo sapiens
ccatccttagtacatgctc

SEQ ID NO: 191070 - DNA, 24 bp, Homo sapiens
ccatcttcatcccaacagcccagc

SEQ ID NO: 191071 - DNA, 22 bp, Homo sapiens
ccattctgacatccacatgctc

SEQ ID NO: 191072 - DNA, 19 bp, Homo sapiens
cccacaagcaccactctgg

SEQ ID NO: 191073 - DNA, 20 bp, Homo sapiens
cccacatatcttacagccag

SEQ ID NO: 191074 - DNA, 21 bp, Homo sapiens
cccacatatcttacagccaga

SEQ ID NO: 191075 - DNA, 13 bp, Homo sapiens
cccaccctgtgcc

SEQ ID NO: 191076 - DNA, 21 bp, Homo sapiens
cccactcagccattctctacc

SEQ ID NO: 191077 - DNA, 17 bp, Homo sapiens
cccagcttcgtcagctc

SEQ ID NO: 191078 - DNA, 20 bp, Homo sapiens
cccagcttcgtcagctccag

SEQ ID NO: 191079 - DNA, 21 bp, Homo sapiens
cccaggcacaacttcagcagg

SEQ ID NO: 191080 - DNA, 17 bp, Homo sapiens
ccccacaagcaccactc

SEQ ID NO: 191081 - DNA, 22 bp, Homo sapiens
ccccacaagcaccactctgggc

SEQ ID NO: 191082 - DNA, 13 bp, Homo sapiens
cccccaccctgtg

SEQ ID NO: 191083 - DNA, 15 bp, Homo sapiens
ccccttaagccaaca

SEQ ID NO: 191084 - DNA, 14 bp, Homo sapiens
cccgcttccctcct

SEQ ID NO: 191085 - DNA, 14 bp, Homo sapiens
ccctgtccctagct

SEQ ID NO: 191086 - DNA, 15 bp, Homo sapiens
ccctgtccctagctc

SEQ ID NO: 191087 - DNA, 19 bp, Homo sapiens
ccctgtccctagctcacac

SEQ ID NO: 191088 - DNA, 20 bp, Homo sapiens
ccgcatcctcactgggctca

SEQ ID NO: 191089 - DNA, 12 bp, Homo sapiens
ccgcccgcttcc

SEQ ID NO: 191090 - DNA, 17 bp, Homo sapiens
ccgcccgcttccctcct

SEQ ID NO: 191091 - DNA, 11 bp, Homo sapiens
ccgctgagccc

SEQ ID NO: 191092 - DNA, 19 bp, Homo sapiens
cctagctcacactcatcca

SEQ ID NO: 191093 - DNA, 15 bp, Homo sapiens
cctcacccagggccc

SEQ ID NO: 191094 - DNA, 21 bp, Homo sapiens
cctcacccagggcccccaaag

SEQ ID NO: 191095 - DNA, 16 bp, Homo sapiens
cctcactgggctcact

SEQ ID NO: 191096 - DNA, 17 bp, Homo sapiens
cctccaaccttctgccc

SEQ ID NO: 191097 - DNA, 19 bp, Homo sapiens
cctccaaccttctgccctc

SEQ ID NO: 191098 - DNA, 15 bp, Homo sapiens
cctccaatccccact

SEQ ID NO: 191099 - DNA, 21 bp, Homo sapiens
cctcctcctgctgctcactcc

SEQ ID NO: 191100 - DNA, 14 bp, Homo sapiens
cctcctgctgctca

SEQ ID NO: 191101 - DNA, 16 bp, Homo sapiens
cctcctgctgctcact

SEQ ID NO: 191102 - DNA, 17 bp, Homo sapiens
cctcctgctgctcactc

SEQ ID NO: 191103 - DNA, 11 bp, Homo sapiens
cctctcacaca

SEQ ID NO: 191104 - DNA, 15 bp, Homo sapiens
cctgctgctcactcc

SEQ ID NO: 191105 - DNA, 23 bp, Homo sapiens
cctggggtgctgcctctcacaca

SEQ ID NO: 191106 - DNA, 15 bp, Homo sapiens
cctgtccctagctca

SEQ ID NO: 191107 - DNA, 16 bp, Homo sapiens
cctgtccctagctcac

SEQ ID NO: 191108 - DNA, 23 bp, Homo sapiens
cctgtccctagctcacactcatc

SEQ ID NO: 191109 - DNA, 20 bp, Homo sapiens
ccttagtacatgctctgtcc

SEQ ID NO: 191110 - DNA, 15 bp, Homo sapiens
ccttctcaggctggc

SEQ ID NO: 191111 - DNA, 13 bp, Homo sapiens
ccttctgccctcc

SEQ ID NO: 191112 - DNA, 14 bp, Homo sapiens
cgagacccaggaga

SEQ ID NO: 191113 - DNA, 14 bp, Homo sapiens
aaacagcccttcct

SEQ ID NO: 191114 - DNA, 20 bp, Homo sapiens
aacaaggggcctccaacctt

SEQ ID NO: 191115 - DNA, 14 bp, Homo sapiens
aacacctcctcctg

SEQ ID NO: 191116 - DNA, 20 bp, Homo sapiens
aaccttctgccctcctgcca

SEQ ID NO: 191117 - DNA, 14 bp, Homo sapiens
aacttcagcagggg

SEQ ID NO: 191118 - DNA, 13 bp, Homo sapiens
aagatctggggag

SEQ ID NO: 191119 - DNA, 17 bp, Homo sapiens
aagcaccactctgggca

SEQ ID NO: 191120 - DNA, 21 bp, Homo sapiens
aagcgtctgggcaagaggaaa

SEQ ID NO: 191121 - DNA, 21 bp, Homo sapiens
aagctcacacctgtccttctc

SEQ ID NO: 191122 - DNA, 19 bp, Homo sapiens
aaggaaaatactacctgtc

SEQ ID NO: 191123 - DNA, 17 bp, Homo sapiens
aaggtcaaggaaggaaa

SEQ ID NO: 191124 - DNA, 15 bp, Homo sapiens
aatccccactcctcc

SEQ ID NO: 191125 - DNA, 14 bp, Homo sapiens
acaacacctcctcc

SEQ ID NO: 191126 - DNA, 15 bp, Homo sapiens
acaacacctcctcct

SEQ ID NO: 191127 - DNA, 16 bp, Homo sapiens
acaacacctcctcctg

SEQ ID NO: 191128 - DNA, 21 bp, Homo sapiens
acaacacctcctcctgctgct

SEQ ID NO: 191129 - DNA, 17 bp, Homo sapiens
acaaccacagtgccacc

SEQ ID NO: 191130 - DNA, 16 bp, Homo sapiens
acaacttcagcagggg

SEQ ID NO: 191131 - DNA, 18 bp, Homo sapiens
acaacttcagcaggggat

SEQ ID NO: 191132 - DNA, 14 bp, Homo sapiens
acacctcctcctgc

SEQ ID NO: 191133 - DNA, 17 bp, Homo sapiens
acacctcctcctgctgc

SEQ ID NO: 191134 - DNA, 18 bp, Homo sapiens
acacctcctcctgctgct

SEQ ID NO: 191135 - DNA, 18 bp, Homo sapiens
acagtgccaccaagctca

SEQ ID NO: 191136 - DNA, 15 bp, Homo sapiens
acatcgggctcacct

SEQ ID NO: 191137 - DNA, 12 bp, Homo sapiens
accaaaagctca

SEQ ID NO: 191138 - DNA, 14 bp, Homo sapiens
accacagtgccacc

SEQ ID NO: 191139 - DNA, 16 bp, Homo sapiens
accacagtgccaccaa

SEQ ID NO: 191140 - DNA, 14 bp, Homo sapiens
accaccgcatcctc

SEQ ID NO: 191141 - DNA, 20 bp, Homo sapiens
accaccgcatcctcactggg

SEQ ID NO: 191142 - DNA, 16 bp, Homo sapiens
accaggcccgcactgg

SEQ ID NO: 191143 - DNA, 20 bp, Homo sapiens
accaggcccgcactgggggc

SEQ ID NO: 191144 - DNA, 12 bp, Homo sapiens
acccactcagcc

SEQ ID NO: 191145 - DNA, 20 bp, Homo sapiens
accccacaagcaccactctg

SEQ ID NO: 191146 - DNA, 18 bp, Homo sapiens
acctcctcctgctgctca

SEQ ID NO: 191147 - DNA, 23 bp, Homo sapiens
acctgtcccctatgccactaagc

SEQ ID NO: 191148 - DNA, 13 bp, Homo sapiens
accttctgccctc

SEQ ID NO: 191149 - DNA, 16 bp, Homo sapiens
accttctgccctcctg

SEQ ID NO: 191150 - DNA, 19 bp, Homo sapiens
accttctgccctcctgcca

SEQ ID NO: 191151 - DNA, 15 bp, Homo sapiens
acgtggtggcccagc

SEQ ID NO: 191152 - DNA, 22 bp, Homo sapiens
actacctgtcccctatgccact

SEQ ID NO: 191153 - DNA, 14 bp, Homo sapiens
actcagccattctc

SEQ ID NO: 191154 - DNA, 15 bp, Homo sapiens
actccatcactgaga

SEQ ID NO: 191155 - DNA, 19 bp, Homo sapiens
actcccgctgagcccactc

SEQ ID NO: 191156 - DNA, 20 bp, Homo sapiens
actcccgctgagcccactct

SEQ ID NO: 191157 - DNA, 20 bp, Homo sapiens
actcctccgagacccaggag

SEQ ID NO: 191158 - DNA, 20 bp, Homo sapiens
acttgggaatcattctggct

SEQ ID NO: 191159 - DNA, 20 bp, Homo sapiens
acttggggatttctggtcaa

SEQ ID NO: 191160 - DNA, 17 bp, Homo sapiens
agaccaggtgctcagcc

SEQ ID NO: 191161 - DNA, 14 bp, Homo sapiens
agatgtacacccac

SEQ ID NO: 191162 - DNA, 19 bp, Homo sapiens
agcaagcgtctgggcaaga

SEQ ID NO: 191163 - DNA, 22 bp, Homo sapiens
agccaacaaccacagtgccacc

SEQ ID NO: 191164 - DNA, 22 bp, Homo sapiens
agccaacgtgtgtgtcagctgg

SEQ ID NO: 191165 - DNA, 12 bp, Homo sapiens
agccagaggaac

SEQ ID NO: 191166 - DNA, 19 bp, Homo sapiens
agcccactctactgcccca

SEQ ID NO: 191167 - DNA, 22 bp, Homo sapiens
agcccactctactgccccagct

SEQ ID NO: 191168 - DNA, 13 bp, Homo sapiens
agcccaggcacaa

SEQ ID NO: 191169 - DNA, 16 bp, Homo sapiens
agccctcgtgcacaca

SEQ ID NO: 191170 - DNA, 13 bp, Homo sapiens
agcccttccttgg

SEQ ID NO: 191171 - DNA, 14 bp, Homo sapiens
agctcacacctgtc

SEQ ID NO: 191172 - DNA, 21 bp, Homo sapiens
agctcacacctgtccttctca

SEQ ID NO: 191173 - DNA, 19 bp, Homo sapiens
agctcagggccctgtgcca

SEQ ID NO: 191174 - DNA, 20 bp, Homo sapiens
agctcagggccctgtgccag

SEQ ID NO: 191175 - DNA, 14 bp, Homo sapiens
agctcctcacccag

SEQ ID NO: 191176 - DNA, 14 bp, Homo sapiens
agctgggggcgcag

SEQ ID NO: 191177 - DNA, 14 bp, Homo sapiens
agctggtagctggg

SEQ ID NO: 191178 - DNA, 17 bp, Homo sapiens
agctttccccagggtga

SEQ ID NO: 191179 - DNA, 12 bp, Homo sapiens
aggagctgctca

SEQ ID NO: 191180 - DNA, 20 bp, Homo sapiens
aggcacaacttcagcagggg

SEQ ID NO: 191181 - DNA, 16 bp, Homo sapiens
aggcccgcactggggg

SEQ ID NO: 191182 - DNA, 19 bp, Homo sapiens
aggcccgcactgggggcaa

SEQ ID NO: 191183 - DNA, 18 bp, Homo sapiens
aggctggcatctccccca

SEQ ID NO: 191184 - DNA, 23 bp, Homo sapiens
aggcttggcggagggagcggcat

SEQ ID NO: 191185 - DNA, 13 bp, Homo sapiens
agggagcggcatg

SEQ ID NO: 191186 - DNA, 14 bp, Homo sapiens
agggagcggcatgg

SEQ ID NO: 191187 - DNA, 20 bp, Homo sapiens
agggatgctaggtgtctggg

SEQ ID NO: 191188 - DNA, 21 bp, Homo sapiens
agggcactctgttcccctccc

SEQ ID NO: 191189 - DNA, 15 bp, Homo sapiens
aggtgctcagcccag

SEQ ID NO: 191190 - DNA, 22 bp, Homo sapiens
agtgccaccaagctcacacctg

SEQ ID NO: 191191 - DNA, 15 bp, Homo sapiens
ccgctgagcccactc

SEQ ID NO: 191192 - DNA, 13 bp, Homo sapiens
cctagctcacact

SEQ ID NO: 191193 - DNA, 15 bp, Homo sapiens
cctagctcacactca

SEQ ID NO: 191194 - DNA, 18 bp, Homo sapiens
cctcactgggctcactgc

SEQ ID NO: 191195 - DNA, 19 bp, Homo sapiens
cctcactgggctcactgca

SEQ ID NO: 191196 - DNA, 14 bp, Homo sapiens
cctccaaccttctg

SEQ ID NO: 191197 - DNA, 16 bp, Homo sapiens
cctccaatccccactc

SEQ ID NO: 191198 - DNA, 17 bp, Homo sapiens
cctccaatccccactcc

SEQ ID NO: 191199 - DNA, 19 bp, Homo sapiens
cctccaatccccactcctc

SEQ ID NO: 191200 - DNA, 18 bp, Homo sapiens
cctccgagacccaggaga

SEQ ID NO: 191201 - DNA, 14 bp, Homo sapiens
cctcctcctgctgc

SEQ ID NO: 191202 - DNA, 16 bp, Homo sapiens
cctcctcctgctgctc

SEQ ID NO: 191203 - DNA, 15 bp, Homo sapiens
cctcctgctgctcac

SEQ ID NO: 191204 - DNA, 19 bp, Homo sapiens
cctcctgctgctcactccc

SEQ ID NO: 191205 - DNA, 22 bp, Homo sapiens
cctgccaaaagatctggggagt

SEQ ID NO: 191206 - DNA, 16 bp, Homo sapiens
cctgctgctcactccc

SEQ ID NO: 191207 - DNA, 18 bp, Homo sapiens
cctggccggccgcccaca

SEQ ID NO: 191208 - DNA, 19 bp, Homo sapiens
cctggggtgctgcctctca

SEQ ID NO: 191209 - DNA, 20 bp, Homo sapiens
cctggggtgctgcctctcac

SEQ ID NO: 191210 - DNA, 17 bp, Homo sapiens
cctgtcccctatgccac

SEQ ID NO: 191211 - DNA, 22 bp, Homo sapiens
cctgtcccctatgccactaagc

SEQ ID NO: 191212 - DNA, 13 bp, Homo sapiens
cctgtccctagct

SEQ ID NO: 191213 - DNA, 20 bp, Homo sapiens
cctgtccctagctcacactc

SEQ ID NO: 191214 - DNA, 13 bp, Homo sapiens
cctgtccttctca

SEQ ID NO: 191215 - DNA, 15 bp, Homo sapiens
ccttctgccctcctg

SEQ ID NO: 191216 - DNA, 20 bp, Homo sapiens
cgagacccaggagacaaaca

SEQ ID NO: 191217 - DNA, 22 bp, Homo sapiens
cgatgtcactcagccccttccc

SEQ ID NO: 191218 - DNA, 18 bp, Homo sapiens
gcccgcttccctccttca

SEQ ID NO: 191219 - DNA, 16 bp, Homo sapiens
gccctgtccctagctc

SEQ ID NO: 191220 - DNA, 15 bp, Homo sapiens
gcccttccttgggga

SEQ ID NO: 191221 - DNA, 23 bp, Homo sapiens
gcctccaaccttctgccctcctg

SEQ ID NO: 191222 - DNA, 21 bp, Homo sapiens
gcgatgtcactcagccccttc

SEQ ID NO: 191223 - DNA, 18 bp, Homo sapiens
gctaggggacttggggat

SEQ ID NO: 191224 - DNA, 14 bp, Homo sapiens
gctcacactcatcc

SEQ ID NO: 191225 - DNA, 15 bp, Homo sapiens
gctcacactcatcca

SEQ ID NO: 191226 - DNA, 18 bp, Homo sapiens
gctcactcccgctgagcc

SEQ ID NO: 191227 - DNA, 14 bp, Homo sapiens
gctcactgcaggca

SEQ ID NO: 191228 - DNA, 22 bp, Homo sapiens
gctcactgcaggcatgctgaac

SEQ ID NO: 191229 - DNA, 17 bp, Homo sapiens
gctcaggcttggcggag

SEQ ID NO: 191230 - DNA, 15 bp, Homo sapiens
gctcagggccctgtg

SEQ ID NO: 191231 - DNA, 20 bp, Homo sapiens
gctctgcagtcctggccccc

SEQ ID NO: 191232 - DNA, 23 bp, Homo sapiens
gctgagcccactctactgcccca

SEQ ID NO: 191233 - DNA, 22 bp, Homo sapiens
gctgctcactcccgctgagccc

SEQ ID NO: 191234 - DNA, 22 bp, Homo sapiens
gctggcatctcccccaccctgt

SEQ ID NO: 191235 - DNA, 18 bp, Homo sapiens
gcttaaacaacacctcct

SEQ ID NO: 191236 - DNA, 20 bp, Homo sapiens
gcttaccaaaagctcagggc

SEQ ID NO: 191237 - DNA, 22 bp, Homo sapiens
gctttgcttaccaaaagctcag

SEQ ID NO: 191238 - DNA, 16 bp, Homo sapiens
ggagacaaacagccct

SEQ ID NO: 191239 - DNA, 18 bp, Homo sapiens
ggagacaaacagcccttc

SEQ ID NO: 191240 - DNA, 19 bp, Homo sapiens
ggagacaaacagcccttcc

SEQ ID NO: 191241 - DNA, 20 bp, Homo sapiens
ggatggcgctaggggacttg

SEQ ID NO: 191242 - DNA, 13 bp, Homo sapiens
ggatttctggtca

SEQ ID NO: 191243 - DNA, 14 bp, Homo sapiens
ggcaactgagagct

SEQ ID NO: 191244 - DNA, 14 bp, Homo sapiens
ggcactctgttccc

SEQ ID NO: 191245 - DNA, 19 bp, Homo sapiens
ggcactctgttcccctccc

SEQ ID NO: 191246 - DNA, 14 bp, Homo sapiens
atcattctggctta

SEQ ID NO: 191247 - DNA, 17 bp, Homo sapiens
atcccaacagcccagca

SEQ ID NO: 191248 - DNA, 15 bp, Homo sapiens
atccccactcctccg

SEQ ID NO: 191249 - DNA, 19 bp, Homo sapiens
atctcccccaccctgtgcc

SEQ ID NO: 191250 - DNA, 23 bp, Homo sapiens
atgccctgtccctagctcacact

SEQ ID NO: 191251 - DNA, 16 bp, Homo sapiens
atgctctgtccagctt

SEQ ID NO: 191252 - DNA, 14 bp, Homo sapiens
attcccccatcttc

SEQ ID NO: 191253 - DNA, 12 bp, Homo sapiens
attgacttcctc

SEQ ID NO: 191254 - DNA, 13 bp, Homo sapiens
attgacttcctcc

SEQ ID NO: 191255 - DNA, 22 bp, Homo sapiens
caaaagctcagggccctgtgcc

SEQ ID NO: 191256 - DNA, 17 bp, Homo sapiens
caaacagcccttccttg

SEQ ID NO: 191257 - DNA, 15 bp, Homo sapiens
caacacctcctcctg

SEQ ID NO: 191258 - DNA, 22 bp, Homo sapiens
caacacctcctcctgctgctca

SEQ ID NO: 191259 - DNA, 19 bp, Homo sapiens
caaccccacaagcaccact

SEQ ID NO: 191260 - DNA, 13 bp, Homo sapiens
caaccttctgccc

SEQ ID NO: 191261 - DNA, 19 bp, Homo sapiens
caacgtgtgtgtcagctgg

SEQ ID NO: 191262 - DNA, 20 bp, Homo sapiens
caacgtgtgtgtcagctggt

SEQ ID NO: 191263 - DNA, 14 bp, Homo sapiens
caacttcagcaggg

SEQ ID NO: 191264 - DNA, 16 bp, Homo sapiens
caacttcagcagggga

SEQ ID NO: 191265 - DNA, 23 bp, Homo sapiens
caagaggaaaatgccctgtccct

SEQ ID NO: 191266 - DNA, 15 bp, Homo sapiens
caagcaccactctgg

SEQ ID NO: 191267 - DNA, 16 bp, Homo sapiens
caagcaccactctggg

SEQ ID NO: 191268 - DNA, 21 bp, Homo sapiens
caagcgtctgggcaagaggaa

SEQ ID NO: 191269 - DNA, 17 bp, Homo sapiens
caagctcacacctgtcc

SEQ ID NO: 191270 - DNA, 13 bp, Homo sapiens
caaggaaggaaaa

SEQ ID NO: 191271 - DNA, 18 bp, Homo sapiens
ggcagcacccactcagcc

SEQ ID NO: 191272 - DNA, 13 bp, Homo sapiens
ggcctccaacctt

SEQ ID NO: 191273 - DNA, 16 bp, Homo sapiens
ggctggcatctccccc

SEQ ID NO: 191274 - DNA, 14 bp, Homo sapiens
gggacttggggatt

SEQ ID NO: 191275 - DNA, 17 bp, Homo sapiens
gggcccccaaagagcaa

SEQ ID NO: 191276 - DNA, 21 bp, Homo sapiens
gggccctgtgccaggccaaag

SEQ ID NO: 191277 - DNA, 22 bp, Homo sapiens
gggcctccaaccttctgccctc

SEQ ID NO: 191278 - DNA, 22 bp, Homo sapiens
gggcgatgtcactcagcccctt

SEQ ID NO: 191279 - DNA, 23 bp, Homo sapiens
gggcgatgtcactcagccccttc

SEQ ID NO: 191280 - DNA, 18 bp, Homo sapiens
gggctcactgcaggcatg

SEQ ID NO: 191281 - DNA, 22 bp, Homo sapiens
ggtggcatcaggagctgctcag

SEQ ID NO: 191282 - DNA, 23 bp, Homo sapiens
gtcaaccccacaagcaccactct

SEQ ID NO: 191283 - DNA, 14 bp, Homo sapiens
gtcaaggaaggaaa

SEQ ID NO: 191284 - DNA, 15 bp, Homo sapiens
gtcaaggaaggaaaa

SEQ ID NO: 191285 - DNA, 18 bp, Homo sapiens
gtcactcagccccttccc

SEQ ID NO: 191286 - DNA, 15 bp, Homo sapiens
gtccctagctcacac

SEQ ID NO: 191287 - DNA, 20 bp, Homo sapiens
gtgaggagagggtggcatca

SEQ ID NO: 191288 - DNA, 21 bp, Homo sapiens
gtgcccagcttcgtcagctcc

SEQ ID NO: 191289 - DNA, 13 bp, Homo sapiens
gtgtgaggagagg

SEQ ID NO: 191290 - DNA, 22 bp, Homo sapiens
taagccaacaaccacagtgcca

SEQ ID NO: 191291 - DNA, 16 bp, Homo sapiens
tacatgctctgtccag

SEQ ID NO: 191292 - DNA, 20 bp, Homo sapiens
tactacctgtcccctatgcc

SEQ ID NO: 191293 - DNA, 21 bp, Homo sapiens
tagctcacactcatccacact

SEQ ID NO: 191294 - DNA, 16 bp, Homo sapiens
tatcttacagccagag

SEQ ID NO: 191295 - DNA, 18 bp, Homo sapiens
tcactcagccccttcccg

SEQ ID NO: 191296 - DNA, 21 bp, Homo sapiens
tcactgggctcactgcaggca

SEQ ID NO: 191297 - DNA, 23 bp, Homo sapiens
tcagcaggggatggcgctagggg

SEQ ID NO: 191298 - DNA, 14 bp, Homo sapiens
tcagccccttcccg

SEQ ID NO: 191299 - DNA, 20 bp, Homo sapiens
tcaggctggcatctccccca

SEQ ID NO: 191300 - DNA, 13 bp, Homo sapiens
tcattctggctta

SEQ ID NO: 191301 - DNA, 12 bp, Homo sapiens
tccaaccttctg

SEQ ID NO: 191302 - DNA, 15 bp, Homo sapiens
tccaaccttctgccc

SEQ ID NO: 191303 - DNA, 12 bp, Homo sapiens
tccaatccccac

SEQ ID NO: 191304 - DNA, 13 bp, Homo sapiens
tcccccaccctgt

SEQ ID NO: 191305 - DNA, 19 bp, Homo sapiens
tcccccaccctgtgcccct

SEQ ID NO: 191306 - DNA, 13 bp, Homo sapiens
tcccccatcttca

SEQ ID NO: 191307 - DNA, 17 bp, Homo sapiens
tcccccatcttcatccc

SEQ ID NO: 191308 - DNA, 15 bp, Homo sapiens
tcccctatgccacta

SEQ ID NO: 191309 - DNA, 14 bp, Homo sapiens
tcccgctgagccca

SEQ ID NO: 191310 - DNA, 17 bp, Homo sapiens
tcccgctgagcccactc

SEQ ID NO: 191311 - DNA, 11 bp, Homo sapiens
tccctccttca

SEQ ID NO: 191312 - DNA, 17 bp, Homo sapiens
tcctcactgggctcact

SEQ ID NO: 191313 - DNA, 14 bp, Homo sapiens
tcctcctgctgctc

SEQ ID NO: 191314 - DNA, 18 bp, Homo sapiens
tcctgctgctcactcccg

SEQ ID NO: 191315 - DNA, 20 bp, Homo sapiens
tccttggggaaacttgggaa

SEQ ID NO: 191316 - DNA, 12 bp, Homo sapiens
tcgggctcacct

SEQ ID NO: 191317 - DNA, 22 bp, Homo sapiens
tcgtcattttctttcccagaag

SEQ ID NO: 191318 - DNA, 16 bp, Homo sapiens
tctactgccccagctc

SEQ ID NO: 191319 - DNA, 17 bp, Homo sapiens
tctactgccccagctcc

SEQ ID NO: 191320 - DNA, 13 bp, Homo sapiens
tctcccccaccct

SEQ ID NO: 191321 - DNA, 19 bp, Homo sapiens
tctcccccaccctgtgccc

SEQ ID NO: 191322 - DNA, 14 bp, Homo sapiens
tctgccctcctgcc

SEQ ID NO: 191323 - DNA, 19 bp, Homo sapiens
tctgccctcctgccaaaag

SEQ ID NO: 191324 - DNA, 19 bp, Homo sapiens
tctggcttaaacaacacct

SEQ ID NO: 191325 - DNA, 23 bp, Homo sapiens
tctggcttaaacaacacctcctc

SEQ ID NO: 191326 - DNA, 13 bp, Homo sapiens
tcttacagccaga

SEQ ID NO: 191327 - DNA, 17 bp, Homo sapiens
tgacatccacatgctct

SEQ ID NO: 191328 - DNA, 12 bp, Homo sapiens
tgagagctgagc

SEQ ID NO: 191329 - DNA, 12 bp, Homo sapiens
tgagcccactct

SEQ ID NO: 191330 - DNA, 13 bp, Homo sapiens
tgagcccactcta

SEQ ID NO: 191331 - DNA, 21 bp, Homo sapiens
tgagcccactctactgcccca

SEQ ID NO: 191332 - DNA, 14 bp, Homo sapiens
tgccaccaagctca

SEQ ID NO: 191333 - DNA, 11 bp, Homo sapiens
tgccctcctgc

SEQ ID NO: 191334 - DNA, 23 bp, Homo sapiens
tgctaattggcagcacccactca

SEQ ID NO: 191335 - DNA, 18 bp, Homo sapiens
tgctcaggcttggcggag

SEQ ID NO: 191336 - DNA, 22 bp, Homo sapiens
tgctgctcactcccgctgagcc

SEQ ID NO: 191337 - DNA, 15 bp, Homo sapiens
tgcttaccaaaagct

SEQ ID NO: 191338 - DNA, 18 bp, Homo sapiens
tgcttaccaaaagctcag

SEQ ID NO: 191339 - DNA, 19 bp, Homo sapiens
tgcttaccaaaagctcagg

SEQ ID NO: 191340 - DNA, 21 bp, Homo sapiens
tgcttaccaaaagctcagggc

SEQ ID NO: 191341 - DNA, 16 bp, Homo sapiens
tggcagcacccactca

SEQ ID NO: 191342 - DNA, 18 bp, Homo sapiens
tggcagcacccactcagc

SEQ ID NO: 191343 - DNA, 20 bp, Homo sapiens
tggcatcaggagctgctcag

SEQ ID NO: 191344 - DNA, 21 bp, Homo sapiens
tggcatcaggagctgctcagg

SEQ ID NO: 191345 - DNA, 20 bp, Homo sapiens
tggcatctcccccaccctgt

SEQ ID NO: 191346 - DNA, 12 bp, Homo sapiens
tggcccagctcc

SEQ ID NO: 191347 - DNA, 22 bp, Homo sapiens
tggcttaaacaacacctcctcc

SEQ ID NO: 191348 - DNA, 16 bp, Homo sapiens
tgggaatcattctggc

SEQ ID NO: 191349 - DNA, 13 bp, Homo sapiens
tgggctcactgca

SEQ ID NO: 191350 - DNA, 15 bp, Homo sapiens
tgggctcactgcagg

SEQ ID NO: 191351 - DNA, 15 bp, Homo sapiens
tggggacaggtagac

SEQ ID NO: 191352 - DNA, 21 bp, Homo sapiens
tggggtgctgcctctcacaca

SEQ ID NO: 191353 - DNA, 23 bp, Homo sapiens
tggtaccaggcccgcactggggg

SEQ ID NO: 191354 - DNA, 15 bp, Homo sapiens
tggtggcccagctcc

SEQ ID NO: 191355 - DNA, 21 bp, Homo sapiens
tgtcccctatgccactaagcc

SEQ ID NO: 191356 - DNA, 16 bp, Homo sapiens
tgtccctagctcacac

SEQ ID NO: 191357 - DNA, 17 bp, Homo sapiens
tgtccctagctcacact

SEQ ID NO: 191358 - DNA, 19 bp, Homo sapiens
tgtccctagctcacactca

SEQ ID NO: 191359 - DNA, 22 bp, Homo sapiens
tgtccctagctcacactcatcc

SEQ ID NO: 191360 - DNA, 21 bp, Homo sapiens
tgtgaggagagggtggcatca

SEQ ID NO: 191361 - DNA, 19 bp, Homo sapiens
tgtgccaggccaaagatcc

SEQ ID NO: 191362 - DNA, 20 bp, Homo sapiens
ttattcccccatcttcatcc

SEQ ID NO: 191363 - DNA, 17 bp, Homo sapiens
ttcagatgtacacccac

SEQ ID NO: 191364 - DNA, 23 bp, Homo sapiens
ttcccggtccgcccgcttccctc

SEQ ID NO: 191365 - DNA, 16 bp, Homo sapiens
ttcctccaatccccac

SEQ ID NO: 191366 - DNA, 21 bp, Homo sapiens
ttcctccaatccccactcctc

SEQ ID NO: 191367 - DNA, 12 bp, Homo sapiens
ttccttggggaa

SEQ ID NO: 191368 - DNA, 13 bp, Homo sapiens
ttcgtcagctcca

SEQ ID NO: 191369 - DNA, 14 bp, Homo sapiens
ttcgtttctggggc

SEQ ID NO: 191370 - DNA, 20 bp, Homo sapiens
ttctaccaccgcatcctcac

SEQ ID NO: 191371 - DNA, 16 bp, Homo sapiens
ttctcaggctggcatc

SEQ ID NO: 191372 - DNA, 21 bp, Homo sapiens
ttctgacatccacatgctctg

SEQ ID NO: 191373 - DNA, 14 bp, Homo sapiens
ttctgccctcctgc

SEQ ID NO: 191374 - DNA, 18 bp, Homo sapiens
ttctggggcaactgagag

SEQ ID NO: 191375 - DNA, 13 bp, Homo sapiens
gtggtctttgaat

SEQ ID NO: 191376 - DNA, 14 bp, Homo sapiens
taaagtctgagtgg

SEQ ID NO: 191377 - DNA, 17 bp, Homo sapiens
tacccccgtggtctttg

SEQ ID NO: 191378 - DNA, 18 bp, Homo sapiens
tacccccgtggtctttga

SEQ ID NO: 191379 - DNA, 20 bp, Homo sapiens
tacccccgtggtctttgaat

SEQ ID NO: 191380 - DNA, 22 bp, Homo sapiens
tccccccagcccctcctcccct

SEQ ID NO: 191381 - DNA, 17 bp, Homo sapiens
tccccttcctgcacccg

SEQ ID NO: 191382 - DNA, 17 bp, Homo sapiens
tcctggaggttccccag

SEQ ID NO: 191383 - DNA, 19 bp, Homo sapiens
tcctggaggttccccagcc

SEQ ID NO: 191384 - DNA, 14 bp, Homo sapiens
tcggtggccatgct

SEQ ID NO: 191385 - DNA, 10 bp, Homo sapiens
tctttgaata

SEQ ID NO: 191386 - DNA, 15 bp, Homo sapiens
tctttgaataaagtc

SEQ ID NO: 191387 - DNA, 16 bp, Homo sapiens
tctttgaataaagtct

SEQ ID NO: 191388 - DNA, 13 bp, Homo sapiens
tgaataaagtctg

SEQ ID NO: 191389 - DNA, 14 bp, Homo sapiens
tgaataaagtctga

SEQ ID NO: 191390 - DNA, 15 bp, Homo sapiens
tgaataaagtctgag

SEQ ID NO: 191391 - DNA, 13 bp, Homo sapiens
tgcggcccctccc

SEQ ID NO: 191392 - DNA, 15 bp, Homo sapiens
tgcggcccctccccc

SEQ ID NO: 191393 - DNA, 16 bp, Homo sapiens
tgcttcttgccccttg

SEQ ID NO: 191394 - DNA, 21 bp, Homo sapiens
tgcttcttgccccttgggcct

SEQ ID NO: 191395 - DNA, 20 bp, Homo sapiens
tggagcctcggtggccatgc

SEQ ID NO: 191396 - DNA, 15 bp, Homo sapiens
tggccatgcttcttg

SEQ ID NO: 191397 - DNA, 17 bp, Homo sapiens
tggccatgcttcttgcc

SEQ ID NO: 191398 - DNA, 11 bp, Homo sapiens
tggtctttgaa

SEQ ID NO: 191399 - DNA, 15 bp, Homo sapiens
tggtctttgaataaa

SEQ ID NO: 191400 - DNA, 19 bp, Homo sapiens
tggtctttgaataaagtct

SEQ ID NO: 191401 - DNA, 22 bp, Homo sapiens
tggtctttgaataaagtctgag

SEQ ID NO: 191402 - DNA, 20 bp, Homo sapiens
tgtgtttttacgtagtgtca

SEQ ID NO: 191403 - DNA, 14 bp, Homo sapiens
ttcctgcacccgta

SEQ ID NO: 191404 - DNA, 18 bp, Homo sapiens
ttcttgccccttgggcct

SEQ ID NO: 191405 - DNA, 18 bp, Homo sapiens
ttgaataaagtctgagtg

SEQ ID NO: 191406 - DNA, 16 bp, Homo sapiens
ttgccccttgggcctc

SEQ ID NO: 191407 - DNA, 10 bp, Homo sapiens
tttgaataaa

SEQ ID NO: 191408 - DNA, 16 bp, Homo sapiens
tttgaataaagtctga

SEQ ID NO: 191409 - DNA, 12 bp, Homo sapiens
gcccctcccccg

SEQ ID NO: 191410 - DNA, 20 bp, Homo sapiens
gcccctcctccccttcctgc

SEQ ID NO: 191411 - DNA, 13 bp, Homo sapiens
gccccttgggcct

SEQ ID NO: 191412 - DNA, 15 bp, Homo sapiens
gcctccccccagccc

SEQ ID NO: 191413 - DNA, 20 bp, Homo sapiens
gcctccgggacccccaggac

SEQ ID NO: 191414 - DNA, 14 bp, Homo sapiens
gcctcggtggccat

SEQ ID NO: 191415 - DNA, 16 bp, Homo sapiens
gcctcggtggccatgc

SEQ ID NO: 191416 - DNA, 17 bp, Homo sapiens
gcctcggtggccatgct

SEQ ID NO: 191417 - DNA, 19 bp, Homo sapiens
gcctcggtggccatgcttc

SEQ ID NO: 191418 - DNA, 21 bp, Homo sapiens
gcctcggtggccatgcttctt

SEQ ID NO: 191419 - DNA, 14 bp, Homo sapiens
gcggcccctccccc

SEQ ID NO: 191420 - DNA, 15 bp, Homo sapiens
gctgcggcccctccc

SEQ ID NO: 191421 - DNA, 17 bp, Homo sapiens
gctgcggcccctccccc

SEQ ID NO: 191422 - DNA, 14 bp, Homo sapiens
gcttcttgcccctt

SEQ ID NO: 191423 - DNA, 16 bp, Homo sapiens
gcttcttgccccttgg

SEQ ID NO: 191424 - DNA, 19 bp, Homo sapiens
ggacaggctgcggcccctc

SEQ ID NO: 191425 - DNA, 19 bp, Homo sapiens
ggacccccaggacaggctg

SEQ ID NO: 191426 - DNA, 18 bp, Homo sapiens
ggagcctcggtggccatg

SEQ ID NO: 191427 - DNA, 20 bp, Homo sapiens
ggagcctcggtggccatgct

SEQ ID NO: 191428 - DNA, 9 bp, Homo sapiens
ggaggttcc

SEQ ID NO: 191429 - DNA, 20 bp, Homo sapiens
ggccatgcttcttgcccctt

SEQ ID NO: 191430 - DNA, 18 bp, Homo sapiens
ggctgcggcccctccccc

SEQ ID NO: 191431 - DNA, 13 bp, Homo sapiens
gggacccccagga

SEQ ID NO: 191432 - DNA, 16 bp, Homo sapiens
gggcctccccccagcc

SEQ ID NO: 191433 - DNA, 11 bp, Homo sapiens
ggtctttgaat

SEQ ID NO: 191434 - DNA, 13 bp, Homo sapiens
ggtctttgaataa

SEQ ID NO: 191435 - DNA, 12 bp, Homo sapiens
ggtggccatgct

SEQ ID NO: 191436 - DNA, 16 bp, Homo sapiens
gtaatgcgccaataaa

SEQ ID NO: 191437 - DNA, 22 bp, Homo sapiens
gtacccccgtggtctttgaata

SEQ ID NO: 191438 - DNA, 12 bp, Homo sapiens
gtcatgttctgt

SEQ ID NO: 191439 - DNA, 13 bp, Homo sapiens
gtctgagtgggcg

SEQ ID NO: 191440 - DNA, 14 bp, Homo sapiens
gtctttgaataaag

SEQ ID NO: 191441 - DNA, 17 bp, Homo sapiens
gtctttgaataaagtct

SEQ ID NO: 191442 - DNA, 21 bp, Homo sapiens
gtctttgaataaagtctgagt

SEQ ID NO: 191443 - DNA, 17 bp, Homo sapiens
gtggccatgcttcttgc

SEQ ID NO: 191444 - DNA, 19 bp, Homo sapiens
gtggccatgcttcttgccc

SEQ ID NO: 191445 - DNA, 19 bp, Homo sapiens
gggcctccccccagcccct

SEQ ID NO: 191446 - DNA, 15 bp, Homo sapiens
ggtctttgaataaag

SEQ ID NO: 191447 - DNA, 17 bp, Homo sapiens
ggtctttgaataaagtc

SEQ ID NO: 191448 - DNA, 20 bp, Homo sapiens
ggtctttgaataaagtctga

SEQ ID NO: 191449 - DNA, 19 bp, Homo sapiens
gtacccccgtggtctttga

SEQ ID NO: 191450 - DNA, 11 bp, Homo sapiens
gtggtctttga

SEQ ID NO: 191451 - DNA, 19 bp, Homo sapiens
gtggtctttgaataaagtc

SEQ ID NO: 191452 - DNA, 15 bp, Homo sapiens
gtgtcatgttctgtg

SEQ ID NO: 191453 - DNA, 17 bp, Homo sapiens
taaaccaatgaacgaag

SEQ ID NO: 191454 - DNA, 22 bp, Homo sapiens
tacccccgtggtctttgaataa

SEQ ID NO: 191455 - DNA, 21 bp, Homo sapiens
taccgcgtaatgcgccaataa

SEQ ID NO: 191456 - DNA, 12 bp, Homo sapiens
tccccccagccc

SEQ ID NO: 191457 - DNA, 15 bp, Homo sapiens
tccccccagcccctc

SEQ ID NO: 191458 - DNA, 15 bp, Homo sapiens
tcctccccttcctgc

SEQ ID NO: 191459 - DNA, 18 bp, Homo sapiens
tcctccccttcctgcacc

SEQ ID NO: 191460 - DNA, 19 bp, Homo sapiens
tcctccccttcctgcaccc

SEQ ID NO: 191461 - DNA, 22 bp, Homo sapiens
tcctggaggttccccagcccca

SEQ ID NO: 191462 - DNA, 15 bp, Homo sapiens
tcggtggccatgctt

SEQ ID NO: 191463 - DNA, 12 bp, Homo sapiens
tgaataaagtct

SEQ ID NO: 191464 - DNA, 17 bp, Homo sapiens
tgccccttgggcctccc

SEQ ID NO: 191465 - DNA, 21 bp, Homo sapiens
tgctgagggccgtgtctggtg

SEQ ID NO: 191466 - DNA, 13 bp, Homo sapiens
tgcttcttgcccc

SEQ ID NO: 191467 - DNA, 14 bp, Homo sapiens
tgcttcttgcccct

SEQ ID NO: 191468 - DNA, 15 bp, Homo sapiens
tgcttcttgcccctt

SEQ ID NO: 191469 - DNA, 19 bp, Homo sapiens
tgcttcttgccccttgggc

SEQ ID NO: 191470 - DNA, 18 bp, Homo sapiens
tggagcctcggtggccat

SEQ ID NO: 191471 - DNA, 19 bp, Homo sapiens
tggagcctcggtggccatg

SEQ ID NO: 191472 - DNA, 21 bp, Homo sapiens
tggagcctcggtggccatgct

SEQ ID NO: 191473 - DNA, 16 bp, Homo sapiens
tggccatgcttcttgc

SEQ ID NO: 191474 - DNA, 13 bp, Homo sapiens
aaagtctgagtgg

SEQ ID NO: 191475 - DNA, 18 bp, Homo sapiens
aaagtctgagtgggcggc

SEQ ID NO: 191476 - DNA, 14 bp, Homo sapiens
aataaagtctgagt

SEQ ID NO: 191477 - DNA, 15 bp, Homo sapiens
aatgcgccaataaac

SEQ ID NO: 191478 - DNA, 16 bp, Homo sapiens
acaggctgcggcccct

SEQ ID NO: 191479 - DNA, 19 bp, Homo sapiens
acccccgtggtctttgaat

SEQ ID NO: 191480 - DNA, 21 bp, Homo sapiens
acccccgtggtctttgaataa

SEQ ID NO: 191481 - DNA, 22 bp, Homo sapiens
acccccgtggtctttgaataaa

SEQ ID NO: 191482 - DNA, 17 bp, Homo sapiens
agccccacttaccgcgt

SEQ ID NO: 191483 - DNA, 13 bp, Homo sapiens
agcccctcctccc

SEQ ID NO: 191484 - DNA, 17 bp, Homo sapiens
agcccctcctccccttc

SEQ ID NO: 191485 - DNA, 21 bp, Homo sapiens
agcccctcctccccttcctgc

SEQ ID NO: 191486 - DNA, 15 bp, Homo sapiens
agcctcggtggccat

SEQ ID NO: 191487 - DNA, 16 bp, Homo sapiens
aggacaggctgcggcc

SEQ ID NO: 191488 - DNA, 21 bp, Homo sapiens
aggacaggctgcggcccctcc

SEQ ID NO: 191489 - DNA, 13 bp, Homo sapiens
agtctgagtgggc

SEQ ID NO: 191490 - DNA, 15 bp, Homo sapiens
atgcttcttgcccct

SEQ ID NO: 191491 - DNA, 22 bp, Homo sapiens
atgcttcttgccccttgggcct

SEQ ID NO: 191492 - DNA, 20 bp, Homo sapiens
caataaaccaatgaacgaag

SEQ ID NO: 191493 - DNA, 14 bp, Homo sapiens
cagcccctcctccc

SEQ ID NO: 191494 - DNA, 20 bp, Homo sapiens
cagcccctcctccccttcct

SEQ ID NO: 191495 - DNA, 22 bp, Homo sapiens
cagcccctcctccccttcctgc

SEQ ID NO: 191496 - DNA, 23 bp, Homo sapiens
caggacaggctgcggcccctccc

SEQ ID NO: 191497 - DNA, 19 bp, Homo sapiens
caggctgcggcccctcccc

SEQ ID NO: 191498 - DNA, 20 bp, Homo sapiens
ccaataaaccaatgaacgaa

SEQ ID NO: 191499 - DNA, 13 bp, Homo sapiens
ccagcccctcctc

SEQ ID NO: 191500 - DNA, 24 bp, Homo sapiens
ccagcccctcctccccttcctgca

SEQ ID NO: 191501 - DNA, 13 bp, Homo sapiens
ccaggacaggctg

SEQ ID NO: 191502 - DNA, 19 bp, Homo sapiens
ccatgcttcttgccccttg

SEQ ID NO: 191503 - DNA, 16 bp, Homo sapiens
cccagccccacttacc

SEQ ID NO: 191504 - DNA, 13 bp, Homo sapiens
ccccagccccact

SEQ ID NO: 191505 - DNA, 14 bp, Homo sapiens
ccccagccccactt

SEQ ID NO: 191506 - DNA, 21 bp, Homo sapiens
ccccagcccctcctccccttc

SEQ ID NO: 191507 - DNA, 13 bp, Homo sapiens
ccccaggacaggc

SEQ ID NO: 191508 - DNA, 15 bp, Homo sapiens
ccccaggacaggctg

SEQ ID NO: 191509 - DNA, 14 bp, Homo sapiens
cccccaggacaggc

SEQ ID NO: 191510 - DNA, 15 bp, Homo sapiens
cccccgtggtctttg

SEQ ID NO: 191511 - DNA, 17 bp, Homo sapiens
ccccgtggtctttgaat

SEQ ID NO: 191512 - DNA, 21 bp, Homo sapiens
cccctcctccccttcctgcac

SEQ ID NO: 191513 - DNA, 15 bp, Homo sapiens
ccccttcctgcaccc

SEQ ID NO: 191514 - DNA, 17 bp, Homo sapiens
cccgtacccccgtggtc

SEQ ID NO: 191515 - DNA, 20 bp, Homo sapiens
cccgtacccccgtggtcttt

SEQ ID NO: 191516 - DNA, 17 bp, Homo sapiens
cccgtggtctttgaata

SEQ ID NO: 191517 - DNA, 19 bp, Homo sapiens
cccgtggtctttgaataaa

SEQ ID NO: 191518 - DNA, 20 bp, Homo sapiens
ccctcctccccttcctgcac

SEQ ID NO: 191519 - DNA, 14 bp, Homo sapiens
cccttcctgcaccc

SEQ ID NO: 191520 - DNA, 17 bp, Homo sapiens
ccgcctccgggaccccc

SEQ ID NO: 191521 - DNA, 18 bp, Homo sapiens
ccgcctccgggaccccca

SEQ ID NO: 191522 - DNA, 23 bp, Homo sapiens
ccgcctccgggacccccaggaca

SEQ ID NO: 191523 - DNA, 20 bp, Homo sapiens
ccgtacccccgtggtctttg

SEQ ID NO: 191524 - DNA, 22 bp, Homo sapiens
ccgtacccccgtggtctttgaa

SEQ ID NO: 191525 - DNA, 12 bp, Homo sapiens
ccgtggtctttg

SEQ ID NO: 191526 - DNA, 15 bp, Homo sapiens
ccgtggtctttgaat

SEQ ID NO: 191527 - DNA, 19 bp, Homo sapiens
ccgtggtctttgaataaag

SEQ ID NO: 191528 - DNA, 22 bp, Homo sapiens
ccgtggtctttgaataaagtct

SEQ ID NO: 191529 - DNA, 19 bp, Homo sapiens
cctccccccagcccctcct

SEQ ID NO: 191530 - DNA, 17 bp, Homo sapiens
cctcctccccttcctgc

SEQ ID NO: 191531 - DNA, 21 bp, Homo sapiens
cctcggtggccatgcttcttg

SEQ ID NO: 191532 - DNA, 17 bp, Homo sapiens
cctgcttacctctgttt

SEQ ID NO: 191533 - DNA, 22 bp, Homo sapiens
ccttgggcctccccccagcccc

SEQ ID NO: 191534 - DNA, 17 bp, Homo sapiens
cgcctccgggaccccca

SEQ ID NO: 191535 - DNA, 13 bp, Homo sapiens
cggtggccatgct

SEQ ID NO: 191536 - DNA, 21 bp, Homo sapiens
cgtacccccgtggtctttgaa

SEQ ID NO: 191537 - DNA, 13 bp, Homo sapiens
cgtggtctttgaa

SEQ ID NO: 191538 - DNA, 15 bp, Homo sapiens
cgtggtctttgaata

SEQ ID NO: 191539 - DNA, 16 bp, Homo sapiens
cgtggtctttgaataa

SEQ ID NO: 191540 - DNA, 17 bp, Homo sapiens
cgtggtctttgaataaa

SEQ ID NO: 191541 - DNA, 21 bp, Homo sapiens
cgtggtctttgaataaagtct

SEQ ID NO: 191542 - DNA, 11 bp, Homo sapiens
ctccccttcct

SEQ ID NO: 191543 - DNA, 15 bp, Homo sapiens
ctccccttcctgcac

SEQ ID NO: 191544 - DNA, 16 bp, Homo sapiens
ctccccttcctgcacc

SEQ ID NO: 191545 - DNA, 18 bp, Homo sapiens
ctccccttcctgcacccg

SEQ ID NO: 191546 - DNA, 20 bp, Homo sapiens
ctccccttcctgcacccgta

SEQ ID NO: 191547 - DNA, 17 bp, Homo sapiens
ctccgggacccccagga

SEQ ID NO: 191548 - DNA, 18 bp, Homo sapiens
ctcctccccttcctgcac

SEQ ID NO: 191549 - DNA, 14 bp, Homo sapiens
ctcggtggccatgc

SEQ ID NO: 191550 - DNA, 18 bp, Homo sapiens
ctcggtggccatgcttct

SEQ ID NO: 191551 - DNA, 19 bp, Homo sapiens
ctcggtggccatgcttctt

SEQ ID NO: 191552 - DNA, 16 bp, Homo sapiens
ctgcacccgtaccccc

SEQ ID NO: 191553 - DNA, 16 bp, Homo sapiens
ctgcggcccctccccc

SEQ ID NO: 191554 - DNA, 19 bp, Homo sapiens
ctggagcctcggtggccat

SEQ ID NO: 191555 - DNA, 21 bp, Homo sapiens
ctggagcctcggtggccatgc

SEQ ID NO: 191556 - DNA, 13 bp, Homo sapiens
cttcctgcacccg

SEQ ID NO: 191557 - DNA, 12 bp, Homo sapiens
cttctctgtgtt

SEQ ID NO: 191558 - DNA, 20 bp, Homo sapiens
cttcttgccccttgggcctc

SEQ ID NO: 191559 - DNA, 22 bp, Homo sapiens
cttgggcctccccccagcccct

SEQ ID NO: 191560 - DNA, 16 bp, Homo sapiens
ctttgaataaagtctg

SEQ ID NO: 191561 - DNA, 18 bp, Homo sapiens
ctttgaataaagtctgag

SEQ ID NO: 191562 - DNA, 19 bp, Homo sapiens
ctttgaataaagtctgagt

SEQ ID NO: 191563 - DNA, 19 bp, Homo sapiens
gaataaagtctgagtgggc

SEQ ID NO: 191564 - DNA, 15 bp, Homo sapiens
gacaggctgcggccc

SEQ ID NO: 191565 - DNA, 12 bp, Homo sapiens
gagacttgtgtc

SEQ ID NO: 191566 - DNA, 20 bp, Homo sapiens
gcacccgtacccccgtggtc

SEQ ID NO: 191567 - DNA, 22 bp, Homo sapiens
gcacccgtacccccgtggtctt

SEQ ID NO: 191568 - DNA, 16 bp, Homo sapiens
gccaataaaccaatga

SEQ ID NO: 191569 - DNA, 22 bp, Homo sapiens
gccaataaaccaatgaacgaag

SEQ ID NO: 191570 - DNA, 13 bp, Homo sapiens
gccatgcttcttg

SEQ ID NO: 191571 - DNA, 14 bp, Homo sapiens
gccatgcttcttgc

SEQ ID NO: 191572 - DNA, 15 bp, Homo sapiens
gccatgcttcttgcc

SEQ ID NO: 191573 - DNA, 20 bp, Homo sapiens
gccatgcttcttgccccttg

SEQ ID NO: 191574 - DNA, 22 bp, Homo sapiens
gccatgcttcttgccccttggg

SEQ ID NO: 191575 - DNA, 22 bp, Homo sapiens
gcccctcccccgtcctggaggt

SEQ ID NO: 191576 - DNA, 23 bp, Homo sapiens
gcccctcctccccttcctgcacc

SEQ ID NO: 191577 - DNA, 14 bp, Homo sapiens
gcccttctctgtgt

SEQ ID NO: 191578 - DNA, 18 bp, Homo sapiens
gccgcctccgggaccccc

SEQ ID NO: 191579 - DNA, 19 bp, Homo sapiens
gccgcctccgggaccccca

SEQ ID NO: 191580 - DNA, 22 bp, Homo sapiens
gccgcctccgggacccccagga

SEQ ID NO: 191581 - DNA, 18 bp, Homo sapiens
gcctccccccagcccctc

SEQ ID NO: 191582 - DNA, 18 bp, Homo sapiens
gcctcggtggccatgctt

SEQ ID NO: 191583 - DNA, 20 bp, Homo sapiens
gcctcggtggccatgcttct

SEQ ID NO: 191584 - DNA, 17 bp, Homo sapiens
gcggcccctcccccgtc

SEQ ID NO: 191585 - DNA, 20 bp, Homo sapiens
gctggagcctcggtggccat

SEQ ID NO: 191586 - DNA, 22 bp, Homo sapiens
gctggagcctcggtggccatgc

SEQ ID NO: 191587 - DNA, 23 bp, Homo sapiens
gctggagcctcggtggccatgct

SEQ ID NO: 191588 - DNA, 17 bp, Homo sapiens
gcttcttgccccttggg

SEQ ID NO: 191589 - DNA, 19 bp, Homo sapiens
ggagcctcggtggccatgc

SEQ ID NO: 191590 - DNA, 17 bp, Homo sapiens
ggcccctcccccgtcct

SEQ ID NO: 191591 - DNA, 19 bp, Homo sapiens
ggcctccccccagcccctc

SEQ ID NO: 191592 - DNA, 11 bp, Homo sapiens
gggacccccag

SEQ ID NO: 191593 - DNA, 12 bp, Homo sapiens
ggtctttgaata

SEQ ID NO: 191594 - DNA, 14 bp, Homo sapiens
ggtctttgaataaa

SEQ ID NO: 191595 - DNA, 18 bp, Homo sapiens
ggtctttgaataaagtct

SEQ ID NO: 191596 - DNA, 19 bp, Homo sapiens
ggtggccatgcttcttgcc

SEQ ID NO: 191597 - DNA, 17 bp, Homo sapiens
gtaatgcgccaataaac

SEQ ID NO: 191598 - DNA, 16 bp, Homo sapiens
gtacccccgtggtctt

SEQ ID NO: 191599 - DNA, 20 bp, Homo sapiens
gtacccccgtggtctttgaa

SEQ ID NO: 191600 - DNA, 23 bp, Homo sapiens
gtacccccgtggtctttgaataa

SEQ ID NO: 191601 - DNA, 18 bp, Homo sapiens
gtcctggaggttccccag

SEQ ID NO: 191602 - DNA, 22 bp, Homo sapiens
gtctgctgagggccgtgtctgg

SEQ ID NO: 191603 - DNA, 15 bp, Homo sapiens
gtggccatgcttctt

SEQ ID NO: 191604 - DNA, 12 bp, Homo sapiens
gtggtctttgaa

SEQ ID NO: 191605 - DNA, 17 bp, Homo sapiens
gtggtctttgaataaag

SEQ ID NO: 191606 - DNA, 22 bp, Homo sapiens
gtggtctttgaataaagtctga

SEQ ID NO: 191607 - DNA, 19 bp, Homo sapiens
taaagtctgagtgggcggc

SEQ ID NO: 191608 - DNA, 16 bp, Homo sapiens
tacccccgtggtcttt

SEQ ID NO: 191609 - DNA, 17 bp, Homo sapiens
taccgcgtaatgcgcca

SEQ ID NO: 191610 - DNA, 23 bp, Homo sapiens
taccgcgtaatgcgccaataaac

SEQ ID NO: 191611 - DNA, 14 bp, Homo sapiens
tccccccagcccct

SEQ ID NO: 191612 - DNA, 16 bp, Homo sapiens
tccccttcctgcaccc

SEQ ID NO: 191613 - DNA, 10 bp, Homo sapiens
tcctcccctt

SEQ ID NO: 191614 - DNA, 11 bp, Homo sapiens
tcctccccttc

SEQ ID NO: 191615 - DNA, 13 bp, Homo sapiens
tcctccccttcct

SEQ ID NO: 191616 - DNA, 14 bp, Homo sapiens
tcttgccccttggg

SEQ ID NO: 191617 - DNA, 12 bp, Homo sapiens
tctttgaataaa

SEQ ID NO: 191618 - DNA, 13 bp, Homo sapiens
tctttgaataaag

SEQ ID NO: 191619 - DNA, 14 bp, Homo sapiens
tctttgaataaagt

SEQ ID NO: 191620 - DNA, 17 bp, Homo sapiens
tctttgaataaagtctg

SEQ ID NO: 191621 - DNA, 19 bp, Homo sapiens
tctttgaataaagtctgag

SEQ ID NO: 191622 - DNA, 18 bp, Homo sapiens
tgaataaagtctgagtgg

SEQ ID NO: 191623 - DNA, 20 bp, Homo sapiens
tgaataaagtctgagtgggc

SEQ ID NO: 191624 - DNA, 22 bp, Homo sapiens
tgaataaagtctgagtgggcgg

SEQ ID NO: 191625 - DNA, 18 bp, Homo sapiens
tgagcccttctctgtgtt

SEQ ID NO: 191626 - DNA, 22 bp, Homo sapiens
tgcacccgtacccccgtggtct

SEQ ID NO: 191627 - DNA, 15 bp, Homo sapiens
tgccccttgggcctc

SEQ ID NO: 191628 - DNA, 18 bp, Homo sapiens
tgcggcccctcccccgtc

SEQ ID NO: 191629 - DNA, 15 bp, Homo sapiens
tgcttacctctgttt

SEQ ID NO: 191630 - DNA, 19 bp, Homo sapiens
tggccatgcttcttgcccc

SEQ ID NO: 191631 - DNA, 19 bp, Homo sapiens
tgggcctccccccagcccc

SEQ ID NO: 191632 - DNA, 14 bp, Homo sapiens
tggtctttgaataa

SEQ ID NO: 191633 - DNA, 16 bp, Homo sapiens
tggtctttgaataaag

SEQ ID NO: 191634 - DNA, 17 bp, Homo sapiens
tggtctttgaataaagt

SEQ ID NO: 191635 - DNA, 21 bp, Homo sapiens
ttaccgcgtaatgcgccaata

SEQ ID NO: 191636 - DNA, 15 bp, Homo sapiens
ttcttgccccttggg

SEQ ID NO: 191637 - DNA, 13 bp, Homo sapiens
ttgaataaagtct

SEQ ID NO: 191638 - DNA, 12 bp, Homo sapiens
ttgccccttggg

SEQ ID NO: 191639 - DNA, 19 bp, Homo sapiens
ttgccccttgggcctcccc

SEQ ID NO: 191640 - DNA, 22 bp, Homo sapiens
ttgccccttgggcctcccccca

SEQ ID NO: 191641 - DNA, 12 bp, Homo sapiens
ttgggcctcccc

SEQ ID NO: 191642 - DNA, 13 bp, Homo sapiens
aataaagtctgag

SEQ ID NO: 191643 - DNA, 21 bp, Homo sapiens
acaggctgcggcccctccccc

SEQ ID NO: 191644 - DNA, 12 bp, Homo sapiens
acccccaggaca

SEQ ID NO: 191645 - DNA, 18 bp, Homo sapiens
acccccgtggtctttgaa

SEQ ID NO: 191646 - DNA, 23 bp, Homo sapiens
acccgtacccccgtggtctttga

SEQ ID NO: 191647 - DNA, 16 bp, Homo sapiens
accgcgtaatgcgcca

SEQ ID NO: 191648 - DNA, 13 bp, Homo sapiens
agccccacttacc

SEQ ID NO: 191649 - DNA, 14 bp, Homo sapiens
agcccctcctcccc

SEQ ID NO: 191650 - DNA, 19 bp, Homo sapiens
agcccctcctccccttcct

SEQ ID NO: 191651 - DNA, 12 bp, Homo sapiens
aggacaggctgc

SEQ ID NO: 191652 - DNA, 19 bp, Homo sapiens
aggctgcggcccctccccc

SEQ ID NO: 191653 - DNA, 13 bp, Homo sapiens
ataaagtctgagt

SEQ ID NO: 191654 - DNA, 16 bp, Homo sapiens
atgcgccaataaacca

SEQ ID NO: 191655 - DNA, 18 bp, Homo sapiens
atgcgccaataaaccaat

SEQ ID NO: 191656 - DNA, 19 bp, Homo sapiens
caataaaccaatgaacgaa

SEQ ID NO: 191657 - DNA, 23 bp, Homo sapiens
cacccgtacccccgtggtctttg

SEQ ID NO: 191658 - DNA, 17 bp, Homo sapiens
cagcccctcctcccctt

SEQ ID NO: 191659 - DNA, 21 bp, Homo sapiens
cagcccctcctccccttcctg

SEQ ID NO: 191660 - DNA, 15 bp, Homo sapiens
caggctgcggcccct

SEQ ID NO: 191661 - DNA, 16 bp, Homo sapiens
caggctgcggcccctc

SEQ ID NO: 191662 - DNA, 18 bp, Homo sapiens
caggctgcggcccctccc

SEQ ID NO: 191663 - DNA, 13 bp, Homo sapiens
catgcttcttgcc

SEQ ID NO: 191664 - DNA, 17 bp, Homo sapiens
catgcttcttgcccctt

SEQ ID NO: 191665 - DNA, 11 bp, Homo sapiens
ccagcccctcc

SEQ ID NO: 191666 - DNA, 17 bp, Homo sapiens
ccagcccctcctcccct

SEQ ID NO: 191667 - DNA, 12 bp, Homo sapiens
ccatgcttcttg

SEQ ID NO: 191668 - DNA, 14 bp, Homo sapiens
ccatgcttcttgcc

SEQ ID NO: 191669 - DNA, 18 bp, Homo sapiens
ccatgcttcttgcccctt

SEQ ID NO: 191670 - DNA, 22 bp, Homo sapiens
cccagcccctcctccccttcct

SEQ ID NO: 191671 - DNA, 15 bp, Homo sapiens
ccccagccccactta

SEQ ID NO: 191672 - DNA, 14 bp, Homo sapiens
ccccaggacaggct

SEQ ID NO: 191673 - DNA, 16 bp, Homo sapiens
cccccgtggtctttga

SEQ ID NO: 191674 - DNA, 23 bp, Homo sapiens
ccccgtcctggaggttccccagc

SEQ ID NO: 191675 - DNA, 22 bp, Homo sapiens
ccccgtggtctttgaataaagt

SEQ ID NO: 191676 - DNA, 14 bp, Homo sapiens
ccccttcctgcacc

SEQ ID NO: 191677 - DNA, 13 bp, Homo sapiens
ccccttgggcctc

SEQ ID NO: 191678 - DNA, 15 bp, Homo sapiens
ccccttgggcctccc

SEQ ID NO: 191679 - DNA, 20 bp, Homo sapiens
cccgtggtctttgaataaag

SEQ ID NO: 191680 - DNA, 13 bp, Homo sapiens
ccctcccccgtcc

SEQ ID NO: 191681 - DNA, 15 bp, Homo sapiens
cccttctctgtgttc

SEQ ID NO: 191682 - DNA, 13 bp, Homo sapiens
ccgggacccccag

SEQ ID NO: 191683 - DNA, 15 bp, Homo sapiens
ccgggacccccagga

SEQ ID NO: 191684 - DNA, 19 bp, Homo sapiens
ccgtacccccgtggtcttt

SEQ ID NO: 191685 - DNA, 21 bp, Homo sapiens
ccgtacccccgtggtctttga

SEQ ID NO: 191686 - DNA, 20 bp, Homo sapiens
ccgtcctggaggttccccag

SEQ ID NO: 191687 - DNA, 16 bp, Homo sapiens
ccgtggtctttgaata

SEQ ID NO: 191688 - DNA, 17 bp, Homo sapiens
cctccccccagcccctc

SEQ ID NO: 191689 - DNA, 22 bp, Homo sapiens
cctccccccagcccctcctccc

SEQ ID NO: 191690 - DNA, 13 bp, Homo sapiens
cctccccttcctg

SEQ ID NO: 191691 - DNA, 18 bp, Homo sapiens
cctccccttcctgcaccc

SEQ ID NO: 191692 - DNA, 15 bp, Homo sapiens
cctccgggaccccca

SEQ ID NO: 191693 - DNA, 19 bp, Homo sapiens
cctcctccccttcctgcac

SEQ ID NO: 191694 - DNA, 13 bp, Homo sapiens
cctgcacccgtac

SEQ ID NO: 191695 - DNA, 17 bp, Homo sapiens
cctggaggttccccagc

SEQ ID NO: 191696 - DNA, 14 bp, Homo sapiens
ccttcctgcacccg

SEQ ID NO: 191697 - DNA, 19 bp, Homo sapiens
cgcctccgggacccccagg

SEQ ID NO: 191698 - DNA, 22 bp, Homo sapiens
cgcctccgggacccccaggaca

SEQ ID NO: 191699 - DNA, 20 bp, Homo sapiens
cggtggccatgcttcttgcc

SEQ ID NO: 191700 - DNA, 19 bp, Homo sapiens
cgtacccccgtggtctttg

SEQ ID NO: 191701 - DNA, 22 bp, Homo sapiens
agcctcggtggccatgcttctt

SEQ ID NO: 191702 - DNA, 16 bp, Homo sapiens
aggctgcggcccctcc

SEQ ID NO: 191703 - DNA, 17 bp, Homo sapiens
aggctgcggcccctccc

SEQ ID NO: 191704 - DNA, 18 bp, Homo sapiens
aggctgcggcccctcccc

SEQ ID NO: 191705 - DNA, 17 bp, Homo sapiens
ataaagtctgagtgggc

SEQ ID NO: 191706 - DNA, 14 bp, Homo sapiens
atgcttcttgcccc

SEQ ID NO: 191707 - DNA, 19 bp, Homo sapiens
atgcttcttgccccttggg

SEQ ID NO: 191708 - DNA, 21 bp, Homo sapiens
atgcttcttgccccttgggcc

SEQ ID NO: 191709 - DNA, 16 bp, Homo sapiens
caataaaccaatgaac

SEQ ID NO: 191710 - DNA, 15 bp, Homo sapiens
cagcccctcctcccc

SEQ ID NO: 191711 - DNA, 16 bp, Homo sapiens
cagcccctcctcccct

SEQ ID NO: 191712 - DNA, 18 bp, Homo sapiens
caggacaggctgcggccc

SEQ ID NO: 191713 - DNA, 22 bp, Homo sapiens
caggacaggctgcggcccctcc

SEQ ID NO: 191714 - DNA, 20 bp, Homo sapiens
caggctgcggcccctccccc

SEQ ID NO: 191715 - DNA, 12 bp, Homo sapiens
catgcttcttgc

SEQ ID NO: 191716 - DNA, 19 bp, Homo sapiens
catgcttcttgccccttgg

SEQ ID NO: 191717 - DNA, 15 bp, Homo sapiens
ccagcccctcctccc

SEQ ID NO: 191718 - DNA, 16 bp, Homo sapiens
ccagcccctcctcccc

SEQ ID NO: 191719 - DNA, 22 bp, Homo sapiens
ccagcccctcctccccttcctg

SEQ ID NO: 191720 - DNA, 23 bp, Homo sapiens
ccaggccctgcttacctctgttt

SEQ ID NO: 191721 - DNA, 16 bp, Homo sapiens
cccagcccctcctccc

SEQ ID NO: 191722 - DNA, 19 bp, Homo sapiens
cccagcccctcctcccctt

SEQ ID NO: 191723 - DNA, 19 bp, Homo sapiens
ccccagcccctcctcccct

SEQ ID NO: 191724 - DNA, 13 bp, Homo sapiens
ccccccagcccct

SEQ ID NO: 191725 - DNA, 14 bp, Homo sapiens
cccccgtggtcttt

SEQ ID NO: 191726 - DNA, 17 bp, Homo sapiens
cccccgtggtctttgaa

SEQ ID NO: 191727 - DNA, 21 bp, Homo sapiens
ccccgtggtctttgaataaag

SEQ ID NO: 191728 - DNA, 15 bp, Homo sapiens
cccctcccccgtcct

SEQ ID NO: 191729 - DNA, 20 bp, Homo sapiens
cccctcccccgtcctggagg

SEQ ID NO: 191730 - DNA, 13 bp, Homo sapiens
ccccttcctgcac

SEQ ID NO: 191731 - DNA, 16 bp, Homo sapiens
ccccttcctgcacccg

SEQ ID NO: 191732 - DNA, 12 bp, Homo sapiens
cccgtggtcttt

SEQ ID NO: 191733 - DNA, 21 bp, Homo sapiens
cccgtggtctttgaataaagt

SEQ ID NO: 191734 - DNA, 22 bp, Homo sapiens
ccctcctccccttcctgcaccc

SEQ ID NO: 191735 - DNA, 17 bp, Homo sapiens
cccttgggcctcccccc

SEQ ID NO: 191736 - DNA, 22 bp, Homo sapiens
cccttgggcctccccccagccc

SEQ ID NO: 191737 - DNA, 21 bp, Homo sapiens
ccgcctccgggacccccagga

SEQ ID NO: 191738 - DNA, 22 bp, Homo sapiens
ccgcctccgggacccccaggac

SEQ ID NO: 191739 - DNA, 17 bp, Homo sapiens
ccgggacccccaggaca

SEQ ID NO: 191740 - DNA, 18 bp, Homo sapiens
ccgtggtctttgaataaa

SEQ ID NO: 191741 - DNA, 16 bp, Homo sapiens
cctccccttcctgcac

SEQ ID NO: 191742 - DNA, 18 bp, Homo sapiens
cctccgggacccccagga

SEQ ID NO: 191743 - DNA, 19 bp, Homo sapiens
cctccgggacccccaggac

SEQ ID NO: 191744 - DNA, 16 bp, Homo sapiens
cctcctccccttcctg

SEQ ID NO: 191745 - DNA, 20 bp, Homo sapiens
cctcctccccttcctgcacc

SEQ ID NO: 191746 - DNA, 15 bp, Homo sapiens
cctcggtggccatgc

SEQ ID NO: 191747 - DNA, 17 bp, Homo sapiens
cctcggtggccatgctt

SEQ ID NO: 191748 - DNA, 19 bp, Homo sapiens
cctcggtggccatgcttct

SEQ ID NO: 191749 - DNA, 16 bp, Homo sapiens
cctggaggttccccag

SEQ ID NO: 191750 - DNA, 13 bp, Homo sapiens
ccttgggcctccc

SEQ ID NO: 191751 - DNA, 16 bp, Homo sapiens
cgccaataaaccaatg

SEQ ID NO: 191752 - DNA, 23 bp, Homo sapiens
cgccaataaaccaatgaacgaag

SEQ ID NO: 191753 - DNA, 20 bp, Homo sapiens
cgcctccgggacccccagga

SEQ ID NO: 191754 - DNA, 15 bp, Homo sapiens
cggtggccatgcttc

SEQ ID NO: 191755 - DNA, 18 bp, Homo sapiens
cgtacccccgtggtcttt

SEQ ID NO: 191756 - DNA, 20 bp, Homo sapiens
cgtacccccgtggtctttga

SEQ ID NO: 191757 - DNA, 19 bp, Homo sapiens
cgtggtctttgaataaagt

SEQ ID NO: 191758 - DNA, 21 bp, Homo sapiens
ctccccccagcccctcctccc

SEQ ID NO: 191759 - DNA, 19 bp, Homo sapiens
ctccccttcctgcacccgt

SEQ ID NO: 191760 - DNA, 21 bp, Homo sapiens
ctccccttcctgcacccgtac

SEQ ID NO: 191761 - DNA, 14 bp, Homo sapiens
ctcctccccttcct

SEQ ID NO: 191762 - DNA, 15 bp, Homo sapiens
ctcctccccttcctg

SEQ ID NO: 191763 - DNA, 14 bp, Homo sapiens
ctgcacccgtaccc

SEQ ID NO: 191764 - DNA, 20 bp, Homo sapiens
ctggagcctcggtggccatg

SEQ ID NO: 191765 - DNA, 12 bp, Homo sapiens
cttcttgcccct

SEQ ID NO: 191766 - DNA, 14 bp, Homo sapiens
cttcttgccccttg

SEQ ID NO: 191767 - DNA, 17 bp, Homo sapiens
cttcttgccccttgggc

SEQ ID NO: 191768 - DNA, 19 bp, Homo sapiens
cttgccccttgggcctccc

SEQ ID NO: 191769 - DNA, 20 bp, Homo sapiens
ctttgaataaagtctgagtg

SEQ ID NO: 191770 - DNA, 13 bp, Homo sapiens
gaataaagtctga

SEQ ID NO: 191771 - DNA, 16 bp, Homo sapiens
gaataaagtctgagtg

SEQ ID NO: 191772 - DNA, 18 bp, Homo sapiens
gacaggctgcggcccctc

SEQ ID NO: 191773 - DNA, 12 bp, Homo sapiens
gacccccaggac

SEQ ID NO: 191774 - DNA, 17 bp, Homo sapiens
gagcctcggtggccatg

SEQ ID NO: 191775 - DNA, 18 bp, Homo sapiens
gagcctcggtggccatgc

SEQ ID NO: 191776 - DNA, 19 bp, Homo sapiens
gagcctcggtggccatgct

SEQ ID NO: 191777 - DNA, 21 bp, Homo sapiens
gagtgagcccttctctgtgtt

SEQ ID NO: 191778 - DNA, 17 bp, Homo sapiens
gccatgcttcttgcccc

SEQ ID NO: 191779 - DNA, 21 bp, Homo sapiens
gccatgcttcttgccccttgg

SEQ ID NO: 191780 - DNA, 23 bp, Homo sapiens
gccatgcttcttgccccttgggc

SEQ ID NO: 191781 - DNA, 14 bp, Homo sapiens
gccccacttaccgc

SEQ ID NO: 191782 - DNA, 22 bp, Homo sapiens
cgtacccccgtggtctttgaat

SEQ ID NO: 191783 - DNA, 12 bp, Homo sapiens
cgtggtctttga

SEQ ID NO: 191784 - DNA, 20 bp, Homo sapiens
cgtggtctttgaataaagtc

SEQ ID NO: 191785 - DNA, 22 bp, Homo sapiens
cgtggtctttgaataaagtctg

SEQ ID NO: 191786 - DNA, 23 bp, Homo sapiens
cgtggtctttgaataaagtctga

SEQ ID NO: 191787 - DNA, 13 bp, Homo sapiens
ctccccttcctgc

SEQ ID NO: 191788 - DNA, 14 bp, Homo sapiens
ctccccttcctgca

SEQ ID NO: 191789 - DNA, 14 bp, Homo sapiens
ctccgggaccccca

SEQ ID NO: 191790 - DNA, 15 bp, Homo sapiens
ctccgggacccccag

SEQ ID NO: 191791 - DNA, 16 bp, Homo sapiens
ctccgggacccccagg

SEQ ID NO: 191792 - DNA, 16 bp, Homo sapiens
ctcctccccttcctgc

SEQ ID NO: 191793 - DNA, 13 bp, Homo sapiens
ctcggtggccatg

SEQ ID NO: 191794 - DNA, 23 bp, Homo sapiens
ctctgactccttcggtagctgca

SEQ ID NO: 191795 - DNA, 20 bp, Homo sapiens
ctgcacccgtacccccgtgg

SEQ ID NO: 191796 - DNA, 23 bp, Homo sapiens
ctggagcctcggtggccatgctt

SEQ ID NO: 191797 - DNA, 11 bp, Homo sapiens
cttcctgcacc

SEQ ID NO: 191798 - DNA, 14 bp, Homo sapiens
cttcctgcacccgt

SEQ ID NO: 191799 - DNA, 15 bp, Homo sapiens
cttcctgcacccgta

SEQ ID NO: 191800 - DNA, 13 bp, Homo sapiens
cttcttgcccctt

SEQ ID NO: 191801 - DNA, 15 bp, Homo sapiens
cttcttgccccttgg

SEQ ID NO: 191802 - DNA, 15 bp, Homo sapiens
cttgccccttgggcc

SEQ ID NO: 191803 - DNA, 16 bp, Homo sapiens
cttgccccttgggcct

SEQ ID NO: 191804 - DNA, 18 bp, Homo sapiens
cttgccccttgggcctcc

SEQ ID NO: 191805 - DNA, 17 bp, Homo sapiens
ctttgaataaagtctga

SEQ ID NO: 191806 - DNA, 23 bp, Homo sapiens
gacaggctgcggcccctcccccg

SEQ ID NO: 191807 - DNA, 16 bp, Homo sapiens
gagcctcggtggccat

SEQ ID NO: 191808 - DNA, 23 bp, Homo sapiens
gcacccgtacccccgtggtcttt

SEQ ID NO: 191809 - DNA, 19 bp, Homo sapiens
gccatgcttcttgcccctt

SEQ ID NO: 191810 - DNA, 22 bp, Homo sapiens
gcccctcctccccttcctgcac

SEQ ID NO: 191811 - DNA, 12 bp, Homo sapiens
gccccttgggcc

SEQ ID NO: 191812 - DNA, 15 bp, Homo sapiens
gccccttgggcctcc

SEQ ID NO: 191813 - DNA, 23 bp, Homo sapiens
gccgcctccgggacccccaggac

SEQ ID NO: 191814 - DNA, 17 bp, Homo sapiens
gcctccccccagcccct

SEQ ID NO: 191815 - DNA, 19 bp, Homo sapiens
gcctccccccagcccctcc

SEQ ID NO: 191816 - DNA, 21 bp, Homo sapiens
gcctccccccagcccctcctc

SEQ ID NO: 191817 - DNA, 17 bp, Homo sapiens
gcctccgggacccccag

SEQ ID NO: 191818 - DNA, 15 bp, Homo sapiens
gcctcggtggccatg

SEQ ID NO: 191819 - DNA, 23 bp, Homo sapiens
gcctcggtggccatgcttcttgc

SEQ ID NO: 191820 - DNA, 19 bp, Homo sapiens
gcttcttgccccttgggcc

SEQ ID NO: 191821 - DNA, 21 bp, Homo sapiens
gcttcttgccccttgggcctc

SEQ ID NO: 191822 - DNA, 22 bp, Homo sapiens
gcttcttgccccttgggcctcc

SEQ ID NO: 191823 - DNA, 23 bp, Homo sapiens
gcttcttgccccttgggcctccc

SEQ ID NO: 191824 - DNA, 21 bp, Homo sapiens
ggacaggctgcggcccctccc

SEQ ID NO: 191825 - DNA, 16 bp, Homo sapiens
ggcctccccccagccc

SEQ ID NO: 191826 - DNA, 18 bp, Homo sapiens
ggcctccccccagcccct

SEQ ID NO: 191827 - DNA, 22 bp, Homo sapiens
ggcctccccccagcccctcctc

SEQ ID NO: 191828 - DNA, 23 bp, Homo sapiens
ggcctccccccagcccctcctcc

SEQ ID NO: 191829 - DNA, 12 bp, Homo sapiens
ggctgcggcccc

SEQ ID NO: 191830 - DNA, 17 bp, Homo sapiens
gggcctccccccagccc

SEQ ID NO: 191831 - DNA, 19 bp, Homo sapiens
ggtctttgaataaagtctg

SEQ ID NO: 191832 - DNA, 15 bp, Homo sapiens
ggtggccatgcttct

SEQ ID NO: 191833 - DNA, 17 bp, Homo sapiens
ggtggccatgcttcttg

SEQ ID NO: 191834 - DNA, 17 bp, Homo sapiens
gtacccccgtggtcttt

SEQ ID NO: 191835 - DNA, 12 bp, Homo sapiens
gtctttgaataa

SEQ ID NO: 191836 - DNA, 13 bp, Homo sapiens
gtctttgaataaa

SEQ ID NO: 191837 - DNA, 15 bp, Homo sapiens
gtctttgaataaagt

SEQ ID NO: 191838 - DNA, 16 bp, Homo sapiens
gtctttgaataaagtc

SEQ ID NO: 191839 - DNA, 23 bp, Homo sapiens
gtctttgaataaagtctgagtgg

SEQ ID NO: 191840 - DNA, 12 bp, Homo sapiens
gtggccatgctt

SEQ ID NO: 191841 - DNA, 16 bp, Homo sapiens
gtggccatgcttcttg

SEQ ID NO: 191842 - DNA, 15 bp, Homo sapiens
gtggtctttgaataa

SEQ ID NO: 191843 - DNA, 16 bp, Homo sapiens
gtggtctttgaataaa

SEQ ID NO: 191844 - DNA, 18 bp, Homo sapiens
gtggtctttgaataaagt

SEQ ID NO: 191845 - DNA, 17 bp, Homo sapiens
taatgcgccaataaacc

SEQ ID NO: 191846 - DNA, 15 bp, Homo sapiens
tacccccgtggtctt

SEQ ID NO: 191847 - DNA, 19 bp, Homo sapiens
tacccccgtggtctttgaa

SEQ ID NO: 191848 - DNA, 21 bp, Homo sapiens
tacccccgtggtctttgaata

SEQ ID NO: 191849 - DNA, 18 bp, Homo sapiens
tccccccagcccctcctc

SEQ ID NO: 191850 - DNA, 15 bp, Homo sapiens
tccccttcctgcacc

SEQ ID NO: 191851 - DNA, 18 bp, Homo sapiens
tccccttcctgcacccgt

SEQ ID NO: 191852 - DNA, 19 bp, Homo sapiens
tccccttcctgcacccgta

SEQ ID NO: 191853 - DNA, 13 bp, Homo sapiens
tccgggaccccca

SEQ ID NO: 191854 - DNA, 16 bp, Homo sapiens
tccgggacccccagga

SEQ ID NO: 191855 - DNA, 14 bp, Homo sapiens
tcctccccttcctg

SEQ ID NO: 191856 - DNA, 16 bp, Homo sapiens
tcctccccttcctgca

SEQ ID NO: 191857 - DNA, 12 bp, Homo sapiens
tcggtggccatg

SEQ ID NO: 191858 - DNA, 19 bp, Homo sapiens
tcggtggccatgcttcttg

SEQ ID NO: 191859 - DNA, 14 bp, Homo sapiens
tctgagtgggcggc

SEQ ID NO: 191860 - DNA, 16 bp, Homo sapiens
tcttgccccttgggcc

SEQ ID NO: 191861 - DNA, 18 bp, Homo sapiens
tctttgaataaagtctga

SEQ ID NO: 191862 - DNA, 20 bp, Homo sapiens
tctttgaataaagtctgagt

SEQ ID NO: 191863 - DNA, 19 bp, Homo sapiens
tgaataaagtctgagtggg

SEQ ID NO: 191864 - DNA, 13 bp, Homo sapiens
tgcacccgtaccc

SEQ ID NO: 191865 - DNA, 16 bp, Homo sapiens
tgcggcccctcccccg

SEQ ID NO: 191866 - DNA, 14 bp, Homo sapiens
tggccatgcttctt

SEQ ID NO: 191867 - DNA, 23 bp, Homo sapiens
tggccatgcttcttgccccttgg

SEQ ID NO: 191868 - DNA, 10 bp, Homo sapiens
tggtctttga

SEQ ID NO: 191869 - DNA, 12 bp, Homo sapiens
tggtctttgaat

SEQ ID NO: 191870 - DNA, 23 bp, Homo sapiens
tggtctttgaataaagtctgagt

SEQ ID NO: 191871 - DNA, 11 bp, Homo sapiens
ttcctgcaccc

SEQ ID NO: 191872 - DNA, 12 bp, Homo sapiens
ttcctgcacccg

SEQ ID NO: 191873 - DNA, 14 bp, Homo sapiens
ttgaataaagtctg

SEQ ID NO: 191874 - DNA, 21 bp, Homo sapiens
ttgccccttgggcctcccccc

SEQ ID NO: 191875 - DNA, 13 bp, Homo sapiens
aagtctgagtggg

SEQ ID NO: 191876 - DNA, 16 bp, Homo sapiens
aataaagtctgagtgg

SEQ ID NO: 191877 - DNA, 19 bp, Homo sapiens
acaggctgcggcccctccc

SEQ ID NO: 191878 - DNA, 16 bp, Homo sapiens
acccccgtggtctttg

SEQ ID NO: 191879 - DNA, 17 bp, Homo sapiens
acccccgtggtctttga

SEQ ID NO: 191880 - DNA, 19 bp, Homo sapiens
acccgtacccccgtggtct

SEQ ID NO: 191881 - DNA, 22 bp, Homo sapiens
acccgtacccccgtggtctttg

SEQ ID NO: 191882 - DNA, 20 bp, Homo sapiens
acttaccgcgtaatgcgcca

SEQ ID NO: 191883 - DNA, 16 bp, Homo sapiens
agcccctcctcccctt

SEQ ID NO: 191884 - DNA, 22 bp, Homo sapiens
agcccctcctccccttcctgca

SEQ ID NO: 191885 - DNA, 16 bp, Homo sapiens
agcctcggtggccatg

SEQ ID NO: 191886 - DNA, 18 bp, Homo sapiens
agcctcggtggccatgct

SEQ ID NO: 191887 - DNA, 21 bp, Homo sapiens
agcctcggtggccatgcttct

SEQ ID NO: 191888 - DNA, 18 bp, Homo sapiens
tggccatgcttcttgccc

SEQ ID NO: 191889 - DNA, 21 bp, Homo sapiens
tggccatgcttcttgcccctt

SEQ ID NO: 191890 - DNA, 20 bp, Homo sapiens
tgggcctccccccagcccct

SEQ ID NO: 191891 - DNA, 21 bp, Homo sapiens
tgggcctccccccagcccctc

SEQ ID NO: 191892 - DNA, 13 bp, Homo sapiens
tggtctttgaata

SEQ ID NO: 191893 - DNA, 18 bp, Homo sapiens
tggtctttgaataaagtc

SEQ ID NO: 191894 - DNA, 21 bp, Homo sapiens
tggtctttgaataaagtctga

SEQ ID NO: 191895 - DNA, 22 bp, Homo sapiens
ttaccgcgtaatgcgccaataa

SEQ ID NO: 191896 - DNA, 14 bp, Homo sapiens
ttccccagccccac

SEQ ID NO: 191897 - DNA, 16 bp, Homo sapiens
ttcctgcacccgtacc

SEQ ID NO: 191898 - DNA, 14 bp, Homo sapiens
ttcttgccccttgg

SEQ ID NO: 191899 - DNA, 15 bp, Homo sapiens
ttgaataaagtctga

SEQ ID NO: 191900 - DNA, 16 bp, Homo sapiens
ttgaataaagtctgag

SEQ ID NO: 191901 - DNA, 17 bp, Homo sapiens
ttgaataaagtctgagt

SEQ ID NO: 191902 - DNA, 19 bp, Homo sapiens
ttgaataaagtctgagtgg

SEQ ID NO: 191903 - DNA, 13 bp, Homo sapiens
ttgccccttgggc

SEQ ID NO: 191904 - DNA, 17 bp, Homo sapiens
ttgccccttgggcctcc

SEQ ID NO: 191905 - DNA, 20 bp, Homo sapiens
ttgggcctccccccagcccc

SEQ ID NO: 191906 - DNA, 22 bp, Homo sapiens
ttgggcctccccccagcccctc

SEQ ID NO: 191907 - DNA, 19 bp, Homo sapiens
tttgaataaagtctgagtg

SEQ ID NO: 191908 - DNA, 15 bp, Homo sapiens
aaccaatgaacgaag

SEQ ID NO: 191909 - DNA, 16 bp, Homo sapiens
aacgggccctcctccc

SEQ ID NO: 191910 - DNA, 19 bp, Homo sapiens
aataaaccaatgaacgaag

SEQ ID NO: 191911 - DNA, 18 bp, Homo sapiens
acaggctgcggcccctcc

SEQ ID NO: 191912 - DNA, 24 bp, Homo sapiens
acaggctgcggcccctcccccgtc

SEQ ID NO: 191913 - DNA, 15 bp, Homo sapiens
acccccgtggtcttt

SEQ ID NO: 191914 - DNA, 15 bp, Homo sapiens
acccgtacccccgtg

SEQ ID NO: 191915 - DNA, 21 bp, Homo sapiens
acccgtacccccgtggtcttt

SEQ ID NO: 191916 - DNA, 18 bp, Homo sapiens
agccgttcctcctgcccg

SEQ ID NO: 191917 - DNA, 17 bp, Homo sapiens
agcctcggtggccatgc

SEQ ID NO: 191918 - DNA, 20 bp, Homo sapiens
agcctcggtggccatgcttc

SEQ ID NO: 191919 - DNA, 20 bp, Homo sapiens
aggacaggctgcggcccctc

SEQ ID NO: 191920 - DNA, 17 bp, Homo sapiens
ataaaccaatgaacgaa

SEQ ID NO: 191921 - DNA, 15 bp, Homo sapiens
ataaagtctgagtgg

SEQ ID NO: 191922 - DNA, 15 bp, Homo sapiens
atgcgccaataaacc

SEQ ID NO: 191923 - DNA, 12 bp, Homo sapiens
atgcttcttgcc

SEQ ID NO: 191924 - DNA, 13 bp, Homo sapiens
cagcccctcctcc

SEQ ID NO: 191925 - DNA, 14 bp, Homo sapiens
catgcttcttgccc

SEQ ID NO: 191926 - DNA, 21 bp, Homo sapiens
catgcttcttgccccttgggc

SEQ ID NO: 191927 - DNA, 20 bp, Homo sapiens
ccagcccctcctccccttcc

SEQ ID NO: 191928 - DNA, 23 bp, Homo sapiens
ccagcccctcctccccttcctgc

SEQ ID NO: 191929 - DNA, 20 bp, Homo sapiens
ccaggacaggctgcggcccc

SEQ ID NO: 191930 - DNA, 15 bp, Homo sapiens
ccatgcttcttgccc

SEQ ID NO: 191931 - DNA, 17 bp, Homo sapiens
ccatgcttcttgcccct

SEQ ID NO: 191932 - DNA, 20 bp, Homo sapiens
ccatgcttcttgccccttgg

SEQ ID NO: 191933 - DNA, 21 bp, Homo sapiens
ccatgcttcttgccccttggg

SEQ ID NO: 191934 - DNA, 13 bp, Homo sapiens
cccagccccactt

SEQ ID NO: 191935 - DNA, 21 bp, Homo sapiens
cccagcccctcctccccttcc

SEQ ID NO: 191936 - DNA, 23 bp, Homo sapiens
cccagcccctcctccccttcctg

SEQ ID NO: 191937 - DNA, 18 bp, Homo sapiens
ccccacttaccgcgtaat

SEQ ID NO: 191938 - DNA, 21 bp, Homo sapiens
cccccaggacaggctgcggcc

SEQ ID NO: 191939 - DNA, 12 bp, Homo sapiens
cccctcctcccc

SEQ ID NO: 191940 - DNA, 20 bp, Homo sapiens
ccccttcctgcacccgtacc

SEQ ID NO: 191941 - DNA, 22 bp, Homo sapiens
cccgtacccccgtggtctttga

SEQ ID NO: 191942 - DNA, 13 bp, Homo sapiens
cccgtggtctttg

SEQ ID NO: 191943 - DNA, 14 bp, Homo sapiens
cccgtggtctttga

SEQ ID NO: 191944 - DNA, 15 bp, Homo sapiens
cccgtggtctttgaa

SEQ ID NO: 191945 - DNA, 14 bp, Homo sapiens
ccctcctccccttc

SEQ ID NO: 191946 - DNA, 19 bp, Homo sapiens
ccctcctccccttcctgca

SEQ ID NO: 191947 - DNA, 13 bp, Homo sapiens
cccttcctgcacc

SEQ ID NO: 191948 - DNA, 23 bp, Homo sapiens
ccgtacccccgtggtctttgaat

SEQ ID NO: 191949 - DNA, 14 bp, Homo sapiens
ccgtggtctttgaa

SEQ ID NO: 191950 - DNA, 17 bp, Homo sapiens
ccgtggtctttgaataa

SEQ ID NO: 191951 - DNA, 20 bp, Homo sapiens
ccgtggtctttgaataaagt

SEQ ID NO: 191952 - DNA, 23 bp, Homo sapiens
ccgtggtctttgaataaagtctg

SEQ ID NO: 191953 - DNA, 16 bp, Homo sapiens
cctccccccagcccct

SEQ ID NO: 191954 - DNA, 18 bp, Homo sapiens
cctcccccgtcctggagg

SEQ ID NO: 191955 - DNA, 17 bp, Homo sapiens
cctccccttcctgcacc

SEQ ID NO: 191956 - DNA, 14 bp, Homo sapiens
cctcctccccttcc

SEQ ID NO: 191957 - DNA, 14 bp, Homo sapiens
cctcggtggccatg

SEQ ID NO: 191958 - DNA, 16 bp, Homo sapiens
cctcggtggccatgct

SEQ ID NO: 191959 - DNA, 20 bp, Homo sapiens
cctcggtggccatgcttctt

SEQ ID NO: 191960 - DNA, 22 bp, Homo sapiens
cctcggtggccatgcttcttgc

SEQ ID NO: 191961 - DNA, 15 bp, Homo sapiens
cctgcacccgtaccc

SEQ ID NO: 191962 - DNA, 13 bp, Homo sapiens
ccttcctgcaccc

SEQ ID NO: 191963 - DNA, 23 bp, Homo sapiens
ccttgggcctccccccagcccct

SEQ ID NO: 191964 - DNA, 21 bp, Homo sapiens
cgccgcctccgggacccccag

SEQ ID NO: 191965 - DNA, 12 bp, Homo sapiens
cggtggccatgc

SEQ ID NO: 191966 - DNA, 21 bp, Homo sapiens
cggtggccatgcttcttgccc

SEQ ID NO: 191967 - DNA, 17 bp, Homo sapiens
cgtaatgcgccaataaa

SEQ ID NO: 191968 - DNA, 17 bp, Homo sapiens
cgtacccccgtggtctt

SEQ ID NO: 191969 - DNA, 23 bp, Homo sapiens
cgtacccccgtggtctttgaata

SEQ ID NO: 191970 - DNA, 20 bp, Homo sapiens
cgtcctggaggttccccagc

SEQ ID NO: 191971 - DNA, 14 bp, Homo sapiens
cgtggtctttgaat

SEQ ID NO: 191972 - DNA, 18 bp, Homo sapiens
cgtggtctttgaataaag

SEQ ID NO: 191973 - DNA, 16 bp, Homo sapiens
ctccccccagcccctc

SEQ ID NO: 191974 - DNA, 17 bp, Homo sapiens
ctcccccgtcctggagg

SEQ ID NO: 191975 - DNA, 17 bp, Homo sapiens
ctccccttcctgcaccc

SEQ ID NO: 191976 - DNA, 15 bp, Homo sapiens
ctcggtggccatgct

SEQ ID NO: 191977 - DNA, 16 bp, Homo sapiens
ctcggtggccatgctt

SEQ ID NO: 191978 - DNA, 22 bp, Homo sapiens
ctggagcctcggtggccatgct

SEQ ID NO: 191979 - DNA, 22 bp, Homo sapiens
cttaccgcgtaatgcgccaata

SEQ ID NO: 191980 - DNA, 19 bp, Homo sapiens
cttcttgccccttgggcct

SEQ ID NO: 191981 - DNA, 22 bp, Homo sapiens
cttcttgccccttgggcctccc

SEQ ID NO: 191982 - DNA, 14 bp, Homo sapiens
cttgccccttgggc

SEQ ID NO: 191983 - DNA, 17 bp, Homo sapiens
cttgccccttgggcctc

SEQ ID NO: 191984 - DNA, 21 bp, Homo sapiens
cttgggcctccccccagcccc

SEQ ID NO: 191985 - DNA, 11 bp, Homo sapiens
ctttgaataaa

SEQ ID NO: 191986 - DNA, 13 bp, Homo sapiens
ctttgaataaagt

SEQ ID NO: 191987 - DNA, 14 bp, Homo sapiens
ctttgaataaagtc

SEQ ID NO: 191988 - DNA, 15 bp, Homo sapiens
ctttgaataaagtct

SEQ ID NO: 191989 - DNA, 14 bp, Homo sapiens
gaataaagtctgag

SEQ ID NO: 191990 - DNA, 17 bp, Homo sapiens
gaataaagtctgagtgg

SEQ ID NO: 191991 - DNA, 18 bp, Homo sapiens
gaataaagtctgagtggg

SEQ ID NO: 191992 - DNA, 22 bp, Homo sapiens
gacaggctgcggcccctccccc

SEQ ID NO: 191993 - DNA, 13 bp, Homo sapiens
gacccccaggaca

SEQ ID NO: 191994 - DNA, 17 bp, Homo sapiens
gagtgagcccttctctg

SEQ ID NO: 191995 - DNA, 14 bp, Homo sapiens
gcacccgtaccccc

SEQ ID NO: 191996 - DNA, 19 bp, Homo sapiens
gccaataaaccaatgaacg

SEQ ID NO: 191997 - DNA, 16 bp, Homo sapiens
gccatgcttcttgccc

SEQ ID NO: 191998 - DNA, 18 bp, Homo sapiens
gccatgcttcttgcccct

SEQ ID NO: 191999 - DNA, 19 bp, Homo sapiens
gcccctcccccgtcctgga

SEQ ID NO: 192000 - DNA, 14 bp, Homo sapiens
gcccctcctcccct

SEQ ID NO: 192001 - DNA, 15 bp, Homo sapiens
gcccctcctcccctt

SEQ ID NO: 192002 - DNA, 16 bp, Homo sapiens
gcccctcctccccttc

SEQ ID NO: 192003 - DNA, 19 bp, Homo sapiens
gccctgcttacctctgttt

SEQ ID NO: 192004 - DNA, 15 bp, Homo sapiens
gcctccgggaccccc

SEQ ID NO: 192005 - DNA, 16 bp, Homo sapiens
gcctccgggaccccca

SEQ ID NO: 192006 - DNA, 18 bp, Homo sapiens
gcctccgggacccccagg

SEQ ID NO: 192007 - DNA, 19 bp, Homo sapiens
gcctccgggacccccagga

SEQ ID NO: 192008 - DNA, 13 bp, Homo sapiens
gcgccaataaacc

SEQ ID NO: 192009 - DNA, 21 bp, Homo sapiens
gctggagcctcggtggccatg

SEQ ID NO: 192010 - DNA, 12 bp, Homo sapiens
gcttcttgcccc

SEQ ID NO: 192011 - DNA, 13 bp, Homo sapiens
gcttcttgcccct

SEQ ID NO: 192012 - DNA, 15 bp, Homo sapiens
gcttcttgccccttg

SEQ ID NO: 192013 - DNA, 22 bp, Homo sapiens
ggacaggctgcggcccctcccc

SEQ ID NO: 192014 - DNA, 17 bp, Homo sapiens
ggccatgcttcttgccc

SEQ ID NO: 192015 - DNA, 19 bp, Homo sapiens
ggccatgcttcttgcccct

SEQ ID NO: 192016 - DNA, 21 bp, Homo sapiens
ggccatgcttcttgccccttg

SEQ ID NO: 192017 - DNA, 22 bp, Homo sapiens
ggccatgcttcttgccccttgg

SEQ ID NO: 192018 - DNA, 13 bp, Homo sapiens
ggcccctcccccg

SEQ ID NO: 192019 - DNA, 14 bp, Homo sapiens
aattcttccctggg

SEQ ID NO: 192020 - DNA, 16 bp, Homo sapiens
aattcttccctggggg

SEQ ID NO: 192021 - DNA, 15 bp, Homo sapiens
aattcttgaaggaaa

SEQ ID NO: 192022 - DNA, 16 bp, Homo sapiens
aattcttgaaggaaaa

SEQ ID NO: 192023 - DNA, 14 bp, Homo sapiens
aattgaaaaggact

SEQ ID NO: 192024 - DNA, 14 bp, Homo sapiens
aattgaagaaaatc

SEQ ID NO: 192025 - DNA, 21 bp, Homo sapiens
aattgaatgtcaatatgagat

SEQ ID NO: 192026 - DNA, 17 bp, Homo sapiens
aattgacagggaaaata

SEQ ID NO: 192027 - DNA, 20 bp, Homo sapiens
aattgacatgttgtcacatt

SEQ ID NO: 192028 - DNA, 15 bp, Homo sapiens
aattgactcaaatct

SEQ ID NO: 192029 - DNA, 15 bp, Homo sapiens
aattgagattagagg

SEQ ID NO: 192030 - DNA, 14 bp, Homo sapiens
aattgataataaac

SEQ ID NO: 192031 - DNA, 14 bp, Homo sapiens
aattgatcattcat

SEQ ID NO: 192032 - DNA, 23 bp, Homo sapiens
aattgatgtatatgtttatatac

SEQ ID NO: 192033 - DNA, 14 bp, Homo sapiens
aattgatgtgttta

SEQ ID NO: 192034 - DNA, 14 bp, Homo sapiens
aattgattaaactg

SEQ ID NO: 192035 - DNA, 23 bp, Homo sapiens
aattgattaaactgtatgtctta

SEQ ID NO: 192036 - DNA, 14 bp, Homo sapiens
aattgcaaagaaaa

SEQ ID NO: 192037 - DNA, 21 bp, Homo sapiens
aattgcaaagaaaattctcaa

SEQ ID NO: 192038 - DNA, 14 bp, Homo sapiens
aattgcacaaatac

SEQ ID NO: 192039 - DNA, 16 bp, Homo sapiens
aattgcacaaatacaa

SEQ ID NO: 192040 - DNA, 20 bp, Homo sapiens
aattgcagataactttgact

SEQ ID NO: 192041 - DNA, 17 bp, Homo sapiens
aattgcagcagttgcta

SEQ ID NO: 192042 - DNA, 16 bp, Homo sapiens
aattgcataaagcata

SEQ ID NO: 192043 - DNA, 20 bp, Homo sapiens
aattgcattttttaaaacaa

SEQ ID NO: 192044 - DNA, 18 bp, Homo sapiens
aattgcctcccttcctcc

SEQ ID NO: 192045 - DNA, 14 bp, Homo sapiens
aattgctgagatgt

SEQ ID NO: 192046 - DNA, 17 bp, Homo sapiens
aattgcttttgttgtga

SEQ ID NO: 192047 - DNA, 22 bp, Homo sapiens
aattgcttttgttgtgactttt

SEQ ID NO: 192048 - DNA, 22 bp, Homo sapiens
aattggacagttttgatacaaa

SEQ ID NO: 192049 - DNA, 13 bp, Homo sapiens
aattggcattaaa

SEQ ID NO: 192050 - DNA, 16 bp, Homo sapiens
aattggctcctttccc

SEQ ID NO: 192051 - DNA, 18 bp, Homo sapiens
aattggctcctttcccac

SEQ ID NO: 192052 - DNA, 23 bp, Homo sapiens
aattggcttgtttaaggttcttg

SEQ ID NO: 192053 - DNA, 17 bp, Homo sapiens
aattgggtgtgccctgg

SEQ ID NO: 192054 - DNA, 14 bp, Homo sapiens
aattggtgtatatc

SEQ ID NO: 192055 - DNA, 16 bp, Homo sapiens
aattggttaatcactt

SEQ ID NO: 192056 - DNA, 17 bp, Homo sapiens
aattgtaaaactgaggc

SEQ ID NO: 192057 - DNA, 11 bp, Homo sapiens
aattgtaaaag

SEQ ID NO: 192058 - DNA, 21 bp, Homo sapiens
aattgtagcccagttggtcaa

SEQ ID NO: 192059 - DNA, 12 bp, Homo sapiens
aattgtgaaaaa

SEQ ID NO: 192060 - DNA, 13 bp, Homo sapiens
aattgtggagagg

SEQ ID NO: 192061 - DNA, 15 bp, Homo sapiens
aattgtgtacaaagt

SEQ ID NO: 192062 - DNA, 21 bp, Homo sapiens
aattgtgtacaaagtagagaa

SEQ ID NO: 192063 - DNA, 21 bp, Homo sapiens
aattgtgtggtcagtggctct

SEQ ID NO: 192064 - DNA, 14 bp, Homo sapiens
aattgttacaattt

SEQ ID NO: 192065 - DNA, 19 bp, Homo sapiens
aattgttcctgatgtgcca

SEQ ID NO: 192066 - DNA, 14 bp, Homo sapiens
aattgttctgggtg

SEQ ID NO: 192067 - DNA, 21 bp, Homo sapiens
aattgttgaaactaaagcact

SEQ ID NO: 192068 - DNA, 15 bp, Homo sapiens
aattgtttaaaagca

SEQ ID NO: 192069 - DNA, 20 bp, Homo sapiens
aattgttttgcactttttta

SEQ ID NO: 192070 - DNA, 17 bp, Homo sapiens
aattgtttttgaattta

SEQ ID NO: 192071 - DNA, 17 bp, Homo sapiens
aatttaaaaaaatacag

SEQ ID NO: 192072 - DNA, 12 bp, Homo sapiens
aatttaaaaaac

SEQ ID NO: 192073 - DNA, 18 bp, Homo sapiens
aatttaaaaaactcctgt

SEQ ID NO: 192074 - DNA, 14 bp, Homo sapiens
aatttaaaaaataa

SEQ ID NO: 192075 - DNA, 12 bp, Homo sapiens
aatttaaaacaa

SEQ ID NO: 192076 - DNA, 15 bp, Homo sapiens
aatttaaaacaaaca

SEQ ID NO: 192077 - DNA, 22 bp, Homo sapiens
aatttaaaatcattcaatatct

SEQ ID NO: 192078 - DNA, 12 bp, Homo sapiens
aatttaaataaa

SEQ ID NO: 192079 - DNA, 23 bp, Homo sapiens
aatttaaatataattctgtaaat

SEQ ID NO: 192080 - DNA, 22 bp, Homo sapiens
aatttaactgcatatagataat

SEQ ID NO: 192081 - DNA, 23 bp, Homo sapiens
aatttaagccaataaataatatt

SEQ ID NO: 192082 - DNA, 17 bp, Homo sapiens
aatttaaggaacacaga

SEQ ID NO: 192083 - DNA, 14 bp, Homo sapiens
aatttaagtatctt

SEQ ID NO: 192084 - DNA, 17 bp, Homo sapiens
aatttaatatactgcat

SEQ ID NO: 192085 - DNA, 21 bp, Homo sapiens
aatttaattaggggttgctaa

SEQ ID NO: 192086 - DNA, 16 bp, Homo sapiens
aatttacatcatttct

SEQ ID NO: 192087 - DNA, 15 bp, Homo sapiens
aatttacctgaagtc

SEQ ID NO: 192088 - DNA, 17 bp, Homo sapiens
aatttacctttaaaata

SEQ ID NO: 192089 - DNA, 17 bp, Homo sapiens
aatttacgtatatttca

SEQ ID NO: 192090 - DNA, 22 bp, Homo sapiens
aatttactttttaaacagtgtt

SEQ ID NO: 192091 - DNA, 23 bp, Homo sapiens
aatttactttttaaacagtgttt

SEQ ID NO: 192092 - DNA, 22 bp, Homo sapiens
aatttaggaatgctcaatgtgc

SEQ ID NO: 192093 - DNA, 13 bp, Homo sapiens
aatttagtcatta

SEQ ID NO: 192094 - DNA, 19 bp, Homo sapiens
aatttataacaattgattt

SEQ ID NO: 192095 - DNA, 15 bp, Homo sapiens
aatttatagtttata

SEQ ID NO: 192096 - DNA, 17 bp, Homo sapiens
aatttatcacacttctg

SEQ ID NO: 192097 - DNA, 22 bp, Homo sapiens
aatttatcagattgcttttgtg

SEQ ID NO: 192098 - DNA, 17 bp, Homo sapiens
aatttattagttaatat

SEQ ID NO: 192099 - DNA, 18 bp, Homo sapiens
aatttattagttaatata

SEQ ID NO: 192100 - DNA, 21 bp, Homo sapiens
aatttattcaattcctctggg

SEQ ID NO: 192101 - DNA, 22 bp, Homo sapiens
aatttatttattaagatggatt

SEQ ID NO: 192102 - DNA, 12 bp, Homo sapiens
aatttattttgt

SEQ ID NO: 192103 - DNA, 15 bp, Homo sapiens
aatttcaaaaatata

SEQ ID NO: 192104 - DNA, 19 bp, Homo sapiens
aatttcaaaaatataactt

SEQ ID NO: 192105 - DNA, 13 bp, Homo sapiens
aatttcaaaatgc

SEQ ID NO: 192106 - DNA, 17 bp, Homo sapiens
aatttcaaaatgcatgt

SEQ ID NO: 192107 - DNA, 15 bp, Homo sapiens
aatttcaatttgttc

SEQ ID NO: 192108 - DNA, 12 bp, Homo sapiens
aatttcataaat

SEQ ID NO: 192109 - DNA, 15 bp, Homo sapiens
aatttcataaattgg

SEQ ID NO: 192110 - DNA, 16 bp, Homo sapiens
aatttcataaattggc

SEQ ID NO: 192111 - DNA, 20 bp, Homo sapiens
aatttcataaattggctcct

SEQ ID NO: 192112 - DNA, 17 bp, Homo sapiens
aatttcatctttccaaa

SEQ ID NO: 192113 - DNA, 18 bp, Homo sapiens
aatttcatctttccaaat

SEQ ID NO: 192114 - DNA, 15 bp, Homo sapiens
aatttcattgtctct

SEQ ID NO: 192115 - DNA, 21 bp, Homo sapiens
aatttccacaaaatctgtcca

SEQ ID NO: 192116 - DNA, 20 bp, Homo sapiens
aatttccagtacctttgtca

SEQ ID NO: 192117 - DNA, 15 bp, Homo sapiens
aatttcccaaagcag

SEQ ID NO: 192118 - DNA, 21 bp, Homo sapiens
aatttcccacaccccagcgcc

SEQ ID NO: 192119 - DNA, 16 bp, Homo sapiens
aatttcctatctgtat

SEQ ID NO: 192120 - DNA, 21 bp, Homo sapiens
aatttcctttatatttagtga

SEQ ID NO: 192121 - DNA, 22 bp, Homo sapiens
aatttctcacaatagacagaaa

SEQ ID NO: 192122 - DNA, 20 bp, Homo sapiens
aatttctcagtttttgctga

SEQ ID NO: 192123 - DNA, 21 bp, Homo sapiens
aatttctcccgaatcctgagg

SEQ ID NO: 192124 - DNA, 23 bp, Homo sapiens
aatttctcttaagtactgaaata

SEQ ID NO: 192125 - DNA, 19 bp, Homo sapiens
aatttctgggatatttaac

SEQ ID NO: 192126 - DNA, 14 bp, Homo sapiens
aatttctgtccaga

SEQ ID NO: 192127 - DNA, 20 bp, Homo sapiens
aatttcttactaaacatttt

SEQ ID NO: 192128 - DNA, 20 bp, Homo sapiens
aatttcttcactgttgaaaa

SEQ ID NO: 192129 - DNA, 15 bp, Homo sapiens
aatttgaatgaaaaa

SEQ ID NO: 192130 - DNA, 16 bp, Homo sapiens
aatttgaatgaaaaat

SEQ ID NO: 192131 - DNA, 18 bp, Homo sapiens
aatttgaatggattaaat

SEQ ID NO: 192132 - DNA, 22 bp, Homo sapiens
aatttgaatggattaaatggca

SEQ ID NO: 192133 - DNA, 23 bp, Homo sapiens
aatttgatggtgaatattacatt

SEQ ID NO: 192134 - DNA, 23 bp, Homo sapiens
aatttgcatattctattgtatta

SEQ ID NO: 192135 - DNA, 13 bp, Homo sapiens
aatttgctgctga

SEQ ID NO: 192136 - DNA, 15 bp, Homo sapiens
aatttgggcatctct

SEQ ID NO: 192137 - DNA, 18 bp, Homo sapiens
aatttgggggaaaattta

SEQ ID NO: 192138 - DNA, 17 bp, Homo sapiens
aatttgggtcccagcta

SEQ ID NO: 192139 - DNA, 22 bp, Homo sapiens
aatttggtcttagctttacatt

SEQ ID NO: 192140 - DNA, 22 bp, Homo sapiens
aatttggttctaatagaactca

SEQ ID NO: 192141 - DNA, 16 bp, Homo sapiens
aatttgtaacctcagc

SEQ ID NO: 192142 - DNA, 14 bp, Homo sapiens
aatttgtaagttta

SEQ ID NO: 192143 - DNA, 14 bp, Homo sapiens
aatttgtataaaat

SEQ ID NO: 192144 - DNA, 12 bp, Homo sapiens
aatttgtatctg

SEQ ID NO: 192145 - DNA, 17 bp, Homo sapiens
aatttgtatctgaagga

SEQ ID NO: 192146 - DNA, 13 bp, Homo sapiens
aatttgtgtagat

SEQ ID NO: 192147 - DNA, 16 bp, Homo sapiens
aatttgttataatgaa

SEQ ID NO: 192148 - DNA, 18 bp, Homo sapiens
aatttgttgtcatgtgta

SEQ ID NO: 192149 - DNA, 21 bp, Homo sapiens
aatttgttgtcatgtgtatga

SEQ ID NO: 192150 - DNA, 17 bp, Homo sapiens
aatttgtttgaaatctt

SEQ ID NO: 192151 - DNA, 13 bp, Homo sapiens
aattttaacattt

SEQ ID NO: 192152 - DNA, 16 bp, Homo sapiens
aattttaacatttgat

SEQ ID NO: 192153 - DNA, 16 bp, Homo sapiens
aattaaatgaaatact

SEQ ID NO: 192154 - DNA, 20 bp, Homo sapiens
aattaaattcttattggcca

SEQ ID NO: 192155 - DNA, 14 bp, Homo sapiens
aattaaattttaat

SEQ ID NO: 192156 - DNA, 22 bp, Homo sapiens
aattaaattttgagttctacat

SEQ ID NO: 192157 - DNA, 14 bp, Homo sapiens
aattaacatataat

SEQ ID NO: 192158 - DNA, 19 bp, Homo sapiens
aattaacatataatatatg

SEQ ID NO: 192159 - DNA, 21 bp, Homo sapiens
aattaacatataatatatgtt

SEQ ID NO: 192160 - DNA, 12 bp, Homo sapiens
aattaacctggt

SEQ ID NO: 192161 - DNA, 19 bp, Homo sapiens
aattaactccgtttccaaa

SEQ ID NO: 192162 - DNA, 18 bp, Homo sapiens
aattaactgaagcaaata

SEQ ID NO: 192163 - DNA, 11 bp, Homo sapiens
aattaacttga

SEQ ID NO: 192164 - DNA, 15 bp, Homo sapiens
aattaacttgagttt

SEQ ID NO: 192165 - DNA, 13 bp, Homo sapiens
aattaagaagtac

SEQ ID NO: 192166 - DNA, 19 bp, Homo sapiens
aattaagaggatacacacg

SEQ ID NO: 192167 - DNA, 21 bp, Homo sapiens
aattaaggcaactgaacaaaa

SEQ ID NO: 192168 - DNA, 22 bp, Homo sapiens
aattaaggcaactgaacaaaaa

SEQ ID NO: 192169 - DNA, 17 bp, Homo sapiens
aattaaggcagctgaaa

SEQ ID NO: 192170 - DNA, 18 bp, Homo sapiens
aattaagttattaacatt

SEQ ID NO: 192171 - DNA, 14 bp, Homo sapiens
aattaatagctttt

SEQ ID NO: 192172 - DNA, 22 bp, Homo sapiens
aattaatgagttttatccaaga

SEQ ID NO: 192173 - DNA, 13 bp, Homo sapiens
aattaatttcagt

SEQ ID NO: 192174 - DNA, 14 bp, Homo sapiens
aattacacagttca

SEQ ID NO: 192175 - DNA, 13 bp, Homo sapiens
aattacataacag

SEQ ID NO: 192176 - DNA, 14 bp, Homo sapiens
aattacataacagg

SEQ ID NO: 192177 - DNA, 17 bp, Homo sapiens
aattacatgtaaaacat

SEQ ID NO: 192178 - DNA, 17 bp, Homo sapiens
aattacattttatatgt

SEQ ID NO: 192179 - DNA, 19 bp, Homo sapiens
aattacctaagagccacaa

SEQ ID NO: 192180 - DNA, 15 bp, Homo sapiens
aattactacaaaatt

SEQ ID NO: 192181 - DNA, 13 bp, Homo sapiens
aattacttatatt

SEQ ID NO: 192182 - DNA, 16 bp, Homo sapiens
aattacttatattcat

SEQ ID NO: 192183 - DNA, 23 bp, Homo sapiens
aattagaaacacacttttgcaca

SEQ ID NO: 192184 - DNA, 14 bp, Homo sapiens
aattagaagaaaat

SEQ ID NO: 192185 - DNA, 21 bp, Homo sapiens
aattaggaagtgtaacagctg

SEQ ID NO: 192186 - DNA, 22 bp, Homo sapiens
aattaggaagtgtaacagctga

SEQ ID NO: 192187 - DNA, 20 bp, Homo sapiens
aattaggggttgctaagaag

SEQ ID NO: 192188 - DNA, 22 bp, Homo sapiens
aattaggtctgcattttctcag

SEQ ID NO: 192189 - DNA, 17 bp, Homo sapiens
aattagtcctcacagcc

SEQ ID NO: 192190 - DNA, 14 bp, Homo sapiens
aattagtgagattt

SEQ ID NO: 192191 - DNA, 17 bp, Homo sapiens
aattagtgagatttgta

SEQ ID NO: 192192 - DNA, 14 bp, Homo sapiens
aattataagtcaca

SEQ ID NO: 192193 - DNA, 16 bp, Homo sapiens
aattataagtcacaaa

SEQ ID NO: 192194 - DNA, 16 bp, Homo sapiens
aattataatatactat

SEQ ID NO: 192195 - DNA, 18 bp, Homo sapiens
aattataggagacttgta

SEQ ID NO: 192196 - DNA, 20 bp, Homo sapiens
aattatataggttgtgcaaa

SEQ ID NO: 192197 - DNA, 13 bp, Homo sapiens
aattatatgatat

SEQ ID NO: 192198 - DNA, 16 bp, Homo sapiens
aattatatgatatgca

SEQ ID NO: 192199 - DNA, 19 bp, Homo sapiens
aattatatgatatgcatgt

SEQ ID NO: 192200 - DNA, 20 bp, Homo sapiens
aattatcggaagcagtgcct

SEQ ID NO: 192201 - DNA, 23 bp, Homo sapiens
aattatcgggaacagtgtttccc

SEQ ID NO: 192202 - DNA, 12 bp, Homo sapiens
aattatctattt

SEQ ID NO: 192203 - DNA, 14 bp, Homo sapiens
aattatctatttgt

SEQ ID NO: 192204 - DNA, 19 bp, Homo sapiens
aattatctatttgtatata

SEQ ID NO: 192205 - DNA, 15 bp, Homo sapiens
aattatctgggcatg

SEQ ID NO: 192206 - DNA, 19 bp, Homo sapiens
aattatgctaacaaactga

SEQ ID NO: 192207 - DNA, 23 bp, Homo sapiens
aattatgggaacaagtgtacaga

SEQ ID NO: 192208 - DNA, 14 bp, Homo sapiens
aattatggtgaaat

SEQ ID NO: 192209 - DNA, 15 bp, Homo sapiens
aattatgtatgttta

SEQ ID NO: 192210 - DNA, 16 bp, Homo sapiens
aattatgtatgtttac

SEQ ID NO: 192211 - DNA, 21 bp, Homo sapiens
aattatgtatgtttacatatc

SEQ ID NO: 192212 - DNA, 21 bp, Homo sapiens
aattatgtgacaacctttgtg

SEQ ID NO: 192213 - DNA, 23 bp, Homo sapiens
aattatgtgacaacctttgtgta

SEQ ID NO: 192214 - DNA, 16 bp, Homo sapiens
aattatgttattgaaa

SEQ ID NO: 192215 - DNA, 18 bp, Homo sapiens
aattatgttattgaaaaa

SEQ ID NO: 192216 - DNA, 16 bp, Homo sapiens
aattattaactacatt

SEQ ID NO: 192217 - DNA, 20 bp, Homo sapiens
aattattaactacatttatg

SEQ ID NO: 192218 - DNA, 22 bp, Homo sapiens
aattattactttaaattatatg

SEQ ID NO: 192219 - DNA, 22 bp, Homo sapiens
aattattatttatatatgtatt

SEQ ID NO: 192220 - DNA, 12 bp, Homo sapiens
aattattctagt

SEQ ID NO: 192221 - DNA, 18 bp, Homo sapiens
aattattctagtcaactg

SEQ ID NO: 192222 - DNA, 19 bp, Homo sapiens
aattattctagtcaactgc

SEQ ID NO: 192223 - DNA, 13 bp, Homo sapiens
aattattgtaaac

SEQ ID NO: 192224 - DNA, 14 bp, Homo sapiens
aattattgtaaact

SEQ ID NO: 192225 - DNA, 15 bp, Homo sapiens
aattattgtaaactt

SEQ ID NO: 192226 - DNA, 14 bp, Homo sapiens
aattatttaaagaa

SEQ ID NO: 192227 - DNA, 17 bp, Homo sapiens
aattatttaatatgcat

SEQ ID NO: 192228 - DNA, 19 bp, Homo sapiens
aattatttaatatgcatct

SEQ ID NO: 192229 - DNA, 16 bp, Homo sapiens
aattatttgcctttta

SEQ ID NO: 192230 - DNA, 15 bp, Homo sapiens
aattatttgtgtaat

SEQ ID NO: 192231 - DNA, 21 bp, Homo sapiens
aattatttgtgtaatagaaaa

SEQ ID NO: 192232 - DNA, 18 bp, Homo sapiens
aattattttaaacaaaat

SEQ ID NO: 192233 - DNA, 21 bp, Homo sapiens
aattattttaaattataagga

SEQ ID NO: 192234 - DNA, 22 bp, Homo sapiens
aattattttaaattataaggac

SEQ ID NO: 192235 - DNA, 12 bp, Homo sapiens
aattatttttgt

SEQ ID NO: 192236 - DNA, 19 bp, Homo sapiens
aattattttttttctttta

SEQ ID NO: 192237 - DNA, 16 bp, Homo sapiens
aattcaaaaagtgttt

SEQ ID NO: 192238 - DNA, 16 bp, Homo sapiens
aattcaaacctaagtt

SEQ ID NO: 192239 - DNA, 16 bp, Homo sapiens
aattcaacacttattt

SEQ ID NO: 192240 - DNA, 19 bp, Homo sapiens
aattcaaggagatataaaa

SEQ ID NO: 192241 - DNA, 23 bp, Homo sapiens
aattcagcactgatttcacaaca

SEQ ID NO: 192242 - DNA, 13 bp, Homo sapiens
aattcagctgccc

SEQ ID NO: 192243 - DNA, 16 bp, Homo sapiens
aattcaggcacatgtg

SEQ ID NO: 192244 - DNA, 11 bp, Homo sapiens
aattcagttgt

SEQ ID NO: 192245 - DNA, 22 bp, Homo sapiens
aattcagttgttagtgtgtctt

SEQ ID NO: 192246 - DNA, 21 bp, Homo sapiens
aattcagttttagtttcaaaa

SEQ ID NO: 192247 - DNA, 13 bp, Homo sapiens
aattcatactctg

SEQ ID NO: 192248 - DNA, 22 bp, Homo sapiens
aattcatactctgttgcctcct

SEQ ID NO: 192249 - DNA, 23 bp, Homo sapiens
aattcatactctgttgcctcctc

SEQ ID NO: 192250 - DNA, 12 bp, Homo sapiens
aattcattaaag

SEQ ID NO: 192251 - DNA, 16 bp, Homo sapiens
aattcattaaagaaaa

SEQ ID NO: 192252 - DNA, 14 bp, Homo sapiens
aattcattaaattt

SEQ ID NO: 192253 - DNA, 15 bp, Homo sapiens
aattccacccctcct

SEQ ID NO: 192254 - DNA, 21 bp, Homo sapiens
aattccacccctccttccctg

SEQ ID NO: 192255 - DNA, 14 bp, Homo sapiens
aattccactgtcaa

SEQ ID NO: 192256 - DNA, 22 bp, Homo sapiens
aattccactgtcaagaaagagc

SEQ ID NO: 192257 - DNA, 14 bp, Homo sapiens
aatggatgtaatat

SEQ ID NO: 192258 - DNA, 13 bp, Homo sapiens
aatggattaaatg

SEQ ID NO: 192259 - DNA, 10 bp, Homo sapiens
aatggccatg

SEQ ID NO: 192260 - DNA, 20 bp, Homo sapiens
aatggcgcagtgcctctggt

SEQ ID NO: 192261 - DNA, 15 bp, Homo sapiens
aatggctgggtttgg

SEQ ID NO: 192262 - DNA, 13 bp, Homo sapiens
aatggcttctatg

SEQ ID NO: 192263 - DNA, 21 bp, Homo sapiens
aatggctttggtctcttgctt

SEQ ID NO: 192264 - DNA, 14 bp, Homo sapiens
aatgggactggagt

SEQ ID NO: 192265 - DNA, 18 bp, Homo sapiens
aatgggagacagcctctt

SEQ ID NO: 192266 - DNA, 19 bp, Homo sapiens
aatgggagtgaacatttct

SEQ ID NO: 192267 - DNA, 15 bp, Homo sapiens
aatgggcctgcccaa

SEQ ID NO: 192268 - DNA, 17 bp, Homo sapiens
aatggtgatcctctatt

SEQ ID NO: 192269 - DNA, 19 bp, Homo sapiens
aatggtgatcctctatttt

SEQ ID NO: 192270 - DNA, 20 bp, Homo sapiens
aatggtgatcctctattttg

SEQ ID NO: 192271 - DNA, 17 bp, Homo sapiens
aatggtgtagctgtcct

SEQ ID NO: 192272 - DNA, 18 bp, Homo sapiens
aatggtgtagctgtcctc

SEQ ID NO: 192273 - DNA, 23 bp, Homo sapiens
aatggttaataaaactgcacagt

SEQ ID NO: 192274 - DNA, 19 bp, Homo sapiens
aatggttgggacaatggca

SEQ ID NO: 192275 - DNA, 18 bp, Homo sapiens
aatggtttactgctgtca

SEQ ID NO: 192276 - DNA, 19 bp, Homo sapiens
aatggtttactgctgtcat

SEQ ID NO: 192277 - DNA, 16 bp, Homo sapiens
aatggtttgtcctgat

SEQ ID NO: 192278 - DNA, 18 bp, Homo sapiens
aatggttttcttgtgtgt

SEQ ID NO: 192279 - DNA, 12 bp, Homo sapiens
aatgtaaaaaag

SEQ ID NO: 192280 - DNA, 17 bp, Homo sapiens
aatgtaaaaaagaaaaa

SEQ ID NO: 192281 - DNA, 12 bp, Homo sapiens
aatgtaaatatt

SEQ ID NO: 192282 - DNA, 16 bp, Homo sapiens
aatgtaaatttgtact

SEQ ID NO: 192283 - DNA, 18 bp, Homo sapiens
aatgtacaagttttgtat

SEQ ID NO: 192284 - DNA, 20 bp, Homo sapiens
aatgtacaagttttgtataa

SEQ ID NO: 192285 - DNA, 15 bp, Homo sapiens
aatgtacattaatta

SEQ ID NO: 192286 - DNA, 17 bp, Homo sapiens
aatgtactatatgtata

SEQ ID NO: 192287 - DNA, 15 bp, Homo sapiens
aatgtactgagattt

SEQ ID NO: 192288 - DNA, 16 bp, Homo sapiens
aatgtagaagaaagca

SEQ ID NO: 192289 - DNA, 17 bp, Homo sapiens
aatgtagaagaaagcaa

SEQ ID NO: 192290 - DNA, 18 bp, Homo sapiens
aatgtagaagaaagcaaa

SEQ ID NO: 192291 - DNA, 22 bp, Homo sapiens
aatgtagctatttttcttgttg

SEQ ID NO: 192292 - DNA, 21 bp, Homo sapiens
aatgtagctggtttcctcatt

SEQ ID NO: 192293 - DNA, 20 bp, Homo sapiens
aatgtaggtatgaataagtt

SEQ ID NO: 192294 - DNA, 16 bp, Homo sapiens
aatgtatatttaactt

SEQ ID NO: 192295 - DNA, 18 bp, Homo sapiens
aatgtatcaggaaatata

SEQ ID NO: 192296 - DNA, 14 bp, Homo sapiens
aatgtatcctgata

SEQ ID NO: 192297 - DNA, 15 bp, Homo sapiens
aatgtatcttattta

SEQ ID NO: 192298 - DNA, 15 bp, Homo sapiens
aatgtatgtgaaagt

SEQ ID NO: 192299 - DNA, 13 bp, Homo sapiens
aatgtatgtgcac

SEQ ID NO: 192300 - DNA, 18 bp, Homo sapiens
aatgtatgtgcactgtca

SEQ ID NO: 192301 - DNA, 17 bp, Homo sapiens
aatgtattattctgcag

SEQ ID NO: 192302 - DNA, 17 bp, Homo sapiens
aatgtattcaagcaaac

SEQ ID NO: 192303 - DNA, 21 bp, Homo sapiens
aatgtattctatctctcttta

SEQ ID NO: 192304 - DNA, 21 bp, Homo sapiens
aatgtattttgaaaacactta

SEQ ID NO: 192305 - DNA, 14 bp, Homo sapiens
aatgtcaaggtgct

SEQ ID NO: 192306 - DNA, 17 bp, Homo sapiens
aatgtcacttaaaggct

SEQ ID NO: 192307 - DNA, 19 bp, Homo sapiens
aatgtcagaaaccagttat

SEQ ID NO: 192308 - DNA, 23 bp, Homo sapiens
aatgtcagtctacaggcctttca

SEQ ID NO: 192309 - DNA, 15 bp, Homo sapiens
aatgtcagtgtgact

SEQ ID NO: 192310 - DNA, 17 bp, Homo sapiens
aatgtcagtgtgactga

SEQ ID NO: 192311 - DNA, 17 bp, Homo sapiens
aatgtcattatgtagaa

SEQ ID NO: 192312 - DNA, 12 bp, Homo sapiens
aatgtcatttgc

SEQ ID NO: 192313 - DNA, 17 bp, Homo sapiens
aatgtcatttgctaatg

SEQ ID NO: 192314 - DNA, 17 bp, Homo sapiens
aatgtccccattctata

SEQ ID NO: 192315 - DNA, 19 bp, Homo sapiens
aatgtccccattctataaa

SEQ ID NO: 192316 - DNA, 23 bp, Homo sapiens
aatgtccccattctataaattca

SEQ ID NO: 192317 - DNA, 23 bp, Homo sapiens
aatgtcccccacctcttttccta

SEQ ID NO: 192318 - DNA, 14 bp, Homo sapiens
aatgtcctcagagg

SEQ ID NO: 192319 - DNA, 23 bp, Homo sapiens
aatgtcctcagagggtccctagg

SEQ ID NO: 192320 - DNA, 18 bp, Homo sapiens
aatgtcgagtatattatt

SEQ ID NO: 192321 - DNA, 15 bp, Homo sapiens
aatgtctaaaattgt

SEQ ID NO: 192322 - DNA, 23 bp, Homo sapiens
aatgtcttaaataaaactattta

SEQ ID NO: 192323 - DNA, 17 bp, Homo sapiens
aatgtcttcatttcatt

SEQ ID NO: 192324 - DNA, 23 bp, Homo sapiens
aatgtgaactaagttttttactt

SEQ ID NO: 192325 - DNA, 17 bp, Homo sapiens
aatgtgaagttttcttt

SEQ ID NO: 192326 - DNA, 19 bp, Homo sapiens
aatgtgatatgtgtaatat

SEQ ID NO: 192327 - DNA, 21 bp, Homo sapiens
aatgtgatatgtgtaatatca

SEQ ID NO: 192328 - DNA, 15 bp, Homo sapiens
aatgtgatcatcttt

SEQ ID NO: 192329 - DNA, 22 bp, Homo sapiens
aatgtgattctaatgtcttcat

SEQ ID NO: 192330 - DNA, 16 bp, Homo sapiens
aatgtgatttttctga

SEQ ID NO: 192331 - DNA, 17 bp, Homo sapiens
aatgtgatttttttata

SEQ ID NO: 192332 - DNA, 17 bp, Homo sapiens
aatgtgcagtgtcttgt

SEQ ID NO: 192333 - DNA, 16 bp, Homo sapiens
aatgtgcccagtcatg

SEQ ID NO: 192334 - DNA, 21 bp, Homo sapiens
aatgtgcccagtcatgacatt

SEQ ID NO: 192335 - DNA, 18 bp, Homo sapiens
aatgtgcccctggcccat

SEQ ID NO: 192336 - DNA, 15 bp, Homo sapiens
aatgtgctgcaaaga

SEQ ID NO: 192337 - DNA, 22 bp, Homo sapiens
aatgtgctgttgattctttcaa

SEQ ID NO: 192338 - DNA, 14 bp, Homo sapiens
aatgtgcttttcca

SEQ ID NO: 192339 - DNA, 15 bp, Homo sapiens
aatgtgcttttccat

SEQ ID NO: 192340 - DNA, 22 bp, Homo sapiens
aatgtgcttttccatctaaaat

SEQ ID NO: 192341 - DNA, 21 bp, Homo sapiens
aatgtggaattacataacagg

SEQ ID NO: 192342 - DNA, 16 bp, Homo sapiens
aatgtggcagctgtct

SEQ ID NO: 192343 - DNA, 14 bp, Homo sapiens
aatgtggctcctgg

SEQ ID NO: 192344 - DNA, 14 bp, Homo sapiens
aatgtgtatgtctg

SEQ ID NO: 192345 - DNA, 21 bp, Homo sapiens
aatgtgtctgcaacatggatt

SEQ ID NO: 192346 - DNA, 21 bp, Homo sapiens
aatgtgtggtgctaactgtat

SEQ ID NO: 192347 - DNA, 16 bp, Homo sapiens
aatgtgtgttgactgc

SEQ ID NO: 192348 - DNA, 12 bp, Homo sapiens
aatgttaataaa

SEQ ID NO: 192349 - DNA, 16 bp, Homo sapiens
aatgttaataaaggtt

SEQ ID NO: 192350 - DNA, 17 bp, Homo sapiens
aatgttaataaaggttt

SEQ ID NO: 192351 - DNA, 13 bp, Homo sapiens
aatgttactgatc

SEQ ID NO: 192352 - DNA, 19 bp, Homo sapiens
aatgttactgatcatgcat

SEQ ID NO: 192353 - DNA, 21 bp, Homo sapiens
aatgttactgatcatgcattg

SEQ ID NO: 192354 - DNA, 20 bp, Homo sapiens
aatgttattgtcctcacctt

SEQ ID NO: 192355 - DNA, 14 bp, Homo sapiens
aatgttatttaaga

SEQ ID NO: 192356 - DNA, 21 bp, Homo sapiens
aatgttatttgttattttcag

SEQ ID NO: 192357 - DNA, 21 bp, Homo sapiens
aatgttcaggagagtaaaaat

SEQ ID NO: 192358 - DNA, 12 bp, Homo sapiens
aatgttcattct

SEQ ID NO: 192359 - DNA, 11 bp, Homo sapiens
aatgttcattg

SEQ ID NO: 192360 - DNA, 15 bp, Homo sapiens
aatgttccattcagt

SEQ ID NO: 192361 - DNA, 14 bp, Homo sapiens
aatgttccctgcac

SEQ ID NO: 192362 - DNA, 17 bp, Homo sapiens
aatgttccgttcatctg

SEQ ID NO: 192363 - DNA, 18 bp, Homo sapiens
aatgttccgttcatctga

SEQ ID NO: 192364 - DNA, 21 bp, Homo sapiens
aatgttccgttcatctgagga

SEQ ID NO: 192365 - DNA, 21 bp, Homo sapiens
aatgttctgaataatttctta

SEQ ID NO: 192366 - DNA, 15 bp, Homo sapiens
aatgttctgacatta

SEQ ID NO: 192367 - DNA, 16 bp, Homo sapiens
aatgttgaagaactca

SEQ ID NO: 192368 - DNA, 23 bp, Homo sapiens
aatgttgaagaactcatgtgatt

SEQ ID NO: 192369 - DNA, 17 bp, Homo sapiens
aatgttggtgcaattaa

SEQ ID NO: 192370 - DNA, 17 bp, Homo sapiens
aatgttgtattcagtga

SEQ ID NO: 192371 - DNA, 12 bp, Homo sapiens
aatgttgtcctg

SEQ ID NO: 192372 - DNA, 17 bp, Homo sapiens
aatgttgtcctgtgtca

SEQ ID NO: 192373 - DNA, 14 bp, Homo sapiens
aatgtttaaaagca

SEQ ID NO: 192374 - DNA, 12 bp, Homo sapiens
aatgtttaagat

SEQ ID NO: 192375 - DNA, 12 bp, Homo sapiens
aatgtttccttt

SEQ ID NO: 192376 - DNA, 22 bp, Homo sapiens
aatgtttcttctaggttctaaa

SEQ ID NO: 192377 - DNA, 22 bp, Homo sapiens
aatgtttgctttacgtattttg

SEQ ID NO: 192378 - DNA, 17 bp, Homo sapiens
aatgttttatactgttt

SEQ ID NO: 192379 - DNA, 12 bp, Homo sapiens
aatgttttgcta

SEQ ID NO: 192380 - DNA, 18 bp, Homo sapiens
aatgttttgtacaattac

SEQ ID NO: 192381 - DNA, 16 bp, Homo sapiens
aatgtttttattaaca

SEQ ID NO: 192382 - DNA, 14 bp, Homo sapiens
aatgtttttgtgta

SEQ ID NO: 192383 - DNA, 18 bp, Homo sapiens
aattaaaaaaataataac

SEQ ID NO: 192384 - DNA, 11 bp, Homo sapiens
aattaaaaaat

SEQ ID NO: 192385 - DNA, 21 bp, Homo sapiens
aattaaaaacacctaagtgac

SEQ ID NO: 192386 - DNA, 18 bp, Homo sapiens
aattaaaacacaacatct

SEQ ID NO: 192387 - DNA, 23 bp, Homo sapiens
aattaaacccacaagctgcctct

SEQ ID NO: 192388 - DNA, 15 bp, Homo sapiens
aattaaagggcagat

SEQ ID NO: 192389 - DNA, 14 bp, Homo sapiens
aattaaataatttt

SEQ ID NO: 192390 - DNA, 17 bp, Homo sapiens
aattaaataattttaca

SEQ ID NO: 192391 - DNA, 17 bp, Homo sapiens
aatgaatttgactggtt

SEQ ID NO: 192392 - DNA, 18 bp, Homo sapiens
aatgacagagagttctgg

SEQ ID NO: 192393 - DNA, 13 bp, Homo sapiens
aatgacatcttca

SEQ ID NO: 192394 - DNA, 18 bp, Homo sapiens
aatgacatcttcaaagct

SEQ ID NO: 192395 - DNA, 23 bp, Homo sapiens
aatgacatgtgtcaagctgcttg

SEQ ID NO: 192396 - DNA, 14 bp, Homo sapiens
aatgaccaatatta

SEQ ID NO: 192397 - DNA, 19 bp, Homo sapiens
aatgaccacacctgcctct

SEQ ID NO: 192398 - DNA, 16 bp, Homo sapiens
aatgactataaacatt

SEQ ID NO: 192399 - DNA, 15 bp, Homo sapiens
aatgactgaaagaag

SEQ ID NO: 192400 - DNA, 21 bp, Homo sapiens
aatgacttattgattaagtat

SEQ ID NO: 192401 - DNA, 16 bp, Homo sapiens
aatgacttcatttctg

SEQ ID NO: 192402 - DNA, 20 bp, Homo sapiens
aatgacttcatttctgatgt

SEQ ID NO: 192403 - DNA, 12 bp, Homo sapiens
aatgagaaagaa

SEQ ID NO: 192404 - DNA, 18 bp, Homo sapiens
aatgagacttgttttccc

SEQ ID NO: 192405 - DNA, 10 bp, Homo sapiens
aatgagagag

SEQ ID NO: 192406 - DNA, 21 bp, Homo sapiens
aatgagatagaagatgtttgc

SEQ ID NO: 192407 - DNA, 15 bp, Homo sapiens
aatgagcaaatggaa

SEQ ID NO: 192408 - DNA, 13 bp, Homo sapiens
aatgagcatcaga

SEQ ID NO: 192409 - DNA, 22 bp, Homo sapiens
aatgaggaacaatcacaaaagc

SEQ ID NO: 192410 - DNA, 14 bp, Homo sapiens
aatgaggacatgtt

SEQ ID NO: 192411 - DNA, 16 bp, Homo sapiens
aatgaggacatgtttt

SEQ ID NO: 192412 - DNA, 16 bp, Homo sapiens
aatgaggtctgaaatg

SEQ ID NO: 192413 - DNA, 15 bp, Homo sapiens
aatgaggttatgaga

SEQ ID NO: 192414 - DNA, 19 bp, Homo sapiens
aatgaggttatgagaaaaa

SEQ ID NO: 192415 - DNA, 21 bp, Homo sapiens
aatgaggttatgagaaaaaaa

SEQ ID NO: 192416 - DNA, 23 bp, Homo sapiens
aatgaggttatgagaaaaaaaca

SEQ ID NO: 192417 - DNA, 21 bp, Homo sapiens
aatgagtaatgcagacattta

SEQ ID NO: 192418 - DNA, 20 bp, Homo sapiens
aatgagtttccagctaagcc

SEQ ID NO: 192419 - DNA, 17 bp, Homo sapiens
aatgagttttacattac

SEQ ID NO: 192420 - DNA, 18 bp, Homo sapiens
aatgataagtaaatgcta

SEQ ID NO: 192421 - DNA, 21 bp, Homo sapiens
aatgataagtaaatgctaggt

SEQ ID NO: 192422 - DNA, 16 bp, Homo sapiens
aatgatactgtctaag

SEQ ID NO: 192423 - DNA, 21 bp, Homo sapiens
aatgatactgtctaagaataa

SEQ ID NO: 192424 - DNA, 18 bp, Homo sapiens
aatgatagataatgcctt

SEQ ID NO: 192425 - DNA, 19 bp, Homo sapiens
aatgatagtgttttgtact

SEQ ID NO: 192426 - DNA, 17 bp, Homo sapiens
aatgatatgtctttaaa

SEQ ID NO: 192427 - DNA, 18 bp, Homo sapiens
aatgatatgtctttaaaa

SEQ ID NO: 192428 - DNA, 16 bp, Homo sapiens
aatgatatttattaaa

SEQ ID NO: 192429 - DNA, 14 bp, Homo sapiens
aatgatctaggttt

SEQ ID NO: 192430 - DNA, 17 bp, Homo sapiens
aatgatctaggtttaac

SEQ ID NO: 192431 - DNA, 13 bp, Homo sapiens
aatgatctattgc

SEQ ID NO: 192432 - DNA, 15 bp, Homo sapiens
aatgatgagtattag

SEQ ID NO: 192433 - DNA, 23 bp, Homo sapiens
aatgatgatgacgacgacaacga

SEQ ID NO: 192434 - DNA, 17 bp, Homo sapiens
aatgatgatgataatga

SEQ ID NO: 192435 - DNA, 20 bp, Homo sapiens
aatgatgatgggaattgtgt

SEQ ID NO: 192436 - DNA, 15 bp, Homo sapiens
aatgatgattaaaca

SEQ ID NO: 192437 - DNA, 17 bp, Homo sapiens
aatgatgattaaacacc

SEQ ID NO: 192438 - DNA, 20 bp, Homo sapiens
aatgatgattaaacacctga

SEQ ID NO: 192439 - DNA, 20 bp, Homo sapiens
aatgatgattcaatcatttt

SEQ ID NO: 192440 - DNA, 20 bp, Homo sapiens
aatgatgccatgaggaacaa

SEQ ID NO: 192441 - DNA, 15 bp, Homo sapiens
aatgatgtatgattt

SEQ ID NO: 192442 - DNA, 18 bp, Homo sapiens
aatgatgtccagaagaat

SEQ ID NO: 192443 - DNA, 22 bp, Homo sapiens
aatgatgtgtcatatgagtcct

SEQ ID NO: 192444 - DNA, 19 bp, Homo sapiens
aatgatgttttagaatgat

SEQ ID NO: 192445 - DNA, 12 bp, Homo sapiens
aatgattccaaa

SEQ ID NO: 192446 - DNA, 14 bp, Homo sapiens
aatgattccaaata

SEQ ID NO: 192447 - DNA, 15 bp, Homo sapiens
aatgattccaaataa

SEQ ID NO: 192448 - DNA, 18 bp, Homo sapiens
aatgattccctcttgcta

SEQ ID NO: 192449 - DNA, 14 bp, Homo sapiens
aatgattgtaaaat

SEQ ID NO: 192450 - DNA, 18 bp, Homo sapiens
aatgattgtttaattgta

SEQ ID NO: 192451 - DNA, 18 bp, Homo sapiens
aatgatttaagcatttta

SEQ ID NO: 192452 - DNA, 22 bp, Homo sapiens
aatgatttgtgtccatttcaag

SEQ ID NO: 192453 - DNA, 18 bp, Homo sapiens
aatgattttcatcaattt

SEQ ID NO: 192454 - DNA, 20 bp, Homo sapiens
aatgattttcatcaatttaa

SEQ ID NO: 192455 - DNA, 16 bp, Homo sapiens
aatgatttttgtgtat

SEQ ID NO: 192456 - DNA, 17 bp, Homo sapiens
aatgatttttgtgtatc

SEQ ID NO: 192457 - DNA, 14 bp, Homo sapiens
aatgcaaaaccttt

SEQ ID NO: 192458 - DNA, 17 bp, Homo sapiens
aatgcaagctagtggct

SEQ ID NO: 192459 - DNA, 24 bp, Homo sapiens
aatgcacatttgtcactgaataat

SEQ ID NO: 192460 - DNA, 21 bp, Homo sapiens
aatgcactggggtaccacatg

SEQ ID NO: 192461 - DNA, 15 bp, Homo sapiens
aatgcagacacacaa

SEQ ID NO: 192462 - DNA, 22 bp, Homo sapiens
aatgcagacacacaacatcaag

SEQ ID NO: 192463 - DNA, 21 bp, Homo sapiens
aatgcagacatttacatgttc

SEQ ID NO: 192464 - DNA, 18 bp, Homo sapiens
aatgcagaggaggagaaa

SEQ ID NO: 192465 - DNA, 19 bp, Homo sapiens
aatgcagattcctgggcct

SEQ ID NO: 192466 - DNA, 18 bp, Homo sapiens
aatgcagggaagagggca

SEQ ID NO: 192467 - DNA, 17 bp, Homo sapiens
aatgcagtataaaatgt

SEQ ID NO: 192468 - DNA, 23 bp, Homo sapiens
aatgcatgatattgtatgtacct

SEQ ID NO: 192469 - DNA, 13 bp, Homo sapiens
aatgcatgtgatt

SEQ ID NO: 192470 - DNA, 14 bp, Homo sapiens
aatgcatgtgattg

SEQ ID NO: 192471 - DNA, 19 bp, Homo sapiens
aatgcattcaaaatataac

SEQ ID NO: 192472 - DNA, 12 bp, Homo sapiens
aatgcattcatg

SEQ ID NO: 192473 - DNA, 15 bp, Homo sapiens
aatgcattcatgttt

SEQ ID NO: 192474 - DNA, 11 bp, Homo sapiens
aatgccaaaac

SEQ ID NO: 192475 - DNA, 20 bp, Homo sapiens
aatgccaagtaacaatgcat

SEQ ID NO: 192476 - DNA, 13 bp, Homo sapiens
aatgccaatctct

SEQ ID NO: 192477 - DNA, 13 bp, Homo sapiens
aatgccacagcca

SEQ ID NO: 192478 - DNA, 16 bp, Homo sapiens
aatgccacagccaagc

SEQ ID NO: 192479 - DNA, 20 bp, Homo sapiens
aatgccacattttgctttat

SEQ ID NO: 192480 - DNA, 23 bp, Homo sapiens
aatgccacgtgccattgtctttc

SEQ ID NO: 192481 - DNA, 14 bp, Homo sapiens
aatgccacttaaca

SEQ ID NO: 192482 - DNA, 13 bp, Homo sapiens
aatgccagcccaa

SEQ ID NO: 192483 - DNA, 18 bp, Homo sapiens
aatgccaggacagctgca

SEQ ID NO: 192484 - DNA, 19 bp, Homo sapiens
aatgccctcctaaatgtca

SEQ ID NO: 192485 - DNA, 22 bp, Homo sapiens
aatgcctctgccttgatggaga

SEQ ID NO: 192486 - DNA, 19 bp, Homo sapiens
aatgcctgtgccaataaaa

SEQ ID NO: 192487 - DNA, 21 bp, Homo sapiens
aatgcctttctagcaattgct

SEQ ID NO: 192488 - DNA, 20 bp, Homo sapiens
aatgctacaaaatgtgtgct

SEQ ID NO: 192489 - DNA, 19 bp, Homo sapiens
aatgctattgttgtgggct

SEQ ID NO: 192490 - DNA, 14 bp, Homo sapiens
aatgctcaatgtgc

SEQ ID NO: 192491 - DNA, 17 bp, Homo sapiens
aatgctcaatgtgctgt

SEQ ID NO: 192492 - DNA, 20 bp, Homo sapiens
aatgctcccccatcctcccc

SEQ ID NO: 192493 - DNA, 22 bp, Homo sapiens
aatgctcccccatcctcccctt

SEQ ID NO: 192494 - DNA, 19 bp, Homo sapiens
aatgctcgtatctccttga

SEQ ID NO: 192495 - DNA, 13 bp, Homo sapiens
aatgctctgtgcc

SEQ ID NO: 192496 - DNA, 23 bp, Homo sapiens
aatgctgcacaccagttactgtt

SEQ ID NO: 192497 - DNA, 21 bp, Homo sapiens
aatgctgcccagggtcagtgt

SEQ ID NO: 192498 - DNA, 12 bp, Homo sapiens
aatgctgtacct

SEQ ID NO: 192499 - DNA, 16 bp, Homo sapiens
aatgctgtacctttct

SEQ ID NO: 192500 - DNA, 12 bp, Homo sapiens
aatgctgtagaa

SEQ ID NO: 192501 - DNA, 13 bp, Homo sapiens
aatgctgtagaat

SEQ ID NO: 192502 - DNA, 20 bp, Homo sapiens
aatgctgtgcaaacagtgta

SEQ ID NO: 192503 - DNA, 20 bp, Homo sapiens
aatgcttaatttctaaagat

SEQ ID NO: 192504 - DNA, 20 bp, Homo sapiens
aatgcttatgtgttgcataa

SEQ ID NO: 192505 - DNA, 20 bp, Homo sapiens
aatgcttcaagtgttgctct

SEQ ID NO: 192506 - DNA, 19 bp, Homo sapiens
aatgcttgccaagaaatcg

SEQ ID NO: 192507 - DNA, 12 bp, Homo sapiens
aatgcttggaat

SEQ ID NO: 192508 - DNA, 17 bp, Homo sapiens
aatgctttgggaggcca

SEQ ID NO: 192509 - DNA, 20 bp, Homo sapiens
aatgctttgggaggccaagg

SEQ ID NO: 192510 - DNA, 19 bp, Homo sapiens
aatgcttttatatggccca

SEQ ID NO: 192511 - DNA, 23 bp, Homo sapiens
aatgcttttatatggcccagcct

SEQ ID NO: 192512 - DNA, 13 bp, Homo sapiens
aatggaagaaacc

SEQ ID NO: 192513 - DNA, 17 bp, Homo sapiens
aatggaagcactgccat

SEQ ID NO: 192514 - DNA, 22 bp, Homo sapiens
aatggaatataatatgtcttca

SEQ ID NO: 192515 - DNA, 21 bp, Homo sapiens
aatggaatcagcttttaataa

SEQ ID NO: 192516 - DNA, 22 bp, Homo sapiens
aatggaatgtgcccctggccca

SEQ ID NO: 192517 - DNA, 20 bp, Homo sapiens
aatggagatttgaaggtctg

SEQ ID NO: 192518 - DNA, 13 bp, Homo sapiens
aatggaggccaag

SEQ ID NO: 192519 - DNA, 20 bp, Homo sapiens
aatggaggccaagcctgcag

SEQ ID NO: 192520 - DNA, 15 bp, Homo sapiens
aatggagtccagacc

SEQ ID NO: 192521 - DNA, 22 bp, Homo sapiens
aatggatccccagtgaaaacta

SEQ ID NO: 192522 - DNA, 16 bp, Homo sapiens
aatggatgacaaagaa

SEQ ID NO: 192523 - DNA, 18 bp, Homo sapiens
aatggatgacaaagaaaa

SEQ ID NO: 192524 - DNA, 12 bp, Homo sapiens
aatacagataac

SEQ ID NO: 192525 - DNA, 17 bp, Homo sapiens
aatacagataacattag

SEQ ID NO: 192526 - DNA, 23 bp, Homo sapiens
aatacagggcatgcattttgcag

SEQ ID NO: 192527 - DNA, 16 bp, Homo sapiens
aatacagggcattttg

SEQ ID NO: 192528 - DNA, 21 bp, Homo sapiens
aatacagtaagctgctctatt

SEQ ID NO: 192529 - DNA, 16 bp, Homo sapiens
aatacagtattctgta

SEQ ID NO: 192530 - DNA, 15 bp, Homo sapiens
aatacagtgctttat

SEQ ID NO: 192531 - DNA, 16 bp, Homo sapiens
aatacagtgctttatg

SEQ ID NO: 192532 - DNA, 17 bp, Homo sapiens
aatacagttctgtcata

SEQ ID NO: 192533 - DNA, 13 bp, Homo sapiens
actaggtgtcccc

SEQ ID NO: 192534 - DNA, 16 bp, Homo sapiens
actaggtgtccccaac

SEQ ID NO: 192535 - DNA, 16 bp, Homo sapiens
actagtacaaattata

SEQ ID NO: 192536 - DNA, 19 bp, Homo sapiens
actagtattgtccatatca

SEQ ID NO: 192537 - DNA, 17 bp, Homo sapiens
actagtgctgaagctta

SEQ ID NO: 192538 - DNA, 19 bp, Homo sapiens
actagtgctgaagcttatt

SEQ ID NO: 192539 - DNA, 17 bp, Homo sapiens
actagtgtttctgcaga

SEQ ID NO: 192540 - DNA, 20 bp, Homo sapiens
actagtttgttattaatcca

SEQ ID NO: 192541 - DNA, 20 bp, Homo sapiens
actataaacattaaaagaag

SEQ ID NO: 192542 - DNA, 14 bp, Homo sapiens
actataaatatatt

SEQ ID NO: 192543 - DNA, 23 bp, Homo sapiens
actataaccatcagttactggtt

SEQ ID NO: 192544 - DNA, 15 bp, Homo sapiens
actatagcagggctg

SEQ ID NO: 192545 - DNA, 17 bp, Homo sapiens
actatagccatttgccc

SEQ ID NO: 192546 - DNA, 20 bp, Homo sapiens
actataggtaattaaggcag

SEQ ID NO: 192547 - DNA, 16 bp, Homo sapiens
actatagtttaaaaca

SEQ ID NO: 192548 - DNA, 20 bp, Homo sapiens
actatataaagtactactgt

SEQ ID NO: 192549 - DNA, 23 bp, Homo sapiens
actatataaagtactactgtaga

SEQ ID NO: 192550 - DNA, 16 bp, Homo sapiens
actatatctgttttac

SEQ ID NO: 192551 - DNA, 19 bp, Homo sapiens
actatatctgttttactgc

SEQ ID NO: 192552 - DNA, 16 bp, Homo sapiens
actatatgcataaaca

SEQ ID NO: 192553 - DNA, 23 bp, Homo sapiens
actatatgtatatctttgcactg

SEQ ID NO: 192554 - DNA, 19 bp, Homo sapiens
actatcggttcaagttgat

SEQ ID NO: 192555 - DNA, 17 bp, Homo sapiens
actatctactctcctca

SEQ ID NO: 192556 - DNA, 14 bp, Homo sapiens
actatgcaaagaac

SEQ ID NO: 192557 - DNA, 19 bp, Homo sapiens
actatgcacagattaaact

SEQ ID NO: 192558 - DNA, 17 bp, Homo sapiens
actatggctgtattttt

SEQ ID NO: 192559 - DNA, 19 bp, Homo sapiens
actatgggaagctctgtgt

SEQ ID NO: 192560 - DNA, 17 bp, Homo sapiens
actatgtaatgcttatg

SEQ ID NO: 192561 - DNA, 18 bp, Homo sapiens
actatgtatgtaaaatat

SEQ ID NO: 192562 - DNA, 15 bp, Homo sapiens
actatgtgtcatgat

SEQ ID NO: 192563 - DNA, 15 bp, Homo sapiens
actattaagatatct

SEQ ID NO: 192564 - DNA, 22 bp, Homo sapiens
actattaagcagtaaaaactgt

SEQ ID NO: 192565 - DNA, 19 bp, Homo sapiens
actattactattactattt

SEQ ID NO: 192566 - DNA, 17 bp, Homo sapiens
actattaggaggaatgt

SEQ ID NO: 192567 - DNA, 19 bp, Homo sapiens
actattagtattattaaca

SEQ ID NO: 192568 - DNA, 13 bp, Homo sapiens
actattcaagtat

SEQ ID NO: 192569 - DNA, 20 bp, Homo sapiens
actattcagaacttgtaact

SEQ ID NO: 192570 - DNA, 22 bp, Homo sapiens
actattcaggagagtagaacag

SEQ ID NO: 192571 - DNA, 23 bp, Homo sapiens
actattccacagggataccttaa

SEQ ID NO: 192572 - DNA, 20 bp, Homo sapiens
actattccctttgacttcag

SEQ ID NO: 192573 - DNA, 23 bp, Homo sapiens
actattccctttgacttcagctg

SEQ ID NO: 192574 - DNA, 17 bp, Homo sapiens
actattctgttaaaatc

SEQ ID NO: 192575 - DNA, 18 bp, Homo sapiens
actattcttaagcacttt

SEQ ID NO: 192576 - DNA, 19 bp, Homo sapiens
actattcttaagcactttg

SEQ ID NO: 192577 - DNA, 21 bp, Homo sapiens
actattcttaagcactttgaa

SEQ ID NO: 192578 - DNA, 22 bp, Homo sapiens
actattcttgatgtaaaatctt

SEQ ID NO: 192579 - DNA, 23 bp, Homo sapiens
actattcttgatgtaaaatcttg

SEQ ID NO: 192580 - DNA, 17 bp, Homo sapiens
actattggacagacaca

SEQ ID NO: 192581 - DNA, 14 bp, Homo sapiens
actattgtagagtg

SEQ ID NO: 192582 - DNA, 16 bp, Homo sapiens
actattgttagtctct

SEQ ID NO: 192583 - DNA, 11 bp, Homo sapiens
actatttaaaa

SEQ ID NO: 192584 - DNA, 16 bp, Homo sapiens
actatttaactgacta

SEQ ID NO: 192585 - DNA, 15 bp, Homo sapiens
actatttaacttgag

SEQ ID NO: 192586 - DNA, 21 bp, Homo sapiens
actcaaaaggagaactgtgct

SEQ ID NO: 192587 - DNA, 13 bp, Homo sapiens
actcaaaggactg

SEQ ID NO: 192588 - DNA, 17 bp, Homo sapiens
actcaaaggactgacct

SEQ ID NO: 192589 - DNA, 17 bp, Homo sapiens
actcaaagggtggaata

SEQ ID NO: 192590 - DNA, 23 bp, Homo sapiens
actcaacatgttactgaccagca

SEQ ID NO: 192591 - DNA, 17 bp, Homo sapiens
actcaaccataacactt

SEQ ID NO: 192592 - DNA, 13 bp, Homo sapiens
actcaatattaaa

SEQ ID NO: 192593 - DNA, 23 bp, Homo sapiens
actcaatctccccttgcactaaa

SEQ ID NO: 192594 - DNA, 19 bp, Homo sapiens
actcaatgtggaaaaaata

SEQ ID NO: 192595 - DNA, 17 bp, Homo sapiens
actcacagagacacagg

SEQ ID NO: 192596 - DNA, 22 bp, Homo sapiens
actcacatgctggacaggtctg

SEQ ID NO: 192597 - DNA, 23 bp, Homo sapiens
actcaccaaaaagctttaaaaaa

SEQ ID NO: 192598 - DNA, 17 bp, Homo sapiens
actcaccaaaatatagt

SEQ ID NO: 192599 - DNA, 14 bp, Homo sapiens
actcaccagggtcc

SEQ ID NO: 192600 - DNA, 15 bp, Homo sapiens
actcaccagggtccg

SEQ ID NO: 192601 - DNA, 19 bp, Homo sapiens
actcaccagggtccgcacc

SEQ ID NO: 192602 - DNA, 11 bp, Homo sapiens
actcacctcct

SEQ ID NO: 192603 - DNA, 13 bp, Homo sapiens
actcacctcctcc

SEQ ID NO: 192604 - DNA, 13 bp, Homo sapiens
actcacctgctgg

SEQ ID NO: 192605 - DNA, 20 bp, Homo sapiens
actcacctgctggcccctca

SEQ ID NO: 192606 - DNA, 14 bp, Homo sapiens
actcaccttgaaca

SEQ ID NO: 192607 - DNA, 16 bp, Homo sapiens
actcactccagcccaa

SEQ ID NO: 192608 - DNA, 22 bp, Homo sapiens
actcactgctcaagaagacatg

SEQ ID NO: 192609 - DNA, 11 bp, Homo sapiens
actcactgtgc

SEQ ID NO: 192610 - DNA, 14 bp, Homo sapiens
actcactgtgctcc

SEQ ID NO: 192611 - DNA, 13 bp, Homo sapiens
actcacttttcac

SEQ ID NO: 192612 - DNA, 19 bp, Homo sapiens
actcacttttcacttgtct

SEQ ID NO: 192613 - DNA, 15 bp, Homo sapiens
actcagaatgctcta

SEQ ID NO: 192614 - DNA, 17 bp, Homo sapiens
actcagaattattcata

SEQ ID NO: 192615 - DNA, 14 bp, Homo sapiens
actcagagcagagc

SEQ ID NO: 192616 - DNA, 19 bp, Homo sapiens
actcagatcactactgcag

SEQ ID NO: 192617 - DNA, 12 bp, Homo sapiens
actcagatgtcc

SEQ ID NO: 192618 - DNA, 16 bp, Homo sapiens
actcagcagttgacat

SEQ ID NO: 192619 - DNA, 14 bp, Homo sapiens
actcagcatcccca

SEQ ID NO: 192620 - DNA, 12 bp, Homo sapiens
actcagccttaa

SEQ ID NO: 192621 - DNA, 20 bp, Homo sapiens
actcagctgagaaggccagc

SEQ ID NO: 192622 - DNA, 18 bp, Homo sapiens
actcaggatccagtccct

SEQ ID NO: 192623 - DNA, 12 bp, Homo sapiens
actcaggcccac

SEQ ID NO: 192624 - DNA, 14 bp, Homo sapiens
actcaggcctgcca

SEQ ID NO: 192625 - DNA, 16 bp, Homo sapiens
actcagggctggcccg

SEQ ID NO: 192626 - DNA, 15 bp, Homo sapiens
actcagtgtatttta

SEQ ID NO: 192627 - DNA, 21 bp, Homo sapiens
actcagtgtggactgggaagc

SEQ ID NO: 192628 - DNA, 22 bp, Homo sapiens
actcagtttgtcagactttaaa

SEQ ID NO: 192629 - DNA, 18 bp, Homo sapiens
actcataaaggtttttgt

SEQ ID NO: 192630 - DNA, 21 bp, Homo sapiens
actcatatgagtatctttaaa

SEQ ID NO: 192631 - DNA, 20 bp, Homo sapiens
actcatattctgggctcctg

SEQ ID NO: 192632 - DNA, 12 bp, Homo sapiens
actcatcataaa

SEQ ID NO: 192633 - DNA, 17 bp, Homo sapiens
actcatcataaaataaa

SEQ ID NO: 192634 - DNA, 20 bp, Homo sapiens
actcatctgttatcctgcta

SEQ ID NO: 192635 - DNA, 15 bp, Homo sapiens
actcatttttctata

SEQ ID NO: 192636 - DNA, 19 bp, Homo sapiens
actcatttttgccatacat

SEQ ID NO: 192637 - DNA, 14 bp, Homo sapiens
actccaactcttcc

SEQ ID NO: 192638 - DNA, 13 bp, Homo sapiens
actccaaggcaaa

SEQ ID NO: 192639 - DNA, 20 bp, Homo sapiens
actccaaggcaaatgtccaa

SEQ ID NO: 192640 - DNA, 22 bp, Homo sapiens
actccaaggcaaatgtccaagc

SEQ ID NO: 192641 - DNA, 23 bp, Homo sapiens
actccaaggcaaatgtccaagca

SEQ ID NO: 192642 - DNA, 19 bp, Homo sapiens
actccacagggactgttct

SEQ ID NO: 192643 - DNA, 13 bp, Homo sapiens
actccactcccct

SEQ ID NO: 192644 - DNA, 22 bp, Homo sapiens
actccactctccttcgtgtctc

SEQ ID NO: 192645 - DNA, 23 bp, Homo sapiens
actccactctccttcgtgtctct

SEQ ID NO: 192646 - DNA, 15 bp, Homo sapiens
actccactgacctgg

SEQ ID NO: 192647 - DNA, 19 bp, Homo sapiens
actccactgacctggaaga

SEQ ID NO: 192648 - DNA, 23 bp, Homo sapiens
actccagaatctgctgttgccat

SEQ ID NO: 192649 - DNA, 13 bp, Homo sapiens
actccagacccct

SEQ ID NO: 192650 - DNA, 21 bp, Homo sapiens
actccagacccctggcttttc

SEQ ID NO: 192651 - DNA, 14 bp, Homo sapiens
actccagagtctga

SEQ ID NO: 192652 - DNA, 17 bp, Homo sapiens
actccagagtctgagcc

SEQ ID NO: 192653 - DNA, 18 bp, Homo sapiens
actccagagtctgagccc

SEQ ID NO: 192654 - DNA, 12 bp, Homo sapiens
actccagcctgg

SEQ ID NO: 192655 - DNA, 15 bp, Homo sapiens
actccagcctgggca

SEQ ID NO: 192656 - DNA, 14 bp, Homo sapiens
actccagcctgggt

SEQ ID NO: 192657 - DNA, 15 bp, Homo sapiens
actccagcctgggtg

SEQ ID NO: 192658 - DNA, 23 bp, Homo sapiens
actccagcggttgccttttttat

SEQ ID NO: 192659 - DNA, 20 bp, Homo sapiens
actccaggaaggggctggac

SEQ ID NO: 192660 - DNA, 13 bp, Homo sapiens
actccaggagagg

SEQ ID NO: 192661 - DNA, 14 bp, Homo sapiens
actccaggagagga

SEQ ID NO: 192662 - DNA, 18 bp, Homo sapiens
actccaggatcctcctgg

SEQ ID NO: 192663 - DNA, 15 bp, Homo sapiens
aacccgactgtgaaa

SEQ ID NO: 192664 - DNA, 13 bp, Homo sapiens
aacccgctgcttc

SEQ ID NO: 192665 - DNA, 19 bp, Homo sapiens
aacccggtcccaggccgca

SEQ ID NO: 192666 - DNA, 15 bp, Homo sapiens
aaccctacagtatat

SEQ ID NO: 192667 - DNA, 16 bp, Homo sapiens
aaccctacagtatata

SEQ ID NO: 192668 - DNA, 18 bp, Homo sapiens
aaccctccacctcctctc

SEQ ID NO: 192669 - DNA, 14 bp, Homo sapiens
aaccctccctcagc

SEQ ID NO: 192670 - DNA, 19 bp, Homo sapiens
aaccctccctcagcccctc

SEQ ID NO: 192671 - DNA, 20 bp, Homo sapiens
aaccctccctcagcccctct

SEQ ID NO: 192672 - DNA, 21 bp, Homo sapiens
aaccctccctcagcccctctt

SEQ ID NO: 192673 - DNA, 19 bp, Homo sapiens
aaccctcctatcacctccc

SEQ ID NO: 192674 - DNA, 21 bp, Homo sapiens
aaccctcctatcacctcccct

SEQ ID NO: 192675 - DNA, 11 bp, Homo sapiens
aaccctgcccc

SEQ ID NO: 192676 - DNA, 12 bp, Homo sapiens
aaccctgcccct

SEQ ID NO: 192677 - DNA, 17 bp, Homo sapiens
aaccctgcctctcagag

SEQ ID NO: 192678 - DNA, 20 bp, Homo sapiens
aaccctgcttctgctgccct

SEQ ID NO: 192679 - DNA, 18 bp, Homo sapiens
aaccctggggactctgct

SEQ ID NO: 192680 - DNA, 20 bp, Homo sapiens
aaccctggggactctgcttg

SEQ ID NO: 192681 - DNA, 13 bp, Homo sapiens
aacccttgtcagt

SEQ ID NO: 192682 - DNA, 21 bp, Homo sapiens
aacccttgtcagtgacagtat

SEQ ID NO: 192683 - DNA, 22 bp, Homo sapiens
aacccttttggcccccgagctg

SEQ ID NO: 192684 - DNA, 15 bp, Homo sapiens
aaccgagcaaagatc

SEQ ID NO: 192685 - DNA, 17 bp, Homo sapiens
aaccgagcaaagatcaa

SEQ ID NO: 192686 - DNA, 15 bp, Homo sapiens
aaccgagccagcagc

SEQ ID NO: 192687 - DNA, 18 bp, Homo sapiens
aacctaaggcaacatttc

SEQ ID NO: 192688 - DNA, 14 bp, Homo sapiens
aacctacaaaaaaa

SEQ ID NO: 192689 - DNA, 23 bp, Homo sapiens
aacctaccttcatttcaggaggg

SEQ ID NO: 192690 - DNA, 17 bp, Homo sapiens
aacctacgaccccagag

SEQ ID NO: 192691 - DNA, 22 bp, Homo sapiens
aacctactagacaatgatgtga

SEQ ID NO: 192692 - DNA, 20 bp, Homo sapiens
aacctcaagggctttcccac

SEQ ID NO: 192693 - DNA, 11 bp, Homo sapiens
aacctccacct

SEQ ID NO: 192694 - DNA, 18 bp, Homo sapiens
aacctccatcctgccagg

SEQ ID NO: 192695 - DNA, 19 bp, Homo sapiens
aacctccatcctgccagga

SEQ ID NO: 192696 - DNA, 12 bp, Homo sapiens
aacctccctggg

SEQ ID NO: 192697 - DNA, 15 bp, Homo sapiens
aacctctacaggcat

SEQ ID NO: 192698 - DNA, 16 bp, Homo sapiens
aacctctacaggcatt

SEQ ID NO: 192699 - DNA, 17 bp, Homo sapiens
aacctctatatctttaa

SEQ ID NO: 192700 - DNA, 14 bp, Homo sapiens
aacctctatatgtt

SEQ ID NO: 192701 - DNA, 15 bp, Homo sapiens
aacctctctgatctt

SEQ ID NO: 192702 - DNA, 23 bp, Homo sapiens
aacctctctgatcttgtgctcag

SEQ ID NO: 192703 - DNA, 20 bp, Homo sapiens
aacctgacagatgtcagccg

SEQ ID NO: 192704 - DNA, 16 bp, Homo sapiens
aacctgcaaaatctgt

SEQ ID NO: 192705 - DNA, 22 bp, Homo sapiens
aacctgcagttcctgagtacct

SEQ ID NO: 192706 - DNA, 14 bp, Homo sapiens
aacctgcatgcagc

SEQ ID NO: 192707 - DNA, 16 bp, Homo sapiens
aacctgccacaatgtg

SEQ ID NO: 192708 - DNA, 11 bp, Homo sapiens
aacctgccctg

SEQ ID NO: 192709 - DNA, 13 bp, Homo sapiens
aacctgccctgcc

SEQ ID NO: 192710 - DNA, 16 bp, Homo sapiens
aacctgccctgcctga

SEQ ID NO: 192711 - DNA, 19 bp, Homo sapiens
aacctgccctgcctgaggg

SEQ ID NO: 192712 - DNA, 14 bp, Homo sapiens
aacctgcctgtgca

SEQ ID NO: 192713 - DNA, 19 bp, Homo sapiens
aacctgcctgtgcatgacc

SEQ ID NO: 192714 - DNA, 23 bp, Homo sapiens
aacctgggcttaagttttacttg

SEQ ID NO: 192715 - DNA, 14 bp, Homo sapiens
aacctggtgctgga

SEQ ID NO: 192716 - DNA, 11 bp, Homo sapiens
aacctggtggc

SEQ ID NO: 192717 - DNA, 15 bp, Homo sapiens
aacctggtggctgga

SEQ ID NO: 192718 - DNA, 20 bp, Homo sapiens
actcctgattttgtagttaa

SEQ ID NO: 192719 - DNA, 16 bp, Homo sapiens
actcctgatttttatc

SEQ ID NO: 192720 - DNA, 15 bp, Homo sapiens
actcctgcaaaattt

SEQ ID NO: 192721 - DNA, 17 bp, Homo sapiens
actcctggcctcaagcc

SEQ ID NO: 192722 - DNA, 16 bp, Homo sapiens
actcctggggcctctt

SEQ ID NO: 192723 - DNA, 13 bp, Homo sapiens
actcctgtacact

SEQ ID NO: 192724 - DNA, 15 bp, Homo sapiens
actcctgtacactga

SEQ ID NO: 192725 - DNA, 16 bp, Homo sapiens
actcctgtacactgaa

SEQ ID NO: 192726 - DNA, 12 bp, Homo sapiens
actcctgtcccg

SEQ ID NO: 192727 - DNA, 19 bp, Homo sapiens
actcctgtcccgccttcct

SEQ ID NO: 192728 - DNA, 19 bp, Homo sapiens
actcctgtgtgtggaaggc

SEQ ID NO: 192729 - DNA, 20 bp, Homo sapiens
actcctgttacttacctaaa

SEQ ID NO: 192730 - DNA, 22 bp, Homo sapiens
actccttaatatgatctgtgga

SEQ ID NO: 192731 - DNA, 15 bp, Homo sapiens
actccttattttgta

SEQ ID NO: 192732 - DNA, 14 bp, Homo sapiens
actccttccatcct

SEQ ID NO: 192733 - DNA, 11 bp, Homo sapiens
actccttcctc

SEQ ID NO: 192734 - DNA, 20 bp, Homo sapiens
actccttcctgccacctgct

SEQ ID NO: 192735 - DNA, 14 bp, Homo sapiens
actccttctcccca

SEQ ID NO: 192736 - DNA, 15 bp, Homo sapiens
actccttctccccaa

SEQ ID NO: 192737 - DNA, 16 bp, Homo sapiens
actccttggatttgca

SEQ ID NO: 192738 - DNA, 22 bp, Homo sapiens
actccttggatttgcatttttg

SEQ ID NO: 192739 - DNA, 14 bp, Homo sapiens
actccttggcctag

SEQ ID NO: 192740 - DNA, 16 bp, Homo sapiens
actccttggcctagcc

SEQ ID NO: 192741 - DNA, 16 bp, Homo sapiens
actcgagaccatcctg

SEQ ID NO: 192742 - DNA, 21 bp, Homo sapiens
actcgagaccatcctggcccc

SEQ ID NO: 192743 - DNA, 11 bp, Homo sapiens
actcgatgcac

SEQ ID NO: 192744 - DNA, 13 bp, Homo sapiens
actcgcagtcgca

SEQ ID NO: 192745 - DNA, 14 bp, Homo sapiens
actcgcccgcccac

SEQ ID NO: 192746 - DNA, 15 bp, Homo sapiens
actcgcccgcccact

SEQ ID NO: 192747 - DNA, 18 bp, Homo sapiens
actcgcttgccgggcctg

SEQ ID NO: 192748 - DNA, 20 bp, Homo sapiens
actcgggctaagtccagctc

SEQ ID NO: 192749 - DNA, 18 bp, Homo sapiens
actcggtctgagaagatt

SEQ ID NO: 192750 - DNA, 14 bp, Homo sapiens
actcgtatatgtct

SEQ ID NO: 192751 - DNA, 12 bp, Homo sapiens
actcgtctgatg

SEQ ID NO: 192752 - DNA, 13 bp, Homo sapiens
actcgtctgatgt

SEQ ID NO: 192753 - DNA, 13 bp, Homo sapiens
actcgtgtgcatg

SEQ ID NO: 192754 - DNA, 18 bp, Homo sapiens
actcgtgtgcatgagaat

SEQ ID NO: 192755 - DNA, 23 bp, Homo sapiens
actcgtgtgcatgagaatgtcat

SEQ ID NO: 192756 - DNA, 19 bp, Homo sapiens
actcgttctcgtgacccag

SEQ ID NO: 192757 - DNA, 17 bp, Homo sapiens
actctaacactcgactc

SEQ ID NO: 192758 - DNA, 22 bp, Homo sapiens
actctaagaaatggctttccac

SEQ ID NO: 192759 - DNA, 16 bp, Homo sapiens
actctaagtgtaaaaa

SEQ ID NO: 192760 - DNA, 21 bp, Homo sapiens
actctaatagtgcttaaaaat

SEQ ID NO: 192761 - DNA, 22 bp, Homo sapiens
actctaattcccattttgcaaa

SEQ ID NO: 192762 - DNA, 16 bp, Homo sapiens
actctaattggtcatt

SEQ ID NO: 192763 - DNA, 13 bp, Homo sapiens
actctacataatt

SEQ ID NO: 192764 - DNA, 17 bp, Homo sapiens
actctacccatattaca

SEQ ID NO: 192765 - DNA, 15 bp, Homo sapiens
actctacccctgctc

SEQ ID NO: 192766 - DNA, 15 bp, Homo sapiens
actctaccctcccac

SEQ ID NO: 192767 - DNA, 23 bp, Homo sapiens
actctaccctggtaggaaagcac

SEQ ID NO: 192768 - DNA, 17 bp, Homo sapiens
actctacgccaaagtgc

SEQ ID NO: 192769 - DNA, 23 bp, Homo sapiens
actctagaaaacgcgaccttggc

SEQ ID NO: 192770 - DNA, 23 bp, Homo sapiens
actctagtgacttcctggtgagg

SEQ ID NO: 192771 - DNA, 17 bp, Homo sapiens
actctatctgggcctgg

SEQ ID NO: 192772 - DNA, 18 bp, Homo sapiens
actctatctgggcctggg

SEQ ID NO: 192773 - DNA, 14 bp, Homo sapiens
actctattctcaaa

SEQ ID NO: 192774 - DNA, 21 bp, Homo sapiens
actctcccagaggctcctgga

SEQ ID NO: 192775 - DNA, 11 bp, Homo sapiens
actctccccac

SEQ ID NO: 192776 - DNA, 14 bp, Homo sapiens
actctccccacact

SEQ ID NO: 192777 - DNA, 12 bp, Homo sapiens
actctccccagt

SEQ ID NO: 192778 - DNA, 15 bp, Homo sapiens
actctccccagtgcc

SEQ ID NO: 192779 - DNA, 20 bp, Homo sapiens
actctccccagtgcctgcca

SEQ ID NO: 192780 - DNA, 23 bp, Homo sapiens
actctcctagagacagaagcagg

SEQ ID NO: 192781 - DNA, 14 bp, Homo sapiens
actctcctcatctc

SEQ ID NO: 192782 - DNA, 12 bp, Homo sapiens
actctcctcctc

SEQ ID NO: 192783 - DNA, 16 bp, Homo sapiens
actctcctcctcccct

SEQ ID NO: 192784 - DNA, 20 bp, Homo sapiens
actctcctcggccccctcca

SEQ ID NO: 192785 - DNA, 17 bp, Homo sapiens
actctcctgctcctcag

SEQ ID NO: 192786 - DNA, 13 bp, Homo sapiens
actctcctgggcc

SEQ ID NO: 192787 - DNA, 16 bp, Homo sapiens
actctcctgggcccct

SEQ ID NO: 192788 - DNA, 23 bp, Homo sapiens
actctccttcgtgtctctcccac

SEQ ID NO: 192789 - DNA, 13 bp, Homo sapiens
actctcctttgat

SEQ ID NO: 192790 - DNA, 13 bp, Homo sapiens
actctcggggccc

SEQ ID NO: 192791 - DNA, 22 bp, Homo sapiens
actctcggggcccttggggcct

SEQ ID NO: 192792 - DNA, 22 bp, Homo sapiens
actctctactggtaggaagagg

SEQ ID NO: 192793 - DNA, 19 bp, Homo sapiens
actctctcctctctctccc

SEQ ID NO: 192794 - DNA, 18 bp, Homo sapiens
actgatgggtcctgctgc

SEQ ID NO: 192795 - DNA, 15 bp, Homo sapiens
actgatgtcatcttg

SEQ ID NO: 192796 - DNA, 19 bp, Homo sapiens
actgatgttaggctgggcc

SEQ ID NO: 192797 - DNA, 22 bp, Homo sapiens
actgatttacaagactaacctt

SEQ ID NO: 192798 - DNA, 13 bp, Homo sapiens
actgatttcacaa

SEQ ID NO: 192799 - DNA, 17 bp, Homo sapiens
actgatttcacaacaga

SEQ ID NO: 192800 - DNA, 17 bp, Homo sapiens
actgcaaaaagtacata

SEQ ID NO: 192801 - DNA, 19 bp, Homo sapiens
actgcaaattgtagcccag

SEQ ID NO: 192802 - DNA, 21 bp, Homo sapiens
actgcaaattgtagcccagtt

SEQ ID NO: 192803 - DNA, 12 bp, Homo sapiens
actgcaacagga

SEQ ID NO: 192804 - DNA, 14 bp, Homo sapiens
actgcaacttctgc

SEQ ID NO: 192805 - DNA, 17 bp, Homo sapiens
actgcaagctccaactc

SEQ ID NO: 192806 - DNA, 15 bp, Homo sapiens
actgcaatagagact

SEQ ID NO: 192807 - DNA, 16 bp, Homo sapiens
actgcaatagagactg

SEQ ID NO: 192808 - DNA, 18 bp, Homo sapiens
actgcaatagagactgta

SEQ ID NO: 192809 - DNA, 19 bp, Homo sapiens
actgcaatagagactgtag

SEQ ID NO: 192810 - DNA, 22 bp, Homo sapiens
actgcaatagagactgtagatt

SEQ ID NO: 192811 - DNA, 22 bp, Homo sapiens
actgcaatttccattcttttaa

SEQ ID NO: 192812 - DNA, 17 bp, Homo sapiens
actgcacacacagctcc

SEQ ID NO: 192813 - DNA, 14 bp, Homo sapiens
actgcacagtgctg

SEQ ID NO: 192814 - DNA, 17 bp, Homo sapiens
actgcacccagctccag

SEQ ID NO: 192815 - DNA, 18 bp, Homo sapiens
actgcacccagctccagg

SEQ ID NO: 192816 - DNA, 16 bp, Homo sapiens
actgcactccagcctg

SEQ ID NO: 192817 - DNA, 20 bp, Homo sapiens
actgcactccagcctgggca

SEQ ID NO: 192818 - DNA, 13 bp, Homo sapiens
actgcactgtttt

SEQ ID NO: 192819 - DNA, 19 bp, Homo sapiens
actgcacttggtgctgctt

SEQ ID NO: 192820 - DNA, 20 bp, Homo sapiens
actgcagaggagccacctgg

SEQ ID NO: 192821 - DNA, 22 bp, Homo sapiens
actgcagaggagccacctgggc

SEQ ID NO: 192822 - DNA, 21 bp, Homo sapiens
actgcagcctcgaactcctgg

SEQ ID NO: 192823 - DNA, 22 bp, Homo sapiens
actgcagcctctgcctcccagg

SEQ ID NO: 192824 - DNA, 23 bp, Homo sapiens
actgcagcctctgcctcccaggc

SEQ ID NO: 192825 - DNA, 12 bp, Homo sapiens
actgcagctgca

SEQ ID NO: 192826 - DNA, 16 bp, Homo sapiens
actgcagctgcaccag

SEQ ID NO: 192827 - DNA, 17 bp, Homo sapiens
actgcagggactgccag

SEQ ID NO: 192828 - DNA, 18 bp, Homo sapiens
actgcagtcacccctgtc

SEQ ID NO: 192829 - DNA, 19 bp, Homo sapiens
actgcagtcacccctgtct

SEQ ID NO: 192830 - DNA, 20 bp, Homo sapiens
actgcagtcacccctgtctg

SEQ ID NO: 192831 - DNA, 16 bp, Homo sapiens
actgcatccaggcctg

SEQ ID NO: 192832 - DNA, 23 bp, Homo sapiens
actgcatccaggcctgaggctgc

SEQ ID NO: 192833 - DNA, 22 bp, Homo sapiens
actgcatcctactcctacctgg

SEQ ID NO: 192834 - DNA, 14 bp, Homo sapiens
actgcatgcaagct

SEQ ID NO: 192835 - DNA, 16 bp, Homo sapiens
actgcatgcaagctca

SEQ ID NO: 192836 - DNA, 17 bp, Homo sapiens
actgcatgcaagctcag

SEQ ID NO: 192837 - DNA, 13 bp, Homo sapiens
actgcatgctgct

SEQ ID NO: 192838 - DNA, 17 bp, Homo sapiens
actgcatgctgctggac

SEQ ID NO: 192839 - DNA, 14 bp, Homo sapiens
actgcatggaccta

SEQ ID NO: 192840 - DNA, 20 bp, Homo sapiens
actgcatggacctaacattc

SEQ ID NO: 192841 - DNA, 21 bp, Homo sapiens
actgcatggacctaacattcg

SEQ ID NO: 192842 - DNA, 16 bp, Homo sapiens
actgcatggtaattta

SEQ ID NO: 192843 - DNA, 21 bp, Homo sapiens
actgccaaagggaaatatcat

SEQ ID NO: 192844 - DNA, 22 bp, Homo sapiens
actgccacacgtctgaccctct

SEQ ID NO: 192845 - DNA, 12 bp, Homo sapiens
actgccagagct

SEQ ID NO: 192846 - DNA, 17 bp, Homo sapiens
actgccaggattttgta

SEQ ID NO: 192847 - DNA, 18 bp, Homo sapiens
actgccaggattttgtat

SEQ ID NO: 192848 - DNA, 23 bp, Homo sapiens
actgccaggattttgtattgcca

SEQ ID NO: 192849 - DNA, 13 bp, Homo sapiens
actgccaggcacc

SEQ ID NO: 192850 - DNA, 21 bp, Homo sapiens
actgccatgatagctggggct

SEQ ID NO: 192851 - DNA, 18 bp, Homo sapiens
actgccatggaggcacac

SEQ ID NO: 192852 - DNA, 21 bp, Homo sapiens
actgccatggaggcacacagc

SEQ ID NO: 192853 - DNA, 20 bp, Homo sapiens
actgccattagactgaattt

SEQ ID NO: 192854 - DNA, 16 bp, Homo sapiens
actgcccaccctgggc

SEQ ID NO: 192855 - DNA, 18 bp, Homo sapiens
actgcccaccctgggcct

SEQ ID NO: 192856 - DNA, 19 bp, Homo sapiens
actgcccaggcctgcctgt

SEQ ID NO: 192857 - DNA, 16 bp, Homo sapiens
actgcccccagaaagc

SEQ ID NO: 192858 - DNA, 21 bp, Homo sapiens
actgcccccagaaagcctcct

SEQ ID NO: 192859 - DNA, 22 bp, Homo sapiens
actgcccccagaaagcctcctg

SEQ ID NO: 192860 - DNA, 15 bp, Homo sapiens
aactgaaaacataaa

SEQ ID NO: 192861 - DNA, 18 bp, Homo sapiens
aactgaaaacataaaaag

SEQ ID NO: 192862 - DNA, 14 bp, Homo sapiens
aactgaaaaccagt

SEQ ID NO: 192863 - DNA, 21 bp, Homo sapiens
aactgaaaactcccatttacg

SEQ ID NO: 192864 - DNA, 19 bp, Homo sapiens
aactgaaaatctaatatta

SEQ ID NO: 192865 - DNA, 15 bp, Homo sapiens
aactgaaaatgtaaa

SEQ ID NO: 192866 - DNA, 16 bp, Homo sapiens
aactgaacaaaaaaat

SEQ ID NO: 192867 - DNA, 11 bp, Homo sapiens
aactgaagcaa

SEQ ID NO: 192868 - DNA, 12 bp, Homo sapiens
aactgaagcaaa

SEQ ID NO: 192869 - DNA, 19 bp, Homo sapiens
aactgaccagcctccatgc

SEQ ID NO: 192870 - DNA, 22 bp, Homo sapiens
aactgactattcttgatgtaaa

SEQ ID NO: 192871 - DNA, 23 bp, Homo sapiens
aactgactattcttgatgtaaaa

SEQ ID NO: 192872 - DNA, 15 bp, Homo sapiens
aactgacttctgcta

SEQ ID NO: 192873 - DNA, 13 bp, Homo sapiens
aactgactttatc

SEQ ID NO: 192874 - DNA, 14 bp, Homo sapiens
aactgactttctcc

SEQ ID NO: 192875 - DNA, 14 bp, Homo sapiens
aactgagagaagta

SEQ ID NO: 192876 - DNA, 10 bp, Homo sapiens
aactgagccg

SEQ ID NO: 192877 - DNA, 18 bp, Homo sapiens
aactgagctcctctgggc

SEQ ID NO: 192878 - DNA, 23 bp, Homo sapiens
aactgaggatgacccggggcagc

SEQ ID NO: 192879 - DNA, 15 bp, Homo sapiens
aactgaggcccagag

SEQ ID NO: 192880 - DNA, 15 bp, Homo sapiens
aactgagtcctgttc

SEQ ID NO: 192881 - DNA, 19 bp, Homo sapiens
aactgatcatttgcagctg

SEQ ID NO: 192882 - DNA, 22 bp, Homo sapiens
aactgatggaccgggtgggcct

SEQ ID NO: 192883 - DNA, 19 bp, Homo sapiens
aactgattcttatgattac

SEQ ID NO: 192884 - DNA, 17 bp, Homo sapiens
aactgcaatagagactg

SEQ ID NO: 192885 - DNA, 18 bp, Homo sapiens
aactgcaatagagactgt

SEQ ID NO: 192886 - DNA, 23 bp, Homo sapiens
aactgcaatagagactgtagatt

SEQ ID NO: 192887 - DNA, 15 bp, Homo sapiens
aactgcaatttccat

SEQ ID NO: 192888 - DNA, 15 bp, Homo sapiens
aactgcacagtgctg

SEQ ID NO: 192889 - DNA, 18 bp, Homo sapiens
aactgcccattgtaactt

SEQ ID NO: 192890 - DNA, 13 bp, Homo sapiens
aactgcccccact

SEQ ID NO: 192891 - DNA, 14 bp, Homo sapiens
aactgccctgtcta

SEQ ID NO: 192892 - DNA, 23 bp, Homo sapiens
aactgcccttttaaatggcatga

SEQ ID NO: 192893 - DNA, 16 bp, Homo sapiens
aactgccgctggaggc

SEQ ID NO: 192894 - DNA, 20 bp, Homo sapiens
aactgcctaccagtcgccct

SEQ ID NO: 192895 - DNA, 15 bp, Homo sapiens
aactgcctctttcct

SEQ ID NO: 192896 - DNA, 14 bp, Homo sapiens
aactgcctgttcct

SEQ ID NO: 192897 - DNA, 16 bp, Homo sapiens
aactgctgagccactc

SEQ ID NO: 192898 - DNA, 10 bp, Homo sapiens
aactgctgca

SEQ ID NO: 192899 - DNA, 21 bp, Homo sapiens
aactgcttgcatttctttatt

SEQ ID NO: 192900 - DNA, 20 bp, Homo sapiens
aactgctttatcccacggaa

SEQ ID NO: 192901 - DNA, 22 bp, Homo sapiens
aactgcttttttttttccagca

SEQ ID NO: 192902 - DNA, 14 bp, Homo sapiens
aactggccccaggc

SEQ ID NO: 192903 - DNA, 22 bp, Homo sapiens
aactggcttctgcttgtcatcc

SEQ ID NO: 192904 - DNA, 18 bp, Homo sapiens
aactggctttttcccagc

SEQ ID NO: 192905 - DNA, 19 bp, Homo sapiens
aactgggaagatgctggcc

SEQ ID NO: 192906 - DNA, 22 bp, Homo sapiens
aactgggccttgtgtgctggct

SEQ ID NO: 192907 - DNA, 18 bp, Homo sapiens
aactggggtgatgtttta

SEQ ID NO: 192908 - DNA, 13 bp, Homo sapiens
aactggtccaggc

SEQ ID NO: 192909 - DNA, 17 bp, Homo sapiens
aactggtccaggccagg

SEQ ID NO: 192910 - DNA, 22 bp, Homo sapiens
aactggtccaggccaggcctca

SEQ ID NO: 192911 - DNA, 16 bp, Homo sapiens
aactggttcttgcctt

SEQ ID NO: 192912 - DNA, 18 bp, Homo sapiens
aactgtacttttaaggca

SEQ ID NO: 192913 - DNA, 14 bp, Homo sapiens
aactgtagaaatga

SEQ ID NO: 192914 - DNA, 19 bp, Homo sapiens
aactgtagaaatgatgatg

SEQ ID NO: 192915 - DNA, 19 bp, Homo sapiens
aactgtatcaaatctgtat

SEQ ID NO: 192916 - DNA, 14 bp, Homo sapiens
aactgtatgtcaga

SEQ ID NO: 192917 - DNA, 18 bp, Homo sapiens
aactgtatgtcttataag

SEQ ID NO: 192918 - DNA, 19 bp, Homo sapiens
aactgtatgtcttataaga

SEQ ID NO: 192919 - DNA, 17 bp, Homo sapiens
aactgtcctctttcaga

SEQ ID NO: 192920 - DNA, 19 bp, Homo sapiens
aactgtcctctttcagaaa

SEQ ID NO: 192921 - DNA, 20 bp, Homo sapiens
aactgtcctctttcagaaaa

SEQ ID NO: 192922 - DNA, 19 bp, Homo sapiens
aactgtgaataataaatac

SEQ ID NO: 192923 - DNA, 14 bp, Homo sapiens
accctcccctctcc

SEQ ID NO: 192924 - DNA, 13 bp, Homo sapiens
accctccctgtcc

SEQ ID NO: 192925 - DNA, 14 bp, Homo sapiens
accctccctgtccc

SEQ ID NO: 192926 - DNA, 17 bp, Homo sapiens
accctccctgtcccctg

SEQ ID NO: 192927 - DNA, 21 bp, Homo sapiens
accctcctatcacctcccctc

SEQ ID NO: 192928 - DNA, 19 bp, Homo sapiens
accctcctctatttcttta

SEQ ID NO: 192929 - DNA, 15 bp, Homo sapiens
accctcgtggacacc

SEQ ID NO: 192930 - DNA, 20 bp, Homo sapiens
accctcgtggacacctgccc

SEQ ID NO: 192931 - DNA, 14 bp, Homo sapiens
accctctccacccc

SEQ ID NO: 192932 - DNA, 15 bp, Homo sapiens
accctctccacccca

SEQ ID NO: 192933 - DNA, 11 bp, Homo sapiens
accctctcttt

SEQ ID NO: 192934 - DNA, 18 bp, Homo sapiens
accctctggtccttctga

SEQ ID NO: 192935 - DNA, 23 bp, Homo sapiens
accctcttctcagctccactctg

SEQ ID NO: 192936 - DNA, 21 bp, Homo sapiens
accctgaatggttccatgcct

SEQ ID NO: 192937 - DNA, 15 bp, Homo sapiens
accctgaatttgaga

SEQ ID NO: 192938 - DNA, 17 bp, Homo sapiens
accctgagtgaacaccc

SEQ ID NO: 192939 - DNA, 17 bp, Homo sapiens
accctgatttcttgctt

SEQ ID NO: 192940 - DNA, 12 bp, Homo sapiens
accctgcagcca

SEQ ID NO: 192941 - DNA, 12 bp, Homo sapiens
accctgccctgc

SEQ ID NO: 192942 - DNA, 15 bp, Homo sapiens
accctgccctgcacc

SEQ ID NO: 192943 - DNA, 16 bp, Homo sapiens
accctgccctgcacct

SEQ ID NO: 192944 - DNA, 22 bp, Homo sapiens
accctgccgagggggctgtcat

SEQ ID NO: 192945 - DNA, 15 bp, Homo sapiens
accctgcctctcaga

SEQ ID NO: 192946 - DNA, 14 bp, Homo sapiens
accctgcctgagcc

SEQ ID NO: 192947 - DNA, 19 bp, Homo sapiens
accctgcctgagcccagga

SEQ ID NO: 192948 - DNA, 23 bp, Homo sapiens
accctgcctgagcccaggagctg

SEQ ID NO: 192949 - DNA, 18 bp, Homo sapiens
accctgccttatcttgca

SEQ ID NO: 192950 - DNA, 14 bp, Homo sapiens
accctgctaaatga

SEQ ID NO: 192951 - DNA, 15 bp, Homo sapiens
accctgctcctcctg

SEQ ID NO: 192952 - DNA, 22 bp, Homo sapiens
accctgcttcccaaactcccag

SEQ ID NO: 192953 - DNA, 21 bp, Homo sapiens
accctgcttctgctgccctga

SEQ ID NO: 192954 - DNA, 19 bp, Homo sapiens
accctgcttggggcctggc

SEQ ID NO: 192955 - DNA, 20 bp, Homo sapiens
accctgcttggggcctggcg

SEQ ID NO: 192956 - DNA, 24 bp, Homo sapiens
accctggaaactaccagtgggcat

SEQ ID NO: 192957 - DNA, 19 bp, Homo sapiens
accctggaaaggggagttg

SEQ ID NO: 192958 - DNA, 22 bp, Homo sapiens
accctggagcccggcagtgcac

SEQ ID NO: 192959 - DNA, 17 bp, Homo sapiens
accctggcagagaagag

SEQ ID NO: 192960 - DNA, 11 bp, Homo sapiens
accctggcccg

SEQ ID NO: 192961 - DNA, 22 bp, Homo sapiens
accctggcccgcccctcgctgc

SEQ ID NO: 192962 - DNA, 16 bp, Homo sapiens
accctgggcaacatga

SEQ ID NO: 192963 - DNA, 19 bp, Homo sapiens
accctggggcctggacctg

SEQ ID NO: 192964 - DNA, 22 bp, Homo sapiens
accctggggtaagtggagttgg

SEQ ID NO: 192965 - DNA, 21 bp, Homo sapiens
accctgggtcaccttcctggg

SEQ ID NO: 192966 - DNA, 14 bp, Homo sapiens
accctgggtgccat

SEQ ID NO: 192967 - DNA, 21 bp, Homo sapiens
accctgggtgccattcccagc

SEQ ID NO: 192968 - DNA, 19 bp, Homo sapiens
accctggtaggaaagcacc

SEQ ID NO: 192969 - DNA, 20 bp, Homo sapiens
accctggtgaggaagctcca

SEQ ID NO: 192970 - DNA, 14 bp, Homo sapiens
accctgtctctact

SEQ ID NO: 192971 - DNA, 19 bp, Homo sapiens
accctgtggcaaatgccag

SEQ ID NO: 192972 - DNA, 11 bp, Homo sapiens
accctgttgag

SEQ ID NO: 192973 - DNA, 19 bp, Homo sapiens
accctgttgagtatttgct

SEQ ID NO: 192974 - DNA, 19 bp, Homo sapiens
acccttaccccttagcctc

SEQ ID NO: 192975 - DNA, 19 bp, Homo sapiens
acccttagagattgcccca

SEQ ID NO: 192976 - DNA, 17 bp, Homo sapiens
acccttcacgctggctt

SEQ ID NO: 192977 - DNA, 12 bp, Homo sapiens
acccttcagacc

SEQ ID NO: 192978 - DNA, 16 bp, Homo sapiens
acccttcagaccccag

SEQ ID NO: 192979 - DNA, 10 bp, Homo sapiens
acccttcccc

SEQ ID NO: 192980 - DNA, 13 bp, Homo sapiens
acccttccccact

SEQ ID NO: 192981 - DNA, 22 bp, Homo sapiens
acccttcccctccttctccctt

SEQ ID NO: 192982 - DNA, 23 bp, Homo sapiens
acccttctactttttccttcctg

SEQ ID NO: 192983 - DNA, 16 bp, Homo sapiens
acccttctcccctgcc

SEQ ID NO: 192984 - DNA, 21 bp, Homo sapiens
acccttctcccctgccccgtc

SEQ ID NO: 192985 - DNA, 13 bp, Homo sapiens
acccttctgggca

SEQ ID NO: 192986 - DNA, 14 bp, Homo sapiens
acccttctgtgccc

SEQ ID NO: 192987 - DNA, 16 bp, Homo sapiens
acccttctgtgcccag

SEQ ID NO: 192988 - DNA, 18 bp, Homo sapiens
acccttctgtgcccagct

SEQ ID NO: 192989 - DNA, 14 bp, Homo sapiens
acccttgaatttct

SEQ ID NO: 192990 - DNA, 20 bp, Homo sapiens
acccttgaatttctagacag

SEQ ID NO: 192991 - DNA, 13 bp, Homo sapiens
acccttggacttg

SEQ ID NO: 192992 - DNA, 15 bp, Homo sapiens
acccttggcctgtcc

SEQ ID NO: 192993 - DNA, 15 bp, Homo sapiens
acccttggtagagtt

SEQ ID NO: 192994 - DNA, 19 bp, Homo sapiens
acccttggtagagtttatt

SEQ ID NO: 192995 - DNA, 20 bp, Homo sapiens
accctttagccaaacccttg

SEQ ID NO: 192996 - DNA, 23 bp, Homo sapiens
accctttcttttgaatcaatctg

SEQ ID NO: 192997 - DNA, 22 bp, Homo sapiens
accctttgctgtgaggctgtcc

SEQ ID NO: 192998 - DNA, 10 bp, Homo sapiens
acccttttct

SEQ ID NO: 192999 - DNA, 19 bp, Homo sapiens
acccttttgggtttctgcc

SEQ ID NO: 193000 - DNA, 20 bp, Homo sapiens
accgaggcgatgccacgctt

SEQ ID NO: 193001 - DNA, 15 bp, Homo sapiens
accgagtatctgtaa

SEQ ID NO: 193002 - DNA, 23 bp, Homo sapiens
accgagtatctgtaacccttgaa

SEQ ID NO: 193003 - DNA, 24 bp, Homo sapiens
accgagtctcttctccactggatg

SEQ ID NO: 193004 - DNA, 21 bp, Homo sapiens
accgagtgaacctaccttcat

SEQ ID NO: 193005 - DNA, 14 bp, Homo sapiens
accgatggtcccag

SEQ ID NO: 193006 - DNA, 15 bp, Homo sapiens
accgatggtcccagg

SEQ ID NO: 193007 - DNA, 23 bp, Homo sapiens
accgatggtcccaggaagcaggg

SEQ ID NO: 193008 - DNA, 24 bp, Homo sapiens
accgattctttggagttgtcacat

SEQ ID NO: 193009 - DNA, 19 bp, Homo sapiens
accgatttcagcacatgca

SEQ ID NO: 193010 - DNA, 23 bp, Homo sapiens
accgatttcagcacatgcactac

SEQ ID NO: 193011 - DNA, 16 bp, Homo sapiens
accgcatatgcatgcc

SEQ ID NO: 193012 - DNA, 19 bp, Homo sapiens
accgcatatgcatgccagg

SEQ ID NO: 193013 - DNA, 16 bp, Homo sapiens
accgcccaacccccac

SEQ ID NO: 193014 - DNA, 12 bp, Homo sapiens
accgcccaccca

SEQ ID NO: 193015 - DNA, 15 bp, Homo sapiens
accgcccagctctcc

SEQ ID NO: 193016 - DNA, 19 bp, Homo sapiens
accgccctcctcgctgtgc

SEQ ID NO: 193017 - DNA, 21 bp, Homo sapiens
accgccctcctcgctgtgcca

SEQ ID NO: 193018 - DNA, 12 bp, Homo sapiens
accgccctgggc

SEQ ID NO: 193019 - DNA, 15 bp, Homo sapiens
accgccctgggctgg

SEQ ID NO: 193020 - DNA, 20 bp, Homo sapiens
accgccctgggctggactgg

SEQ ID NO: 193021 - DNA, 13 bp, Homo sapiens
accgcctgcttca

SEQ ID NO: 193022 - DNA, 20 bp, Homo sapiens
accgcctgcttcacacccct

SEQ ID NO: 193023 - DNA, 13 bp, Homo sapiens
accgctccccagc

SEQ ID NO: 193024 - DNA, 17 bp, Homo sapiens
accgcttcacccctgca

SEQ ID NO: 193025 - DNA, 18 bp, Homo sapiens
accgcttcacccctgcac

SEQ ID NO: 193026 - DNA, 16 bp, Homo sapiens
accggaagctcctggt

SEQ ID NO: 193027 - DNA, 15 bp, Homo sapiens
accggagcggctgag

SEQ ID NO: 193028 - DNA, 23 bp, Homo sapiens
accgggagcctgcgtggcctggg

SEQ ID NO: 193029 - DNA, 14 bp, Homo sapiens
accggggcaagagg

SEQ ID NO: 193030 - DNA, 15 bp, Homo sapiens
accggggcaagaggg

SEQ ID NO: 193031 - DNA, 16 bp, Homo sapiens
accgggggctctgagc

SEQ ID NO: 193032 - DNA, 16 bp, Homo sapiens
accgggtgggcctggc

SEQ ID NO: 193033 - DNA, 21 bp, Homo sapiens
accgggtgggcctggcctgag

SEQ ID NO: 193034 - DNA, 23 bp, Homo sapiens
accgggtgggcctggcctgagct

SEQ ID NO: 193035 - DNA, 15 bp, Homo sapiens
accggttgcttctgg

SEQ ID NO: 193036 - DNA, 16 bp, Homo sapiens
accggttgcttctggg

SEQ ID NO: 193037 - DNA, 14 bp, Homo sapiens
accgtaattttatt

SEQ ID NO: 193038 - DNA, 13 bp, Homo sapiens
accgtactctcac

SEQ ID NO: 193039 - DNA, 23 bp, Homo sapiens
accgtcatggcttaatgtttatt

SEQ ID NO: 193040 - DNA, 23 bp, Homo sapiens
accgtgatttggaagagaggcac

SEQ ID NO: 193041 - DNA, 21 bp, Homo sapiens
accgtgccattgtactccagc

SEQ ID NO: 193042 - DNA, 22 bp, Homo sapiens
accgtgccattgtactccagcc

SEQ ID NO: 193043 - DNA, 19 bp, Homo sapiens
accttaaagcaataagttc

SEQ ID NO: 193044 - DNA, 12 bp, Homo sapiens
accttaaattaa

SEQ ID NO: 193045 - DNA, 14 bp, Homo sapiens
accttaaattaaac

SEQ ID NO: 193046 - DNA, 17 bp, Homo sapiens
accttaaattaaacaat

SEQ ID NO: 193047 - DNA, 21 bp, Homo sapiens
accttaaattaaacaatttat

SEQ ID NO: 193048 - DNA, 22 bp, Homo sapiens
accttaaattaaacaatttatt

SEQ ID NO: 193049 - DNA, 20 bp, Homo sapiens
accttaccaactttctgtaa

SEQ ID NO: 193050 - DNA, 18 bp, Homo sapiens
accttaccctactggctg

SEQ ID NO: 193051 - DNA, 20 bp, Homo sapiens
accttacttaaagcttgttt

SEQ ID NO: 193052 - DNA, 22 bp, Homo sapiens
accttagaaatcattgtagaaa

SEQ ID NO: 193053 - DNA, 16 bp, Homo sapiens
accttagcgttctgga

SEQ ID NO: 193054 - DNA, 13 bp, Homo sapiens
accttagctccct

SEQ ID NO: 193055 - DNA, 23 bp, Homo sapiens
accttagctccctcccgcacccc

SEQ ID NO: 193056 - DNA, 13 bp, Homo sapiens
accttatctgtgc

SEQ ID NO: 193057 - DNA, 22 bp, Homo sapiens
accttatctgtgcgtgaaacac

SEQ ID NO: 193058 - DNA, 22 bp, Homo sapiens
accttattgagcgtgattctgt

SEQ ID NO: 193059 - DNA, 14 bp, Homo sapiens
accttattgtacct

SEQ ID NO: 193060 - DNA, 17 bp, Homo sapiens
accttattgtacctctc

SEQ ID NO: 193061 - DNA, 18 bp, Homo sapiens
accttattgtacctctct

SEQ ID NO: 193062 - DNA, 13 bp, Homo sapiens
accttcaaagctg

SEQ ID NO: 193063 - DNA, 18 bp, Homo sapiens
accttcaccaagcttaga

SEQ ID NO: 193064 - DNA, 17 bp, Homo sapiens
aaatgccaggacagctg

SEQ ID NO: 193065 - DNA, 16 bp, Homo sapiens
aaatgcctctgccttg

SEQ ID NO: 193066 - DNA, 14 bp, Homo sapiens
aaatgctgatttaa

SEQ ID NO: 193067 - DNA, 14 bp, Homo sapiens
aaatgctgcctgcc

SEQ ID NO: 193068 - DNA, 17 bp, Homo sapiens
aaatgctgcgcccttcc

SEQ ID NO: 193069 - DNA, 14 bp, Homo sapiens
aaatgctgtgcaaa

SEQ ID NO: 193070 - DNA, 19 bp, Homo sapiens
aaatggaacaaacaatgaa

SEQ ID NO: 193071 - DNA, 17 bp, Homo sapiens
aaatggacgtgttatga

SEQ ID NO: 193072 - DNA, 19 bp, Homo sapiens
aaatggagcttgtacatat

SEQ ID NO: 193073 - DNA, 14 bp, Homo sapiens
aaatggatgacaaa

SEQ ID NO: 193074 - DNA, 14 bp, Homo sapiens
aaatggatgtaata

SEQ ID NO: 193075 - DNA, 16 bp, Homo sapiens
aaatggcacctgtata

SEQ ID NO: 193076 - DNA, 13 bp, Homo sapiens
aaatgggaaatgt

SEQ ID NO: 193077 - DNA, 19 bp, Homo sapiens
aaatgggactgatgtcatc

SEQ ID NO: 193078 - DNA, 23 bp, Homo sapiens
aaatgggggcggctggaaagagg

SEQ ID NO: 193079 - DNA, 18 bp, Homo sapiens
aaatggtgttttcatgta

SEQ ID NO: 193080 - DNA, 22 bp, Homo sapiens
aaatggtgttttcatgtaaata

SEQ ID NO: 193081 - DNA, 17 bp, Homo sapiens
aaatgtaaaaatgaagg

SEQ ID NO: 193082 - DNA, 18 bp, Homo sapiens
aaatgtaaaaatgaagga

SEQ ID NO: 193083 - DNA, 19 bp, Homo sapiens
aaatgtaaaaatgaaggaa

SEQ ID NO: 193084 - DNA, 18 bp, Homo sapiens
aaatgtagaagaaagcaa

SEQ ID NO: 193085 - DNA, 20 bp, Homo sapiens
aaatgtatcctgataaacat

SEQ ID NO: 193086 - DNA, 21 bp, Homo sapiens
aaatgtatcctgataaacatt

SEQ ID NO: 193087 - DNA, 23 bp, Homo sapiens
aaatgtatcctgataaacattaa

SEQ ID NO: 193088 - DNA, 13 bp, Homo sapiens
aaatgtattcaag

SEQ ID NO: 193089 - DNA, 17 bp, Homo sapiens
aaatgtattcaagcaaa

SEQ ID NO: 193090 - DNA, 22 bp, Homo sapiens
aaatgtattttgaaaacactta

SEQ ID NO: 193091 - DNA, 19 bp, Homo sapiens
aaatgtcccccacctcttt

SEQ ID NO: 193092 - DNA, 13 bp, Homo sapiens
aaatgtcctcaga

SEQ ID NO: 193093 - DNA, 22 bp, Homo sapiens
aaatgtcctccagaagcctctg

SEQ ID NO: 193094 - DNA, 19 bp, Homo sapiens
aaatgtcgattttcaataa

SEQ ID NO: 193095 - DNA, 23 bp, Homo sapiens
aaatgtctgtggccttgttctct

SEQ ID NO: 193096 - DNA, 13 bp, Homo sapiens
aaatgtctgtttc

SEQ ID NO: 193097 - DNA, 21 bp, Homo sapiens
aaatgtgatttttttatataa

SEQ ID NO: 193098 - DNA, 16 bp, Homo sapiens
aaatgtggatgctctt

SEQ ID NO: 193099 - DNA, 19 bp, Homo sapiens
aaatgtgggattatgggtc

SEQ ID NO: 193100 - DNA, 16 bp, Homo sapiens
aaatgtgtggtgctaa

SEQ ID NO: 193101 - DNA, 15 bp, Homo sapiens
aaatgtgtgttgact

SEQ ID NO: 193102 - DNA, 23 bp, Homo sapiens
aaatgtgtgtttttttagggttt

SEQ ID NO: 193103 - DNA, 17 bp, Homo sapiens
aaatgttaataaaggtt

SEQ ID NO: 193104 - DNA, 14 bp, Homo sapiens
aaatgttatgactc

SEQ ID NO: 193105 - DNA, 15 bp, Homo sapiens
aaatgttatgactcc

SEQ ID NO: 193106 - DNA, 20 bp, Homo sapiens
aaatgttattttttaattat

SEQ ID NO: 193107 - DNA, 11 bp, Homo sapiens
aaatgttcatt

SEQ ID NO: 193108 - DNA, 13 bp, Homo sapiens
aaatgttggtgca

SEQ ID NO: 193109 - DNA, 23 bp, Homo sapiens
aaatgttgttcattattggaggg

SEQ ID NO: 193110 - DNA, 22 bp, Homo sapiens
aaatgtttaatatctgactgaa

SEQ ID NO: 193111 - DNA, 11 bp, Homo sapiens
aaatgtttgtt

SEQ ID NO: 193112 - DNA, 22 bp, Homo sapiens
aaattaaagggcagatattctc

SEQ ID NO: 193113 - DNA, 17 bp, Homo sapiens
aaattaaataaatcttt

SEQ ID NO: 193114 - DNA, 13 bp, Homo sapiens
aaattaaataatt

SEQ ID NO: 193115 - DNA, 20 bp, Homo sapiens
aaattaaatatatgtatgta

SEQ ID NO: 193116 - DNA, 13 bp, Homo sapiens
aaattaaatctgt

SEQ ID NO: 193117 - DNA, 22 bp, Homo sapiens
aaattaaattcttattggccaa

SEQ ID NO: 193118 - DNA, 16 bp, Homo sapiens
aaattaacttctattt

SEQ ID NO: 193119 - DNA, 20 bp, Homo sapiens
aaattaacttctattttcaa

SEQ ID NO: 193120 - DNA, 12 bp, Homo sapiens
aaattaagacat

SEQ ID NO: 193121 - DNA, 16 bp, Homo sapiens
aaattaatacttcatt

SEQ ID NO: 193122 - DNA, 15 bp, Homo sapiens
aaattacaagtttca

SEQ ID NO: 193123 - DNA, 14 bp, Homo sapiens
aaattacagcttca

SEQ ID NO: 193124 - DNA, 16 bp, Homo sapiens
aaattagaaaaaaaca

SEQ ID NO: 193125 - DNA, 17 bp, Homo sapiens
aaattagaaaaaaacaa

SEQ ID NO: 193126 - DNA, 23 bp, Homo sapiens
aaattagaaaccttaatatgtgg

SEQ ID NO: 193127 - DNA, 14 bp, Homo sapiens
aaattagcatctgg

SEQ ID NO: 193128 - DNA, 14 bp, Homo sapiens
aaattaggaataaa

SEQ ID NO: 193129 - DNA, 15 bp, Homo sapiens
aaattagtgagattt

SEQ ID NO: 193130 - DNA, 15 bp, Homo sapiens
aaattataaactcta

SEQ ID NO: 193131 - DNA, 12 bp, Homo sapiens
aaattataagga

SEQ ID NO: 193132 - DNA, 16 bp, Homo sapiens
aaattataaggactgc

SEQ ID NO: 193133 - DNA, 20 bp, Homo sapiens
aaattatatgatatgcatgt

SEQ ID NO: 193134 - DNA, 15 bp, Homo sapiens
aaattatcaagctaa

SEQ ID NO: 193135 - DNA, 20 bp, Homo sapiens
aaattatcaagctaataaaa

SEQ ID NO: 193136 - DNA, 16 bp, Homo sapiens
aaattatctatttgta

SEQ ID NO: 193137 - DNA, 20 bp, Homo sapiens
aaattatctatttgtatata

SEQ ID NO: 193138 - DNA, 13 bp, Homo sapiens
aaattatctttaa

SEQ ID NO: 193139 - DNA, 14 bp, Homo sapiens
aaattatctttaaa

SEQ ID NO: 193140 - DNA, 14 bp, Homo sapiens
aaattatggtgaaa

SEQ ID NO: 193141 - DNA, 19 bp, Homo sapiens
aaattattataagcattga

SEQ ID NO: 193142 - DNA, 22 bp, Homo sapiens
aaattattataagcattgaaat

SEQ ID NO: 193143 - DNA, 14 bp, Homo sapiens
aaattattcagtta

SEQ ID NO: 193144 - DNA, 21 bp, Homo sapiens
aaattattcagttaagaaaaa

SEQ ID NO: 193145 - DNA, 12 bp, Homo sapiens
aaattattctag

SEQ ID NO: 193146 - DNA, 13 bp, Homo sapiens
aaattattctagt

SEQ ID NO: 193147 - DNA, 13 bp, Homo sapiens
aaattattgtaaa

SEQ ID NO: 193148 - DNA, 15 bp, Homo sapiens
aaattatttaatatg

SEQ ID NO: 193149 - DNA, 18 bp, Homo sapiens
aaattatttgccttttaa

SEQ ID NO: 193150 - DNA, 16 bp, Homo sapiens
aaattatttgtgtaat

SEQ ID NO: 193151 - DNA, 23 bp, Homo sapiens
aaattatttgtgtaatagaaaac

SEQ ID NO: 193152 - DNA, 15 bp, Homo sapiens
aaattattttaaatt

SEQ ID NO: 193153 - DNA, 22 bp, Homo sapiens
aaattattttaaattataagga

SEQ ID NO: 193154 - DNA, 22 bp, Homo sapiens
aaattcaaccccagaaattgac

SEQ ID NO: 193155 - DNA, 20 bp, Homo sapiens
aaattcaagaaaataaaact

SEQ ID NO: 193156 - DNA, 16 bp, Homo sapiens
aaattcacaaagttaa

SEQ ID NO: 193157 - DNA, 14 bp, Homo sapiens
aaattcacactgtg

SEQ ID NO: 193158 - DNA, 21 bp, Homo sapiens
aaattcacccccatccacagt

SEQ ID NO: 193159 - DNA, 22 bp, Homo sapiens
aaattcatttttttcactggag

SEQ ID NO: 193160 - DNA, 17 bp, Homo sapiens
aaattccacccctcctt

SEQ ID NO: 193161 - DNA, 20 bp, Homo sapiens
aaattccatttacttgatca

SEQ ID NO: 193162 - DNA, 19 bp, Homo sapiens
aaattctataggaacatat

SEQ ID NO: 193163 - DNA, 12 bp, Homo sapiens
aaattctccaac

SEQ ID NO: 193164 - DNA, 16 bp, Homo sapiens
aaattctccaacccaa

SEQ ID NO: 193165 - DNA, 16 bp, Homo sapiens
aaattctgctgcttga

SEQ ID NO: 193166 - DNA, 18 bp, Homo sapiens
aaattctgctgcttgaaa

SEQ ID NO: 193167 - DNA, 17 bp, Homo sapiens
aaattcttgaagttcat

SEQ ID NO: 193168 - DNA, 15 bp, Homo sapiens
aaattcttgcactgt

SEQ ID NO: 193169 - DNA, 11 bp, Homo sapiens
aaattcttttt

SEQ ID NO: 193170 - DNA, 19 bp, Homo sapiens
aaattgacatgttgtcaca

SEQ ID NO: 193171 - DNA, 18 bp, Homo sapiens
aaattgcagcagttgcta

SEQ ID NO: 193172 - DNA, 16 bp, Homo sapiens
aaattgcatgctgctt

SEQ ID NO: 193173 - DNA, 22 bp, Homo sapiens
aaattgcatttttacctttcat

SEQ ID NO: 193174 - DNA, 13 bp, Homo sapiens
aaattgcctccct

SEQ ID NO: 193175 - DNA, 13 bp, Homo sapiens
aaattgccttcag

SEQ ID NO: 193176 - DNA, 14 bp, Homo sapiens
aaattgccttcagc

SEQ ID NO: 193177 - DNA, 15 bp, Homo sapiens
aaattgccttcagcc

SEQ ID NO: 193178 - DNA, 13 bp, Homo sapiens
aaattgctgagat

SEQ ID NO: 193179 - DNA, 15 bp, Homo sapiens
aaattgctgagatgt

SEQ ID NO: 193180 - DNA, 16 bp, Homo sapiens
aaattgctgagatgtt

SEQ ID NO: 193181 - DNA, 20 bp, Homo sapiens
accaagctgtacccttgaga

SEQ ID NO: 193182 - DNA, 20 bp, Homo sapiens
accaagcttaaggagaggag

SEQ ID NO: 193183 - DNA, 21 bp, Homo sapiens
accaagcttaaggagaggaga

SEQ ID NO: 193184 - DNA, 22 bp, Homo sapiens
accaagcttgtttccctgctgg

SEQ ID NO: 193185 - DNA, 13 bp, Homo sapiens
accaaggcagcct

SEQ ID NO: 193186 - DNA, 18 bp, Homo sapiens
accaagggtatctgctgc

SEQ ID NO: 193187 - DNA, 20 bp, Homo sapiens
accaaggtgcggaccggagc

SEQ ID NO: 193188 - DNA, 23 bp, Homo sapiens
accaagtaaccaggccccagcct

SEQ ID NO: 193189 - DNA, 16 bp, Homo sapiens
accaagtacagccttc

SEQ ID NO: 193190 - DNA, 16 bp, Homo sapiens
accaataaaacaagaa

SEQ ID NO: 193191 - DNA, 12 bp, Homo sapiens
accaataacttc

SEQ ID NO: 193192 - DNA, 15 bp, Homo sapiens
accaatacaaattga

SEQ ID NO: 193193 - DNA, 13 bp, Homo sapiens
accaatcatttta

SEQ ID NO: 193194 - DNA, 20 bp, Homo sapiens
accaatcattttaattatta

SEQ ID NO: 193195 - DNA, 14 bp, Homo sapiens
aaattgtaaatgtt

SEQ ID NO: 193196 - DNA, 16 bp, Homo sapiens
aaattgtagcgtttcc

SEQ ID NO: 193197 - DNA, 19 bp, Homo sapiens
aaattgtatacattttgtt

SEQ ID NO: 193198 - DNA, 19 bp, Homo sapiens
aaattgtatgaaaatcctt

SEQ ID NO: 193199 - DNA, 20 bp, Homo sapiens
aaattgtgaaagctccatgt

SEQ ID NO: 193200 - DNA, 12 bp, Homo sapiens
aaatttaaaaat

SEQ ID NO: 193201 - DNA, 14 bp, Homo sapiens
aaatttaaaaatct

SEQ ID NO: 193202 - DNA, 16 bp, Homo sapiens
aaatttaaaaatcttt

SEQ ID NO: 193203 - DNA, 14 bp, Homo sapiens
aaatttaaaacaaa

SEQ ID NO: 193204 - DNA, 16 bp, Homo sapiens
aaatttaactgcatat

SEQ ID NO: 193205 - DNA, 17 bp, Homo sapiens
aaatttaactgcatata

SEQ ID NO: 193206 - DNA, 15 bp, Homo sapiens
aaatttaagcattgt

SEQ ID NO: 193207 - DNA, 15 bp, Homo sapiens
aaatttaagtatctt

SEQ ID NO: 193208 - DNA, 20 bp, Homo sapiens
aaatttaatatactgcatat

SEQ ID NO: 193209 - DNA, 18 bp, Homo sapiens
aaatttacgtatatttca

SEQ ID NO: 193210 - DNA, 21 bp, Homo sapiens
aaatttataaactaattttgt

SEQ ID NO: 193211 - DNA, 14 bp, Homo sapiens
aaatttattatgtc

SEQ ID NO: 193212 - DNA, 15 bp, Homo sapiens
aaatttcacaatata

SEQ ID NO: 193213 - DNA, 18 bp, Homo sapiens
aaatttcatctttccaaa

SEQ ID NO: 193214 - DNA, 23 bp, Homo sapiens
aaatttccagtacctttgtcaca

SEQ ID NO: 193215 - DNA, 20 bp, Homo sapiens
aaatttctagatatgagaaa

SEQ ID NO: 193216 - DNA, 14 bp, Homo sapiens
aaatttctatcatt

SEQ ID NO: 193217 - DNA, 18 bp, Homo sapiens
aaatttgtttgaaatctt

SEQ ID NO: 193218 - DNA, 15 bp, Homo sapiens
aaattttagtccaaa

SEQ ID NO: 193219 - DNA, 15 bp, Homo sapiens
aaattttatctcagt

SEQ ID NO: 193220 - DNA, 20 bp, Homo sapiens
aaattttatctcttcttcct

SEQ ID NO: 193221 - DNA, 11 bp, Homo sapiens
aaattttcacc

SEQ ID NO: 193222 - DNA, 14 bp, Homo sapiens
aaattttctagact

SEQ ID NO: 193223 - DNA, 21 bp, Homo sapiens
aaattttggaaagattatcct

SEQ ID NO: 193224 - DNA, 18 bp, Homo sapiens
aaattttggccaaagtgt

SEQ ID NO: 193225 - DNA, 20 bp, Homo sapiens
aaatttttctgggaagaaaa

SEQ ID NO: 193226 - DNA, 16 bp, Homo sapiens
aaatttttttccagaa

SEQ ID NO: 193227 - DNA, 19 bp, Homo sapiens
aaatttttttccagaattg

SEQ ID NO: 193228 - DNA, 16 bp, Homo sapiens
aacaaaaactttccat

SEQ ID NO: 193229 - DNA, 18 bp, Homo sapiens
aacaaaaactttccatga

SEQ ID NO: 193230 - DNA, 14 bp, Homo sapiens
aacaaaaatgccag

SEQ ID NO: 193231 - DNA, 13 bp, Homo sapiens
aacaaaacaagaa

SEQ ID NO: 193232 - DNA, 17 bp, Homo sapiens
aacaaaacaagaaagaa

SEQ ID NO: 193233 - DNA, 13 bp, Homo sapiens
aacaaaacttaaa

SEQ ID NO: 193234 - DNA, 12 bp, Homo sapiens
aacaaaatgtta

SEQ ID NO: 193235 - DNA, 17 bp, Homo sapiens
aacaaactgaaaaatct

SEQ ID NO: 193236 - DNA, 22 bp, Homo sapiens
aacaaagcatttgactttctgt

SEQ ID NO: 193237 - DNA, 12 bp, Homo sapiens
aacaaatatgca

SEQ ID NO: 193238 - DNA, 15 bp, Homo sapiens
aacaaatcactgtat

SEQ ID NO: 193239 - DNA, 16 bp, Homo sapiens
aacaaatctaatctct

SEQ ID NO: 193240 - DNA, 12 bp, Homo sapiens
aacaaattaaaa

SEQ ID NO: 193241 - DNA, 14 bp, Homo sapiens
aacaaattaaaaac

SEQ ID NO: 193242 - DNA, 20 bp, Homo sapiens
aacaaattaaaaacacctaa

SEQ ID NO: 193243 - DNA, 15 bp, Homo sapiens
aacaacaacagaaca

SEQ ID NO: 193244 - DNA, 23 bp, Homo sapiens
aacaacagtacctgaaggattat

SEQ ID NO: 193245 - DNA, 20 bp, Homo sapiens
aacaaccctgttgagtattt

SEQ ID NO: 193246 - DNA, 14 bp, Homo sapiens
aacaacctgccaca

SEQ ID NO: 193247 - DNA, 20 bp, Homo sapiens
aacaacctgccacaatgtga

SEQ ID NO: 193248 - DNA, 13 bp, Homo sapiens
aacaactgactaa

SEQ ID NO: 193249 - DNA, 12 bp, Homo sapiens
aacaactttgtt

SEQ ID NO: 193250 - DNA, 14 bp, Homo sapiens
aacaagaaagaaac

SEQ ID NO: 193251 - DNA, 15 bp, Homo sapiens
aacaagaaagtttcc

SEQ ID NO: 193252 - DNA, 21 bp, Homo sapiens
aacaagaagccacagacctag

SEQ ID NO: 193253 - DNA, 19 bp, Homo sapiens
aacaagaccccgtctcaaa

SEQ ID NO: 193254 - DNA, 16 bp, Homo sapiens
aacaagactgcctccc

SEQ ID NO: 193255 - DNA, 11 bp, Homo sapiens
aacaagaggag

SEQ ID NO: 193256 - DNA, 15 bp, Homo sapiens
aacaagaggagcagg

SEQ ID NO: 193257 - DNA, 22 bp, Homo sapiens
aacaagccaaacattcttattt

SEQ ID NO: 193258 - DNA, 16 bp, Homo sapiens
aacaaggcaaggctgt

SEQ ID NO: 193259 - DNA, 18 bp, Homo sapiens
aacaaggcaaggctgtca

SEQ ID NO: 193260 - DNA, 19 bp, Homo sapiens
aacaagtcacagctgcagc

SEQ ID NO: 193261 - DNA, 20 bp, Homo sapiens
aacaagtgaacacattgtgt

SEQ ID NO: 193262 - DNA, 22 bp, Homo sapiens
aacaagttggctagaagaaagt

SEQ ID NO: 193263 - DNA, 15 bp, Homo sapiens
aacaataactactgt

SEQ ID NO: 193264 - DNA, 18 bp, Homo sapiens
aacaataactactgtgtt

SEQ ID NO: 193265 - DNA, 19 bp, Homo sapiens
aacaataactactgtgttc

SEQ ID NO: 193266 - DNA, 20 bp, Homo sapiens
aacaataactactgtgttcc

SEQ ID NO: 193267 - DNA, 15 bp, Homo sapiens
aacaataataaatgt

SEQ ID NO: 193268 - DNA, 19 bp, Homo sapiens
aacaatatatgatatataa

SEQ ID NO: 193269 - DNA, 23 bp, Homo sapiens
aacaatcacaaaagctgtgtctc

SEQ ID NO: 193270 - DNA, 16 bp, Homo sapiens
aacaatcactattctt

SEQ ID NO: 193271 - DNA, 18 bp, Homo sapiens
aacaatcactattcttaa

SEQ ID NO: 193272 - DNA, 18 bp, Homo sapiens
aacaatccaaatgcattc

SEQ ID NO: 193273 - DNA, 20 bp, Homo sapiens
aacaatcccagcatctgatt

SEQ ID NO: 193274 - DNA, 14 bp, Homo sapiens
aacaatcctttctg

SEQ ID NO: 193275 - DNA, 19 bp, Homo sapiens
aacaattaggtctgcattt

SEQ ID NO: 193276 - DNA, 22 bp, Homo sapiens
aacaattaggtctgcattttct

SEQ ID NO: 193277 - DNA, 13 bp, Homo sapiens
aacaatttctgtc

SEQ ID NO: 193278 - DNA, 21 bp, Homo sapiens
aacaatttgcataatactaat

SEQ ID NO: 193279 - DNA, 23 bp, Homo sapiens
aacaattttaggaggaccagagc

SEQ ID NO: 193280 - DNA, 17 bp, Homo sapiens
aacacaatgttattcgt

SEQ ID NO: 193281 - DNA, 10 bp, Homo sapiens
aacacacaca

SEQ ID NO: 193282 - DNA, 12 bp, Homo sapiens
aacacacacaca

SEQ ID NO: 193283 - DNA, 15 bp, Homo sapiens
aacacacacacacgc

SEQ ID NO: 193284 - DNA, 13 bp, Homo sapiens
aacacacacacat

SEQ ID NO: 193285 - DNA, 22 bp, Homo sapiens
aacacacttttgcacatatatt

SEQ ID NO: 193286 - DNA, 16 bp, Homo sapiens
aacacagcatgtgcca

SEQ ID NO: 193287 - DNA, 19 bp, Homo sapiens
aacacagcatgtgccaaga

SEQ ID NO: 193288 - DNA, 16 bp, Homo sapiens
aacacaggcaaagagg

SEQ ID NO: 193289 - DNA, 22 bp, Homo sapiens
aacacagtgcctggcaaggcct

SEQ ID NO: 193290 - DNA, 17 bp, Homo sapiens
aacacataaagtaaatg

SEQ ID NO: 193291 - DNA, 14 bp, Homo sapiens
aacacatacaaaag

SEQ ID NO: 193292 - DNA, 16 bp, Homo sapiens
aacacatacaaaagaa

SEQ ID NO: 193293 - DNA, 17 bp, Homo sapiens
aacacatactagaaagc

SEQ ID NO: 193294 - DNA, 22 bp, Homo sapiens
aacacatagattcacctgtaaa

SEQ ID NO: 193295 - DNA, 20 bp, Homo sapiens
aacacatcaataaatacttt

SEQ ID NO: 193296 - DNA, 21 bp, Homo sapiens
aacacattatcgggagcagtg

SEQ ID NO: 193297 - DNA, 20 bp, Homo sapiens
aacacatttgattctgtgtg

SEQ ID NO: 193298 - DNA, 22 bp, Homo sapiens
aacaccaagacttgaaggtgcc

SEQ ID NO: 193299 - DNA, 15 bp, Homo sapiens
aacaccacactgacc

SEQ ID NO: 193300 - DNA, 18 bp, Homo sapiens
aacaccacactgaccaca

SEQ ID NO: 193301 - DNA, 13 bp, Homo sapiens
aacaccacagaca

SEQ ID NO: 193302 - DNA, 23 bp, Homo sapiens
aacaccacagacacacacacgca

SEQ ID NO: 193303 - DNA, 13 bp, Homo sapiens
aacaccaggactt

SEQ ID NO: 193304 - DNA, 14 bp, Homo sapiens
aacaccaggactta

SEQ ID NO: 193305 - DNA, 22 bp, Homo sapiens
aacaccaggacttaagacaaat

SEQ ID NO: 193306 - DNA, 23 bp, Homo sapiens
aacacccatcgtataaggaaatc

SEQ ID NO: 193307 - DNA, 21 bp, Homo sapiens
aacacccgccccccccatgtt

SEQ ID NO: 193308 - DNA, 14 bp, Homo sapiens
aacacccggaaaga

SEQ ID NO: 193309 - DNA, 20 bp, Homo sapiens
aacacccggaaagactgaaa

SEQ ID NO: 193310 - DNA, 16 bp, Homo sapiens
aacaccctatattttg

SEQ ID NO: 193311 - DNA, 15 bp, Homo sapiens
aacacctaagtgact

SEQ ID NO: 193312 - DNA, 18 bp, Homo sapiens
aacacctagatcagaaca

SEQ ID NO: 193313 - DNA, 14 bp, Homo sapiens
aacacctgacacat

SEQ ID NO: 193314 - DNA, 17 bp, Homo sapiens
aacacctgacacatctt

SEQ ID NO: 193315 - DNA, 24 bp, Homo sapiens
aacaccttcttggcttctgggacc

SEQ ID NO: 193316 - DNA, 18 bp, Homo sapiens
aacactaacatataatgt

SEQ ID NO: 193317 - DNA, 13 bp, Homo sapiens
aacactaataata

SEQ ID NO: 193318 - DNA, 18 bp, Homo sapiens
aacactcgaaaagagcac

SEQ ID NO: 193319 - DNA, 17 bp, Homo sapiens
accaggaagaaggcccg

SEQ ID NO: 193320 - DNA, 21 bp, Homo sapiens
accaggaagaaggcccgggag

SEQ ID NO: 193321 - DNA, 16 bp, Homo sapiens
accaggactccctcct

SEQ ID NO: 193322 - DNA, 17 bp, Homo sapiens
accaggactccctcctc

SEQ ID NO: 193323 - DNA, 21 bp, Homo sapiens
accaggactccctcctcacct

SEQ ID NO: 193324 - DNA, 15 bp, Homo sapiens
accaggactctgcct

SEQ ID NO: 193325 - DNA, 20 bp, Homo sapiens
accaggactctgccttccag

SEQ ID NO: 193326 - DNA, 22 bp, Homo sapiens
accaggactctgccttccaggc

SEQ ID NO: 193327 - DNA, 19 bp, Homo sapiens
accaggacttggggtcagg

SEQ ID NO: 193328 - DNA, 14 bp, Homo sapiens
accaggagaaccac

SEQ ID NO: 193329 - DNA, 18 bp, Homo sapiens
accaggagaaccactaca

SEQ ID NO: 193330 - DNA, 14 bp, Homo sapiens
accaggagccaggt

SEQ ID NO: 193331 - DNA, 14 bp, Homo sapiens
accaggaggggtct

SEQ ID NO: 193332 - DNA, 15 bp, Homo sapiens
accaggaggggtctg

SEQ ID NO: 193333 - DNA, 21 bp, Homo sapiens
accaggaggggtctgcctccc

SEQ ID NO: 193334 - DNA, 14 bp, Homo sapiens
accaggatttctaa

SEQ ID NO: 193335 - DNA, 15 bp, Homo sapiens
accaggatttctaat

SEQ ID NO: 193336 - DNA, 15 bp, Homo sapiens
accaggccacccact

SEQ ID NO: 193337 - DNA, 13 bp, Homo sapiens
accaggccccagc

SEQ ID NO: 193338 - DNA, 21 bp, Homo sapiens
accaggccccagcctccaggc

SEQ ID NO: 193339 - DNA, 19 bp, Homo sapiens
accaggccgccccagcctc

SEQ ID NO: 193340 - DNA, 18 bp, Homo sapiens
accaggccgtcctcccgg

SEQ ID NO: 193341 - DNA, 19 bp, Homo sapiens
accaggccgtcctcccggg

SEQ ID NO: 193342 - DNA, 18 bp, Homo sapiens
accagggcaccaagccca

SEQ ID NO: 193343 - DNA, 14 bp, Homo sapiens
accagggctcagct

SEQ ID NO: 193344 - DNA, 19 bp, Homo sapiens
accagggtccgcaccagct

SEQ ID NO: 193345 - DNA, 23 bp, Homo sapiens
accaggtcctgtgagcaaagtgc

SEQ ID NO: 193346 - DNA, 21 bp, Homo sapiens
accaggtgctagggtgcctgc

SEQ ID NO: 193347 - DNA, 22 bp, Homo sapiens
accaggtgctagggtgcctgct

SEQ ID NO: 193348 - DNA, 18 bp, Homo sapiens
accaggtgtctagaggca

SEQ ID NO: 193349 - DNA, 19 bp, Homo sapiens
accaggtgttctacactca

SEQ ID NO: 193350 - DNA, 20 bp, Homo sapiens
accagtcgccctctgtgcct

SEQ ID NO: 193351 - DNA, 14 bp, Homo sapiens
accagtctgaagtt

SEQ ID NO: 193352 - DNA, 21 bp, Homo sapiens
accagtctgaagtttcattta

SEQ ID NO: 193353 - DNA, 14 bp, Homo sapiens
accagtctgtctac

SEQ ID NO: 193354 - DNA, 19 bp, Homo sapiens
accagtctgtctactgtgg

SEQ ID NO: 193355 - DNA, 19 bp, Homo sapiens
accagtcttaccaaacaat

SEQ ID NO: 193356 - DNA, 16 bp, Homo sapiens
accagtcttctccctg

SEQ ID NO: 193357 - DNA, 18 bp, Homo sapiens
accagtgcaacagcactg

SEQ ID NO: 193358 - DNA, 19 bp, Homo sapiens
accagtgtactgctttcaa

SEQ ID NO: 193359 - DNA, 16 bp, Homo sapiens
accagtgtctgaacca

SEQ ID NO: 193360 - DNA, 21 bp, Homo sapiens
accagtgttagtgggaagagc

SEQ ID NO: 193361 - DNA, 24 bp, Homo sapiens
accagtgttagtgggaagagctgg

SEQ ID NO: 193362 - DNA, 14 bp, Homo sapiens
accagttaaaagca

SEQ ID NO: 193363 - DNA, 13 bp, Homo sapiens
accagttactgtt

SEQ ID NO: 193364 - DNA, 24 bp, Homo sapiens
accagttgaataaaagtgcacacc

SEQ ID NO: 193365 - DNA, 18 bp, Homo sapiens
accagttgggagcactgg

SEQ ID NO: 193366 - DNA, 21 bp, Homo sapiens
accagttgggagcactggagt

SEQ ID NO: 193367 - DNA, 15 bp, Homo sapiens
accagttgtatttaa

SEQ ID NO: 193368 - DNA, 19 bp, Homo sapiens
accagttgtatttaatttt

SEQ ID NO: 193369 - DNA, 18 bp, Homo sapiens
accataaaataaataatc

SEQ ID NO: 193370 - DNA, 21 bp, Homo sapiens
accataagggactgtgccaga

SEQ ID NO: 193371 - DNA, 15 bp, Homo sapiens
accataatgttacat

SEQ ID NO: 193372 - DNA, 15 bp, Homo sapiens
accatactgagggac

SEQ ID NO: 193373 - DNA, 13 bp, Homo sapiens
accatagaactgt

SEQ ID NO: 193374 - DNA, 15 bp, Homo sapiens
accatatgattgaaa

SEQ ID NO: 193375 - DNA, 18 bp, Homo sapiens
accatatgattgaaaaga

SEQ ID NO: 193376 - DNA, 19 bp, Homo sapiens
accatatgattgaaaagaa

SEQ ID NO: 193377 - DNA, 15 bp, Homo sapiens
accatcacagcttgt

SEQ ID NO: 193378 - DNA, 17 bp, Homo sapiens
accatcagttactggtt

SEQ ID NO: 193379 - DNA, 19 bp, Homo sapiens
accatcctggcccctccag

SEQ ID NO: 193380 - DNA, 13 bp, Homo sapiens
accatctggcctg

SEQ ID NO: 193381 - DNA, 16 bp, Homo sapiens
accatctggcctggcc

SEQ ID NO: 193382 - DNA, 18 bp, Homo sapiens
accatctgtaccctgctt

SEQ ID NO: 193383 - DNA, 22 bp, Homo sapiens
accatcttaatctttattttat

SEQ ID NO: 193384 - DNA, 13 bp, Homo sapiens
accatctttctaa

SEQ ID NO: 193385 - DNA, 15 bp, Homo sapiens
accatgactgtgacc

SEQ ID NO: 193386 - DNA, 16 bp, Homo sapiens
accatgactgtgacca

SEQ ID NO: 193387 - DNA, 21 bp, Homo sapiens
accatgagaagagggcctgtg

SEQ ID NO: 193388 - DNA, 23 bp, Homo sapiens
accatgagaataagagaaagaaa

SEQ ID NO: 193389 - DNA, 15 bp, Homo sapiens
accatgcacccctga

SEQ ID NO: 193390 - DNA, 17 bp, Homo sapiens
accatgcactcaataaa

SEQ ID NO: 193391 - DNA, 12 bp, Homo sapiens
accatgctgctt

SEQ ID NO: 193392 - DNA, 22 bp, Homo sapiens
accatgctgctttttggcacag

SEQ ID NO: 193393 - DNA, 15 bp, Homo sapiens
accatggctgaagga

SEQ ID NO: 193394 - DNA, 23 bp, Homo sapiens
accatggctgaaggaaaccagtg

SEQ ID NO: 193395 - DNA, 13 bp, Homo sapiens
accatgtcactgt

SEQ ID NO: 193396 - DNA, 19 bp, Homo sapiens
accatgtctctaagccaac

SEQ ID NO: 193397 - DNA, 16 bp, Homo sapiens
accattaaaactgctt

SEQ ID NO: 193398 - DNA, 19 bp, Homo sapiens
accattaaaactgcttttt

SEQ ID NO: 193399 - DNA, 20 bp, Homo sapiens
accattaagaacaaggaatt

SEQ ID NO: 193400 - DNA, 20 bp, Homo sapiens
accattataaaatctttcca

SEQ ID NO: 193401 - DNA, 19 bp, Homo sapiens
accattatggctttgtgct

SEQ ID NO: 193402 - DNA, 22 bp, Homo sapiens
accattcatctttcctttgctc

SEQ ID NO: 193403 - DNA, 14 bp, Homo sapiens
accattcctttaaa

SEQ ID NO: 193404 - DNA, 23 bp, Homo sapiens
accattcctttaaattctccaac

SEQ ID NO: 193405 - DNA, 20 bp, Homo sapiens
accattctgttgggcaacaa

SEQ ID NO: 193406 - DNA, 13 bp, Homo sapiens
accattctttctt

SEQ ID NO: 193407 - DNA, 13 bp, Homo sapiens
accattgacctca

SEQ ID NO: 193408 - DNA, 15 bp, Homo sapiens
accattgacctcagc

SEQ ID NO: 193409 - DNA, 16 bp, Homo sapiens
accattgacctcagct

SEQ ID NO: 193410 - DNA, 20 bp, Homo sapiens
accattgacctcagctgcac

SEQ ID NO: 193411 - DNA, 24 bp, Homo sapiens
accattgacctcagctgcacattc

SEQ ID NO: 193412 - DNA, 23 bp, Homo sapiens
accattgatgagcactcctgatt

SEQ ID NO: 193413 - DNA, 11 bp, Homo sapiens
accattgcttc

SEQ ID NO: 193414 - DNA, 16 bp, Homo sapiens
accattgttcagaaga

SEQ ID NO: 193415 - DNA, 18 bp, Homo sapiens
accatttatgaaggtttg

SEQ ID NO: 193416 - DNA, 21 bp, Homo sapiens
accatttcatccatatttctt

SEQ ID NO: 193417 - DNA, 14 bp, Homo sapiens
accatttgtaataa

SEQ ID NO: 193418 - DNA, 15 bp, Homo sapiens
accatttgtaataaa

SEQ ID NO: 193419 - DNA, 13 bp, Homo sapiens
accattttctggt

SEQ ID NO: 193420 - DNA, 22 bp, Homo sapiens
accattttgaaatattcacaag

SEQ ID NO: 193421 - DNA, 18 bp, Homo sapiens
accattttgcgatgtgtt

SEQ ID NO: 193422 - DNA, 19 bp, Homo sapiens
accattttgcgatgtgttt

SEQ ID NO: 193423 - DNA, 21 bp, Homo sapiens
accattttgcgatgtgtttta

SEQ ID NO: 193424 - DNA, 22 bp, Homo sapiens
accattttgctgtcccttttcc

SEQ ID NO: 193425 - DNA, 18 bp, Homo sapiens
acccaaaacacacaattt

SEQ ID NO: 193426 - DNA, 15 bp, Homo sapiens
acccaaaccccttcc

SEQ ID NO: 193427 - DNA, 17 bp, Homo sapiens
acccaaagtattcttct

SEQ ID NO: 193428 - DNA, 23 bp, Homo sapiens
acccaaagtattcttcttttctt

SEQ ID NO: 193429 - DNA, 12 bp, Homo sapiens
acccaaccactc

SEQ ID NO: 193430 - DNA, 13 bp, Homo sapiens
acccaagcttggc

SEQ ID NO: 193431 - DNA, 14 bp, Homo sapiens
acccaagcttggca

SEQ ID NO: 193432 - DNA, 18 bp, Homo sapiens
acccaagcttggcagccg

SEQ ID NO: 193433 - DNA, 23 bp, Homo sapiens
acccaaggtggtcttggagagga

SEQ ID NO: 193434 - DNA, 13 bp, Homo sapiens
acccaagtccacc

SEQ ID NO: 193435 - DNA, 15 bp, Homo sapiens
acccaataattctgt

SEQ ID NO: 193436 - DNA, 13 bp, Homo sapiens
acccaatggagac

SEQ ID NO: 193437 - DNA, 22 bp, Homo sapiens
acccaattaagtcctactttac

SEQ ID NO: 193438 - DNA, 17 bp, Homo sapiens
acccaattttaaaaaat

SEQ ID NO: 193439 - DNA, 14 bp, Homo sapiens
acccacaagctgcc

SEQ ID NO: 193440 - DNA, 17 bp, Homo sapiens
acccacaagctgcctct

SEQ ID NO: 193441 - DNA, 22 bp, Homo sapiens
acccacaagctgcctctgacag

SEQ ID NO: 193442 - DNA, 17 bp, Homo sapiens
acccacaagtgccactg

SEQ ID NO: 193443 - DNA, 19 bp, Homo sapiens
acccacactgcaacaggaa

SEQ ID NO: 193444 - DNA, 13 bp, Homo sapiens
acccacagggcct

SEQ ID NO: 193445 - DNA, 18 bp, Homo sapiens
acccacagggcctgactt

SEQ ID NO: 193446 - DNA, 21 bp, Homo sapiens
acccacagggcctgactttta

SEQ ID NO: 193447 - DNA, 23 bp, Homo sapiens
acccaccaaatgcctctgccttg

SEQ ID NO: 193448 - DNA, 15 bp, Homo sapiens
acccaccaccatgcc

SEQ ID NO: 193449 - DNA, 15 bp, Homo sapiens
acccaccagtgcctt

SEQ ID NO: 193450 - DNA, 17 bp, Homo sapiens
acccacccatcttcctg

SEQ ID NO: 193451 - DNA, 22 bp, Homo sapiens
acccacccatcttcctgctgct

SEQ ID NO: 193452 - DNA, 17 bp, Homo sapiens
acccaccccctctttgt

SEQ ID NO: 193453 - DNA, 14 bp, Homo sapiens
acccacccctcctg

SEQ ID NO: 193454 - DNA, 14 bp, Homo sapiens
acccaccctctggt

SEQ ID NO: 193455 - DNA, 23 bp, Homo sapiens
acccccggcctccaggctggggc

SEQ ID NO: 193456 - DNA, 14 bp, Homo sapiens
acccccgggtgcct

SEQ ID NO: 193457 - DNA, 15 bp, Homo sapiens
acccccgggtgcctg

SEQ ID NO: 193458 - DNA, 15 bp, Homo sapiens
acccccgtgccaaat

SEQ ID NO: 193459 - DNA, 22 bp, Homo sapiens
acccccgtgccaaatcctgggc

SEQ ID NO: 193460 - DNA, 14 bp, Homo sapiens
accccctccctggc

SEQ ID NO: 193461 - DNA, 15 bp, Homo sapiens
accccctccctggcc

SEQ ID NO: 193462 - DNA, 14 bp, Homo sapiens
accccctcggagcc

SEQ ID NO: 193463 - DNA, 15 bp, Homo sapiens
accccctcggagcct

SEQ ID NO: 193464 - DNA, 18 bp, Homo sapiens
accccctcggagcctgtg

SEQ ID NO: 193465 - DNA, 16 bp, Homo sapiens
accccctgccccagag

SEQ ID NO: 193466 - DNA, 20 bp, Homo sapiens
accccctgtcccattctaga

SEQ ID NO: 193467 - DNA, 17 bp, Homo sapiens
acccccttgtctgctgc

SEQ ID NO: 193468 - DNA, 18 bp, Homo sapiens
acccccttgtctgctgct

SEQ ID NO: 193469 - DNA, 19 bp, Homo sapiens
acccccttgtctgctgctc

SEQ ID NO: 193470 - DNA, 18 bp, Homo sapiens
accccctttgctgtgagg

SEQ ID NO: 193471 - DNA, 18 bp, Homo sapiens
accccgaccacctgccca

SEQ ID NO: 193472 - DNA, 13 bp, Homo sapiens
accccgagcccta

SEQ ID NO: 193473 - DNA, 18 bp, Homo sapiens
accccgcggtgctctggc

SEQ ID NO: 193474 - DNA, 19 bp, Homo sapiens
accccgcggtgctctggcg

SEQ ID NO: 193475 - DNA, 21 bp, Homo sapiens
accccgcggtgctctggcggc

SEQ ID NO: 193476 - DNA, 22 bp, Homo sapiens
accccgcggtgctctggcggct

SEQ ID NO: 193477 - DNA, 13 bp, Homo sapiens
accccgctgcctg

SEQ ID NO: 193478 - DNA, 14 bp, Homo sapiens
accccgctgcctgg

SEQ ID NO: 193479 - DNA, 14 bp, Homo sapiens
accccggcaggccc

SEQ ID NO: 193480 - DNA, 15 bp, Homo sapiens
accccggcaggccct

SEQ ID NO: 193481 - DNA, 16 bp, Homo sapiens
accccggcaggccctg

SEQ ID NO: 193482 - DNA, 21 bp, Homo sapiens
accccggcaggccctgcagtg

SEQ ID NO: 193483 - DNA, 15 bp, Homo sapiens
accccggcctccact

SEQ ID NO: 193484 - DNA, 13 bp, Homo sapiens
accccgggctctc

SEQ ID NO: 193485 - DNA, 17 bp, Homo sapiens
accccgggctctctgct

SEQ ID NO: 193486 - DNA, 22 bp, Homo sapiens
accccggggcatggacagggcc

SEQ ID NO: 193487 - DNA, 24 bp, Homo sapiens
accccggggcatggacagggccag

SEQ ID NO: 193488 - DNA, 15 bp, Homo sapiens
accccgtcccggccc

SEQ ID NO: 193489 - DNA, 19 bp, Homo sapiens
accccgtcccggccccgcg

SEQ ID NO: 193490 - DNA, 15 bp, Homo sapiens
accccgtccctttcc

SEQ ID NO: 193491 - DNA, 17 bp, Homo sapiens
accccgtccctttccct

SEQ ID NO: 193492 - DNA, 20 bp, Homo sapiens
accccgtccctttccctgca

SEQ ID NO: 193493 - DNA, 21 bp, Homo sapiens
accccgtccctttccctgcat

SEQ ID NO: 193494 - DNA, 22 bp, Homo sapiens
accccgtccctttccctgcatc

SEQ ID NO: 193495 - DNA, 20 bp, Homo sapiens
accccgttacagctccccaa

SEQ ID NO: 193496 - DNA, 14 bp, Homo sapiens
acccctaagtgccc

SEQ ID NO: 193497 - DNA, 18 bp, Homo sapiens
acccctacagcctgcaca

SEQ ID NO: 193498 - DNA, 19 bp, Homo sapiens
acccctacagcctgcacac

SEQ ID NO: 193499 - DNA, 17 bp, Homo sapiens
acccctcagcgctccct

SEQ ID NO: 193500 - DNA, 16 bp, Homo sapiens
acccctcccaacctca

SEQ ID NO: 193501 - DNA, 18 bp, Homo sapiens
acccctcccctaatgcct

SEQ ID NO: 193502 - DNA, 15 bp, Homo sapiens
acccctccctctgct

SEQ ID NO: 193503 - DNA, 15 bp, Homo sapiens
acccctcctgggccc

SEQ ID NO: 193504 - DNA, 18 bp, Homo sapiens
acccctctggccaggatg

SEQ ID NO: 193505 - DNA, 23 bp, Homo sapiens
acccctcttagcttacaggaagc

SEQ ID NO: 193506 - DNA, 13 bp, Homo sapiens
acccctcttcccc

SEQ ID NO: 193507 - DNA, 14 bp, Homo sapiens
acccctcttccccc

SEQ ID NO: 193508 - DNA, 20 bp, Homo sapiens
acccctgcaccagcccttcc

SEQ ID NO: 193509 - DNA, 14 bp, Homo sapiens
acccctgcccaggc

SEQ ID NO: 193510 - DNA, 17 bp, Homo sapiens
acccctgccggccttgg

SEQ ID NO: 193511 - DNA, 18 bp, Homo sapiens
acccctgccggccttggc

SEQ ID NO: 193512 - DNA, 11 bp, Homo sapiens
acccctgcctg

SEQ ID NO: 193513 - DNA, 12 bp, Homo sapiens
acccctgcctgg

SEQ ID NO: 193514 - DNA, 14 bp, Homo sapiens
acccctgcctttgt

SEQ ID NO: 193515 - DNA, 11 bp, Homo sapiens
acccctgctcc

SEQ ID NO: 193516 - DNA, 15 bp, Homo sapiens
acccctgctcccagc

SEQ ID NO: 193517 - DNA, 20 bp, Homo sapiens
acccctgctcccagcctgct

SEQ ID NO: 193518 - DNA, 14 bp, Homo sapiens
acccctgcttctga

SEQ ID NO: 193519 - DNA, 12 bp, Homo sapiens
acccctggcttt

SEQ ID NO: 193520 - DNA, 17 bp, Homo sapiens
acccctgtacccagcca

SEQ ID NO: 193521 - DNA, 20 bp, Homo sapiens
acccctgtacccagccacct

SEQ ID NO: 193522 - DNA, 17 bp, Homo sapiens
acccctgtacccagctc

SEQ ID NO: 193523 - DNA, 19 bp, Homo sapiens
acccctgtggagcccgcac

SEQ ID NO: 193524 - DNA, 16 bp, Homo sapiens
accccttacttagcat

SEQ ID NO: 193525 - DNA, 15 bp, Homo sapiens
accccttagcctccc

SEQ ID NO: 193526 - DNA, 22 bp, Homo sapiens
accccttcagccgagcccagac

SEQ ID NO: 193527 - DNA, 16 bp, Homo sapiens
accccttccccactgc

SEQ ID NO: 193528 - DNA, 18 bp, Homo sapiens
accccttccccactgcct

SEQ ID NO: 193529 - DNA, 20 bp, Homo sapiens
accccttccccactgcctgc

SEQ ID NO: 193530 - DNA, 17 bp, Homo sapiens
accccttcctgtctggc

SEQ ID NO: 193531 - DNA, 12 bp, Homo sapiens
acccctttctag

SEQ ID NO: 193532 - DNA, 17 bp, Homo sapiens
acccgacaacatttctg

SEQ ID NO: 193533 - DNA, 21 bp, Homo sapiens
acccgagcccagctacattcc

SEQ ID NO: 193534 - DNA, 23 bp, Homo sapiens
acccgagcccagctacattcctc

SEQ ID NO: 193535 - DNA, 13 bp, Homo sapiens
acccgccccagag

SEQ ID NO: 193536 - DNA, 15 bp, Homo sapiens
acccgccccagagac

SEQ ID NO: 193537 - DNA, 19 bp, Homo sapiens
acccgccctttccttgcct

SEQ ID NO: 193538 - DNA, 21 bp, Homo sapiens
acccgccctttccttgccttc

SEQ ID NO: 193539 - DNA, 14 bp, Homo sapiens
acccgctgcccagc

SEQ ID NO: 193540 - DNA, 17 bp, Homo sapiens
acccgctgcccagccct

SEQ ID NO: 193541 - DNA, 12 bp, Homo sapiens
acccggaaagac

SEQ ID NO: 193542 - DNA, 12 bp, Homo sapiens
acccggaggcca

SEQ ID NO: 193543 - DNA, 15 bp, Homo sapiens
acccggaggccacat

SEQ ID NO: 193544 - DNA, 15 bp, Homo sapiens
acccggaggggcctg

SEQ ID NO: 193545 - DNA, 15 bp, Homo sapiens
acccggatctccagg

SEQ ID NO: 193546 - DNA, 20 bp, Homo sapiens
acccggatctccaggcccag

SEQ ID NO: 193547 - DNA, 22 bp, Homo sapiens
acccggatctccaggcccagcc

SEQ ID NO: 193548 - DNA, 15 bp, Homo sapiens
acccggcagcccccc

SEQ ID NO: 193549 - DNA, 17 bp, Homo sapiens
acccggcagccccccag

SEQ ID NO: 193550 - DNA, 18 bp, Homo sapiens
acccggcccccgccctct

SEQ ID NO: 193551 - DNA, 19 bp, Homo sapiens
acccggcccccgccctctg

SEQ ID NO: 193552 - DNA, 16 bp, Homo sapiens
acccggcccctaccag

SEQ ID NO: 193553 - DNA, 17 bp, Homo sapiens
acccggcccctaccagc

SEQ ID NO: 193554 - DNA, 23 bp, Homo sapiens
acccggctgggtcggccctgccc

SEQ ID NO: 193555 - DNA, 18 bp, Homo sapiens
acccggggaactggtttt

SEQ ID NO: 193556 - DNA, 14 bp, Homo sapiens
acccggtcccaggc

SEQ ID NO: 193557 - DNA, 18 bp, Homo sapiens
acccggtcccaggccgca

SEQ ID NO: 193558 - DNA, 15 bp, Homo sapiens
acccgtaggcagcct

SEQ ID NO: 193559 - DNA, 17 bp, Homo sapiens
acccgtaggcagcctct

SEQ ID NO: 193560 - DNA, 20 bp, Homo sapiens
acccgtaggcagcctctctg

SEQ ID NO: 193561 - DNA, 16 bp, Homo sapiens
acccgtgttctcctcc

SEQ ID NO: 193562 - DNA, 14 bp, Homo sapiens
acccgttaatttaa

SEQ ID NO: 193563 - DNA, 19 bp, Homo sapiens
acccgttaatttaaagctg

SEQ ID NO: 193564 - DNA, 23 bp, Homo sapiens
acccgttctgctggcctggatct

SEQ ID NO: 193565 - DNA, 22 bp, Homo sapiens
acccgttttatgatttactcat

SEQ ID NO: 193566 - DNA, 14 bp, Homo sapiens
accctaactgagct

SEQ ID NO: 193567 - DNA, 14 bp, Homo sapiens
accctacaagatgc

SEQ ID NO: 193568 - DNA, 23 bp, Homo sapiens
accctacaagttgatcatgcagg

SEQ ID NO: 193569 - DNA, 23 bp, Homo sapiens
accctacacctctgggccctgca

SEQ ID NO: 193570 - DNA, 13 bp, Homo sapiens
accctacctgttc

SEQ ID NO: 193571 - DNA, 15 bp, Homo sapiens
accctactgtggatt

SEQ ID NO: 193572 - DNA, 19 bp, Homo sapiens
accctagcacaaatttgct

SEQ ID NO: 193573 - DNA, 17 bp, Homo sapiens
accctaggtctccaccc

SEQ ID NO: 193574 - DNA, 18 bp, Homo sapiens
accctaggtctccacccc

SEQ ID NO: 193575 - DNA, 24 bp, Homo sapiens
accctaggtctccacccctcaagc

SEQ ID NO: 193576 - DNA, 23 bp, Homo sapiens
accctatattttgcatagtacca

SEQ ID NO: 193577 - DNA, 13 bp, Homo sapiens
accctattcccta

SEQ ID NO: 193578 - DNA, 13 bp, Homo sapiens
accctcaaagtag

SEQ ID NO: 193579 - DNA, 14 bp, Homo sapiens
accctcacacacac

SEQ ID NO: 193580 - DNA, 19 bp, Homo sapiens
accctcacacacacagctg

SEQ ID NO: 193581 - DNA, 9 bp, Homo sapiens
accctcact

SEQ ID NO: 193582 - DNA, 16 bp, Homo sapiens
accctcactctgccag

SEQ ID NO: 193583 - DNA, 17 bp, Homo sapiens
accctcactctgccagg

SEQ ID NO: 193584 - DNA, 11 bp, Homo sapiens
accctcagagc

SEQ ID NO: 193585 - DNA, 19 bp, Homo sapiens
accctcaggcataggcctg

SEQ ID NO: 193586 - DNA, 21 bp, Homo sapiens
aaagatttaagcacaaacttt

SEQ ID NO: 193587 - DNA, 12 bp, Homo sapiens
aaagatttaatg

SEQ ID NO: 193588 - DNA, 21 bp, Homo sapiens
aaagatttaatgttacagcat

SEQ ID NO: 193589 - DNA, 21 bp, Homo sapiens
aaagattttcagaaaatatta

SEQ ID NO: 193590 - DNA, 22 bp, Homo sapiens
aaagatttttgttaagctcagg

SEQ ID NO: 193591 - DNA, 13 bp, Homo sapiens
aaagcaaccacct

SEQ ID NO: 193592 - DNA, 14 bp, Homo sapiens
aaagcaagactgtt

SEQ ID NO: 193593 - DNA, 17 bp, Homo sapiens
aaagcaattgccctgta

SEQ ID NO: 193594 - DNA, 14 bp, Homo sapiens
aaagcacagtgtta

SEQ ID NO: 193595 - DNA, 17 bp, Homo sapiens
aaagcacttcttttcca

SEQ ID NO: 193596 - DNA, 19 bp, Homo sapiens
aaagcacttggactcttgc

SEQ ID NO: 193597 - DNA, 22 bp, Homo sapiens
aaagcacttggactcttgctct

SEQ ID NO: 193598 - DNA, 22 bp, Homo sapiens
aaagcagaacagttaagcagcc

SEQ ID NO: 193599 - DNA, 19 bp, Homo sapiens
aaagcagaatagtattttt

SEQ ID NO: 193600 - DNA, 20 bp, Homo sapiens
aaagcagacagcaagggctt

SEQ ID NO: 193601 - DNA, 20 bp, Homo sapiens
aaagcaggaaagatcccaag

SEQ ID NO: 193602 - DNA, 21 bp, Homo sapiens
aaagcaggaaagatcccaagt

SEQ ID NO: 193603 - DNA, 17 bp, Homo sapiens
aaagcaggagcagctgt

SEQ ID NO: 193604 - DNA, 21 bp, Homo sapiens
aaagcaggcttgtgctttata

SEQ ID NO: 193605 - DNA, 17 bp, Homo sapiens
aaagcagggaatttcta

SEQ ID NO: 193606 - DNA, 18 bp, Homo sapiens
aaagcagggaatttctat

SEQ ID NO: 193607 - DNA, 10 bp, Homo sapiens
aaagcagtgt

SEQ ID NO: 193608 - DNA, 22 bp, Homo sapiens
aaagcatatataaaacaaaaca

SEQ ID NO: 193609 - DNA, 16 bp, Homo sapiens
aaagcatccctgtgag

SEQ ID NO: 193610 - DNA, 13 bp, Homo sapiens
aaagcatgctcag

SEQ ID NO: 193611 - DNA, 10 bp, Homo sapiens
aaagccaagc

SEQ ID NO: 193612 - DNA, 15 bp, Homo sapiens
aaagccacaaggctg

SEQ ID NO: 193613 - DNA, 19 bp, Homo sapiens
aaagccacaaggctggcca

SEQ ID NO: 193614 - DNA, 21 bp, Homo sapiens
aaagccacaaggctggccagc

SEQ ID NO: 193615 - DNA, 20 bp, Homo sapiens
aaagccacataaccagcggg

SEQ ID NO: 193616 - DNA, 12 bp, Homo sapiens
aaagccacctct

SEQ ID NO: 193617 - DNA, 16 bp, Homo sapiens
aaagccactagactct

SEQ ID NO: 193618 - DNA, 16 bp, Homo sapiens
aaagccagtgactcca

SEQ ID NO: 193619 - DNA, 17 bp, Homo sapiens
aaagccataacttgaaa

SEQ ID NO: 193620 - DNA, 19 bp, Homo sapiens
aaagccatattccagcagt

SEQ ID NO: 193621 - DNA, 13 bp, Homo sapiens
aaagcccacctga

SEQ ID NO: 193622 - DNA, 18 bp, Homo sapiens
aaagcccacctgggctgg

SEQ ID NO: 193623 - DNA, 16 bp, Homo sapiens
aaagcccagcccggct

SEQ ID NO: 193624 - DNA, 20 bp, Homo sapiens
acatataaacatcacacaca

SEQ ID NO: 193625 - DNA, 13 bp, Homo sapiens
acatataaattaa

SEQ ID NO: 193626 - DNA, 22 bp, Homo sapiens
acatataaattaatacataagt

SEQ ID NO: 193627 - DNA, 17 bp, Homo sapiens
acatatattttttacaa

SEQ ID NO: 193628 - DNA, 19 bp, Homo sapiens
acatatgagtgtggaagcc

SEQ ID NO: 193629 - DNA, 16 bp, Homo sapiens
acatatgtacataaat

SEQ ID NO: 193630 - DNA, 13 bp, Homo sapiens
acatatgtagata

SEQ ID NO: 193631 - DNA, 19 bp, Homo sapiens
acatatgtcttactacttt

SEQ ID NO: 193632 - DNA, 23 bp, Homo sapiens
acatatgtcttactactttaaat

SEQ ID NO: 193633 - DNA, 20 bp, Homo sapiens
acatattactgttgcattta

SEQ ID NO: 193634 - DNA, 18 bp, Homo sapiens
acatattaggaaaatatg

SEQ ID NO: 193635 - DNA, 15 bp, Homo sapiens
acatattcaaatcag

SEQ ID NO: 193636 - DNA, 22 bp, Homo sapiens
acatattcccatggtagactgt

SEQ ID NO: 193637 - DNA, 16 bp, Homo sapiens
acatatttgaatgact

SEQ ID NO: 193638 - DNA, 21 bp, Homo sapiens
acatatttgtagctagaatat

SEQ ID NO: 193639 - DNA, 23 bp, Homo sapiens
acatcaaataaatttctgggata

SEQ ID NO: 193640 - DNA, 11 bp, Homo sapiens
acatcaagaaa

SEQ ID NO: 193641 - DNA, 14 bp, Homo sapiens
acatcaagaaaaca

SEQ ID NO: 193642 - DNA, 13 bp, Homo sapiens
acatcaatgttca

SEQ ID NO: 193643 - DNA, 16 bp, Homo sapiens
acatcaatgttcattg

SEQ ID NO: 193644 - DNA, 20 bp, Homo sapiens
acatcacctttttgactttt

SEQ ID NO: 193645 - DNA, 22 bp, Homo sapiens
acatcactatccatgcaccaaa

SEQ ID NO: 193646 - DNA, 16 bp, Homo sapiens
acatcagacctgtctt

SEQ ID NO: 193647 - DNA, 21 bp, Homo sapiens
acatcagacctgtcttccaag

SEQ ID NO: 193648 - DNA, 18 bp, Homo sapiens
acatcaggtgatccacct

SEQ ID NO: 193649 - DNA, 20 bp, Homo sapiens
acatcaggtgatccacctgc

SEQ ID NO: 193650 - DNA, 15 bp, Homo sapiens
acatcatgaatttta

SEQ ID NO: 193651 - DNA, 13 bp, Homo sapiens
acatcatttcttt

SEQ ID NO: 193652 - DNA, 13 bp, Homo sapiens
acatccaaatcta

SEQ ID NO: 193653 - DNA, 13 bp, Homo sapiens
acatccaagcttc

SEQ ID NO: 193654 - DNA, 16 bp, Homo sapiens
acatccaagcttcctt

SEQ ID NO: 193655 - DNA, 22 bp, Homo sapiens
acatcccaataaagtcctcttc

SEQ ID NO: 193656 - DNA, 16 bp, Homo sapiens
acatcccactggatct

SEQ ID NO: 193657 - DNA, 18 bp, Homo sapiens
acatcccactggatctgg

SEQ ID NO: 193658 - DNA, 20 bp, Homo sapiens
acatcccactggatctggct

SEQ ID NO: 193659 - DNA, 18 bp, Homo sapiens
acatcccagcctgtggtt

SEQ ID NO: 193660 - DNA, 23 bp, Homo sapiens
acatcccaggaggggcctctgaa

SEQ ID NO: 193661 - DNA, 18 bp, Homo sapiens
acatccccaccttccaag

SEQ ID NO: 193662 - DNA, 16 bp, Homo sapiens
acatccccgctggctg

SEQ ID NO: 193663 - DNA, 17 bp, Homo sapiens
acatccccgctggctgg

SEQ ID NO: 193664 - DNA, 19 bp, Homo sapiens
acatccccgctggctgggg

SEQ ID NO: 193665 - DNA, 19 bp, Homo sapiens
acatcctgctacactcatc

SEQ ID NO: 193666 - DNA, 16 bp, Homo sapiens
acatcgatatgaaaaa

SEQ ID NO: 193667 - DNA, 15 bp, Homo sapiens
acatctctgcttgag

SEQ ID NO: 193668 - DNA, 23 bp, Homo sapiens
acatctctgtaaaaagcaggtga

SEQ ID NO: 193669 - DNA, 18 bp, Homo sapiens
acatctgaaaagaaatgc

SEQ ID NO: 193670 - DNA, 14 bp, Homo sapiens
acatctgtgttcta

SEQ ID NO: 193671 - DNA, 16 bp, Homo sapiens
acatcttcagcaaata

SEQ ID NO: 193672 - DNA, 19 bp, Homo sapiens
acatctttatcattaaaca

SEQ ID NO: 193673 - DNA, 14 bp, Homo sapiens
acatctttattaac

SEQ ID NO: 193674 - DNA, 15 bp, Homo sapiens
acatcttttaactgc

SEQ ID NO: 193675 - DNA, 14 bp, Homo sapiens
acatcttttgggaa

SEQ ID NO: 193676 - DNA, 16 bp, Homo sapiens
acatcttttgggaagc

SEQ ID NO: 193677 - DNA, 16 bp, Homo sapiens
acatctttttcctccc

SEQ ID NO: 193678 - DNA, 18 bp, Homo sapiens
acatctttttcctccctt

SEQ ID NO: 193679 - DNA, 20 bp, Homo sapiens
acatctttttcctccctttc

SEQ ID NO: 193680 - DNA, 12 bp, Homo sapiens
acatgaaaacat

SEQ ID NO: 193681 - DNA, 17 bp, Homo sapiens
acatgaaaacattgatg

SEQ ID NO: 193682 - DNA, 16 bp, Homo sapiens
acatgaacaatgtgtg

SEQ ID NO: 193683 - DNA, 16 bp, Homo sapiens
acatgaagaagctaaa

SEQ ID NO: 193684 - DNA, 16 bp, Homo sapiens
acatgaagaatgcatt

SEQ ID NO: 193685 - DNA, 15 bp, Homo sapiens
acatgacaactttgc

SEQ ID NO: 193686 - DNA, 15 bp, Homo sapiens
acatgacatttgtcc

SEQ ID NO: 193687 - DNA, 22 bp, Homo sapiens
acatgacatttgtcctgcagag

SEQ ID NO: 193688 - DNA, 23 bp, Homo sapiens
acatgagctatttccattccaga

SEQ ID NO: 193689 - DNA, 13 bp, Homo sapiens
acatgagtgtcaa

SEQ ID NO: 193690 - DNA, 15 bp, Homo sapiens
acatgagttcaaata

SEQ ID NO: 193691 - DNA, 19 bp, Homo sapiens
acatgatcttctttataat

SEQ ID NO: 193692 - DNA, 14 bp, Homo sapiens
acatgatgtgagat

SEQ ID NO: 193693 - DNA, 13 bp, Homo sapiens
acatgattccttc

SEQ ID NO: 193694 - DNA, 21 bp, Homo sapiens
acatgatttagggaagcaggg

SEQ ID NO: 193695 - DNA, 20 bp, Homo sapiens
acatgcacagtttgcaatct

SEQ ID NO: 193696 - DNA, 16 bp, Homo sapiens
acatgcactatgagga

SEQ ID NO: 193697 - DNA, 20 bp, Homo sapiens
acatgcactcagtgtggact

SEQ ID NO: 193698 - DNA, 22 bp, Homo sapiens
acatgcagcccatgcccacctg

SEQ ID NO: 193699 - DNA, 23 bp, Homo sapiens
acatgcagctctgcagcaatatt

SEQ ID NO: 193700 - DNA, 15 bp, Homo sapiens
acatgcagttcatta

SEQ ID NO: 193701 - DNA, 22 bp, Homo sapiens
acatgcagttcattattttgtg

SEQ ID NO: 193702 - DNA, 12 bp, Homo sapiens
acatgcatttga

SEQ ID NO: 193703 - DNA, 19 bp, Homo sapiens
acatgcattttatcagaca

SEQ ID NO: 193704 - DNA, 22 bp, Homo sapiens
acatgccgcgggcggccaggca

SEQ ID NO: 193705 - DNA, 21 bp, Homo sapiens
acatgcctgccccaaacaaat

SEQ ID NO: 193706 - DNA, 23 bp, Homo sapiens
acatgcggcttccgagggcacta

SEQ ID NO: 193707 - DNA, 15 bp, Homo sapiens
acatgctcacctcta

SEQ ID NO: 193708 - DNA, 22 bp, Homo sapiens
acatgctggacaggtctgggag

SEQ ID NO: 193709 - DNA, 17 bp, Homo sapiens
acatgctgtgctctttg

SEQ ID NO: 193710 - DNA, 19 bp, Homo sapiens
acatgctgtgtaagctgtg

SEQ ID NO: 193711 - DNA, 21 bp, Homo sapiens
acatgctgtgtaagctgtgtc

SEQ ID NO: 193712 - DNA, 13 bp, Homo sapiens
acatggaagaagt

SEQ ID NO: 193713 - DNA, 14 bp, Homo sapiens
acatggaagggaag

SEQ ID NO: 193714 - DNA, 19 bp, Homo sapiens
acatggacccggagctaac

SEQ ID NO: 193715 - DNA, 21 bp, Homo sapiens
acatggagactcctgccctgt

SEQ ID NO: 193716 - DNA, 22 bp, Homo sapiens
acatggagactcctgccctgtt

SEQ ID NO: 193717 - DNA, 11 bp, Homo sapiens
acatggccaca

SEQ ID NO: 193718 - DNA, 14 bp, Homo sapiens
acatggcctttgct

SEQ ID NO: 193719 - DNA, 20 bp, Homo sapiens
acatggggagtgtttcatgg

SEQ ID NO: 193720 - DNA, 17 bp, Homo sapiens
acatggggcctggccca

SEQ ID NO: 193721 - DNA, 17 bp, Homo sapiens
acatggggttggctggg

SEQ ID NO: 193722 - DNA, 21 bp, Homo sapiens
acatggggttggctgggccca

SEQ ID NO: 193723 - DNA, 23 bp, Homo sapiens
acatggtactcttgttgagttct

SEQ ID NO: 193724 - DNA, 18 bp, Homo sapiens
acatggtagcagggtctt

SEQ ID NO: 193725 - DNA, 14 bp, Homo sapiens
acatggtctcctct

SEQ ID NO: 193726 - DNA, 15 bp, Homo sapiens
acatggtgtgtgtct

SEQ ID NO: 193727 - DNA, 16 bp, Homo sapiens
aaatataattctgtaa

SEQ ID NO: 193728 - DNA, 14 bp, Homo sapiens
aaatataattgaca

SEQ ID NO: 193729 - DNA, 11 bp, Homo sapiens
aaatatactaa

SEQ ID NO: 193730 - DNA, 14 bp, Homo sapiens
aaatatactaataa

SEQ ID NO: 193731 - DNA, 17 bp, Homo sapiens
aaatatactaataaaaa

SEQ ID NO: 193732 - DNA, 22 bp, Homo sapiens
aaatatactaataaaaaggttt

SEQ ID NO: 193733 - DNA, 15 bp, Homo sapiens
aaatatactatgaaa

SEQ ID NO: 193734 - DNA, 13 bp, Homo sapiens
aaatatagaattt

SEQ ID NO: 193735 - DNA, 16 bp, Homo sapiens
aaatatagttgtcttt

SEQ ID NO: 193736 - DNA, 19 bp, Homo sapiens
aaatatagttgtctttctt

SEQ ID NO: 193737 - DNA, 23 bp, Homo sapiens
aaatatagttgtctttctttgct

SEQ ID NO: 193738 - DNA, 21 bp, Homo sapiens
aaatatagtttgattcttcat

SEQ ID NO: 193739 - DNA, 21 bp, Homo sapiens
aaatatataaaaagaaaagat

SEQ ID NO: 193740 - DNA, 18 bp, Homo sapiens
aaatatataatggtttac

SEQ ID NO: 193741 - DNA, 13 bp, Homo sapiens
aaatatatatata

SEQ ID NO: 193742 - DNA, 23 bp, Homo sapiens
aaatatatatgtgtgtgtatgtt

SEQ ID NO: 193743 - DNA, 13 bp, Homo sapiens
aaatatatgtttt

SEQ ID NO: 193744 - DNA, 14 bp, Homo sapiens
aaatatatgttttg

SEQ ID NO: 193745 - DNA, 17 bp, Homo sapiens
aaatatatgttttgaga

SEQ ID NO: 193746 - DNA, 18 bp, Homo sapiens
aaatatattaaaaatata

SEQ ID NO: 193747 - DNA, 16 bp, Homo sapiens
aaatatattcaggagt

SEQ ID NO: 193748 - DNA, 12 bp, Homo sapiens
aaatatatttaa

SEQ ID NO: 193749 - DNA, 20 bp, Homo sapiens
aaatatatttaagataatta

SEQ ID NO: 193750 - DNA, 22 bp, Homo sapiens
aaatatatttaagataattata

SEQ ID NO: 193751 - DNA, 14 bp, Homo sapiens
aaatatcactttgt

SEQ ID NO: 193752 - DNA, 15 bp, Homo sapiens
aaatatcagactagt

SEQ ID NO: 193753 - DNA, 14 bp, Homo sapiens
aaatatcataatgt

SEQ ID NO: 193754 - DNA, 13 bp, Homo sapiens
aactctgcggata

SEQ ID NO: 193755 - DNA, 19 bp, Homo sapiens
aactctgggcacttttgaa

SEQ ID NO: 193756 - DNA, 16 bp, Homo sapiens
aactctgtgcaggtgc

SEQ ID NO: 193757 - DNA, 17 bp, Homo sapiens
aactctgtgcaggtgct

SEQ ID NO: 193758 - DNA, 11 bp, Homo sapiens
aactcttcaag

SEQ ID NO: 193759 - DNA, 15 bp, Homo sapiens
aactcttcaaggcca

SEQ ID NO: 193760 - DNA, 14 bp, Homo sapiens
aactcttgctcact

SEQ ID NO: 193761 - DNA, 19 bp, Homo sapiens
aactcttgctcactcccta

SEQ ID NO: 193762 - DNA, 11 bp, Homo sapiens
aactgaaaaca

SEQ ID NO: 193763 - DNA, 12 bp, Homo sapiens
aactgaaaacat

SEQ ID NO: 193764 - DNA, 16 bp, Homo sapiens
aactgaaaactgtaaa

SEQ ID NO: 193765 - DNA, 18 bp, Homo sapiens
aactgaaaactgtaaata

SEQ ID NO: 193766 - DNA, 14 bp, Homo sapiens
aactgaaaatgtaa

SEQ ID NO: 193767 - DNA, 14 bp, Homo sapiens
aactgaaagtgttt

SEQ ID NO: 193768 - DNA, 21 bp, Homo sapiens
aactgaaagtgttttactctt

SEQ ID NO: 193769 - DNA, 14 bp, Homo sapiens
aactgaacgacaaa

SEQ ID NO: 193770 - DNA, 22 bp, Homo sapiens
aactgaagcaaataccaaagca

SEQ ID NO: 193771 - DNA, 22 bp, Homo sapiens
aactgaccctcccttcctgtcc

SEQ ID NO: 193772 - DNA, 14 bp, Homo sapiens
aactgacttaacaa

SEQ ID NO: 193773 - DNA, 13 bp, Homo sapiens
aactgacttgctg

SEQ ID NO: 193774 - DNA, 18 bp, Homo sapiens
aactgactttatcctcag

SEQ ID NO: 193775 - DNA, 21 bp, Homo sapiens
aactgagccgtgcagctggga

SEQ ID NO: 193776 - DNA, 22 bp, Homo sapiens
aactgagctcctctgggcagga

SEQ ID NO: 193777 - DNA, 21 bp, Homo sapiens
aactgaggcccagagagctga

SEQ ID NO: 193778 - DNA, 13 bp, Homo sapiens
aactgagtcctgt

SEQ ID NO: 193779 - DNA, 14 bp, Homo sapiens
aactgagtcctgtt

SEQ ID NO: 193780 - DNA, 23 bp, Homo sapiens
aactgatatacttgagtgtgcaa

SEQ ID NO: 193781 - DNA, 20 bp, Homo sapiens
aactgatcatttgcagctgc

SEQ ID NO: 193782 - DNA, 14 bp, Homo sapiens
aactgatgctttca

SEQ ID NO: 193783 - DNA, 23 bp, Homo sapiens
aactgatggaccgggtgggcctg

SEQ ID NO: 193784 - DNA, 13 bp, Homo sapiens
aactgcaatagag

SEQ ID NO: 193785 - DNA, 21 bp, Homo sapiens
aactgcacagtgctgttggtg

SEQ ID NO: 193786 - DNA, 16 bp, Homo sapiens
aactgcatatagataa

SEQ ID NO: 193787 - DNA, 14 bp, Homo sapiens
aactgcatgctgct

SEQ ID NO: 193788 - DNA, 16 bp, Homo sapiens
aactgcatgctgctgg

SEQ ID NO: 193789 - DNA, 15 bp, Homo sapiens
aactgcatggaccta

SEQ ID NO: 193790 - DNA, 18 bp, Homo sapiens
aactgcattctataataa

SEQ ID NO: 193791 - DNA, 17 bp, Homo sapiens
aactgccagccttggag

SEQ ID NO: 193792 - DNA, 18 bp, Homo sapiens
aactgcccttttaaatgg

SEQ ID NO: 193793 - DNA, 20 bp, Homo sapiens
aactgcccttttaaatggca

SEQ ID NO: 193794 - DNA, 20 bp, Homo sapiens
aactgccgtgggaattttat

SEQ ID NO: 193795 - DNA, 23 bp, Homo sapiens
aactgccttaaccttctggggga

SEQ ID NO: 193796 - DNA, 15 bp, Homo sapiens
aactgctgagccact

SEQ ID NO: 193797 - DNA, 19 bp, Homo sapiens
aactgctgttttatgtcat

SEQ ID NO: 193798 - DNA, 20 bp, Homo sapiens
aactgctgttttatgtcata

SEQ ID NO: 193799 - DNA, 14 bp, Homo sapiens
aactgcttgcattt

SEQ ID NO: 193800 - DNA, 20 bp, Homo sapiens
aactgcttgcatttctttat

SEQ ID NO: 193801 - DNA, 18 bp, Homo sapiens
aactgcttgcccagggtg

SEQ ID NO: 193802 - DNA, 20 bp, Homo sapiens
aactgcttttttttttccag

SEQ ID NO: 193803 - DNA, 13 bp, Homo sapiens
aactggagaggct

SEQ ID NO: 193804 - DNA, 20 bp, Homo sapiens
aactggcatctgacacaaaa

SEQ ID NO: 193805 - DNA, 15 bp, Homo sapiens
aactgggaaaacagt

SEQ ID NO: 193806 - DNA, 16 bp, Homo sapiens
aactgggaaaacagtg

SEQ ID NO: 193807 - DNA, 17 bp, Homo sapiens
aactgggaagatgctgg

SEQ ID NO: 193808 - DNA, 11 bp, Homo sapiens
aactggtccag

SEQ ID NO: 193809 - DNA, 15 bp, Homo sapiens
aactggtccaggcca

SEQ ID NO: 193810 - DNA, 23 bp, Homo sapiens
aactgtaaatacaaaataaaatt

SEQ ID NO: 193811 - DNA, 17 bp, Homo sapiens
aactgtagaaatgatga

SEQ ID NO: 193812 - DNA, 14 bp, Homo sapiens
aactgtagtaattg

SEQ ID NO: 193813 - DNA, 22 bp, Homo sapiens
aactgtagtaattgttacaatt

SEQ ID NO: 193814 - DNA, 20 bp, Homo sapiens
aactgtatcaaatctgtata

SEQ ID NO: 193815 - DNA, 21 bp, Homo sapiens
aactgtctcctacctctgctc

SEQ ID NO: 193816 - DNA, 16 bp, Homo sapiens
aactgtgaacctggag

SEQ ID NO: 193817 - DNA, 17 bp, Homo sapiens
aactgtgaagtttacat

SEQ ID NO: 193818 - DNA, 21 bp, Homo sapiens
aactgtgaatacttgaactct

SEQ ID NO: 193819 - DNA, 13 bp, Homo sapiens
aactgtgacattc

SEQ ID NO: 193820 - DNA, 14 bp, Homo sapiens
aactgtgagataaa

SEQ ID NO: 193821 - DNA, 13 bp, Homo sapiens
aactgtgtatgta

SEQ ID NO: 193822 - DNA, 17 bp, Homo sapiens
aactgtgtgaagaaatg

SEQ ID NO: 193823 - DNA, 18 bp, Homo sapiens
aactgtgtgaagaaatgg

SEQ ID NO: 193824 - DNA, 14 bp, Homo sapiens
aactgttgattgca

SEQ ID NO: 193825 - DNA, 15 bp, Homo sapiens
aactgttgccagaga

SEQ ID NO: 193826 - DNA, 13 bp, Homo sapiens
aactgttgtttga

SEQ ID NO: 193827 - DNA, 15 bp, Homo sapiens
aactgtttttgaaga

SEQ ID NO: 193828 - DNA, 20 bp, Homo sapiens
aacttaaaaagtctgcatta

SEQ ID NO: 193829 - DNA, 18 bp, Homo sapiens
aacttaaaaatgtaaata

SEQ ID NO: 193830 - DNA, 13 bp, Homo sapiens
aacttaaataata

SEQ ID NO: 193831 - DNA, 14 bp, Homo sapiens
aacttaaataataa

SEQ ID NO: 193832 - DNA, 13 bp, Homo sapiens
aacttaaatcact

SEQ ID NO: 193833 - DNA, 14 bp, Homo sapiens
aacttaaatcactg

SEQ ID NO: 193834 - DNA, 16 bp, Homo sapiens
aacttaaatcactgag

SEQ ID NO: 193835 - DNA, 14 bp, Homo sapiens
aacttaacatattt

SEQ ID NO: 193836 - DNA, 16 bp, Homo sapiens
aacttaacatatttac

SEQ ID NO: 193837 - DNA, 12 bp, Homo sapiens
aacttaacatgc

SEQ ID NO: 193838 - DNA, 15 bp, Homo sapiens
aacttaagtttagaa

SEQ ID NO: 193839 - DNA, 22 bp, Homo sapiens
aacttaagtttagaaattacaa

SEQ ID NO: 193840 - DNA, 19 bp, Homo sapiens
aacttacacttggagcccg

SEQ ID NO: 193841 - DNA, 19 bp, Homo sapiens
aacttacctgggcattctt

SEQ ID NO: 193842 - DNA, 15 bp, Homo sapiens
aacttagaataaaat

SEQ ID NO: 193843 - DNA, 17 bp, Homo sapiens
aacttagaataaaattg

SEQ ID NO: 193844 - DNA, 12 bp, Homo sapiens
aacttaggctac

SEQ ID NO: 193845 - DNA, 18 bp, Homo sapiens
aacttagtgtttagcatt

SEQ ID NO: 193846 - DNA, 14 bp, Homo sapiens
aacttataaatcat

SEQ ID NO: 193847 - DNA, 22 bp, Homo sapiens
aacttattgcctgggcagtgcc

SEQ ID NO: 193848 - DNA, 13 bp, Homo sapiens
aacttatttgagt

SEQ ID NO: 193849 - DNA, 21 bp, Homo sapiens
aacttcaccaccccctgtccc

SEQ ID NO: 193850 - DNA, 22 bp, Homo sapiens
aacttcaccaccccctgtccca

SEQ ID NO: 193851 - DNA, 23 bp, Homo sapiens
aacttcaccaccccctgtcccat

SEQ ID NO: 193852 - DNA, 13 bp, Homo sapiens
aacttcaccttaa

SEQ ID NO: 193853 - DNA, 15 bp, Homo sapiens
aacttcaccttaaaa

SEQ ID NO: 193854 - DNA, 15 bp, Homo sapiens
aacttcagcaaccct

SEQ ID NO: 193855 - DNA, 11 bp, Homo sapiens
aacttcagcag

SEQ ID NO: 193856 - DNA, 20 bp, Homo sapiens
aacttcagctagagcttcaa

SEQ ID NO: 193857 - DNA, 17 bp, Homo sapiens
aacttcagctgtacttc

SEQ ID NO: 193858 - DNA, 17 bp, Homo sapiens
aacttcattctaaacca

SEQ ID NO: 193859 - DNA, 20 bp, Homo sapiens
aacttccaagacctgactca

SEQ ID NO: 193860 - DNA, 15 bp, Homo sapiens
aacttccattctttc

SEQ ID NO: 193861 - DNA, 15 bp, Homo sapiens
aacttccctgttctt

SEQ ID NO: 193862 - DNA, 17 bp, Homo sapiens
aacttccctgttcttta

SEQ ID NO: 193863 - DNA, 20 bp, Homo sapiens
aacttcgaccctttctctga

SEQ ID NO: 193864 - DNA, 15 bp, Homo sapiens
aacttctctggaaag

SEQ ID NO: 193865 - DNA, 18 bp, Homo sapiens
aacttctgaactttggaa

SEQ ID NO: 193866 - DNA, 13 bp, Homo sapiens
aacttctgcctgt

SEQ ID NO: 193867 - DNA, 15 bp, Homo sapiens
aacttgagcatgtta

SEQ ID NO: 193868 - DNA, 12 bp, Homo sapiens
aacttgagccca

SEQ ID NO: 193869 - DNA, 15 bp, Homo sapiens
aacttgaggacacat

SEQ ID NO: 193870 - DNA, 16 bp, Homo sapiens
aacttgagggtaataa

SEQ ID NO: 193871 - DNA, 23 bp, Homo sapiens
aacttgatttgcatggattttgg

SEQ ID NO: 193872 - DNA, 19 bp, Homo sapiens
aacttgcaatgaaaagaaa

SEQ ID NO: 193873 - DNA, 19 bp, Homo sapiens
aacttgctgctgtgcctgc

SEQ ID NO: 193874 - DNA, 12 bp, Homo sapiens
aacttggagccg

SEQ ID NO: 193875 - DNA, 23 bp, Homo sapiens
aacttggttcccatttgctcctt

SEQ ID NO: 193876 - DNA, 21 bp, Homo sapiens
aactttaagtttcaggataca

SEQ ID NO: 193877 - DNA, 20 bp, Homo sapiens
aactttaattctctttcaaa

SEQ ID NO: 193878 - DNA, 22 bp, Homo sapiens
aactttagaagtgcatttctga

SEQ ID NO: 193879 - DNA, 21 bp, Homo sapiens
aactttagggggtgggagggg

SEQ ID NO: 193880 - DNA, 21 bp, Homo sapiens
aactttatcacattatttgca

SEQ ID NO: 193881 - DNA, 13 bp, Homo sapiens
aactttccatgac

SEQ ID NO: 193882 - DNA, 21 bp, Homo sapiens
aactttccatgacagtagcat

SEQ ID NO: 193883 - DNA, 18 bp, Homo sapiens
aactttctcttcatactt

SEQ ID NO: 193884 - DNA, 15 bp, Homo sapiens
aactttctgtaaact

SEQ ID NO: 193885 - DNA, 16 bp, Homo sapiens
aactttgcatgttctt

SEQ ID NO: 193886 - DNA, 22 bp, Homo sapiens
aactttgcatgttcttgttttg

SEQ ID NO: 193887 - DNA, 23 bp, Homo sapiens
aactttgcatgttcttgttttgt

SEQ ID NO: 193888 - DNA, 16 bp, Homo sapiens
actttggaatgttgaa

SEQ ID NO: 193889 - DNA, 15 bp, Homo sapiens
actttgggaggccaa

SEQ ID NO: 193890 - DNA, 14 bp, Homo sapiens
actttgtacttgtg

SEQ ID NO: 193891 - DNA, 14 bp, Homo sapiens
actttgtattctct

SEQ ID NO: 193892 - DNA, 14 bp, Homo sapiens
actttgtcacttct

SEQ ID NO: 193893 - DNA, 13 bp, Homo sapiens
actttgtcccgct

SEQ ID NO: 193894 - DNA, 12 bp, Homo sapiens
actttgtgcaaa

SEQ ID NO: 193895 - DNA, 17 bp, Homo sapiens
actttgtgcaaaagcag

SEQ ID NO: 193896 - DNA, 16 bp, Homo sapiens
actttgtggatgtctt

SEQ ID NO: 193897 - DNA, 15 bp, Homo sapiens
actttgttctttagg

SEQ ID NO: 193898 - DNA, 23 bp, Homo sapiens
actttgtttcttttgcttaggaa

SEQ ID NO: 193899 - DNA, 17 bp, Homo sapiens
acttttacagcttttct

SEQ ID NO: 193900 - DNA, 22 bp, Homo sapiens
acttttattgtataattatgaa

SEQ ID NO: 193901 - DNA, 12 bp, Homo sapiens
acttttcagtga

SEQ ID NO: 193902 - DNA, 15 bp, Homo sapiens
acttttctccatgag

SEQ ID NO: 193903 - DNA, 15 bp, Homo sapiens
acttttgaaatttaa

SEQ ID NO: 193904 - DNA, 23 bp, Homo sapiens
acttttgaactcacgagccttgc

SEQ ID NO: 193905 - DNA, 16 bp, Homo sapiens
acttttgcacatatat

SEQ ID NO: 193906 - DNA, 19 bp, Homo sapiens
acttttgcagcttccttcc

SEQ ID NO: 193907 - DNA, 19 bp, Homo sapiens
acttttgtgtattctgtgg

SEQ ID NO: 193908 - DNA, 14 bp, Homo sapiens
acttttgtgtgaaa

SEQ ID NO: 193909 - DNA, 13 bp, Homo sapiens
acttttgtttcag

SEQ ID NO: 193910 - DNA, 12 bp, Homo sapiens
actttttccccc

SEQ ID NO: 193911 - DNA, 13 bp, Homo sapiens
actttttccttcc

SEQ ID NO: 193912 - DNA, 17 bp, Homo sapiens
actttttctgagctttt

SEQ ID NO: 193913 - DNA, 13 bp, Homo sapiens
acttttttatagc

SEQ ID NO: 193914 - DNA, 18 bp, Homo sapiens
acttttttcctgtcaata

SEQ ID NO: 193915 - DNA, 16 bp, Homo sapiens
agaaaaaaaaaaagaa

SEQ ID NO: 193916 - DNA, 17 bp, Homo sapiens
agaaaaaaaataacaca

SEQ ID NO: 193917 - DNA, 21 bp, Homo sapiens
atcaactgcatcaagatgtga

SEQ ID NO: 193918 - DNA, 12 bp, Homo sapiens
atcaagaaattg

SEQ ID NO: 193919 - DNA, 23 bp, Homo sapiens
atcaagaagtcagagaaaacact

SEQ ID NO: 193920 - DNA, 22 bp, Homo sapiens
atcaagagtgagtgaacaacta

SEQ ID NO: 193921 - DNA, 13 bp, Homo sapiens
atcaagcccctgt

SEQ ID NO: 193922 - DNA, 17 bp, Homo sapiens
atcaagcttgtgtactt

SEQ ID NO: 193923 - DNA, 13 bp, Homo sapiens
atcaaggagcctc

SEQ ID NO: 193924 - DNA, 14 bp, Homo sapiens
atcaaggagcctcc

SEQ ID NO: 193925 - DNA, 21 bp, Homo sapiens
atcaaggcaaaaatatcagga

SEQ ID NO: 193926 - DNA, 11 bp, Homo sapiens
atcaaggctgc

SEQ ID NO: 193927 - DNA, 16 bp, Homo sapiens
atcaaggctgcctgga

SEQ ID NO: 193928 - DNA, 14 bp, Homo sapiens
atcaaggtcgtttt

SEQ ID NO: 193929 - DNA, 15 bp, Homo sapiens
atcaaggtcgttttt

SEQ ID NO: 193930 - DNA, 19 bp, Homo sapiens
atcaagtcaatcatttctc

SEQ ID NO: 193931 - DNA, 23 bp, Homo sapiens
atcaagtcccgaggcagcaacag

SEQ ID NO: 193932 - DNA, 14 bp, Homo sapiens
atcaagtctgtgaa

SEQ ID NO: 193933 - DNA, 13 bp, Homo sapiens
atcaagtgtcttc

SEQ ID NO: 193934 - DNA, 15 bp, Homo sapiens
atcaagtgtgcttta

SEQ ID NO: 193935 - DNA, 16 bp, Homo sapiens
atcaataaaatgtgat

SEQ ID NO: 193936 - DNA, 17 bp, Homo sapiens
atcaataaaatgtgatt

SEQ ID NO: 193937 - DNA, 14 bp, Homo sapiens
atcaataaagcact

SEQ ID NO: 193938 - DNA, 18 bp, Homo sapiens
atcaataaatagatgagt

SEQ ID NO: 193939 - DNA, 21 bp, Homo sapiens
atcaatacccttggcactgat

SEQ ID NO: 193940 - DNA, 15 bp, Homo sapiens
atcaatacttttgtg

SEQ ID NO: 193941 - DNA, 13 bp, Homo sapiens
atcaatcatgccc

SEQ ID NO: 193942 - DNA, 16 bp, Homo sapiens
atcaatgaatattgaa

SEQ ID NO: 193943 - DNA, 23 bp, Homo sapiens
atcaatggcgcagtgcctctggt

SEQ ID NO: 193944 - DNA, 13 bp, Homo sapiens
atcaatgttcatt

SEQ ID NO: 193945 - DNA, 14 bp, Homo sapiens
atcaatgttcattg

SEQ ID NO: 193946 - DNA, 15 bp, Homo sapiens
atcaattaaatgtag

SEQ ID NO: 193947 - DNA, 15 bp, Homo sapiens
atcaattaattctta

SEQ ID NO: 193948 - DNA, 17 bp, Homo sapiens
atcaattaattcttaat

SEQ ID NO: 193949 - DNA, 16 bp, Homo sapiens
atcaattattacattt

SEQ ID NO: 193950 - DNA, 15 bp, Homo sapiens
atcaattctctatca

SEQ ID NO: 193951 - DNA, 19 bp, Homo sapiens
atcaattctgatacagcct

SEQ ID NO: 193952 - DNA, 21 bp, Homo sapiens
atcaatttaaaatcattcaat

SEQ ID NO: 193953 - DNA, 23 bp, Homo sapiens
atcaatttaaaatcattcaatat

SEQ ID NO: 193954 - DNA, 15 bp, Homo sapiens
atcaattttaacatt

SEQ ID NO: 193955 - DNA, 15 bp, Homo sapiens
atcacaactcagcat

SEQ ID NO: 193956 - DNA, 15 bp, Homo sapiens
atcacaaggtcagga

SEQ ID NO: 193957 - DNA, 17 bp, Homo sapiens
atcacaaggtcaggagt

SEQ ID NO: 193958 - DNA, 18 bp, Homo sapiens
atcacaatgtactatatg

SEQ ID NO: 193959 - DNA, 13 bp, Homo sapiens
atcacacaaagca

SEQ ID NO: 193960 - DNA, 11 bp, Homo sapiens
atcacacacac

SEQ ID NO: 193961 - DNA, 16 bp, Homo sapiens
atcacaccactgtact

SEQ ID NO: 193962 - DNA, 13 bp, Homo sapiens
atcacacctctgg

SEQ ID NO: 193963 - DNA, 18 bp, Homo sapiens
atcacacctctgggcttc

SEQ ID NO: 193964 - DNA, 20 bp, Homo sapiens
atcacagatgggtattaaac

SEQ ID NO: 193965 - DNA, 22 bp, Homo sapiens
atcacagatgggtattaaactt

SEQ ID NO: 193966 - DNA, 13 bp, Homo sapiens
atcacagatgtgc

SEQ ID NO: 193967 - DNA, 14 bp, Homo sapiens
atcacagccagccc

SEQ ID NO: 193968 - DNA, 15 bp, Homo sapiens
atcacagccagccca

SEQ ID NO: 193969 - DNA, 16 bp, Homo sapiens
atcacagccagcccag

SEQ ID NO: 193970 - DNA, 10 bp, Homo sapiens
atcacagcct

SEQ ID NO: 193971 - DNA, 17 bp, Homo sapiens
atcacagcctccagggc

SEQ ID NO: 193972 - DNA, 14 bp, Homo sapiens
atcacagcttgttt

SEQ ID NO: 193973 - DNA, 21 bp, Homo sapiens
atcacaggctctgcatacaca

SEQ ID NO: 193974 - DNA, 22 bp, Homo sapiens
atcacaggctctgcatacacat

SEQ ID NO: 193975 - DNA, 12 bp, Homo sapiens
atcacaggggcg

SEQ ID NO: 193976 - DNA, 24 bp, Homo sapiens
atcacattcaggcatgcgaatgag

SEQ ID NO: 193977 - DNA, 15 bp, Homo sapiens
atcaccagcccggcc

SEQ ID NO: 193978 - DNA, 21 bp, Homo sapiens
atcacctttttgacttttcca

SEQ ID NO: 193979 - DNA, 15 bp, Homo sapiens
atcacgggcccgctc

SEQ ID NO: 193980 - DNA, 16 bp, Homo sapiens
atcacgggcccgctca

SEQ ID NO: 193981 - DNA, 19 bp, Homo sapiens
atcactataaccatcagtt

SEQ ID NO: 193982 - DNA, 12 bp, Homo sapiens
atcactattctt

SEQ ID NO: 193983 - DNA, 22 bp, Homo sapiens
atcactattcttaagcactttg

SEQ ID NO: 193984 - DNA, 12 bp, Homo sapiens
atcactccctgg

SEQ ID NO: 193985 - DNA, 14 bp, Homo sapiens
atcactccctggat

SEQ ID NO: 193986 - DNA, 14 bp, Homo sapiens
atcactgagtttgt

SEQ ID NO: 193987 - DNA, 14 bp, Homo sapiens
atcactgtctttcc

SEQ ID NO: 193988 - DNA, 15 bp, Homo sapiens
atcactgtctttcct

SEQ ID NO: 193989 - DNA, 17 bp, Homo sapiens
atcacttaagcccagga

SEQ ID NO: 193990 - DNA, 14 bp, Homo sapiens
atcacttctccccg

SEQ ID NO: 193991 - DNA, 16 bp, Homo sapiens
atcacttctccccgca

SEQ ID NO: 193992 - DNA, 19 bp, Homo sapiens
atcacttgaggtcaggagt

SEQ ID NO: 193993 - DNA, 15 bp, Homo sapiens
atcactttgctctga

SEQ ID NO: 193994 - DNA, 12 bp, Homo sapiens
atcactttggtc

SEQ ID NO: 193995 - DNA, 15 bp, Homo sapiens
atcactttgtattct

SEQ ID NO: 193996 - DNA, 13 bp, Homo sapiens
atcagaaaaggga

SEQ ID NO: 193997 - DNA, 21 bp, Homo sapiens
atcagaactgggaaaacagtg

SEQ ID NO: 193998 - DNA, 23 bp, Homo sapiens
atcagaagaccacaaaaattgac

SEQ ID NO: 193999 - DNA, 16 bp, Homo sapiens
atcagaccataatgtt

SEQ ID NO: 194000 - DNA, 12 bp, Homo sapiens
atcagacctctg

SEQ ID NO: 194001 - DNA, 14 bp, Homo sapiens
atcagacctgtctt

SEQ ID NO: 194002 - DNA, 16 bp, Homo sapiens
atcagagagtgtacat

SEQ ID NO: 194003 - DNA, 20 bp, Homo sapiens
atcagagtctggcctgccag

SEQ ID NO: 194004 - DNA, 16 bp, Homo sapiens
atcagatcttacaagt

SEQ ID NO: 194005 - DNA, 15 bp, Homo sapiens
atcagattgcttttg

SEQ ID NO: 194006 - DNA, 19 bp, Homo sapiens
atcagattgcttttgtgca

SEQ ID NO: 194007 - DNA, 13 bp, Homo sapiens
atcagcaaagaat

SEQ ID NO: 194008 - DNA, 13 bp, Homo sapiens
atcagcagagaga

SEQ ID NO: 194009 - DNA, 14 bp, Homo sapiens
atcagcattcaaaa

SEQ ID NO: 194010 - DNA, 12 bp, Homo sapiens
atcagcccaggt

SEQ ID NO: 194011 - DNA, 23 bp, Homo sapiens
atcagccccgctcctcccctctt

SEQ ID NO: 194012 - DNA, 15 bp, Homo sapiens
atcagcctctggcca

SEQ ID NO: 194013 - DNA, 16 bp, Homo sapiens
atcagcctctggccag

SEQ ID NO: 194014 - DNA, 18 bp, Homo sapiens
atcagcctctggccagac

SEQ ID NO: 194015 - DNA, 15 bp, Homo sapiens
atcagcctcttaaag

SEQ ID NO: 194016 - DNA, 17 bp, Homo sapiens
atcagcctgagtctcct

SEQ ID NO: 194017 - DNA, 20 bp, Homo sapiens
atcagcctgagtctcctgtg

SEQ ID NO: 194018 - DNA, 11 bp, Homo sapiens
atcagctccct

SEQ ID NO: 194019 - DNA, 19 bp, Homo sapiens
atcagctcccttcccctgc

SEQ ID NO: 194020 - DNA, 16 bp, Homo sapiens
atcagctctctgcaga

SEQ ID NO: 194021 - DNA, 16 bp, Homo sapiens
agaaatacttgtgatt

SEQ ID NO: 194022 - DNA, 17 bp, Homo sapiens
agaaatataaaaataat

SEQ ID NO: 194023 - DNA, 22 bp, Homo sapiens
agaaatatgattttatttgaca

SEQ ID NO: 194024 - DNA, 21 bp, Homo sapiens
agaaatatgcacaatagcagt

SEQ ID NO: 194025 - DNA, 14 bp, Homo sapiens
agaaatcaattttt

SEQ ID NO: 194026 - DNA, 16 bp, Homo sapiens
agaaatcacaggggcg

SEQ ID NO: 194027 - DNA, 17 bp, Homo sapiens
agaaatcattgtagaaa

SEQ ID NO: 194028 - DNA, 16 bp, Homo sapiens
agaaatcccagttcat

SEQ ID NO: 194029 - DNA, 12 bp, Homo sapiens
agaaatgaataa

SEQ ID NO: 194030 - DNA, 17 bp, Homo sapiens
agaaatgccgctgtgtc

SEQ ID NO: 194031 - DNA, 15 bp, Homo sapiens
agaaatgctgcctgc

SEQ ID NO: 194032 - DNA, 15 bp, Homo sapiens
agaaatggctttcca

SEQ ID NO: 194033 - DNA, 16 bp, Homo sapiens
agaaatggggaattct

SEQ ID NO: 194034 - DNA, 14 bp, Homo sapiens
agaaatgtgctgca

SEQ ID NO: 194035 - DNA, 16 bp, Homo sapiens
agaaatgtgctgcaaa

SEQ ID NO: 194036 - DNA, 17 bp, Homo sapiens
agaaattagaaacctta

SEQ ID NO: 194037 - DNA, 19 bp, Homo sapiens
agaaattagggctctaatt

SEQ ID NO: 194038 - DNA, 14 bp, Homo sapiens
agaaattatttaat

SEQ ID NO: 194039 - DNA, 16 bp, Homo sapiens
agaaattatttaataa

SEQ ID NO: 194040 - DNA, 16 bp, Homo sapiens
agaaattatttaatat

SEQ ID NO: 194041 - DNA, 22 bp, Homo sapiens
agaaattatttaatatgcatct

SEQ ID NO: 194042 - DNA, 17 bp, Homo sapiens
agaaattccctggacca

SEQ ID NO: 194043 - DNA, 22 bp, Homo sapiens
agaaattccctggaccagatgc

SEQ ID NO: 194044 - DNA, 13 bp, Homo sapiens
agaaattctgtgg

SEQ ID NO: 194045 - DNA, 12 bp, Homo sapiens
agaaattctgtt

SEQ ID NO: 194046 - DNA, 15 bp, Homo sapiens
agaaattcttcaatt

SEQ ID NO: 194047 - DNA, 19 bp, Homo sapiens
agaaattcttcaatttgaa

SEQ ID NO: 194048 - DNA, 17 bp, Homo sapiens
agaaattgcatttcctg

SEQ ID NO: 194049 - DNA, 16 bp, Homo sapiens
agaaattgcctccagt

SEQ ID NO: 194050 - DNA, 16 bp, Homo sapiens
agaaattgcctcctta

SEQ ID NO: 194051 - DNA, 13 bp, Homo sapiens
agaaattttcaac

SEQ ID NO: 194052 - DNA, 19 bp, Homo sapiens
agaacaaaacctcttctgt

SEQ ID NO: 194053 - DNA, 18 bp, Homo sapiens
agaacaaacaaaacttaa

SEQ ID NO: 194054 - DNA, 14 bp, Homo sapiens
agaacaaacagaaa

SEQ ID NO: 194055 - DNA, 15 bp, Homo sapiens
agaacaaacctctat

SEQ ID NO: 194056 - DNA, 18 bp, Homo sapiens
agaacaaagaccaatgtg

SEQ ID NO: 194057 - DNA, 20 bp, Homo sapiens
agaacaaagggccaaataga

SEQ ID NO: 194058 - DNA, 20 bp, Homo sapiens
atcagttgcgcgttctgaaa

SEQ ID NO: 194059 - DNA, 18 bp, Homo sapiens
atcagttttgtgtacagt

SEQ ID NO: 194060 - DNA, 19 bp, Homo sapiens
atcataaaaggtgaccctt

SEQ ID NO: 194061 - DNA, 17 bp, Homo sapiens
atcataacatagttgaa

SEQ ID NO: 194062 - DNA, 18 bp, Homo sapiens
atcataacatagttgaaa

SEQ ID NO: 194063 - DNA, 22 bp, Homo sapiens
atcatagaggatgatgtaatta

SEQ ID NO: 194064 - DNA, 16 bp, Homo sapiens
atcatataataaatgt

SEQ ID NO: 194065 - DNA, 20 bp, Homo sapiens
atcatatgtatctaaatgaa

SEQ ID NO: 194066 - DNA, 21 bp, Homo sapiens
atcatatgtatctaaatgaaa

SEQ ID NO: 194067 - DNA, 22 bp, Homo sapiens
atcatatgtatctaaatgaaaa

SEQ ID NO: 194068 - DNA, 17 bp, Homo sapiens
atcatattgatgaaaag

SEQ ID NO: 194069 - DNA, 18 bp, Homo sapiens
atcatattgatgaaaaga

SEQ ID NO: 194070 - DNA, 16 bp, Homo sapiens
atcatatttaatagga

SEQ ID NO: 194071 - DNA, 22 bp, Homo sapiens
atcatcatagaggatgatgtaa

SEQ ID NO: 194072 - DNA, 23 bp, Homo sapiens
atcatctccatcatatgcctgac

SEQ ID NO: 194073 - DNA, 17 bp, Homo sapiens
atcatctctgcctttga

SEQ ID NO: 194074 - DNA, 18 bp, Homo sapiens
atcatctgtgtgaaaatg

SEQ ID NO: 194075 - DNA, 21 bp, Homo sapiens
atcatcttctctttttccaga

SEQ ID NO: 194076 - DNA, 12 bp, Homo sapiens
atcatctttgct

SEQ ID NO: 194077 - DNA, 15 bp, Homo sapiens
atcatgaaatatgca

SEQ ID NO: 194078 - DNA, 15 bp, Homo sapiens
atcatgagattgatg

SEQ ID NO: 194079 - DNA, 17 bp, Homo sapiens
atcatgagattgatgca

SEQ ID NO: 194080 - DNA, 13 bp, Homo sapiens
atcatgcattgtt

SEQ ID NO: 194081 - DNA, 20 bp, Homo sapiens
atcatggattcattacagct

SEQ ID NO: 194082 - DNA, 22 bp, Homo sapiens
atcatggctaagcttaaaaaaa

SEQ ID NO: 194083 - DNA, 15 bp, Homo sapiens
atcatggctcactgc

SEQ ID NO: 194084 - DNA, 20 bp, Homo sapiens
atcatggctcactgcagcct

SEQ ID NO: 194085 - DNA, 15 bp, Homo sapiens
atcatgtaaatgctc

SEQ ID NO: 194086 - DNA, 21 bp, Homo sapiens
atcatgtgaacccgggacgca

SEQ ID NO: 194087 - DNA, 18 bp, Homo sapiens
atcatgttaatcctagct

SEQ ID NO: 194088 - DNA, 14 bp, Homo sapiens
atcatgttatttta

SEQ ID NO: 194089 - DNA, 23 bp, Homo sapiens
atcatgttttgatgagaaaaaac

SEQ ID NO: 194090 - DNA, 18 bp, Homo sapiens
atcattaaacatgaattt

SEQ ID NO: 194091 - DNA, 11 bp, Homo sapiens
atcattaatac

SEQ ID NO: 194092 - DNA, 19 bp, Homo sapiens
atcattagggggaactcta

SEQ ID NO: 194093 - DNA, 16 bp, Homo sapiens
atcattataaacgtga

SEQ ID NO: 194094 - DNA, 19 bp, Homo sapiens
atcattatagcatgtaata

SEQ ID NO: 194095 - DNA, 15 bp, Homo sapiens
atcattcataatttt

SEQ ID NO: 194096 - DNA, 23 bp, Homo sapiens
atcattctacaagtaattttgca

SEQ ID NO: 194097 - DNA, 13 bp, Homo sapiens
atcattctccttg

SEQ ID NO: 194098 - DNA, 16 bp, Homo sapiens
atcattctttctgcta

SEQ ID NO: 194099 - DNA, 23 bp, Homo sapiens
atcattctttgtatcttaaatct

SEQ ID NO: 194100 - DNA, 21 bp, Homo sapiens
atcattgcactctagcctggg

SEQ ID NO: 194101 - DNA, 18 bp, Homo sapiens
atcattgccctcttcaag

SEQ ID NO: 194102 - DNA, 23 bp, Homo sapiens
atcattgctttgaagcagttgtg

SEQ ID NO: 194103 - DNA, 17 bp, Homo sapiens
atcattggataaatttg

SEQ ID NO: 194104 - DNA, 22 bp, Homo sapiens
atcattggtatctgatatctgt

SEQ ID NO: 194105 - DNA, 18 bp, Homo sapiens
atcattgtatatatgtgt

SEQ ID NO: 194106 - DNA, 21 bp, Homo sapiens
atcatttatcttatctagcaa

SEQ ID NO: 194107 - DNA, 22 bp, Homo sapiens
atcatttattttttacattatt

SEQ ID NO: 194108 - DNA, 13 bp, Homo sapiens
atcatttccagca

SEQ ID NO: 194109 - DNA, 19 bp, Homo sapiens
atcatttctcctttaaaga

SEQ ID NO: 194110 - DNA, 11 bp, Homo sapiens
atcatttctgt

SEQ ID NO: 194111 - DNA, 18 bp, Homo sapiens
atcatttcttgggccctc

SEQ ID NO: 194112 - DNA, 16 bp, Homo sapiens
atcatttgcagctgct

SEQ ID NO: 194113 - DNA, 15 bp, Homo sapiens
atcattttattcaca

SEQ ID NO: 194114 - DNA, 13 bp, Homo sapiens
atcattttcctgg

SEQ ID NO: 194115 - DNA, 14 bp, Homo sapiens
atcattttcctggg

SEQ ID NO: 194116 - DNA, 17 bp, Homo sapiens
atcattttcctgggagt

SEQ ID NO: 194117 - DNA, 23 bp, Homo sapiens
atccaaagactgtactggccagt

SEQ ID NO: 194118 - DNA, 20 bp, Homo sapiens
atccaaagcattgcagaaca

SEQ ID NO: 194119 - DNA, 11 bp, Homo sapiens
atccaaagtaa

SEQ ID NO: 194120 - DNA, 18 bp, Homo sapiens
atccaaatcttgaatttc

SEQ ID NO: 194121 - DNA, 21 bp, Homo sapiens
atccaaatcttgaatttctgc

SEQ ID NO: 194122 - DNA, 20 bp, Homo sapiens
atccaaatgcattcatgttt

SEQ ID NO: 194123 - DNA, 14 bp, Homo sapiens
atccaaatgctgtg

SEQ ID NO: 194124 - DNA, 18 bp, Homo sapiens
atccaaatgctgtgcaaa

SEQ ID NO: 194125 - DNA, 14 bp, Homo sapiens
atccaacacaagtt

SEQ ID NO: 194126 - DNA, 14 bp, Homo sapiens
atccaacatttcct

SEQ ID NO: 194127 - DNA, 21 bp, Homo sapiens
atccaacctctttcctctctg

SEQ ID NO: 194128 - DNA, 15 bp, Homo sapiens
atccaaggcaaacaa

SEQ ID NO: 194129 - DNA, 16 bp, Homo sapiens
atccaaggcaaacaat

SEQ ID NO: 194130 - DNA, 14 bp, Homo sapiens
atccaagtaccaat

SEQ ID NO: 194131 - DNA, 14 bp, Homo sapiens
atccaatcctcact

SEQ ID NO: 194132 - DNA, 20 bp, Homo sapiens
atccaatcctcactgggtgg

SEQ ID NO: 194133 - DNA, 13 bp, Homo sapiens
atccacaaatatg

SEQ ID NO: 194134 - DNA, 23 bp, Homo sapiens
atccacaaatatgctaaatgtta

SEQ ID NO: 194135 - DNA, 16 bp, Homo sapiens
atccacaaattcctcc

SEQ ID NO: 194136 - DNA, 19 bp, Homo sapiens
atccacacaacaccaggac

SEQ ID NO: 194137 - DNA, 21 bp, Homo sapiens
atccacacaacaccaggactt

SEQ ID NO: 194138 - DNA, 18 bp, Homo sapiens
atccacagttgtcagttg

SEQ ID NO: 194139 - DNA, 15 bp, Homo sapiens
atccaccaccttgcc

SEQ ID NO: 194140 - DNA, 13 bp, Homo sapiens
atccacccagtgc

SEQ ID NO: 194141 - DNA, 14 bp, Homo sapiens
atccacccagtgct

SEQ ID NO: 194142 - DNA, 19 bp, Homo sapiens
atccacccagtgctgccat

SEQ ID NO: 194143 - DNA, 23 bp, Homo sapiens
atccacccagtgctgccatgcca

SEQ ID NO: 194144 - DNA, 18 bp, Homo sapiens
atccacctgtctcagcct

SEQ ID NO: 194145 - DNA, 22 bp, Homo sapiens
atccactctaccctcccacccc

SEQ ID NO: 194146 - DNA, 16 bp, Homo sapiens
atccactggcattttt

SEQ ID NO: 194147 - DNA, 15 bp, Homo sapiens
atccagaaggaagct

SEQ ID NO: 194148 - DNA, 22 bp, Homo sapiens
atccagacatcatgaattttac

SEQ ID NO: 194149 - DNA, 22 bp, Homo sapiens
atccagaggtgagggaggcctg

SEQ ID NO: 194150 - DNA, 19 bp, Homo sapiens
atccagatgaactgagaag

SEQ ID NO: 194151 - DNA, 12 bp, Homo sapiens
agaagataaaaa

SEQ ID NO: 194152 - DNA, 22 bp, Homo sapiens
agaagatgaaaatggaagtggc

SEQ ID NO: 194153 - DNA, 22 bp, Homo sapiens
agaagatgccctccaatccttt

SEQ ID NO: 194154 - DNA, 19 bp, Homo sapiens
agaagatggactctgaaaa

SEQ ID NO: 194155 - DNA, 19 bp, Homo sapiens
agaagatttgatgctggag

SEQ ID NO: 194156 - DNA, 18 bp, Homo sapiens
agaagcaaaggcaggagg

SEQ ID NO: 194157 - DNA, 19 bp, Homo sapiens
agaagcaaaggcaggaggt

SEQ ID NO: 194158 - DNA, 21 bp, Homo sapiens
agaagcaattatttaaagaaa

SEQ ID NO: 194159 - DNA, 15 bp, Homo sapiens
agaagcactctgctg

SEQ ID NO: 194160 - DNA, 17 bp, Homo sapiens
agaagcactctgctggc

SEQ ID NO: 194161 - DNA, 14 bp, Homo sapiens
agaagcaggctgga

SEQ ID NO: 194162 - DNA, 18 bp, Homo sapiens
agaagcattaacttctct

SEQ ID NO: 194163 - DNA, 17 bp, Homo sapiens
agaagccaagacagtgg

SEQ ID NO: 194164 - DNA, 21 bp, Homo sapiens
agaagccaagacagtggcagc

SEQ ID NO: 194165 - DNA, 20 bp, Homo sapiens
agaagccaccatgtatgtgg

SEQ ID NO: 194166 - DNA, 18 bp, Homo sapiens
agaagcccaatattataa

SEQ ID NO: 194167 - DNA, 21 bp, Homo sapiens
agaagcccaatattataattt

SEQ ID NO: 194168 - DNA, 20 bp, Homo sapiens
agaagccctccttgccaccc

SEQ ID NO: 194169 - DNA, 13 bp, Homo sapiens
agaagcctctggc

SEQ ID NO: 194170 - DNA, 23 bp, Homo sapiens
agaagcctctggctagaggccag

SEQ ID NO: 194171 - DNA, 22 bp, Homo sapiens
agaagccttttccataaagtgt

SEQ ID NO: 194172 - DNA, 14 bp, Homo sapiens
agaagcgagcactg

SEQ ID NO: 194173 - DNA, 15 bp, Homo sapiens
agaagcgtctccctt

SEQ ID NO: 194174 - DNA, 22 bp, Homo sapiens
agaagcgtctcccttggccacg

SEQ ID NO: 194175 - DNA, 23 bp, Homo sapiens
agaagctaatgtaggactgtata

SEQ ID NO: 194176 - DNA, 16 bp, Homo sapiens
agaagctgatctgatt

SEQ ID NO: 194177 - DNA, 19 bp, Homo sapiens
agaagcttcttgctcctgt

SEQ ID NO: 194178 - DNA, 22 bp, Homo sapiens
agaagcttttgaataaaaactt

SEQ ID NO: 194179 - DNA, 14 bp, Homo sapiens
agaaggaaaagagt

SEQ ID NO: 194180 - DNA, 16 bp, Homo sapiens
agaaggaaaaggctgg

SEQ ID NO: 194181 - DNA, 18 bp, Homo sapiens
agaaggaaaaggctggca

SEQ ID NO: 194182 - DNA, 16 bp, Homo sapiens
agaaggagagggagta

SEQ ID NO: 194183 - DNA, 22 bp, Homo sapiens
agaaggagatgtaatgacagag

SEQ ID NO: 194184 - DNA, 21 bp, Homo sapiens
agaaggagggcagagccatgg

SEQ ID NO: 194185 - DNA, 21 bp, Homo sapiens
agaaggcaagctggcaggagg

SEQ ID NO: 194186 - DNA, 16 bp, Homo sapiens
agaaggccagccctcc

SEQ ID NO: 194187 - DNA, 23 bp, Homo sapiens
agaaggcccgggaggaggatccg

SEQ ID NO: 194188 - DNA, 15 bp, Homo sapiens
agaaggcctgccccc

SEQ ID NO: 194189 - DNA, 16 bp, Homo sapiens
agaaggcctgcccccc

SEQ ID NO: 194190 - DNA, 19 bp, Homo sapiens
agaaggcctgccccccttc

SEQ ID NO: 194191 - DNA, 12 bp, Homo sapiens
agaaggcctggt

SEQ ID NO: 194192 - DNA, 16 bp, Homo sapiens
agaaggcctggtcagc

SEQ ID NO: 194193 - DNA, 13 bp, Homo sapiens
agaaggcgaggag

SEQ ID NO: 194194 - DNA, 23 bp, Homo sapiens
atcccaggaggggcctctgaaat

SEQ ID NO: 194195 - DNA, 14 bp, Homo sapiens
atcccagttcatgt

SEQ ID NO: 194196 - DNA, 14 bp, Homo sapiens
atcccataaagaaa

SEQ ID NO: 194197 - DNA, 16 bp, Homo sapiens
atcccatccatcagct

SEQ ID NO: 194198 - DNA, 19 bp, Homo sapiens
atcccatccatcagctccc

SEQ ID NO: 194199 - DNA, 16 bp, Homo sapiens
atcccatctcagaaga

SEQ ID NO: 194200 - DNA, 17 bp, Homo sapiens
atcccatctcagaagat

SEQ ID NO: 194201 - DNA, 12 bp, Homo sapiens
atccccaagctg

SEQ ID NO: 194202 - DNA, 22 bp, Homo sapiens
atccccaccctcccctctcctg

SEQ ID NO: 194203 - DNA, 23 bp, Homo sapiens
atccccagccccctggcccctcc

SEQ ID NO: 194204 - DNA, 22 bp, Homo sapiens
atccccaggccaggtccctgga

SEQ ID NO: 194205 - DNA, 19 bp, Homo sapiens
atccccaggggtcccagcc

SEQ ID NO: 194206 - DNA, 17 bp, Homo sapiens
atccccatcctccagct

SEQ ID NO: 194207 - DNA, 20 bp, Homo sapiens
atccccatcctccagcttct

SEQ ID NO: 194208 - DNA, 16 bp, Homo sapiens
atccccgacagtggct

SEQ ID NO: 194209 - DNA, 22 bp, Homo sapiens
atcccctaaacaaaaagaacaa

SEQ ID NO: 194210 - DNA, 20 bp, Homo sapiens
atcccctccctgcctgctcc

SEQ ID NO: 194211 - DNA, 19 bp, Homo sapiens
atcccctgctactccactg

SEQ ID NO: 194212 - DNA, 22 bp, Homo sapiens
atccccttctcccctgcactgt

SEQ ID NO: 194213 - DNA, 16 bp, Homo sapiens
atcccggcctcttcca

SEQ ID NO: 194214 - DNA, 18 bp, Homo sapiens
atcccggcctcttccacc

SEQ ID NO: 194215 - DNA, 22 bp, Homo sapiens
atcccggggccatggaagctgg

SEQ ID NO: 194216 - DNA, 21 bp, Homo sapiens
atcccggtgcatgcaggtctc

SEQ ID NO: 194217 - DNA, 17 bp, Homo sapiens
atcccggtttcagaagc

SEQ ID NO: 194218 - DNA, 18 bp, Homo sapiens
atcccggtttcagaagct

SEQ ID NO: 194219 - DNA, 22 bp, Homo sapiens
atcccgtacctcttcccatgac

SEQ ID NO: 194220 - DNA, 20 bp, Homo sapiens
atcccgtgcaaaacatgcta

SEQ ID NO: 194221 - DNA, 18 bp, Homo sapiens
atccctaagaattcccag

SEQ ID NO: 194222 - DNA, 14 bp, Homo sapiens
atccctacccccta

SEQ ID NO: 194223 - DNA, 19 bp, Homo sapiens
atccctatgctgcctaggc

SEQ ID NO: 194224 - DNA, 21 bp, Homo sapiens
atccctatgtcccagcccctg

SEQ ID NO: 194225 - DNA, 18 bp, Homo sapiens
atccctcggaagccgtct

SEQ ID NO: 194226 - DNA, 18 bp, Homo sapiens
atccctcggtcagcaccg

SEQ ID NO: 194227 - DNA, 21 bp, Homo sapiens
atccctgaaacattgcatgta

SEQ ID NO: 194228 - DNA, 14 bp, Homo sapiens
atccctgccaagaa

SEQ ID NO: 194229 - DNA, 18 bp, Homo sapiens
atccctgcttgcccgctc

SEQ ID NO: 194230 - DNA, 20 bp, Homo sapiens
atccctgtgtgtcgttccct

SEQ ID NO: 194231 - DNA, 18 bp, Homo sapiens
atccctgttacccagaga

SEQ ID NO: 194232 - DNA, 12 bp, Homo sapiens
atccctgttcat

SEQ ID NO: 194233 - DNA, 19 bp, Homo sapiens
atcccttccttttagccta

SEQ ID NO: 194234 - DNA, 21 bp, Homo sapiens
atcccttccttttagcctagt

SEQ ID NO: 194235 - DNA, 13 bp, Homo sapiens
atcccttctcaca

SEQ ID NO: 194236 - DNA, 14 bp, Homo sapiens
atcccttggcccct

SEQ ID NO: 194237 - DNA, 23 bp, Homo sapiens
atccctttctctcttgtccaatg

SEQ ID NO: 194238 - DNA, 17 bp, Homo sapiens
atccctttctcttctga

SEQ ID NO: 194239 - DNA, 13 bp, Homo sapiens
atccgagcgacgg

SEQ ID NO: 194240 - DNA, 15 bp, Homo sapiens
atccgcatgtgtctg

SEQ ID NO: 194241 - DNA, 14 bp, Homo sapiens
atccgccctgggct

SEQ ID NO: 194242 - DNA, 18 bp, Homo sapiens
atccgcctacctcagcct

SEQ ID NO: 194243 - DNA, 19 bp, Homo sapiens
atccgcctacctcagcctc

SEQ ID NO: 194244 - DNA, 14 bp, Homo sapiens
atccgcctctgagc

SEQ ID NO: 194245 - DNA, 18 bp, Homo sapiens
atccgcctctgagccagg

SEQ ID NO: 194246 - DNA, 19 bp, Homo sapiens
atccgcctctgagccagga

SEQ ID NO: 194247 - DNA, 20 bp, Homo sapiens
atccgcggggaccctgccga

SEQ ID NO: 194248 - DNA, 12 bp, Homo sapiens
atccgctgccac

SEQ ID NO: 194249 - DNA, 14 bp, Homo sapiens
atccgctgccacca

SEQ ID NO: 194250 - DNA, 20 bp, Homo sapiens
atccggcccccagagcgccc

SEQ ID NO: 194251 - DNA, 20 bp, Homo sapiens
atccgtaccatcggtcagca

SEQ ID NO: 194252 - DNA, 21 bp, Homo sapiens
atcctaaccccctaagctcca

SEQ ID NO: 194253 - DNA, 14 bp, Homo sapiens
atcctaccaacctc

SEQ ID NO: 194254 - DNA, 15 bp, Homo sapiens
atcctaccaacctct

SEQ ID NO: 194255 - DNA, 20 bp, Homo sapiens
atcctagacttgaaagtttt

SEQ ID NO: 194256 - DNA, 16 bp, Homo sapiens
atcctagagattctta

SEQ ID NO: 194257 - DNA, 13 bp, Homo sapiens
atcctagctgtgt

SEQ ID NO: 194258 - DNA, 14 bp, Homo sapiens
atcctagctgtgtg

SEQ ID NO: 194259 - DNA, 15 bp, Homo sapiens
atcctataaatgtga

SEQ ID NO: 194260 - DNA, 19 bp, Homo sapiens
atcctatcaacaacaaggt

SEQ ID NO: 194261 - DNA, 20 bp, Homo sapiens
atcctatcgatctggaaaga

SEQ ID NO: 194262 - DNA, 16 bp, Homo sapiens
atcctatgtcatttct

SEQ ID NO: 194263 - DNA, 15 bp, Homo sapiens
atcctcactgggtgg

SEQ ID NO: 194264 - DNA, 10 bp, Homo sapiens
atcctcagcc

SEQ ID NO: 194265 - DNA, 14 bp, Homo sapiens
atcctcagccccag

SEQ ID NO: 194266 - DNA, 16 bp, Homo sapiens
atcctcagccccaggg

SEQ ID NO: 194267 - DNA, 17 bp, Homo sapiens
atcctcagccccagggc

SEQ ID NO: 194268 - DNA, 18 bp, Homo sapiens
atcctcagccccagggcc

SEQ ID NO: 194269 - DNA, 18 bp, Homo sapiens
atcctcaggtagtactgg

SEQ ID NO: 194270 - DNA, 20 bp, Homo sapiens
atcctcaggtagtactggga

SEQ ID NO: 194271 - DNA, 22 bp, Homo sapiens
atcctcaggtagtactgggaat

SEQ ID NO: 194272 - DNA, 19 bp, Homo sapiens
atcctcagttcctgcagca

SEQ ID NO: 194273 - DNA, 17 bp, Homo sapiens
atcctcagttggaatca

SEQ ID NO: 194274 - DNA, 16 bp, Homo sapiens
atcctcatatggccca

SEQ ID NO: 194275 - DNA, 23 bp, Homo sapiens
atcctcatcgggctttgtccctc

SEQ ID NO: 194276 - DNA, 23 bp, Homo sapiens
atcctccaacttcatttgatgct

SEQ ID NO: 194277 - DNA, 11 bp, Homo sapiens
atcctccagct

SEQ ID NO: 194278 - DNA, 12 bp, Homo sapiens
atcctccagctt

SEQ ID NO: 194279 - DNA, 22 bp, Homo sapiens
atcctccagggggcctgcaggc

SEQ ID NO: 194280 - DNA, 18 bp, Homo sapiens
atgatttttgtgtatcca

SEQ ID NO: 194281 - DNA, 22 bp, Homo sapiens
atgcaaagtaccaactgagcca

SEQ ID NO: 194282 - DNA, 20 bp, Homo sapiens
atgcaaagtataaatttgtg

SEQ ID NO: 194283 - DNA, 18 bp, Homo sapiens
atgcaaatcagtctcaca

SEQ ID NO: 194284 - DNA, 19 bp, Homo sapiens
atgcaaattaaagggcaga

SEQ ID NO: 194285 - DNA, 17 bp, Homo sapiens
atgcaaccagataaaga

SEQ ID NO: 194286 - DNA, 15 bp, Homo sapiens
atgcaagaagaatat

SEQ ID NO: 194287 - DNA, 22 bp, Homo sapiens
atgcaagaagaatataaataaa

SEQ ID NO: 194288 - DNA, 20 bp, Homo sapiens
atgcaagtcgccaggcagga

SEQ ID NO: 194289 - DNA, 21 bp, Homo sapiens
atgcaagtgggagatgaaaac

SEQ ID NO: 194290 - DNA, 22 bp, Homo sapiens
atgcaagtgggagatgaaaacc

SEQ ID NO: 194291 - DNA, 22 bp, Homo sapiens
atgcacaactagttaaaagcct

SEQ ID NO: 194292 - DNA, 19 bp, Homo sapiens
atgcacacaaacacctcct

SEQ ID NO: 194293 - DNA, 22 bp, Homo sapiens
atgcacacaaacacctcctagc

SEQ ID NO: 194294 - DNA, 13 bp, Homo sapiens
atgcacaccaaat

SEQ ID NO: 194295 - DNA, 18 bp, Homo sapiens
atgcacaccaaattgctg

SEQ ID NO: 194296 - DNA, 19 bp, Homo sapiens
atgcacaccaaattgctga

SEQ ID NO: 194297 - DNA, 11 bp, Homo sapiens
atgcacagatt

SEQ ID NO: 194298 - DNA, 19 bp, Homo sapiens
atgcacagattaaacttca

SEQ ID NO: 194299 - DNA, 21 bp, Homo sapiens
atgcacagtttgctatttgct

SEQ ID NO: 194300 - DNA, 21 bp, Homo sapiens
atgcacatttgtcactgaata

SEQ ID NO: 194301 - DNA, 20 bp, Homo sapiens
atgcacatttgtgcataaat

SEQ ID NO: 194302 - DNA, 22 bp, Homo sapiens
atgcacatttgtgcataaattt

SEQ ID NO: 194303 - DNA, 15 bp, Homo sapiens
atgcaccaagtacag

SEQ ID NO: 194304 - DNA, 18 bp, Homo sapiens
atgcaccaagtacagcct

SEQ ID NO: 194305 - DNA, 22 bp, Homo sapiens
atgcaccaagtacagccttcac

SEQ ID NO: 194306 - DNA, 12 bp, Homo sapiens
atgcacccctgg

SEQ ID NO: 194307 - DNA, 18 bp, Homo sapiens
atgcacccctggaaccag

SEQ ID NO: 194308 - DNA, 17 bp, Homo sapiens
atgcacggtttctgttc

SEQ ID NO: 194309 - DNA, 19 bp, Homo sapiens
atgcacggtttctgttctg

SEQ ID NO: 194310 - DNA, 22 bp, Homo sapiens
atgcacgtgtgcacacacacca

SEQ ID NO: 194311 - DNA, 14 bp, Homo sapiens
atgcacgttaacag

SEQ ID NO: 194312 - DNA, 18 bp, Homo sapiens
atgcacgttaacagcgtg

SEQ ID NO: 194313 - DNA, 15 bp, Homo sapiens
atgcactcagtgtgg

SEQ ID NO: 194314 - DNA, 14 bp, Homo sapiens
atgcactcgcactg

SEQ ID NO: 194315 - DNA, 20 bp, Homo sapiens
atgcactggggtaccacatg

SEQ ID NO: 194316 - DNA, 22 bp, Homo sapiens
atgcactttccctagaaagcca

SEQ ID NO: 194317 - DNA, 11 bp, Homo sapiens
atgcagacaca

SEQ ID NO: 194318 - DNA, 18 bp, Homo sapiens
atgcagactcctcagatc

SEQ ID NO: 194319 - DNA, 17 bp, Homo sapiens
atgcagaggaggagaaa

SEQ ID NO: 194320 - DNA, 19 bp, Homo sapiens
atgcagatctagccaggcc

SEQ ID NO: 194321 - DNA, 20 bp, Homo sapiens
atgcagatctagccaggcct

SEQ ID NO: 194322 - DNA, 12 bp, Homo sapiens
atgcagatgcca

SEQ ID NO: 194323 - DNA, 20 bp, Homo sapiens
atgcagattcctgggcctgt

SEQ ID NO: 194324 - DNA, 21 bp, Homo sapiens
atgcagattcctgggcctgtc

SEQ ID NO: 194325 - DNA, 22 bp, Homo sapiens
atgcagattcctgggcctgtcc

SEQ ID NO: 194326 - DNA, 14 bp, Homo sapiens
atgcagcaacaccc

SEQ ID NO: 194327 - DNA, 17 bp, Homo sapiens
atgcagcaacacccaag

SEQ ID NO: 194328 - DNA, 15 bp, Homo sapiens
atgcagcatacaaaa

SEQ ID NO: 194329 - DNA, 20 bp, Homo sapiens
atgcagcatacaaaaatata

SEQ ID NO: 194330 - DNA, 23 bp, Homo sapiens
atgcagcccatgcccacctgccc

SEQ ID NO: 194331 - DNA, 18 bp, Homo sapiens
atgcagccgccttccttg

SEQ ID NO: 194332 - DNA, 11 bp, Homo sapiens
atgcaggctgt

SEQ ID NO: 194333 - DNA, 18 bp, Homo sapiens
atgcagggaagagggcag

SEQ ID NO: 194334 - DNA, 15 bp, Homo sapiens
atgcagggagggagg

SEQ ID NO: 194335 - DNA, 17 bp, Homo sapiens
atgcagggaggggaggc

SEQ ID NO: 194336 - DNA, 21 bp, Homo sapiens
atgcaggtctccatgaagaag

SEQ ID NO: 194337 - DNA, 13 bp, Homo sapiens
atgcagtataaaa

SEQ ID NO: 194338 - DNA, 16 bp, Homo sapiens
atgcagtataaaatgt

SEQ ID NO: 194339 - DNA, 16 bp, Homo sapiens
atgcagtgaattgtga

SEQ ID NO: 194340 - DNA, 17 bp, Homo sapiens
atgcagtgcctttcccc

SEQ ID NO: 194341 - DNA, 14 bp, Homo sapiens
atgcagtgctgctt

SEQ ID NO: 194342 - DNA, 14 bp, Homo sapiens
atgcagttttaaga

SEQ ID NO: 194343 - DNA, 17 bp, Homo sapiens
atgcagttttaagaatt

SEQ ID NO: 194344 - DNA, 13 bp, Homo sapiens
atgcataaacaac

SEQ ID NO: 194345 - DNA, 17 bp, Homo sapiens
atgcatatcctgagcca

SEQ ID NO: 194346 - DNA, 17 bp, Homo sapiens
atgcatatcgctgggct

SEQ ID NO: 194347 - DNA, 21 bp, Homo sapiens
atgcatgatattgtatgtacc

SEQ ID NO: 194348 - DNA, 21 bp, Homo sapiens
atgcatgatccagctgtgtgt

SEQ ID NO: 194349 - DNA, 18 bp, Homo sapiens
atgcatgcactcttttga

SEQ ID NO: 194350 - DNA, 14 bp, Homo sapiens
atgcatgccaggct

SEQ ID NO: 194351 - DNA, 19 bp, Homo sapiens
atgcatgccaggctgggca

SEQ ID NO: 194352 - DNA, 16 bp, Homo sapiens
atgcatgctttggaaa

SEQ ID NO: 194353 - DNA, 23 bp, Homo sapiens
atgcatggaaacctgaaaaaaag

SEQ ID NO: 194354 - DNA, 13 bp, Homo sapiens
atgcatggcctcc

SEQ ID NO: 194355 - DNA, 14 bp, Homo sapiens
atgcatggcctccc

SEQ ID NO: 194356 - DNA, 13 bp, Homo sapiens
atgcatgggatgt

SEQ ID NO: 194357 - DNA, 20 bp, Homo sapiens
atgcatgtagcatataaatg

SEQ ID NO: 194358 - DNA, 23 bp, Homo sapiens
atgcatgtattcactaaaataaa

SEQ ID NO: 194359 - DNA, 20 bp, Homo sapiens
atgcattaccttctgttcct

SEQ ID NO: 194360 - DNA, 17 bp, Homo sapiens
atgcattcaaaatataa

SEQ ID NO: 194361 - DNA, 14 bp, Homo sapiens
atgcattcactcag

SEQ ID NO: 194362 - DNA, 16 bp, Homo sapiens
atgcattgtcttgtgg

SEQ ID NO: 194363 - DNA, 15 bp, Homo sapiens
atgcattgttgaggt

SEQ ID NO: 194364 - DNA, 20 bp, Homo sapiens
atgcatttaaactcatttga

SEQ ID NO: 194365 - DNA, 14 bp, Homo sapiens
agagtatgagaaat

SEQ ID NO: 194366 - DNA, 18 bp, Homo sapiens
agagtatgagaaatacag

SEQ ID NO: 194367 - DNA, 17 bp, Homo sapiens
agagtatgcaagaagaa

SEQ ID NO: 194368 - DNA, 21 bp, Homo sapiens
agagtatgcaagaagaatata

SEQ ID NO: 194369 - DNA, 15 bp, Homo sapiens
agagtatggattgaa

SEQ ID NO: 194370 - DNA, 18 bp, Homo sapiens
agagtcatctccatcagc

SEQ ID NO: 194371 - DNA, 19 bp, Homo sapiens
agagtcatctccatcagct

SEQ ID NO: 194372 - DNA, 17 bp, Homo sapiens
agagtccaatttaagga

SEQ ID NO: 194373 - DNA, 16 bp, Homo sapiens
agagtccggaggcagc

SEQ ID NO: 194374 - DNA, 13 bp, Homo sapiens
agagtcctcactc

SEQ ID NO: 194375 - DNA, 14 bp, Homo sapiens
agagtcctcactcc

SEQ ID NO: 194376 - DNA, 14 bp, Homo sapiens
agagtcctgaggca

SEQ ID NO: 194377 - DNA, 19 bp, Homo sapiens
agagtcctgaggcagaacc

SEQ ID NO: 194378 - DNA, 22 bp, Homo sapiens
agagtcctgaggcagaacctgg

SEQ ID NO: 194379 - DNA, 21 bp, Homo sapiens
agagtcgagtgatatggcttg

SEQ ID NO: 194380 - DNA, 18 bp, Homo sapiens
agagtctcactcccctcc

SEQ ID NO: 194381 - DNA, 12 bp, Homo sapiens
agagtctgaaca

SEQ ID NO: 194382 - DNA, 17 bp, Homo sapiens
agagtctgaacagctgt

SEQ ID NO: 194383 - DNA, 12 bp, Homo sapiens
agagtctgagcc

SEQ ID NO: 194384 - DNA, 19 bp, Homo sapiens
agagtctgagcccccggct

SEQ ID NO: 194385 - DNA, 16 bp, Homo sapiens
agagtctggcctgcca

SEQ ID NO: 194386 - DNA, 22 bp, Homo sapiens
agagtctggcctgccaggctcc

SEQ ID NO: 194387 - DNA, 18 bp, Homo sapiens
agagtctgggcctctgac

SEQ ID NO: 194388 - DNA, 19 bp, Homo sapiens
agagtctgtgtgtagccag

SEQ ID NO: 194389 - DNA, 24 bp, Homo sapiens
agagtctgtgtgtagccaggaagc

SEQ ID NO: 194390 - DNA, 13 bp, Homo sapiens
agagtcttaattt

SEQ ID NO: 194391 - DNA, 18 bp, Homo sapiens
agagtcttaattttctaa

SEQ ID NO: 194392 - DNA, 17 bp, Homo sapiens
agagtgaaagggctatg

SEQ ID NO: 194393 - DNA, 19 bp, Homo sapiens
agagtgactagtacaaatt

SEQ ID NO: 194394 - DNA, 20 bp, Homo sapiens
agagtgagaataattgtgta

SEQ ID NO: 194395 - DNA, 22 bp, Homo sapiens
agagtgagaataattgtgtaca

SEQ ID NO: 194396 - DNA, 15 bp, Homo sapiens
agagtgagaatctgg

SEQ ID NO: 194397 - DNA, 11 bp, Homo sapiens
agagtgagaga

SEQ ID NO: 194398 - DNA, 13 bp, Homo sapiens
agagtgagagaga

SEQ ID NO: 194399 - DNA, 14 bp, Homo sapiens
agagtgagagagag

SEQ ID NO: 194400 - DNA, 22 bp, Homo sapiens
agagtgagagagagtgagagca

SEQ ID NO: 194401 - DNA, 17 bp, Homo sapiens
agagtgataatacaagt

SEQ ID NO: 194402 - DNA, 19 bp, Homo sapiens
agagtgcccttaaaataat

SEQ ID NO: 194403 - DNA, 18 bp, Homo sapiens
agagtggactcttccctc

SEQ ID NO: 194404 - DNA, 17 bp, Homo sapiens
agagtggagactctgtt

SEQ ID NO: 194405 - DNA, 16 bp, Homo sapiens
agagtggatctggagt

SEQ ID NO: 194406 - DNA, 11 bp, Homo sapiens
agagtggcctg

SEQ ID NO: 194407 - DNA, 13 bp, Homo sapiens
agagtggcctggc

SEQ ID NO: 194408 - DNA, 16 bp, Homo sapiens
agagtggcctggccag

SEQ ID NO: 194409 - DNA, 14 bp, Homo sapiens
agagtggctcctcc

SEQ ID NO: 194410 - DNA, 12 bp, Homo sapiens
agatcttgagca

SEQ ID NO: 194411 - DNA, 16 bp, Homo sapiens
agatcttgagcaaggc

SEQ ID NO: 194412 - DNA, 17 bp, Homo sapiens
agatcttgagcaaggca

SEQ ID NO: 194413 - DNA, 18 bp, Homo sapiens
agatctttgcttccttgc

SEQ ID NO: 194414 - DNA, 18 bp, Homo sapiens
agatgaaaataaaataaa

SEQ ID NO: 194415 - DNA, 14 bp, Homo sapiens
agatgaaattgcca

SEQ ID NO: 194416 - DNA, 21 bp, Homo sapiens
agatgaactctttctggcctg

SEQ ID NO: 194417 - DNA, 18 bp, Homo sapiens
agatgaatatgagctcat

SEQ ID NO: 194418 - DNA, 14 bp, Homo sapiens
agatgacacataaa

SEQ ID NO: 194419 - DNA, 19 bp, Homo sapiens
agatgacacataaatctgt

SEQ ID NO: 194420 - DNA, 21 bp, Homo sapiens
agatgacacataaatctgtct

SEQ ID NO: 194421 - DNA, 22 bp, Homo sapiens
agatgacaccctaaagcaggct

SEQ ID NO: 194422 - DNA, 15 bp, Homo sapiens
agatgacagaaatat

SEQ ID NO: 194423 - DNA, 17 bp, Homo sapiens
agatgacagggagctgg

SEQ ID NO: 194424 - DNA, 18 bp, Homo sapiens
agatgacatctgtctagg

SEQ ID NO: 194425 - DNA, 17 bp, Homo sapiens
agatgagaaaacaggct

SEQ ID NO: 194426 - DNA, 16 bp, Homo sapiens
agatgagaagccaaag

SEQ ID NO: 194427 - DNA, 23 bp, Homo sapiens
agatgagaagttaagcagccttt

SEQ ID NO: 194428 - DNA, 17 bp, Homo sapiens
agatgagatttgccagc

SEQ ID NO: 194429 - DNA, 19 bp, Homo sapiens
agatgagatttgccagcac

SEQ ID NO: 194430 - DNA, 20 bp, Homo sapiens
agatgagatttgccagcaca

SEQ ID NO: 194431 - DNA, 21 bp, Homo sapiens
agatgagatttgccagcacag

SEQ ID NO: 194432 - DNA, 18 bp, Homo sapiens
agatgagcaaggacattg

SEQ ID NO: 194433 - DNA, 19 bp, Homo sapiens
agatgagcaaggacattgc

SEQ ID NO: 194434 - DNA, 20 bp, Homo sapiens
agatgagccccacgtggagc

SEQ ID NO: 194435 - DNA, 23 bp, Homo sapiens
agatgagcttcattgggagttcc

SEQ ID NO: 194436 - DNA, 16 bp, Homo sapiens
agatgattttgctttt

SEQ ID NO: 194437 - DNA, 17 bp, Homo sapiens
agatgattttgcttttc

SEQ ID NO: 194438 - DNA, 20 bp, Homo sapiens
agatgatttttaagtacaaa

SEQ ID NO: 194439 - DNA, 16 bp, Homo sapiens
agatgccatctgtgtc

SEQ ID NO: 194440 - DNA, 21 bp, Homo sapiens
agatgccatggcctgtgctgg

SEQ ID NO: 194441 - DNA, 13 bp, Homo sapiens
agatgcctccctg

SEQ ID NO: 194442 - DNA, 23 bp, Homo sapiens
agatgcctccctgaccctgcaga

SEQ ID NO: 194443 - DNA, 22 bp, Homo sapiens
agatgcctcttctacctcttcc

SEQ ID NO: 194444 - DNA, 13 bp, Homo sapiens
agatgccttctag

SEQ ID NO: 194445 - DNA, 23 bp, Homo sapiens
agatgctactggacttgaatggt

SEQ ID NO: 194446 - DNA, 18 bp, Homo sapiens
agatgctactgtcagtgt

SEQ ID NO: 194447 - DNA, 20 bp, Homo sapiens
agatgctactgtcagtgtcc

SEQ ID NO: 194448 - DNA, 21 bp, Homo sapiens
agatgctactgtcagtgtcct

SEQ ID NO: 194449 - DNA, 21 bp, Homo sapiens
agatgctgaaacaggagagaa

SEQ ID NO: 194450 - DNA, 20 bp, Homo sapiens
agatgctgactgtactcctc

SEQ ID NO: 194451 - DNA, 23 bp, Homo sapiens
agatgctgactgtactcctccca

SEQ ID NO: 194452 - DNA, 12 bp, Homo sapiens
agatgctgccta

SEQ ID NO: 194453 - DNA, 12 bp, Homo sapiens
agatgctggccc

SEQ ID NO: 194454 - DNA, 23 bp, Homo sapiens
agatgctggcctgcgcctgcacc

SEQ ID NO: 194455 - DNA, 19 bp, Homo sapiens
agatggaaaaaaaaaacaa

SEQ ID NO: 194456 - DNA, 21 bp, Homo sapiens
agatggaaaaaaaaaacaaaa

SEQ ID NO: 194457 - DNA, 17 bp, Homo sapiens
agatggaaagaaagcac

SEQ ID NO: 194458 - DNA, 22 bp, Homo sapiens
agatggaacccttttggccccc

SEQ ID NO: 194459 - DNA, 23 bp, Homo sapiens
agatggaagttgcagtgagctga

SEQ ID NO: 194460 - DNA, 18 bp, Homo sapiens
agatggaatgctgtgtta

SEQ ID NO: 194461 - DNA, 17 bp, Homo sapiens
agatggacccctccctt

SEQ ID NO: 194462 - DNA, 13 bp, Homo sapiens
agatggagcccat

SEQ ID NO: 194463 - DNA, 22 bp, Homo sapiens
agatggagcccataggccaccc

SEQ ID NO: 194464 - DNA, 17 bp, Homo sapiens
agatggaggttctcaga

SEQ ID NO: 194465 - DNA, 13 bp, Homo sapiens
agatggatgtaga

SEQ ID NO: 194466 - DNA, 16 bp, Homo sapiens
agatggatgtagatac

SEQ ID NO: 194467 - DNA, 16 bp, Homo sapiens
agatggattctcagat

SEQ ID NO: 194468 - DNA, 20 bp, Homo sapiens
agatggattctcagatattt

SEQ ID NO: 194469 - DNA, 15 bp, Homo sapiens
agatggatttgcctg

SEQ ID NO: 194470 - DNA, 16 bp, Homo sapiens
agatggcaaatgacca

SEQ ID NO: 194471 - DNA, 16 bp, Homo sapiens
agatggcacctgtggc

SEQ ID NO: 194472 - DNA, 16 bp, Homo sapiens
agatggccataggaga

SEQ ID NO: 194473 - DNA, 19 bp, Homo sapiens
agatggcccagctccccaa

SEQ ID NO: 194474 - DNA, 19 bp, Homo sapiens
agatggcgcatagtgtgct

SEQ ID NO: 194475 - DNA, 20 bp, Homo sapiens
agatggcggtgatcagcaga

SEQ ID NO: 194476 - DNA, 21 bp, Homo sapiens
agatggcggtgatcagcagag

SEQ ID NO: 194477 - DNA, 14 bp, Homo sapiens
agatggctgtgcct

SEQ ID NO: 194478 - DNA, 20 bp, Homo sapiens
agatggctgtgcctctgcct

SEQ ID NO: 194479 - DNA, 21 bp, Homo sapiens
agatggctgtgcctctgcctg

SEQ ID NO: 194480 - DNA, 22 bp, Homo sapiens
agatggctgtgcctctgcctgt

SEQ ID NO: 194481 - DNA, 21 bp, Homo sapiens
agatggcttccgtgagacaca

SEQ ID NO: 194482 - DNA, 19 bp, Homo sapiens
agatgggactgggagggcc

SEQ ID NO: 194483 - DNA, 16 bp, Homo sapiens
agatgggatgcttgcc

SEQ ID NO: 194484 - DNA, 15 bp, Homo sapiens
agatggggcctctgt

SEQ ID NO: 194485 - DNA, 16 bp, Homo sapiens
agatgggtattaaact

SEQ ID NO: 194486 - DNA, 17 bp, Homo sapiens
agatgggtattaaactt

SEQ ID NO: 194487 - DNA, 18 bp, Homo sapiens
agatgggtattaaacttg

SEQ ID NO: 194488 - DNA, 22 bp, Homo sapiens
agatggtatgcagcatacaaaa

SEQ ID NO: 194489 - DNA, 14 bp, Homo sapiens
agatggttcccttt

SEQ ID NO: 194490 - DNA, 17 bp, Homo sapiens
agatgtaagaagctaaa

SEQ ID NO: 194491 - DNA, 17 bp, Homo sapiens
agatgtaatgacagaga

SEQ ID NO: 194492 - DNA, 13 bp, Homo sapiens
agatgtaatgtag

SEQ ID NO: 194493 - DNA, 14 bp, Homo sapiens
agatgtactgagag

SEQ ID NO: 194494 - DNA, 17 bp, Homo sapiens
agatgtactgagaggag

SEQ ID NO: 194495 - DNA, 21 bp, Homo sapiens
agatgtagcaaaacgcatgga

SEQ ID NO: 194496 - DNA, 15 bp, Homo sapiens
agatgtagcattgtt

SEQ ID NO: 194497 - DNA, 19 bp, Homo sapiens
agatgtagcattgttccac

SEQ ID NO: 194498 - DNA, 19 bp, Homo sapiens
agatgtatcatgattgatt

SEQ ID NO: 194499 - DNA, 17 bp, Homo sapiens
agatgtatgaaggcttt

SEQ ID NO: 194500 - DNA, 22 bp, Homo sapiens
agatgtattaacctacctgtga

SEQ ID NO: 194501 - DNA, 18 bp, Homo sapiens
agatgtattatgcaaagt

SEQ ID NO: 194502 - DNA, 14 bp, Homo sapiens
agatgtattttcaa

SEQ ID NO: 194503 - DNA, 13 bp, Homo sapiens
agatgtcaaatat

SEQ ID NO: 194504 - DNA, 15 bp, Homo sapiens
agatgtcaaatatct

SEQ ID NO: 194505 - DNA, 22 bp, Homo sapiens
agatgtccctttcttggccagt

SEQ ID NO: 194506 - DNA, 20 bp, Homo sapiens
agatgtctgggaaagcagag

SEQ ID NO: 194507 - DNA, 14 bp, Homo sapiens
atgcttctgagagc

SEQ ID NO: 194508 - DNA, 17 bp, Homo sapiens
atgcttctgctcacatt

SEQ ID NO: 194509 - DNA, 23 bp, Homo sapiens
atgcttgcctagggcctggtcca

SEQ ID NO: 194510 - DNA, 21 bp, Homo sapiens
atgcttggaatatctgctgta

SEQ ID NO: 194511 - DNA, 12 bp, Homo sapiens
atgcttgtttat

SEQ ID NO: 194512 - DNA, 22 bp, Homo sapiens
atgcttgtttatgatatttctt

SEQ ID NO: 194513 - DNA, 15 bp, Homo sapiens
atgctttctcctttt

SEQ ID NO: 194514 - DNA, 16 bp, Homo sapiens
atgctttctccttttt

SEQ ID NO: 194515 - DNA, 18 bp, Homo sapiens
atgctttgggaggccaag

SEQ ID NO: 194516 - DNA, 19 bp, Homo sapiens
atgctttgggaggccaagg

SEQ ID NO: 194517 - DNA, 22 bp, Homo sapiens
atgcttttatatggcccagcct

SEQ ID NO: 194518 - DNA, 20 bp, Homo sapiens
atggaaaaaaaaaacaaaaa

SEQ ID NO: 194519 - DNA, 21 bp, Homo sapiens
atggaaaacttagtttgtgaa

SEQ ID NO: 194520 - DNA, 22 bp, Homo sapiens
atggaaaagtcttcaagggctg

SEQ ID NO: 194521 - DNA, 23 bp, Homo sapiens
atggaaacctgaaaaaaagttta

SEQ ID NO: 194522 - DNA, 22 bp, Homo sapiens
atggaaactgttgccagagatg

SEQ ID NO: 194523 - DNA, 20 bp, Homo sapiens
atggaaagggtgtggcttgg

SEQ ID NO: 194524 - DNA, 21 bp, Homo sapiens
atggaaagggtgtggcttgga

SEQ ID NO: 194525 - DNA, 13 bp, Homo sapiens
atggaaatcctgt

SEQ ID NO: 194526 - DNA, 15 bp, Homo sapiens
atggaaatcctgtta

SEQ ID NO: 194527 - DNA, 16 bp, Homo sapiens
atggaacacacacaca

SEQ ID NO: 194528 - DNA, 24 bp, Homo sapiens
atggaacacacacacacgcagaca

SEQ ID NO: 194529 - DNA, 18 bp, Homo sapiens
atggaacttctaatatat

SEQ ID NO: 194530 - DNA, 16 bp, Homo sapiens
atggaaggagagaggt

SEQ ID NO: 194531 - DNA, 18 bp, Homo sapiens
atggaagtggcagtgaaa

SEQ ID NO: 194532 - DNA, 15 bp, Homo sapiens
atggaataaaccatt

SEQ ID NO: 194533 - DNA, 16 bp, Homo sapiens
atggaataactctgtg

SEQ ID NO: 194534 - DNA, 16 bp, Homo sapiens
atggaatgctgtgtta

SEQ ID NO: 194535 - DNA, 21 bp, Homo sapiens
atggaatgctgtgttaaataa

SEQ ID NO: 194536 - DNA, 15 bp, Homo sapiens
atggaattatgtata

SEQ ID NO: 194537 - DNA, 17 bp, Homo sapiens
atggaatttgtaagttt

SEQ ID NO: 194538 - DNA, 22 bp, Homo sapiens
agtccggacccacctcaccccg

SEQ ID NO: 194539 - DNA, 15 bp, Homo sapiens
agtccggaggcagca

SEQ ID NO: 194540 - DNA, 16 bp, Homo sapiens
agtcctattctattgc

SEQ ID NO: 194541 - DNA, 13 bp, Homo sapiens
agtcctcacagcc

SEQ ID NO: 194542 - DNA, 15 bp, Homo sapiens
agtcctcacagccta

SEQ ID NO: 194543 - DNA, 16 bp, Homo sapiens
agtcctcacagcctag

SEQ ID NO: 194544 - DNA, 20 bp, Homo sapiens
agtcctcacagcctctccct

SEQ ID NO: 194545 - DNA, 21 bp, Homo sapiens
agtcctcacagcctctccctt

SEQ ID NO: 194546 - DNA, 17 bp, Homo sapiens
agtcctcacatgcccgc

SEQ ID NO: 194547 - DNA, 18 bp, Homo sapiens
agtcctcactcccagtcc

SEQ ID NO: 194548 - DNA, 16 bp, Homo sapiens
agtcctccaaaacaca

SEQ ID NO: 194549 - DNA, 16 bp, Homo sapiens
agtcctccctcctgca

SEQ ID NO: 194550 - DNA, 24 bp, Homo sapiens
agtcctccctcctgcaggctggct

SEQ ID NO: 194551 - DNA, 13 bp, Homo sapiens
agtcctccctgct

SEQ ID NO: 194552 - DNA, 17 bp, Homo sapiens
agtcctccctgctcagc

SEQ ID NO: 194553 - DNA, 19 bp, Homo sapiens
agtcctccctgctcagctg

SEQ ID NO: 194554 - DNA, 16 bp, Homo sapiens
agtcctcctttgcttg

SEQ ID NO: 194555 - DNA, 18 bp, Homo sapiens
agtcctgcagaggattta

SEQ ID NO: 194556 - DNA, 16 bp, Homo sapiens
agtcctgcctcagcct

SEQ ID NO: 194557 - DNA, 14 bp, Homo sapiens
agtcctgcctggcc

SEQ ID NO: 194558 - DNA, 15 bp, Homo sapiens
agtcctgcctggcca

SEQ ID NO: 194559 - DNA, 16 bp, Homo sapiens
agtcctgcctggccag

SEQ ID NO: 194560 - DNA, 14 bp, Homo sapiens
agtcctgcctttgg

SEQ ID NO: 194561 - DNA, 16 bp, Homo sapiens
agtcctggtggggctg

SEQ ID NO: 194562 - DNA, 17 bp, Homo sapiens
agtcctgttctcagagc

SEQ ID NO: 194563 - DNA, 18 bp, Homo sapiens
agtcctgttctcagagct

SEQ ID NO: 194564 - DNA, 14 bp, Homo sapiens
agtccttagaatga

SEQ ID NO: 194565 - DNA, 13 bp, Homo sapiens
agtccttcagtga

SEQ ID NO: 194566 - DNA, 19 bp, Homo sapiens
agtccttcagtgagcccct

SEQ ID NO: 194567 - DNA, 14 bp, Homo sapiens
agtcctttcttttg

SEQ ID NO: 194568 - DNA, 22 bp, Homo sapiens
agtcctttcttttgaaatgcca

SEQ ID NO: 194569 - DNA, 13 bp, Homo sapiens
agtcgatgctcaa

SEQ ID NO: 194570 - DNA, 17 bp, Homo sapiens
agtcgcaggatccgctg

SEQ ID NO: 194571 - DNA, 20 bp, Homo sapiens
agtcgcaggatccgctgcca

SEQ ID NO: 194572 - DNA, 15 bp, Homo sapiens
agtcgccctctgtgc

SEQ ID NO: 194573 - DNA, 18 bp, Homo sapiens
agtcgccctctgtgccta

SEQ ID NO: 194574 - DNA, 13 bp, Homo sapiens
agtcgctgaggaa

SEQ ID NO: 194575 - DNA, 18 bp, Homo sapiens
agtcggatctagccatgg

SEQ ID NO: 194576 - DNA, 12 bp, Homo sapiens
agtcggattaga

SEQ ID NO: 194577 - DNA, 13 bp, Homo sapiens
agtcggctgggca

SEQ ID NO: 194578 - DNA, 12 bp, Homo sapiens
agtctaaagttt

SEQ ID NO: 194579 - DNA, 17 bp, Homo sapiens
agtctaaatatttcctt

SEQ ID NO: 194580 - DNA, 18 bp, Homo sapiens
agtctaatctctaaatca

SEQ ID NO: 194581 - DNA, 19 bp, Homo sapiens
agtctcaaaaatacaaaat

SEQ ID NO: 194582 - DNA, 16 bp, Homo sapiens
agtctcaatgttccat

SEQ ID NO: 194583 - DNA, 17 bp, Homo sapiens
agtctcaatgttccatt

SEQ ID NO: 194584 - DNA, 13 bp, Homo sapiens
agtctcaattttg

SEQ ID NO: 194585 - DNA, 18 bp, Homo sapiens
agtctcaattttgtattt

SEQ ID NO: 194586 - DNA, 13 bp, Homo sapiens
agtctcacccact

SEQ ID NO: 194587 - DNA, 15 bp, Homo sapiens
agtctccaccaggaa

SEQ ID NO: 194588 - DNA, 13 bp, Homo sapiens
agtctcccaggcc

SEQ ID NO: 194589 - DNA, 21 bp, Homo sapiens
agtctcctttgcactgagggc

SEQ ID NO: 194590 - DNA, 22 bp, Homo sapiens
agtctcctttgcactgagggcc

SEQ ID NO: 194591 - DNA, 18 bp, Homo sapiens
agtctctcatttctttca

SEQ ID NO: 194592 - DNA, 16 bp, Homo sapiens
agtctctctgtgaata

SEQ ID NO: 194593 - DNA, 17 bp, Homo sapiens
agtctctctgtgaatac

SEQ ID NO: 194594 - DNA, 19 bp, Homo sapiens
agtctctcttacccttctg

SEQ ID NO: 194595 - DNA, 22 bp, Homo sapiens
agtctctgggtttacaacaaac

SEQ ID NO: 194596 - DNA, 12 bp, Homo sapiens
agtctcttcaga

SEQ ID NO: 194597 - DNA, 13 bp, Homo sapiens
agtctcttctcca

SEQ ID NO: 194598 - DNA, 14 bp, Homo sapiens
agtctcttctccac

SEQ ID NO: 194599 - DNA, 17 bp, Homo sapiens
agtctcttctccactgg

SEQ ID NO: 194600 - DNA, 16 bp, Homo sapiens
agtctcttgattcata

SEQ ID NO: 194601 - DNA, 16 bp, Homo sapiens
agtctgaacagctgta

SEQ ID NO: 194602 - DNA, 18 bp, Homo sapiens
agtctgaacagctgtaat

SEQ ID NO: 194603 - DNA, 16 bp, Homo sapiens
agtctgaaggagagga

SEQ ID NO: 194604 - DNA, 18 bp, Homo sapiens
agtctgaagtttcattta

SEQ ID NO: 194605 - DNA, 18 bp, Homo sapiens
agtctgagaccagcctgg

SEQ ID NO: 194606 - DNA, 21 bp, Homo sapiens
agtctgagtcatcaaaaagag

SEQ ID NO: 194607 - DNA, 11 bp, Homo sapiens
agtctgcagct

SEQ ID NO: 194608 - DNA, 22 bp, Homo sapiens
agtctgcagctattcacacaca

SEQ ID NO: 194609 - DNA, 23 bp, Homo sapiens
agtctgcagctattcacacacac

SEQ ID NO: 194610 - DNA, 13 bp, Homo sapiens
agtctgcattaca

SEQ ID NO: 194611 - DNA, 18 bp, Homo sapiens
agtctgcattacattcct

SEQ ID NO: 194612 - DNA, 15 bp, Homo sapiens
agtctgcgcccttgt

SEQ ID NO: 194613 - DNA, 16 bp, Homo sapiens
agtctgctgccctcca

SEQ ID NO: 194614 - DNA, 17 bp, Homo sapiens
agtctgctgccctccat

SEQ ID NO: 194615 - DNA, 21 bp, Homo sapiens
agtctgcttaccaaaacataa

SEQ ID NO: 194616 - DNA, 17 bp, Homo sapiens
agtctggcaaacatgtg

SEQ ID NO: 194617 - DNA, 15 bp, Homo sapiens
agtctggccaacatc

SEQ ID NO: 194618 - DNA, 15 bp, Homo sapiens
agtctggcctgccag

SEQ ID NO: 194619 - DNA, 20 bp, Homo sapiens
agtctggcctgccaggctcc

SEQ ID NO: 194620 - DNA, 15 bp, Homo sapiens
agtctgggcctctga

SEQ ID NO: 194621 - DNA, 17 bp, Homo sapiens
agtctgtcagggccttg

SEQ ID NO: 194622 - DNA, 23 bp, Homo sapiens
agtctgtcagggccttggcccag

SEQ ID NO: 194623 - DNA, 16 bp, Homo sapiens
actcctaggagagcca

SEQ ID NO: 194624 - DNA, 23 bp, Homo sapiens
actcctatccccaggccaggtcc

SEQ ID NO: 194625 - DNA, 14 bp, Homo sapiens
actcctcaaccttg

SEQ ID NO: 194626 - DNA, 18 bp, Homo sapiens
actcctcagatctgaaca

SEQ ID NO: 194627 - DNA, 13 bp, Homo sapiens
actcctcccttcc

SEQ ID NO: 194628 - DNA, 16 bp, Homo sapiens
actcctcccttcccca

SEQ ID NO: 194629 - DNA, 18 bp, Homo sapiens
actcctcgggcaagggcc

SEQ ID NO: 194630 - DNA, 12 bp, Homo sapiens
actcctctgcag

SEQ ID NO: 194631 - DNA, 14 bp, Homo sapiens
actcctctgtccag

SEQ ID NO: 194632 - DNA, 21 bp, Homo sapiens
actcctgacagtcttgtgctt

SEQ ID NO: 194633 - DNA, 18 bp, Homo sapiens
actcctgacctcaggtga

SEQ ID NO: 194634 - DNA, 16 bp, Homo sapiens
actcctgattgctctg

SEQ ID NO: 194635 - DNA, 22 bp, Homo sapiens
actcctgattgctctggaagcc

SEQ ID NO: 194636 - DNA, 21 bp, Homo sapiens
actcctgattttgtagttaat

SEQ ID NO: 194637 - DNA, 23 bp, Homo sapiens
actcctgccagttgaaaatggat

SEQ ID NO: 194638 - DNA, 14 bp, Homo sapiens
actcctgccctgtt

SEQ ID NO: 194639 - DNA, 22 bp, Homo sapiens
actcctgccctgttgtgtatag

SEQ ID NO: 194640 - DNA, 12 bp, Homo sapiens
actcctgcctgt

SEQ ID NO: 194641 - DNA, 15 bp, Homo sapiens
actcctgcctgtgtt

SEQ ID NO: 194642 - DNA, 21 bp, Homo sapiens
actcctgggctcaagcagtct

SEQ ID NO: 194643 - DNA, 20 bp, Homo sapiens
actcctgtcccgccttcctc

SEQ ID NO: 194644 - DNA, 12 bp, Homo sapiens
actcctgtgtgt

SEQ ID NO: 194645 - DNA, 14 bp, Homo sapiens
actcctgtgtgtgg

SEQ ID NO: 194646 - DNA, 19 bp, Homo sapiens
actccttaaccacctagtc

SEQ ID NO: 194647 - DNA, 14 bp, Homo sapiens
actccttaatatga

SEQ ID NO: 194648 - DNA, 18 bp, Homo sapiens
actccttattttgtatta

SEQ ID NO: 194649 - DNA, 22 bp, Homo sapiens
actccttcctctttgcttgggt

SEQ ID NO: 194650 - DNA, 11 bp, Homo sapiens
actccttcctg

SEQ ID NO: 194651 - DNA, 21 bp, Homo sapiens
actccttcctgccacctgctg

SEQ ID NO: 194652 - DNA, 23 bp, Homo sapiens
actccttggatttgcatttttgt

SEQ ID NO: 194653 - DNA, 11 bp, Homo sapiens
actccttggcc

SEQ ID NO: 194654 - DNA, 12 bp, Homo sapiens
actccttggcct

SEQ ID NO: 194655 - DNA, 16 bp, Homo sapiens
actcgagagggctgag

SEQ ID NO: 194656 - DNA, 22 bp, Homo sapiens
actcgcccgcccactgtcctgg

SEQ ID NO: 194657 - DNA, 16 bp, Homo sapiens
actcgcttctctgtga

SEQ ID NO: 194658 - DNA, 17 bp, Homo sapiens
actcggtgtgtggccgc

SEQ ID NO: 194659 - DNA, 23 bp, Homo sapiens
actcgtataagcatggagaacag

SEQ ID NO: 194660 - DNA, 16 bp, Homo sapiens
actcgtctgactgtgt

SEQ ID NO: 194661 - DNA, 14 bp, Homo sapiens
actcgtctgatgtt

SEQ ID NO: 194662 - DNA, 19 bp, Homo sapiens
actcgtctgatgttttgat

SEQ ID NO: 194663 - DNA, 20 bp, Homo sapiens
actcgttctcgtgacccagt

SEQ ID NO: 194664 - DNA, 20 bp, Homo sapiens
actctaagtctccaagaata

SEQ ID NO: 194665 - DNA, 19 bp, Homo sapiens
actctacataatttagagt

SEQ ID NO: 194666 - DNA, 19 bp, Homo sapiens
actctacccatattacaga

SEQ ID NO: 194667 - DNA, 16 bp, Homo sapiens
actctacgccaaagtg

SEQ ID NO: 194668 - DNA, 20 bp, Homo sapiens
actctacttagcatgtccct

SEQ ID NO: 194669 - DNA, 13 bp, Homo sapiens
actggttcttgcc

SEQ ID NO: 194670 - DNA, 15 bp, Homo sapiens
actggttcttgcctt

SEQ ID NO: 194671 - DNA, 14 bp, Homo sapiens
actggtttgtttct

SEQ ID NO: 194672 - DNA, 14 bp, Homo sapiens
actgtaagatgttg

SEQ ID NO: 194673 - DNA, 22 bp, Homo sapiens
actgtaatatctttaaatgatg

SEQ ID NO: 194674 - DNA, 14 bp, Homo sapiens
actgtaatcttaaa

SEQ ID NO: 194675 - DNA, 21 bp, Homo sapiens
actgtacagattgctgcttct

SEQ ID NO: 194676 - DNA, 22 bp, Homo sapiens
actgtacagattgctgcttctg

SEQ ID NO: 194677 - DNA, 14 bp, Homo sapiens
actgtacatttttt

SEQ ID NO: 194678 - DNA, 17 bp, Homo sapiens
actgtagattgcttctg

SEQ ID NO: 194679 - DNA, 18 bp, Homo sapiens
actgtagattgcttctgt

SEQ ID NO: 194680 - DNA, 15 bp, Homo sapiens
actgtaggactatat

SEQ ID NO: 194681 - DNA, 19 bp, Homo sapiens
actgtaggcgcccctgggg

SEQ ID NO: 194682 - DNA, 20 bp, Homo sapiens
actgtaggcgcccctggggt

SEQ ID NO: 194683 - DNA, 14 bp, Homo sapiens
actgtagtaattgt

SEQ ID NO: 194684 - DNA, 23 bp, Homo sapiens
actgtataggtagatccagatcc

SEQ ID NO: 194685 - DNA, 17 bp, Homo sapiens
actgtatcaaatctgta

SEQ ID NO: 194686 - DNA, 12 bp, Homo sapiens
actgtatctaaa

SEQ ID NO: 194687 - DNA, 18 bp, Homo sapiens
actgtatctaaaaaataa

SEQ ID NO: 194688 - DNA, 12 bp, Homo sapiens
actgtatttctg

SEQ ID NO: 194689 - DNA, 18 bp, Homo sapiens
actgtatttctgtggaaa

SEQ ID NO: 194690 - DNA, 13 bp, Homo sapiens
actgtatttgtat

SEQ ID NO: 194691 - DNA, 15 bp, Homo sapiens
actgtcaagtcatga

SEQ ID NO: 194692 - DNA, 14 bp, Homo sapiens
actgtcaatgaggt

SEQ ID NO: 194693 - DNA, 15 bp, Homo sapiens
actgtcactgtttct

SEQ ID NO: 194694 - DNA, 16 bp, Homo sapiens
actgtcactgtttctc

SEQ ID NO: 194695 - DNA, 19 bp, Homo sapiens
actgtcactttgctctggg

SEQ ID NO: 194696 - DNA, 14 bp, Homo sapiens
actgtcagctgagc

SEQ ID NO: 194697 - DNA, 21 bp, Homo sapiens
actgtcatataatgcaacagg

SEQ ID NO: 194698 - DNA, 14 bp, Homo sapiens
actgtcatgtggct

SEQ ID NO: 194699 - DNA, 18 bp, Homo sapiens
actgtcatgtggcttggt

SEQ ID NO: 194700 - DNA, 18 bp, Homo sapiens
actgtccccctacccacc

SEQ ID NO: 194701 - DNA, 22 bp, Homo sapiens
actgtccgcctctgcccgcaga

SEQ ID NO: 194702 - DNA, 19 bp, Homo sapiens
actgtcctctttcagaaaa

SEQ ID NO: 194703 - DNA, 21 bp, Homo sapiens
actgtcctctttcagaaaaca

SEQ ID NO: 194704 - DNA, 14 bp, Homo sapiens
actgtcctggcttt

SEQ ID NO: 194705 - DNA, 22 bp, Homo sapiens
actgtcctggcttttatttaaa

SEQ ID NO: 194706 - DNA, 12 bp, Homo sapiens
actgtcctgggc

SEQ ID NO: 194707 - DNA, 13 bp, Homo sapiens
actgtcctgggcg

SEQ ID NO: 194708 - DNA, 23 bp, Homo sapiens
actgtcctgggcgccctggaagc

SEQ ID NO: 194709 - DNA, 17 bp, Homo sapiens
actgtcctttctccagg

SEQ ID NO: 194710 - DNA, 17 bp, Homo sapiens
actgtcggagaggctgt

SEQ ID NO: 194711 - DNA, 21 bp, Homo sapiens
actgtcggagaggctgtctgg

SEQ ID NO: 194712 - DNA, 21 bp, Homo sapiens
actgtctcaagagggcactgg

SEQ ID NO: 194713 - DNA, 23 bp, Homo sapiens
actgtctcaagagggcactggtg

SEQ ID NO: 194714 - DNA, 18 bp, Homo sapiens
actgtctcagtttcactt

SEQ ID NO: 194715 - DNA, 14 bp, Homo sapiens
actgtctccttccc

SEQ ID NO: 194716 - DNA, 21 bp, Homo sapiens
actgtctccttcccactgtcc

SEQ ID NO: 194717 - DNA, 17 bp, Homo sapiens
actgtctggttttaaca

SEQ ID NO: 194718 - DNA, 16 bp, Homo sapiens
actgtctgtagtgttt

SEQ ID NO: 194719 - DNA, 14 bp, Homo sapiens
aatgtaaaattcat

SEQ ID NO: 194720 - DNA, 14 bp, Homo sapiens
aatgtaaatttata

SEQ ID NO: 194721 - DNA, 12 bp, Homo sapiens
aatgtaagaaaa

SEQ ID NO: 194722 - DNA, 16 bp, Homo sapiens
aatgtaagaaaacaaa

SEQ ID NO: 194723 - DNA, 21 bp, Homo sapiens
aatgtaagaaaacaaaatcta

SEQ ID NO: 194724 - DNA, 14 bp, Homo sapiens
aatgtaatcattta

SEQ ID NO: 194725 - DNA, 17 bp, Homo sapiens
aatgtacaagttttgta

SEQ ID NO: 194726 - DNA, 19 bp, Homo sapiens
aatgtacaagttttgtata

SEQ ID NO: 194727 - DNA, 16 bp, Homo sapiens
aatgtacagagtggcc

SEQ ID NO: 194728 - DNA, 14 bp, Homo sapiens
aatgtacccagtat

SEQ ID NO: 194729 - DNA, 17 bp, Homo sapiens
aatgtactacatttgca

SEQ ID NO: 194730 - DNA, 18 bp, Homo sapiens
aatgtactacatttgcat

SEQ ID NO: 194731 - DNA, 12 bp, Homo sapiens
aatgtagaagaa

SEQ ID NO: 194732 - DNA, 15 bp, Homo sapiens
aatgtaggactgtat

SEQ ID NO: 194733 - DNA, 23 bp, Homo sapiens
aatgtagttctttgttcctgctt

SEQ ID NO: 194734 - DNA, 18 bp, Homo sapiens
aatgtatatttaacttct

SEQ ID NO: 194735 - DNA, 15 bp, Homo sapiens
aatgtatcaggaaat

SEQ ID NO: 194736 - DNA, 21 bp, Homo sapiens
aatgtatcccttctcacagca

SEQ ID NO: 194737 - DNA, 14 bp, Homo sapiens
aatgtatcttattt

SEQ ID NO: 194738 - DNA, 18 bp, Homo sapiens
aatgtatcttatttatat

SEQ ID NO: 194739 - DNA, 19 bp, Homo sapiens
aatgtatcttatttatata

SEQ ID NO: 194740 - DNA, 21 bp, Homo sapiens
aatgtatcttatttatatatg

SEQ ID NO: 194741 - DNA, 12 bp, Homo sapiens
aatgtatgtgaa

SEQ ID NO: 194742 - DNA, 17 bp, Homo sapiens
aatgtatgtgaaagtgt

SEQ ID NO: 194743 - DNA, 21 bp, Homo sapiens
aatgtatgtgaaagtgtaaaa

SEQ ID NO: 194744 - DNA, 21 bp, Homo sapiens
aatgtatgtgcactgtcactt

SEQ ID NO: 194745 - DNA, 18 bp, Homo sapiens
aatgtattattctgcagc

SEQ ID NO: 194746 - DNA, 12 bp, Homo sapiens
aatgtattcaag

SEQ ID NO: 194747 - DNA, 13 bp, Homo sapiens
aatgtattcaagc

SEQ ID NO: 194748 - DNA, 19 bp, Homo sapiens
aatgtattcaagcaaacat

SEQ ID NO: 194749 - DNA, 19 bp, Homo sapiens
aatgtattttgaaaacact

SEQ ID NO: 194750 - DNA, 20 bp, Homo sapiens
aatgtattttgaaaacactt

SEQ ID NO: 194751 - DNA, 13 bp, Homo sapiens
aatgtcagtgtga

SEQ ID NO: 194752 - DNA, 16 bp, Homo sapiens
aatgtcagtgtgactg

SEQ ID NO: 194753 - DNA, 14 bp, Homo sapiens
aatgtcatttgcta

SEQ ID NO: 194754 - DNA, 23 bp, Homo sapiens
aatgtcatttgctaatgaatttt

SEQ ID NO: 194755 - DNA, 21 bp, Homo sapiens
aatgtccaagcatcagcaaga

SEQ ID NO: 194756 - DNA, 21 bp, Homo sapiens
aatgtcccaaataaatttata

SEQ ID NO: 194757 - DNA, 17 bp, Homo sapiens
aatgtcctccagaagcc

SEQ ID NO: 194758 - DNA, 16 bp, Homo sapiens
aatgtcctttccctgg

SEQ ID NO: 194759 - DNA, 18 bp, Homo sapiens
aatgtcttaaataaaact

SEQ ID NO: 194760 - DNA, 12 bp, Homo sapiens
aatgtcttcctt

SEQ ID NO: 194761 - DNA, 19 bp, Homo sapiens
aatgtcttccttttctttc

SEQ ID NO: 194762 - DNA, 13 bp, Homo sapiens
agattttccttcc

SEQ ID NO: 194763 - DNA, 19 bp, Homo sapiens
agattttctgtaaatgaag

SEQ ID NO: 194764 - DNA, 17 bp, Homo sapiens
agatttttctcatctcc

SEQ ID NO: 194765 - DNA, 22 bp, Homo sapiens
agatttttgttaagctcaggat

SEQ ID NO: 194766 - DNA, 20 bp, Homo sapiens
agcaaaaaatgaatgtctaa

SEQ ID NO: 194767 - DNA, 18 bp, Homo sapiens
agcaaaaccattgcttca

SEQ ID NO: 194768 - DNA, 22 bp, Homo sapiens
agcaaaaccattgcttcactac

SEQ ID NO: 194769 - DNA, 16 bp, Homo sapiens
agcaaaaggcagctca

SEQ ID NO: 194770 - DNA, 17 bp, Homo sapiens
agcaaaaggcagctcac

SEQ ID NO: 194771 - DNA, 17 bp, Homo sapiens
agcaaaataaggaagag

SEQ ID NO: 194772 - DNA, 12 bp, Homo sapiens
agcaaaatatat

SEQ ID NO: 194773 - DNA, 16 bp, Homo sapiens
agcaaaatatgcccct

SEQ ID NO: 194774 - DNA, 19 bp, Homo sapiens
agcaaaattgatgtgttta

SEQ ID NO: 194775 - DNA, 23 bp, Homo sapiens
agcaaaattgatgtgtttattta

SEQ ID NO: 194776 - DNA, 13 bp, Homo sapiens
agcaaacacacag

SEQ ID NO: 194777 - DNA, 15 bp, Homo sapiens
agcaaacctgcccca

SEQ ID NO: 194778 - DNA, 16 bp, Homo sapiens
agcaaaccttctcagg

SEQ ID NO: 194779 - DNA, 17 bp, Homo sapiens
agcaaagatcaaaataa

SEQ ID NO: 194780 - DNA, 21 bp, Homo sapiens
agcaaagccaccaagggcctc

SEQ ID NO: 194781 - DNA, 22 bp, Homo sapiens
agcaaaggagacaaagcaggag

SEQ ID NO: 194782 - DNA, 13 bp, Homo sapiens
agcaaataccaaa

SEQ ID NO: 194783 - DNA, 13 bp, Homo sapiens
agcaaatcagaca

SEQ ID NO: 194784 - DNA, 15 bp, Homo sapiens
agcaaatcagacaca

SEQ ID NO: 194785 - DNA, 18 bp, Homo sapiens
agcaaattcttgaataaa

SEQ ID NO: 194786 - DNA, 21 bp, Homo sapiens
agcaaatttcatctttccaaa

SEQ ID NO: 194787 - DNA, 13 bp, Homo sapiens
agcaacacaatgt

SEQ ID NO: 194788 - DNA, 21 bp, Homo sapiens
agcaacacaatgttattcgtt

SEQ ID NO: 194789 - DNA, 13 bp, Homo sapiens
agcaacacccaag

SEQ ID NO: 194790 - DNA, 15 bp, Homo sapiens
agcaacacccaagtc

SEQ ID NO: 194791 - DNA, 17 bp, Homo sapiens
agcaacacccaagtcca

SEQ ID NO: 194792 - DNA, 19 bp, Homo sapiens
agcaacacccaagtccacc

SEQ ID NO: 194793 - DNA, 21 bp, Homo sapiens
agcaacacccaagtccacccc

SEQ ID NO: 194794 - DNA, 17 bp, Homo sapiens
agcaacaggaccaggag

SEQ ID NO: 194795 - DNA, 20 bp, Homo sapiens
agcaacaggaccaggagcca

SEQ ID NO: 194796 - DNA, 16 bp, Homo sapiens
agcaacatcagcttga

SEQ ID NO: 194797 - DNA, 13 bp, Homo sapiens
agcaacatgaatt

SEQ ID NO: 194798 - DNA, 19 bp, Homo sapiens
agcaacatgaattaagaac

SEQ ID NO: 194799 - DNA, 20 bp, Homo sapiens
agcaacatgcttcatgaaaa

SEQ ID NO: 194800 - DNA, 17 bp, Homo sapiens
agcaaccctacagtata

SEQ ID NO: 194801 - DNA, 20 bp, Homo sapiens
agcaaccctacagtatataa

SEQ ID NO: 194802 - DNA, 13 bp, Homo sapiens
agcaacctatttg

SEQ ID NO: 194803 - DNA, 17 bp, Homo sapiens
agcaaccttaaagcaat

SEQ ID NO: 194804 - DNA, 21 bp, Homo sapiens
agcaacgcctgccttctgggc

SEQ ID NO: 194805 - DNA, 18 bp, Homo sapiens
agcaactctccactccat

SEQ ID NO: 194806 - DNA, 21 bp, Homo sapiens
agcaacttgtctttttctgga

SEQ ID NO: 194807 - DNA, 17 bp, Homo sapiens
agcaactttccaacttt

SEQ ID NO: 194808 - DNA, 19 bp, Homo sapiens
agcaagaagattctaaaac

SEQ ID NO: 194809 - DNA, 15 bp, Homo sapiens
agcaagacagagacg

SEQ ID NO: 194810 - DNA, 23 bp, Homo sapiens
agcaagacagagacgcaggaatg

SEQ ID NO: 194811 - DNA, 13 bp, Homo sapiens
agcaagagcacaa

SEQ ID NO: 194812 - DNA, 23 bp, Homo sapiens
agcaagatgatttttaagtacaa

SEQ ID NO: 194813 - DNA, 15 bp, Homo sapiens
agcaagcccgtcatc

SEQ ID NO: 194814 - DNA, 11 bp, Homo sapiens
agcaaggacat

SEQ ID NO: 194815 - DNA, 19 bp, Homo sapiens
agcaaggacattgccccaa

SEQ ID NO: 194816 - DNA, 21 bp, Homo sapiens
agcaaggacattgccccaaga

SEQ ID NO: 194817 - DNA, 22 bp, Homo sapiens
agcaaggacattgccccaagat

SEQ ID NO: 194818 - DNA, 20 bp, Homo sapiens
agcaaggaccagtgagacag

SEQ ID NO: 194819 - DNA, 14 bp, Homo sapiens
agcaaggcacaggc

SEQ ID NO: 194820 - DNA, 14 bp, Homo sapiens
agcaagtgtacagt

SEQ ID NO: 194821 - DNA, 18 bp, Homo sapiens
agcaagtgtacagtattt

SEQ ID NO: 194822 - DNA, 13 bp, Homo sapiens
agcaataaatgaa

SEQ ID NO: 194823 - DNA, 19 bp, Homo sapiens
agcaataagttcattaaac

SEQ ID NO: 194824 - DNA, 20 bp, Homo sapiens
agcaataagttcattaaaca

SEQ ID NO: 194825 - DNA, 23 bp, Homo sapiens
agcaataagttcattaaacagaa

SEQ ID NO: 194826 - DNA, 24 bp, Homo sapiens
agcaatatattaccagcaagaata

SEQ ID NO: 194827 - DNA, 15 bp, Homo sapiens
agcaatatgtaaata

SEQ ID NO: 194828 - DNA, 11 bp, Homo sapiens
agcaatattta

SEQ ID NO: 194829 - DNA, 18 bp, Homo sapiens
agcaatgatgtccagaag

SEQ ID NO: 194830 - DNA, 23 bp, Homo sapiens
agcaatgatgtccagaagaatat

SEQ ID NO: 194831 - DNA, 11 bp, Homo sapiens
agcaatgggac

SEQ ID NO: 194832 - DNA, 12 bp, Homo sapiens
agcaatgggact

SEQ ID NO: 194833 - DNA, 14 bp, Homo sapiens
agcaatgggactgg

SEQ ID NO: 194834 - DNA, 16 bp, Homo sapiens
agcaatgtgagtccca

SEQ ID NO: 194835 - DNA, 18 bp, Homo sapiens
agcaattatttaaagaaa

SEQ ID NO: 194836 - DNA, 16 bp, Homo sapiens
agcaattctcctgcct

SEQ ID NO: 194837 - DNA, 18 bp, Homo sapiens
agcaattctcctgcctca

SEQ ID NO: 194838 - DNA, 23 bp, Homo sapiens
agcacaaagataacgcaggagag

SEQ ID NO: 194839 - DNA, 21 bp, Homo sapiens
agcacaactgctgtttagtga

SEQ ID NO: 194840 - DNA, 16 bp, Homo sapiens
agcacaagaagtggga

SEQ ID NO: 194841 - DNA, 18 bp, Homo sapiens
agcacaagcgtgtttcta

SEQ ID NO: 194842 - DNA, 15 bp, Homo sapiens
agcacaattctgtcc

SEQ ID NO: 194843 - DNA, 16 bp, Homo sapiens
agcacaattctgtccc

SEQ ID NO: 194844 - DNA, 19 bp, Homo sapiens
agcacaattctgtccctgt

SEQ ID NO: 194845 - DNA, 19 bp, Homo sapiens
agcacactgagtttgaaca

SEQ ID NO: 194846 - DNA, 23 bp, Homo sapiens
agcacacttgacatcaactgcat

SEQ ID NO: 194847 - DNA, 19 bp, Homo sapiens
agcacagaaacagaggaga

SEQ ID NO: 194848 - DNA, 20 bp, Homo sapiens
agcacagagagggggccacc

SEQ ID NO: 194849 - DNA, 17 bp, Homo sapiens
agcaggcccacctacct

SEQ ID NO: 194850 - DNA, 23 bp, Homo sapiens
agcaggcccacctaccttcaaag

SEQ ID NO: 194851 - DNA, 17 bp, Homo sapiens
agcaggctcgggctccc

SEQ ID NO: 194852 - DNA, 14 bp, Homo sapiens
agcaggctggcagc

SEQ ID NO: 194853 - DNA, 22 bp, Homo sapiens
agcaggctggcagctctccagt

SEQ ID NO: 194854 - DNA, 21 bp, Homo sapiens
agcagggaaagctccacggtg

SEQ ID NO: 194855 - DNA, 16 bp, Homo sapiens
agcagggaatttctat

SEQ ID NO: 194856 - DNA, 16 bp, Homo sapiens
agcagggccctcagag

SEQ ID NO: 194857 - DNA, 17 bp, Homo sapiens
agcagggccctcagagg

SEQ ID NO: 194858 - DNA, 17 bp, Homo sapiens
agcagggcgggccagga

SEQ ID NO: 194859 - DNA, 19 bp, Homo sapiens
agcagggcgggccaggaga

SEQ ID NO: 194860 - DNA, 20 bp, Homo sapiens
agcaggggggttgggttcca

SEQ ID NO: 194861 - DNA, 22 bp, Homo sapiens
agcaggggggttgggttccaga

SEQ ID NO: 194862 - DNA, 14 bp, Homo sapiens
agcagggtctttgt

SEQ ID NO: 194863 - DNA, 16 bp, Homo sapiens
agcaggtgtggtggct

SEQ ID NO: 194864 - DNA, 15 bp, Homo sapiens
agcagtaaaaactgt

SEQ ID NO: 194865 - DNA, 18 bp, Homo sapiens
agcagtaccatcccactg

SEQ ID NO: 194866 - DNA, 19 bp, Homo sapiens
agcagtaccatcccactga

SEQ ID NO: 194867 - DNA, 15 bp, Homo sapiens
agcagtacttgctca

SEQ ID NO: 194868 - DNA, 20 bp, Homo sapiens
agcagtacttgctcaataaa

SEQ ID NO: 194869 - DNA, 20 bp, Homo sapiens
agcagtcccagtattctcag

SEQ ID NO: 194870 - DNA, 19 bp, Homo sapiens
agcagtcctgcctcagcct

SEQ ID NO: 194871 - DNA, 15 bp, Homo sapiens
agcagtctacttctg

SEQ ID NO: 194872 - DNA, 16 bp, Homo sapiens
agcagtctacttctgt

SEQ ID NO: 194873 - DNA, 15 bp, Homo sapiens
agcagtcttgctctg

SEQ ID NO: 194874 - DNA, 22 bp, Homo sapiens
agcagtgaaacttgtgctatag

SEQ ID NO: 194875 - DNA, 16 bp, Homo sapiens
agcagtgagtctcttc

SEQ ID NO: 194876 - DNA, 21 bp, Homo sapiens
agcagtgattgaagtatctgt

SEQ ID NO: 194877 - DNA, 19 bp, Homo sapiens
agcagtgcatgctgtccct

SEQ ID NO: 194878 - DNA, 15 bp, Homo sapiens
agcagtgcctcgagg

SEQ ID NO: 194879 - DNA, 20 bp, Homo sapiens
agcagtgcctcgaggcaccg

SEQ ID NO: 194880 - DNA, 21 bp, Homo sapiens
agcagtgcctcgaggcaccgg

SEQ ID NO: 194881 - DNA, 16 bp, Homo sapiens
agcagtgccttccata

SEQ ID NO: 194882 - DNA, 23 bp, Homo sapiens
agcagtgccttccataattatga

SEQ ID NO: 194883 - DNA, 14 bp, Homo sapiens
agcagtgctgggcc

SEQ ID NO: 194884 - DNA, 16 bp, Homo sapiens
agcagtggctggtcca

SEQ ID NO: 194885 - DNA, 17 bp, Homo sapiens
agcagtggctggtccag

SEQ ID NO: 194886 - DNA, 18 bp, Homo sapiens
agcagtggctggtccagg

SEQ ID NO: 194887 - DNA, 19 bp, Homo sapiens
agcagtggctggtccaggg

SEQ ID NO: 194888 - DNA, 22 bp, Homo sapiens
agcagtggctggtccagggcta

SEQ ID NO: 194889 - DNA, 15 bp, Homo sapiens
agcagtggggagcgg

SEQ ID NO: 194890 - DNA, 15 bp, Homo sapiens
agcagtgtcatcaga

SEQ ID NO: 194891 - DNA, 20 bp, Homo sapiens
agcagtgtcatcagaagata

SEQ ID NO: 194892 - DNA, 23 bp, Homo sapiens
agcagtgtcctgtgctttctgca

SEQ ID NO: 194893 - DNA, 16 bp, Homo sapiens
agcagtgtcttccata

SEQ ID NO: 194894 - DNA, 22 bp, Homo sapiens
agcagtgtcttccataatgtat

SEQ ID NO: 194895 - DNA, 15 bp, Homo sapiens
agcagtgtgtctcct

SEQ ID NO: 194896 - DNA, 16 bp, Homo sapiens
agcagttctgcaaata

SEQ ID NO: 194897 - DNA, 23 bp, Homo sapiens
agcagttctgcaaatagaaaaca

SEQ ID NO: 194898 - DNA, 15 bp, Homo sapiens
agcagttgacatcca

SEQ ID NO: 194899 - DNA, 18 bp, Homo sapiens
agcagttgttatattcat

SEQ ID NO: 194900 - DNA, 19 bp, Homo sapiens
agcagttttccaggaggcc

SEQ ID NO: 194901 - DNA, 13 bp, Homo sapiens
agcatacatttat

SEQ ID NO: 194902 - DNA, 14 bp, Homo sapiens
agcatactctatgt

SEQ ID NO: 194903 - DNA, 16 bp, Homo sapiens
aattattttttttctt

SEQ ID NO: 194904 - DNA, 13 bp, Homo sapiens
aattcaaacctaa

SEQ ID NO: 194905 - DNA, 16 bp, Homo sapiens
aattcaacaaatgatg

SEQ ID NO: 194906 - DNA, 17 bp, Homo sapiens
aattcaacacttatttt

SEQ ID NO: 194907 - DNA, 21 bp, Homo sapiens
aattcaaccactgtaaaatga

SEQ ID NO: 194908 - DNA, 13 bp, Homo sapiens
aattcaactctgt

SEQ ID NO: 194909 - DNA, 14 bp, Homo sapiens
aattcaactctgtg

SEQ ID NO: 194910 - DNA, 20 bp, Homo sapiens
aattcaagaaaacaacttca

SEQ ID NO: 194911 - DNA, 19 bp, Homo sapiens
aattcaagaaaataaaact

SEQ ID NO: 194912 - DNA, 21 bp, Homo sapiens
aattcaaggagatataaaatc

SEQ ID NO: 194913 - DNA, 15 bp, Homo sapiens
aattcacaagctgcc

SEQ ID NO: 194914 - DNA, 18 bp, Homo sapiens
aattcagcaccctgggtg

SEQ ID NO: 194915 - DNA, 15 bp, Homo sapiens
aattcaggcacatgt

SEQ ID NO: 194916 - DNA, 22 bp, Homo sapiens
aattcagggtggtaaagtatgt

SEQ ID NO: 194917 - DNA, 17 bp, Homo sapiens
aattcagttgttagtgt

SEQ ID NO: 194918 - DNA, 22 bp, Homo sapiens
aattcagttttagtttcaaaat

SEQ ID NO: 194919 - DNA, 14 bp, Homo sapiens
aattcataaaaata

SEQ ID NO: 194920 - DNA, 15 bp, Homo sapiens
aattcataaaaataa

SEQ ID NO: 194921 - DNA, 16 bp, Homo sapiens
aattcataaaaataac

SEQ ID NO: 194922 - DNA, 17 bp, Homo sapiens
aattcataaaaataacc

SEQ ID NO: 194923 - DNA, 14 bp, Homo sapiens
aattcatactctgt

SEQ ID NO: 194924 - DNA, 19 bp, Homo sapiens
aattcatagcatcctgatt

SEQ ID NO: 194925 - DNA, 14 bp, Homo sapiens
aattcattaaaagt

SEQ ID NO: 194926 - DNA, 14 bp, Homo sapiens
aattcattaaagaa

SEQ ID NO: 194927 - DNA, 17 bp, Homo sapiens
aattcattaaagaaaaa

SEQ ID NO: 194928 - DNA, 23 bp, Homo sapiens
aattcattaaatttctggatttg

SEQ ID NO: 194929 - DNA, 15 bp, Homo sapiens
aattcatttttttca

SEQ ID NO: 194930 - DNA, 16 bp, Homo sapiens
aattccaatatgatga

SEQ ID NO: 194931 - DNA, 17 bp, Homo sapiens
aattccaattatatgag

SEQ ID NO: 194932 - DNA, 14 bp, Homo sapiens
aattccaccaggat

SEQ ID NO: 194933 - DNA, 15 bp, Homo sapiens
aattcccagatagtc

SEQ ID NO: 194934 - DNA, 16 bp, Homo sapiens
aattcccattttgcaa

SEQ ID NO: 194935 - DNA, 19 bp, Homo sapiens
aattccccttcccttattt

SEQ ID NO: 194936 - DNA, 13 bp, Homo sapiens
aattcctctggga

SEQ ID NO: 194937 - DNA, 19 bp, Homo sapiens
aattcctgcaaaattacct

SEQ ID NO: 194938 - DNA, 22 bp, Homo sapiens
aattccttaggcttaagagaga

SEQ ID NO: 194939 - DNA, 21 bp, Homo sapiens
aattctaagattgtacatatg

SEQ ID NO: 194940 - DNA, 15 bp, Homo sapiens
aattctacattgtca

SEQ ID NO: 194941 - DNA, 15 bp, Homo sapiens
aattctagtctctga

SEQ ID NO: 194942 - DNA, 13 bp, Homo sapiens
aattctatactgt

SEQ ID NO: 194943 - DNA, 14 bp, Homo sapiens
aattctatttgctg

SEQ ID NO: 194944 - DNA, 13 bp, Homo sapiens
aattctcagacga

SEQ ID NO: 194945 - DNA, 11 bp, Homo sapiens
aattctccaac

SEQ ID NO: 194946 - DNA, 20 bp, Homo sapiens
aattctcccgcattggtggc

SEQ ID NO: 194947 - DNA, 15 bp, Homo sapiens
aattctctaggaaag

SEQ ID NO: 194948 - DNA, 14 bp, Homo sapiens
aattctctctaaaa

SEQ ID NO: 194949 - DNA, 21 bp, Homo sapiens
aattctgcaactagccaaggc

SEQ ID NO: 194950 - DNA, 14 bp, Homo sapiens
aattctgctcctga

SEQ ID NO: 194951 - DNA, 14 bp, Homo sapiens
aattctgctgcttg

SEQ ID NO: 194952 - DNA, 13 bp, Homo sapiens
aattctgtccctg

SEQ ID NO: 194953 - DNA, 18 bp, Homo sapiens
aattctgtccctgtccct

SEQ ID NO: 194954 - DNA, 23 bp, Homo sapiens
aattctgtccctgtccctgcccc

SEQ ID NO: 194955 - DNA, 13 bp, Homo sapiens
aattctgtgaaga

SEQ ID NO: 194956 - DNA, 20 bp, Homo sapiens
aattctgtgaagaatgaagt

SEQ ID NO: 194957 - DNA, 20 bp, Homo sapiens
aattctgttctgatattaat

SEQ ID NO: 194958 - DNA, 13 bp, Homo sapiens
aattcttacctca

SEQ ID NO: 194959 - DNA, 14 bp, Homo sapiens
aattcttacctcat

SEQ ID NO: 194960 - DNA, 19 bp, Homo sapiens
aattcttacctcatttgca

SEQ ID NO: 194961 - DNA, 15 bp, Homo sapiens
aattcttatttcccc

SEQ ID NO: 194962 - DNA, 20 bp, Homo sapiens
aattcttatttcccctttcc

SEQ ID NO: 194963 - DNA, 22 bp, Homo sapiens
aattcttattttataattttaa

SEQ ID NO: 194964 - DNA, 23 bp, Homo sapiens
aattcttattttataattttaaa

SEQ ID NO: 194965 - DNA, 13 bp, Homo sapiens
aattcttgaagtt

SEQ ID NO: 194966 - DNA, 15 bp, Homo sapiens
aattcttgcactgta

SEQ ID NO: 194967 - DNA, 22 bp, Homo sapiens
aattcttgcactgtatccaagt

SEQ ID NO: 194968 - DNA, 23 bp, Homo sapiens
aattctttgttgcttaatctaga

SEQ ID NO: 194969 - DNA, 15 bp, Homo sapiens
aattctttgtttcct

SEQ ID NO: 194970 - DNA, 19 bp, Homo sapiens
aattgacagggaaaatata

SEQ ID NO: 194971 - DNA, 14 bp, Homo sapiens
aattgacatgttgt

SEQ ID NO: 194972 - DNA, 19 bp, Homo sapiens
aattgacctgatttccatt

SEQ ID NO: 194973 - DNA, 15 bp, Homo sapiens
aattgacttcagcag

SEQ ID NO: 194974 - DNA, 18 bp, Homo sapiens
aattgacttcgactgtga

SEQ ID NO: 194975 - DNA, 22 bp, Homo sapiens
aattgagaggtgggggatgctg

SEQ ID NO: 194976 - DNA, 13 bp, Homo sapiens
aattgataataaa

SEQ ID NO: 194977 - DNA, 13 bp, Homo sapiens
aattgatcattca

SEQ ID NO: 194978 - DNA, 22 bp, Homo sapiens
aattgatcattttccccccact

SEQ ID NO: 194979 - DNA, 20 bp, Homo sapiens
agccatgtctacaaaagcaa

SEQ ID NO: 194980 - DNA, 14 bp, Homo sapiens
agccattcactgcc

SEQ ID NO: 194981 - DNA, 18 bp, Homo sapiens
agccattcatctgggctg

SEQ ID NO: 194982 - DNA, 20 bp, Homo sapiens
agccattcatctgggctggc

SEQ ID NO: 194983 - DNA, 22 bp, Homo sapiens
agccattcatctgggctggcag

SEQ ID NO: 194984 - DNA, 19 bp, Homo sapiens
agccatttgccccaactta

SEQ ID NO: 194985 - DNA, 23 bp, Homo sapiens
agccatttgccccaacttaagtt

SEQ ID NO: 194986 - DNA, 15 bp, Homo sapiens
agccattttgtaact

SEQ ID NO: 194987 - DNA, 14 bp, Homo sapiens
agcccaaagctgga

SEQ ID NO: 194988 - DNA, 10 bp, Homo sapiens
agcccaataa

SEQ ID NO: 194989 - DNA, 14 bp, Homo sapiens
agcccaataaaggt

SEQ ID NO: 194990 - DNA, 15 bp, Homo sapiens
agcccaatattataa

SEQ ID NO: 194991 - DNA, 16 bp, Homo sapiens
agcccaatattataat

SEQ ID NO: 194992 - DNA, 20 bp, Homo sapiens
agcccaatattataattttt

SEQ ID NO: 194993 - DNA, 13 bp, Homo sapiens
agcccaatcactg

SEQ ID NO: 194994 - DNA, 15 bp, Homo sapiens
agcccacacttgaga

SEQ ID NO: 194995 - DNA, 17 bp, Homo sapiens
agcccacagaggacagt

SEQ ID NO: 194996 - DNA, 17 bp, Homo sapiens
agcccacagtgctcagt

SEQ ID NO: 194997 - DNA, 22 bp, Homo sapiens
agcccacagtgctcagttgtac

SEQ ID NO: 194998 - DNA, 16 bp, Homo sapiens
agcccacccgccccag

SEQ ID NO: 194999 - DNA, 18 bp, Homo sapiens
agcccacccgccccagag

SEQ ID NO: 195000 - DNA, 23 bp, Homo sapiens
agcccacccgccccagagactgc

SEQ ID NO: 195001 - DNA, 14 bp, Homo sapiens
agcccaccctggga

SEQ ID NO: 195002 - DNA, 9 bp, Homo sapiens
agcccacct

SEQ ID NO: 195003 - DNA, 11 bp, Homo sapiens
agcccacctga

SEQ ID NO: 195004 - DNA, 14 bp, Homo sapiens
agcccacctgaaag

SEQ ID NO: 195005 - DNA, 21 bp, Homo sapiens
agcccacctgaaagcctgtct

SEQ ID NO: 195006 - DNA, 22 bp, Homo sapiens
agcccacctgaaagcctgtctc

SEQ ID NO: 195007 - DNA, 17 bp, Homo sapiens
agcccacctgggctggg

SEQ ID NO: 195008 - DNA, 22 bp, Homo sapiens
agcccacggctaagaggctgct

SEQ ID NO: 195009 - DNA, 14 bp, Homo sapiens
agcccactggatca

SEQ ID NO: 195010 - DNA, 12 bp, Homo sapiens
agcccagacaaa

SEQ ID NO: 195011 - DNA, 12 bp, Homo sapiens
agcccagagaga

SEQ ID NO: 195012 - DNA, 21 bp, Homo sapiens
agcccagagagaccctgccaa

SEQ ID NO: 195013 - DNA, 12 bp, Homo sapiens
agcccagcccgg

SEQ ID NO: 195014 - DNA, 14 bp, Homo sapiens
agcccagcccggca

SEQ ID NO: 195015 - DNA, 16 bp, Homo sapiens
agcccagctacattcc

SEQ ID NO: 195016 - DNA, 19 bp, Homo sapiens
agcccagctacattcctca

SEQ ID NO: 195017 - DNA, 22 bp, Homo sapiens
agcccagctacattcctcagct

SEQ ID NO: 195018 - DNA, 23 bp, Homo sapiens
agcccagctacattcctcagctg

SEQ ID NO: 195019 - DNA, 20 bp, Homo sapiens
agcccagctccactcagggc

SEQ ID NO: 195020 - DNA, 14 bp, Homo sapiens
agcccagctgctct

SEQ ID NO: 195021 - DNA, 15 bp, Homo sapiens
agcccagctgctctg

SEQ ID NO: 195022 - DNA, 22 bp, Homo sapiens
agcccagctgctctgcccagag

SEQ ID NO: 195023 - DNA, 14 bp, Homo sapiens
agcccagcttcctg

SEQ ID NO: 195024 - DNA, 18 bp, Homo sapiens
agcccagcttcctggtgt

SEQ ID NO: 195025 - DNA, 10 bp, Homo sapiens
agcccaggat

SEQ ID NO: 195026 - DNA, 22 bp, Homo sapiens
agcccaggccggggtggagcat

SEQ ID NO: 195027 - DNA, 23 bp, Homo sapiens
agcccaggccgttccccttggct

SEQ ID NO: 195028 - DNA, 15 bp, Homo sapiens
agcccaggcctggcc

SEQ ID NO: 195029 - DNA, 14 bp, Homo sapiens
agcccaggtcccag

SEQ ID NO: 195030 - DNA, 23 bp, Homo sapiens
agcccagtagccattttgtaact

SEQ ID NO: 195031 - DNA, 20 bp, Homo sapiens
agcccagtccctggagctgt

SEQ ID NO: 195032 - DNA, 14 bp, Homo sapiens
agcccatcctctcg

SEQ ID NO: 195033 - DNA, 17 bp, Homo sapiens
agcccatcctctcgcca

SEQ ID NO: 195034 - DNA, 11 bp, Homo sapiens
agcccatgccc

SEQ ID NO: 195035 - DNA, 16 bp, Homo sapiens
agcccatgcccacctg

SEQ ID NO: 195036 - DNA, 18 bp, Homo sapiens
agccccaactccaggggc

SEQ ID NO: 195037 - DNA, 21 bp, Homo sapiens
agccccaactccaggggcacc

SEQ ID NO: 195038 - DNA, 16 bp, Homo sapiens
agccccaagaaggctg

SEQ ID NO: 195039 - DNA, 17 bp, Homo sapiens
agccccaagaaggctgg

SEQ ID NO: 195040 - DNA, 12 bp, Homo sapiens
agccccacccag

SEQ ID NO: 195041 - DNA, 15 bp, Homo sapiens
agccccacccaggag

SEQ ID NO: 195042 - DNA, 16 bp, Homo sapiens
agccccacccaggagg

SEQ ID NO: 195043 - DNA, 20 bp, Homo sapiens
agccccacccctaagtgccc

SEQ ID NO: 195044 - DNA, 15 bp, Homo sapiens
agccccacctctcca

SEQ ID NO: 195045 - DNA, 17 bp, Homo sapiens
agccccacgtggagctc

SEQ ID NO: 195046 - DNA, 19 bp, Homo sapiens
agccccactcccggccagg

SEQ ID NO: 195047 - DNA, 12 bp, Homo sapiens
agccccacttca

SEQ ID NO: 195048 - DNA, 23 bp, Homo sapiens
agccccagaaccccaactcccag

SEQ ID NO: 195049 - DNA, 16 bp, Homo sapiens
agccccagccagccct

SEQ ID NO: 195050 - DNA, 20 bp, Homo sapiens
acaaactgcaatagagactg

SEQ ID NO: 195051 - DNA, 22 bp, Homo sapiens
acaaactttagggtaaaaattg

SEQ ID NO: 195052 - DNA, 23 bp, Homo sapiens
acaaactttgtttgctaatgcac

SEQ ID NO: 195053 - DNA, 11 bp, Homo sapiens
acaaagaaaat

SEQ ID NO: 195054 - DNA, 12 bp, Homo sapiens
acaaagacaggg

SEQ ID NO: 195055 - DNA, 23 bp, Homo sapiens
acaaagagaataaagacttcatg

SEQ ID NO: 195056 - DNA, 19 bp, Homo sapiens
acaaagataacgcaggaga

SEQ ID NO: 195057 - DNA, 21 bp, Homo sapiens
acaaagataacgcaggagaga

SEQ ID NO: 195058 - DNA, 22 bp, Homo sapiens
acaaagataagacttgtttctt

SEQ ID NO: 195059 - DNA, 15 bp, Homo sapiens
acaaagcacagtgtt

SEQ ID NO: 195060 - DNA, 18 bp, Homo sapiens
acaaagcaggagtggaag

SEQ ID NO: 195061 - DNA, 12 bp, Homo sapiens
acaaagcatgct

SEQ ID NO: 195062 - DNA, 14 bp, Homo sapiens
acaaagcatgctca

SEQ ID NO: 195063 - DNA, 16 bp, Homo sapiens
acaaagcatgctcagt

SEQ ID NO: 195064 - DNA, 21 bp, Homo sapiens
acaaagcatgctcagtattga

SEQ ID NO: 195065 - DNA, 18 bp, Homo sapiens
acaaagccttatcaagtg

SEQ ID NO: 195066 - DNA, 15 bp, Homo sapiens
acaaagctgatttcc

SEQ ID NO: 195067 - DNA, 19 bp, Homo sapiens
acaaagctgatttcccttt

SEQ ID NO: 195068 - DNA, 21 bp, Homo sapiens
acaaagcttctatcccaggag

SEQ ID NO: 195069 - DNA, 23 bp, Homo sapiens
acaaagcttctatcccaggaggt

SEQ ID NO: 195070 - DNA, 13 bp, Homo sapiens
acaaagtagagaa

SEQ ID NO: 195071 - DNA, 14 bp, Homo sapiens
acaaagtagagaag

SEQ ID NO: 195072 - DNA, 15 bp, Homo sapiens
acaaagtagagaagt

SEQ ID NO: 195073 - DNA, 18 bp, Homo sapiens
acaaagtgactgtttggc

SEQ ID NO: 195074 - DNA, 21 bp, Homo sapiens
acaaagtgactgtttggctta

SEQ ID NO: 195075 - DNA, 14 bp, Homo sapiens
acaaataaagatgg

SEQ ID NO: 195076 - DNA, 17 bp, Homo sapiens
acaaataaagatggcta

SEQ ID NO: 195077 - DNA, 22 bp, Homo sapiens
acaaatacctccattaaatggt

SEQ ID NO: 195078 - DNA, 23 bp, Homo sapiens
acaaatactcttaggaagagaaa

SEQ ID NO: 195079 - DNA, 22 bp, Homo sapiens
acaaatagtaggctaaaaacat

SEQ ID NO: 195080 - DNA, 20 bp, Homo sapiens
acaaatatgattctcctctc

SEQ ID NO: 195081 - DNA, 19 bp, Homo sapiens
acaaatatgctaaatgtta

SEQ ID NO: 195082 - DNA, 19 bp, Homo sapiens
acaaatattttagaagcta

SEQ ID NO: 195083 - DNA, 20 bp, Homo sapiens
acaaatcaccttaactccct

SEQ ID NO: 195084 - DNA, 14 bp, Homo sapiens
acaaatctttaaga

SEQ ID NO: 195085 - DNA, 14 bp, Homo sapiens
acaaatgcagacac

SEQ ID NO: 195086 - DNA, 20 bp, Homo sapiens
acaaatgcagacacacaaca

SEQ ID NO: 195087 - DNA, 23 bp, Homo sapiens
acaaatgttgacctttgaggtct

SEQ ID NO: 195088 - DNA, 18 bp, Homo sapiens
acaaattaaaaacaccta

SEQ ID NO: 195089 - DNA, 14 bp, Homo sapiens
acaaatttaaaaca

SEQ ID NO: 195090 - DNA, 16 bp, Homo sapiens
acaaatttaaaacaaa

SEQ ID NO: 195091 - DNA, 18 bp, Homo sapiens
acaaatttaaaacaaaca

SEQ ID NO: 195092 - DNA, 13 bp, Homo sapiens
acaacaaaaattt

SEQ ID NO: 195093 - DNA, 14 bp, Homo sapiens
acaacaacaaagca

SEQ ID NO: 195094 - DNA, 15 bp, Homo sapiens
acaacaacaaagcat

SEQ ID NO: 195095 - DNA, 13 bp, Homo sapiens
acaacaagagttt

SEQ ID NO: 195096 - DNA, 20 bp, Homo sapiens
acaacaatcccagcatctga

SEQ ID NO: 195097 - DNA, 15 bp, Homo sapiens
acaacaccaggactt

SEQ ID NO: 195098 - DNA, 15 bp, Homo sapiens
acaacagcacgtgca

SEQ ID NO: 195099 - DNA, 19 bp, Homo sapiens
acaaccaccgctccccagc

SEQ ID NO: 195100 - DNA, 20 bp, Homo sapiens
acaaccactgggatcagctg

SEQ ID NO: 195101 - DNA, 12 bp, Homo sapiens
acaaccagagcc

SEQ ID NO: 195102 - DNA, 22 bp, Homo sapiens
acaaccctgttgagtatttgct

SEQ ID NO: 195103 - DNA, 22 bp, Homo sapiens
acaaccgatgctccagccaacc

SEQ ID NO: 195104 - DNA, 16 bp, Homo sapiens
acaacctctctgatct

SEQ ID NO: 195105 - DNA, 18 bp, Homo sapiens
acaacctgcccctcccca

SEQ ID NO: 195106 - DNA, 16 bp, Homo sapiens
acaacctttgtgtaat

SEQ ID NO: 195107 - DNA, 17 bp, Homo sapiens
acaactaacaatgcctt

SEQ ID NO: 195108 - DNA, 15 bp, Homo sapiens
acaactatgaaatcg

SEQ ID NO: 195109 - DNA, 13 bp, Homo sapiens
acaattctttgtt

SEQ ID NO: 195110 - DNA, 21 bp, Homo sapiens
acaattgtttggggttgaaaa

SEQ ID NO: 195111 - DNA, 15 bp, Homo sapiens
acaatttaaattgtt

SEQ ID NO: 195112 - DNA, 14 bp, Homo sapiens
acaatttaatgtat

SEQ ID NO: 195113 - DNA, 19 bp, Homo sapiens
acaatttaggaatgctcaa

SEQ ID NO: 195114 - DNA, 12 bp, Homo sapiens
acaatttatttt

SEQ ID NO: 195115 - DNA, 20 bp, Homo sapiens
acaatttattttattttagc

SEQ ID NO: 195116 - DNA, 23 bp, Homo sapiens
acaatttcctttatatttagtga

SEQ ID NO: 195117 - DNA, 16 bp, Homo sapiens
acacaaaaagaaagct

SEQ ID NO: 195118 - DNA, 18 bp, Homo sapiens
acacaaaaagaaagctgt

SEQ ID NO: 195119 - DNA, 16 bp, Homo sapiens
acacaaaaaggagcgg

SEQ ID NO: 195120 - DNA, 17 bp, Homo sapiens
acacaaaacaacagcaa

SEQ ID NO: 195121 - DNA, 15 bp, Homo sapiens
acacaaacacctcct

SEQ ID NO: 195122 - DNA, 20 bp, Homo sapiens
acacaaaggacaaaaatata

SEQ ID NO: 195123 - DNA, 16 bp, Homo sapiens
acacaaatattgcttg

SEQ ID NO: 195124 - DNA, 21 bp, Homo sapiens
acacaaatattgcttggacta

SEQ ID NO: 195125 - DNA, 15 bp, Homo sapiens
acacaacaccaggac

SEQ ID NO: 195126 - DNA, 13 bp, Homo sapiens
acacaacatgtat

SEQ ID NO: 195127 - DNA, 16 bp, Homo sapiens
acacaacatgtatgtg

SEQ ID NO: 195128 - DNA, 22 bp, Homo sapiens
acacaagcttttttacacaaat

SEQ ID NO: 195129 - DNA, 12 bp, Homo sapiens
acacaatgttat

SEQ ID NO: 195130 - DNA, 13 bp, Homo sapiens
acacaatgttatt

SEQ ID NO: 195131 - DNA, 21 bp, Homo sapiens
acacaatgttgcactgaaaac

SEQ ID NO: 195132 - DNA, 21 bp, Homo sapiens
acacaatttaattcctctttt

SEQ ID NO: 195133 - DNA, 13 bp, Homo sapiens
acacacaaatgca

SEQ ID NO: 195134 - DNA, 21 bp, Homo sapiens
acacacaaatgcagacacaca

SEQ ID NO: 195135 - DNA, 10 bp, Homo sapiens
acacacacac

SEQ ID NO: 195136 - DNA, 14 bp, Homo sapiens
acacacacacaaat

SEQ ID NO: 195137 - DNA, 13 bp, Homo sapiens
acacacacacaca

SEQ ID NO: 195138 - DNA, 15 bp, Homo sapiens
acacacacacacaca

SEQ ID NO: 195139 - DNA, 16 bp, Homo sapiens
acacacacacacacac

SEQ ID NO: 195140 - DNA, 12 bp, Homo sapiens
acacacacacag

SEQ ID NO: 195141 - DNA, 14 bp, Homo sapiens
acacacacacagga

SEQ ID NO: 195142 - DNA, 13 bp, Homo sapiens
acacacacacata

SEQ ID NO: 195143 - DNA, 14 bp, Homo sapiens
acacacacacgcac

SEQ ID NO: 195144 - DNA, 16 bp, Homo sapiens
acacacacacgcacgc

SEQ ID NO: 195145 - DNA, 11 bp, Homo sapiens
acacacacagc

SEQ ID NO: 195146 - DNA, 14 bp, Homo sapiens
acacacacagccat

SEQ ID NO: 195147 - DNA, 14 bp, Homo sapiens
acacacacccttcc

SEQ ID NO: 195148 - DNA, 15 bp, Homo sapiens
acacacacccttccc

SEQ ID NO: 195149 - DNA, 15 bp, Homo sapiens
acacacacgcagaca

SEQ ID NO: 195150 - DNA, 11 bp, Homo sapiens
acacacagcca

SEQ ID NO: 195151 - DNA, 12 bp, Homo sapiens
acacacagcctg

SEQ ID NO: 195152 - DNA, 19 bp, Homo sapiens
acacacagcctttctgtat

SEQ ID NO: 195153 - DNA, 11 bp, Homo sapiens
acacacagctc

SEQ ID NO: 195154 - DNA, 13 bp, Homo sapiens
acacacagtattc

SEQ ID NO: 195155 - DNA, 14 bp, Homo sapiens
acacaccacagaag

SEQ ID NO: 195156 - DNA, 18 bp, Homo sapiens
acacaccaggctgtgggc

SEQ ID NO: 195157 - DNA, 11 bp, Homo sapiens
acacaccctcc

SEQ ID NO: 195158 - DNA, 12 bp, Homo sapiens
acacacccttcc

SEQ ID NO: 195159 - DNA, 23 bp, Homo sapiens
acacacgcacacacacacacagg

SEQ ID NO: 195160 - DNA, 15 bp, Homo sapiens
acacacgcacgcaca

SEQ ID NO: 195161 - DNA, 16 bp, Homo sapiens
acacacgcacgcacac

SEQ ID NO: 195162 - DNA, 13 bp, Homo sapiens
acacacgcagaca

SEQ ID NO: 195163 - DNA, 17 bp, Homo sapiens
acacacgtgtgatgtat

SEQ ID NO: 195164 - DNA, 13 bp, Homo sapiens
acacactcagcag

SEQ ID NO: 195165 - DNA, 18 bp, Homo sapiens
acacactgtaaacccctg

SEQ ID NO: 195166 - DNA, 21 bp, Homo sapiens
acacactgtaaacccctgggt

SEQ ID NO: 195167 - DNA, 13 bp, Homo sapiens
acacacttttgca

SEQ ID NO: 195168 - DNA, 15 bp, Homo sapiens
acacacttttgcaca

SEQ ID NO: 195169 - DNA, 20 bp, Homo sapiens
acacacttttgcacatatat

SEQ ID NO: 195170 - DNA, 20 bp, Homo sapiens
acacagatggcacctgtggc

SEQ ID NO: 195171 - DNA, 13 bp, Homo sapiens
acacagcatgtgc

SEQ ID NO: 195172 - DNA, 14 bp, Homo sapiens
acacagcctggcct

SEQ ID NO: 195173 - DNA, 16 bp, Homo sapiens
acacagcctggcctcc

SEQ ID NO: 195174 - DNA, 24 bp, Homo sapiens
acacagcctggcctcccctgcgga

SEQ ID NO: 195175 - DNA, 22 bp, Homo sapiens
acacagcctgtcttcagatcct

SEQ ID NO: 195176 - DNA, 14 bp, Homo sapiens
acacagcctttctg

SEQ ID NO: 195177 - DNA, 15 bp, Homo sapiens
acacagcctttctgt

SEQ ID NO: 195178 - DNA, 12 bp, Homo sapiens
acacagctgggc

SEQ ID NO: 195179 - DNA, 14 bp, Homo sapiens
acacagctgggcaa

SEQ ID NO: 195180 - DNA, 18 bp, Homo sapiens
acacagctgggcaaagcc

SEQ ID NO: 195181 - DNA, 12 bp, Homo sapiens
acacaggcctgg

SEQ ID NO: 195182 - DNA, 17 bp, Homo sapiens
acacaggcctggcccag

SEQ ID NO: 195183 - DNA, 21 bp, Homo sapiens
acacaggggaggtgatagcat

SEQ ID NO: 195184 - DNA, 23 bp, Homo sapiens
acacagtatttattgttcccaca

SEQ ID NO: 195185 - DNA, 23 bp, Homo sapiens
acacagttcacaaacagtaaagg

SEQ ID NO: 195186 - DNA, 20 bp, Homo sapiens
acacataaaagtaattaatt

SEQ ID NO: 195187 - DNA, 20 bp, Homo sapiens
acacatacacggtattccca

SEQ ID NO: 195188 - DNA, 15 bp, Homo sapiens
acacatactagaaag

SEQ ID NO: 195189 - DNA, 17 bp, Homo sapiens
acacatagcatgtaatg

SEQ ID NO: 195190 - DNA, 22 bp, Homo sapiens
acacatataaacatcacacaca

SEQ ID NO: 195191 - DNA, 16 bp, Homo sapiens
acacatcaaataaact

SEQ ID NO: 195192 - DNA, 19 bp, Homo sapiens
acacatccctaatgtgtgc

SEQ ID NO: 195193 - DNA, 20 bp, Homo sapiens
acacatccctaatgtgtgcc

SEQ ID NO: 195194 - DNA, 14 bp, Homo sapiens
agccgccccagccc

SEQ ID NO: 195195 - DNA, 15 bp, Homo sapiens
agccgccccagcccc

SEQ ID NO: 195196 - DNA, 21 bp, Homo sapiens
agccgccccgtgtccccccag

SEQ ID NO: 195197 - DNA, 22 bp, Homo sapiens
agccgccccgtgtccccccagg

SEQ ID NO: 195198 - DNA, 14 bp, Homo sapiens
agccgcgctctgcc

SEQ ID NO: 195199 - DNA, 15 bp, Homo sapiens
agccgcgctctgccc

SEQ ID NO: 195200 - DNA, 19 bp, Homo sapiens
agccgcgctctgcccctcc

SEQ ID NO: 195201 - DNA, 20 bp, Homo sapiens
agccgcgctctgcccctccg

SEQ ID NO: 195202 - DNA, 15 bp, Homo sapiens
agccgctaggagaga

SEQ ID NO: 195203 - DNA, 16 bp, Homo sapiens
agccggatcttggaga

SEQ ID NO: 195204 - DNA, 20 bp, Homo sapiens
agccggcaagcgagcacagt

SEQ ID NO: 195205 - DNA, 16 bp, Homo sapiens
agccggcacagggtct

SEQ ID NO: 195206 - DNA, 19 bp, Homo sapiens
agccggccccccctctttt

SEQ ID NO: 195207 - DNA, 19 bp, Homo sapiens
agccggggcctgcctagca

SEQ ID NO: 195208 - DNA, 21 bp, Homo sapiens
agccggggtggggtgcctgag

SEQ ID NO: 195209 - DNA, 22 bp, Homo sapiens
agccggggtggggtgcctgagc

SEQ ID NO: 195210 - DNA, 17 bp, Homo sapiens
agccggtttgggagaga

SEQ ID NO: 195211 - DNA, 22 bp, Homo sapiens
agccgtcccgcgttcaagactt

SEQ ID NO: 195212 - DNA, 18 bp, Homo sapiens
agccgtctgactccagag

SEQ ID NO: 195213 - DNA, 20 bp, Homo sapiens
agccgtctgactccagagtc

SEQ ID NO: 195214 - DNA, 21 bp, Homo sapiens
agccgtctgactccagagtct

SEQ ID NO: 195215 - DNA, 23 bp, Homo sapiens
agccgtctgactccagagtctga

SEQ ID NO: 195216 - DNA, 20 bp, Homo sapiens
agccgtgatgctcaggcttg

SEQ ID NO: 195217 - DNA, 16 bp, Homo sapiens
agccgtgccttcagct

SEQ ID NO: 195218 - DNA, 13 bp, Homo sapiens
agccgtggcttcc

SEQ ID NO: 195219 - DNA, 17 bp, Homo sapiens
agcctaagaaaaaggaa

SEQ ID NO: 195220 - DNA, 12 bp, Homo sapiens
agcctaatgaaa

SEQ ID NO: 195221 - DNA, 23 bp, Homo sapiens
agcctaatgaaagggaaagtcag

SEQ ID NO: 195222 - DNA, 15 bp, Homo sapiens
agcctactgaaaatg

SEQ ID NO: 195223 - DNA, 13 bp, Homo sapiens
agcctactgtctc

SEQ ID NO: 195224 - DNA, 18 bp, Homo sapiens
agcctactgtctccttcc

SEQ ID NO: 195225 - DNA, 22 bp, Homo sapiens
agcctactgtctccttcccact

SEQ ID NO: 195226 - DNA, 20 bp, Homo sapiens
agcctaggggtcagggacca

SEQ ID NO: 195227 - DNA, 21 bp, Homo sapiens
agcctagtaggagctgagctt

SEQ ID NO: 195228 - DNA, 15 bp, Homo sapiens
agcctagttcatcca

SEQ ID NO: 195229 - DNA, 20 bp, Homo sapiens
agcctagttcatccaatcct

SEQ ID NO: 195230 - DNA, 23 bp, Homo sapiens
agcctagttcatccaatcctcac

SEQ ID NO: 195231 - DNA, 11 bp, Homo sapiens
agcctatggca

SEQ ID NO: 195232 - DNA, 20 bp, Homo sapiens
agcctatgggggctctcgga

SEQ ID NO: 195233 - DNA, 14 bp, Homo sapiens
agcctcacccctgc

SEQ ID NO: 195234 - DNA, 18 bp, Homo sapiens
agcctcacccctgcaggc

SEQ ID NO: 195235 - DNA, 14 bp, Homo sapiens
agcctcacccttgc

SEQ ID NO: 195236 - DNA, 17 bp, Homo sapiens
agcctcacttgaatgtg

SEQ ID NO: 195237 - DNA, 23 bp, Homo sapiens
agcctcagtccctccctcctggc

SEQ ID NO: 195238 - DNA, 15 bp, Homo sapiens
agcctcagtgccact

SEQ ID NO: 195239 - DNA, 23 bp, Homo sapiens
agcctcagtgccacttgacattc

SEQ ID NO: 195240 - DNA, 22 bp, Homo sapiens
agtttatatatatgctactttt

SEQ ID NO: 195241 - DNA, 19 bp, Homo sapiens
agtttatgcagtgctgctt

SEQ ID NO: 195242 - DNA, 17 bp, Homo sapiens
agtttatggcagaaggg

SEQ ID NO: 195243 - DNA, 16 bp, Homo sapiens
agtttatgtctaaaga

SEQ ID NO: 195244 - DNA, 21 bp, Homo sapiens
agtttatgtctaaagagcttt

SEQ ID NO: 195245 - DNA, 15 bp, Homo sapiens
agtttattggaagtg

SEQ ID NO: 195246 - DNA, 22 bp, Homo sapiens
agtttatttccaaataaaatga

SEQ ID NO: 195247 - DNA, 14 bp, Homo sapiens
agtttcaaaatgtt

SEQ ID NO: 195248 - DNA, 19 bp, Homo sapiens
agtttcaaaatgttaacaa

SEQ ID NO: 195249 - DNA, 12 bp, Homo sapiens
agtttcaatgtg

SEQ ID NO: 195250 - DNA, 13 bp, Homo sapiens
agtttcagaagta

SEQ ID NO: 195251 - DNA, 14 bp, Homo sapiens
agtttcagacaggg

SEQ ID NO: 195252 - DNA, 23 bp, Homo sapiens
agtttcagatatatatcatattg

SEQ ID NO: 195253 - DNA, 15 bp, Homo sapiens
agtttcagcttaaaa

SEQ ID NO: 195254 - DNA, 20 bp, Homo sapiens
agtttcaggatacatgtgcc

SEQ ID NO: 195255 - DNA, 24 bp, Homo sapiens
agtttcaggcaaggcagctcccag

SEQ ID NO: 195256 - DNA, 19 bp, Homo sapiens
agtttcagtaatagctgaa

SEQ ID NO: 195257 - DNA, 21 bp, Homo sapiens
agtttcagtaatagctgaacc

SEQ ID NO: 195258 - DNA, 23 bp, Homo sapiens
agtttcagtaatagctgaacctg

SEQ ID NO: 195259 - DNA, 22 bp, Homo sapiens
agtttcatttttcattttctct

SEQ ID NO: 195260 - DNA, 22 bp, Homo sapiens
agtttcccaaaaaccccagtgt

SEQ ID NO: 195261 - DNA, 23 bp, Homo sapiens
agtttccgtttccaggtgtttat

SEQ ID NO: 195262 - DNA, 17 bp, Homo sapiens
agtttcctcaggctgct

SEQ ID NO: 195263 - DNA, 14 bp, Homo sapiens
agtttcctttaaat

SEQ ID NO: 195264 - DNA, 18 bp, Homo sapiens
agtttctacattctctat

SEQ ID NO: 195265 - DNA, 17 bp, Homo sapiens
agtttctagaggcctca

SEQ ID NO: 195266 - DNA, 13 bp, Homo sapiens
agtttctcagctc

SEQ ID NO: 195267 - DNA, 16 bp, Homo sapiens
agtttctcagctccca

SEQ ID NO: 195268 - DNA, 20 bp, Homo sapiens
agtttctggctgaaaatggt

SEQ ID NO: 195269 - DNA, 17 bp, Homo sapiens
agtttctgttgtttctt

SEQ ID NO: 195270 - DNA, 20 bp, Homo sapiens
agtttcttgaagtccagtgt

SEQ ID NO: 195271 - DNA, 22 bp, Homo sapiens
agtttgaacctttttttttgaa

SEQ ID NO: 195272 - DNA, 17 bp, Homo sapiens
agtttgagacaagccct

SEQ ID NO: 195273 - DNA, 20 bp, Homo sapiens
agtttgagacaagccctggc

SEQ ID NO: 195274 - DNA, 23 bp, Homo sapiens
agtttgagacaagccctggcaac

SEQ ID NO: 195275 - DNA, 19 bp, Homo sapiens
agtttgatcatagaattgt

SEQ ID NO: 195276 - DNA, 23 bp, Homo sapiens
agtttgcatacttcctggatttt

SEQ ID NO: 195277 - DNA, 12 bp, Homo sapiens
agtttgccctgg

SEQ ID NO: 195278 - DNA, 16 bp, Homo sapiens
agtttggcaatagttt

SEQ ID NO: 195279 - DNA, 21 bp, Homo sapiens
agtttggttgtgtaagagaat

SEQ ID NO: 195280 - DNA, 22 bp, Homo sapiens
agtttgttatgcactttaaatg

SEQ ID NO: 195281 - DNA, 22 bp, Homo sapiens
agttttaagaattgtttttgaa

SEQ ID NO: 195282 - DNA, 13 bp, Homo sapiens
agttttacagatt

SEQ ID NO: 195283 - DNA, 20 bp, Homo sapiens
agttttacagattgcctcct

SEQ ID NO: 195284 - DNA, 22 bp, Homo sapiens
agttttagacctcatctccaag

SEQ ID NO: 195285 - DNA, 21 bp, Homo sapiens
agttttagttgcagaaacatt

SEQ ID NO: 195286 - DNA, 12 bp, Homo sapiens
agttttatcatt

SEQ ID NO: 195287 - DNA, 13 bp, Homo sapiens
agttttatcattt

SEQ ID NO: 195288 - DNA, 14 bp, Homo sapiens
agttttatcatttt

SEQ ID NO: 195289 - DNA, 15 bp, Homo sapiens
agttttatcattttc

SEQ ID NO: 195290 - DNA, 19 bp, Homo sapiens
agttttattgatgtgaaat

SEQ ID NO: 195291 - DNA, 17 bp, Homo sapiens
agttttcagaacctctt

SEQ ID NO: 195292 - DNA, 20 bp, Homo sapiens
agttttcagaacctcttccc

SEQ ID NO: 195293 - DNA, 18 bp, Homo sapiens
agttttccagtattgaaa

SEQ ID NO: 195294 - DNA, 16 bp, Homo sapiens
agttttccatgaaaac

SEQ ID NO: 195295 - DNA, 22 bp, Homo sapiens
agttttcgtattgcaaataaga

SEQ ID NO: 195296 - DNA, 18 bp, Homo sapiens
agttttcttttttaaatt

SEQ ID NO: 195297 - DNA, 21 bp, Homo sapiens
agttttgatacaaactttgtt

SEQ ID NO: 195298 - DNA, 24 bp, Homo sapiens
agttttgattaatgtttcttaaat

SEQ ID NO: 195299 - DNA, 23 bp, Homo sapiens
agttttgctaggtataaaaaata

SEQ ID NO: 195300 - DNA, 11 bp, Homo sapiens
agttttgtata

SEQ ID NO: 195301 - DNA, 13 bp, Homo sapiens
agttttgtataaa

SEQ ID NO: 195302 - DNA, 21 bp, Homo sapiens
agttttgtgtacagtatgtgt

SEQ ID NO: 195303 - DNA, 22 bp, Homo sapiens
agtttttacctaccacagtgtc

SEQ ID NO: 195304 - DNA, 23 bp, Homo sapiens
agtttttcaggagcgcaagatag

SEQ ID NO: 195305 - DNA, 14 bp, Homo sapiens
agtttttgctgaag

SEQ ID NO: 195306 - DNA, 15 bp, Homo sapiens
agtttttgctgaagg

SEQ ID NO: 195307 - DNA, 19 bp, Homo sapiens
agttttttgccactgcaaa

SEQ ID NO: 195308 - DNA, 20 bp, Homo sapiens
ataaaaaaaaaaggatgaaa

SEQ ID NO: 195309 - DNA, 15 bp, Homo sapiens
ataaaaaacaagaaa

SEQ ID NO: 195310 - DNA, 18 bp, Homo sapiens
ataaaaaagaaaacattc

SEQ ID NO: 195311 - DNA, 15 bp, Homo sapiens
ataaaaaagatccca

SEQ ID NO: 195312 - DNA, 16 bp, Homo sapiens
ataaaaaagatcccaa

SEQ ID NO: 195313 - DNA, 17 bp, Homo sapiens
ataaaaaagatcccaaa

SEQ ID NO: 195314 - DNA, 12 bp, Homo sapiens
ataaaaaatgga

SEQ ID NO: 195315 - DNA, 14 bp, Homo sapiens
ataaaaataaaaaa

SEQ ID NO: 195316 - DNA, 19 bp, Homo sapiens
ataaaaataaaaaagatcc

SEQ ID NO: 195317 - DNA, 22 bp, Homo sapiens
ataaaaataaatttggttctaa

SEQ ID NO: 195318 - DNA, 16 bp, Homo sapiens
ataaaaataattaaaa

SEQ ID NO: 195319 - DNA, 12 bp, Homo sapiens
ataaaaatggat

SEQ ID NO: 195320 - DNA, 13 bp, Homo sapiens
ataaaacaagaat

SEQ ID NO: 195321 - DNA, 13 bp, Homo sapiens
ataaaacctttca

SEQ ID NO: 195322 - DNA, 18 bp, Homo sapiens
ataaaacgttatctcatt

SEQ ID NO: 195323 - DNA, 15 bp, Homo sapiens
ataaaactatttaaa

SEQ ID NO: 195324 - DNA, 12 bp, Homo sapiens
ataaaactgcac

SEQ ID NO: 195325 - DNA, 19 bp, Homo sapiens
ataaaactttatgtactgc

SEQ ID NO: 195326 - DNA, 16 bp, Homo sapiens
ataaaagcagcatctg

SEQ ID NO: 195327 - DNA, 20 bp, Homo sapiens
ataaaagcagcatctgctaa

SEQ ID NO: 195328 - DNA, 19 bp, Homo sapiens
ataaaagtgatattcctat

SEQ ID NO: 195329 - DNA, 17 bp, Homo sapiens
ataaaagtgatcaataa

SEQ ID NO: 195330 - DNA, 13 bp, Homo sapiens
ataaaagttaaca

SEQ ID NO: 195331 - DNA, 21 bp, Homo sapiens
ataaaataaacgaaacattta

SEQ ID NO: 195332 - DNA, 14 bp, Homo sapiens
ataaaataaagtat

SEQ ID NO: 195333 - DNA, 12 bp, Homo sapiens
ataaaataaata

SEQ ID NO: 195334 - DNA, 16 bp, Homo sapiens
ataaaataaatatact

SEQ ID NO: 195335 - DNA, 23 bp, Homo sapiens
ataaaataaatatactaataaaa

SEQ ID NO: 195336 - DNA, 11 bp, Homo sapiens
ataaaataagt

SEQ ID NO: 195337 - DNA, 17 bp, Homo sapiens
ataaaatactctagcct

SEQ ID NO: 195338 - DNA, 13 bp, Homo sapiens
ataaaatatcatt

SEQ ID NO: 195339 - DNA, 19 bp, Homo sapiens
ataaaatatcattcagcaa

SEQ ID NO: 195340 - DNA, 15 bp, Homo sapiens
ataaaatctgtattg

SEQ ID NO: 195341 - DNA, 23 bp, Homo sapiens
ataaaatcttcaactaatttttg

SEQ ID NO: 195342 - DNA, 19 bp, Homo sapiens
ataaaatgaggacatgttt

SEQ ID NO: 195343 - DNA, 15 bp, Homo sapiens
ataaaatgaggcagt

SEQ ID NO: 195344 - DNA, 15 bp, Homo sapiens
ataaaatgatgtatg

SEQ ID NO: 195345 - DNA, 15 bp, Homo sapiens
ataaaatgcatttaa

SEQ ID NO: 195346 - DNA, 16 bp, Homo sapiens
ataaaatgtattcaag

SEQ ID NO: 195347 - DNA, 11 bp, Homo sapiens
ataaaattgta

SEQ ID NO: 195348 - DNA, 21 bp, Homo sapiens
ataaaattgtaaaattgtata

SEQ ID NO: 195349 - DNA, 16 bp, Homo sapiens
ataaaatttaaaaaac

SEQ ID NO: 195350 - DNA, 19 bp, Homo sapiens
ataaacaacttaatgttct

SEQ ID NO: 195351 - DNA, 14 bp, Homo sapiens
ataaacaatccaaa

SEQ ID NO: 195352 - DNA, 20 bp, Homo sapiens
ataaacacatagattcacct

SEQ ID NO: 195353 - DNA, 22 bp, Homo sapiens
ataaacacattgaatgcgcttt

SEQ ID NO: 195354 - DNA, 22 bp, Homo sapiens
ataaacagcttcatgcctttgt

SEQ ID NO: 195355 - DNA, 16 bp, Homo sapiens
ataaacatcacacaca

SEQ ID NO: 195356 - DNA, 17 bp, Homo sapiens
ataaacatcacacacac

SEQ ID NO: 195357 - DNA, 16 bp, Homo sapiens
ataaacattaaaagaa

SEQ ID NO: 195358 - DNA, 20 bp, Homo sapiens
ataaacattaaaagaagact

SEQ ID NO: 195359 - DNA, 17 bp, Homo sapiens
ataaacattaaacactg

SEQ ID NO: 195360 - DNA, 15 bp, Homo sapiens
ataaaccaataaatc

SEQ ID NO: 195361 - DNA, 15 bp, Homo sapiens
ataaacccatctgta

SEQ ID NO: 195362 - DNA, 18 bp, Homo sapiens
ataaacccatctgtaata

SEQ ID NO: 195363 - DNA, 16 bp, Homo sapiens
ataaacctcaaaatgt

SEQ ID NO: 195364 - DNA, 14 bp, Homo sapiens
ataaaccttaaatg

SEQ ID NO: 195365 - DNA, 22 bp, Homo sapiens
ataaacgaaacatttagacaat

SEQ ID NO: 195366 - DNA, 14 bp, Homo sapiens
ataaactagatctc

SEQ ID NO: 195367 - DNA, 12 bp, Homo sapiens
ataaactgaaaa

SEQ ID NO: 195368 - DNA, 12 bp, Homo sapiens
ataaactgactt

SEQ ID NO: 195369 - DNA, 10 bp, Homo sapiens
ataaactgtg

SEQ ID NO: 195370 - DNA, 21 bp, Homo sapiens
atacattccatcacagccagc

SEQ ID NO: 195371 - DNA, 13 bp, Homo sapiens
atacattcctgag

SEQ ID NO: 195372 - DNA, 17 bp, Homo sapiens
atacattcctgagattc

SEQ ID NO: 195373 - DNA, 20 bp, Homo sapiens
atacattcctgagattctgg

SEQ ID NO: 195374 - DNA, 15 bp, Homo sapiens
atacatttaaaactt

SEQ ID NO: 195375 - DNA, 22 bp, Homo sapiens
atacatttatcttctgtttttc

SEQ ID NO: 195376 - DNA, 16 bp, Homo sapiens
atacatttgataaagt

SEQ ID NO: 195377 - DNA, 21 bp, Homo sapiens
atacattttatatctggattt

SEQ ID NO: 195378 - DNA, 19 bp, Homo sapiens
ataccaccaccaagaaagc

SEQ ID NO: 195379 - DNA, 16 bp, Homo sapiens
ataccagactgcaggt

SEQ ID NO: 195380 - DNA, 12 bp, Homo sapiens
ataccagagacc

SEQ ID NO: 195381 - DNA, 19 bp, Homo sapiens
ataccagagacctgaggca

SEQ ID NO: 195382 - DNA, 13 bp, Homo sapiens
ataccagcaaaag

SEQ ID NO: 195383 - DNA, 17 bp, Homo sapiens
ataccaggccgccccag

SEQ ID NO: 195384 - DNA, 19 bp, Homo sapiens
ataccaggttacctcactt

SEQ ID NO: 195385 - DNA, 16 bp, Homo sapiens
ataccaggttgaaaga

SEQ ID NO: 195386 - DNA, 15 bp, Homo sapiens
ataccatgtctctaa

SEQ ID NO: 195387 - DNA, 18 bp, Homo sapiens
ataccattaaaactgctt

SEQ ID NO: 195388 - DNA, 19 bp, Homo sapiens
ataccattaaaactgcttt

SEQ ID NO: 195389 - DNA, 13 bp, Homo sapiens
atacccagagaga

SEQ ID NO: 195390 - DNA, 15 bp, Homo sapiens
ataccccatttgatt

SEQ ID NO: 195391 - DNA, 21 bp, Homo sapiens
atacccccgtcggaatggtaa

SEQ ID NO: 195392 - DNA, 16 bp, Homo sapiens
ataccccctgccccag

SEQ ID NO: 195393 - DNA, 21 bp, Homo sapiens
ataccccctgccccagagaag

SEQ ID NO: 195394 - DNA, 15 bp, Homo sapiens
atacccctcatcaca

SEQ ID NO: 195395 - DNA, 23 bp, Homo sapiens
ataccctaggtctccacccctca

SEQ ID NO: 195396 - DNA, 12 bp, Homo sapiens
ataccctccccc

SEQ ID NO: 195397 - DNA, 18 bp, Homo sapiens
atacctccattaaatggt

SEQ ID NO: 195398 - DNA, 16 bp, Homo sapiens
atacctctaataacct

SEQ ID NO: 195399 - DNA, 14 bp, Homo sapiens
atacctctctctat

SEQ ID NO: 195400 - DNA, 17 bp, Homo sapiens
atacctctttgaaagaa

SEQ ID NO: 195401 - DNA, 16 bp, Homo sapiens
ataccttaattctttg

SEQ ID NO: 195402 - DNA, 19 bp, Homo sapiens
atacctttaaatatcattc

SEQ ID NO: 195403 - DNA, 16 bp, Homo sapiens
atacgcactacatgtg

SEQ ID NO: 195404 - DNA, 23 bp, Homo sapiens
atacgtgtgtgtgtgtgtatgtg

SEQ ID NO: 195405 - DNA, 20 bp, Homo sapiens
atactaaatatgaaatttta

SEQ ID NO: 195406 - DNA, 13 bp, Homo sapiens
atactaataaaaa

SEQ ID NO: 195407 - DNA, 14 bp, Homo sapiens
atactaataaaaag

SEQ ID NO: 195408 - DNA, 18 bp, Homo sapiens
atactaataaaaaggttt

SEQ ID NO: 195409 - DNA, 19 bp, Homo sapiens
atactaataaaaaggttta

SEQ ID NO: 195410 - DNA, 20 bp, Homo sapiens
atactaggttaacatttgta

SEQ ID NO: 195411 - DNA, 17 bp, Homo sapiens
atactatgaaataaaaa

SEQ ID NO: 195412 - DNA, 16 bp, Homo sapiens
atactatttattaaaa

SEQ ID NO: 195413 - DNA, 17 bp, Homo sapiens
atactatttattaaaac

SEQ ID NO: 195414 - DNA, 21 bp, Homo sapiens
atactcagggattccttctaa

SEQ ID NO: 195415 - DNA, 17 bp, Homo sapiens
atactcctccaaggtta

SEQ ID NO: 195416 - DNA, 12 bp, Homo sapiens
atactctccagg

SEQ ID NO: 195417 - DNA, 20 bp, Homo sapiens
atactctgtgtaatctctga

SEQ ID NO: 195418 - DNA, 14 bp, Homo sapiens
atactctgttgcct

SEQ ID NO: 195419 - DNA, 19 bp, Homo sapiens
atactcttaggaagagaaa

SEQ ID NO: 195420 - DNA, 21 bp, Homo sapiens
atactcttaggaagagaaacc

SEQ ID NO: 195421 - DNA, 22 bp, Homo sapiens
atactcttaggaagagaaacca

SEQ ID NO: 195422 - DNA, 15 bp, Homo sapiens
atactgaaacatttg

SEQ ID NO: 195423 - DNA, 14 bp, Homo sapiens
atactgaagtcttt

SEQ ID NO: 195424 - DNA, 16 bp, Homo sapiens
atactgaatttctttg

SEQ ID NO: 195425 - DNA, 19 bp, Homo sapiens
atactgaatttctttgatt

SEQ ID NO: 195426 - DNA, 22 bp, Homo sapiens
atactgagggaccaactgggcc

SEQ ID NO: 195427 - DNA, 14 bp, Homo sapiens
atactgatgagaca

SEQ ID NO: 195428 - DNA, 20 bp, Homo sapiens
atactgatgagacaacacac

SEQ ID NO: 195429 - DNA, 21 bp, Homo sapiens
atactgcatatcctggtgtct

SEQ ID NO: 195430 - DNA, 14 bp, Homo sapiens
atactgctgatgct

SEQ ID NO: 195431 - DNA, 16 bp, Homo sapiens
atactggaaataacct

SEQ ID NO: 195432 - DNA, 22 bp, Homo sapiens
atactggaaataacctgtgaat

SEQ ID NO: 195433 - DNA, 16 bp, Homo sapiens
atactgggttcttgtt

SEQ ID NO: 195434 - DNA, 21 bp, Homo sapiens
atactggttatagttgatatg

SEQ ID NO: 195435 - DNA, 22 bp, Homo sapiens
atactggttatcctgtgctaca

SEQ ID NO: 195436 - DNA, 23 bp, Homo sapiens
atactggttatcctgtgctacag

SEQ ID NO: 195437 - DNA, 15 bp, Homo sapiens
atactgtcatataat

SEQ ID NO: 195438 - DNA, 21 bp, Homo sapiens
atactgtcggttttttttaaa

SEQ ID NO: 195439 - DNA, 21 bp, Homo sapiens
atactgtgtcatggtgatgca

SEQ ID NO: 195440 - DNA, 13 bp, Homo sapiens
atactgtttgtaa

SEQ ID NO: 195441 - DNA, 19 bp, Homo sapiens
atactgtttgtaatataca

SEQ ID NO: 195442 - DNA, 22 bp, Homo sapiens
atacttaataaatctgccattt

SEQ ID NO: 195443 - DNA, 15 bp, Homo sapiens
atacttatatttccc

SEQ ID NO: 195444 - DNA, 17 bp, Homo sapiens
atacttatgttgtattg

SEQ ID NO: 195445 - DNA, 16 bp, Homo sapiens
atacttgaatattata

SEQ ID NO: 195446 - DNA, 18 bp, Homo sapiens
atacttgacaacattttt

SEQ ID NO: 195447 - DNA, 12 bp, Homo sapiens
atacttgatgca

SEQ ID NO: 195448 - DNA, 17 bp, Homo sapiens
atacttgttccagatgg

SEQ ID NO: 195449 - DNA, 12 bp, Homo sapiens
atactttacatg

SEQ ID NO: 195450 - DNA, 20 bp, Homo sapiens
atactttctgagatggtggt

SEQ ID NO: 195451 - DNA, 14 bp, Homo sapiens
atactttgtgtctt

SEQ ID NO: 195452 - DNA, 23 bp, Homo sapiens
atactttgtgtcttttgttctct

SEQ ID NO: 195453 - DNA, 23 bp, Homo sapiens
atacttttgataatagataactg

SEQ ID NO: 195454 - DNA, 23 bp, Homo sapiens
atacttttgatatgattgtaaca

SEQ ID NO: 195455 - DNA, 13 bp, Homo sapiens
atacttttgtgta

SEQ ID NO: 195456 - DNA, 18 bp, Homo sapiens
atacttttgtgtattctg

SEQ ID NO: 195457 - DNA, 20 bp, Homo sapiens
atacttttgtgtattctgtg

SEQ ID NO: 195458 - DNA, 13 bp, Homo sapiens
atacttttttcta

SEQ ID NO: 195459 - DNA, 14 bp, Homo sapiens
atactttttttcac

SEQ ID NO: 195460 - DNA, 23 bp, Homo sapiens
atagaaaacaggaaaaaaacttt

SEQ ID NO: 195461 - DNA, 21 bp, Homo sapiens
atagaactcagttttaactag

SEQ ID NO: 195462 - DNA, 21 bp, Homo sapiens
atagaactgtcccacaaaata

SEQ ID NO: 195463 - DNA, 22 bp, Homo sapiens
atagaactgtcccacaaaatat

SEQ ID NO: 195464 - DNA, 21 bp, Homo sapiens
atagaatacttttttctagtt

SEQ ID NO: 195465 - DNA, 19 bp, Homo sapiens
atagaatataattatcgga

SEQ ID NO: 195466 - DNA, 20 bp, Homo sapiens
atagaatttcctaatgagat

SEQ ID NO: 195467 - DNA, 13 bp, Homo sapiens
atagaatttttaa

SEQ ID NO: 195468 - DNA, 15 bp, Homo sapiens
atagacaaaggcctt

SEQ ID NO: 195469 - DNA, 15 bp, Homo sapiens
atagacttatatgca

SEQ ID NO: 195470 - DNA, 17 bp, Homo sapiens
atagacttcgaaaacag

SEQ ID NO: 195471 - DNA, 19 bp, Homo sapiens
atagacttcgaaaacagat

SEQ ID NO: 195472 - DNA, 23 bp, Homo sapiens
atagagactgtagattgcttctg

SEQ ID NO: 195473 - DNA, 17 bp, Homo sapiens
atagagacttctaaatc

SEQ ID NO: 195474 - DNA, 19 bp, Homo sapiens
atagagatgagctttcttt

SEQ ID NO: 195475 - DNA, 15 bp, Homo sapiens
atagagcaaaattga

SEQ ID NO: 195476 - DNA, 16 bp, Homo sapiens
atagagcttttaaaaa

SEQ ID NO: 195477 - DNA, 18 bp, Homo sapiens
atagagcttttaaaaatg

SEQ ID NO: 195478 - DNA, 14 bp, Homo sapiens
atagagtatatgca

SEQ ID NO: 195479 - DNA, 15 bp, Homo sapiens
atagagtatatgcac

SEQ ID NO: 195480 - DNA, 14 bp, Homo sapiens
atagagtgtactta

SEQ ID NO: 195481 - DNA, 19 bp, Homo sapiens
atagagtgtacttaactat

SEQ ID NO: 195482 - DNA, 21 bp, Homo sapiens
atagagtgtacttaactattc

SEQ ID NO: 195483 - DNA, 13 bp, Homo sapiens
atagataattatc

SEQ ID NO: 195484 - DNA, 20 bp, Homo sapiens
atagataccattttgaaata

SEQ ID NO: 195485 - DNA, 22 bp, Homo sapiens
atagataccattttgaaatatt

SEQ ID NO: 195486 - DNA, 16 bp, Homo sapiens
atagatacttttgata

SEQ ID NO: 195487 - DNA, 13 bp, Homo sapiens
atagatcttctga

SEQ ID NO: 195488 - DNA, 16 bp, Homo sapiens
atagatgaacttttta

SEQ ID NO: 195489 - DNA, 23 bp, Homo sapiens
atagatgaactttttaacaaatg

SEQ ID NO: 195490 - DNA, 15 bp, Homo sapiens
atagatgagtcctgt

SEQ ID NO: 195491 - DNA, 16 bp, Homo sapiens
atagatgcaagatatt

SEQ ID NO: 195492 - DNA, 21 bp, Homo sapiens
atagatgcaagatatttatat

SEQ ID NO: 195493 - DNA, 14 bp, Homo sapiens
atagatgccctgct

SEQ ID NO: 195494 - DNA, 23 bp, Homo sapiens
atagatgtccctttcttggccag

SEQ ID NO: 195495 - DNA, 14 bp, Homo sapiens
atagattaaaggaa

SEQ ID NO: 195496 - DNA, 21 bp, Homo sapiens
atagattcacctgtaaaactt

SEQ ID NO: 195497 - DNA, 23 bp, Homo sapiens
atagattggagccaccatgccca

SEQ ID NO: 195498 - DNA, 13 bp, Homo sapiens
atagatttggaat

SEQ ID NO: 195499 - DNA, 18 bp, Homo sapiens
taaagctgcctgtagtta

SEQ ID NO: 195500 - DNA, 21 bp, Homo sapiens
taaagctgcctgtagttagga

SEQ ID NO: 195501 - DNA, 19 bp, Homo sapiens
taaagctggacaagaagct

SEQ ID NO: 195502 - DNA, 13 bp, Homo sapiens
taaagcttaaatt

SEQ ID NO: 195503 - DNA, 19 bp, Homo sapiens
taaagcttgcaacaaaatt

SEQ ID NO: 195504 - DNA, 23 bp, Homo sapiens
taaagcttgtggccccttttact

SEQ ID NO: 195505 - DNA, 17 bp, Homo sapiens
taaaggcagcaaccatt

SEQ ID NO: 195506 - DNA, 20 bp, Homo sapiens
taaaggcctcttccttgctg

SEQ ID NO: 195507 - DNA, 23 bp, Homo sapiens
taaaggcctggaaccagggagga

SEQ ID NO: 195508 - DNA, 19 bp, Homo sapiens
taaagggagccatgctctt

SEQ ID NO: 195509 - DNA, 21 bp, Homo sapiens
taaaggggacagatcttgagc

SEQ ID NO: 195510 - DNA, 15 bp, Homo sapiens
taaaggggggagggg

SEQ ID NO: 195511 - DNA, 21 bp, Homo sapiens
taaaggtcccttagccccgag

SEQ ID NO: 195512 - DNA, 21 bp, Homo sapiens
taaaggtggtgaggcaataaa

SEQ ID NO: 195513 - DNA, 20 bp, Homo sapiens
taaaggtttcgttgcatggt

SEQ ID NO: 195514 - DNA, 15 bp, Homo sapiens
taaagtaaagctaaa

SEQ ID NO: 195515 - DNA, 17 bp, Homo sapiens
taaagtaaatgctacct

SEQ ID NO: 195516 - DNA, 18 bp, Homo sapiens
taaagtacgtgtttactt

SEQ ID NO: 195517 - DNA, 15 bp, Homo sapiens
taaagtactactgta

SEQ ID NO: 195518 - DNA, 19 bp, Homo sapiens
taaagtactactgtagaac

SEQ ID NO: 195519 - DNA, 19 bp, Homo sapiens
taaagtatatatagaatct

SEQ ID NO: 195520 - DNA, 14 bp, Homo sapiens
taaagtatcatgca

SEQ ID NO: 195521 - DNA, 16 bp, Homo sapiens
taaagtatcatgcatt

SEQ ID NO: 195522 - DNA, 15 bp, Homo sapiens
taaagtatgtaaaca

SEQ ID NO: 195523 - DNA, 21 bp, Homo sapiens
taaagtatgtaaagtatgtaa

SEQ ID NO: 195524 - DNA, 22 bp, Homo sapiens
taaagtatgtaaagtatgtaaa

SEQ ID NO: 195525 - DNA, 15 bp, Homo sapiens
taaagtgaccaggct

SEQ ID NO: 195526 - DNA, 20 bp, Homo sapiens
taaagtgttggtctttctaa

SEQ ID NO: 195527 - DNA, 15 bp, Homo sapiens
taaagttaattcatt

SEQ ID NO: 195528 - DNA, 16 bp, Homo sapiens
taaagttaattcatta

SEQ ID NO: 195529 - DNA, 12 bp, Homo sapiens
taaagtttaaat

SEQ ID NO: 195530 - DNA, 17 bp, Homo sapiens
taaagtttaaataccag

SEQ ID NO: 195531 - DNA, 17 bp, Homo sapiens
taaagtttacagtaaat

SEQ ID NO: 195532 - DNA, 14 bp, Homo sapiens
taaagttttagggt

SEQ ID NO: 195533 - DNA, 13 bp, Homo sapiens
taaataaaaatag

SEQ ID NO: 195534 - DNA, 15 bp, Homo sapiens
taaataaaagcagca

SEQ ID NO: 195535 - DNA, 19 bp, Homo sapiens
taaataaaagtgatcaata

SEQ ID NO: 195536 - DNA, 17 bp, Homo sapiens
taaataaaattcatttc

SEQ ID NO: 195537 - DNA, 14 bp, Homo sapiens
taaataaagaagaa

SEQ ID NO: 195538 - DNA, 20 bp, Homo sapiens
taaataaagtatcatgcatt

SEQ ID NO: 195539 - DNA, 23 bp, Homo sapiens
taaataaccaattcctcatttgt

SEQ ID NO: 195540 - DNA, 14 bp, Homo sapiens
taaatacagacact

SEQ ID NO: 195541 - DNA, 15 bp, Homo sapiens
taaatacagacacta

SEQ ID NO: 195542 - DNA, 17 bp, Homo sapiens
taaatacagacactaag

SEQ ID NO: 195543 - DNA, 19 bp, Homo sapiens
taaatacagacactaagtt

SEQ ID NO: 195544 - DNA, 16 bp, Homo sapiens
taaatactaaatatga

SEQ ID NO: 195545 - DNA, 17 bp, Homo sapiens
taaatactttaacttcc

SEQ ID NO: 195546 - DNA, 13 bp, Homo sapiens
taaatagaacttg

SEQ ID NO: 195547 - DNA, 15 bp, Homo sapiens
taaatagatactttt

SEQ ID NO: 195548 - DNA, 16 bp, Homo sapiens
taaatagcatctgctc

SEQ ID NO: 195549 - DNA, 17 bp, Homo sapiens
taaatagcatctgctct

SEQ ID NO: 195550 - DNA, 19 bp, Homo sapiens
taaatagctatatccatgt

SEQ ID NO: 195551 - DNA, 22 bp, Homo sapiens
taaatagctatatccatgtact

SEQ ID NO: 195552 - DNA, 17 bp, Homo sapiens
taaatataaatgtttaa

SEQ ID NO: 195553 - DNA, 13 bp, Homo sapiens
taaatataattct

SEQ ID NO: 195554 - DNA, 18 bp, Homo sapiens
taaatataattctgtaaa

SEQ ID NO: 195555 - DNA, 13 bp, Homo sapiens
taaatatactaat

SEQ ID NO: 195556 - DNA, 16 bp, Homo sapiens
taaatatactaataaa

SEQ ID NO: 195557 - DNA, 22 bp, Homo sapiens
taaatatactaataaaaaggtt

SEQ ID NO: 195558 - DNA, 15 bp, Homo sapiens
taaatatatgtatgt

SEQ ID NO: 195559 - DNA, 17 bp, Homo sapiens
taaatatatgttttgag

SEQ ID NO: 195560 - DNA, 21 bp, Homo sapiens
taaatatatgttttgagaaaa

SEQ ID NO: 195561 - DNA, 14 bp, Homo sapiens
taaatatattgtat

SEQ ID NO: 195562 - DNA, 17 bp, Homo sapiens
taaatatatttaagata

SEQ ID NO: 195563 - DNA, 15 bp, Homo sapiens
taaatatattttcaa

SEQ ID NO: 195564 - DNA, 14 bp, Homo sapiens
taaatatgaaatga

SEQ ID NO: 195565 - DNA, 18 bp, Homo sapiens
taaatattatgattttat

SEQ ID NO: 195566 - DNA, 19 bp, Homo sapiens
taaatattctatatgaatt

SEQ ID NO: 195567 - DNA, 23 bp, Homo sapiens
taaatattcttgtccacattcta

SEQ ID NO: 195568 - DNA, 16 bp, Homo sapiens
taaatatttatgtaga

SEQ ID NO: 195569 - DNA, 17 bp, Homo sapiens
taaatatttttccctcc

SEQ ID NO: 195570 - DNA, 18 bp, Homo sapiens
taaatatttttccctccg

SEQ ID NO: 195571 - DNA, 22 bp, Homo sapiens
taaatcaattctgatacagcct

SEQ ID NO: 195572 - DNA, 22 bp, Homo sapiens
taaatcatgttaatcctagctg

SEQ ID NO: 195573 - DNA, 15 bp, Homo sapiens
taaatcatgttttga

SEQ ID NO: 195574 - DNA, 23 bp, Homo sapiens
taaatcatttcagtatcatctcc

SEQ ID NO: 195575 - DNA, 13 bp, Homo sapiens
taaatcatttcat

SEQ ID NO: 195576 - DNA, 14 bp, Homo sapiens
taaatccaaagtaa

SEQ ID NO: 195577 - DNA, 15 bp, Homo sapiens
taaatccattttcta

SEQ ID NO: 195578 - DNA, 16 bp, Homo sapiens
taaatccattttctaa

SEQ ID NO: 195579 - DNA, 17 bp, Homo sapiens
taaatccattttctaaa

SEQ ID NO: 195580 - DNA, 18 bp, Homo sapiens
taaatcctagacttgaaa

SEQ ID NO: 195581 - DNA, 17 bp, Homo sapiens
taaatcctttactgtta

SEQ ID NO: 195582 - DNA, 21 bp, Homo sapiens
taaatctaaattaacttctat

SEQ ID NO: 195583 - DNA, 14 bp, Homo sapiens
taaatctctaatat

SEQ ID NO: 195584 - DNA, 16 bp, Homo sapiens
taaatctgccatttca

SEQ ID NO: 195585 - DNA, 18 bp, Homo sapiens
taaatctgtctgattcta

SEQ ID NO: 195586 - DNA, 12 bp, Homo sapiens
taaatctgtgat

SEQ ID NO: 195587 - DNA, 20 bp, Homo sapiens
taaatctgttgccaagctgg

SEQ ID NO: 195588 - DNA, 15 bp, Homo sapiens
taaatgaaatacttg

SEQ ID NO: 195589 - DNA, 15 bp, Homo sapiens
taaatgaaattgtaa

SEQ ID NO: 195590 - DNA, 20 bp, Homo sapiens
taaatgaagtttatacagta

SEQ ID NO: 195591 - DNA, 15 bp, Homo sapiens
taaatgaatgaaata

SEQ ID NO: 195592 - DNA, 22 bp, Homo sapiens
taaatgaatgaaatataaactg

SEQ ID NO: 195593 - DNA, 13 bp, Homo sapiens
taaatgaatgttt

SEQ ID NO: 195594 - DNA, 12 bp, Homo sapiens
taaatgaccagt

SEQ ID NO: 195595 - DNA, 17 bp, Homo sapiens
taaatgaggggcctcag

SEQ ID NO: 195596 - DNA, 13 bp, Homo sapiens
taaatgattccaa

SEQ ID NO: 195597 - DNA, 15 bp, Homo sapiens
taaatgattccaaat

SEQ ID NO: 195598 - DNA, 16 bp, Homo sapiens
taaatgattccaaata

SEQ ID NO: 195599 - DNA, 18 bp, Homo sapiens
taaatgattccaaataaa

SEQ ID NO: 195600 - DNA, 16 bp, Homo sapiens
taaatgcaaattaaag

SEQ ID NO: 195601 - DNA, 16 bp, Homo sapiens
taaatgcagttttaag

SEQ ID NO: 195602 - DNA, 20 bp, Homo sapiens
taaatgcatatcctgagcca

SEQ ID NO: 195603 - DNA, 14 bp, Homo sapiens
taaatggaataatt

SEQ ID NO: 195604 - DNA, 17 bp, Homo sapiens
taaatggaattattttg

SEQ ID NO: 195605 - DNA, 22 bp, Homo sapiens
taaatggaattattttgaatgt

SEQ ID NO: 195606 - DNA, 15 bp, Homo sapiens
taaatggacttgctt

SEQ ID NO: 195607 - DNA, 15 bp, Homo sapiens
taaatggagcttgta

SEQ ID NO: 195608 - DNA, 15 bp, Homo sapiens
taaatggcacctgta

SEQ ID NO: 195609 - DNA, 20 bp, Homo sapiens
taaatgggtgaaaaatggta

SEQ ID NO: 195610 - DNA, 18 bp, Homo sapiens
taaatggtgagaattaaa

SEQ ID NO: 195611 - DNA, 23 bp, Homo sapiens
taaatggtgagaattaaaataaa

SEQ ID NO: 195612 - DNA, 16 bp, Homo sapiens
taaatggtgatttctt

SEQ ID NO: 195613 - DNA, 17 bp, Homo sapiens
taaatggtgatttcttg

SEQ ID NO: 195614 - DNA, 20 bp, Homo sapiens
taaatggtgatttcttgcta

SEQ ID NO: 195615 - DNA, 13 bp, Homo sapiens
taaatgtaaaaat

SEQ ID NO: 195616 - DNA, 13 bp, Homo sapiens
taaatgtactaca

SEQ ID NO: 195617 - DNA, 20 bp, Homo sapiens
taaatgtactacatttgcat

SEQ ID NO: 195618 - DNA, 12 bp, Homo sapiens
taaatgtgtggt

SEQ ID NO: 195619 - DNA, 22 bp, Homo sapiens
taaatgtgtggtgctaactgta

SEQ ID NO: 195620 - DNA, 18 bp, Homo sapiens
taaatgttctaacagatc

SEQ ID NO: 195621 - DNA, 20 bp, Homo sapiens
taaatgtttttattaacaat

SEQ ID NO: 195622 - DNA, 13 bp, Homo sapiens
taaattaaatata

SEQ ID NO: 195623 - DNA, 21 bp, Homo sapiens
taaattaaatatatgtatgta

SEQ ID NO: 195624 - DNA, 21 bp, Homo sapiens
taaattaatgagttttatcca

SEQ ID NO: 195625 - DNA, 17 bp, Homo sapiens
taaattaggaataaata

SEQ ID NO: 195626 - DNA, 21 bp, Homo sapiens
taaattaggaataaataaaaa

SEQ ID NO: 195627 - DNA, 22 bp, Homo sapiens
taaattaggaataaataaaaat

SEQ ID NO: 195628 - DNA, 17 bp, Homo sapiens
taaattataaggactgc

SEQ ID NO: 195629 - DNA, 14 bp, Homo sapiens
taagattgtacata

SEQ ID NO: 195630 - DNA, 19 bp, Homo sapiens
taagatttaattgtaattg

SEQ ID NO: 195631 - DNA, 14 bp, Homo sapiens
taagattttacaaa

SEQ ID NO: 195632 - DNA, 16 bp, Homo sapiens
taagcaacatgaatta

SEQ ID NO: 195633 - DNA, 16 bp, Homo sapiens
taagcactacataaac

SEQ ID NO: 195634 - DNA, 15 bp, Homo sapiens
taagcactttgaaaa

SEQ ID NO: 195635 - DNA, 18 bp, Homo sapiens
taagcagagttctttgca

SEQ ID NO: 195636 - DNA, 17 bp, Homo sapiens
taagcagcctttctgtg

SEQ ID NO: 195637 - DNA, 20 bp, Homo sapiens
taagcagcctttctgtggag

SEQ ID NO: 195638 - DNA, 17 bp, Homo sapiens
taagcagctaaattttc

SEQ ID NO: 195639 - DNA, 15 bp, Homo sapiens
taagcattgtttgct

SEQ ID NO: 195640 - DNA, 17 bp, Homo sapiens
taagcattgtttgctta

SEQ ID NO: 195641 - DNA, 18 bp, Homo sapiens
taagcattgtttgcttat

SEQ ID NO: 195642 - DNA, 19 bp, Homo sapiens
taagcattgtttgcttatt

SEQ ID NO: 195643 - DNA, 20 bp, Homo sapiens
taagccaagaagtgaggcct

SEQ ID NO: 195644 - DNA, 20 bp, Homo sapiens
taagccaatgaagcaaacac

SEQ ID NO: 195645 - DNA, 23 bp, Homo sapiens
taagccactcccgccacacgctc

SEQ ID NO: 195646 - DNA, 20 bp, Homo sapiens
taagccatatgacaatttca

SEQ ID NO: 195647 - DNA, 22 bp, Homo sapiens
taagccatatgacaatttcaaa

SEQ ID NO: 195648 - DNA, 11 bp, Homo sapiens
taagccctgtc

SEQ ID NO: 195649 - DNA, 15 bp, Homo sapiens
taagctatgtcacta

SEQ ID NO: 195650 - DNA, 19 bp, Homo sapiens
taagctccaggtgccctgt

SEQ ID NO: 195651 - DNA, 22 bp, Homo sapiens
taagctccaggtgccctgtggg

SEQ ID NO: 195652 - DNA, 18 bp, Homo sapiens
taagctccttcagtttga

SEQ ID NO: 195653 - DNA, 19 bp, Homo sapiens
taagctctatctgcaatgt

SEQ ID NO: 195654 - DNA, 14 bp, Homo sapiens
taagctctttgaaa

SEQ ID NO: 195655 - DNA, 21 bp, Homo sapiens
taagctctttgaaacaacttt

SEQ ID NO: 195656 - DNA, 15 bp, Homo sapiens
taagctctttgagaa

SEQ ID NO: 195657 - DNA, 16 bp, Homo sapiens
taagctctttgagaac

SEQ ID NO: 195658 - DNA, 15 bp, Homo sapiens
taagctgaataaagt

SEQ ID NO: 195659 - DNA, 13 bp, Homo sapiens
taagctgctgaat

SEQ ID NO: 195660 - DNA, 12 bp, Homo sapiens
taagctgctttt

SEQ ID NO: 195661 - DNA, 21 bp, Homo sapiens
taaggaaagcaataaatgaat

SEQ ID NO: 195662 - DNA, 16 bp, Homo sapiens
taaggaaatccagccc

SEQ ID NO: 195663 - DNA, 23 bp, Homo sapiens
taaggaaatccagccccatagaa

SEQ ID NO: 195664 - DNA, 16 bp, Homo sapiens
taaggaaccctggaaa

SEQ ID NO: 195665 - DNA, 18 bp, Homo sapiens
taaggaaccctggaaact

SEQ ID NO: 195666 - DNA, 23 bp, Homo sapiens
taaggaagaataaaaaagaagag

SEQ ID NO: 195667 - DNA, 19 bp, Homo sapiens
taaggaatgtagctggttt

SEQ ID NO: 195668 - DNA, 22 bp, Homo sapiens
taaggacttgtgcctcttggga

SEQ ID NO: 195669 - DNA, 16 bp, Homo sapiens
taaggatagcctttgt

SEQ ID NO: 195670 - DNA, 16 bp, Homo sapiens
taaggatctctcagga

SEQ ID NO: 195671 - DNA, 16 bp, Homo sapiens
taaggatgagcagcag

SEQ ID NO: 195672 - DNA, 19 bp, Homo sapiens
taaggcaactgaacaaaaa

SEQ ID NO: 195673 - DNA, 16 bp, Homo sapiens
taaggcatatacaaat

SEQ ID NO: 195674 - DNA, 18 bp, Homo sapiens
taaggcatgctcccagca

SEQ ID NO: 195675 - DNA, 20 bp, Homo sapiens
taaggccaaggcctcaggag

SEQ ID NO: 195676 - DNA, 20 bp, Homo sapiens
taaggccgaagaagggtcct

SEQ ID NO: 195677 - DNA, 16 bp, Homo sapiens
taaggcctcttgctgg

SEQ ID NO: 195678 - DNA, 12 bp, Homo sapiens
taaggcctgccc

SEQ ID NO: 195679 - DNA, 13 bp, Homo sapiens
taaggggcaggaa

SEQ ID NO: 195680 - DNA, 20 bp, Homo sapiens
taaggtaccaagatcacaaa

SEQ ID NO: 195681 - DNA, 22 bp, Homo sapiens
taaggtcagtgttataaaatct

SEQ ID NO: 195682 - DNA, 21 bp, Homo sapiens
taaggtctgggagtgttctgt

SEQ ID NO: 195683 - DNA, 17 bp, Homo sapiens
taaggtgagttctcact

SEQ ID NO: 195684 - DNA, 16 bp, Homo sapiens
taaggttctcatagga

SEQ ID NO: 195685 - DNA, 23 bp, Homo sapiens
taaggtttgttttccatccattc

SEQ ID NO: 195686 - DNA, 13 bp, Homo sapiens
taagtaaatgcta

SEQ ID NO: 195687 - DNA, 14 bp, Homo sapiens
taagtaaatgtctg

SEQ ID NO: 195688 - DNA, 22 bp, Homo sapiens
taagtaaattagtaatgtacta

SEQ ID NO: 195689 - DNA, 22 bp, Homo sapiens
taagtaacctctacaggcattt

SEQ ID NO: 195690 - DNA, 21 bp, Homo sapiens
taagtagactttaattcttct

SEQ ID NO: 195691 - DNA, 14 bp, Homo sapiens
taagtataacaaac

SEQ ID NO: 195692 - DNA, 14 bp, Homo sapiens
taagtatacagttc

SEQ ID NO: 195693 - DNA, 14 bp, Homo sapiens
taagtatcagaaag

SEQ ID NO: 195694 - DNA, 20 bp, Homo sapiens
taagtatgtgtaaaatgtga

SEQ ID NO: 195695 - DNA, 20 bp, Homo sapiens
taagtattccttggcccagc

SEQ ID NO: 195696 - DNA, 10 bp, Homo sapiens
taagtattta

SEQ ID NO: 195697 - DNA, 19 bp, Homo sapiens
taagtatttatatatttat

SEQ ID NO: 195698 - DNA, 23 bp, Homo sapiens
taagtatttatatatttataact

SEQ ID NO: 195699 - DNA, 19 bp, Homo sapiens
taagtatttcagatgcttt

SEQ ID NO: 195700 - DNA, 21 bp, Homo sapiens
taagtcagtttcacatatttg

SEQ ID NO: 195701 - DNA, 15 bp, Homo sapiens
taagtccctgccccc

SEQ ID NO: 195702 - DNA, 17 bp, Homo sapiens
taagtccctgccccctc

SEQ ID NO: 195703 - DNA, 22 bp, Homo sapiens
taagtccctgccccctcccctt

SEQ ID NO: 195704 - DNA, 15 bp, Homo sapiens
taagtcgctgaacaa

SEQ ID NO: 195705 - DNA, 18 bp, Homo sapiens
taagtctaaatatttcct

SEQ ID NO: 195706 - DNA, 16 bp, Homo sapiens
taagtcttacaggaag

SEQ ID NO: 195707 - DNA, 15 bp, Homo sapiens
taagtgacatagata

SEQ ID NO: 195708 - DNA, 17 bp, Homo sapiens
taagtgagtttttaatg

SEQ ID NO: 195709 - DNA, 10 bp, Homo sapiens
taagtgccca

SEQ ID NO: 195710 - DNA, 15 bp, Homo sapiens
taagtgcccaaagtg

SEQ ID NO: 195711 - DNA, 15 bp, Homo sapiens
taagtgcctacatta

SEQ ID NO: 195712 - DNA, 19 bp, Homo sapiens
taagtgcttggttgaaaag

SEQ ID NO: 195713 - DNA, 13 bp, Homo sapiens
taagtgctttgta

SEQ ID NO: 195714 - DNA, 12 bp, Homo sapiens
taagtggaaaaa

SEQ ID NO: 195715 - DNA, 13 bp, Homo sapiens
taagtggaaaaaa

SEQ ID NO: 195716 - DNA, 17 bp, Homo sapiens
taagtggaaaaaagaga

SEQ ID NO: 195717 - DNA, 22 bp, Homo sapiens
taagtggaaaaaagagaaaaac

SEQ ID NO: 195718 - DNA, 21 bp, Homo sapiens
taagtggaggaaatgttggaa

SEQ ID NO: 195719 - DNA, 21 bp, Homo sapiens
taagtggattggctttgtgct

SEQ ID NO: 195720 - DNA, 12 bp, Homo sapiens
taagtgtaaaaa

SEQ ID NO: 195721 - DNA, 21 bp, Homo sapiens
taagtgtttcgtaagacaaaa

SEQ ID NO: 195722 - DNA, 20 bp, Homo sapiens
taagttaaaggcagtccaga

SEQ ID NO: 195723 - DNA, 22 bp, Homo sapiens
taagttaaaggcagtccagagc

SEQ ID NO: 195724 - DNA, 18 bp, Homo sapiens
taagttataccagcaaaa

SEQ ID NO: 195725 - DNA, 12 bp, Homo sapiens
taagttcaccgt

SEQ ID NO: 195726 - DNA, 17 bp, Homo sapiens
taagttcatgtttgtaa

SEQ ID NO: 195727 - DNA, 18 bp, Homo sapiens
taagttcattaaacagaa

SEQ ID NO: 195728 - DNA, 17 bp, Homo sapiens
taagttcgaggtggcta

SEQ ID NO: 195729 - DNA, 18 bp, Homo sapiens
taagttctaagttcatgt

SEQ ID NO: 195730 - DNA, 13 bp, Homo sapiens
taagttgaccttt

SEQ ID NO: 195731 - DNA, 17 bp, Homo sapiens
taagttgacctttattt

SEQ ID NO: 195732 - DNA, 17 bp, Homo sapiens
taagttgattctgtccc

SEQ ID NO: 195733 - DNA, 14 bp, Homo sapiens
taagttgtcttaca

SEQ ID NO: 195734 - DNA, 21 bp, Homo sapiens
taagtttagaaattacaagtt

SEQ ID NO: 195735 - DNA, 17 bp, Homo sapiens
taagtttatccaaatct

SEQ ID NO: 195736 - DNA, 17 bp, Homo sapiens
taagtttatgtctaaag

SEQ ID NO: 195737 - DNA, 20 bp, Homo sapiens
taagtttatgtctaaagagc

SEQ ID NO: 195738 - DNA, 14 bp, Homo sapiens
taagtttctgggac

SEQ ID NO: 195739 - DNA, 16 bp, Homo sapiens
taagttttgtgtgtat

SEQ ID NO: 195740 - DNA, 18 bp, Homo sapiens
taagttttgtgtgtatat

SEQ ID NO: 195741 - DNA, 20 bp, Homo sapiens
taagttttttacttccacag

SEQ ID NO: 195742 - DNA, 17 bp, Homo sapiens
taataaaaaacaagaaa

SEQ ID NO: 195743 - DNA, 21 bp, Homo sapiens
taataaaaaacaagaaaccaa

SEQ ID NO: 195744 - DNA, 14 bp, Homo sapiens
taataaaaaatgga

SEQ ID NO: 195745 - DNA, 15 bp, Homo sapiens
taataaaaaatggaa

SEQ ID NO: 195746 - DNA, 21 bp, Homo sapiens
taataaaaaatggaaagaatc

SEQ ID NO: 195747 - DNA, 10 bp, Homo sapiens
taataaaaag

SEQ ID NO: 195748 - DNA, 18 bp, Homo sapiens
taataaaaataaaagaga

SEQ ID NO: 195749 - DNA, 16 bp, Homo sapiens
taataaaaatttgttt

SEQ ID NO: 195750 - DNA, 13 bp, Homo sapiens
taataaaacatct

SEQ ID NO: 195751 - DNA, 15 bp, Homo sapiens
taataaaatatcatt

SEQ ID NO: 195752 - DNA, 20 bp, Homo sapiens
taataaactgtcctctttca

SEQ ID NO: 195753 - DNA, 14 bp, Homo sapiens
taataaactgtgtt

SEQ ID NO: 195754 - DNA, 15 bp, Homo sapiens
taataaactgtgttt

SEQ ID NO: 195755 - DNA, 13 bp, Homo sapiens
taataaagtattc

SEQ ID NO: 195756 - DNA, 17 bp, Homo sapiens
taataaatatactatga

SEQ ID NO: 195757 - DNA, 18 bp, Homo sapiens
taataaatcatgttttga

SEQ ID NO: 195758 - DNA, 14 bp, Homo sapiens
taataaatgaccag

SEQ ID NO: 195759 - DNA, 18 bp, Homo sapiens
tacagttacttccttcct

SEQ ID NO: 195760 - DNA, 20 bp, Homo sapiens
tacagttaggcaccagaaga

SEQ ID NO: 195761 - DNA, 16 bp, Homo sapiens
tacagttcaataaact

SEQ ID NO: 195762 - DNA, 12 bp, Homo sapiens
tacagttcttcg

SEQ ID NO: 195763 - DNA, 21 bp, Homo sapiens
tacagttcttcgggaagagag

SEQ ID NO: 195764 - DNA, 22 bp, Homo sapiens
tacagttcttcgggaagagagg

SEQ ID NO: 195765 - DNA, 21 bp, Homo sapiens
tacagttgactggctttcctc

SEQ ID NO: 195766 - DNA, 16 bp, Homo sapiens
tacagttgttggcctc

SEQ ID NO: 195767 - DNA, 14 bp, Homo sapiens
tacagttttaaaga

SEQ ID NO: 195768 - DNA, 16 bp, Homo sapiens
tacataaacaagtcct

SEQ ID NO: 195769 - DNA, 20 bp, Homo sapiens
tacataacaggcattgcact

SEQ ID NO: 195770 - DNA, 13 bp, Homo sapiens
tacataatgctta

SEQ ID NO: 195771 - DNA, 20 bp, Homo sapiens
tacataatgcttaatttcta

SEQ ID NO: 195772 - DNA, 17 bp, Homo sapiens
tacataattaaatttta

SEQ ID NO: 195773 - DNA, 13 bp, Homo sapiens
tacatagtctttg

SEQ ID NO: 195774 - DNA, 15 bp, Homo sapiens
tacatagtggtcatt

SEQ ID NO: 195775 - DNA, 17 bp, Homo sapiens
tacatatctgtttagga

SEQ ID NO: 195776 - DNA, 16 bp, Homo sapiens
tacatatgagtgtgga

SEQ ID NO: 195777 - DNA, 15 bp, Homo sapiens
tacatatgataaatt

SEQ ID NO: 195778 - DNA, 17 bp, Homo sapiens
tacatatgataggcagc

SEQ ID NO: 195779 - DNA, 17 bp, Homo sapiens
tacatatgctttaagaa

SEQ ID NO: 195780 - DNA, 19 bp, Homo sapiens
tacatatggaaatcctgtt

SEQ ID NO: 195781 - DNA, 23 bp, Homo sapiens
tacatatggaaatcctgttactt

SEQ ID NO: 195782 - DNA, 23 bp, Homo sapiens
tacatattaggaaaatatgggtt

SEQ ID NO: 195783 - DNA, 17 bp, Homo sapiens
tacatatttgagactag

SEQ ID NO: 195784 - DNA, 23 bp, Homo sapiens
tacatcagttattcattctgtga

SEQ ID NO: 195785 - DNA, 12 bp, Homo sapiens
tacatcatttct

SEQ ID NO: 195786 - DNA, 13 bp, Homo sapiens
tacatcctgctac

SEQ ID NO: 195787 - DNA, 18 bp, Homo sapiens
tacatcgcttctttttca

SEQ ID NO: 195788 - DNA, 14 bp, Homo sapiens
tacatctaagtcag

SEQ ID NO: 195789 - DNA, 15 bp, Homo sapiens
tacatctaagtcagt

SEQ ID NO: 195790 - DNA, 17 bp, Homo sapiens
tacatctaagtcagttt

SEQ ID NO: 195791 - DNA, 23 bp, Homo sapiens
tacatctgcagctctttcttctt

SEQ ID NO: 195792 - DNA, 23 bp, Homo sapiens
tacatctgtatttttaaattctg

SEQ ID NO: 195793 - DNA, 21 bp, Homo sapiens
tacatctttatcattaaacat

SEQ ID NO: 195794 - DNA, 16 bp, Homo sapiens
tacatcttttgggaag

SEQ ID NO: 195795 - DNA, 16 bp, Homo sapiens
tacatgactgggcctc

SEQ ID NO: 195796 - DNA, 17 bp, Homo sapiens
tacatgatgatttcaga

SEQ ID NO: 195797 - DNA, 22 bp, Homo sapiens
tacatgatgatttcagaaacaa

SEQ ID NO: 195798 - DNA, 16 bp, Homo sapiens
tacatgcaatttatta

SEQ ID NO: 195799 - DNA, 22 bp, Homo sapiens
tacatgcaatttattaaaatga

SEQ ID NO: 195800 - DNA, 15 bp, Homo sapiens
tacatgcagaaattg

SEQ ID NO: 195801 - DNA, 17 bp, Homo sapiens
tacatgcagcccatgcc

SEQ ID NO: 195802 - DNA, 14 bp, Homo sapiens
tacatggtagcagg

SEQ ID NO: 195803 - DNA, 16 bp, Homo sapiens
tacatggtagcagggt

SEQ ID NO: 195804 - DNA, 14 bp, Homo sapiens
tacatgtatagtga

SEQ ID NO: 195805 - DNA, 16 bp, Homo sapiens
tacatgtatagtgagt

SEQ ID NO: 195806 - DNA, 23 bp, Homo sapiens
tacatgtatagtgagtgtggctt

SEQ ID NO: 195807 - DNA, 17 bp, Homo sapiens
tacatgtgccgaatgtg

SEQ ID NO: 195808 - DNA, 14 bp, Homo sapiens
tacatgtggtttat

SEQ ID NO: 195809 - DNA, 17 bp, Homo sapiens
tacattaaaataactaa

SEQ ID NO: 195810 - DNA, 21 bp, Homo sapiens
tacattatctaactgtgctca

SEQ ID NO: 195811 - DNA, 24 bp, Homo sapiens
tacattatctaactgtgctcaaga

SEQ ID NO: 195812 - DNA, 19 bp, Homo sapiens
tacattccatcacagccag

SEQ ID NO: 195813 - DNA, 10 bp, Homo sapiens
tacattcctc

SEQ ID NO: 195814 - DNA, 17 bp, Homo sapiens
tacattcctcagctgcc

SEQ ID NO: 195815 - DNA, 20 bp, Homo sapiens
tacattcctcagctgccaag

SEQ ID NO: 195816 - DNA, 23 bp, Homo sapiens
tacattcctcagctgccaagcac

SEQ ID NO: 195817 - DNA, 14 bp, Homo sapiens
tacattcctgagat

SEQ ID NO: 195818 - DNA, 17 bp, Homo sapiens
tacattcctgagattct

SEQ ID NO: 195819 - DNA, 12 bp, Homo sapiens
tacattcctgat

SEQ ID NO: 195820 - DNA, 20 bp, Homo sapiens
tacattccttgataatgttg

SEQ ID NO: 195821 - DNA, 13 bp, Homo sapiens
tacattctctatt

SEQ ID NO: 195822 - DNA, 22 bp, Homo sapiens
tacattctctatttttgttaat

SEQ ID NO: 195823 - DNA, 23 bp, Homo sapiens
tacattgtataggccatctgtaa

SEQ ID NO: 195824 - DNA, 23 bp, Homo sapiens
tacattgtgggatgttcagcact

SEQ ID NO: 195825 - DNA, 19 bp, Homo sapiens
tacattgtttgtctgtctt

SEQ ID NO: 195826 - DNA, 23 bp, Homo sapiens
tacattgtttgtctgtcttcata

SEQ ID NO: 195827 - DNA, 23 bp, Homo sapiens
tacatttcataaggcctgccctc

SEQ ID NO: 195828 - DNA, 22 bp, Homo sapiens
tacatttgcatgccttttgggt

SEQ ID NO: 195829 - DNA, 23 bp, Homo sapiens
tacatttgtatgttgtgaagatg

SEQ ID NO: 195830 - DNA, 14 bp, Homo sapiens
tacattttttttca

SEQ ID NO: 195831 - DNA, 19 bp, Homo sapiens
taccaaagaaacaccactt

SEQ ID NO: 195832 - DNA, 13 bp, Homo sapiens
taccaaaggatag

SEQ ID NO: 195833 - DNA, 14 bp, Homo sapiens
taccaactttctgt

SEQ ID NO: 195834 - DNA, 15 bp, Homo sapiens
taccaactttctgta

SEQ ID NO: 195835 - DNA, 22 bp, Homo sapiens
taccaatcaacagcatgtctac

SEQ ID NO: 195836 - DNA, 20 bp, Homo sapiens
taccaatcattttaattatt

SEQ ID NO: 195837 - DNA, 22 bp, Homo sapiens
taccaatcattttaattattat

SEQ ID NO: 195838 - DNA, 12 bp, Homo sapiens
taccaatgcatg

SEQ ID NO: 195839 - DNA, 15 bp, Homo sapiens
taccaccccactggc

SEQ ID NO: 195840 - DNA, 15 bp, Homo sapiens
taccacctgtacata

SEQ ID NO: 195841 - DNA, 23 bp, Homo sapiens
taccacgaggaaaagaacaaaca

SEQ ID NO: 195842 - DNA, 17 bp, Homo sapiens
taccactgagcccttgc

SEQ ID NO: 195843 - DNA, 17 bp, Homo sapiens
taccactgctaataaat

SEQ ID NO: 195844 - DNA, 22 bp, Homo sapiens
taccactgctaataaatgacca

SEQ ID NO: 195845 - DNA, 12 bp, Homo sapiens
taccagatgcta

SEQ ID NO: 195846 - DNA, 16 bp, Homo sapiens
taccagatgctactgg

SEQ ID NO: 195847 - DNA, 21 bp, Homo sapiens
taccagatgctactggacttg

SEQ ID NO: 195848 - DNA, 12 bp, Homo sapiens
taccagcaaaag

SEQ ID NO: 195849 - DNA, 18 bp, Homo sapiens
taccagcaaaagtgcagt

SEQ ID NO: 195850 - DNA, 17 bp, Homo sapiens
taccagccctggggctg

SEQ ID NO: 195851 - DNA, 19 bp, Homo sapiens
taccagccctggggctggg

SEQ ID NO: 195852 - DNA, 17 bp, Homo sapiens
taccagcgcccgctggg

SEQ ID NO: 195853 - DNA, 14 bp, Homo sapiens
taccaggccaccca

SEQ ID NO: 195854 - DNA, 17 bp, Homo sapiens
taccagtcgccctctgt

SEQ ID NO: 195855 - DNA, 21 bp, Homo sapiens
taccagtcgccctctgtgcct

SEQ ID NO: 195856 - DNA, 14 bp, Homo sapiens
taccagtgggcatg

SEQ ID NO: 195857 - DNA, 19 bp, Homo sapiens
taccagtgggcatgtatta

SEQ ID NO: 195858 - DNA, 14 bp, Homo sapiens
taccagtgtactgc

SEQ ID NO: 195859 - DNA, 19 bp, Homo sapiens
taccagtgtactgctttca

SEQ ID NO: 195860 - DNA, 14 bp, Homo sapiens
taccataatgttcc

SEQ ID NO: 195861 - DNA, 19 bp, Homo sapiens
taccatagcgctgctctta

SEQ ID NO: 195862 - DNA, 16 bp, Homo sapiens
taccatcaataaagta

SEQ ID NO: 195863 - DNA, 16 bp, Homo sapiens
taccatcttaatcttt

SEQ ID NO: 195864 - DNA, 18 bp, Homo sapiens
taccatcttaatctttat

SEQ ID NO: 195865 - DNA, 15 bp, Homo sapiens
taccatgaaacaaag

SEQ ID NO: 195866 - DNA, 22 bp, Homo sapiens
taccatgctgctttttggcaca

SEQ ID NO: 195867 - DNA, 14 bp, Homo sapiens
taccatgttaaaga

SEQ ID NO: 195868 - DNA, 14 bp, Homo sapiens
taccattaaaactg

SEQ ID NO: 195869 - DNA, 14 bp, Homo sapiens
taccattttgcgat

SEQ ID NO: 195870 - DNA, 22 bp, Homo sapiens
taccattttgcgatgtgtttta

SEQ ID NO: 195871 - DNA, 22 bp, Homo sapiens
tacccaaggtcacatagctggg

SEQ ID NO: 195872 - DNA, 23 bp, Homo sapiens
tacccaatacttatgttgtattg

SEQ ID NO: 195873 - DNA, 23 bp, Homo sapiens
tacccacagggcctgacttttac

SEQ ID NO: 195874 - DNA, 19 bp, Homo sapiens
tacccaccctaatttgccc

SEQ ID NO: 195875 - DNA, 23 bp, Homo sapiens
tacccaccgatggagcccccaga

SEQ ID NO: 195876 - DNA, 23 bp, Homo sapiens
tacccacctgagctttggacgca

SEQ ID NO: 195877 - DNA, 15 bp, Homo sapiens
tacccagagaatata

SEQ ID NO: 195878 - DNA, 19 bp, Homo sapiens
tacccagccaccttcctga

SEQ ID NO: 195879 - DNA, 16 bp, Homo sapiens
tacccagcccatcttg

SEQ ID NO: 195880 - DNA, 20 bp, Homo sapiens
tacccaggctggagtgcagt

SEQ ID NO: 195881 - DNA, 13 bp, Homo sapiens
tacccatgagcct

SEQ ID NO: 195882 - DNA, 15 bp, Homo sapiens
tacccatgagcctgc

SEQ ID NO: 195883 - DNA, 16 bp, Homo sapiens
tacccatgagcctgcc

SEQ ID NO: 195884 - DNA, 22 bp, Homo sapiens
tacccatgttgggaaaaactgg

SEQ ID NO: 195885 - DNA, 23 bp, Homo sapiens
tacccatgttgggaaaaactggc

SEQ ID NO: 195886 - DNA, 16 bp, Homo sapiens
taccccacgaagacat

SEQ ID NO: 195887 - DNA, 23 bp, Homo sapiens
taccccagttcatctctgctgaa

SEQ ID NO: 195888 - DNA, 21 bp, Homo sapiens
agctatttatttatttattga

SEQ ID NO: 195889 - DNA, 18 bp, Homo sapiens
agctatttccattccaga

SEQ ID NO: 195890 - DNA, 22 bp, Homo sapiens
agctatttctcatcaattctct

SEQ ID NO: 195891 - DNA, 23 bp, Homo sapiens
agctatttttcttgttgcatctt

SEQ ID NO: 195892 - DNA, 14 bp, Homo sapiens
agctcaaggctgca

SEQ ID NO: 195893 - DNA, 14 bp, Homo sapiens
agctcacccctggg

SEQ ID NO: 195894 - DNA, 19 bp, Homo sapiens
agctcacccctgggcaggc

SEQ ID NO: 195895 - DNA, 20 bp, Homo sapiens
agctcacccctgggcaggcg

SEQ ID NO: 195896 - DNA, 17 bp, Homo sapiens
agctcagaggagtctgg

SEQ ID NO: 195897 - DNA, 17 bp, Homo sapiens
agctcagcacagcctca

SEQ ID NO: 195898 - DNA, 19 bp, Homo sapiens
agctcagcagttcacttcc

SEQ ID NO: 195899 - DNA, 14 bp, Homo sapiens
agctcagcccaccc

SEQ ID NO: 195900 - DNA, 15 bp, Homo sapiens
agctcagcccacccc

SEQ ID NO: 195901 - DNA, 21 bp, Homo sapiens
agctcagcccacccccctcat

SEQ ID NO: 195902 - DNA, 13 bp, Homo sapiens
agctcagccccag

SEQ ID NO: 195903 - DNA, 15 bp, Homo sapiens
agctcagccccagcc

SEQ ID NO: 195904 - DNA, 19 bp, Homo sapiens
agctcagccccggccactc

SEQ ID NO: 195905 - DNA, 22 bp, Homo sapiens
agctcaggagaaggcctgcccc

SEQ ID NO: 195906 - DNA, 22 bp, Homo sapiens
agctcaggagagagcttcctgt

SEQ ID NO: 195907 - DNA, 13 bp, Homo sapiens
agctcaggatctc

SEQ ID NO: 195908 - DNA, 16 bp, Homo sapiens
agctcaggggcagctc

SEQ ID NO: 195909 - DNA, 17 bp, Homo sapiens
agctcaggggcagctca

SEQ ID NO: 195910 - DNA, 18 bp, Homo sapiens
agctcagtcttccctagg

SEQ ID NO: 195911 - DNA, 21 bp, Homo sapiens
agctcagtcttccctagggct

SEQ ID NO: 195912 - DNA, 22 bp, Homo sapiens
agctcagtcttccctagggctg

SEQ ID NO: 195913 - DNA, 23 bp, Homo sapiens
agctcagtcttccctagggctgg

SEQ ID NO: 195914 - DNA, 17 bp, Homo sapiens
agctcatctccaaggat

SEQ ID NO: 195915 - DNA, 21 bp, Homo sapiens
agctcatttcggggtcaggtg

SEQ ID NO: 195916 - DNA, 22 bp, Homo sapiens
agctccaacactttgagcattt

SEQ ID NO: 195917 - DNA, 16 bp, Homo sapiens
agctccacagaagaca

SEQ ID NO: 195918 - DNA, 17 bp, Homo sapiens
agctccactcagggctg

SEQ ID NO: 195919 - DNA, 19 bp, Homo sapiens
agctccactcagggctggc

SEQ ID NO: 195920 - DNA, 21 bp, Homo sapiens
agctccactcagggctggccc

SEQ ID NO: 195921 - DNA, 16 bp, Homo sapiens
agctccagacccccag

SEQ ID NO: 195922 - DNA, 17 bp, Homo sapiens
agctccagacccccagc

SEQ ID NO: 195923 - DNA, 15 bp, Homo sapiens
agctccagtcctgct

SEQ ID NO: 195924 - DNA, 17 bp, Homo sapiens
agctccagtcctgctct

SEQ ID NO: 195925 - DNA, 14 bp, Homo sapiens
agctccagtggaag

SEQ ID NO: 195926 - DNA, 15 bp, Homo sapiens
agctccatctccact

SEQ ID NO: 195927 - DNA, 17 bp, Homo sapiens
agctccccaccacccca

SEQ ID NO: 195928 - DNA, 11 bp, Homo sapiens
agctccccagg

SEQ ID NO: 195929 - DNA, 18 bp, Homo sapiens
agctccccaggagctcag

SEQ ID NO: 195930 - DNA, 20 bp, Homo sapiens
agctccccgcttctgcctgc

SEQ ID NO: 195931 - DNA, 21 bp, Homo sapiens
agctccccgcttctgcctgca

SEQ ID NO: 195932 - DNA, 12 bp, Homo sapiens
agctcccctgga

SEQ ID NO: 195933 - DNA, 17 bp, Homo sapiens
agctcccctggagccag

SEQ ID NO: 195934 - DNA, 17 bp, Homo sapiens
agctccctagactgcat

SEQ ID NO: 195935 - DNA, 13 bp, Homo sapiens
agctccctcctcc

SEQ ID NO: 195936 - DNA, 14 bp, Homo sapiens
agctccctcctccc

SEQ ID NO: 195937 - DNA, 16 bp, Homo sapiens
agctccctcctcccat

SEQ ID NO: 195938 - DNA, 18 bp, Homo sapiens
agctccctcctcccatct

SEQ ID NO: 195939 - DNA, 13 bp, Homo sapiens
agctcccttctct

SEQ ID NO: 195940 - DNA, 14 bp, Homo sapiens
agctcccttctctg

SEQ ID NO: 195941 - DNA, 17 bp, Homo sapiens
agctccgcctggcaccc

SEQ ID NO: 195942 - DNA, 16 bp, Homo sapiens
agctcctcaactcacc

SEQ ID NO: 195943 - DNA, 18 bp, Homo sapiens
agctcctctccttgggct

SEQ ID NO: 195944 - DNA, 20 bp, Homo sapiens
agctcctctccttgggctcc

SEQ ID NO: 195945 - DNA, 21 bp, Homo sapiens
agctcctctccttgggctcct

SEQ ID NO: 195946 - DNA, 22 bp, Homo sapiens
agctcctctccttgggctcctg

SEQ ID NO: 195947 - DNA, 19 bp, Homo sapiens
agctcctctgggcaggacc

SEQ ID NO: 195948 - DNA, 20 bp, Homo sapiens
agctcctggtcttgagatgt

SEQ ID NO: 195949 - DNA, 15 bp, Homo sapiens
agctccttcatgctt

SEQ ID NO: 195950 - DNA, 14 bp, Homo sapiens
agctccttggagca

SEQ ID NO: 195951 - DNA, 18 bp, Homo sapiens
agctccttggttccctct

SEQ ID NO: 195952 - DNA, 23 bp, Homo sapiens
agctccttttgtccccagggccc

SEQ ID NO: 195953 - DNA, 17 bp, Homo sapiens
agctcgtgtatcctggg

SEQ ID NO: 195954 - DNA, 19 bp, Homo sapiens
agctcgtgtatcctggggc

SEQ ID NO: 195955 - DNA, 20 bp, Homo sapiens
agctcgtgtatcctggggct

SEQ ID NO: 195956 - DNA, 14 bp, Homo sapiens
agctcgtttttcag

SEQ ID NO: 195957 - DNA, 23 bp, Homo sapiens
agctcgtttttcagcacccccac

SEQ ID NO: 195958 - DNA, 21 bp, Homo sapiens
agctctaatagagtcacagct

SEQ ID NO: 195959 - DNA, 20 bp, Homo sapiens
agctctagacaaccctgcaa

SEQ ID NO: 195960 - DNA, 21 bp, Homo sapiens
agctctcagttgcagccctgc

SEQ ID NO: 195961 - DNA, 19 bp, Homo sapiens
agctctcccctgcgcaggc

SEQ ID NO: 195962 - DNA, 21 bp, Homo sapiens
agctctcccctgcgcaggccc

SEQ ID NO: 195963 - DNA, 22 bp, Homo sapiens
agctctcccctgcgcaggccct

SEQ ID NO: 195964 - DNA, 17 bp, Homo sapiens
agctctcctgactttta

SEQ ID NO: 195965 - DNA, 14 bp, Homo sapiens
agctctcctgggcc

SEQ ID NO: 195966 - DNA, 16 bp, Homo sapiens
agctctcctgggccag

SEQ ID NO: 195967 - DNA, 20 bp, Homo sapiens
agctctcggaactgcatgct

SEQ ID NO: 195968 - DNA, 23 bp, Homo sapiens
agctctcggaactgcatgctgct

SEQ ID NO: 195969 - DNA, 14 bp, Homo sapiens
agctctctcagacc

SEQ ID NO: 195970 - DNA, 16 bp, Homo sapiens
agctctctcagaccct

SEQ ID NO: 195971 - DNA, 21 bp, Homo sapiens
agctctgacctgcccccgctc

SEQ ID NO: 195972 - DNA, 19 bp, Homo sapiens
agctctgactgaaggggct

SEQ ID NO: 195973 - DNA, 11 bp, Homo sapiens
agctctgagcc

SEQ ID NO: 195974 - DNA, 21 bp, Homo sapiens
agctctgcagagcaggaaaca

SEQ ID NO: 195975 - DNA, 13 bp, Homo sapiens
agctctgcatgtg

SEQ ID NO: 195976 - DNA, 12 bp, Homo sapiens
agctctgcatta

SEQ ID NO: 195977 - DNA, 13 bp, Homo sapiens
agctctgcattat

SEQ ID NO: 195978 - DNA, 17 bp, Homo sapiens
agctctggagccacctg

SEQ ID NO: 195979 - DNA, 12 bp, Homo sapiens
agctctggccac

SEQ ID NO: 195980 - DNA, 13 bp, Homo sapiens
agctctggccaca

SEQ ID NO: 195981 - DNA, 15 bp, Homo sapiens
agctctgggagagga

SEQ ID NO: 195982 - DNA, 12 bp, Homo sapiens
agctctgtggcc

SEQ ID NO: 195983 - DNA, 18 bp, Homo sapiens
agctctgtggcctgtgtc

SEQ ID NO: 195984 - DNA, 20 bp, Homo sapiens
agctctgtggcctgtgtcca

SEQ ID NO: 195985 - DNA, 16 bp, Homo sapiens
agctctgtgttgccat

SEQ ID NO: 195986 - DNA, 22 bp, Homo sapiens
agctcttagtcctccctgctca

SEQ ID NO: 195987 - DNA, 17 bp, Homo sapiens
agctcttcaggcctccc

SEQ ID NO: 195988 - DNA, 21 bp, Homo sapiens
agctcttctgggcagagcctg

SEQ ID NO: 195989 - DNA, 22 bp, Homo sapiens
agctcttctgggcagagcctgt

SEQ ID NO: 195990 - DNA, 15 bp, Homo sapiens
agctctttcttcttt

SEQ ID NO: 195991 - DNA, 17 bp, Homo sapiens
agctctttcttctttga

SEQ ID NO: 195992 - DNA, 18 bp, Homo sapiens
agctctttgtctcaccag

SEQ ID NO: 195993 - DNA, 19 bp, Homo sapiens
agctgaagccgccaggacc

SEQ ID NO: 195994 - DNA, 20 bp, Homo sapiens
agctgaatattttttatttc

SEQ ID NO: 195995 - DNA, 24 bp, Homo sapiens
acaggtgtactatggctgtatttt

SEQ ID NO: 195996 - DNA, 13 bp, Homo sapiens
acaggttttcagc

SEQ ID NO: 195997 - DNA, 22 bp, Homo sapiens
acaggttttcctgaagaattga

SEQ ID NO: 195998 - DNA, 12 bp, Homo sapiens
acagtaaataaa

SEQ ID NO: 195999 - DNA, 14 bp, Homo sapiens
acagtaaataaatt

SEQ ID NO: 196000 - DNA, 13 bp, Homo sapiens
acagtaatcagtt

SEQ ID NO: 196001 - DNA, 18 bp, Homo sapiens
acagtagagtagggtaga

SEQ ID NO: 196002 - DNA, 20 bp, Homo sapiens
acagtagcatactgatgaga

SEQ ID NO: 196003 - DNA, 13 bp, Homo sapiens
acagtagctgtgg

SEQ ID NO: 196004 - DNA, 18 bp, Homo sapiens
acagtatataagcttttt

SEQ ID NO: 196005 - DNA, 21 bp, Homo sapiens
acagtatcactgtctttccta

SEQ ID NO: 196006 - DNA, 17 bp, Homo sapiens
acagtatgtgtctagca

SEQ ID NO: 196007 - DNA, 22 bp, Homo sapiens
acagtatgtgtctagcaaagcc

SEQ ID NO: 196008 - DNA, 17 bp, Homo sapiens
acagtattctgtaccat

SEQ ID NO: 196009 - DNA, 12 bp, Homo sapiens
acagtattgcca

SEQ ID NO: 196010 - DNA, 15 bp, Homo sapiens
acagtattgccacct

SEQ ID NO: 196011 - DNA, 18 bp, Homo sapiens
acagtcaaggagtggctt

SEQ ID NO: 196012 - DNA, 15 bp, Homo sapiens
acagtcagatttcca

SEQ ID NO: 196013 - DNA, 22 bp, Homo sapiens
acagtcattatttaaagcacat

SEQ ID NO: 196014 - DNA, 17 bp, Homo sapiens
acagtcatttgcgcaca

SEQ ID NO: 196015 - DNA, 18 bp, Homo sapiens
acagtcctcacagcctct

SEQ ID NO: 196016 - DNA, 17 bp, Homo sapiens
acagtctcaattttgta

SEQ ID NO: 196017 - DNA, 14 bp, Homo sapiens
acagtctcattaca

SEQ ID NO: 196018 - DNA, 17 bp, Homo sapiens
acatctaagtcagtttc

SEQ ID NO: 196019 - DNA, 21 bp, Homo sapiens
acatctcctccatactcagga

SEQ ID NO: 196020 - DNA, 13 bp, Homo sapiens
acatctctgtaaa

SEQ ID NO: 196021 - DNA, 18 bp, Homo sapiens
acatctctgtaaaaagca

SEQ ID NO: 196022 - DNA, 14 bp, Homo sapiens
acatctgaaaagaa

SEQ ID NO: 196023 - DNA, 19 bp, Homo sapiens
acatctgccttgctgcacc

SEQ ID NO: 196024 - DNA, 23 bp, Homo sapiens
acatctgtatttttaaattctgc

SEQ ID NO: 196025 - DNA, 22 bp, Homo sapiens
acatcttaattaagctccttca

SEQ ID NO: 196026 - DNA, 18 bp, Homo sapiens
acatcttcaatctaggcg

SEQ ID NO: 196027 - DNA, 19 bp, Homo sapiens
acatcttggtcagatttga

SEQ ID NO: 196028 - DNA, 22 bp, Homo sapiens
acatctttattaacctcagcat

SEQ ID NO: 196029 - DNA, 22 bp, Homo sapiens
acatctttttcctccctttccc

SEQ ID NO: 196030 - DNA, 23 bp, Homo sapiens
acatgaaaagataggtttgagtt

SEQ ID NO: 196031 - DNA, 21 bp, Homo sapiens
acatgaaaattacaacagata

SEQ ID NO: 196032 - DNA, 18 bp, Homo sapiens
acatgaattgcattttac

SEQ ID NO: 196033 - DNA, 15 bp, Homo sapiens
acatgaatttaatgt

SEQ ID NO: 196034 - DNA, 15 bp, Homo sapiens
acatgactgggcctc

SEQ ID NO: 196035 - DNA, 16 bp, Homo sapiens
acatgactgggcctcc

SEQ ID NO: 196036 - DNA, 18 bp, Homo sapiens
acatgactgggcctccct

SEQ ID NO: 196037 - DNA, 18 bp, Homo sapiens
acatgagtcccagtggga

SEQ ID NO: 196038 - DNA, 22 bp, Homo sapiens
acatgattccttcctgttctga

SEQ ID NO: 196039 - DNA, 23 bp, Homo sapiens
acatgcacagctaacatggaagt

SEQ ID NO: 196040 - DNA, 18 bp, Homo sapiens
acatgcactactgaaatt

SEQ ID NO: 196041 - DNA, 15 bp, Homo sapiens
acatgcactcagtgt

SEQ ID NO: 196042 - DNA, 21 bp, Homo sapiens
acatgcagaaattgacctgat

SEQ ID NO: 196043 - DNA, 16 bp, Homo sapiens
acatgcagctctgcag

SEQ ID NO: 196044 - DNA, 20 bp, Homo sapiens
acatgcatgttttatgtgca

SEQ ID NO: 196045 - DNA, 14 bp, Homo sapiens
acatgccagggaaa

SEQ ID NO: 196046 - DNA, 21 bp, Homo sapiens
acatgccgcgggcggccaggc

SEQ ID NO: 196047 - DNA, 15 bp, Homo sapiens
acatgcctgccccaa

SEQ ID NO: 196048 - DNA, 16 bp, Homo sapiens
acatgcgggctgggca

SEQ ID NO: 196049 - DNA, 17 bp, Homo sapiens
acatgcgggctgggcag

SEQ ID NO: 196050 - DNA, 19 bp, Homo sapiens
acatgcgggctgggcagct

SEQ ID NO: 196051 - DNA, 21 bp, Homo sapiens
acatgcgggctgggcagctgt

SEQ ID NO: 196052 - DNA, 19 bp, Homo sapiens
acatgctcatcccaaaagc

SEQ ID NO: 196053 - DNA, 16 bp, Homo sapiens
acatgctggccagcct

SEQ ID NO: 196054 - DNA, 19 bp, Homo sapiens
acatgctggccagcctggg

SEQ ID NO: 196055 - DNA, 16 bp, Homo sapiens
acatgctgtgctcttt

SEQ ID NO: 196056 - DNA, 20 bp, Homo sapiens
acatgctgtgctctttgaag

SEQ ID NO: 196057 - DNA, 20 bp, Homo sapiens
acatgctgtgtaagctgtgt

SEQ ID NO: 196058 - DNA, 23 bp, Homo sapiens
acatgcttcatgaaaatcctacc

SEQ ID NO: 196059 - DNA, 18 bp, Homo sapiens
acatggaagaagtatatt

SEQ ID NO: 196060 - DNA, 22 bp, Homo sapiens
acatggacccggagctaacact

SEQ ID NO: 196061 - DNA, 16 bp, Homo sapiens
acatggagactcctgc

SEQ ID NO: 196062 - DNA, 13 bp, Homo sapiens
acatggagttccc

SEQ ID NO: 196063 - DNA, 18 bp, Homo sapiens
acatggattccaaagcat

SEQ ID NO: 196064 - DNA, 17 bp, Homo sapiens
acatggccaatagtcat

SEQ ID NO: 196065 - DNA, 22 bp, Homo sapiens
acatgggaaacttccaagacct

SEQ ID NO: 196066 - DNA, 16 bp, Homo sapiens
acatgggtagcttctg

SEQ ID NO: 196067 - DNA, 13 bp, Homo sapiens
acatgggttcaat

SEQ ID NO: 196068 - DNA, 15 bp, Homo sapiens
acatgggttcaattg

SEQ ID NO: 196069 - DNA, 15 bp, Homo sapiens
acatggtagcagggt

SEQ ID NO: 196070 - DNA, 23 bp, Homo sapiens
acatggtagcagggtctttgtgt

SEQ ID NO: 196071 - DNA, 20 bp, Homo sapiens
acatggtccatttcatgtga

SEQ ID NO: 196072 - DNA, 22 bp, Homo sapiens
acatggtccatttcatgtgatc

SEQ ID NO: 196073 - DNA, 23 bp, Homo sapiens
acatggtgaaaccccgtctctac

SEQ ID NO: 196074 - DNA, 20 bp, Homo sapiens
acatggttacctctgcataa

SEQ ID NO: 196075 - DNA, 17 bp, Homo sapiens
acatgtaataaaaagta

SEQ ID NO: 196076 - DNA, 20 bp, Homo sapiens
acatgtaataaaaagtatat

SEQ ID NO: 196077 - DNA, 23 bp, Homo sapiens
acatgtaataaaaagtatatgtt

SEQ ID NO: 196078 - DNA, 15 bp, Homo sapiens
acatgtatagtgagt

SEQ ID NO: 196079 - DNA, 14 bp, Homo sapiens
acatgtatgtggat

SEQ ID NO: 196080 - DNA, 21 bp, Homo sapiens
acatgtccagtgggaggtgag

SEQ ID NO: 196081 - DNA, 15 bp, Homo sapiens
acatgtgcaactctt

SEQ ID NO: 196082 - DNA, 19 bp, Homo sapiens
acatgtgcaactcttgtat

SEQ ID NO: 196083 - DNA, 19 bp, Homo sapiens
acatgtggaaagtgaattt

SEQ ID NO: 196084 - DNA, 21 bp, Homo sapiens
acatgtggcaaaatatggttt

SEQ ID NO: 196085 - DNA, 18 bp, Homo sapiens
acatgtggggacagggct

SEQ ID NO: 196086 - DNA, 16 bp, Homo sapiens
acatgtggtttataga

SEQ ID NO: 196087 - DNA, 13 bp, Homo sapiens
acatgtgtcaagc

SEQ ID NO: 196088 - DNA, 12 bp, Homo sapiens
acatgtgtttta

SEQ ID NO: 196089 - DNA, 17 bp, Homo sapiens
acatgttactgaccagc

SEQ ID NO: 196090 - DNA, 16 bp, Homo sapiens
acatgttattgttttc

SEQ ID NO: 196091 - DNA, 14 bp, Homo sapiens
acatgttcttccag

SEQ ID NO: 196092 - DNA, 13 bp, Homo sapiens
acatgtttccatc

SEQ ID NO: 196093 - DNA, 20 bp, Homo sapiens
acattaaaagaagactggaa

SEQ ID NO: 196094 - DNA, 20 bp, Homo sapiens
acattaaacactgtaatctt

SEQ ID NO: 196095 - DNA, 22 bp, Homo sapiens
acattaacagttttccatgaaa

SEQ ID NO: 196096 - DNA, 15 bp, Homo sapiens
acattaagtggcttt

SEQ ID NO: 196097 - DNA, 19 bp, Homo sapiens
acattaggcattgagactt

SEQ ID NO: 196098 - DNA, 17 bp, Homo sapiens
acattatagaaattact

SEQ ID NO: 196099 - DNA, 14 bp, Homo sapiens
acattatattctct

SEQ ID NO: 196100 - DNA, 18 bp, Homo sapiens
acattatcgggagcagtg

SEQ ID NO: 196101 - DNA, 19 bp, Homo sapiens
acattatcgggagcagtgt

SEQ ID NO: 196102 - DNA, 22 bp, Homo sapiens
acattatcgggagcagtgtctt

SEQ ID NO: 196103 - DNA, 20 bp, Homo sapiens
acattatctaactgtgctca

SEQ ID NO: 196104 - DNA, 13 bp, Homo sapiens
acattatcttagt

SEQ ID NO: 196105 - DNA, 16 bp, Homo sapiens
acattcaccaacaaca

SEQ ID NO: 196106 - DNA, 16 bp, Homo sapiens
acattcagtactttat

SEQ ID NO: 196107 - DNA, 20 bp, Homo sapiens
acattcatatttgcaataaa

SEQ ID NO: 196108 - DNA, 17 bp, Homo sapiens
acattccctctcatcca

SEQ ID NO: 196109 - DNA, 19 bp, Homo sapiens
acattccctctcctgccca

SEQ ID NO: 196110 - DNA, 23 bp, Homo sapiens
acattccgacaaccgatgctcca

SEQ ID NO: 196111 - DNA, 12 bp, Homo sapiens
acattcctcagc

SEQ ID NO: 196112 - DNA, 19 bp, Homo sapiens
acattcctcagctgccaag

SEQ ID NO: 196113 - DNA, 20 bp, Homo sapiens
acattcctcatgaatgtaaa

SEQ ID NO: 196114 - DNA, 21 bp, Homo sapiens
acattcctcatgaatgtaaat

SEQ ID NO: 196115 - DNA, 22 bp, Homo sapiens
acattcctcatgaatgtaaatt

SEQ ID NO: 196116 - DNA, 20 bp, Homo sapiens
acattcctccagcctcccct

SEQ ID NO: 196117 - DNA, 20 bp, Homo sapiens
acattcctgagattctggga

SEQ ID NO: 196118 - DNA, 21 bp, Homo sapiens
acattcctgagattctgggaa

SEQ ID NO: 196119 - DNA, 16 bp, Homo sapiens
acattcctgatactgg

SEQ ID NO: 196120 - DNA, 14 bp, Homo sapiens
acattcgatctcat

SEQ ID NO: 196121 - DNA, 19 bp, Homo sapiens
acattctacttcagctttg

SEQ ID NO: 196122 - DNA, 21 bp, Homo sapiens
acattctgctgcccccagacc

SEQ ID NO: 196123 - DNA, 14 bp, Homo sapiens
acattcttcactgt

SEQ ID NO: 196124 - DNA, 21 bp, Homo sapiens
acattcttcactgtctgttgt

SEQ ID NO: 196125 - DNA, 12 bp, Homo sapiens
acattgaaagag

SEQ ID NO: 196126 - DNA, 19 bp, Homo sapiens
acattgaagtaatgaattt

SEQ ID NO: 196127 - DNA, 20 bp, Homo sapiens
acattgaagtaatgaatttt

SEQ ID NO: 196128 - DNA, 20 bp, Homo sapiens
acattgaccaagaactgcat

SEQ ID NO: 196129 - DNA, 20 bp, Homo sapiens
acattgcactttataaacac

SEQ ID NO: 196130 - DNA, 23 bp, Homo sapiens
acattgcaggaagagatgctcta

SEQ ID NO: 196131 - DNA, 20 bp, Homo sapiens
acattgcataagtggaccca

SEQ ID NO: 196132 - DNA, 16 bp, Homo sapiens
acattgcccacacctg

SEQ ID NO: 196133 - DNA, 16 bp, Homo sapiens
acattgccccaagata

SEQ ID NO: 196134 - DNA, 18 bp, Homo sapiens
agctgttccacaggggct

SEQ ID NO: 196135 - DNA, 13 bp, Homo sapiens
agctgttgagctg

SEQ ID NO: 196136 - DNA, 14 bp, Homo sapiens
agctgttgagctgt

SEQ ID NO: 196137 - DNA, 15 bp, Homo sapiens
agctgttgagctgtt

SEQ ID NO: 196138 - DNA, 17 bp, Homo sapiens
agctgttgagctgtttt

SEQ ID NO: 196139 - DNA, 16 bp, Homo sapiens
agctgtttaagatggg

SEQ ID NO: 196140 - DNA, 14 bp, Homo sapiens
agctgtttccatag

SEQ ID NO: 196141 - DNA, 21 bp, Homo sapiens
agctgtttctaaacagttgag

SEQ ID NO: 196142 - DNA, 15 bp, Homo sapiens
agctgttttccctga

SEQ ID NO: 196143 - DNA, 14 bp, Homo sapiens
agcttaaaaaaaac

SEQ ID NO: 196144 - DNA, 23 bp, Homo sapiens
agcttaaaataaacagttgtgaa

SEQ ID NO: 196145 - DNA, 16 bp, Homo sapiens
agcttaaggagaggag

SEQ ID NO: 196146 - DNA, 17 bp, Homo sapiens
agcttaatagccctccc

SEQ ID NO: 196147 - DNA, 22 bp, Homo sapiens
aggaaatgttggaactctgtgc

SEQ ID NO: 196148 - DNA, 18 bp, Homo sapiens
aggaaattaaataatttt

SEQ ID NO: 196149 - DNA, 22 bp, Homo sapiens
aggaacacgtgggtgagcgtgt

SEQ ID NO: 196150 - DNA, 14 bp, Homo sapiens
aggaacagtggctg

SEQ ID NO: 196151 - DNA, 16 bp, Homo sapiens
aggaacatatgaaaat

SEQ ID NO: 196152 - DNA, 19 bp, Homo sapiens
aggaacatatgaaaataca

SEQ ID NO: 196153 - DNA, 14 bp, Homo sapiens
aggaacatgtaact

SEQ ID NO: 196154 - DNA, 17 bp, Homo sapiens
aggaacattcccacata

SEQ ID NO: 196155 - DNA, 20 bp, Homo sapiens
aggaacccggtcccaggccg

SEQ ID NO: 196156 - DNA, 20 bp, Homo sapiens
aggaacctggaccaaagctg

SEQ ID NO: 196157 - DNA, 22 bp, Homo sapiens
aggaacgagcactggccagaga

SEQ ID NO: 196158 - DNA, 18 bp, Homo sapiens
aggaactggtccaggcca

SEQ ID NO: 196159 - DNA, 22 bp, Homo sapiens
aggaactggtccaggccaggcc

SEQ ID NO: 196160 - DNA, 23 bp, Homo sapiens
aggaactggtccaggccaggcct

SEQ ID NO: 196161 - DNA, 18 bp, Homo sapiens
aggaacttgctgctgtgc

SEQ ID NO: 196162 - DNA, 23 bp, Homo sapiens
aggaacttgctgctgtgcctgcg

SEQ ID NO: 196163 - DNA, 17 bp, Homo sapiens
aggaagaacagtacatt

SEQ ID NO: 196164 - DNA, 18 bp, Homo sapiens
aggaagaacagtacattt

SEQ ID NO: 196165 - DNA, 17 bp, Homo sapiens
aggaagagggctgagct

SEQ ID NO: 196166 - DNA, 18 bp, Homo sapiens
aggaagagggctgagctg

SEQ ID NO: 196167 - DNA, 19 bp, Homo sapiens
aggaagagggctgagctga

SEQ ID NO: 196168 - DNA, 18 bp, Homo sapiens
aggaagatcactttgctc

SEQ ID NO: 196169 - DNA, 16 bp, Homo sapiens
aggaagatcttaaatt

SEQ ID NO: 196170 - DNA, 18 bp, Homo sapiens
aggaagatcttgagagct

SEQ ID NO: 196171 - DNA, 14 bp, Homo sapiens
aggaagcaaggcca

SEQ ID NO: 196172 - DNA, 15 bp, Homo sapiens
aggaagcaaggccag

SEQ ID NO: 196173 - DNA, 20 bp, Homo sapiens
aggaagcaaggccagccctg

SEQ ID NO: 196174 - DNA, 12 bp, Homo sapiens
aggaagcacaag

SEQ ID NO: 196175 - DNA, 21 bp, Homo sapiens
aggaagcacaagaagtgggag

SEQ ID NO: 196176 - DNA, 16 bp, Homo sapiens
aggaagcacagcaggt

SEQ ID NO: 196177 - DNA, 16 bp, Homo sapiens
aggaagcagagcactg

SEQ ID NO: 196178 - DNA, 14 bp, Homo sapiens
aggaagccacgtgc

SEQ ID NO: 196179 - DNA, 22 bp, Homo sapiens
aggaagccccgctcaggtagcc

SEQ ID NO: 196180 - DNA, 19 bp, Homo sapiens
aggaagccgcctagtgcag

SEQ ID NO: 196181 - DNA, 18 bp, Homo sapiens
aggaagcctcctgctgag

SEQ ID NO: 196182 - DNA, 22 bp, Homo sapiens
aggaagctccagtcctgctctc

SEQ ID NO: 196183 - DNA, 13 bp, Homo sapiens
aggaagctttctc

SEQ ID NO: 196184 - DNA, 17 bp, Homo sapiens
aggaagctttctctgct

SEQ ID NO: 196185 - DNA, 18 bp, Homo sapiens
aggaagctttctctgctt

SEQ ID NO: 196186 - DNA, 20 bp, Homo sapiens
aggaagctttctctgcttca

SEQ ID NO: 196187 - DNA, 21 bp, Homo sapiens
aggaaggagagaaggggagga

SEQ ID NO: 196188 - DNA, 15 bp, Homo sapiens
aggaaggagagcctg

SEQ ID NO: 196189 - DNA, 17 bp, Homo sapiens
aggaaggagagcctgct

SEQ ID NO: 196190 - DNA, 18 bp, Homo sapiens
aggaaggagagcctgctg

SEQ ID NO: 196191 - DNA, 21 bp, Homo sapiens
aggaaggaggggaagctgcag

SEQ ID NO: 196192 - DNA, 13 bp, Homo sapiens
aggaaggcagctg

SEQ ID NO: 196193 - DNA, 16 bp, Homo sapiens
aggaaggcagctgctc

SEQ ID NO: 196194 - DNA, 13 bp, Homo sapiens
aggaaggcggggc

SEQ ID NO: 196195 - DNA, 14 bp, Homo sapiens
aggaagggactggt

SEQ ID NO: 196196 - DNA, 17 bp, Homo sapiens
aggaagggactggtcca

SEQ ID NO: 196197 - DNA, 17 bp, Homo sapiens
aggaagggcaggaagga

SEQ ID NO: 196198 - DNA, 18 bp, Homo sapiens
aggaagggcatccttctg

SEQ ID NO: 196199 - DNA, 17 bp, Homo sapiens
aggaagggccagagcct

SEQ ID NO: 196200 - DNA, 16 bp, Homo sapiens
aggaaggggctggact

SEQ ID NO: 196201 - DNA, 14 bp, Homo sapiens
aggaaggtgctgag

SEQ ID NO: 196202 - DNA, 16 bp, Homo sapiens
aggaaggtgctgagct

SEQ ID NO: 196203 - DNA, 11 bp, Homo sapiens
aggaagtactg

SEQ ID NO: 196204 - DNA, 15 bp, Homo sapiens
aggaagtactggaga

SEQ ID NO: 196205 - DNA, 17 bp, Homo sapiens
aggaagtagcaggccca

SEQ ID NO: 196206 - DNA, 14 bp, Homo sapiens
aggaagtcaggagc

SEQ ID NO: 196207 - DNA, 18 bp, Homo sapiens
aggaagtcaggagccagc

SEQ ID NO: 196208 - DNA, 21 bp, Homo sapiens
aggaagtcaggagccagcagg

SEQ ID NO: 196209 - DNA, 15 bp, Homo sapiens
aggaagtgacttgaa

SEQ ID NO: 196210 - DNA, 20 bp, Homo sapiens
aggaagtgggagaagtggcc

SEQ ID NO: 196211 - DNA, 22 bp, Homo sapiens
aggaagtgggagaagtggcccc

SEQ ID NO: 196212 - DNA, 16 bp, Homo sapiens
aggaagtgtaacagct

SEQ ID NO: 196213 - DNA, 20 bp, Homo sapiens
aggaagttgctgagaaatgg

SEQ ID NO: 196214 - DNA, 14 bp, Homo sapiens
aggaataaatgaga

SEQ ID NO: 196215 - DNA, 15 bp, Homo sapiens
aggaataacactgca

SEQ ID NO: 196216 - DNA, 17 bp, Homo sapiens
aggaataacactgcagc

SEQ ID NO: 196217 - DNA, 17 bp, Homo sapiens
aggaataattatttatt

SEQ ID NO: 196218 - DNA, 22 bp, Homo sapiens
aggaataattatttatttaata

SEQ ID NO: 196219 - DNA, 17 bp, Homo sapiens
aggaataggtaggagac

SEQ ID NO: 196220 - DNA, 11 bp, Homo sapiens
aggaatataca

SEQ ID NO: 196221 - DNA, 20 bp, Homo sapiens
aggaatataccacaccgagg

SEQ ID NO: 196222 - DNA, 20 bp, Homo sapiens
aggaatcgaggaaccagagc

SEQ ID NO: 196223 - DNA, 12 bp, Homo sapiens
aggaatctgcct

SEQ ID NO: 196224 - DNA, 16 bp, Homo sapiens
aggaatcttttactgt

SEQ ID NO: 196225 - DNA, 15 bp, Homo sapiens
aggaatgcaagagaa

SEQ ID NO: 196226 - DNA, 13 bp, Homo sapiens
aggaatgcctgtg

SEQ ID NO: 196227 - DNA, 18 bp, Homo sapiens
aggaatgctcaatgtgct

SEQ ID NO: 196228 - DNA, 20 bp, Homo sapiens
aggaatgctcaatgtgctgt

SEQ ID NO: 196229 - DNA, 12 bp, Homo sapiens
aggaatgctccc

SEQ ID NO: 196230 - DNA, 14 bp, Homo sapiens
aggaatgctctgtg

SEQ ID NO: 196231 - DNA, 15 bp, Homo sapiens
aggaatgctctgtgc

SEQ ID NO: 196232 - DNA, 21 bp, Homo sapiens
aggaatgggccaagccagggt

SEQ ID NO: 196233 - DNA, 21 bp, Homo sapiens
aggaatgtttcagctgcagtt

SEQ ID NO: 196234 - DNA, 20 bp, Homo sapiens
aggaattgacttcagcaggg

SEQ ID NO: 196235 - DNA, 19 bp, Homo sapiens
aggacaaaaatgaactgaa

SEQ ID NO: 196236 - DNA, 11 bp, Homo sapiens
aggacaaacag

SEQ ID NO: 196237 - DNA, 13 bp, Homo sapiens
aggacaaacagtg

SEQ ID NO: 196238 - DNA, 18 bp, Homo sapiens
aggacaacctgcccctcc

SEQ ID NO: 196239 - DNA, 21 bp, Homo sapiens
aggacaacctgcccctcccca

SEQ ID NO: 196240 - DNA, 19 bp, Homo sapiens
aggacaattgtcagttttg

SEQ ID NO: 196241 - DNA, 22 bp, Homo sapiens
aggacacaccccacaccccagc

SEQ ID NO: 196242 - DNA, 23 bp, Homo sapiens
aggacacactaatcgaactatga

SEQ ID NO: 196243 - DNA, 18 bp, Homo sapiens
aggacacatcccggcctc

SEQ ID NO: 196244 - DNA, 23 bp, Homo sapiens
aggacacatcccggcctcttcca

SEQ ID NO: 196245 - DNA, 12 bp, Homo sapiens
aggacacatttg

SEQ ID NO: 196246 - DNA, 12 bp, Homo sapiens
aggacacccctc

SEQ ID NO: 196247 - DNA, 19 bp, Homo sapiens
aggacagatccagggactg

SEQ ID NO: 196248 - DNA, 12 bp, Homo sapiens
aggacagctgca

SEQ ID NO: 196249 - DNA, 18 bp, Homo sapiens
aggacagctgcaggtgcc

SEQ ID NO: 196250 - DNA, 12 bp, Homo sapiens
aggacagggagg

SEQ ID NO: 196251 - DNA, 20 bp, Homo sapiens
aggacagtgctgaccccagg

SEQ ID NO: 196252 - DNA, 14 bp, Homo sapiens
aggacagtttagga

SEQ ID NO: 196253 - DNA, 18 bp, Homo sapiens
aggaccaacccatgccct

SEQ ID NO: 196254 - DNA, 21 bp, Homo sapiens
aggaccaacccatgccctgcc

SEQ ID NO: 196255 - DNA, 22 bp, Homo sapiens
aggaccacagtgggtggcacct

SEQ ID NO: 196256 - DNA, 14 bp, Homo sapiens
aggaccaggagcca

SEQ ID NO: 196257 - DNA, 15 bp, Homo sapiens
aggaccaggagccag

SEQ ID NO: 196258 - DNA, 12 bp, Homo sapiens
aggaccagtttt

SEQ ID NO: 196259 - DNA, 22 bp, Homo sapiens
aggacccacccatcttcctgct

SEQ ID NO: 196260 - DNA, 15 bp, Homo sapiens
aggacccaggccctc

SEQ ID NO: 196261 - DNA, 19 bp, Homo sapiens
aggacccaggccctccatg

SEQ ID NO: 196262 - DNA, 14 bp, Homo sapiens
aggaccccagaggg

SEQ ID NO: 196263 - DNA, 15 bp, Homo sapiens
aggaccccagaggga

SEQ ID NO: 196264 - DNA, 16 bp, Homo sapiens
aggaccccatctgctg

SEQ ID NO: 196265 - DNA, 17 bp, Homo sapiens
aggacccggaggggcct

SEQ ID NO: 196266 - DNA, 21 bp, Homo sapiens
aggacccggaggggcctggca

SEQ ID NO: 196267 - DNA, 22 bp, Homo sapiens
aggacccgggaccacagctgct

SEQ ID NO: 196268 - DNA, 23 bp, Homo sapiens
aggacccttctactttttccttc

SEQ ID NO: 196269 - DNA, 16 bp, Homo sapiens
aggaccgccaaagaat

SEQ ID NO: 196270 - DNA, 23 bp, Homo sapiens
aggacctccacctgggagatgct

SEQ ID NO: 196271 - DNA, 16 bp, Homo sapiens
aggacctttctgagga

SEQ ID NO: 196272 - DNA, 23 bp, Homo sapiens
aggacgagggatgggatttcatg

SEQ ID NO: 196273 - DNA, 20 bp, Homo sapiens
aggacgcagggagaccctgg

SEQ ID NO: 196274 - DNA, 13 bp, Homo sapiens
aggacgcattcca

SEQ ID NO: 196275 - DNA, 15 bp, Homo sapiens
aggacggggcagagc

SEQ ID NO: 196276 - DNA, 14 bp, Homo sapiens
aggacgtgggcggc

SEQ ID NO: 196277 - DNA, 14 bp, Homo sapiens
acccatgcacagaa

SEQ ID NO: 196278 - DNA, 21 bp, Homo sapiens
acccatgcacagaacaagcca

SEQ ID NO: 196279 - DNA, 18 bp, Homo sapiens
acccatgcatggcctccc

SEQ ID NO: 196280 - DNA, 19 bp, Homo sapiens
acccatgcatggcctccca

SEQ ID NO: 196281 - DNA, 21 bp, Homo sapiens
acccatgcatggcctcccagc

SEQ ID NO: 196282 - DNA, 23 bp, Homo sapiens
acccatgcatggcctcccagcca

SEQ ID NO: 196283 - DNA, 24 bp, Homo sapiens
acccatgtaaataccagactgcag

SEQ ID NO: 196284 - DNA, 17 bp, Homo sapiens
aggactaatgcatgtgg

SEQ ID NO: 196285 - DNA, 19 bp, Homo sapiens
aggactcaggcctgccaat

SEQ ID NO: 196286 - DNA, 17 bp, Homo sapiens
aggactccctcctcacc

SEQ ID NO: 196287 - DNA, 23 bp, Homo sapiens
aggactcgggctaagtccagctc

SEQ ID NO: 196288 - DNA, 14 bp, Homo sapiens
aggactctctttct

SEQ ID NO: 196289 - DNA, 15 bp, Homo sapiens
aggactctgcccaga

SEQ ID NO: 196290 - DNA, 18 bp, Homo sapiens
aggactctgccccttctg

SEQ ID NO: 196291 - DNA, 21 bp, Homo sapiens
aggactctgccccttctgttt

SEQ ID NO: 196292 - DNA, 16 bp, Homo sapiens
aggactctgcctcctc

SEQ ID NO: 196293 - DNA, 14 bp, Homo sapiens
aggactgacctgcc

SEQ ID NO: 196294 - DNA, 18 bp, Homo sapiens
aggactgacctgcccctg

SEQ ID NO: 196295 - DNA, 20 bp, Homo sapiens
aggactgcatggtaatttat

SEQ ID NO: 196296 - DNA, 21 bp, Homo sapiens
aggactgcatggtaatttata

SEQ ID NO: 196297 - DNA, 18 bp, Homo sapiens
aggactgccccgtgcaga

SEQ ID NO: 196298 - DNA, 13 bp, Homo sapiens
aggactgccgacc

SEQ ID NO: 196299 - DNA, 22 bp, Homo sapiens
aggactggagaccgcttcaccc

SEQ ID NO: 196300 - DNA, 17 bp, Homo sapiens
aggactggattggccaa

SEQ ID NO: 196301 - DNA, 22 bp, Homo sapiens
aggactggctttgtcccacagc

SEQ ID NO: 196302 - DNA, 22 bp, Homo sapiens
aggactgtgactcattcccagt

SEQ ID NO: 196303 - DNA, 18 bp, Homo sapiens
aggacttaacggctccag

SEQ ID NO: 196304 - DNA, 20 bp, Homo sapiens
aggacttaacggctccagga

SEQ ID NO: 196305 - DNA, 18 bp, Homo sapiens
aggacttaagacaaatgg

SEQ ID NO: 196306 - DNA, 23 bp, Homo sapiens
aggacttcctgctacagtagctg

SEQ ID NO: 196307 - DNA, 22 bp, Homo sapiens
aggacttgcttccaagcccttc

SEQ ID NO: 196308 - DNA, 19 bp, Homo sapiens
aggacttgggggcagagca

SEQ ID NO: 196309 - DNA, 13 bp, Homo sapiens
aggacttgtgcct

SEQ ID NO: 196310 - DNA, 15 bp, Homo sapiens
aggacttgtgcctct

SEQ ID NO: 196311 - DNA, 23 bp, Homo sapiens
aggacttgtgcctcttgggagac

SEQ ID NO: 196312 - DNA, 16 bp, Homo sapiens
aggactttagggatct

SEQ ID NO: 196313 - DNA, 17 bp, Homo sapiens
aggactttagggatctg

SEQ ID NO: 196314 - DNA, 18 bp, Homo sapiens
aggactttagggatctgg

SEQ ID NO: 196315 - DNA, 11 bp, Homo sapiens
aggactttgca

SEQ ID NO: 196316 - DNA, 12 bp, Homo sapiens
aggagaaacaca

SEQ ID NO: 196317 - DNA, 14 bp, Homo sapiens
aggagaaccactac

SEQ ID NO: 196318 - DNA, 15 bp, Homo sapiens
aggagaaccactaca

SEQ ID NO: 196319 - DNA, 14 bp, Homo sapiens
aggagaactgtgct

SEQ ID NO: 196320 - DNA, 16 bp, Homo sapiens
aggagaactgtgctct

SEQ ID NO: 196321 - DNA, 17 bp, Homo sapiens
aggagaaggcctgcccc

SEQ ID NO: 196322 - DNA, 19 bp, Homo sapiens
aggagaaggcctgcccccc

SEQ ID NO: 196323 - DNA, 22 bp, Homo sapiens
aggagaaggcctgccccccttc

SEQ ID NO: 196324 - DNA, 21 bp, Homo sapiens
aggagaatcgcttgaacctgg

SEQ ID NO: 196325 - DNA, 22 bp, Homo sapiens
aggagacaaagcaggagtggaa

SEQ ID NO: 196326 - DNA, 17 bp, Homo sapiens
aggagacacagatggca

SEQ ID NO: 196327 - DNA, 20 bp, Homo sapiens
aggagacacgtgtggcgggc

SEQ ID NO: 196328 - DNA, 14 bp, Homo sapiens
aggagaccagaagt

SEQ ID NO: 196329 - DNA, 12 bp, Homo sapiens
aggagaccctgg

SEQ ID NO: 196330 - DNA, 15 bp, Homo sapiens
aggagaccctggaat

SEQ ID NO: 196331 - DNA, 16 bp, Homo sapiens
aggagaccctgtcttt

SEQ ID NO: 196332 - DNA, 14 bp, Homo sapiens
aggagactcaggcc

SEQ ID NO: 196333 - DNA, 19 bp, Homo sapiens
aggagactgaggcttagag

SEQ ID NO: 196334 - DNA, 21 bp, Homo sapiens
aggagagaaggggaggagggc

SEQ ID NO: 196335 - DNA, 11 bp, Homo sapiens
aggagagaccg

SEQ ID NO: 196336 - DNA, 19 bp, Homo sapiens
aggagagactgaaagcagc

SEQ ID NO: 196337 - DNA, 22 bp, Homo sapiens
aggagagactgaaagcagcagc

SEQ ID NO: 196338 - DNA, 18 bp, Homo sapiens
aggagagagatgctgctc

SEQ ID NO: 196339 - DNA, 14 bp, Homo sapiens
aggagagagccttg

SEQ ID NO: 196340 - DNA, 17 bp, Homo sapiens
aggagagcatcaccacc

SEQ ID NO: 196341 - DNA, 21 bp, Homo sapiens
aggagagcatcaccaccacac

SEQ ID NO: 196342 - DNA, 15 bp, Homo sapiens
aggagagcatctgct

SEQ ID NO: 196343 - DNA, 20 bp, Homo sapiens
aggagagcatctgctctgag

SEQ ID NO: 196344 - DNA, 21 bp, Homo sapiens
aggagagcatctgctctgaga

SEQ ID NO: 196345 - DNA, 14 bp, Homo sapiens
aggagagcccccac

SEQ ID NO: 196346 - DNA, 21 bp, Homo sapiens
aggagagcccccaccagcagc

SEQ ID NO: 196347 - DNA, 22 bp, Homo sapiens
aggagagcccccaccagcagca

SEQ ID NO: 196348 - DNA, 18 bp, Homo sapiens
aggagagccctctgctgc

SEQ ID NO: 196349 - DNA, 15 bp, Homo sapiens
aggagagcctgctgc

SEQ ID NO: 196350 - DNA, 16 bp, Homo sapiens
aggagagcggaggagg

SEQ ID NO: 196351 - DNA, 12 bp, Homo sapiens
aggagaggagag

SEQ ID NO: 196352 - DNA, 15 bp, Homo sapiens
aggagagtaaaaatt

SEQ ID NO: 196353 - DNA, 18 bp, Homo sapiens
aggagagtaaaaattcat

SEQ ID NO: 196354 - DNA, 17 bp, Homo sapiens
aggagagtcccagagca

SEQ ID NO: 196355 - DNA, 20 bp, Homo sapiens
aggagatggaagttgcagtg

SEQ ID NO: 196356 - DNA, 17 bp, Homo sapiens
aggagatggggacaggg

SEQ ID NO: 196357 - DNA, 20 bp, Homo sapiens
aggagatgtaatgacagaga

SEQ ID NO: 196358 - DNA, 23 bp, Homo sapiens
aggagatgtaatgacagagagtt

SEQ ID NO: 196359 - DNA, 16 bp, Homo sapiens
aggagattgctctggg

SEQ ID NO: 196360 - DNA, 20 bp, Homo sapiens
aggagcaaaacgcctctttt

SEQ ID NO: 196361 - DNA, 19 bp, Homo sapiens
aggagcaaacactgaaata

SEQ ID NO: 196362 - DNA, 13 bp, Homo sapiens
aggagcaatggga

SEQ ID NO: 196363 - DNA, 15 bp, Homo sapiens
aggagcaatgggact

SEQ ID NO: 196364 - DNA, 16 bp, Homo sapiens
aggagcaatgggactg

SEQ ID NO: 196365 - DNA, 20 bp, Homo sapiens
aggagcaatgggactggagt

SEQ ID NO: 196366 - DNA, 22 bp, Homo sapiens
aggagcacaggcagctggatga

SEQ ID NO: 196367 - DNA, 17 bp, Homo sapiens
aggagcacccccagcct

SEQ ID NO: 196368 - DNA, 20 bp, Homo sapiens
aggagcacccccagcctccc

SEQ ID NO: 196369 - DNA, 12 bp, Homo sapiens
aggagcagcctc

SEQ ID NO: 196370 - DNA, 12 bp, Homo sapiens
aggagcagctgt

SEQ ID NO: 196371 - DNA, 13 bp, Homo sapiens
aggagcagctgtg

SEQ ID NO: 196372 - DNA, 14 bp, Homo sapiens
aggagcagctgtgc

SEQ ID NO: 196373 - DNA, 20 bp, Homo sapiens
aggagcagctgtgctgcacc

SEQ ID NO: 196374 - DNA, 21 bp, Homo sapiens
aggagccacctgggctgggag

SEQ ID NO: 196375 - DNA, 21 bp, Homo sapiens
aggagccagcagggcgggcca

SEQ ID NO: 196376 - DNA, 24 bp, Homo sapiens
aggagcccacggctaagaggctgc

SEQ ID NO: 196377 - DNA, 16 bp, Homo sapiens
aggagccccagccagc

SEQ ID NO: 196378 - DNA, 20 bp, Homo sapiens
aggagccccagccagccctt

SEQ ID NO: 196379 - DNA, 13 bp, Homo sapiens
aggagccctcatc

SEQ ID NO: 196380 - DNA, 13 bp, Homo sapiens
aggagcctgcggc

SEQ ID NO: 196381 - DNA, 14 bp, Homo sapiens
aggagcctgcggct

SEQ ID NO: 196382 - DNA, 21 bp, Homo sapiens
aggagcctgcggctgctggca

SEQ ID NO: 196383 - DNA, 13 bp, Homo sapiens
aggagcctggagt

SEQ ID NO: 196384 - DNA, 14 bp, Homo sapiens
aggagccttggagt

SEQ ID NO: 196385 - DNA, 23 bp, Homo sapiens
aggagcgcgcgtgatagaagaaa

SEQ ID NO: 196386 - DNA, 18 bp, Homo sapiens
aggagcgggacctgtggc

SEQ ID NO: 196387 - DNA, 15 bp, Homo sapiens
aggagctcaggtggg

SEQ ID NO: 196388 - DNA, 17 bp, Homo sapiens
aggagctcttcaggcct

SEQ ID NO: 196389 - DNA, 19 bp, Homo sapiens
aggagctcttcaggcctcc

SEQ ID NO: 196390 - DNA, 21 bp, Homo sapiens
aggagctcttcaggcctccct

SEQ ID NO: 196391 - DNA, 18 bp, Homo sapiens
aggagctgagtcacctcc

SEQ ID NO: 196392 - DNA, 12 bp, Homo sapiens
aggagctgctgg

SEQ ID NO: 196393 - DNA, 13 bp, Homo sapiens
aggagctgctggc

SEQ ID NO: 196394 - DNA, 17 bp, Homo sapiens
aggagctggggagggag

SEQ ID NO: 196395 - DNA, 14 bp, Homo sapiens
aggagcttccagat

SEQ ID NO: 196396 - DNA, 16 bp, Homo sapiens
aggaggaactggtcca

SEQ ID NO: 196397 - DNA, 17 bp, Homo sapiens
aggaggaactggtccag

SEQ ID NO: 196398 - DNA, 22 bp, Homo sapiens
aggaggaactggtccaggccag

SEQ ID NO: 196399 - DNA, 23 bp, Homo sapiens
aggaggaactggtccaggccagg

SEQ ID NO: 196400 - DNA, 13 bp, Homo sapiens
aggaggaagcaga

SEQ ID NO: 196401 - DNA, 21 bp, Homo sapiens
aggaggaagggactggtccag

SEQ ID NO: 196402 - DNA, 16 bp, Homo sapiens
aggaggacaattgtca

SEQ ID NO: 196403 - DNA, 11 bp, Homo sapiens
aggaggacagg

SEQ ID NO: 196404 - DNA, 15 bp, Homo sapiens
aggaggacagggagg

SEQ ID NO: 196405 - DNA, 19 bp, Homo sapiens
aggaggaccctgaatttga

SEQ ID NO: 196406 - DNA, 16 bp, Homo sapiens
aggaggagacagtcag

SEQ ID NO: 196407 - DNA, 15 bp, Homo sapiens
aggcactgaccctcg

SEQ ID NO: 196408 - DNA, 13 bp, Homo sapiens
aggcagaaaggag

SEQ ID NO: 196409 - DNA, 22 bp, Homo sapiens
aggcagaaccctggtgaggaag

SEQ ID NO: 196410 - DNA, 21 bp, Homo sapiens
aggcagaacctggtggctgga

SEQ ID NO: 196411 - DNA, 18 bp, Homo sapiens
aggcagaataagaaaaca

SEQ ID NO: 196412 - DNA, 14 bp, Homo sapiens
aggcagaatggtgg

SEQ ID NO: 196413 - DNA, 23 bp, Homo sapiens
aggcagaatggtgggctccagag

SEQ ID NO: 196414 - DNA, 16 bp, Homo sapiens
aggcagagaaaacaca

SEQ ID NO: 196415 - DNA, 20 bp, Homo sapiens
aggcagagacaataaaacat

SEQ ID NO: 196416 - DNA, 15 bp, Homo sapiens
aggcagaggagagta

SEQ ID NO: 196417 - DNA, 17 bp, Homo sapiens
aggcagagtgccccacc

SEQ ID NO: 196418 - DNA, 19 bp, Homo sapiens
aggcagagtgccccacctg

SEQ ID NO: 196419 - DNA, 22 bp, Homo sapiens
aggcagatctgtgccccatgcc

SEQ ID NO: 196420 - DNA, 17 bp, Homo sapiens
aggcagattgaaaagga

SEQ ID NO: 196421 - DNA, 19 bp, Homo sapiens
aggcagcaacaggaccagg

SEQ ID NO: 196422 - DNA, 20 bp, Homo sapiens
aggcagcaaccattcatctt

SEQ ID NO: 196423 - DNA, 14 bp, Homo sapiens
aggcagccagggct

SEQ ID NO: 196424 - DNA, 12 bp, Homo sapiens
aggcagccccct

SEQ ID NO: 196425 - DNA, 14 bp, Homo sapiens
aggcagccccctcc

SEQ ID NO: 196426 - DNA, 18 bp, Homo sapiens
acccgacaacatttctgc

SEQ ID NO: 196427 - DNA, 22 bp, Homo sapiens
acccgagcccagctacattcct

SEQ ID NO: 196428 - DNA, 14 bp, Homo sapiens
acccgccccagaga

SEQ ID NO: 196429 - DNA, 18 bp, Homo sapiens
acccgccccagagactgc

SEQ ID NO: 196430 - DNA, 23 bp, Homo sapiens
acccgccccagagactgcccacc

SEQ ID NO: 196431 - DNA, 14 bp, Homo sapiens
acccgcccgccccc

SEQ ID NO: 196432 - DNA, 17 bp, Homo sapiens
acccgcccgcccccgcc

SEQ ID NO: 196433 - DNA, 20 bp, Homo sapiens
acccgcccgcgtccaacccc

SEQ ID NO: 196434 - DNA, 13 bp, Homo sapiens
acccgctgcccag

SEQ ID NO: 196435 - DNA, 13 bp, Homo sapiens
acccggaaagact

SEQ ID NO: 196436 - DNA, 22 bp, Homo sapiens
acccggagctaacactggcccc

SEQ ID NO: 196437 - DNA, 23 bp, Homo sapiens
acccggagctaacactggcccct

SEQ ID NO: 196438 - DNA, 18 bp, Homo sapiens
acccggaggggcctggca

SEQ ID NO: 196439 - DNA, 19 bp, Homo sapiens
acccggatctccaggccca

SEQ ID NO: 196440 - DNA, 14 bp, Homo sapiens
acccggccacagct

SEQ ID NO: 196441 - DNA, 17 bp, Homo sapiens
acccggccacagctgct

SEQ ID NO: 196442 - DNA, 20 bp, Homo sapiens
acccggcccccgccctctgc

SEQ ID NO: 196443 - DNA, 21 bp, Homo sapiens
acccggcccccgccctctgcc

SEQ ID NO: 196444 - DNA, 22 bp, Homo sapiens
acccggcccccgccctctgccc

SEQ ID NO: 196445 - DNA, 22 bp, Homo sapiens
acccggctgggtcggccctgcc

SEQ ID NO: 196446 - DNA, 18 bp, Homo sapiens
acccgggaccacagctgc

SEQ ID NO: 196447 - DNA, 21 bp, Homo sapiens
acccgggaccacagctgctgg

SEQ ID NO: 196448 - DNA, 21 bp, Homo sapiens
acccggggcagctggcaggag

SEQ ID NO: 196449 - DNA, 15 bp, Homo sapiens
acccggtcccaggcc

SEQ ID NO: 196450 - DNA, 21 bp, Homo sapiens
acccgtaggcagcctctctgc

SEQ ID NO: 196451 - DNA, 12 bp, Homo sapiens
acccgtcctggg

SEQ ID NO: 196452 - DNA, 22 bp, Homo sapiens
acccgttctgctggcctggatc

SEQ ID NO: 196453 - DNA, 13 bp, Homo sapiens
acccgtttccaag

SEQ ID NO: 196454 - DNA, 23 bp, Homo sapiens
acccgtttccaagcctgggccac

SEQ ID NO: 196455 - DNA, 21 bp, Homo sapiens
acccgttttatgatttactca

SEQ ID NO: 196456 - DNA, 14 bp, Homo sapiens
accctaaaatttta

SEQ ID NO: 196457 - DNA, 17 bp, Homo sapiens
accctaactcttgctca

SEQ ID NO: 196458 - DNA, 21 bp, Homo sapiens
accctaactcttgctcactcc

SEQ ID NO: 196459 - DNA, 23 bp, Homo sapiens
accctaactcttgctcactccct

SEQ ID NO: 196460 - DNA, 18 bp, Homo sapiens
accctaatttgcccttca

SEQ ID NO: 196461 - DNA, 18 bp, Homo sapiens
accctacacctctgggcc

SEQ ID NO: 196462 - DNA, 19 bp, Homo sapiens
accctacacctctgggccc

SEQ ID NO: 196463 - DNA, 16 bp, Homo sapiens
accctacagtatataa

SEQ ID NO: 196464 - DNA, 22 bp, Homo sapiens
accctacatgcatgttttatgt

SEQ ID NO: 196465 - DNA, 14 bp, Homo sapiens
accctactggctgt

SEQ ID NO: 196466 - DNA, 17 bp, Homo sapiens
accctagccagagaata

SEQ ID NO: 196467 - DNA, 20 bp, Homo sapiens
accctaggtctccacccctc

SEQ ID NO: 196468 - DNA, 21 bp, Homo sapiens
accctaggtctccacccctca

SEQ ID NO: 196469 - DNA, 22 bp, Homo sapiens
accctagtcccttcccctccct

SEQ ID NO: 196470 - DNA, 17 bp, Homo sapiens
accctagtgatttttgg

SEQ ID NO: 196471 - DNA, 17 bp, Homo sapiens
accctcaaaccctgtgg

SEQ ID NO: 196472 - DNA, 22 bp, Homo sapiens
accctcacacacacagctgggc

SEQ ID NO: 196473 - DNA, 17 bp, Homo sapiens
accctcactgctgggga

SEQ ID NO: 196474 - DNA, 20 bp, Homo sapiens
accctcaggcataggcctgg

SEQ ID NO: 196475 - DNA, 18 bp, Homo sapiens
accctcatttctgccagc

SEQ ID NO: 196476 - DNA, 12 bp, Homo sapiens
accctccacctc

SEQ ID NO: 196477 - DNA, 15 bp, Homo sapiens
accctccagcacaga

SEQ ID NO: 196478 - DNA, 17 bp, Homo sapiens
accctccagcacagact

SEQ ID NO: 196479 - DNA, 13 bp, Homo sapiens
accctccatgctc

SEQ ID NO: 196480 - DNA, 12 bp, Homo sapiens
accctcccaccc

SEQ ID NO: 196481 - DNA, 16 bp, Homo sapiens
accctcccatggcacc

SEQ ID NO: 196482 - DNA, 15 bp, Homo sapiens
accctcccctctcct

SEQ ID NO: 196483 - DNA, 18 bp, Homo sapiens
accctcccctctcctgag

SEQ ID NO: 196484 - DNA, 17 bp, Homo sapiens
accctccctcagcccct

SEQ ID NO: 196485 - DNA, 19 bp, Homo sapiens
accctccctcagcccctct

SEQ ID NO: 196486 - DNA, 18 bp, Homo sapiens
accctccctgtcccctga

SEQ ID NO: 196487 - DNA, 17 bp, Homo sapiens
accctcctatcacctcc

SEQ ID NO: 196488 - DNA, 18 bp, Homo sapiens
accctcgtggacacctgc

SEQ ID NO: 196489 - DNA, 19 bp, Homo sapiens
accctcgtggacacctgcc

SEQ ID NO: 196490 - DNA, 23 bp, Homo sapiens
accctcgtggacacctgccctgc

SEQ ID NO: 196491 - DNA, 19 bp, Homo sapiens
accctctctaatggcccct

SEQ ID NO: 196492 - DNA, 23 bp, Homo sapiens
accctctctaatggcccctccat

SEQ ID NO: 196493 - DNA, 13 bp, Homo sapiens
accctctgcaggg

SEQ ID NO: 196494 - DNA, 16 bp, Homo sapiens
accctctgcagggcag

SEQ ID NO: 196495 - DNA, 23 bp, Homo sapiens
accctctgcagggcagcctgtgg

SEQ ID NO: 196496 - DNA, 15 bp, Homo sapiens
accctctggtccttc

SEQ ID NO: 196497 - DNA, 17 bp, Homo sapiens
accctctggtccttctg

SEQ ID NO: 196498 - DNA, 14 bp, Homo sapiens
accctcttctctgg

SEQ ID NO: 196499 - DNA, 18 bp, Homo sapiens
accctcttctctgggccc

SEQ ID NO: 196500 - DNA, 22 bp, Homo sapiens
accctcttctctgggcccagag

SEQ ID NO: 196501 - DNA, 17 bp, Homo sapiens
accctgagactccagaa

SEQ ID NO: 196502 - DNA, 13 bp, Homo sapiens
accctgcagagct

SEQ ID NO: 196503 - DNA, 14 bp, Homo sapiens
accctgcagccagg

SEQ ID NO: 196504 - DNA, 15 bp, Homo sapiens
accctgcagccagga

SEQ ID NO: 196505 - DNA, 20 bp, Homo sapiens
accctgccaactttccagac

SEQ ID NO: 196506 - DNA, 14 bp, Homo sapiens
accctgcccctgcc

SEQ ID NO: 196507 - DNA, 15 bp, Homo sapiens
accctgcccctgccc

SEQ ID NO: 196508 - DNA, 18 bp, Homo sapiens
accctgcccctgccccgt

SEQ ID NO: 196509 - DNA, 14 bp, Homo sapiens
accctgccctgcac

SEQ ID NO: 196510 - DNA, 17 bp, Homo sapiens
accctgcctgagcccag

SEQ ID NO: 196511 - DNA, 14 bp, Homo sapiens
accctgctcctcct

SEQ ID NO: 196512 - DNA, 21 bp, Homo sapiens
accctgctcctcctgccctgt

SEQ ID NO: 196513 - DNA, 17 bp, Homo sapiens
accctgcttcccaaact

SEQ ID NO: 196514 - DNA, 23 bp, Homo sapiens
accctgcttcccaaactcccagg

SEQ ID NO: 196515 - DNA, 18 bp, Homo sapiens
accctggaattcagcacc

SEQ ID NO: 196516 - DNA, 12 bp, Homo sapiens
accctggcagag

SEQ ID NO: 196517 - DNA, 16 bp, Homo sapiens
accctggcagagaaga

SEQ ID NO: 196518 - DNA, 21 bp, Homo sapiens
accctggcttgcttgccgagc

SEQ ID NO: 196519 - DNA, 17 bp, Homo sapiens
accctggggactctgct

SEQ ID NO: 196520 - DNA, 13 bp, Homo sapiens
accctggggcctg

SEQ ID NO: 196521 - DNA, 17 bp, Homo sapiens
accctggggcctggacc

SEQ ID NO: 196522 - DNA, 22 bp, Homo sapiens
accctggggcctggacctgcct

SEQ ID NO: 196523 - DNA, 19 bp, Homo sapiens
accctgtatggagctagag

SEQ ID NO: 196524 - DNA, 17 bp, Homo sapiens
accctgtgaccctctca

SEQ ID NO: 196525 - DNA, 21 bp, Homo sapiens
accctgtgaccctctcacttt

SEQ ID NO: 196526 - DNA, 20 bp, Homo sapiens
accctgttgagtatttgctg

SEQ ID NO: 196527 - DNA, 22 bp, Homo sapiens
accctgttttattgagttctga

SEQ ID NO: 196528 - DNA, 18 bp, Homo sapiens
acccttaccccttagcct

SEQ ID NO: 196529 - DNA, 21 bp, Homo sapiens
acccttcacataccctccccc

SEQ ID NO: 196530 - DNA, 15 bp, Homo sapiens
acccttcacgctggc

SEQ ID NO: 196531 - DNA, 20 bp, Homo sapiens
acccttcacgctggcttcca

SEQ ID NO: 196532 - DNA, 14 bp, Homo sapiens
acccttcagacccc

SEQ ID NO: 196533 - DNA, 15 bp, Homo sapiens
acccttccccactcc

SEQ ID NO: 196534 - DNA, 17 bp, Homo sapiens
acccttccccactcccg

SEQ ID NO: 196535 - DNA, 20 bp, Homo sapiens
acccttctactttttccttc

SEQ ID NO: 196536 - DNA, 17 bp, Homo sapiens
acctcagttttatcatt

SEQ ID NO: 196537 - DNA, 18 bp, Homo sapiens
acctcatcaggatgaacc

SEQ ID NO: 196538 - DNA, 20 bp, Homo sapiens
acctcatcaggatgaaccca

SEQ ID NO: 196539 - DNA, 14 bp, Homo sapiens
acctcatctccaag

SEQ ID NO: 196540 - DNA, 19 bp, Homo sapiens
acctccaaaagccctgagt

SEQ ID NO: 196541 - DNA, 10 bp, Homo sapiens
acctccaccc

SEQ ID NO: 196542 - DNA, 11 bp, Homo sapiens
acctccaccca

SEQ ID NO: 196543 - DNA, 18 bp, Homo sapiens
acctccacccactgtccg

SEQ ID NO: 196544 - DNA, 13 bp, Homo sapiens
acctccacccagc

SEQ ID NO: 196545 - DNA, 17 bp, Homo sapiens
acctccacccccgccac

SEQ ID NO: 196546 - DNA, 20 bp, Homo sapiens
acctccacccccgccacggc

SEQ ID NO: 196547 - DNA, 15 bp, Homo sapiens
acctccagcccacag

SEQ ID NO: 196548 - DNA, 15 bp, Homo sapiens
acctcccacctttgg

SEQ ID NO: 196549 - DNA, 19 bp, Homo sapiens
acctccccaggccgtggct

SEQ ID NO: 196550 - DNA, 22 bp, Homo sapiens
acctcccccaaaccctgcttct

SEQ ID NO: 196551 - DNA, 16 bp, Homo sapiens
acctccccctcttggt

SEQ ID NO: 196552 - DNA, 19 bp, Homo sapiens
acctccctcctgatgtttt

SEQ ID NO: 196553 - DNA, 17 bp, Homo sapiens
acctccctgacccgtct

SEQ ID NO: 196554 - DNA, 14 bp, Homo sapiens
acctcctaccctcc

SEQ ID NO: 196555 - DNA, 17 bp, Homo sapiens
acctcctaccctcccac

SEQ ID NO: 196556 - DNA, 21 bp, Homo sapiens
acctcctagcaagacctgttg

SEQ ID NO: 196557 - DNA, 14 bp, Homo sapiens
acctcctattttaa

SEQ ID NO: 196558 - DNA, 20 bp, Homo sapiens
acctcctccaagaagccctc

SEQ ID NO: 196559 - DNA, 21 bp, Homo sapiens
acctcctccaagaagccctcc

SEQ ID NO: 196560 - DNA, 12 bp, Homo sapiens
acctcctccact

SEQ ID NO: 196561 - DNA, 18 bp, Homo sapiens
acctcctccactcactcc

SEQ ID NO: 196562 - DNA, 20 bp, Homo sapiens
acctcctccactcactccag

SEQ ID NO: 196563 - DNA, 15 bp, Homo sapiens
acctcctctcttgga

SEQ ID NO: 196564 - DNA, 15 bp, Homo sapiens
acctcctggactgta

SEQ ID NO: 196565 - DNA, 18 bp, Homo sapiens
acctccttagccctgtct

SEQ ID NO: 196566 - DNA, 19 bp, Homo sapiens
acctccttagccctgtctg

SEQ ID NO: 196567 - DNA, 17 bp, Homo sapiens
aggccgctagaggcctg

SEQ ID NO: 196568 - DNA, 21 bp, Homo sapiens
aggccgctagaggcctgagga

SEQ ID NO: 196569 - DNA, 13 bp, Homo sapiens
aggccggccagcc

SEQ ID NO: 196570 - DNA, 14 bp, Homo sapiens
aggccggccagcct

SEQ ID NO: 196571 - DNA, 16 bp, Homo sapiens
aggccggccagcctca

SEQ ID NO: 196572 - DNA, 14 bp, Homo sapiens
aggccggccagctc

SEQ ID NO: 196573 - DNA, 23 bp, Homo sapiens
aggccgggctttccagaaggcca

SEQ ID NO: 196574 - DNA, 20 bp, Homo sapiens
aggccgggtgctcagggctg

SEQ ID NO: 196575 - DNA, 20 bp, Homo sapiens
aggccgtggctgcccacaca

SEQ ID NO: 196576 - DNA, 20 bp, Homo sapiens
aggccgtgtccccttgttct

SEQ ID NO: 196577 - DNA, 15 bp, Homo sapiens
aggcctcaccctgct

SEQ ID NO: 196578 - DNA, 17 bp, Homo sapiens
aggcctcaccctgcttg

SEQ ID NO: 196579 - DNA, 15 bp, Homo sapiens
aggcctcacctggct

SEQ ID NO: 196580 - DNA, 18 bp, Homo sapiens
aggcctcacctggcttcc

SEQ ID NO: 196581 - DNA, 22 bp, Homo sapiens
aggcctcacctggcttcccagg

SEQ ID NO: 196582 - DNA, 13 bp, Homo sapiens
aggcctcaggaga

SEQ ID NO: 196583 - DNA, 14 bp, Homo sapiens
aggcctcaggagag

SEQ ID NO: 196584 - DNA, 23 bp, Homo sapiens
aggcctcagtggactttccaccc

SEQ ID NO: 196585 - DNA, 22 bp, Homo sapiens
aggcctcagtttctccatcagc

SEQ ID NO: 196586 - DNA, 14 bp, Homo sapiens
aggcctcatcctcc

SEQ ID NO: 196587 - DNA, 11 bp, Homo sapiens
aggcctccagc

SEQ ID NO: 196588 - DNA, 17 bp, Homo sapiens
aggcctccagcctctcc

SEQ ID NO: 196589 - DNA, 17 bp, Homo sapiens
aggcctcccgcatgctg

SEQ ID NO: 196590 - DNA, 23 bp, Homo sapiens
aggcctcccgcatgctgcctgcc

SEQ ID NO: 196591 - DNA, 22 bp, Homo sapiens
aggcctccctctctcttctgct

SEQ ID NO: 196592 - DNA, 22 bp, Homo sapiens
aggcctcggcagaactctctgt

SEQ ID NO: 196593 - DNA, 18 bp, Homo sapiens
aggcctctgggcctcctc

SEQ ID NO: 196594 - DNA, 22 bp, Homo sapiens
aggcctcttgctggtgcacatg

SEQ ID NO: 196595 - DNA, 21 bp, Homo sapiens
aggcctcttgtgctcacgctc

SEQ ID NO: 196596 - DNA, 21 bp, Homo sapiens
aggcctgaaagaggctgaggc

SEQ ID NO: 196597 - DNA, 23 bp, Homo sapiens
aggcctgaaatgtttccaggcat

SEQ ID NO: 196598 - DNA, 15 bp, Homo sapiens
aggcctgacctcaag

SEQ ID NO: 196599 - DNA, 23 bp, Homo sapiens
aggcctgaggatgagctggaagg

SEQ ID NO: 196600 - DNA, 15 bp, Homo sapiens
aggcctgagggaagc

SEQ ID NO: 196601 - DNA, 17 bp, Homo sapiens
aggcctgatgctgcccc

SEQ ID NO: 196602 - DNA, 18 bp, Homo sapiens
aggcctgccaatgccaca

SEQ ID NO: 196603 - DNA, 21 bp, Homo sapiens
aggcctgccaatgccacagcc

SEQ ID NO: 196604 - DNA, 22 bp, Homo sapiens
aggcctgccaatgccacagcca

SEQ ID NO: 196605 - DNA, 23 bp, Homo sapiens
aggcctgccagacggcacccacc

SEQ ID NO: 196606 - DNA, 15 bp, Homo sapiens
aggcctgcccccctt

SEQ ID NO: 196607 - DNA, 13 bp, Homo sapiens
aggcctgcctgtt

SEQ ID NO: 196608 - DNA, 20 bp, Homo sapiens
aggcctggagcgtttgctgt

SEQ ID NO: 196609 - DNA, 15 bp, Homo sapiens
aggcctggcccagcc

SEQ ID NO: 196610 - DNA, 16 bp, Homo sapiens
aggcctggcccagcca

SEQ ID NO: 196611 - DNA, 17 bp, Homo sapiens
aggcctggcccagccag

SEQ ID NO: 196612 - DNA, 19 bp, Homo sapiens
aggcctggcccagccagca

SEQ ID NO: 196613 - DNA, 23 bp, Homo sapiens
aggcctggcctcggggcagggca

SEQ ID NO: 196614 - DNA, 17 bp, Homo sapiens
aggcctgggacccagct

SEQ ID NO: 196615 - DNA, 20 bp, Homo sapiens
aggcctgggacccagctact

SEQ ID NO: 196616 - DNA, 23 bp, Homo sapiens
aggcctgggacccagctactctg

SEQ ID NO: 196617 - DNA, 12 bp, Homo sapiens
aggcctgggagg

SEQ ID NO: 196618 - DNA, 17 bp, Homo sapiens
aggcctgggtctgtgtc

SEQ ID NO: 196619 - DNA, 19 bp, Homo sapiens
aggcctgggtctgtgtctc

SEQ ID NO: 196620 - DNA, 12 bp, Homo sapiens
aggcctgggtgc

SEQ ID NO: 196621 - DNA, 17 bp, Homo sapiens
aggcctgggtgctggct

SEQ ID NO: 196622 - DNA, 23 bp, Homo sapiens
aggcctgggtggatcggcctcct

SEQ ID NO: 196623 - DNA, 14 bp, Homo sapiens
aggcctggtcagca

SEQ ID NO: 196624 - DNA, 15 bp, Homo sapiens
aggcctggtcagcag

SEQ ID NO: 196625 - DNA, 22 bp, Homo sapiens
aggcctggtctggagcccctat

SEQ ID NO: 196626 - DNA, 17 bp, Homo sapiens
aggcctgtccctggcca

SEQ ID NO: 196627 - DNA, 23 bp, Homo sapiens
aggcctgtgtgttgccaggcagg

SEQ ID NO: 196628 - DNA, 14 bp, Homo sapiens
aggccttaacaaac

SEQ ID NO: 196629 - DNA, 14 bp, Homo sapiens
aggccttcagaaaa

SEQ ID NO: 196630 - DNA, 15 bp, Homo sapiens
aggccttcagaaaag

SEQ ID NO: 196631 - DNA, 22 bp, Homo sapiens
aggccttccagaaagcaggagc

SEQ ID NO: 196632 - DNA, 13 bp, Homo sapiens
aggccttctcctc

SEQ ID NO: 196633 - DNA, 13 bp, Homo sapiens
aggcgagccaggc

SEQ ID NO: 196634 - DNA, 14 bp, Homo sapiens
aggcgagccaggca

SEQ ID NO: 196635 - DNA, 15 bp, Homo sapiens
aggcgaggctgcctc

SEQ ID NO: 196636 - DNA, 20 bp, Homo sapiens
aggcgaggctgcctctgggt

SEQ ID NO: 196637 - DNA, 15 bp, Homo sapiens
aggcgatgccacgct

SEQ ID NO: 196638 - DNA, 19 bp, Homo sapiens
aggcgcagccctagtggga

SEQ ID NO: 196639 - DNA, 14 bp, Homo sapiens
aggcgcccacctgc

SEQ ID NO: 196640 - DNA, 21 bp, Homo sapiens
aggcgcccacctgcccagtta

SEQ ID NO: 196641 - DNA, 13 bp, Homo sapiens
aggcgcccctggg

SEQ ID NO: 196642 - DNA, 14 bp, Homo sapiens
aggcgcgcaccgcc

SEQ ID NO: 196643 - DNA, 15 bp, Homo sapiens
aggcgcgcaccgccc

SEQ ID NO: 196644 - DNA, 19 bp, Homo sapiens
aggcgcgcaccgcccaacc

SEQ ID NO: 196645 - DNA, 22 bp, Homo sapiens
aggcgcggttcaggtcagggct

SEQ ID NO: 196646 - DNA, 19 bp, Homo sapiens
aggcgcgtctgccccaccc

SEQ ID NO: 196647 - DNA, 21 bp, Homo sapiens
aggcggaggggcttggagcag

SEQ ID NO: 196648 - DNA, 12 bp, Homo sapiens
aggcggcagctg

SEQ ID NO: 196649 - DNA, 18 bp, Homo sapiens
aggcggcagctggggccg

SEQ ID NO: 196650 - DNA, 21 bp, Homo sapiens
aggcggcctttgttgctcagc

SEQ ID NO: 196651 - DNA, 17 bp, Homo sapiens
aggcgggggagcctgga

SEQ ID NO: 196652 - DNA, 17 bp, Homo sapiens
aggcgggggatcctgga

SEQ ID NO: 196653 - DNA, 22 bp, Homo sapiens
aggcgggggatcctggagcccc

SEQ ID NO: 196654 - DNA, 16 bp, Homo sapiens
aggcggtatccagagg

SEQ ID NO: 196655 - DNA, 18 bp, Homo sapiens
aggcggtatccagaggtg

SEQ ID NO: 196656 - DNA, 20 bp, Homo sapiens
aggcggtccccatccccacc

SEQ ID NO: 196657 - DNA, 21 bp, Homo sapiens
aggcggtccccatccccacca

SEQ ID NO: 196658 - DNA, 14 bp, Homo sapiens
aggcggtttgggag

SEQ ID NO: 196659 - DNA, 18 bp, Homo sapiens
aggcgtagggccagggct

SEQ ID NO: 196660 - DNA, 17 bp, Homo sapiens
aggcgtcctggtgagga

SEQ ID NO: 196661 - DNA, 13 bp, Homo sapiens
aggcgtgcccccc

SEQ ID NO: 196662 - DNA, 16 bp, Homo sapiens
aggcgtgcccccctcc

SEQ ID NO: 196663 - DNA, 20 bp, Homo sapiens
aggcgtgcccccctcctcca

SEQ ID NO: 196664 - DNA, 23 bp, Homo sapiens
aggcgtgcccccctcctccagta

SEQ ID NO: 196665 - DNA, 17 bp, Homo sapiens
aggcgtgggatccagag

SEQ ID NO: 196666 - DNA, 14 bp, Homo sapiens
agggacagtggtct

SEQ ID NO: 196667 - DNA, 14 bp, Homo sapiens
agggaccaaggacc

SEQ ID NO: 196668 - DNA, 14 bp, Homo sapiens
agggaccagctggg

SEQ ID NO: 196669 - DNA, 20 bp, Homo sapiens
agggaccaggtgtctagagg

SEQ ID NO: 196670 - DNA, 15 bp, Homo sapiens
agggaccctccacca

SEQ ID NO: 196671 - DNA, 17 bp, Homo sapiens
agggaccgggagcctgc

SEQ ID NO: 196672 - DNA, 14 bp, Homo sapiens
agggacgaagaaag

SEQ ID NO: 196673 - DNA, 20 bp, Homo sapiens
agggactgcagctgcaccag

SEQ ID NO: 196674 - DNA, 13 bp, Homo sapiens
agggactggtcca

SEQ ID NO: 196675 - DNA, 17 bp, Homo sapiens
agggactgtacctgtag

SEQ ID NO: 196676 - DNA, 23 bp, Homo sapiens
agggactgtacctgtaggaaaca

SEQ ID NO: 196677 - DNA, 14 bp, Homo sapiens
agggactgtatttc

SEQ ID NO: 196678 - DNA, 16 bp, Homo sapiens
agggactgtatttctg

SEQ ID NO: 196679 - DNA, 19 bp, Homo sapiens
agggactgtatttctgtgg

SEQ ID NO: 196680 - DNA, 16 bp, Homo sapiens
agggactgtcagctga

SEQ ID NO: 196681 - DNA, 16 bp, Homo sapiens
agggacttccctagaa

SEQ ID NO: 196682 - DNA, 15 bp, Homo sapiens
agggagaaggagagg

SEQ ID NO: 196683 - DNA, 16 bp, Homo sapiens
agggagaaggagaggc

SEQ ID NO: 196684 - DNA, 19 bp, Homo sapiens
agggagaagggagaacagg

SEQ ID NO: 196685 - DNA, 17 bp, Homo sapiens
agggagatggagaaaat

SEQ ID NO: 196686 - DNA, 16 bp, Homo sapiens
agggagcaactctcca

SEQ ID NO: 196687 - DNA, 16 bp, Homo sapiens
agggagccatgctctt

SEQ ID NO: 196688 - DNA, 20 bp, Homo sapiens
agggagccggtttgggagag

SEQ ID NO: 196689 - DNA, 12 bp, Homo sapiens
agggagctgctc

SEQ ID NO: 196690 - DNA, 14 bp, Homo sapiens
agggagctgctcag

SEQ ID NO: 196691 - DNA, 23 bp, Homo sapiens
agggaggacccacactgctacac

SEQ ID NO: 196692 - DNA, 19 bp, Homo sapiens
agggagggaaacccgggga

SEQ ID NO: 196693 - DNA, 22 bp, Homo sapiens
agggaggggctgagtctggcta

SEQ ID NO: 196694 - DNA, 21 bp, Homo sapiens
agggagggggcgctcaggacc

SEQ ID NO: 196695 - DNA, 23 bp, Homo sapiens
agggagggggcgctcaggaccca

SEQ ID NO: 196696 - DNA, 16 bp, Homo sapiens
agggaggtcaggccct

SEQ ID NO: 196697 - DNA, 20 bp, Homo sapiens
agggaggtgtttaaagagag

SEQ ID NO: 196698 - DNA, 23 bp, Homo sapiens
agggaggtgtttaaagagaggtt

SEQ ID NO: 196699 - DNA, 20 bp, Homo sapiens
agggagtacaaagacaggga

SEQ ID NO: 196700 - DNA, 17 bp, Homo sapiens
agggagtacctgctgcc

SEQ ID NO: 196701 - DNA, 19 bp, Homo sapiens
agggagtacctgctgcccc

SEQ ID NO: 196702 - DNA, 22 bp, Homo sapiens
agggagtaggctgtattttctt

SEQ ID NO: 196703 - DNA, 15 bp, Homo sapiens
agggagtgcagaaca

SEQ ID NO: 196704 - DNA, 20 bp, Homo sapiens
agggagtgcagaacacctgg

SEQ ID NO: 196705 - DNA, 21 bp, Homo sapiens
agggagtgcagaacacctggc

SEQ ID NO: 196706 - DNA, 17 bp, Homo sapiens
agggagtgtctgcagtc

SEQ ID NO: 196707 - DNA, 16 bp, Homo sapiens
cacttacactttatgc

SEQ ID NO: 196708 - DNA, 20 bp, Homo sapiens
cacttagaaattgcatttcc

SEQ ID NO: 196709 - DNA, 19 bp, Homo sapiens
cacttagccgtccatggca

SEQ ID NO: 196710 - DNA, 22 bp, Homo sapiens
cacttagccgtccatggcacca

SEQ ID NO: 196711 - DNA, 17 bp, Homo sapiens
cacttagtccactctga

SEQ ID NO: 196712 - DNA, 16 bp, Homo sapiens
cacttatgctgctgtg

SEQ ID NO: 196713 - DNA, 17 bp, Homo sapiens
cacttatttcataaaca

SEQ ID NO: 196714 - DNA, 14 bp, Homo sapiens
cacttatttccatg

SEQ ID NO: 196715 - DNA, 12 bp, Homo sapiens
cacttatttcta

SEQ ID NO: 196716 - DNA, 13 bp, Homo sapiens
cacttatttctaa

SEQ ID NO: 196717 - DNA, 17 bp, Homo sapiens
cacttcaaatcagagca

SEQ ID NO: 196718 - DNA, 21 bp, Homo sapiens
cacttcaagtgaccaccagga

SEQ ID NO: 196719 - DNA, 13 bp, Homo sapiens
cacttcaccccca

SEQ ID NO: 196720 - DNA, 15 bp, Homo sapiens
cacttcacccccaac

SEQ ID NO: 196721 - DNA, 14 bp, Homo sapiens
cacttcaccctgga

SEQ ID NO: 196722 - DNA, 13 bp, Homo sapiens
cacttcagagagc

SEQ ID NO: 196723 - DNA, 17 bp, Homo sapiens
cacttccattgtattgt

SEQ ID NO: 196724 - DNA, 19 bp, Homo sapiens
cacttcccatttgtgtttc

SEQ ID NO: 196725 - DNA, 23 bp, Homo sapiens
cacttccccttgggatgggcaca

SEQ ID NO: 196726 - DNA, 21 bp, Homo sapiens
cacttcctagagcatctgtcc

SEQ ID NO: 196727 - DNA, 13 bp, Homo sapiens
cacttcctgtcca

SEQ ID NO: 196728 - DNA, 17 bp, Homo sapiens
cacttcctgtccagaga

SEQ ID NO: 196729 - DNA, 16 bp, Homo sapiens
cacttctccccagaaa

SEQ ID NO: 196730 - DNA, 14 bp, Homo sapiens
cacttctccccgca

SEQ ID NO: 196731 - DNA, 22 bp, Homo sapiens
cacttctgtgagacccccacac

SEQ ID NO: 196732 - DNA, 19 bp, Homo sapiens
cacttcttaaaggcctgga

SEQ ID NO: 196733 - DNA, 18 bp, Homo sapiens
cacttcttgaaacagcct

SEQ ID NO: 196734 - DNA, 21 bp, Homo sapiens
cacttcttgaaacagcctggg

SEQ ID NO: 196735 - DNA, 15 bp, Homo sapiens
cacttgacattcctt

SEQ ID NO: 196736 - DNA, 15 bp, Homo sapiens
cacttgagcccagga

SEQ ID NO: 196737 - DNA, 18 bp, Homo sapiens
cacttgaggtcaggagtt

SEQ ID NO: 196738 - DNA, 22 bp, Homo sapiens
cacttgaggtcaggagttccta

SEQ ID NO: 196739 - DNA, 15 bp, Homo sapiens
cacttgcactgtgct

SEQ ID NO: 196740 - DNA, 16 bp, Homo sapiens
cacttgcactgtgctt

SEQ ID NO: 196741 - DNA, 19 bp, Homo sapiens
cacttgcgtcctgcagagg

SEQ ID NO: 196742 - DNA, 20 bp, Homo sapiens
cacttgctcagacgagacac

SEQ ID NO: 196743 - DNA, 14 bp, Homo sapiens
cacttgctggggct

SEQ ID NO: 196744 - DNA, 20 bp, Homo sapiens
cacttgctggggctcacggg

SEQ ID NO: 196745 - DNA, 17 bp, Homo sapiens
cacttggactcttgctc

SEQ ID NO: 196746 - DNA, 18 bp, Homo sapiens
cacttggactcttgctct

SEQ ID NO: 196747 - DNA, 16 bp, Homo sapiens
cacttggagatctttg

SEQ ID NO: 196748 - DNA, 23 bp, Homo sapiens
cacttggagatctttgcttcctt

SEQ ID NO: 196749 - DNA, 12 bp, Homo sapiens
cacttggagccc

SEQ ID NO: 196750 - DNA, 15 bp, Homo sapiens
cacttggtgctgctt

SEQ ID NO: 196751 - DNA, 14 bp, Homo sapiens
cacttggtgtactg

SEQ ID NO: 196752 - DNA, 14 bp, Homo sapiens
cacttgtcttgctc

SEQ ID NO: 196753 - DNA, 15 bp, Homo sapiens
cacttgtcttgctct

SEQ ID NO: 196754 - DNA, 16 bp, Homo sapiens
cacttgtcttgctctt

SEQ ID NO: 196755 - DNA, 18 bp, Homo sapiens
cacttgtcttgctcttag

SEQ ID NO: 196756 - DNA, 13 bp, Homo sapiens
cacttgtgtgtgg

SEQ ID NO: 196757 - DNA, 17 bp, Homo sapiens
cacttgtgtgtgggctg

SEQ ID NO: 196758 - DNA, 19 bp, Homo sapiens
cacttgtgtgtgggctgtg

SEQ ID NO: 196759 - DNA, 18 bp, Homo sapiens
cacttgtgttgctttctg

SEQ ID NO: 196760 - DNA, 23 bp, Homo sapiens
cacttgtgtttgtatataaatgg

SEQ ID NO: 196761 - DNA, 13 bp, Homo sapiens
cacttgttccagc

SEQ ID NO: 196762 - DNA, 15 bp, Homo sapiens
cacttgttccagctc

SEQ ID NO: 196763 - DNA, 17 bp, Homo sapiens
cacttgttccagctctt

SEQ ID NO: 196764 - DNA, 21 bp, Homo sapiens
cacttgtttttctttttacag

SEQ ID NO: 196765 - DNA, 17 bp, Homo sapiens
cactttaataataaaaa

SEQ ID NO: 196766 - DNA, 21 bp, Homo sapiens
cactttagaggcttgatcatg

SEQ ID NO: 196767 - DNA, 19 bp, Homo sapiens
cactttagtgattgctttt

SEQ ID NO: 196768 - DNA, 15 bp, Homo sapiens
cactttcactgggga

SEQ ID NO: 196769 - DNA, 14 bp, Homo sapiens
cactttccctagaa

SEQ ID NO: 196770 - DNA, 15 bp, Homo sapiens
cactttcccttcccc

SEQ ID NO: 196771 - DNA, 12 bp, Homo sapiens
cactttcctctc

SEQ ID NO: 196772 - DNA, 15 bp, Homo sapiens
cactttcctctctct

SEQ ID NO: 196773 - DNA, 16 bp, Homo sapiens
cactttgaaaatattt

SEQ ID NO: 196774 - DNA, 22 bp, Homo sapiens
cactttgaaaatatttctatgt

SEQ ID NO: 196775 - DNA, 17 bp, Homo sapiens
cactttgcagacctggg

SEQ ID NO: 196776 - DNA, 19 bp, Homo sapiens
cactttgctctgggtggaa

SEQ ID NO: 196777 - DNA, 14 bp, Homo sapiens
cactttgggaggcc

SEQ ID NO: 196778 - DNA, 13 bp, Homo sapiens
cactttggggaac

SEQ ID NO: 196779 - DNA, 13 bp, Homo sapiens
cactttgtattct

SEQ ID NO: 196780 - DNA, 17 bp, Homo sapiens
cactttgtattctctgt

SEQ ID NO: 196781 - DNA, 20 bp, Homo sapiens
cactttgtattctctgtcca

SEQ ID NO: 196782 - DNA, 14 bp, Homo sapiens
cactttgttcttta

SEQ ID NO: 196783 - DNA, 21 bp, Homo sapiens
cactttgttggcccttccagt

SEQ ID NO: 196784 - DNA, 20 bp, Homo sapiens
cacttttcaatcccaattct

SEQ ID NO: 196785 - DNA, 13 bp, Homo sapiens
cactttttctcga

SEQ ID NO: 196786 - DNA, 18 bp, Homo sapiens
cactttttgcagctttct

SEQ ID NO: 196787 - DNA, 19 bp, Homo sapiens
cagaaaaaaaaaaagaaac

SEQ ID NO: 196788 - DNA, 19 bp, Homo sapiens
cagaaaaaaaaatgtttta

SEQ ID NO: 196789 - DNA, 19 bp, Homo sapiens
cagaaaaaaatggtgcctt

SEQ ID NO: 196790 - DNA, 21 bp, Homo sapiens
cagaaaaataacttcaagcaa

SEQ ID NO: 196791 - DNA, 11 bp, Homo sapiens
cagaaaacaac

SEQ ID NO: 196792 - DNA, 14 bp, Homo sapiens
cagaaaacaacaaa

SEQ ID NO: 196793 - DNA, 20 bp, Homo sapiens
cagaaaacaacaaaaaataa

SEQ ID NO: 196794 - DNA, 11 bp, Homo sapiens
aggggcccagg

SEQ ID NO: 196795 - DNA, 20 bp, Homo sapiens
aggggcccaggctcccctgc

SEQ ID NO: 196796 - DNA, 23 bp, Homo sapiens
aggggcccaggctcccctgcccg

SEQ ID NO: 196797 - DNA, 15 bp, Homo sapiens
aggggccccagatct

SEQ ID NO: 196798 - DNA, 22 bp, Homo sapiens
aggggccccggggctggcaagc

SEQ ID NO: 196799 - DNA, 17 bp, Homo sapiens
aggggcccttgggacag

SEQ ID NO: 196800 - DNA, 17 bp, Homo sapiens
aggggcctagggagccg

SEQ ID NO: 196801 - DNA, 16 bp, Homo sapiens
aggggcctctggctgc

SEQ ID NO: 196802 - DNA, 17 bp, Homo sapiens
aggggcctctggctgcc

SEQ ID NO: 196803 - DNA, 15 bp, Homo sapiens
aggggcctggcagcc

SEQ ID NO: 196804 - DNA, 12 bp, Homo sapiens
aggggcctggcc

SEQ ID NO: 196805 - DNA, 14 bp, Homo sapiens
aggggcctggcctg

SEQ ID NO: 196806 - DNA, 17 bp, Homo sapiens
aggggcggcaggaggga

SEQ ID NO: 196807 - DNA, 15 bp, Homo sapiens
aggggcgtgtccctc

SEQ ID NO: 196808 - DNA, 16 bp, Homo sapiens
aggggctatcccttct

SEQ ID NO: 196809 - DNA, 19 bp, Homo sapiens
aggggctgcatcctcagcc

SEQ ID NO: 196810 - DNA, 22 bp, Homo sapiens
aggggctgcgtctgacatcctg

SEQ ID NO: 196811 - DNA, 14 bp, Homo sapiens
aggggctgctgggg

SEQ ID NO: 196812 - DNA, 19 bp, Homo sapiens
aggggctggccttcctgcc

SEQ ID NO: 196813 - DNA, 23 bp, Homo sapiens
aggggctggccttcctgccctac

SEQ ID NO: 196814 - DNA, 13 bp, Homo sapiens
aggggctgggcag

SEQ ID NO: 196815 - DNA, 23 bp, Homo sapiens
aggggctgggcagaggggagagg

SEQ ID NO: 196816 - DNA, 16 bp, Homo sapiens
agggggagactatgtg

SEQ ID NO: 196817 - DNA, 20 bp, Homo sapiens
agggggagggggttacaaac

SEQ ID NO: 196818 - DNA, 20 bp, Homo sapiens
agggggcccatccctgccca

SEQ ID NO: 196819 - DNA, 17 bp, Homo sapiens
agggggcctgagttgag

SEQ ID NO: 196820 - DNA, 15 bp, Homo sapiens
agggggccttggaat

SEQ ID NO: 196821 - DNA, 19 bp, Homo sapiens
agggggcctttaaagactt

SEQ ID NO: 196822 - DNA, 20 bp, Homo sapiens
agggggcctttaaagactta

SEQ ID NO: 196823 - DNA, 15 bp, Homo sapiens
agggggcgctcagga

SEQ ID NO: 196824 - DNA, 21 bp, Homo sapiens
agggggctctccaaaggggct

SEQ ID NO: 196825 - DNA, 22 bp, Homo sapiens
agggggctctccaaaggggctg

SEQ ID NO: 196826 - DNA, 14 bp, Homo sapiens
aggggggagggctg

SEQ ID NO: 196827 - DNA, 17 bp, Homo sapiens
aggggggctgcctggcc

SEQ ID NO: 196828 - DNA, 24 bp, Homo sapiens
aggggggtcggaagcctgtcctca

SEQ ID NO: 196829 - DNA, 19 bp, Homo sapiens
agggggtgtcatctgagga

SEQ ID NO: 196830 - DNA, 12 bp, Homo sapiens
agggggttacaa

SEQ ID NO: 196831 - DNA, 20 bp, Homo sapiens
agggggttacaaactgcaat

SEQ ID NO: 196832 - DNA, 13 bp, Homo sapiens
aggggtaaatata

SEQ ID NO: 196833 - DNA, 23 bp, Homo sapiens
aggggtaaatatatgttttgaga

SEQ ID NO: 196834 - DNA, 15 bp, Homo sapiens
aggggtaattgcatt

SEQ ID NO: 196835 - DNA, 15 bp, Homo sapiens
aggggtatgtcttta

SEQ ID NO: 196836 - DNA, 14 bp, Homo sapiens
aggggtcaaagaaa

SEQ ID NO: 196837 - DNA, 16 bp, Homo sapiens
aggggtcaaagaaatg

SEQ ID NO: 196838 - DNA, 17 bp, Homo sapiens
cacaactaacaatgcct

SEQ ID NO: 196839 - DNA, 19 bp, Homo sapiens
cacaactaacaatgccttg

SEQ ID NO: 196840 - DNA, 19 bp, Homo sapiens
cacaactagttaaaagcct

SEQ ID NO: 196841 - DNA, 14 bp, Homo sapiens
cacaactatttttc

SEQ ID NO: 196842 - DNA, 23 bp, Homo sapiens
cacaacttaaaaagtctgcatta

SEQ ID NO: 196843 - DNA, 15 bp, Homo sapiens
cacaagagctccttg

SEQ ID NO: 196844 - DNA, 16 bp, Homo sapiens
cacaagagctccttga

SEQ ID NO: 196845 - DNA, 17 bp, Homo sapiens
cacaagaggaagagaga

SEQ ID NO: 196846 - DNA, 20 bp, Homo sapiens
cacaagagggactgtatttc

SEQ ID NO: 196847 - DNA, 23 bp, Homo sapiens
cacaagatggaaaaaaaaaacaa

SEQ ID NO: 196848 - DNA, 17 bp, Homo sapiens
cacaagcaaaccttctc

SEQ ID NO: 196849 - DNA, 14 bp, Homo sapiens
cacaagcattcctt

SEQ ID NO: 196850 - DNA, 16 bp, Homo sapiens
cacaagcattccttag

SEQ ID NO: 196851 - DNA, 12 bp, Homo sapiens
cacaagccaggg

SEQ ID NO: 196852 - DNA, 14 bp, Homo sapiens
cacaagctgcctcc

SEQ ID NO: 196853 - DNA, 14 bp, Homo sapiens
cacaagctgcctct

SEQ ID NO: 196854 - DNA, 20 bp, Homo sapiens
cacaaggagtgcccgccttg

SEQ ID NO: 196855 - DNA, 18 bp, Homo sapiens
cacaaggctgaaaagtgc

SEQ ID NO: 196856 - DNA, 22 bp, Homo sapiens
cacaaggctgaaaagtgctttg

SEQ ID NO: 196857 - DNA, 15 bp, Homo sapiens
cacaaggctggccag

SEQ ID NO: 196858 - DNA, 16 bp, Homo sapiens
cacaaggctggccagc

SEQ ID NO: 196859 - DNA, 17 bp, Homo sapiens
cacaaggctggccagca

SEQ ID NO: 196860 - DNA, 23 bp, Homo sapiens
cacaaggtccactccctgctcca

SEQ ID NO: 196861 - DNA, 16 bp, Homo sapiens
cacaagtaggagacac

SEQ ID NO: 196862 - DNA, 19 bp, Homo sapiens
cacaataaatgtattcaaa

SEQ ID NO: 196863 - DNA, 20 bp, Homo sapiens
cacaataaatgtattcaaat

SEQ ID NO: 196864 - DNA, 16 bp, Homo sapiens
cacaataatgaataat

SEQ ID NO: 196865 - DNA, 20 bp, Homo sapiens
cacaatatgagtaatgttta

SEQ ID NO: 196866 - DNA, 23 bp, Homo sapiens
cacaatcctaacacattatcggg

SEQ ID NO: 196867 - DNA, 20 bp, Homo sapiens
cacaatgatgattaaacacc

SEQ ID NO: 196868 - DNA, 17 bp, Homo sapiens
cacaatgttgcactgaa

SEQ ID NO: 196869 - DNA, 21 bp, Homo sapiens
cacacaaaaaggagcgggcag

SEQ ID NO: 196870 - DNA, 15 bp, Homo sapiens
cacacaaaacaacag

SEQ ID NO: 196871 - DNA, 18 bp, Homo sapiens
cacacaaacacctcctag

SEQ ID NO: 196872 - DNA, 22 bp, Homo sapiens
cacacaaatattgcttggacta

SEQ ID NO: 196873 - DNA, 12 bp, Homo sapiens
cacacaaatgca

SEQ ID NO: 196874 - DNA, 18 bp, Homo sapiens
cacacaaatgcagacaca

SEQ ID NO: 196875 - DNA, 19 bp, Homo sapiens
cacacaaatgcagacacac

SEQ ID NO: 196876 - DNA, 14 bp, Homo sapiens
cacacaacaaaaat

SEQ ID NO: 196877 - DNA, 15 bp, Homo sapiens
cacacacaaaacaac

SEQ ID NO: 196878 - DNA, 13 bp, Homo sapiens
cacacacaaatgc

SEQ ID NO: 196879 - DNA, 15 bp, Homo sapiens
cacacacacaaatgc

SEQ ID NO: 196880 - DNA, 15 bp, Homo sapiens
cacacacacaacaaa

SEQ ID NO: 196881 - DNA, 14 bp, Homo sapiens
cacacacacacaca

SEQ ID NO: 196882 - DNA, 15 bp, Homo sapiens
cacacacacacacag

SEQ ID NO: 196883 - DNA, 16 bp, Homo sapiens
cacacacacacacagc

SEQ ID NO: 196884 - DNA, 13 bp, Homo sapiens
cacacacacacag

SEQ ID NO: 196885 - DNA, 16 bp, Homo sapiens
cacacacacacagcca

SEQ ID NO: 196886 - DNA, 12 bp, Homo sapiens
cacacacacagc

SEQ ID NO: 196887 - DNA, 15 bp, Homo sapiens
cacacacacagccat

SEQ ID NO: 196888 - DNA, 16 bp, Homo sapiens
cacacacacccttccc

SEQ ID NO: 196889 - DNA, 14 bp, Homo sapiens
cacacacacgcacg

SEQ ID NO: 196890 - DNA, 12 bp, Homo sapiens
cacacacagcca

SEQ ID NO: 196891 - DNA, 12 bp, Homo sapiens
cacacacagcct

SEQ ID NO: 196892 - DNA, 13 bp, Homo sapiens
cacacacagcctg

SEQ ID NO: 196893 - DNA, 15 bp, Homo sapiens
cacacacagcctggc

SEQ ID NO: 196894 - DNA, 16 bp, Homo sapiens
cacacacagctgggca

SEQ ID NO: 196895 - DNA, 14 bp, Homo sapiens
cacacacgcacgca

SEQ ID NO: 196896 - DNA, 18 bp, Homo sapiens
cacacacgcacgcacaca

SEQ ID NO: 196897 - DNA, 19 bp, Homo sapiens
cacacacgcacgcacacac

SEQ ID NO: 196898 - DNA, 14 bp, Homo sapiens
cacacacgcagaca

SEQ ID NO: 196899 - DNA, 18 bp, Homo sapiens
cacacacgcagacacaca

SEQ ID NO: 196900 - DNA, 20 bp, Homo sapiens
cacacagagtggtctttctg

SEQ ID NO: 196901 - DNA, 13 bp, Homo sapiens
cacacagcctggc

SEQ ID NO: 196902 - DNA, 17 bp, Homo sapiens
cacacagcctggcctcc

SEQ ID NO: 196903 - DNA, 11 bp, Homo sapiens
cacacagcctt

SEQ ID NO: 196904 - DNA, 15 bp, Homo sapiens
cacacagcctttctg

SEQ ID NO: 196905 - DNA, 14 bp, Homo sapiens
cacacagctgggca

SEQ ID NO: 196906 - DNA, 21 bp, Homo sapiens
cacacaggagtcctttctttt

SEQ ID NO: 196907 - DNA, 18 bp, Homo sapiens
cacacaggcccatgccct

SEQ ID NO: 196908 - DNA, 21 bp, Homo sapiens
cacacaggcctggcccagcca

SEQ ID NO: 196909 - DNA, 22 bp, Homo sapiens
cacacaggcctggcccagccag

SEQ ID NO: 196910 - DNA, 12 bp, Homo sapiens
cacacagtattc

SEQ ID NO: 196911 - DNA, 12 bp, Homo sapiens
cacacagtgggc

SEQ ID NO: 196912 - DNA, 22 bp, Homo sapiens
cacacagtgggccggccccagg

SEQ ID NO: 196913 - DNA, 13 bp, Homo sapiens
cacacataacaca

SEQ ID NO: 196914 - DNA, 15 bp, Homo sapiens
cacacataacacaca

SEQ ID NO: 196915 - DNA, 18 bp, Homo sapiens
cacacataacacacatca

SEQ ID NO: 196916 - DNA, 21 bp, Homo sapiens
cacacatataaacatcacaca

SEQ ID NO: 196917 - DNA, 15 bp, Homo sapiens
cacacatgcaaggga

SEQ ID NO: 196918 - DNA, 17 bp, Homo sapiens
cacacattctgtataat

SEQ ID NO: 196919 - DNA, 19 bp, Homo sapiens
cacaccaaattgctgagat

SEQ ID NO: 196920 - DNA, 20 bp, Homo sapiens
cacaccactgccctgcctgc

SEQ ID NO: 196921 - DNA, 17 bp, Homo sapiens
cacaccaggctgtgggc

SEQ ID NO: 196922 - DNA, 19 bp, Homo sapiens
cacaccaggctgtgggcct

SEQ ID NO: 196923 - DNA, 21 bp, Homo sapiens
cacaccaggctgtgggcctca

SEQ ID NO: 196924 - DNA, 19 bp, Homo sapiens
cacaccagtcacacattat

SEQ ID NO: 196925 - DNA, 12 bp, Homo sapiens
cacaccagtggc

SEQ ID NO: 196926 - DNA, 13 bp, Homo sapiens
cacaccccacacc

SEQ ID NO: 196927 - DNA, 15 bp, Homo sapiens
cacaccccagcccac

SEQ ID NO: 196928 - DNA, 14 bp, Homo sapiens
cacaccccgtctgc

SEQ ID NO: 196929 - DNA, 21 bp, Homo sapiens
cacaccccgtctgccccttga

SEQ ID NO: 196930 - DNA, 20 bp, Homo sapiens
cacaccctcactctgccagg

SEQ ID NO: 196931 - DNA, 11 bp, Homo sapiens
cacaccctgca

SEQ ID NO: 196932 - DNA, 12 bp, Homo sapiens
cacaccctgcaa

SEQ ID NO: 196933 - DNA, 11 bp, Homo sapiens
cacacccttcc

SEQ ID NO: 196934 - DNA, 14 bp, Homo sapiens
cacacctcacgctc

SEQ ID NO: 196935 - DNA, 16 bp, Homo sapiens
cacacctcacgctctg

SEQ ID NO: 196936 - DNA, 17 bp, Homo sapiens
cacacctcagttccctt

SEQ ID NO: 196937 - DNA, 15 bp, Homo sapiens
cacacctccacccgt

SEQ ID NO: 196938 - DNA, 15 bp, Homo sapiens
cacacctgcctctga

SEQ ID NO: 196939 - DNA, 13 bp, Homo sapiens
cacacctgcctgc

SEQ ID NO: 196940 - DNA, 23 bp, Homo sapiens
caccactagggtcctggccctct

SEQ ID NO: 196941 - DNA, 17 bp, Homo sapiens
caccactgccctgcctg

SEQ ID NO: 196942 - DNA, 22 bp, Homo sapiens
caccactgccctgcctgcccac

SEQ ID NO: 196943 - DNA, 14 bp, Homo sapiens
caccactgtcccta

SEQ ID NO: 196944 - DNA, 18 bp, Homo sapiens
caccactgtccctaccac

SEQ ID NO: 196945 - DNA, 11 bp, Homo sapiens
caccacttaat

SEQ ID NO: 196946 - DNA, 18 bp, Homo sapiens
caccagaattagtcctca

SEQ ID NO: 196947 - DNA, 21 bp, Homo sapiens
caccagaattagtcctcacag

SEQ ID NO: 196948 - DNA, 21 bp, Homo sapiens
caccagacctgttctgacctc

SEQ ID NO: 196949 - DNA, 21 bp, Homo sapiens
caccagagcatttccaacacc

SEQ ID NO: 196950 - DNA, 17 bp, Homo sapiens
caccagatgagaagtta

SEQ ID NO: 196951 - DNA, 14 bp, Homo sapiens
caccagcaacatct

SEQ ID NO: 196952 - DNA, 22 bp, Homo sapiens
caccagcagcacaattctgtcc

SEQ ID NO: 196953 - DNA, 20 bp, Homo sapiens
caccagcccacatccagtgg

SEQ ID NO: 196954 - DNA, 16 bp, Homo sapiens
caccagccccctggat

SEQ ID NO: 196955 - DNA, 21 bp, Homo sapiens
caccagccctgctgcttccta

SEQ ID NO: 196956 - DNA, 23 bp, Homo sapiens
caccagccctgctgcttcctaac

SEQ ID NO: 196957 - DNA, 19 bp, Homo sapiens
caccagcccttccctgctt

SEQ ID NO: 196958 - DNA, 17 bp, Homo sapiens
caccagccgccccagcc

SEQ ID NO: 196959 - DNA, 11 bp, Homo sapiens
caccagcctga

SEQ ID NO: 196960 - DNA, 13 bp, Homo sapiens
caccagcctgagc

SEQ ID NO: 196961 - DNA, 15 bp, Homo sapiens
caccagcctgagcca

SEQ ID NO: 196962 - DNA, 20 bp, Homo sapiens
caccagcctgagccacagtg

SEQ ID NO: 196963 - DNA, 13 bp, Homo sapiens
caccagctcagcc

SEQ ID NO: 196964 - DNA, 14 bp, Homo sapiens
caccagctcagccc

SEQ ID NO: 196965 - DNA, 22 bp, Homo sapiens
caccagctcagccccggccact

SEQ ID NO: 196966 - DNA, 13 bp, Homo sapiens
caccagctccact

SEQ ID NO: 196967 - DNA, 18 bp, Homo sapiens
caccagctccactggcct

SEQ ID NO: 196968 - DNA, 23 bp, Homo sapiens
caccagctcgtttttcagcaccc

SEQ ID NO: 196969 - DNA, 16 bp, Homo sapiens
caccagctctgtggcc

SEQ ID NO: 196970 - DNA, 17 bp, Homo sapiens
caccagctctgtggcct

SEQ ID NO: 196971 - DNA, 18 bp, Homo sapiens
caccagctctgtggcctg

SEQ ID NO: 196972 - DNA, 22 bp, Homo sapiens
caccagctctgtggcctgtgtc

SEQ ID NO: 196973 - DNA, 15 bp, Homo sapiens
caccagctgctctgc

SEQ ID NO: 196974 - DNA, 17 bp, Homo sapiens
caccagctgctctgccc

SEQ ID NO: 196975 - DNA, 17 bp, Homo sapiens
caccaggaagaaggccc

SEQ ID NO: 196976 - DNA, 17 bp, Homo sapiens
caccaggagaaccacta

SEQ ID NO: 196977 - DNA, 17 bp, Homo sapiens
caccaggctgtgggcct

SEQ ID NO: 196978 - DNA, 16 bp, Homo sapiens
caccagggatggtact

SEQ ID NO: 196979 - DNA, 23 bp, Homo sapiens
caccagggtccgcaccagctgct

SEQ ID NO: 196980 - DNA, 18 bp, Homo sapiens
aggccccagcctccaggc

SEQ ID NO: 196981 - DNA, 14 bp, Homo sapiens
aggccccaggccct

SEQ ID NO: 196982 - DNA, 21 bp, Homo sapiens
aggcccccggaggcgcccacc

SEQ ID NO: 196983 - DNA, 13 bp, Homo sapiens
aggccccctgcat

SEQ ID NO: 196984 - DNA, 12 bp, Homo sapiens
aggcccctgagg

SEQ ID NO: 196985 - DNA, 23 bp, Homo sapiens
aggcccgagatgtgacccaccag

SEQ ID NO: 196986 - DNA, 19 bp, Homo sapiens
aggcccgggcccctggcac

SEQ ID NO: 196987 - DNA, 22 bp, Homo sapiens
aggccctaggattcctccccca

SEQ ID NO: 196988 - DNA, 13 bp, Homo sapiens
aggccctccctgt

SEQ ID NO: 196989 - DNA, 16 bp, Homo sapiens
aggccctccctgtctc

SEQ ID NO: 196990 - DNA, 22 bp, Homo sapiens
aggccctccctgtctccagggc

SEQ ID NO: 196991 - DNA, 16 bp, Homo sapiens
aggccctgccttcagc

SEQ ID NO: 196992 - DNA, 19 bp, Homo sapiens
aggcccttcctctccactg

SEQ ID NO: 196993 - DNA, 22 bp, Homo sapiens
aggcccttcctctccactgcct

SEQ ID NO: 196994 - DNA, 18 bp, Homo sapiens
aggcccttgtcctgccag

SEQ ID NO: 196995 - DNA, 20 bp, Homo sapiens
aggcccttgtcctgccagct

SEQ ID NO: 196996 - DNA, 14 bp, Homo sapiens
aggcccttttctgg

SEQ ID NO: 196997 - DNA, 18 bp, Homo sapiens
aggcccttttctggctcc

SEQ ID NO: 196998 - DNA, 17 bp, Homo sapiens
aggccgaagaagggtcc

SEQ ID NO: 196999 - DNA, 14 bp, Homo sapiens
aggccgaggcaggg

SEQ ID NO: 197000 - DNA, 19 bp, Homo sapiens
aggccgaggcaggggctgg

SEQ ID NO: 197001 - DNA, 14 bp, Homo sapiens
aggccgcatctttc

SEQ ID NO: 197002 - DNA, 15 bp, Homo sapiens
aggccgcatggcccc

SEQ ID NO: 197003 - DNA, 22 bp, Homo sapiens
aggccgcatggcccctccagga

SEQ ID NO: 197004 - DNA, 22 bp, Homo sapiens
aggccgcccacctgcatcagcc

SEQ ID NO: 197005 - DNA, 18 bp, Homo sapiens
aggccgccccagcctctg

SEQ ID NO: 197006 - DNA, 20 bp, Homo sapiens
aggccgctagaggcctgagg

SEQ ID NO: 197007 - DNA, 15 bp, Homo sapiens
aggccggccagctcc

SEQ ID NO: 197008 - DNA, 21 bp, Homo sapiens
aggccgggccgaatcccctcc

SEQ ID NO: 197009 - DNA, 19 bp, Homo sapiens
aggccggtgggaagagggc

SEQ ID NO: 197010 - DNA, 22 bp, Homo sapiens
aggccggtgggaagagggcagg

SEQ ID NO: 197011 - DNA, 16 bp, Homo sapiens
aggccgtcctcccggg

SEQ ID NO: 197012 - DNA, 12 bp, Homo sapiens
aggccgtggctg

SEQ ID NO: 197013 - DNA, 20 bp, Homo sapiens
aggcctagtcagccacatgg

SEQ ID NO: 197014 - DNA, 20 bp, Homo sapiens
aggcctatgccacctgcagc

SEQ ID NO: 197015 - DNA, 16 bp, Homo sapiens
aggcctcaccctgctt

SEQ ID NO: 197016 - DNA, 16 bp, Homo sapiens
aggcctcaggcctccc

SEQ ID NO: 197017 - DNA, 13 bp, Homo sapiens
aggcctcagtgga

SEQ ID NO: 197018 - DNA, 15 bp, Homo sapiens
aggcctcagtggact

SEQ ID NO: 197019 - DNA, 16 bp, Homo sapiens
aggcctcagtggactt

SEQ ID NO: 197020 - DNA, 23 bp, Homo sapiens
aggcctcatcctcctggacccag

SEQ ID NO: 197021 - DNA, 13 bp, Homo sapiens
aggcctccagcct

SEQ ID NO: 197022 - DNA, 14 bp, Homo sapiens
aggcctccagcctc

SEQ ID NO: 197023 - DNA, 14 bp, Homo sapiens
aggcctcggcagaa

SEQ ID NO: 197024 - DNA, 23 bp, Homo sapiens
aggcctcggcagaactctctgtc

SEQ ID NO: 197025 - DNA, 14 bp, Homo sapiens
aggcctcttgctgg

SEQ ID NO: 197026 - DNA, 17 bp, Homo sapiens
aggcctcttgctggtgc

SEQ ID NO: 197027 - DNA, 14 bp, Homo sapiens
aggcctcttgtgct

SEQ ID NO: 197028 - DNA, 20 bp, Homo sapiens
aggcctcttgtgctcacgct

SEQ ID NO: 197029 - DNA, 17 bp, Homo sapiens
aggcctgaaagaggctg

SEQ ID NO: 197030 - DNA, 21 bp, Homo sapiens
aggcctgacctcaagcaacca

SEQ ID NO: 197031 - DNA, 20 bp, Homo sapiens
aggcctgaggatgagctgga

SEQ ID NO: 197032 - DNA, 16 bp, Homo sapiens
aggcctgaggctgctg

SEQ ID NO: 197033 - DNA, 18 bp, Homo sapiens
aggcctgagggaagccca

SEQ ID NO: 197034 - DNA, 19 bp, Homo sapiens
aggcctgagggaagcccac

SEQ ID NO: 197035 - DNA, 23 bp, Homo sapiens
aggcctgagggaagcccacccgc

SEQ ID NO: 197036 - DNA, 15 bp, Homo sapiens
aggcctgatgctgcc

SEQ ID NO: 197037 - DNA, 20 bp, Homo sapiens
aggcctgccaatgccacagc

SEQ ID NO: 197038 - DNA, 12 bp, Homo sapiens
aggcctgccagc

SEQ ID NO: 197039 - DNA, 23 bp, Homo sapiens
aggcctgccccccttcccacccc

SEQ ID NO: 197040 - DNA, 22 bp, Homo sapiens
aggcctggaaccagggaggaga

SEQ ID NO: 197041 - DNA, 19 bp, Homo sapiens
aggcctggactttcctgca

SEQ ID NO: 197042 - DNA, 18 bp, Homo sapiens
aggcctggcccagccagc

SEQ ID NO: 197043 - DNA, 16 bp, Homo sapiens
aggcctgggacccagc

SEQ ID NO: 197044 - DNA, 18 bp, Homo sapiens
aggcctgggacccagcta

SEQ ID NO: 197045 - DNA, 19 bp, Homo sapiens
aggcctgggacccagctac

SEQ ID NO: 197046 - DNA, 14 bp, Homo sapiens
aggcctgggagggc

SEQ ID NO: 197047 - DNA, 16 bp, Homo sapiens
aggcctgggagggcaa

SEQ ID NO: 197048 - DNA, 21 bp, Homo sapiens
aggcctgggtctgtgtctctt

SEQ ID NO: 197049 - DNA, 16 bp, Homo sapiens
aggcctgggtgctggc

SEQ ID NO: 197050 - DNA, 20 bp, Homo sapiens
aggcctggtcagcagagccg

SEQ ID NO: 197051 - DNA, 23 bp, Homo sapiens
aggcctggtcagcagagccgccc

SEQ ID NO: 197052 - DNA, 22 bp, Homo sapiens
aggcctgtccctggccatctct

SEQ ID NO: 197053 - DNA, 22 bp, Homo sapiens
aggcctgtgtgtaagctgactg

SEQ ID NO: 197054 - DNA, 23 bp, Homo sapiens
aggcctgtgtgtaagctgactgg

SEQ ID NO: 197055 - DNA, 15 bp, Homo sapiens
aggcgagccaggcaa

SEQ ID NO: 197056 - DNA, 15 bp, Homo sapiens
aggcgaggagagtgg

SEQ ID NO: 197057 - DNA, 16 bp, Homo sapiens
aggcgaggcgaagctg

SEQ ID NO: 197058 - DNA, 19 bp, Homo sapiens
aggcgaggctgcctctggg

SEQ ID NO: 197059 - DNA, 22 bp, Homo sapiens
aggcgaggctgcctctgggtga

SEQ ID NO: 197060 - DNA, 18 bp, Homo sapiens
aggcgcagccctagtggg

SEQ ID NO: 197061 - DNA, 19 bp, Homo sapiens
aggcgcccacctgcccagt

SEQ ID NO: 197062 - DNA, 14 bp, Homo sapiens
aggcgcccctgggg

SEQ ID NO: 197063 - DNA, 20 bp, Homo sapiens
aggcgcgtctgccccaccct

SEQ ID NO: 197064 - DNA, 22 bp, Homo sapiens
aggcgcgtctgccccaccctca

SEQ ID NO: 197065 - DNA, 18 bp, Homo sapiens
aggcgctcgctcccatgc

SEQ ID NO: 197066 - DNA, 14 bp, Homo sapiens
aggcggcagctggg

SEQ ID NO: 197067 - DNA, 16 bp, Homo sapiens
aggcggcgatttttgt

SEQ ID NO: 197068 - DNA, 14 bp, Homo sapiens
aggcgggggagcct

SEQ ID NO: 197069 - DNA, 19 bp, Homo sapiens
atgggaacaagtgtacaga

SEQ ID NO: 197070 - DNA, 23 bp, Homo sapiens
atgggaacaagtgtacagaagaa

SEQ ID NO: 197071 - DNA, 21 bp, Homo sapiens
atgggaacgcagcctccagtt

SEQ ID NO: 197072 - DNA, 13 bp, Homo sapiens
atgggaagggctt

SEQ ID NO: 197073 - DNA, 21 bp, Homo sapiens
atgggaatgaatgtcagtgtg

SEQ ID NO: 197074 - DNA, 12 bp, Homo sapiens
atgggactgatg

SEQ ID NO: 197075 - DNA, 17 bp, Homo sapiens
atgggactgatgtcatc

SEQ ID NO: 197076 - DNA, 19 bp, Homo sapiens
atgggactgatgtcatctt

SEQ ID NO: 197077 - DNA, 21 bp, Homo sapiens
atgggactggagtcagatgag

SEQ ID NO: 197078 - DNA, 13 bp, Homo sapiens
atgggactgggag

SEQ ID NO: 197079 - DNA, 16 bp, Homo sapiens
atgggactgggagggc

SEQ ID NO: 197080 - DNA, 18 bp, Homo sapiens
atgggactgtgcctttgg

SEQ ID NO: 197081 - DNA, 15 bp, Homo sapiens
atgggagatggtcag

SEQ ID NO: 197082 - DNA, 16 bp, Homo sapiens
atgggagatggtcagt

SEQ ID NO: 197083 - DNA, 13 bp, Homo sapiens
atgggagccccag

SEQ ID NO: 197084 - DNA, 22 bp, Homo sapiens
atgggagccccagggtcttccc

SEQ ID NO: 197085 - DNA, 14 bp, Homo sapiens
atgggaggaacaaa

SEQ ID NO: 197086 - DNA, 16 bp, Homo sapiens
atgggagtcagggagc

SEQ ID NO: 197087 - DNA, 21 bp, Homo sapiens
atgggagtcagggagccctgg

SEQ ID NO: 197088 - DNA, 13 bp, Homo sapiens
atgggagtgggca

SEQ ID NO: 197089 - DNA, 21 bp, Homo sapiens
atgggatatgtggtgtatatc

SEQ ID NO: 197090 - DNA, 15 bp, Homo sapiens
atgggatcctggagt

SEQ ID NO: 197091 - DNA, 19 bp, Homo sapiens
atgggcacaggctgcccca

SEQ ID NO: 197092 - DNA, 15 bp, Homo sapiens
atgggcactggaaaa

SEQ ID NO: 197093 - DNA, 13 bp, Homo sapiens
atgggcagctggg

SEQ ID NO: 197094 - DNA, 22 bp, Homo sapiens
atgggcatggggtgggcctctg

SEQ ID NO: 197095 - DNA, 14 bp, Homo sapiens
atgggcattgggct

SEQ ID NO: 197096 - DNA, 21 bp, Homo sapiens
atgggcattgggctgacacct

SEQ ID NO: 197097 - DNA, 15 bp, Homo sapiens
atgggccaagccagg

SEQ ID NO: 197098 - DNA, 23 bp, Homo sapiens
atgggccaagccagggttccaga

SEQ ID NO: 197099 - DNA, 18 bp, Homo sapiens
atgggccacccaccaggg

SEQ ID NO: 197100 - DNA, 19 bp, Homo sapiens
atgggccacccaccagggc

SEQ ID NO: 197101 - DNA, 13 bp, Homo sapiens
atgggcctgctgc

SEQ ID NO: 197102 - DNA, 20 bp, Homo sapiens
atgggcctggccacctctct

SEQ ID NO: 197103 - DNA, 12 bp, Homo sapiens
atgggcctgggc

SEQ ID NO: 197104 - DNA, 17 bp, Homo sapiens
atgggcctgggcctgct

SEQ ID NO: 197105 - DNA, 19 bp, Homo sapiens
atgggccttgctttgggct

SEQ ID NO: 197106 - DNA, 13 bp, Homo sapiens
atgggcgagtccc

SEQ ID NO: 197107 - DNA, 20 bp, Homo sapiens
atgggcttggacttcctggg

SEQ ID NO: 197108 - DNA, 20 bp, Homo sapiens
atggggagatcggggccaga

SEQ ID NO: 197109 - DNA, 14 bp, Homo sapiens
atggggcctctgtt

SEQ ID NO: 197110 - DNA, 23 bp, Homo sapiens
atggggcttggagcaccgaggcc

SEQ ID NO: 197111 - DNA, 18 bp, Homo sapiens
atgggggaggctctgaag

SEQ ID NO: 197112 - DNA, 17 bp, Homo sapiens
atgggggcactgaggac

SEQ ID NO: 197113 - DNA, 22 bp, Homo sapiens
atgggggctccagacattgtat

SEQ ID NO: 197114 - DNA, 20 bp, Homo sapiens
atggggggaggggggagggc

SEQ ID NO: 197115 - DNA, 22 bp, Homo sapiens
atggggggagtgagctctctca

SEQ ID NO: 197116 - DNA, 16 bp, Homo sapiens
atggggggccaacacc

SEQ ID NO: 197117 - DNA, 15 bp, Homo sapiens
atggggggtatattt

SEQ ID NO: 197118 - DNA, 19 bp, Homo sapiens
atggggtgggcctctggtt

SEQ ID NO: 197119 - DNA, 18 bp, Homo sapiens
atggggttggctgggccc

SEQ ID NO: 197120 - DNA, 23 bp, Homo sapiens
atgggtagcttctgacctcagca

SEQ ID NO: 197121 - DNA, 14 bp, Homo sapiens
atgggtcacaggaa

SEQ ID NO: 197122 - DNA, 21 bp, Homo sapiens
atgggtcccgggttagcctgg

SEQ ID NO: 197123 - DNA, 21 bp, Homo sapiens
atgggtcccttccccctgctc

SEQ ID NO: 197124 - DNA, 22 bp, Homo sapiens
atgggtcccttccccctgctcc

SEQ ID NO: 197125 - DNA, 18 bp, Homo sapiens
atggtaaagatattattc

SEQ ID NO: 197126 - DNA, 22 bp, Homo sapiens
atggtaaccgagccagcagctg

SEQ ID NO: 197127 - DNA, 15 bp, Homo sapiens
atggtaccagccctg

SEQ ID NO: 197128 - DNA, 13 bp, Homo sapiens
atggtactattta

SEQ ID NO: 197129 - DNA, 21 bp, Homo sapiens
atggtagaagatgaatcagta

SEQ ID NO: 197130 - DNA, 16 bp, Homo sapiens
atggtagactgtgaca

SEQ ID NO: 197131 - DNA, 23 bp, Homo sapiens
atggtagctcgccaaccgcatct

SEQ ID NO: 197132 - DNA, 21 bp, Homo sapiens
atggtatatttggtactgtat

SEQ ID NO: 197133 - DNA, 16 bp, Homo sapiens
atggtattgaaggaat

SEQ ID NO: 197134 - DNA, 12 bp, Homo sapiens
atggtattttcg

SEQ ID NO: 197135 - DNA, 20 bp, Homo sapiens
atggtcaacacttaagggtt

SEQ ID NO: 197136 - DNA, 20 bp, Homo sapiens
atggtcagtgtggagagggg

SEQ ID NO: 197137 - DNA, 19 bp, Homo sapiens
atggtccatttcatgtgat

SEQ ID NO: 197138 - DNA, 22 bp, Homo sapiens
atggtccatttcatgtgatcta

SEQ ID NO: 197139 - DNA, 20 bp, Homo sapiens
atggtcccaggaagcaggga

SEQ ID NO: 197140 - DNA, 22 bp, Homo sapiens
atggtcccaggaagcagggaga

SEQ ID NO: 197141 - DNA, 23 bp, Homo sapiens
atggtcctcacaagcctcttctg

SEQ ID NO: 197142 - DNA, 21 bp, Homo sapiens
atggtctcttccagcccagac

SEQ ID NO: 197143 - DNA, 24 bp, Homo sapiens
atggtgaaaccccgtctctactaa

SEQ ID NO: 197144 - DNA, 17 bp, Homo sapiens
atggtgaatattacatt

SEQ ID NO: 197145 - DNA, 14 bp, Homo sapiens
atggtgacttttga

SEQ ID NO: 197146 - DNA, 15 bp, Homo sapiens
atggtgacttttgaa

SEQ ID NO: 197147 - DNA, 14 bp, Homo sapiens
atggtgagaattaa

SEQ ID NO: 197148 - DNA, 20 bp, Homo sapiens
atggtgaggcttaacaatgt

SEQ ID NO: 197149 - DNA, 16 bp, Homo sapiens
atggtgcaatgaatta

SEQ ID NO: 197150 - DNA, 13 bp, Homo sapiens
atggtgccccctg

SEQ ID NO: 197151 - DNA, 15 bp, Homo sapiens
atggtgcctctggag

SEQ ID NO: 197152 - DNA, 22 bp, Homo sapiens
atggtggcacgtgcctgtagtc

SEQ ID NO: 197153 - DNA, 14 bp, Homo sapiens
atggtggccctggg

SEQ ID NO: 197154 - DNA, 15 bp, Homo sapiens
atggtggccctgggg

SEQ ID NO: 197155 - DNA, 20 bp, Homo sapiens
atggtggccctggggaagag

SEQ ID NO: 197156 - DNA, 19 bp, Homo sapiens
atggtggggatatttttaa

SEQ ID NO: 197157 - DNA, 17 bp, Homo sapiens
atggtggtttcagaaag

SEQ ID NO: 197158 - DNA, 17 bp, Homo sapiens
atggtgtgtgtctctga

SEQ ID NO: 197159 - DNA, 18 bp, Homo sapiens
atggtgtgtgtctctgac

SEQ ID NO: 197160 - DNA, 19 bp, Homo sapiens
atggtgtgtgtctctgaca

SEQ ID NO: 197161 - DNA, 16 bp, Homo sapiens
atggtgttttcatgta

SEQ ID NO: 197162 - DNA, 17 bp, Homo sapiens
atggttccatgcctgag

SEQ ID NO: 197163 - DNA, 22 bp, Homo sapiens
atggttccatgcctgagggtgg

SEQ ID NO: 197164 - DNA, 13 bp, Homo sapiens
atggttccttccc

SEQ ID NO: 197165 - DNA, 20 bp, Homo sapiens
atggttccttccctgggaag

SEQ ID NO: 197166 - DNA, 19 bp, Homo sapiens
atggttgagaaatgaataa

SEQ ID NO: 197167 - DNA, 17 bp, Homo sapiens
atggttgccttaaagaa

SEQ ID NO: 197168 - DNA, 22 bp, Homo sapiens
atggttgggacaatggcaatag

SEQ ID NO: 197169 - DNA, 13 bp, Homo sapiens
atggtttactgct

SEQ ID NO: 197170 - DNA, 16 bp, Homo sapiens
atggtttggtttttct

SEQ ID NO: 197171 - DNA, 11 bp, Homo sapiens
atgtaaaaaag

SEQ ID NO: 197172 - DNA, 13 bp, Homo sapiens
atgtaaaaaagaa

SEQ ID NO: 197173 - DNA, 20 bp, Homo sapiens
atgtaaaaatgaaggaatta

SEQ ID NO: 197174 - DNA, 20 bp, Homo sapiens
atgtaaaacaaaaaacaata

SEQ ID NO: 197175 - DNA, 15 bp, Homo sapiens
atgtaaaacagaata

SEQ ID NO: 197176 - DNA, 12 bp, Homo sapiens
atgtaaaatctt

SEQ ID NO: 197177 - DNA, 20 bp, Homo sapiens
agcaatttatacaatatcat

SEQ ID NO: 197178 - DNA, 18 bp, Homo sapiens
agcacaaaccctggggac

SEQ ID NO: 197179 - DNA, 15 bp, Homo sapiens
agcacaaactttagg

SEQ ID NO: 197180 - DNA, 11 bp, Homo sapiens
agcacaaagat

SEQ ID NO: 197181 - DNA, 18 bp, Homo sapiens
agcacaagaagtgggagt

SEQ ID NO: 197182 - DNA, 14 bp, Homo sapiens
agcacaagttcctg

SEQ ID NO: 197183 - DNA, 18 bp, Homo sapiens
agcacaattctgtccctg

SEQ ID NO: 197184 - DNA, 18 bp, Homo sapiens
agcacagactgttccctc

SEQ ID NO: 197185 - DNA, 12 bp, Homo sapiens
agcacagagagg

SEQ ID NO: 197186 - DNA, 21 bp, Homo sapiens
agcacagcagcccctgcacaa

SEQ ID NO: 197187 - DNA, 11 bp, Homo sapiens
agcacagctct

SEQ ID NO: 197188 - DNA, 13 bp, Homo sapiens
agcacaggcagct

SEQ ID NO: 197189 - DNA, 22 bp, Homo sapiens
agcacagtgttaaatgaaattg

SEQ ID NO: 197190 - DNA, 14 bp, Homo sapiens
agcacatcatggca

SEQ ID NO: 197191 - DNA, 15 bp, Homo sapiens
agcacatctgcattt

SEQ ID NO: 197192 - DNA, 23 bp, Homo sapiens
agcacatctgcattttcacccca

SEQ ID NO: 197193 - DNA, 19 bp, Homo sapiens
agcacatgctggccagcct

SEQ ID NO: 197194 - DNA, 21 bp, Homo sapiens
agcacatgctggccagcctgg

SEQ ID NO: 197195 - DNA, 22 bp, Homo sapiens
agcacattttgacacaatgttg

SEQ ID NO: 197196 - DNA, 16 bp, Homo sapiens
agcaccaatacaaatt

SEQ ID NO: 197197 - DNA, 12 bp, Homo sapiens
agcaccacccta

SEQ ID NO: 197198 - DNA, 23 bp, Homo sapiens
agcaccaccctagtcccttcccc

SEQ ID NO: 197199 - DNA, 18 bp, Homo sapiens
aggagctgggagccgggc

SEQ ID NO: 197200 - DNA, 12 bp, Homo sapiens
aggagctgggga

SEQ ID NO: 197201 - DNA, 20 bp, Homo sapiens
aggagcttacctcccacctt

SEQ ID NO: 197202 - DNA, 16 bp, Homo sapiens
aggagcttccagatgg

SEQ ID NO: 197203 - DNA, 17 bp, Homo sapiens
aggaggaagggactggt

SEQ ID NO: 197204 - DNA, 20 bp, Homo sapiens
aggaggaagggactggtcca

SEQ ID NO: 197205 - DNA, 15 bp, Homo sapiens
aggaggaagtcatgg

SEQ ID NO: 197206 - DNA, 22 bp, Homo sapiens
aggaggacctggggggggcaag

SEQ ID NO: 197207 - DNA, 23 bp, Homo sapiens
aggaggacctggggggggcaaga

SEQ ID NO: 197208 - DNA, 13 bp, Homo sapiens
aggaggagaaaat

SEQ ID NO: 197209 - DNA, 11 bp, Homo sapiens
aggaggagaga

SEQ ID NO: 197210 - DNA, 15 bp, Homo sapiens
aggaggagagagatg

SEQ ID NO: 197211 - DNA, 17 bp, Homo sapiens
aggaggagagagatgct

SEQ ID NO: 197212 - DNA, 17 bp, Homo sapiens
aggaggagatggccata

SEQ ID NO: 197213 - DNA, 16 bp, Homo sapiens
aggaggatgctgtgcc

SEQ ID NO: 197214 - DNA, 17 bp, Homo sapiens
aggaggatgctgtgcct

SEQ ID NO: 197215 - DNA, 14 bp, Homo sapiens
aggaggcagaaagc

SEQ ID NO: 197216 - DNA, 16 bp, Homo sapiens
aggaggcagaaccagc

SEQ ID NO: 197217 - DNA, 14 bp, Homo sapiens
aggaggcagccccc

SEQ ID NO: 197218 - DNA, 17 bp, Homo sapiens
aggaggcccctggccca

SEQ ID NO: 197219 - DNA, 14 bp, Homo sapiens
aggaggcctgggag

SEQ ID NO: 197220 - DNA, 17 bp, Homo sapiens
aggaggcctgggagggc

SEQ ID NO: 197221 - DNA, 18 bp, Homo sapiens
aggaggcctgggagggca

SEQ ID NO: 197222 - DNA, 12 bp, Homo sapiens
aggaggctggag

SEQ ID NO: 197223 - DNA, 18 bp, Homo sapiens
aggaggctggaggaaggg

SEQ ID NO: 197224 - DNA, 13 bp, Homo sapiens
aggagggcagagc

SEQ ID NO: 197225 - DNA, 15 bp, Homo sapiens
aggagggcagagcca

SEQ ID NO: 197226 - DNA, 17 bp, Homo sapiens
aggagggcagagccatg

SEQ ID NO: 197227 - DNA, 23 bp, Homo sapiens
aggagggcagagccatgggcctg

SEQ ID NO: 197228 - DNA, 20 bp, Homo sapiens
aggagggccctacctgattg

SEQ ID NO: 197229 - DNA, 14 bp, Homo sapiens
aggagggcctctgg

SEQ ID NO: 197230 - DNA, 12 bp, Homo sapiens
aggaggggcctc

SEQ ID NO: 197231 - DNA, 14 bp, Homo sapiens
aggaggggcctctg

SEQ ID NO: 197232 - DNA, 17 bp, Homo sapiens
aggaggggtaaatatat

SEQ ID NO: 197233 - DNA, 16 bp, Homo sapiens
aggagggtggaggaag

SEQ ID NO: 197234 - DNA, 22 bp, Homo sapiens
aggagggtggaggaaggtgctg

SEQ ID NO: 197235 - DNA, 15 bp, Homo sapiens
aggaggtagagaggg

SEQ ID NO: 197236 - DNA, 13 bp, Homo sapiens
aggaggtgcctga

SEQ ID NO: 197237 - DNA, 15 bp, Homo sapiens
aggaggtgggtgagc

SEQ ID NO: 197238 - DNA, 19 bp, Homo sapiens
aggaggtgtggagtggagg

SEQ ID NO: 197239 - DNA, 14 bp, Homo sapiens
aggaggtttggatg

SEQ ID NO: 197240 - DNA, 23 bp, Homo sapiens
aggagtagaatataaacacataa

SEQ ID NO: 197241 - DNA, 18 bp, Homo sapiens
aggagtctctgccaccca

SEQ ID NO: 197242 - DNA, 20 bp, Homo sapiens
aggagtctgagaccagcctg

SEQ ID NO: 197243 - DNA, 17 bp, Homo sapiens
aggagtgagaggggaca

SEQ ID NO: 197244 - DNA, 22 bp, Homo sapiens
aggagtgattgaaccagctcat

SEQ ID NO: 197245 - DNA, 15 bp, Homo sapiens
aggagtgcatggcca

SEQ ID NO: 197246 - DNA, 16 bp, Homo sapiens
aggagtgcccgccttg

SEQ ID NO: 197247 - DNA, 18 bp, Homo sapiens
aggagtgggctctgagca

SEQ ID NO: 197248 - DNA, 23 bp, Homo sapiens
aggagtgggttttattgtccttc

SEQ ID NO: 197249 - DNA, 12 bp, Homo sapiens
aggagtgtgcaa

SEQ ID NO: 197250 - DNA, 20 bp, Homo sapiens
aggagttaaagagcagcctg

SEQ ID NO: 197251 - DNA, 17 bp, Homo sapiens
aggagttcaatgatcta

SEQ ID NO: 197252 - DNA, 16 bp, Homo sapiens
aggagttggaatgttg

SEQ ID NO: 197253 - DNA, 17 bp, Homo sapiens
aggagtttgagacaagc

SEQ ID NO: 197254 - DNA, 19 bp, Homo sapiens
aggataaattaatgagttt

SEQ ID NO: 197255 - DNA, 21 bp, Homo sapiens
aggatacatgtgccgaatgtg

SEQ ID NO: 197256 - DNA, 12 bp, Homo sapiens
aggataggaaaa

SEQ ID NO: 197257 - DNA, 13 bp, Homo sapiens
aggataggaaaag

SEQ ID NO: 197258 - DNA, 14 bp, Homo sapiens
aggatatttaagaa

SEQ ID NO: 197259 - DNA, 19 bp, Homo sapiens
aggatcaaagacacacagg

SEQ ID NO: 197260 - DNA, 17 bp, Homo sapiens
aggatcacttgagccca

SEQ ID NO: 197261 - DNA, 18 bp, Homo sapiens
aggatcacttgagcccag

SEQ ID NO: 197262 - DNA, 17 bp, Homo sapiens
aggatcagccccgctcc

SEQ ID NO: 197263 - DNA, 16 bp, Homo sapiens
aggatccgctgccacc

SEQ ID NO: 197264 - DNA, 17 bp, Homo sapiens
aggatccgctgccacca

SEQ ID NO: 197265 - DNA, 21 bp, Homo sapiens
aggatccgggctttggactcc

SEQ ID NO: 197266 - DNA, 13 bp, Homo sapiens
aggatcctctcca

SEQ ID NO: 197267 - DNA, 14 bp, Homo sapiens
aggatcctgcagga

SEQ ID NO: 197268 - DNA, 14 bp, Homo sapiens
aggatcgtggccaa

SEQ ID NO: 197269 - DNA, 14 bp, Homo sapiens
aggatctctcagga

SEQ ID NO: 197270 - DNA, 19 bp, Homo sapiens
aggatctctcaggagcaca

SEQ ID NO: 197271 - DNA, 13 bp, Homo sapiens
aggatgagctgga

SEQ ID NO: 197272 - DNA, 12 bp, Homo sapiens
aggatgcactgg

SEQ ID NO: 197273 - DNA, 16 bp, Homo sapiens
aggatgcactggcctg

SEQ ID NO: 197274 - DNA, 13 bp, Homo sapiens
aggatgctgaagt

SEQ ID NO: 197275 - DNA, 13 bp, Homo sapiens
aggatggcagcct

SEQ ID NO: 197276 - DNA, 20 bp, Homo sapiens
aggatggttactgaggacca

SEQ ID NO: 197277 - DNA, 22 bp, Homo sapiens
aggatgttctggacctccccct

SEQ ID NO: 197278 - DNA, 21 bp, Homo sapiens
aggattaagatacactcctgc

SEQ ID NO: 197279 - DNA, 20 bp, Homo sapiens
aggattaatctctaaaattc

SEQ ID NO: 197280 - DNA, 16 bp, Homo sapiens
aggattacatgcatgt

SEQ ID NO: 197281 - DNA, 13 bp, Homo sapiens
aggattgcctttg

SEQ ID NO: 197282 - DNA, 21 bp, Homo sapiens
aggattgtacgtgggagaggc

SEQ ID NO: 197283 - DNA, 19 bp, Homo sapiens
aggattgtccacaaatgtc

SEQ ID NO: 197284 - DNA, 20 bp, Homo sapiens
aggattgtccacaaatgtcc

SEQ ID NO: 197285 - DNA, 16 bp, Homo sapiens
aggatttaaaaactgg

SEQ ID NO: 197286 - DNA, 21 bp, Homo sapiens
aggatttaacagtcatttaaa

SEQ ID NO: 197287 - DNA, 11 bp, Homo sapiens
aggatttgaaa

SEQ ID NO: 197288 - DNA, 16 bp, Homo sapiens
aggattttggaaaaga

SEQ ID NO: 197289 - DNA, 17 bp, Homo sapiens
aggattttggaaaagaa

SEQ ID NO: 197290 - DNA, 23 bp, Homo sapiens
aggattttgggtggccaaagtgt

SEQ ID NO: 197291 - DNA, 15 bp, Homo sapiens
aggcaaaaatatcag

SEQ ID NO: 197292 - DNA, 18 bp, Homo sapiens
aggcaaagttttccattt

SEQ ID NO: 197293 - DNA, 15 bp, Homo sapiens
aggcaaatgtccaag

SEQ ID NO: 197294 - DNA, 21 bp, Homo sapiens
aggcaaatgtccaagcatcag

SEQ ID NO: 197295 - DNA, 20 bp, Homo sapiens
aggcaactagtggagagaac

SEQ ID NO: 197296 - DNA, 19 bp, Homo sapiens
aggcaacttcagtcctggg

SEQ ID NO: 197297 - DNA, 17 bp, Homo sapiens
aggcaagaagtgggatt

SEQ ID NO: 197298 - DNA, 12 bp, Homo sapiens
aggcaagagaat

SEQ ID NO: 197299 - DNA, 19 bp, Homo sapiens
aggcaagattggaaagaca

SEQ ID NO: 197300 - DNA, 20 bp, Homo sapiens
aggcaagattggaaagacag

SEQ ID NO: 197301 - DNA, 22 bp, Homo sapiens
aggcaagattggaaagacagga

SEQ ID NO: 197302 - DNA, 15 bp, Homo sapiens
aggcaagccacagaa

SEQ ID NO: 197303 - DNA, 16 bp, Homo sapiens
aggcaagccacagaaa

SEQ ID NO: 197304 - DNA, 15 bp, Homo sapiens
aggcaagcccctcag

SEQ ID NO: 197305 - DNA, 16 bp, Homo sapiens
aggcaagcccctcagc

SEQ ID NO: 197306 - DNA, 17 bp, Homo sapiens
aggcaagcccctcagcc

SEQ ID NO: 197307 - DNA, 18 bp, Homo sapiens
aggcaagcccctcagccc

SEQ ID NO: 197308 - DNA, 23 bp, Homo sapiens
aggcaagcccctcagcccttgcc

SEQ ID NO: 197309 - DNA, 15 bp, Homo sapiens
aggcaagctggcagg

SEQ ID NO: 197310 - DNA, 22 bp, Homo sapiens
aggcaaggatgaaagacaaaga

SEQ ID NO: 197311 - DNA, 12 bp, Homo sapiens
aggcaaggctgc

SEQ ID NO: 197312 - DNA, 14 bp, Homo sapiens
aggcaataaaaatc

SEQ ID NO: 197313 - DNA, 15 bp, Homo sapiens
aggcaatgactgtga

SEQ ID NO: 197314 - DNA, 22 bp, Homo sapiens
aggcaatgattgttaatttaca

SEQ ID NO: 197315 - DNA, 22 bp, Homo sapiens
aggcacaaaaccagaagtttct

SEQ ID NO: 197316 - DNA, 18 bp, Homo sapiens
aggcacacagctgcagag

SEQ ID NO: 197317 - DNA, 20 bp, Homo sapiens
aggcacagccggggcctgcc

SEQ ID NO: 197318 - DNA, 21 bp, Homo sapiens
aggcacagccggggcctgcct

SEQ ID NO: 197319 - DNA, 13 bp, Homo sapiens
aggcacaggctcc

SEQ ID NO: 197320 - DNA, 14 bp, Homo sapiens
aggcaccagaagaa

SEQ ID NO: 197321 - DNA, 14 bp, Homo sapiens
aggcaccagctctg

SEQ ID NO: 197322 - DNA, 15 bp, Homo sapiens
aggcaccagctctgt

SEQ ID NO: 197323 - DNA, 19 bp, Homo sapiens
aggcaccagctctgtggcc

SEQ ID NO: 197324 - DNA, 21 bp, Homo sapiens
aggcaccagctctgtggcctg

SEQ ID NO: 197325 - DNA, 22 bp, Homo sapiens
aggcaccagctctgtggcctgt

SEQ ID NO: 197326 - DNA, 22 bp, Homo sapiens
aggcacccgccctttccttgcc

SEQ ID NO: 197327 - DNA, 16 bp, Homo sapiens
aggcaccgagaatgtt

SEQ ID NO: 197328 - DNA, 20 bp, Homo sapiens
aggcaccgcagcctgtcagc

SEQ ID NO: 197329 - DNA, 17 bp, Homo sapiens
aggcaccgctgatgggg

SEQ ID NO: 197330 - DNA, 18 bp, Homo sapiens
actgaatatttatatttc

SEQ ID NO: 197331 - DNA, 16 bp, Homo sapiens
actgaatttctttgat

SEQ ID NO: 197332 - DNA, 20 bp, Homo sapiens
actgacactgcgaactctca

SEQ ID NO: 197333 - DNA, 13 bp, Homo sapiens
actgaccagcctc

SEQ ID NO: 197334 - DNA, 15 bp, Homo sapiens
actgaccagcctcca

SEQ ID NO: 197335 - DNA, 23 bp, Homo sapiens
actgaccagcctccatgctgcct

SEQ ID NO: 197336 - DNA, 14 bp, Homo sapiens
actgaccccctccc

SEQ ID NO: 197337 - DNA, 16 bp, Homo sapiens
actgaccccctcccct

SEQ ID NO: 197338 - DNA, 23 bp, Homo sapiens
actgaccctcggcctctactttg

SEQ ID NO: 197339 - DNA, 13 bp, Homo sapiens
actgacctgcccc

SEQ ID NO: 197340 - DNA, 13 bp, Homo sapiens
actgacctggaag

SEQ ID NO: 197341 - DNA, 21 bp, Homo sapiens
actgacggctgtgtatttctg

SEQ ID NO: 197342 - DNA, 17 bp, Homo sapiens
actgactttttcccccc

SEQ ID NO: 197343 - DNA, 16 bp, Homo sapiens
actgagacaatgcctt

SEQ ID NO: 197344 - DNA, 14 bp, Homo sapiens
actgagagaagtac

SEQ ID NO: 197345 - DNA, 17 bp, Homo sapiens
actgagaggaggggtaa

SEQ ID NO: 197346 - DNA, 13 bp, Homo sapiens
actgagccccacc

SEQ ID NO: 197347 - DNA, 14 bp, Homo sapiens
actgagcccttgca

SEQ ID NO: 197348 - DNA, 21 bp, Homo sapiens
actgagctcctctgggcagga

SEQ ID NO: 197349 - DNA, 18 bp, Homo sapiens
actgagcttctctgtgaa

SEQ ID NO: 197350 - DNA, 13 bp, Homo sapiens
actgaggacaggc

SEQ ID NO: 197351 - DNA, 13 bp, Homo sapiens
actgaggcccaga

SEQ ID NO: 197352 - DNA, 13 bp, Homo sapiens
actgaggcttaga

SEQ ID NO: 197353 - DNA, 20 bp, Homo sapiens
actgagggaccaactgggcc

SEQ ID NO: 197354 - DNA, 21 bp, Homo sapiens
actgagggggagctgtcttgt

SEQ ID NO: 197355 - DNA, 23 bp, Homo sapiens
actgagggggagctgtcttgtca

SEQ ID NO: 197356 - DNA, 20 bp, Homo sapiens
actgagtagctctcctgact

SEQ ID NO: 197357 - DNA, 16 bp, Homo sapiens
actgagtccttaaaca

SEQ ID NO: 197358 - DNA, 21 bp, Homo sapiens
actgagtctggcaaacatgtg

SEQ ID NO: 197359 - DNA, 20 bp, Homo sapiens
actgagtctgtggacactgt

SEQ ID NO: 197360 - DNA, 23 bp, Homo sapiens
actgagtctgtggacactgtgga

SEQ ID NO: 197361 - DNA, 22 bp, Homo sapiens
actgagtgttcaaactactgta

SEQ ID NO: 197362 - DNA, 21 bp, Homo sapiens
actgatatacttgagtgtgca

SEQ ID NO: 197363 - DNA, 19 bp, Homo sapiens
actgatatcacgggcccgc

SEQ ID NO: 197364 - DNA, 21 bp, Homo sapiens
actgatatcacgggcccgctc

SEQ ID NO: 197365 - DNA, 22 bp, Homo sapiens
actgatcatttgcagctgctgg

SEQ ID NO: 197366 - DNA, 20 bp, Homo sapiens
actgatcttacctttatgag

SEQ ID NO: 197367 - DNA, 15 bp, Homo sapiens
actgatgacttacta

SEQ ID NO: 197368 - DNA, 21 bp, Homo sapiens
actgatgagacaacacacaca

SEQ ID NO: 197369 - DNA, 18 bp, Homo sapiens
actgatgctgagattctt

SEQ ID NO: 197370 - DNA, 12 bp, Homo sapiens
actgatgtcatc

SEQ ID NO: 197371 - DNA, 13 bp, Homo sapiens
actgatgtcatct

SEQ ID NO: 197372 - DNA, 19 bp, Homo sapiens
actgatgtcatcttgagct

SEQ ID NO: 197373 - DNA, 20 bp, Homo sapiens
actgatttcacaacagatca

SEQ ID NO: 197374 - DNA, 15 bp, Homo sapiens
actgcaaaaagtaca

SEQ ID NO: 197375 - DNA, 12 bp, Homo sapiens
actgcaaatact

SEQ ID NO: 197376 - DNA, 13 bp, Homo sapiens
actgcaaatactt

SEQ ID NO: 197377 - DNA, 16 bp, Homo sapiens
actgcaacttctgcct

SEQ ID NO: 197378 - DNA, 21 bp, Homo sapiens
actgcaagttcaagactgaaa

SEQ ID NO: 197379 - DNA, 17 bp, Homo sapiens
actgcaatagagactgt

SEQ ID NO: 197380 - DNA, 21 bp, Homo sapiens
actgcaatagagactgtagat

SEQ ID NO: 197381 - DNA, 18 bp, Homo sapiens
actgcacacacagctcct

SEQ ID NO: 197382 - DNA, 18 bp, Homo sapiens
actgcacagtgcatctca

SEQ ID NO: 197383 - DNA, 19 bp, Homo sapiens
actgcacagtgctgttggt

SEQ ID NO: 197384 - DNA, 13 bp, Homo sapiens
actgcacccagct

SEQ ID NO: 197385 - DNA, 19 bp, Homo sapiens
actgcactccagcctgggc

SEQ ID NO: 197386 - DNA, 13 bp, Homo sapiens
actgcagaggagc

SEQ ID NO: 197387 - DNA, 14 bp, Homo sapiens
actgcagccctctc

SEQ ID NO: 197388 - DNA, 21 bp, Homo sapiens
actgcagccctctccaccctc

SEQ ID NO: 197389 - DNA, 22 bp, Homo sapiens
actgcagggacacgggcagcct

SEQ ID NO: 197390 - DNA, 16 bp, Homo sapiens
actgcagggactgcca

SEQ ID NO: 197391 - DNA, 21 bp, Homo sapiens
actgcaggttggaccccagag

SEQ ID NO: 197392 - DNA, 17 bp, Homo sapiens
actgcagtcacccctgt

SEQ ID NO: 197393 - DNA, 20 bp, Homo sapiens
actgcatccaggcctgaggc

SEQ ID NO: 197394 - DNA, 13 bp, Homo sapiens
actgcatgcaagc

SEQ ID NO: 197395 - DNA, 18 bp, Homo sapiens
actgcatgcaagctcagg

SEQ ID NO: 197396 - DNA, 15 bp, Homo sapiens
actgcatgtataaat

SEQ ID NO: 197397 - DNA, 20 bp, Homo sapiens
actgcatgtataaatgaagt

SEQ ID NO: 197398 - DNA, 22 bp, Homo sapiens
actgcatttggggcctttccca

SEQ ID NO: 197399 - DNA, 12 bp, Homo sapiens
actgccagcctt

SEQ ID NO: 197400 - DNA, 17 bp, Homo sapiens
actgccaggcacctggc

SEQ ID NO: 197401 - DNA, 19 bp, Homo sapiens
actgccaggcacctggcct

SEQ ID NO: 197402 - DNA, 20 bp, Homo sapiens
actgccaggcacctggcctg

SEQ ID NO: 197403 - DNA, 18 bp, Homo sapiens
actgccatgatagctggg

SEQ ID NO: 197404 - DNA, 16 bp, Homo sapiens
actgccattagactga

SEQ ID NO: 197405 - DNA, 19 bp, Homo sapiens
actgccatttcctcctggg

SEQ ID NO: 197406 - DNA, 13 bp, Homo sapiens
actgcccaccctg

SEQ ID NO: 197407 - DNA, 21 bp, Homo sapiens
actgcccaccctgggcctccc

SEQ ID NO: 197408 - DNA, 14 bp, Homo sapiens
actgccccatctcc

SEQ ID NO: 197409 - DNA, 14 bp, Homo sapiens
actgcccccactgt

SEQ ID NO: 197410 - DNA, 18 bp, Homo sapiens
actgccccgtgcagactg

SEQ ID NO: 197411 - DNA, 18 bp, Homo sapiens
actgccccttgcttctca

SEQ ID NO: 197412 - DNA, 16 bp, Homo sapiens
actgcccgagctggtg

SEQ ID NO: 197413 - DNA, 22 bp, Homo sapiens
actgcccgagctggtgcattac

SEQ ID NO: 197414 - DNA, 20 bp, Homo sapiens
actgccctccagctctttcc

SEQ ID NO: 197415 - DNA, 13 bp, Homo sapiens
actgccctgcctg

SEQ ID NO: 197416 - DNA, 17 bp, Homo sapiens
actgccctgcctgccca

SEQ ID NO: 197417 - DNA, 13 bp, Homo sapiens
actgccctgtcta

SEQ ID NO: 197418 - DNA, 18 bp, Homo sapiens
actgcccttttaaatggc

SEQ ID NO: 197419 - DNA, 18 bp, Homo sapiens
actgccgaccgaggctgg

SEQ ID NO: 197420 - DNA, 23 bp, Homo sapiens
actgcctaccagtcgccctctgt

SEQ ID NO: 197421 - DNA, 17 bp, Homo sapiens
actgcctatacccctca

SEQ ID NO: 197422 - DNA, 17 bp, Homo sapiens
actgcctccctctcttc

SEQ ID NO: 197423 - DNA, 11 bp, Homo sapiens
actgcctctgc

SEQ ID NO: 197424 - DNA, 12 bp, Homo sapiens
actgcctctgcc

SEQ ID NO: 197425 - DNA, 23 bp, Homo sapiens
agtgccccacctgccactaggct

SEQ ID NO: 197426 - DNA, 23 bp, Homo sapiens
agtgcccctcccatggcccagca

SEQ ID NO: 197427 - DNA, 17 bp, Homo sapiens
agtgcccctgcagggga

SEQ ID NO: 197428 - DNA, 14 bp, Homo sapiens
agtgcccctgctgc

SEQ ID NO: 197429 - DNA, 19 bp, Homo sapiens
agtgcccctgctgcctccc

SEQ ID NO: 197430 - DNA, 19 bp, Homo sapiens
agtgcccgcctaggagttg

SEQ ID NO: 197431 - DNA, 20 bp, Homo sapiens
agtgcccgcctaggagttga

SEQ ID NO: 197432 - DNA, 13 bp, Homo sapiens
agtgccggctgtg

SEQ ID NO: 197433 - DNA, 19 bp, Homo sapiens
agtgccggctgtggagcaa

SEQ ID NO: 197434 - DNA, 15 bp, Homo sapiens
agtgccgtagggagt

SEQ ID NO: 197435 - DNA, 18 bp, Homo sapiens
agtgcctaaaattgtatg

SEQ ID NO: 197436 - DNA, 23 bp, Homo sapiens
agtgcctaaaattgtatgaaaat

SEQ ID NO: 197437 - DNA, 16 bp, Homo sapiens
agtgcctcagcgctgc

SEQ ID NO: 197438 - DNA, 20 bp, Homo sapiens
agtgcctcagcgctgcccac

SEQ ID NO: 197439 - DNA, 13 bp, Homo sapiens
agtgcctcctggc

SEQ ID NO: 197440 - DNA, 11 bp, Homo sapiens
agtgcctgcca

SEQ ID NO: 197441 - DNA, 17 bp, Homo sapiens
agtgcctgccactctct

SEQ ID NO: 197442 - DNA, 18 bp, Homo sapiens
agtgcctgccactctctg

SEQ ID NO: 197443 - DNA, 20 bp, Homo sapiens
agtgcctgccactctctggg

SEQ ID NO: 197444 - DNA, 21 bp, Homo sapiens
agtgcctgccactctctggga

SEQ ID NO: 197445 - DNA, 15 bp, Homo sapiens
agtgccttccataat

SEQ ID NO: 197446 - DNA, 17 bp, Homo sapiens
agtgcctttttccttat

SEQ ID NO: 197447 - DNA, 21 bp, Homo sapiens
agtgcgctcttggtccctggt

SEQ ID NO: 197448 - DNA, 20 bp, Homo sapiens
agtgctaagattacaggcgt

SEQ ID NO: 197449 - DNA, 22 bp, Homo sapiens
agtgctctttgtggcagtggcc

SEQ ID NO: 197450 - DNA, 14 bp, Homo sapiens
agtgctgaacagtg

SEQ ID NO: 197451 - DNA, 22 bp, Homo sapiens
agtgctgaagcttattaatgct

SEQ ID NO: 197452 - DNA, 23 bp, Homo sapiens
agtgctgaagcttattaatgcta

SEQ ID NO: 197453 - DNA, 16 bp, Homo sapiens
agtgctgaccccagga

SEQ ID NO: 197454 - DNA, 11 bp, Homo sapiens
agtgctgccat

SEQ ID NO: 197455 - DNA, 15 bp, Homo sapiens
agtgctgccatgcca

SEQ ID NO: 197456 - DNA, 16 bp, Homo sapiens
agtgctgccatgccac

SEQ ID NO: 197457 - DNA, 21 bp, Homo sapiens
agtgctgccatgccactgcca

SEQ ID NO: 197458 - DNA, 16 bp, Homo sapiens
agtgctgcttgtgcct

SEQ ID NO: 197459 - DNA, 18 bp, Homo sapiens
agtgctgctttgccaaat

SEQ ID NO: 197460 - DNA, 21 bp, Homo sapiens
actgcttttttttttccagca

SEQ ID NO: 197461 - DNA, 20 bp, Homo sapiens
actggaaaacatagagtaga

SEQ ID NO: 197462 - DNA, 21 bp, Homo sapiens
actggaaacctgttatgccaa

SEQ ID NO: 197463 - DNA, 16 bp, Homo sapiens
actggaacctccctgg

SEQ ID NO: 197464 - DNA, 19 bp, Homo sapiens
actggactatagcagggct

SEQ ID NO: 197465 - DNA, 21 bp, Homo sapiens
actggagacaatgcagatgcc

SEQ ID NO: 197466 - DNA, 21 bp, Homo sapiens
actggagaccggaattgagag

SEQ ID NO: 197467 - DNA, 12 bp, Homo sapiens
actggagaggct

SEQ ID NO: 197468 - DNA, 18 bp, Homo sapiens
actggagaggctaacctc

SEQ ID NO: 197469 - DNA, 15 bp, Homo sapiens
actggagagtggcaa

SEQ ID NO: 197470 - DNA, 22 bp, Homo sapiens
actggagataccagagactctg

SEQ ID NO: 197471 - DNA, 15 bp, Homo sapiens
actggaggtgggcat

SEQ ID NO: 197472 - DNA, 13 bp, Homo sapiens
actggagtcagat

SEQ ID NO: 197473 - DNA, 16 bp, Homo sapiens
actggagtcagatgag

SEQ ID NO: 197474 - DNA, 13 bp, Homo sapiens
actggagtgcagg

SEQ ID NO: 197475 - DNA, 15 bp, Homo sapiens
actggagttacatta

SEQ ID NO: 197476 - DNA, 17 bp, Homo sapiens
actggagttacattaat

SEQ ID NO: 197477 - DNA, 13 bp, Homo sapiens
actggatgaagat

SEQ ID NO: 197478 - DNA, 14 bp, Homo sapiens
actggatgaagatt

SEQ ID NO: 197479 - DNA, 17 bp, Homo sapiens
actggatgcagaaacag

SEQ ID NO: 197480 - DNA, 23 bp, Homo sapiens
actggcactggtggtttttgctc

SEQ ID NO: 197481 - DNA, 13 bp, Homo sapiens
actggcagccagg

SEQ ID NO: 197482 - DNA, 21 bp, Homo sapiens
actggcagccagggagcccgg

SEQ ID NO: 197483 - DNA, 21 bp, Homo sapiens
actggcaggtgcagatgggct

SEQ ID NO: 197484 - DNA, 23 bp, Homo sapiens
actggcagtgcacctctcatcag

SEQ ID NO: 197485 - DNA, 22 bp, Homo sapiens
actggcatagccctcctgagca

SEQ ID NO: 197486 - DNA, 12 bp, Homo sapiens
actggccagaga

SEQ ID NO: 197487 - DNA, 20 bp, Homo sapiens
actggccagagagggcccag

SEQ ID NO: 197488 - DNA, 17 bp, Homo sapiens
actggccatgcaagtgg

SEQ ID NO: 197489 - DNA, 14 bp, Homo sapiens
actggcccacccct

SEQ ID NO: 197490 - DNA, 11 bp, Homo sapiens
actggccccag

SEQ ID NO: 197491 - DNA, 13 bp, Homo sapiens
actggccccaggc

SEQ ID NO: 197492 - DNA, 22 bp, Homo sapiens
actggccccaggcggaggggct

SEQ ID NO: 197493 - DNA, 21 bp, Homo sapiens
actggcccctagaatcagcct

SEQ ID NO: 197494 - DNA, 23 bp, Homo sapiens
actggcccttgcccaactcccag

SEQ ID NO: 197495 - DNA, 16 bp, Homo sapiens
actggccgctgggaga

SEQ ID NO: 197496 - DNA, 13 bp, Homo sapiens
actggcctgcccg

SEQ ID NO: 197497 - DNA, 21 bp, Homo sapiens
actggcctgttctgtaggaga

SEQ ID NO: 197498 - DNA, 23 bp, Homo sapiens
actggcctgttctgtaggagaga

SEQ ID NO: 197499 - DNA, 21 bp, Homo sapiens
actggctagagtcctcactcc

SEQ ID NO: 197500 - DNA, 14 bp, Homo sapiens
actggctctctcca

SEQ ID NO: 197501 - DNA, 16 bp, Homo sapiens
actggctctctccagg

SEQ ID NO: 197502 - DNA, 16 bp, Homo sapiens
actggctgcacagccc

SEQ ID NO: 197503 - DNA, 13 bp, Homo sapiens
actggctggggca

SEQ ID NO: 197504 - DNA, 16 bp, Homo sapiens
actggctggggcagag

SEQ ID NO: 197505 - DNA, 16 bp, Homo sapiens
actggctgtctgcctg

SEQ ID NO: 197506 - DNA, 17 bp, Homo sapiens
actggctgtctgcctgt

SEQ ID NO: 197507 - DNA, 23 bp, Homo sapiens
actggctgtgcctcccccgccac

SEQ ID NO: 197508 - DNA, 17 bp, Homo sapiens
actggctgtgtgacttt

SEQ ID NO: 197509 - DNA, 19 bp, Homo sapiens
actggctttgtcccacagc

SEQ ID NO: 197510 - DNA, 22 bp, Homo sapiens
actggctttgtcccacagcttg

SEQ ID NO: 197511 - DNA, 15 bp, Homo sapiens
actggctttttccca

SEQ ID NO: 197512 - DNA, 18 bp, Homo sapiens
actggctttttcccagcc

SEQ ID NO: 197513 - DNA, 20 bp, Homo sapiens
actgggaagatgctggcccc

SEQ ID NO: 197514 - DNA, 17 bp, Homo sapiens
actgggaagcattactt

SEQ ID NO: 197515 - DNA, 20 bp, Homo sapiens
actgggaagctggagtgctg

SEQ ID NO: 197516 - DNA, 15 bp, Homo sapiens
actgggagtcagagc

SEQ ID NO: 197517 - DNA, 17 bp, Homo sapiens
actgggagtcagagccc

SEQ ID NO: 197518 - DNA, 20 bp, Homo sapiens
actgggccccattctccctc

SEQ ID NO: 197519 - DNA, 21 bp, Homo sapiens
actgggcctgttgccctttct

SEQ ID NO: 197520 - DNA, 23 bp, Homo sapiens
actggggatcccgtgctggaaga

SEQ ID NO: 197521 - DNA, 15 bp, Homo sapiens
actgggggcctctgc

SEQ ID NO: 197522 - DNA, 21 bp, Homo sapiens
actggggttcacgtcactgcc

SEQ ID NO: 197523 - DNA, 12 bp, Homo sapiens
actgggtacaag

SEQ ID NO: 197524 - DNA, 15 bp, Homo sapiens
actgggtctcactcc

SEQ ID NO: 197525 - DNA, 20 bp, Homo sapiens
actgggtggggtgaggacca

SEQ ID NO: 197526 - DNA, 22 bp, Homo sapiens
actgggtggggtgaggaccact

SEQ ID NO: 197527 - DNA, 18 bp, Homo sapiens
actgggttcaaaaagaaa

SEQ ID NO: 197528 - DNA, 22 bp, Homo sapiens
actggtccaggcatgggtccct

SEQ ID NO: 197529 - DNA, 14 bp, Homo sapiens
actggtcctgtgtg

SEQ ID NO: 197530 - DNA, 14 bp, Homo sapiens
actggtctcagagg

SEQ ID NO: 197531 - DNA, 13 bp, Homo sapiens
actggtctgtact

SEQ ID NO: 197532 - DNA, 21 bp, Homo sapiens
actggtgcatttaaaatggac

SEQ ID NO: 197533 - DNA, 13 bp, Homo sapiens
actggtggaagga

SEQ ID NO: 197534 - DNA, 12 bp, Homo sapiens
actggtggcccg

SEQ ID NO: 197535 - DNA, 18 bp, Homo sapiens
actggttaaatcaattct

SEQ ID NO: 197536 - DNA, 23 bp, Homo sapiens
actggttatagttgatatgtaac

SEQ ID NO: 197537 - DNA, 14 bp, Homo sapiens
actggttatcctgt

SEQ ID NO: 197538 - DNA, 22 bp, Homo sapiens
actggtttgtatgatgtattag

SEQ ID NO: 197539 - DNA, 22 bp, Homo sapiens
actggtttttctgttccctgct

SEQ ID NO: 197540 - DNA, 17 bp, Homo sapiens
actgtaaaatacttctt

SEQ ID NO: 197541 - DNA, 21 bp, Homo sapiens
actgtaaaatgtgggattatg

SEQ ID NO: 197542 - DNA, 18 bp, Homo sapiens
actgtaacatatatgaaa

SEQ ID NO: 197543 - DNA, 14 bp, Homo sapiens
actgtaatatcttt

SEQ ID NO: 197544 - DNA, 17 bp, Homo sapiens
actgtaatcttaaaagt

SEQ ID NO: 197545 - DNA, 18 bp, Homo sapiens
actgtaatcttaaaagtg

SEQ ID NO: 197546 - DNA, 20 bp, Homo sapiens
actgtacaccatagtttaca

SEQ ID NO: 197547 - DNA, 21 bp, Homo sapiens
actgtacaccatagtttacaa

SEQ ID NO: 197548 - DNA, 19 bp, Homo sapiens
actgtacctgtaggaaaca

SEQ ID NO: 197549 - DNA, 20 bp, Homo sapiens
actgtacctgtaggaaacag

SEQ ID NO: 197550 - DNA, 15 bp, Homo sapiens
actgtactcctccca

SEQ ID NO: 197551 - DNA, 20 bp, Homo sapiens
actgtactcctcccaggcgc

SEQ ID NO: 197552 - DNA, 17 bp, Homo sapiens
actgtactgacttgagg

SEQ ID NO: 197553 - DNA, 14 bp, Homo sapiens
actgtactggccag

SEQ ID NO: 197554 - DNA, 16 bp, Homo sapiens
actgtagattgcttct

SEQ ID NO: 197555 - DNA, 21 bp, Homo sapiens
actgtagattgcttctgtagt

SEQ ID NO: 197556 - DNA, 18 bp, Homo sapiens
actgtaggactatataaa

SEQ ID NO: 197557 - DNA, 19 bp, Homo sapiens
actgtaggactatataaag

SEQ ID NO: 197558 - DNA, 20 bp, Homo sapiens
actgtaggactatataaagt

SEQ ID NO: 197559 - DNA, 18 bp, Homo sapiens
actgtagtttttcttcaa

SEQ ID NO: 197560 - DNA, 17 bp, Homo sapiens
actgtatctaaaaaata

SEQ ID NO: 197561 - DNA, 22 bp, Homo sapiens
actgtatctaaaaaataactgt

SEQ ID NO: 197562 - DNA, 21 bp, Homo sapiens
agtgggttttttagttgaatt

SEQ ID NO: 197563 - DNA, 19 bp, Homo sapiens
agtggtagaggtgtgtgcc

SEQ ID NO: 197564 - DNA, 21 bp, Homo sapiens
agtggtccacattctgctgcc

SEQ ID NO: 197565 - DNA, 20 bp, Homo sapiens
agtggtctaattcaactctg

SEQ ID NO: 197566 - DNA, 15 bp, Homo sapiens
agtggtctatttctc

SEQ ID NO: 197567 - DNA, 14 bp, Homo sapiens
agtggtctcctctc

SEQ ID NO: 197568 - DNA, 18 bp, Homo sapiens
agtggtctcctctcagct

SEQ ID NO: 197569 - DNA, 13 bp, Homo sapiens
agtggtctttctg

SEQ ID NO: 197570 - DNA, 15 bp, Homo sapiens
agtggtctttctgga

SEQ ID NO: 197571 - DNA, 19 bp, Homo sapiens
agtggtgaggggccactgg

SEQ ID NO: 197572 - DNA, 19 bp, Homo sapiens
agtggtggcaaaagacatc

SEQ ID NO: 197573 - DNA, 15 bp, Homo sapiens
agtggtggcagctca

SEQ ID NO: 197574 - DNA, 16 bp, Homo sapiens
agtggtggctctgaga

SEQ ID NO: 197575 - DNA, 19 bp, Homo sapiens
agtggtgttccatgacttc

SEQ ID NO: 197576 - DNA, 14 bp, Homo sapiens
agtggttgttgcca

SEQ ID NO: 197577 - DNA, 20 bp, Homo sapiens
agtggtttccacatgctctg

SEQ ID NO: 197578 - DNA, 20 bp, Homo sapiens
agtggtttctatgagcatct

SEQ ID NO: 197579 - DNA, 17 bp, Homo sapiens
agtgtaaaatagaatgt

SEQ ID NO: 197580 - DNA, 13 bp, Homo sapiens
agtgtaagtgtga

SEQ ID NO: 197581 - DNA, 19 bp, Homo sapiens
agtgtaattacctgtcatc

SEQ ID NO: 197582 - DNA, 13 bp, Homo sapiens
agtgtacaatttt

SEQ ID NO: 197583 - DNA, 20 bp, Homo sapiens
agtgtacaattttcatccca

SEQ ID NO: 197584 - DNA, 16 bp, Homo sapiens
agtgtactaattaaca

SEQ ID NO: 197585 - DNA, 23 bp, Homo sapiens
agtgtactaattaacatataata

SEQ ID NO: 197586 - DNA, 18 bp, Homo sapiens
agtgtagatgtagcattg

SEQ ID NO: 197587 - DNA, 19 bp, Homo sapiens
agtgtagatttgttttgtg

SEQ ID NO: 197588 - DNA, 21 bp, Homo sapiens
agtgtagcccacacttgagag

SEQ ID NO: 197589 - DNA, 15 bp, Homo sapiens
agttcatcttgaatt

SEQ ID NO: 197590 - DNA, 22 bp, Homo sapiens
agttcatgttgctcagaagaga

SEQ ID NO: 197591 - DNA, 16 bp, Homo sapiens
agttcattaaacagaa

SEQ ID NO: 197592 - DNA, 20 bp, Homo sapiens
agttcattattttgtggttc

SEQ ID NO: 197593 - DNA, 20 bp, Homo sapiens
agttccacttagagaacaaa

SEQ ID NO: 197594 - DNA, 13 bp, Homo sapiens
agttccagctttt

SEQ ID NO: 197595 - DNA, 14 bp, Homo sapiens
agttccattcttgg

SEQ ID NO: 197596 - DNA, 15 bp, Homo sapiens
agttccattcttggt

SEQ ID NO: 197597 - DNA, 18 bp, Homo sapiens
agttcccggagcacagcc

SEQ ID NO: 197598 - DNA, 19 bp, Homo sapiens
agttcccggagcacagccc

SEQ ID NO: 197599 - DNA, 22 bp, Homo sapiens
agttcccggagcacagccctgg

SEQ ID NO: 197600 - DNA, 23 bp, Homo sapiens
agttcccggagcacagccctggg

SEQ ID NO: 197601 - DNA, 21 bp, Homo sapiens
agttccctcagtgtgaagcct

SEQ ID NO: 197602 - DNA, 22 bp, Homo sapiens
agttccgtctcctctccagccc

SEQ ID NO: 197603 - DNA, 18 bp, Homo sapiens
agttcctaacaggatgaa

SEQ ID NO: 197604 - DNA, 15 bp, Homo sapiens
agttcctctttgcat

SEQ ID NO: 197605 - DNA, 16 bp, Homo sapiens
agttcctctttgcatg

SEQ ID NO: 197606 - DNA, 23 bp, Homo sapiens
agttcctgctacaacttcagcag

SEQ ID NO: 197607 - DNA, 20 bp, Homo sapiens
agttcctgtcccttctctta

SEQ ID NO: 197608 - DNA, 21 bp, Homo sapiens
agttcctgtcccttctcttaa

SEQ ID NO: 197609 - DNA, 18 bp, Homo sapiens
agttcctgtggccaggag

SEQ ID NO: 197610 - DNA, 15 bp, Homo sapiens
agttctaaattttgt

SEQ ID NO: 197611 - DNA, 13 bp, Homo sapiens
agttctatttcta

SEQ ID NO: 197612 - DNA, 14 bp, Homo sapiens
agttctatttctat

SEQ ID NO: 197613 - DNA, 16 bp, Homo sapiens
agttctatttctatct

SEQ ID NO: 197614 - DNA, 18 bp, Homo sapiens
agttctcactatgtttct

SEQ ID NO: 197615 - DNA, 20 bp, Homo sapiens
agttctcactatgtttctca

SEQ ID NO: 197616 - DNA, 15 bp, Homo sapiens
agttctcataaacag

SEQ ID NO: 197617 - DNA, 18 bp, Homo sapiens
agttctcatccacagagg

SEQ ID NO: 197618 - DNA, 22 bp, Homo sapiens
agttctctcccttcctctctcc

SEQ ID NO: 197619 - DNA, 12 bp, Homo sapiens
agttctgaaaac

SEQ ID NO: 197620 - DNA, 16 bp, Homo sapiens
agttctgaaaactgtt

SEQ ID NO: 197621 - DNA, 22 bp, Homo sapiens
agttctgaaaactgtttatggt

SEQ ID NO: 197622 - DNA, 12 bp, Homo sapiens
agttctgaaggt

SEQ ID NO: 197623 - DNA, 20 bp, Homo sapiens
agttctgcaaatagaaaaca

SEQ ID NO: 197624 - DNA, 20 bp, Homo sapiens
agttctgctttagctttcca

SEQ ID NO: 197625 - DNA, 19 bp, Homo sapiens
agttctggaaaagaactgt

SEQ ID NO: 197626 - DNA, 14 bp, Homo sapiens
agttctggttccta

SEQ ID NO: 197627 - DNA, 22 bp, Homo sapiens
agttctgtgcctccccccagac

SEQ ID NO: 197628 - DNA, 15 bp, Homo sapiens
agttctgttaaatat

SEQ ID NO: 197629 - DNA, 19 bp, Homo sapiens
agttctgttaaatattttt

SEQ ID NO: 197630 - DNA, 15 bp, Homo sapiens
agttctgttcatcct

SEQ ID NO: 197631 - DNA, 15 bp, Homo sapiens
agttcttcgggaaga

SEQ ID NO: 197632 - DNA, 17 bp, Homo sapiens
agttcttcgggaagaga

SEQ ID NO: 197633 - DNA, 22 bp, Homo sapiens
agttcttcgggaagagaggagt

SEQ ID NO: 197634 - DNA, 15 bp, Homo sapiens
agttctttgctgccc

SEQ ID NO: 197635 - DNA, 21 bp, Homo sapiens
agttctttgctgcccctgtct

SEQ ID NO: 197636 - DNA, 18 bp, Homo sapiens
agttgaaaaaagaagttt

SEQ ID NO: 197637 - DNA, 16 bp, Homo sapiens
agttgaaaaatctagt

SEQ ID NO: 197638 - DNA, 10 bp, Homo sapiens
agttgaattt

SEQ ID NO: 197639 - DNA, 13 bp, Homo sapiens
agttgaatttttt

SEQ ID NO: 197640 - DNA, 12 bp, Homo sapiens
agttgaccttta

SEQ ID NO: 197641 - DNA, 21 bp, Homo sapiens
agttgagcacaggcaacatta

SEQ ID NO: 197642 - DNA, 15 bp, Homo sapiens
agttgaggggagagg

SEQ ID NO: 197643 - DNA, 16 bp, Homo sapiens
agttgaggggagagga

SEQ ID NO: 197644 - DNA, 18 bp, Homo sapiens
agttgaggggcttccctc

SEQ ID NO: 197645 - DNA, 20 bp, Homo sapiens
agttgagtacagtgaggagg

SEQ ID NO: 197646 - DNA, 22 bp, Homo sapiens
agttgagtgggtatttcttatt

SEQ ID NO: 197647 - DNA, 19 bp, Homo sapiens
agttgataacccctcttag

SEQ ID NO: 197648 - DNA, 19 bp, Homo sapiens
agttgataggagacttgta

SEQ ID NO: 197649 - DNA, 14 bp, Homo sapiens
agttgatcatgcag

SEQ ID NO: 197650 - DNA, 17 bp, Homo sapiens
agttgatcatgcaggaa

SEQ ID NO: 197651 - DNA, 21 bp, Homo sapiens
agttgatctgaaattcctctg

SEQ ID NO: 197652 - DNA, 22 bp, Homo sapiens
agttgatgaccaatctctgtga

SEQ ID NO: 197653 - DNA, 22 bp, Homo sapiens
agttgattctgtcccccacgtg

SEQ ID NO: 197654 - DNA, 18 bp, Homo sapiens
agttgatttaaactctta

SEQ ID NO: 197655 - DNA, 19 bp, Homo sapiens
agttgcaccattctttctt

SEQ ID NO: 197656 - DNA, 16 bp, Homo sapiens
agttgcagactcagtt

SEQ ID NO: 197657 - DNA, 10 bp, Homo sapiens
agttgcagcc

SEQ ID NO: 197658 - DNA, 18 bp, Homo sapiens
agttgccgtggcaactgt

SEQ ID NO: 197659 - DNA, 21 bp, Homo sapiens
agttgcgacggagagaaaaaa

SEQ ID NO: 197660 - DNA, 21 bp, Homo sapiens
agttgctccgcctctgctggc

SEQ ID NO: 197661 - DNA, 18 bp, Homo sapiens
agttgctgtaagcacctg

SEQ ID NO: 197662 - DNA, 20 bp, Homo sapiens
agttgctgtccccttccagg

SEQ ID NO: 197663 - DNA, 22 bp, Homo sapiens
agttgctttaaagtacctgtag

SEQ ID NO: 197664 - DNA, 21 bp, Homo sapiens
agttggaatgactgaaagaag

SEQ ID NO: 197665 - DNA, 20 bp, Homo sapiens
agttggacagcaaaaccatt

SEQ ID NO: 197666 - DNA, 13 bp, Homo sapiens
agttggactgggt

SEQ ID NO: 197667 - DNA, 19 bp, Homo sapiens
agttggcagagaaggcctc

SEQ ID NO: 197668 - DNA, 19 bp, Homo sapiens
agttggcgttgtgggcagg

SEQ ID NO: 197669 - DNA, 15 bp, Homo sapiens
agttgggagcactgg

SEQ ID NO: 197670 - DNA, 15 bp, Homo sapiens
agttggggaaggcaa

SEQ ID NO: 197671 - DNA, 18 bp, Homo sapiens
agttggtcttactttgtg

SEQ ID NO: 197672 - DNA, 22 bp, Homo sapiens
agttggtcttactttgtgcaaa

SEQ ID NO: 197673 - DNA, 20 bp, Homo sapiens
agttggtgattttagatttc

SEQ ID NO: 197674 - DNA, 20 bp, Homo sapiens
agttgtaaggattgcctttg

SEQ ID NO: 197675 - DNA, 19 bp, Homo sapiens
agttgtaccactgctaata

SEQ ID NO: 197676 - DNA, 22 bp, Homo sapiens
agttgtaccactgctaataaat

SEQ ID NO: 197677 - DNA, 19 bp, Homo sapiens
agttgtcaagtctctgctg

SEQ ID NO: 197678 - DNA, 19 bp, Homo sapiens
agttgtcccgattgtaact

SEQ ID NO: 197679 - DNA, 19 bp, Homo sapiens
agttgtctattctgagcct

SEQ ID NO: 197680 - DNA, 12 bp, Homo sapiens
agttgtcttaaa

SEQ ID NO: 197681 - DNA, 15 bp, Homo sapiens
agttgtgccttttat

SEQ ID NO: 197682 - DNA, 19 bp, Homo sapiens
agttgtgcttgtttacagc

SEQ ID NO: 197683 - DNA, 17 bp, Homo sapiens
agttgttagtgtgtctt

SEQ ID NO: 197684 - DNA, 19 bp, Homo sapiens
agttgttggcctccggcct

SEQ ID NO: 197685 - DNA, 20 bp, Homo sapiens
agttgtttctaagagcagag

SEQ ID NO: 197686 - DNA, 15 bp, Homo sapiens
agttgttttgattat

SEQ ID NO: 197687 - DNA, 14 bp, Homo sapiens
agtttaaaaaaata

SEQ ID NO: 197688 - DNA, 12 bp, Homo sapiens
agtttaaatacc

SEQ ID NO: 197689 - DNA, 14 bp, Homo sapiens
agtttaaataccag

SEQ ID NO: 197690 - DNA, 16 bp, Homo sapiens
agtttacaagtgtata

SEQ ID NO: 197691 - DNA, 20 bp, Homo sapiens
agtttacagtaaataaattg

SEQ ID NO: 197692 - DNA, 16 bp, Homo sapiens
agtttaccatttgtaa

SEQ ID NO: 197693 - DNA, 17 bp, Homo sapiens
agtttaccatttgtaat

SEQ ID NO: 197694 - DNA, 18 bp, Homo sapiens
agtttaccatttgtaata

SEQ ID NO: 197695 - DNA, 16 bp, Homo sapiens
agtttagaaattacaa

SEQ ID NO: 197696 - DNA, 16 bp, Homo sapiens
agtttatccaaatctt

SEQ ID NO: 197697 - DNA, 17 bp, Homo sapiens
agtttatccaaatcttg

SEQ ID NO: 197698 - DNA, 22 bp, Homo sapiens
agtttatgtggcacacaatcct

SEQ ID NO: 197699 - DNA, 20 bp, Homo sapiens
actgtattacataaataaat

SEQ ID NO: 197700 - DNA, 20 bp, Homo sapiens
actgtattcgtgcatttttg

SEQ ID NO: 197701 - DNA, 14 bp, Homo sapiens
actgtatttgtatc

SEQ ID NO: 197702 - DNA, 13 bp, Homo sapiens
actgtcaataaac

SEQ ID NO: 197703 - DNA, 17 bp, Homo sapiens
actgtcaataaacagct

SEQ ID NO: 197704 - DNA, 18 bp, Homo sapiens
actgtcaataaacagctt

SEQ ID NO: 197705 - DNA, 23 bp, Homo sapiens
actgtcaatgaggttatgagaaa

SEQ ID NO: 197706 - DNA, 21 bp, Homo sapiens
actgtcactgtttctctgctg

SEQ ID NO: 197707 - DNA, 15 bp, Homo sapiens
actgtcactttgctc

SEQ ID NO: 197708 - DNA, 13 bp, Homo sapiens
actgtcagctgag

SEQ ID NO: 197709 - DNA, 21 bp, Homo sapiens
actgtcagctgagcttgagct

SEQ ID NO: 197710 - DNA, 16 bp, Homo sapiens
actgtcccacaaaata

SEQ ID NO: 197711 - DNA, 19 bp, Homo sapiens
actgtcccacaaaatattt

SEQ ID NO: 197712 - DNA, 22 bp, Homo sapiens
actgtcccacaaaatatttcta

SEQ ID NO: 197713 - DNA, 23 bp, Homo sapiens
actgtcccacaaaatatttctaa

SEQ ID NO: 197714 - DNA, 16 bp, Homo sapiens
actgtccccctaccca

SEQ ID NO: 197715 - DNA, 17 bp, Homo sapiens
actgtcccgacacagcg

SEQ ID NO: 197716 - DNA, 17 bp, Homo sapiens
actgtccctaccactga

SEQ ID NO: 197717 - DNA, 14 bp, Homo sapiens
actgtcctctttca

SEQ ID NO: 197718 - DNA, 22 bp, Homo sapiens
actgtcctctttcagaaaacag

SEQ ID NO: 197719 - DNA, 23 bp, Homo sapiens
actgtcctctttcagaaaacaga

SEQ ID NO: 197720 - DNA, 15 bp, Homo sapiens
actgtcctggctttt

SEQ ID NO: 197721 - DNA, 18 bp, Homo sapiens
actgtcctgggcgccctg

SEQ ID NO: 197722 - DNA, 13 bp, Homo sapiens
actgtcctttctc

SEQ ID NO: 197723 - DNA, 15 bp, Homo sapiens
actgtcctttctcca

SEQ ID NO: 197724 - DNA, 14 bp, Homo sapiens
actgtcggagaggc

SEQ ID NO: 197725 - DNA, 16 bp, Homo sapiens
actgtctaactttaga

SEQ ID NO: 197726 - DNA, 21 bp, Homo sapiens
actgtctagatggatgaatta

SEQ ID NO: 197727 - DNA, 20 bp, Homo sapiens
actgtctcaagagggcactg

SEQ ID NO: 197728 - DNA, 13 bp, Homo sapiens
actgtctccttcc

SEQ ID NO: 197729 - DNA, 16 bp, Homo sapiens
actgtctccttcccac

SEQ ID NO: 197730 - DNA, 17 bp, Homo sapiens
actgtctccttcccact

SEQ ID NO: 197731 - DNA, 19 bp, Homo sapiens
actgtctccttcccactgt

SEQ ID NO: 197732 - DNA, 20 bp, Homo sapiens
actgtctccttcccactgtc

SEQ ID NO: 197733 - DNA, 19 bp, Homo sapiens
actgtctggttttaacaat

SEQ ID NO: 197734 - DNA, 21 bp, Homo sapiens
actgtctgttgtttacctacc

SEQ ID NO: 197735 - DNA, 16 bp, Homo sapiens
actgtcttcaaccctg

SEQ ID NO: 197736 - DNA, 22 bp, Homo sapiens
actgtcttcaaccctgccctgc

SEQ ID NO: 197737 - DNA, 19 bp, Homo sapiens
actgtctttattcttatta

SEQ ID NO: 197738 - DNA, 14 bp, Homo sapiens
actgtctttcctag

SEQ ID NO: 197739 - DNA, 10 bp, Homo sapiens
actgtgaaag

SEQ ID NO: 197740 - DNA, 11 bp, Homo sapiens
actgtgacagg

SEQ ID NO: 197741 - DNA, 12 bp, Homo sapiens
actgtgacattc

SEQ ID NO: 197742 - DNA, 21 bp, Homo sapiens
actgtgacattccacagagtt

SEQ ID NO: 197743 - DNA, 13 bp, Homo sapiens
actgtgaccacct

SEQ ID NO: 197744 - DNA, 16 bp, Homo sapiens
actgtgaccaccttct

SEQ ID NO: 197745 - DNA, 15 bp, Homo sapiens
actgtgagataaata

SEQ ID NO: 197746 - DNA, 21 bp, Homo sapiens
actgtgagcgagcctggcagg

SEQ ID NO: 197747 - DNA, 22 bp, Homo sapiens
actgtgaggcggcagctggggc

SEQ ID NO: 197748 - DNA, 17 bp, Homo sapiens
actgtgatttatttgga

SEQ ID NO: 197749 - DNA, 23 bp, Homo sapiens
actgtgatttatttggagtggag

SEQ ID NO: 197750 - DNA, 13 bp, Homo sapiens
actgtgcactata

SEQ ID NO: 197751 - DNA, 23 bp, Homo sapiens
actgtgcctttgagtttcctcag

SEQ ID NO: 197752 - DNA, 18 bp, Homo sapiens
actgtgcgttttagagta

SEQ ID NO: 197753 - DNA, 20 bp, Homo sapiens
actgtgcgttttagagtatg

SEQ ID NO: 197754 - DNA, 12 bp, Homo sapiens
actgtgctgatt

SEQ ID NO: 197755 - DNA, 21 bp, Homo sapiens
actgtggaacactaaagagct

SEQ ID NO: 197756 - DNA, 14 bp, Homo sapiens
actgtggccagagc

SEQ ID NO: 197757 - DNA, 13 bp, Homo sapiens
actgtggcctcag

SEQ ID NO: 197758 - DNA, 14 bp, Homo sapiens
actgtggcctcagg

SEQ ID NO: 197759 - DNA, 15 bp, Homo sapiens
actgtggcctcagga

SEQ ID NO: 197760 - DNA, 22 bp, Homo sapiens
actgtggccttggtctaacttt

SEQ ID NO: 197761 - DNA, 22 bp, Homo sapiens
actgtggggtgtgcacatctct

SEQ ID NO: 197762 - DNA, 20 bp, Homo sapiens
actgtggtgatctgtagact

SEQ ID NO: 197763 - DNA, 17 bp, Homo sapiens
actgtgtaaccagcagt

SEQ ID NO: 197764 - DNA, 23 bp, Homo sapiens
actgtgtaaccagcagtcacagg

SEQ ID NO: 197765 - DNA, 13 bp, Homo sapiens
actgtgtaactgc

SEQ ID NO: 197766 - DNA, 23 bp, Homo sapiens
actgtgtacataatgcttaattt

SEQ ID NO: 197767 - DNA, 20 bp, Homo sapiens
actgtgtatgtacatatata

SEQ ID NO: 197768 - DNA, 18 bp, Homo sapiens
actgtgtccctctctctg

SEQ ID NO: 197769 - DNA, 19 bp, Homo sapiens
actgtgtccctctctctgg

SEQ ID NO: 197770 - DNA, 21 bp, Homo sapiens
actgtgtccctctctctggaa

SEQ ID NO: 197771 - DNA, 22 bp, Homo sapiens
actgtgtccctctctctggaaa

SEQ ID NO: 197772 - DNA, 18 bp, Homo sapiens
actgtgtgaagaaatgga

SEQ ID NO: 197773 - DNA, 17 bp, Homo sapiens
actgtgtggactgtgat

SEQ ID NO: 197774 - DNA, 14 bp, Homo sapiens
actgtgtgttgcca

SEQ ID NO: 197775 - DNA, 22 bp, Homo sapiens
actgtgtgttgccacaggacac

SEQ ID NO: 197776 - DNA, 12 bp, Homo sapiens
actgtgttcctg

SEQ ID NO: 197777 - DNA, 23 bp, Homo sapiens
actgtgtttaatagtatatctaa

SEQ ID NO: 197778 - DNA, 18 bp, Homo sapiens
actgttaaccatttaagt

SEQ ID NO: 197779 - DNA, 22 bp, Homo sapiens
actgttaatagtactattaaca

SEQ ID NO: 197780 - DNA, 23 bp, Homo sapiens
actgttagatgctgaatatctgt

SEQ ID NO: 197781 - DNA, 19 bp, Homo sapiens
actgttattttcagcatga

SEQ ID NO: 197782 - DNA, 14 bp, Homo sapiens
actgttcacggcag

SEQ ID NO: 197783 - DNA, 22 bp, Homo sapiens
actgttcccagcaaagttttca

SEQ ID NO: 197784 - DNA, 20 bp, Homo sapiens
actgttccctctgctcctgg

SEQ ID NO: 197785 - DNA, 20 bp, Homo sapiens
actgttctggcctcagacca

SEQ ID NO: 197786 - DNA, 22 bp, Homo sapiens
actgttgagttggacacactgt

SEQ ID NO: 197787 - DNA, 12 bp, Homo sapiens
actgttgcattt

SEQ ID NO: 197788 - DNA, 14 bp, Homo sapiens
actgttgccagaga

SEQ ID NO: 197789 - DNA, 12 bp, Homo sapiens
actgttgctcaa

SEQ ID NO: 197790 - DNA, 21 bp, Homo sapiens
actgttgctcaaatctattca

SEQ ID NO: 197791 - DNA, 18 bp, Homo sapiens
actgttgcttaattgtga

SEQ ID NO: 197792 - DNA, 20 bp, Homo sapiens
actgttgcttaattgtgaac

SEQ ID NO: 197793 - DNA, 18 bp, Homo sapiens
actgttgtttgatgtgta

SEQ ID NO: 197794 - DNA, 14 bp, Homo sapiens
actgtttccacatt

SEQ ID NO: 197795 - DNA, 21 bp, Homo sapiens
actgtttgccttctactttta

SEQ ID NO: 197796 - DNA, 14 bp, Homo sapiens
actgtttggcttat

SEQ ID NO: 197797 - DNA, 19 bp, Homo sapiens
actgtttggcttataaaca

SEQ ID NO: 197798 - DNA, 18 bp, Homo sapiens
actgtttgtaatatacag

SEQ ID NO: 197799 - DNA, 20 bp, Homo sapiens
actgtttgtaatatacagtt

SEQ ID NO: 197800 - DNA, 22 bp, Homo sapiens
actgtttgtaatatacagtttt

SEQ ID NO: 197801 - DNA, 13 bp, Homo sapiens
actgttttcatgt

SEQ ID NO: 197802 - DNA, 14 bp, Homo sapiens
actgttttcatgtg

SEQ ID NO: 197803 - DNA, 13 bp, Homo sapiens
actgttttgtgcg

SEQ ID NO: 197804 - DNA, 23 bp, Homo sapiens
actgtttttgaaaaattacagct

SEQ ID NO: 197805 - DNA, 14 bp, Homo sapiens
actgtttttgaaga

SEQ ID NO: 197806 - DNA, 15 bp, Homo sapiens
actgtttttgaagaa

SEQ ID NO: 197807 - DNA, 22 bp, Homo sapiens
actgtttttgaagaagggaaat

SEQ ID NO: 197808 - DNA, 14 bp, Homo sapiens
actgttttttcctg

SEQ ID NO: 197809 - DNA, 16 bp, Homo sapiens
acttaaaaaatgtcca

SEQ ID NO: 197810 - DNA, 13 bp, Homo sapiens
acttaaaaagtct

SEQ ID NO: 197811 - DNA, 20 bp, Homo sapiens
acttaaaaagtctgcattac

SEQ ID NO: 197812 - DNA, 16 bp, Homo sapiens
acttaaaaatgtaaat

SEQ ID NO: 197813 - DNA, 19 bp, Homo sapiens
acttaaaaatgtaaatatt

SEQ ID NO: 197814 - DNA, 15 bp, Homo sapiens
acttaaaagtattca

SEQ ID NO: 197815 - DNA, 20 bp, Homo sapiens
acttaaaatattcctgcatt

SEQ ID NO: 197816 - DNA, 15 bp, Homo sapiens
acttaaacaaaaact

SEQ ID NO: 197817 - DNA, 21 bp, Homo sapiens
acttaaacaaaaactttccat

SEQ ID NO: 197818 - DNA, 23 bp, Homo sapiens
acttaaacaaaaactttccatga

SEQ ID NO: 197819 - DNA, 14 bp, Homo sapiens
acttaaacagcttt

SEQ ID NO: 197820 - DNA, 10 bp, Homo sapiens
acttaaacat

SEQ ID NO: 197821 - DNA, 18 bp, Homo sapiens
acttaaacatcattggat

SEQ ID NO: 197822 - DNA, 15 bp, Homo sapiens
acttaaactttgtca

SEQ ID NO: 197823 - DNA, 18 bp, Homo sapiens
acttaaactttgtcactt

SEQ ID NO: 197824 - DNA, 21 bp, Homo sapiens
acttaaactttgtcacttctg

SEQ ID NO: 197825 - DNA, 22 bp, Homo sapiens
acttaaactttgtcacttctgc

SEQ ID NO: 197826 - DNA, 15 bp, Homo sapiens
acttaaagcttgttt

SEQ ID NO: 197827 - DNA, 13 bp, Homo sapiens
acttaaataattt

SEQ ID NO: 197828 - DNA, 12 bp, Homo sapiens
acttaaatcact

SEQ ID NO: 197829 - DNA, 14 bp, Homo sapiens
acttaacatattta

SEQ ID NO: 197830 - DNA, 15 bp, Homo sapiens
acttaacatgctgtg

SEQ ID NO: 197831 - DNA, 18 bp, Homo sapiens
acttaacatgctgtgtaa

SEQ ID NO: 197832 - DNA, 18 bp, Homo sapiens
agtttattggaagtgttc

SEQ ID NO: 197833 - DNA, 14 bp, Homo sapiens
agtttcaatgtgat

SEQ ID NO: 197834 - DNA, 20 bp, Homo sapiens
agtttcacatatttgtagct

SEQ ID NO: 197835 - DNA, 15 bp, Homo sapiens
agtttcagaagtact

SEQ ID NO: 197836 - DNA, 19 bp, Homo sapiens
agtttcagtaaataatgaa

SEQ ID NO: 197837 - DNA, 14 bp, Homo sapiens
agtttcatttttca

SEQ ID NO: 197838 - DNA, 20 bp, Homo sapiens
agtttcatttttcattttct

SEQ ID NO: 197839 - DNA, 15 bp, Homo sapiens
agtttccagctgctc

SEQ ID NO: 197840 - DNA, 21 bp, Homo sapiens
agtttcccaaaaaccccagtg

SEQ ID NO: 197841 - DNA, 16 bp, Homo sapiens
agtttccgcggcggct

SEQ ID NO: 197842 - DNA, 18 bp, Homo sapiens
agtttcctcaggctgctg

SEQ ID NO: 197843 - DNA, 20 bp, Homo sapiens
agtttcctcaggctgctgga

SEQ ID NO: 197844 - DNA, 23 bp, Homo sapiens
agtttcctcaggctgctggagga

SEQ ID NO: 197845 - DNA, 19 bp, Homo sapiens
agtttctatggattcactt

SEQ ID NO: 197846 - DNA, 18 bp, Homo sapiens
agtttctggctgaaaatg

SEQ ID NO: 197847 - DNA, 21 bp, Homo sapiens
agtttctggctgaaaatggtg

SEQ ID NO: 197848 - DNA, 14 bp, Homo sapiens
ataaataaagcaaa

SEQ ID NO: 197849 - DNA, 14 bp, Homo sapiens
ataaataatattat

SEQ ID NO: 197850 - DNA, 19 bp, Homo sapiens
ataaataatattatattgt

SEQ ID NO: 197851 - DNA, 13 bp, Homo sapiens
ataaataatctca

SEQ ID NO: 197852 - DNA, 15 bp, Homo sapiens
ataaataatctgtac

SEQ ID NO: 197853 - DNA, 23 bp, Homo sapiens
ataaatagctaaatggcaacaaa

SEQ ID NO: 197854 - DNA, 14 bp, Homo sapiens
ataaatagctatat

SEQ ID NO: 197855 - DNA, 13 bp, Homo sapiens
ataaatatactaa

SEQ ID NO: 197856 - DNA, 17 bp, Homo sapiens
ataaatatactaataaa

SEQ ID NO: 197857 - DNA, 15 bp, Homo sapiens
ataaatatattgtat

SEQ ID NO: 197858 - DNA, 22 bp, Homo sapiens
ataaatatctatttatctgtct

SEQ ID NO: 197859 - DNA, 18 bp, Homo sapiens
ataaatatttgtttgggt

SEQ ID NO: 197860 - DNA, 15 bp, Homo sapiens
ataaatcaatgtcac

SEQ ID NO: 197861 - DNA, 18 bp, Homo sapiens
ataaatcatattgatgaa

SEQ ID NO: 197862 - DNA, 18 bp, Homo sapiens
ataaatccagttctacta

SEQ ID NO: 197863 - DNA, 12 bp, Homo sapiens
ataaatctaaat

SEQ ID NO: 197864 - DNA, 12 bp, Homo sapiens
ataaatctgtct

SEQ ID NO: 197865 - DNA, 18 bp, Homo sapiens
ataaatcttccaaagttt

SEQ ID NO: 197866 - DNA, 17 bp, Homo sapiens
ataaatgaagtttatac

SEQ ID NO: 197867 - DNA, 11 bp, Homo sapiens
ataaatgaatg

SEQ ID NO: 197868 - DNA, 18 bp, Homo sapiens
ataaatgaatgaaatata

SEQ ID NO: 197869 - DNA, 15 bp, Homo sapiens
ataaatgaccagttt

SEQ ID NO: 197870 - DNA, 16 bp, Homo sapiens
ataaatgaccagttta

SEQ ID NO: 197871 - DNA, 17 bp, Homo sapiens
ataaatgaccagtttac

SEQ ID NO: 197872 - DNA, 13 bp, Homo sapiens
ataaatggctggt

SEQ ID NO: 197873 - DNA, 18 bp, Homo sapiens
ataaatgggaaatgtcga

SEQ ID NO: 197874 - DNA, 19 bp, Homo sapiens
ataaatgtaaaaataataa

SEQ ID NO: 197875 - DNA, 21 bp, Homo sapiens
ataaatgtaaaaatgaaggaa

SEQ ID NO: 197876 - DNA, 15 bp, Homo sapiens
ataaatgtactacat

SEQ ID NO: 197877 - DNA, 20 bp, Homo sapiens
ataaatgtactacatttgca

SEQ ID NO: 197878 - DNA, 15 bp, Homo sapiens
ataaatgtatcttat

SEQ ID NO: 197879 - DNA, 21 bp, Homo sapiens
ataaatgtgatttttttatat

SEQ ID NO: 197880 - DNA, 16 bp, Homo sapiens
ataaatgttattgtcc

SEQ ID NO: 197881 - DNA, 14 bp, Homo sapiens
ataaatgtttatat

SEQ ID NO: 197882 - DNA, 15 bp, Homo sapiens
ataaatgtttatatt

SEQ ID NO: 197883 - DNA, 12 bp, Homo sapiens
ataaatgtttgt

SEQ ID NO: 197884 - DNA, 14 bp, Homo sapiens
ataaatgtttgtct

SEQ ID NO: 197885 - DNA, 15 bp, Homo sapiens
ataaatgtttttatt

SEQ ID NO: 197886 - DNA, 17 bp, Homo sapiens
ataaatgtttttattaa

SEQ ID NO: 197887 - DNA, 12 bp, Homo sapiens
ataaattaaata

SEQ ID NO: 197888 - DNA, 18 bp, Homo sapiens
ataaattaatacataagt

SEQ ID NO: 197889 - DNA, 14 bp, Homo sapiens
ataaattattactt

SEQ ID NO: 197890 - DNA, 15 bp, Homo sapiens
ataaattattacttt

SEQ ID NO: 197891 - DNA, 18 bp, Homo sapiens
ataaattattactttaaa

SEQ ID NO: 197892 - DNA, 16 bp, Homo sapiens
ataaattatttctaaa

SEQ ID NO: 197893 - DNA, 22 bp, Homo sapiens
ataaattcaacacttattttct

SEQ ID NO: 197894 - DNA, 21 bp, Homo sapiens
ataaattccccatatttgtgt

SEQ ID NO: 197895 - DNA, 16 bp, Homo sapiens
ataaattctataggaa

SEQ ID NO: 197896 - DNA, 17 bp, Homo sapiens
ataaattgcataaagca

SEQ ID NO: 197897 - DNA, 12 bp, Homo sapiens
ataaattgcatg

SEQ ID NO: 197898 - DNA, 20 bp, Homo sapiens
ataaattgcatgctgcttta

SEQ ID NO: 197899 - DNA, 16 bp, Homo sapiens
ataaattgctccttga

SEQ ID NO: 197900 - DNA, 19 bp, Homo sapiens
ataaattggtgataagtgg

SEQ ID NO: 197901 - DNA, 12 bp, Homo sapiens
ataaatttccac

SEQ ID NO: 197902 - DNA, 17 bp, Homo sapiens
ataaatttgttgtcatg

SEQ ID NO: 197903 - DNA, 22 bp, Homo sapiens
ataaatttgttgtcatgtgtat

SEQ ID NO: 197904 - DNA, 13 bp, Homo sapiens
ataaattttatct

SEQ ID NO: 197905 - DNA, 11 bp, Homo sapiens
ataacaacaat

SEQ ID NO: 197906 - DNA, 12 bp, Homo sapiens
ataacaacaatt

SEQ ID NO: 197907 - DNA, 15 bp, Homo sapiens
ataacaattgtttgg

SEQ ID NO: 197908 - DNA, 11 bp, Homo sapiens
ataacacacat

SEQ ID NO: 197909 - DNA, 14 bp, Homo sapiens
ataacactgcagcc

SEQ ID NO: 197910 - DNA, 16 bp, Homo sapiens
ataacagatcctttca

SEQ ID NO: 197911 - DNA, 15 bp, Homo sapiens
ataacaggcattgca

SEQ ID NO: 197912 - DNA, 19 bp, Homo sapiens
ataacaggcattgcactaa

SEQ ID NO: 197913 - DNA, 23 bp, Homo sapiens
ataacaggcattgcactaaaagt

SEQ ID NO: 197914 - DNA, 16 bp, Homo sapiens
ataacagggtaaatta

SEQ ID NO: 197915 - DNA, 19 bp, Homo sapiens
ataacagggtaaattattc

SEQ ID NO: 197916 - DNA, 16 bp, Homo sapiens
ataacagtaaatgtgc

SEQ ID NO: 197917 - DNA, 12 bp, Homo sapiens
ataacatagttg

SEQ ID NO: 197918 - DNA, 17 bp, Homo sapiens
ataacatagttgaaaaa

SEQ ID NO: 197919 - DNA, 16 bp, Homo sapiens
ataacatctctttcat

SEQ ID NO: 197920 - DNA, 16 bp, Homo sapiens
ataacatctgaaaaga

SEQ ID NO: 197921 - DNA, 21 bp, Homo sapiens
ataacatctgaaaagaaatgc

SEQ ID NO: 197922 - DNA, 22 bp, Homo sapiens
ataacattgcactttataaaca

SEQ ID NO: 197923 - DNA, 16 bp, Homo sapiens
ataacatttgctgaat

SEQ ID NO: 197924 - DNA, 15 bp, Homo sapiens
ataacattttgttta

SEQ ID NO: 197925 - DNA, 16 bp, Homo sapiens
ataacattttgtttat

SEQ ID NO: 197926 - DNA, 18 bp, Homo sapiens
ataacattttgtttatgt

SEQ ID NO: 197927 - DNA, 22 bp, Homo sapiens
ataacattttgtttatgttact

SEQ ID NO: 197928 - DNA, 14 bp, Homo sapiens
ataaccaaaaaatg

SEQ ID NO: 197929 - DNA, 14 bp, Homo sapiens
ataaccacaaggtc

SEQ ID NO: 197930 - DNA, 22 bp, Homo sapiens
ataaccacttaaaaaatgtcca

SEQ ID NO: 197931 - DNA, 16 bp, Homo sapiens
ataaccccagcctgac

SEQ ID NO: 197932 - DNA, 15 bp, Homo sapiens
ataacccctgcctgg

SEQ ID NO: 197933 - DNA, 18 bp, Homo sapiens
ataacctatttttttctc

SEQ ID NO: 197934 - DNA, 13 bp, Homo sapiens
ataacgccccaga

SEQ ID NO: 197935 - DNA, 14 bp, Homo sapiens
ataactaccaggaa

SEQ ID NO: 197936 - DNA, 13 bp, Homo sapiens
ataactactgtgt

SEQ ID NO: 197937 - DNA, 15 bp, Homo sapiens
ataactactgtgttc

SEQ ID NO: 197938 - DNA, 19 bp, Homo sapiens
ataactactgtgttcctgg

SEQ ID NO: 197939 - DNA, 14 bp, Homo sapiens
ataactagatctcc

SEQ ID NO: 197940 - DNA, 21 bp, Homo sapiens
ataactagatggtgctgagaa

SEQ ID NO: 197941 - DNA, 16 bp, Homo sapiens
ataactcatcataaaa

SEQ ID NO: 197942 - DNA, 12 bp, Homo sapiens
ataactccttct

SEQ ID NO: 197943 - DNA, 22 bp, Homo sapiens
ataactctgtggcattattgca

SEQ ID NO: 197944 - DNA, 15 bp, Homo sapiens
ataactgacttagtt

SEQ ID NO: 197945 - DNA, 21 bp, Homo sapiens
ataactgctcttttactaaga

SEQ ID NO: 197946 - DNA, 23 bp, Homo sapiens
ataactgctcttttactaagaca

SEQ ID NO: 197947 - DNA, 18 bp, Homo sapiens
ataactggttactcagct

SEQ ID NO: 197948 - DNA, 15 bp, Homo sapiens
ataacttaaataatt

SEQ ID NO: 197949 - DNA, 18 bp, Homo sapiens
ataacttcagagaagtca

SEQ ID NO: 197950 - DNA, 16 bp, Homo sapiens
ataacttcttaaaagt

SEQ ID NO: 197951 - DNA, 17 bp, Homo sapiens
ataacttcttaaaagtt

SEQ ID NO: 197952 - DNA, 19 bp, Homo sapiens
ataacttcttaaaagttgt

SEQ ID NO: 197953 - DNA, 18 bp, Homo sapiens
ataagaaaacatgtaaag

SEQ ID NO: 197954 - DNA, 18 bp, Homo sapiens
ataagaaacatgatgtga

SEQ ID NO: 197955 - DNA, 20 bp, Homo sapiens
ataagaaacatgatgtgaga

SEQ ID NO: 197956 - DNA, 22 bp, Homo sapiens
ataagaaccttttgagtgcctt

SEQ ID NO: 197957 - DNA, 19 bp, Homo sapiens
ataagagagccttggttca

SEQ ID NO: 197958 - DNA, 12 bp, Homo sapiens
ataagagatttg

SEQ ID NO: 197959 - DNA, 18 bp, Homo sapiens
ataagatttaattgtaat

SEQ ID NO: 197960 - DNA, 14 bp, Homo sapiens
ataagcaagagaga

SEQ ID NO: 197961 - DNA, 13 bp, Homo sapiens
ataagctaaagag

SEQ ID NO: 197962 - DNA, 16 bp, Homo sapiens
ataagctaaagaggct

SEQ ID NO: 197963 - DNA, 17 bp, Homo sapiens
ataagctaaagaggctg

SEQ ID NO: 197964 - DNA, 15 bp, Homo sapiens
ataagctatgtcact

SEQ ID NO: 197965 - DNA, 17 bp, Homo sapiens
ataagcttaaaataagt

SEQ ID NO: 197966 - DNA, 12 bp, Homo sapiens
ataaggactgca

SEQ ID NO: 197967 - DNA, 15 bp, Homo sapiens
ataaggactgcatgg

SEQ ID NO: 197968 - DNA, 15 bp, Homo sapiens
ataagggagagggaa

SEQ ID NO: 197969 - DNA, 21 bp, Homo sapiens
ataaggtaccaagatcacaaa

SEQ ID NO: 197970 - DNA, 15 bp, Homo sapiens
ataagtaaatgctag

SEQ ID NO: 197971 - DNA, 13 bp, Homo sapiens
ataagtaacatat

SEQ ID NO: 197972 - DNA, 13 bp, Homo sapiens
ataagtaatatct

SEQ ID NO: 197973 - DNA, 15 bp, Homo sapiens
ataagtaatatcttt

SEQ ID NO: 197974 - DNA, 19 bp, Homo sapiens
ataagtcctaaagtgaaga

SEQ ID NO: 197975 - DNA, 16 bp, Homo sapiens
ataagtgaaaatctta

SEQ ID NO: 197976 - DNA, 18 bp, Homo sapiens
ataagtgaatctaataaa

SEQ ID NO: 197977 - DNA, 20 bp, Homo sapiens
ataagtgaatctaataaaat

SEQ ID NO: 197978 - DNA, 11 bp, Homo sapiens
ataagtggaaa

SEQ ID NO: 197979 - DNA, 21 bp, Homo sapiens
ataagtggaaaaaagagaaaa

SEQ ID NO: 197980 - DNA, 20 bp, Homo sapiens
acttaaggggggatgtcttg

SEQ ID NO: 197981 - DNA, 14 bp, Homo sapiens
acttaatacagatg

SEQ ID NO: 197982 - DNA, 15 bp, Homo sapiens
acttaatcatatcaa

SEQ ID NO: 197983 - DNA, 22 bp, Homo sapiens
acttaatcggttgaccctactg

SEQ ID NO: 197984 - DNA, 11 bp, Homo sapiens
acttaatcttc

SEQ ID NO: 197985 - DNA, 14 bp, Homo sapiens
acttaatctttgct

SEQ ID NO: 197986 - DNA, 13 bp, Homo sapiens
acttacaagtaat

SEQ ID NO: 197987 - DNA, 23 bp, Homo sapiens
acttacaagtaatgaattttatg

SEQ ID NO: 197988 - DNA, 14 bp, Homo sapiens
acttactatggtat

SEQ ID NO: 197989 - DNA, 22 bp, Homo sapiens
acttactgtcagagaatatgac

SEQ ID NO: 197990 - DNA, 16 bp, Homo sapiens
acttagaaattgcatt

SEQ ID NO: 197991 - DNA, 17 bp, Homo sapiens
acttagaataaaattgt

SEQ ID NO: 197992 - DNA, 18 bp, Homo sapiens
acttagaataaaattgta

SEQ ID NO: 197993 - DNA, 22 bp, Homo sapiens
acttagaataaaattgtaaaat

SEQ ID NO: 197994 - DNA, 16 bp, Homo sapiens
acttagagaacaaagg

SEQ ID NO: 197995 - DNA, 20 bp, Homo sapiens
acttagaggtggggagcaga

SEQ ID NO: 197996 - DNA, 22 bp, Homo sapiens
acttagatctgagccctccctc

SEQ ID NO: 197997 - DNA, 16 bp, Homo sapiens
acttagctatcagaag

SEQ ID NO: 197998 - DNA, 22 bp, Homo sapiens
acttatatgctgaattgaacat

SEQ ID NO: 197999 - DNA, 18 bp, Homo sapiens
acttatattcatctattt

SEQ ID NO: 198000 - DNA, 17 bp, Homo sapiens
acttatcaaatcattca

SEQ ID NO: 198001 - DNA, 22 bp, Homo sapiens
acttatcaaatcattcaaaact

SEQ ID NO: 198002 - DNA, 16 bp, Homo sapiens
acttatcgaagctgat

SEQ ID NO: 198003 - DNA, 17 bp, Homo sapiens
acttatgcacatttgtg

SEQ ID NO: 198004 - DNA, 12 bp, Homo sapiens
acttatgctgct

SEQ ID NO: 198005 - DNA, 15 bp, Homo sapiens
acttatgctgctgtg

SEQ ID NO: 198006 - DNA, 20 bp, Homo sapiens
acttatgctgctgtgaattt

SEQ ID NO: 198007 - DNA, 16 bp, Homo sapiens
acttattacaatttgt

SEQ ID NO: 198008 - DNA, 19 bp, Homo sapiens
acttattcaaaaaaatcct

SEQ ID NO: 198009 - DNA, 16 bp, Homo sapiens
acttattgattaagta

SEQ ID NO: 198010 - DNA, 16 bp, Homo sapiens
acttattgcctgggca

SEQ ID NO: 198011 - DNA, 18 bp, Homo sapiens
acttattgcctgggcagt

SEQ ID NO: 198012 - DNA, 21 bp, Homo sapiens
acttattgcctgggcagtgcc

SEQ ID NO: 198013 - DNA, 22 bp, Homo sapiens
acttattgcctgggcagtgccc

SEQ ID NO: 198014 - DNA, 11 bp, Homo sapiens
acttatttgag

SEQ ID NO: 198015 - DNA, 17 bp, Homo sapiens
acttattttatttccat

SEQ ID NO: 198016 - DNA, 14 bp, Homo sapiens
acttattttctgaa

SEQ ID NO: 198017 - DNA, 18 bp, Homo sapiens
acttattttttaatgtga

SEQ ID NO: 198018 - DNA, 15 bp, Homo sapiens
acttcaaaagccata

SEQ ID NO: 198019 - DNA, 16 bp, Homo sapiens
acttcaaagctgaata

SEQ ID NO: 198020 - DNA, 18 bp, Homo sapiens
acttcaaagctgaatatt

SEQ ID NO: 198021 - DNA, 17 bp, Homo sapiens
acttcaagatgcctctt

SEQ ID NO: 198022 - DNA, 18 bp, Homo sapiens
acttcacacagacaagtg

SEQ ID NO: 198023 - DNA, 14 bp, Homo sapiens
acttcaccaccccc

SEQ ID NO: 198024 - DNA, 15 bp, Homo sapiens
acttcacccccaact

SEQ ID NO: 198025 - DNA, 13 bp, Homo sapiens
acttcagactctc

SEQ ID NO: 198026 - DNA, 20 bp, Homo sapiens
acttcagactctctcctctc

SEQ ID NO: 198027 - DNA, 14 bp, Homo sapiens
acttcagagaagtc

SEQ ID NO: 198028 - DNA, 22 bp, Homo sapiens
acttcagcaggggtgggaggct

SEQ ID NO: 198029 - DNA, 15 bp, Homo sapiens
acttcagctgcctga

SEQ ID NO: 198030 - DNA, 21 bp, Homo sapiens
acttcagctgcctgaaacagc

SEQ ID NO: 198031 - DNA, 18 bp, Homo sapiens
acttcaggctcttctcct

SEQ ID NO: 198032 - DNA, 15 bp, Homo sapiens
acttcagtcctggga

SEQ ID NO: 198033 - DNA, 19 bp, Homo sapiens
acttcattctaaaccaaaa

SEQ ID NO: 198034 - DNA, 23 bp, Homo sapiens
acttcattctaaaccaaaacaga

SEQ ID NO: 198035 - DNA, 15 bp, Homo sapiens
acttcatttctgatg

SEQ ID NO: 198036 - DNA, 15 bp, Homo sapiens
acttccaaaattctt

SEQ ID NO: 198037 - DNA, 19 bp, Homo sapiens
acttccaaaattcttattt

SEQ ID NO: 198038 - DNA, 15 bp, Homo sapiens
acttccaagaaaaat

SEQ ID NO: 198039 - DNA, 22 bp, Homo sapiens
acttccaagacctgactcaggc

SEQ ID NO: 198040 - DNA, 18 bp, Homo sapiens
acttccacagcagcagaa

SEQ ID NO: 198041 - DNA, 21 bp, Homo sapiens
acttccaggttccatccacca

SEQ ID NO: 198042 - DNA, 23 bp, Homo sapiens
acttccaggttccatccaccacc

SEQ ID NO: 198043 - DNA, 17 bp, Homo sapiens
acttccatacagctcta

SEQ ID NO: 198044 - DNA, 22 bp, Homo sapiens
acttccataggacatactgcat

SEQ ID NO: 198045 - DNA, 15 bp, Homo sapiens
acttccattctttct

SEQ ID NO: 198046 - DNA, 16 bp, Homo sapiens
acttccattctttctt

SEQ ID NO: 198047 - DNA, 17 bp, Homo sapiens
acttccattctttcttc

SEQ ID NO: 198048 - DNA, 22 bp, Homo sapiens
acttccattctttcttcctcca

SEQ ID NO: 198049 - DNA, 17 bp, Homo sapiens
acttcccaacagcctta

SEQ ID NO: 198050 - DNA, 14 bp, Homo sapiens
acttccctagaagt

SEQ ID NO: 198051 - DNA, 14 bp, Homo sapiens
acttccctgttctt

SEQ ID NO: 198052 - DNA, 22 bp, Homo sapiens
acttccctttctgcttgtgtta

SEQ ID NO: 198053 - DNA, 14 bp, Homo sapiens
acttccgtcaccct

SEQ ID NO: 198054 - DNA, 16 bp, Homo sapiens
acttccgtcacccttg

SEQ ID NO: 198055 - DNA, 23 bp, Homo sapiens
acttcctcctgatggccaagagc

SEQ ID NO: 198056 - DNA, 17 bp, Homo sapiens
acttcctggattttctt

SEQ ID NO: 198057 - DNA, 14 bp, Homo sapiens
acttccttcctgcc

SEQ ID NO: 198058 - DNA, 20 bp, Homo sapiens
acttcgaccctttctctgag

SEQ ID NO: 198059 - DNA, 18 bp, Homo sapiens
acttcgctattcccaggc

SEQ ID NO: 198060 - DNA, 19 bp, Homo sapiens
acttcgctattcccaggca

SEQ ID NO: 198061 - DNA, 19 bp, Homo sapiens
acttcgtcttctaatttca

SEQ ID NO: 198062 - DNA, 20 bp, Homo sapiens
acttcgtcttctaatttcaa

SEQ ID NO: 198063 - DNA, 16 bp, Homo sapiens
acttctaaatcataat

SEQ ID NO: 198064 - DNA, 15 bp, Homo sapiens
acttctaatatcatt

SEQ ID NO: 198065 - DNA, 13 bp, Homo sapiens
acttctagcagaa

SEQ ID NO: 198066 - DNA, 13 bp, Homo sapiens
acttctagttgct

SEQ ID NO: 198067 - DNA, 20 bp, Homo sapiens
acttctatttatttattatt

SEQ ID NO: 198068 - DNA, 18 bp, Homo sapiens
acttctgaactttggaag

SEQ ID NO: 198069 - DNA, 16 bp, Homo sapiens
acttctgctgtacaga

SEQ ID NO: 198070 - DNA, 22 bp, Homo sapiens
acttctggaaggctggctgagt

SEQ ID NO: 198071 - DNA, 20 bp, Homo sapiens
acttctggtcccctgtggtg

SEQ ID NO: 198072 - DNA, 23 bp, Homo sapiens
acttctgtaacgggtcgtgctca

SEQ ID NO: 198073 - DNA, 23 bp, Homo sapiens
acttctgtgagacccccacacct

SEQ ID NO: 198074 - DNA, 14 bp, Homo sapiens
acttctgtgtctgt

SEQ ID NO: 198075 - DNA, 16 bp, Homo sapiens
acttcttaaaagttgt

SEQ ID NO: 198076 - DNA, 16 bp, Homo sapiens
acttcttaaaggcctg

SEQ ID NO: 198077 - DNA, 17 bp, Homo sapiens
acttcttaaaggcctgg

SEQ ID NO: 198078 - DNA, 18 bp, Homo sapiens
acttcttaaaggcctgga

SEQ ID NO: 198079 - DNA, 21 bp, Homo sapiens
acttcttaaaggcctggaacc

SEQ ID NO: 198080 - DNA, 17 bp, Homo sapiens
acttcttatacatttga

SEQ ID NO: 198081 - DNA, 17 bp, Homo sapiens
acttcttcatccataga

SEQ ID NO: 198082 - DNA, 17 bp, Homo sapiens
acttcttcggaggtggc

SEQ ID NO: 198083 - DNA, 18 bp, Homo sapiens
acttcttcggaggtggca

SEQ ID NO: 198084 - DNA, 17 bp, Homo sapiens
acttcttctagagtaat

SEQ ID NO: 198085 - DNA, 18 bp, Homo sapiens
acttcttgaaacagcctg

SEQ ID NO: 198086 - DNA, 24 bp, Homo sapiens
acttcttgaaacagcctgggtgac

SEQ ID NO: 198087 - DNA, 16 bp, Homo sapiens
acttcttgtgctttac

SEQ ID NO: 198088 - DNA, 20 bp, Homo sapiens
acttcttttccaaaaatact

SEQ ID NO: 198089 - DNA, 13 bp, Homo sapiens
acttgaaagcatc

SEQ ID NO: 198090 - DNA, 14 bp, Homo sapiens
acttgaaagcatcc

SEQ ID NO: 198091 - DNA, 18 bp, Homo sapiens
acttgaaagcatccatgt

SEQ ID NO: 198092 - DNA, 20 bp, Homo sapiens
acttgaaagcatccatgtgt

SEQ ID NO: 198093 - DNA, 16 bp, Homo sapiens
acttgaatatggaaca

SEQ ID NO: 198094 - DNA, 17 bp, Homo sapiens
acttgaatatggaacat

SEQ ID NO: 198095 - DNA, 19 bp, Homo sapiens
acttgaatatggaacatat

SEQ ID NO: 198096 - DNA, 23 bp, Homo sapiens
acttgaatatggaacatatgcac

SEQ ID NO: 198097 - DNA, 16 bp, Homo sapiens
acttgaatgtacaaag

SEQ ID NO: 198098 - DNA, 18 bp, Homo sapiens
acttgaatgtacaaagat

SEQ ID NO: 198099 - DNA, 16 bp, Homo sapiens
acttgaatgtgtcact

SEQ ID NO: 198100 - DNA, 19 bp, Homo sapiens
acttgacccccttgagggt

SEQ ID NO: 198101 - DNA, 17 bp, Homo sapiens
acttgactcttgaataa

SEQ ID NO: 198102 - DNA, 21 bp, Homo sapiens
acttgagaactttccattttg

SEQ ID NO: 198103 - DNA, 16 bp, Homo sapiens
acttgagaggatgaat

SEQ ID NO: 198104 - DNA, 19 bp, Homo sapiens
acttgagaggatgaatgta

SEQ ID NO: 198105 - DNA, 19 bp, Homo sapiens
acttgagatgtatgaaggc

SEQ ID NO: 198106 - DNA, 21 bp, Homo sapiens
acttgagatgtatgaaggctt

SEQ ID NO: 198107 - DNA, 17 bp, Homo sapiens
acttgaggacacatgtc

SEQ ID NO: 198108 - DNA, 18 bp, Homo sapiens
acttgaggacacatgtcc

SEQ ID NO: 198109 - DNA, 13 bp, Homo sapiens
atagcaagagatg

SEQ ID NO: 198110 - DNA, 13 bp, Homo sapiens
atagcaagtccca

SEQ ID NO: 198111 - DNA, 21 bp, Homo sapiens
atagcactgggaactctggct

SEQ ID NO: 198112 - DNA, 16 bp, Homo sapiens
atagcagacagtgttt

SEQ ID NO: 198113 - DNA, 16 bp, Homo sapiens
cagactcagtttgtca

SEQ ID NO: 198114 - DNA, 18 bp, Homo sapiens
cagactcctcagatctga

SEQ ID NO: 198115 - DNA, 16 bp, Homo sapiens
cagactcgagagggct

SEQ ID NO: 198116 - DNA, 17 bp, Homo sapiens
cagactcgagagggctg

SEQ ID NO: 198117 - DNA, 19 bp, Homo sapiens
cagactcgatgcaagtgtt

SEQ ID NO: 198118 - DNA, 21 bp, Homo sapiens
cagactcgttctcgtgaccca

SEQ ID NO: 198119 - DNA, 22 bp, Homo sapiens
cagactcgttctcgtgacccag

SEQ ID NO: 198120 - DNA, 19 bp, Homo sapiens
cagactctaaacacacaag

SEQ ID NO: 198121 - DNA, 23 bp, Homo sapiens
cagactctctcctctctctccct

SEQ ID NO: 198122 - DNA, 12 bp, Homo sapiens
cagactggaggg

SEQ ID NO: 198123 - DNA, 18 bp, Homo sapiens
cagactggctgcacagcc

SEQ ID NO: 198124 - DNA, 19 bp, Homo sapiens
cagactggctgcacagccc

SEQ ID NO: 198125 - DNA, 20 bp, Homo sapiens
cagactggtgagcagactgg

SEQ ID NO: 198126 - DNA, 22 bp, Homo sapiens
cagactgtaagatgttgtttta

SEQ ID NO: 198127 - DNA, 24 bp, Homo sapiens
cagactgttagaaaatggacactg

SEQ ID NO: 198128 - DNA, 22 bp, Homo sapiens
cagacttcacacagcacctcct

SEQ ID NO: 198129 - DNA, 22 bp, Homo sapiens
cagacttcgctattcccaggca

SEQ ID NO: 198130 - DNA, 20 bp, Homo sapiens
cagacttctcttattcttta

SEQ ID NO: 198131 - DNA, 15 bp, Homo sapiens
cagacttctggaagg

SEQ ID NO: 198132 - DNA, 19 bp, Homo sapiens
cagacttctggaaggctgg

SEQ ID NO: 198133 - DNA, 13 bp, Homo sapiens
cagacttgtttcc

SEQ ID NO: 198134 - DNA, 15 bp, Homo sapiens
cagactttaaagaat

SEQ ID NO: 198135 - DNA, 21 bp, Homo sapiens
cagactttctacacctgttgc

SEQ ID NO: 198136 - DNA, 13 bp, Homo sapiens
cagagaaaacaca

SEQ ID NO: 198137 - DNA, 15 bp, Homo sapiens
cagagaaaacacacg

SEQ ID NO: 198138 - DNA, 14 bp, Homo sapiens
cagagaaaacactt

SEQ ID NO: 198139 - DNA, 15 bp, Homo sapiens
cagagaaattctgtg

SEQ ID NO: 198140 - DNA, 18 bp, Homo sapiens
cagagaacaatcactatt

SEQ ID NO: 198141 - DNA, 20 bp, Homo sapiens
cagagaacaatcactattct

SEQ ID NO: 198142 - DNA, 21 bp, Homo sapiens
cagagaacaatcactattctt

SEQ ID NO: 198143 - DNA, 22 bp, Homo sapiens
cagagaacaatcactattctta

SEQ ID NO: 198144 - DNA, 17 bp, Homo sapiens
cagagaactagtggtgg

SEQ ID NO: 198145 - DNA, 19 bp, Homo sapiens
cagagaagataatgttctt

SEQ ID NO: 198146 - DNA, 22 bp, Homo sapiens
cagagaaggaaaagactgaatc

SEQ ID NO: 198147 - DNA, 15 bp, Homo sapiens
cagagaaggcctctt

SEQ ID NO: 198148 - DNA, 12 bp, Homo sapiens
cagagaagtcag

SEQ ID NO: 198149 - DNA, 23 bp, Homo sapiens
cagagaagtcagttggagaaaat

SEQ ID NO: 198150 - DNA, 15 bp, Homo sapiens
cagagaattctctta

SEQ ID NO: 198151 - DNA, 16 bp, Homo sapiens
cagagacaaggagggc

SEQ ID NO: 198152 - DNA, 18 bp, Homo sapiens
cagagacaataaaacatt

SEQ ID NO: 198153 - DNA, 14 bp, Homo sapiens
cagagacagagagg

SEQ ID NO: 198154 - DNA, 20 bp, Homo sapiens
cagagacatgggcctcccac

SEQ ID NO: 198155 - DNA, 15 bp, Homo sapiens
cagagacccccgtgc

SEQ ID NO: 198156 - DNA, 13 bp, Homo sapiens
cagagacgcagga

SEQ ID NO: 198157 - DNA, 17 bp, Homo sapiens
cagagacggcagcccca

SEQ ID NO: 198158 - DNA, 21 bp, Homo sapiens
cagagacggcagccccatcct

SEQ ID NO: 198159 - DNA, 10 bp, Homo sapiens
cagagactgc

SEQ ID NO: 198160 - DNA, 12 bp, Homo sapiens
cagagactgccc

SEQ ID NO: 198161 - DNA, 19 bp, Homo sapiens
cagagactgcccaccctgg

SEQ ID NO: 198162 - DNA, 22 bp, Homo sapiens
cagagactgcccaccctgggcc

SEQ ID NO: 198163 - DNA, 22 bp, Homo sapiens
cagagactggcagccagggagc

SEQ ID NO: 198164 - DNA, 15 bp, Homo sapiens
cagagagaaaaagag

SEQ ID NO: 198165 - DNA, 11 bp, Homo sapiens
cagagagacag

SEQ ID NO: 198166 - DNA, 22 bp, Homo sapiens
cagagagaggcgtcctggtgag

SEQ ID NO: 198167 - DNA, 17 bp, Homo sapiens
cagagagctgaagtact

SEQ ID NO: 198168 - DNA, 23 bp, Homo sapiens
cagagagctgaagtactgcaccc

SEQ ID NO: 198169 - DNA, 12 bp, Homo sapiens
cagagagctggt

SEQ ID NO: 198170 - DNA, 16 bp, Homo sapiens
cagagaggacgtgggc

SEQ ID NO: 198171 - DNA, 18 bp, Homo sapiens
cagagaggagaaacacat

SEQ ID NO: 198172 - DNA, 12 bp, Homo sapiens
cagagaggagca

SEQ ID NO: 198173 - DNA, 14 bp, Homo sapiens
cagagaggagcacc

SEQ ID NO: 198174 - DNA, 21 bp, Homo sapiens
cagagaggagcacctgaaccc

SEQ ID NO: 198175 - DNA, 15 bp, Homo sapiens
cagagagggcccagc

SEQ ID NO: 198176 - DNA, 22 bp, Homo sapiens
cagagagggcccagctgtagcc

SEQ ID NO: 198177 - DNA, 23 bp, Homo sapiens
cagagagggcccagctgtagcca

SEQ ID NO: 198178 - DNA, 20 bp, Homo sapiens
cagagagggggccacctccc

SEQ ID NO: 198179 - DNA, 17 bp, Homo sapiens
cagagaggtctcaggtt

SEQ ID NO: 198180 - DNA, 20 bp, Homo sapiens
cagagaggttaaggtgggta

SEQ ID NO: 198181 - DNA, 14 bp, Homo sapiens
cagagagtggctcc

SEQ ID NO: 198182 - DNA, 21 bp, Homo sapiens
cagagatggaggttctctcgg

SEQ ID NO: 198183 - DNA, 18 bp, Homo sapiens
cagagatgggactgggag

SEQ ID NO: 198184 - DNA, 22 bp, Homo sapiens
cagagatgggactgggagggcc

SEQ ID NO: 198185 - DNA, 21 bp, Homo sapiens
cagagattgggggggcttggg

SEQ ID NO: 198186 - DNA, 21 bp, Homo sapiens
cagagcaagactctgtctcaa

SEQ ID NO: 198187 - DNA, 18 bp, Homo sapiens
cagagcacagcagcccct

SEQ ID NO: 198188 - DNA, 13 bp, Homo sapiens
cagagcacctcag

SEQ ID NO: 198189 - DNA, 18 bp, Homo sapiens
cagagcacctcaggaccc

SEQ ID NO: 198190 - DNA, 21 bp, Homo sapiens
cagagcactgtgtaaccagca

SEQ ID NO: 198191 - DNA, 19 bp, Homo sapiens
cagagcagagcaaatgagg

SEQ ID NO: 198192 - DNA, 20 bp, Homo sapiens
cagagcagcacaaagaaaca

SEQ ID NO: 198193 - DNA, 12 bp, Homo sapiens
cagagcagctcc

SEQ ID NO: 198194 - DNA, 21 bp, Homo sapiens
cagagcagctccccaggagct

SEQ ID NO: 198195 - DNA, 19 bp, Homo sapiens
cagagcaggaggcccctgg

SEQ ID NO: 198196 - DNA, 16 bp, Homo sapiens
cagagcaggtctgcag

SEQ ID NO: 198197 - DNA, 18 bp, Homo sapiens
cagagcaggtctgcaggc

SEQ ID NO: 198198 - DNA, 15 bp, Homo sapiens
cagagcatgtgtcag

SEQ ID NO: 198199 - DNA, 18 bp, Homo sapiens
cagagccaaattggtaga

SEQ ID NO: 198200 - DNA, 21 bp, Homo sapiens
cagagccaagtcctccctctc

SEQ ID NO: 198201 - DNA, 15 bp, Homo sapiens
cagagccagcctggg

SEQ ID NO: 198202 - DNA, 17 bp, Homo sapiens
cagagccagcctgggac

SEQ ID NO: 198203 - DNA, 18 bp, Homo sapiens
cagagccagcctgggact

SEQ ID NO: 198204 - DNA, 23 bp, Homo sapiens
cagagccagcctgggactcccag

SEQ ID NO: 198205 - DNA, 14 bp, Homo sapiens
cagagccatggact

SEQ ID NO: 198206 - DNA, 15 bp, Homo sapiens
cagagccatgggcct

SEQ ID NO: 198207 - DNA, 17 bp, Homo sapiens
cagagccatgggcctgg

SEQ ID NO: 198208 - DNA, 17 bp, Homo sapiens
cagagccccggagcacc

SEQ ID NO: 198209 - DNA, 19 bp, Homo sapiens
cagagccccggagcaccac

SEQ ID NO: 198210 - DNA, 12 bp, Homo sapiens
cagagcccgccc

SEQ ID NO: 198211 - DNA, 14 bp, Homo sapiens
cagagccctgccct

SEQ ID NO: 198212 - DNA, 15 bp, Homo sapiens
cagagccctggctgg

SEQ ID NO: 198213 - DNA, 15 bp, Homo sapiens
cagagcccttcactg

SEQ ID NO: 198214 - DNA, 15 bp, Homo sapiens
aggtggtgccttctc

SEQ ID NO: 198215 - DNA, 20 bp, Homo sapiens
aggtgtatggagagaaaaca

SEQ ID NO: 198216 - DNA, 18 bp, Homo sapiens
aggtgtcaccctgcagag

SEQ ID NO: 198217 - DNA, 19 bp, Homo sapiens
aggtgtcaccctgcagagc

SEQ ID NO: 198218 - DNA, 12 bp, Homo sapiens
aggtgtccccaa

SEQ ID NO: 198219 - DNA, 15 bp, Homo sapiens
aggtgtccccaacgt

SEQ ID NO: 198220 - DNA, 15 bp, Homo sapiens
aggtgtcctgactgt

SEQ ID NO: 198221 - DNA, 13 bp, Homo sapiens
aggtgtgctacag

SEQ ID NO: 198222 - DNA, 15 bp, Homo sapiens
aggtgtggagtggag

SEQ ID NO: 198223 - DNA, 12 bp, Homo sapiens
aggtgtggtggc

SEQ ID NO: 198224 - DNA, 16 bp, Homo sapiens
aggtgtggtggctcat

SEQ ID NO: 198225 - DNA, 16 bp, Homo sapiens
aggtgttaaaaaccat

SEQ ID NO: 198226 - DNA, 21 bp, Homo sapiens
aggtgttaaaaaccattataa

SEQ ID NO: 198227 - DNA, 18 bp, Homo sapiens
aggtgttgattttctgtt

SEQ ID NO: 198228 - DNA, 21 bp, Homo sapiens
aggtgttgattttctgttgta

SEQ ID NO: 198229 - DNA, 12 bp, Homo sapiens
aggtgttgccaa

SEQ ID NO: 198230 - DNA, 22 bp, Homo sapiens
aggtgttgccaaatatgtcctg

SEQ ID NO: 198231 - DNA, 23 bp, Homo sapiens
aggtgttgccaaatatgtcctgg

SEQ ID NO: 198232 - DNA, 11 bp, Homo sapiens
aggtgtttata

SEQ ID NO: 198233 - DNA, 14 bp, Homo sapiens
aggttaaaatataa

SEQ ID NO: 198234 - DNA, 14 bp, Homo sapiens
aggttataggtcac

SEQ ID NO: 198235 - DNA, 17 bp, Homo sapiens
aggttataggtcactcc

SEQ ID NO: 198236 - DNA, 19 bp, Homo sapiens
aggttataggtcactcctg

SEQ ID NO: 198237 - DNA, 15 bp, Homo sapiens
aggttatctgcctgg

SEQ ID NO: 198238 - DNA, 19 bp, Homo sapiens
aggttatctgcctggcctg

SEQ ID NO: 198239 - DNA, 13 bp, Homo sapiens
aggttctcagagc

SEQ ID NO: 198240 - DNA, 13 bp, Homo sapiens
aggttctcagcaa

SEQ ID NO: 198241 - DNA, 16 bp, Homo sapiens
aggttctcagcaagtg

SEQ ID NO: 198242 - DNA, 13 bp, Homo sapiens
aggttctccaggt

SEQ ID NO: 198243 - DNA, 12 bp, Homo sapiens
agtcaggcttct

SEQ ID NO: 198244 - DNA, 22 bp, Homo sapiens
agtcagggacagcagcctccct

SEQ ID NO: 198245 - DNA, 15 bp, Homo sapiens
agtcagtaggagagg

SEQ ID NO: 198246 - DNA, 16 bp, Homo sapiens
agtcagtaggagagga

SEQ ID NO: 198247 - DNA, 17 bp, Homo sapiens
agtcagttcccggagca

SEQ ID NO: 198248 - DNA, 19 bp, Homo sapiens
agtcagttcccggagcaca

SEQ ID NO: 198249 - DNA, 20 bp, Homo sapiens
agtcagttcccggagcacag

SEQ ID NO: 198250 - DNA, 15 bp, Homo sapiens
agtcataagctccag

SEQ ID NO: 198251 - DNA, 14 bp, Homo sapiens
agtcatcaaaaaga

SEQ ID NO: 198252 - DNA, 19 bp, Homo sapiens
agtcatcaaaaagagtctt

SEQ ID NO: 198253 - DNA, 18 bp, Homo sapiens
agtcatcaacaaaaggga

SEQ ID NO: 198254 - DNA, 21 bp, Homo sapiens
agtcatcatctttttgtgtgc

SEQ ID NO: 198255 - DNA, 22 bp, Homo sapiens
agtcatcatctttttgtgtgca

SEQ ID NO: 198256 - DNA, 23 bp, Homo sapiens
agtcatcatgggggatttttcat

SEQ ID NO: 198257 - DNA, 16 bp, Homo sapiens
agtcatctactttttt

SEQ ID NO: 198258 - DNA, 14 bp, Homo sapiens
agtcatctttgaga

SEQ ID NO: 198259 - DNA, 13 bp, Homo sapiens
agtcatgacattt

SEQ ID NO: 198260 - DNA, 22 bp, Homo sapiens
agtcatggagaatctgctgcat

SEQ ID NO: 198261 - DNA, 17 bp, Homo sapiens
agtcatgggaacgcagc

SEQ ID NO: 198262 - DNA, 12 bp, Homo sapiens
agtcattcttac

SEQ ID NO: 198263 - DNA, 23 bp, Homo sapiens
agtcattgttacaggtgtactat

SEQ ID NO: 198264 - DNA, 21 bp, Homo sapiens
agtcattttaactttatcaca

SEQ ID NO: 198265 - DNA, 11 bp, Homo sapiens
agtccaaagtc

SEQ ID NO: 198266 - DNA, 18 bp, Homo sapiens
agtccaacgtggggcagc

SEQ ID NO: 198267 - DNA, 23 bp, Homo sapiens
agtccaacgtggggcagcacaga

SEQ ID NO: 198268 - DNA, 10 bp, Homo sapiens
agtccacccc

SEQ ID NO: 198269 - DNA, 19 bp, Homo sapiens
agtccacccccattgtgaa

SEQ ID NO: 198270 - DNA, 21 bp, Homo sapiens
agtccacccccattgtgaatg

SEQ ID NO: 198271 - DNA, 12 bp, Homo sapiens
agtccacctgag

SEQ ID NO: 198272 - DNA, 14 bp, Homo sapiens
agtccactctgagt

SEQ ID NO: 198273 - DNA, 13 bp, Homo sapiens
agtccactgggga

SEQ ID NO: 198274 - DNA, 13 bp, Homo sapiens
agtccactttcct

SEQ ID NO: 198275 - DNA, 16 bp, Homo sapiens
agtccactttcctctc

SEQ ID NO: 198276 - DNA, 16 bp, Homo sapiens
agtccagacctgggcc

SEQ ID NO: 198277 - DNA, 19 bp, Homo sapiens
agtccagacctgggccctg

SEQ ID NO: 198278 - DNA, 20 bp, Homo sapiens
agtccagctctcccctgcgc

SEQ ID NO: 198279 - DNA, 20 bp, Homo sapiens
agtccaggagccccagccag

SEQ ID NO: 198280 - DNA, 18 bp, Homo sapiens
agtccaggccccaaaacc

SEQ ID NO: 198281 - DNA, 18 bp, Homo sapiens
agtccaggtcgggctcag

SEQ ID NO: 198282 - DNA, 22 bp, Homo sapiens
agtccaggtcgggctcagctct

SEQ ID NO: 198283 - DNA, 19 bp, Homo sapiens
agtccagtttgtgcaagac

SEQ ID NO: 198284 - DNA, 19 bp, Homo sapiens
agtcccagaaccacactgt

SEQ ID NO: 198285 - DNA, 17 bp, Homo sapiens
agtcccagtattctcag

SEQ ID NO: 198286 - DNA, 14 bp, Homo sapiens
agtcccccaccaca

SEQ ID NO: 198287 - DNA, 21 bp, Homo sapiens
agtcccccctcccacctccag

SEQ ID NO: 198288 - DNA, 15 bp, Homo sapiens
agtccccgtgccccg

SEQ ID NO: 198289 - DNA, 18 bp, Homo sapiens
agtcccgaggcagcaaca

SEQ ID NO: 198290 - DNA, 19 bp, Homo sapiens
agtccctccctcctggctc

SEQ ID NO: 198291 - DNA, 20 bp, Homo sapiens
agtccctccctcctggctca

SEQ ID NO: 198292 - DNA, 12 bp, Homo sapiens
agtccctcctgt

SEQ ID NO: 198293 - DNA, 15 bp, Homo sapiens
agtccctgagaagcc

SEQ ID NO: 198294 - DNA, 18 bp, Homo sapiens
agtccctgagaagcctca

SEQ ID NO: 198295 - DNA, 23 bp, Homo sapiens
agtccctgagaagcctcatggga

SEQ ID NO: 198296 - DNA, 17 bp, Homo sapiens
agtccctggagctgtcc

SEQ ID NO: 198297 - DNA, 22 bp, Homo sapiens
agtccctggagctgtccttcat

SEQ ID NO: 198298 - DNA, 15 bp, Homo sapiens
agtcccttaaaaatt

SEQ ID NO: 198299 - DNA, 15 bp, Homo sapiens
agtcccttcccctcc

SEQ ID NO: 198300 - DNA, 19 bp, Homo sapiens
agtcccttcccctccctgg

SEQ ID NO: 198301 - DNA, 20 bp, Homo sapiens
agtcccttcccctccctggc

SEQ ID NO: 198302 - DNA, 23 bp, Homo sapiens
agtcccttcccctccctggctcc

SEQ ID NO: 198303 - DNA, 13 bp, Homo sapiens
agtcccttcctgt

SEQ ID NO: 198304 - DNA, 17 bp, Homo sapiens
agtccggacccacctca

SEQ ID NO: 198305 - DNA, 14 bp, Homo sapiens
agtccggaggcagc

SEQ ID NO: 198306 - DNA, 22 bp, Homo sapiens
agtccggaggcagcagacacgc

SEQ ID NO: 198307 - DNA, 22 bp, Homo sapiens
agtcctactttacatatgcttt

SEQ ID NO: 198308 - DNA, 15 bp, Homo sapiens
agtcctagctgacgc

SEQ ID NO: 198309 - DNA, 15 bp, Homo sapiens
agtcctcaaagcttt

SEQ ID NO: 198310 - DNA, 19 bp, Homo sapiens
agtcctcaaagctttttga

SEQ ID NO: 198311 - DNA, 20 bp, Homo sapiens
agtcctcaaagctttttgaa

SEQ ID NO: 198312 - DNA, 23 bp, Homo sapiens
agtcctcaaagctttttgaaaac

SEQ ID NO: 198313 - DNA, 19 bp, Homo sapiens
agtcctcacagcctctccc

SEQ ID NO: 198314 - DNA, 15 bp, Homo sapiens
agtcctcactcccag

SEQ ID NO: 198315 - DNA, 14 bp, Homo sapiens
agtcctccctcctg

SEQ ID NO: 198316 - DNA, 18 bp, Homo sapiens
agtcctccctcctgcagg

SEQ ID NO: 198317 - DNA, 20 bp, Homo sapiens
agtcctccctcctgcaggct

SEQ ID NO: 198318 - DNA, 12 bp, Homo sapiens
agtcctgaggca

SEQ ID NO: 198319 - DNA, 14 bp, Homo sapiens
agtcctgaggcaga

SEQ ID NO: 198320 - DNA, 12 bp, Homo sapiens
agtcctgccttt

SEQ ID NO: 198321 - DNA, 14 bp, Homo sapiens
agtcctgctctcta

SEQ ID NO: 198322 - DNA, 20 bp, Homo sapiens
agtcctggcatgggaatgaa

SEQ ID NO: 198323 - DNA, 22 bp, Homo sapiens
agtcctggcatgggaatgaatg

SEQ ID NO: 198324 - DNA, 22 bp, Homo sapiens
agtcctggctacatcccagcct

SEQ ID NO: 198325 - DNA, 15 bp, Homo sapiens
agtcctggtggggct

SEQ ID NO: 198326 - DNA, 21 bp, Homo sapiens
agtcctggtggggctgagcct

SEQ ID NO: 198327 - DNA, 22 bp, Homo sapiens
agtcctgtgcggtgtcaccatg

SEQ ID NO: 198328 - DNA, 14 bp, Homo sapiens
agtcctgttctcag

SEQ ID NO: 198329 - DNA, 19 bp, Homo sapiens
agtcctgttctcagagctc

SEQ ID NO: 198330 - DNA, 18 bp, Homo sapiens
agtccttaaacagggcat

SEQ ID NO: 198331 - DNA, 15 bp, Homo sapiens
agtccttacctcttc

SEQ ID NO: 198332 - DNA, 18 bp, Homo sapiens
agtcgaattaatagcttt

SEQ ID NO: 198333 - DNA, 21 bp, Homo sapiens
agtcgaattaatagcttttat

SEQ ID NO: 198334 - DNA, 21 bp, Homo sapiens
agtcgattaacctgcatgcag

SEQ ID NO: 198335 - DNA, 13 bp, Homo sapiens
agtcgcggctgca

SEQ ID NO: 198336 - DNA, 13 bp, Homo sapiens
agtcgctgaacaa

SEQ ID NO: 198337 - DNA, 16 bp, Homo sapiens
agtcggatctagccat

SEQ ID NO: 198338 - DNA, 15 bp, Homo sapiens
agtcgggaaattctg

SEQ ID NO: 198339 - DNA, 17 bp, Homo sapiens
agtcgggaaattctgct

SEQ ID NO: 198340 - DNA, 18 bp, Homo sapiens
agtcgtggagatgtcttc

SEQ ID NO: 198341 - DNA, 21 bp, Homo sapiens
agtcgtggagatgtcttcgta

SEQ ID NO: 198342 - DNA, 16 bp, Homo sapiens
agtctcaattttgtat

SEQ ID NO: 198343 - DNA, 14 bp, Homo sapiens
agtctcactctgtt

SEQ ID NO: 198344 - DNA, 15 bp, Homo sapiens
agtctcattcctctg

SEQ ID NO: 198345 - DNA, 22 bp, Homo sapiens
agtctcattctgttgcccaggc

SEQ ID NO: 198346 - DNA, 19 bp, Homo sapiens
agtctcccaggccccctgc

SEQ ID NO: 198347 - DNA, 23 bp, Homo sapiens
agtctcccaggccccctgcatct

SEQ ID NO: 198348 - DNA, 19 bp, Homo sapiens
agtctccctccgactccag

SEQ ID NO: 198349 - DNA, 21 bp, Homo sapiens
agtctccctccgactccagat

SEQ ID NO: 198350 - DNA, 17 bp, Homo sapiens
agtctccctttcccttc

SEQ ID NO: 198351 - DNA, 18 bp, Homo sapiens
agtctcctttgcactgag

SEQ ID NO: 198352 - DNA, 19 bp, Homo sapiens
agtctcgctctgttgccca

SEQ ID NO: 198353 - DNA, 17 bp, Homo sapiens
agtctctcatttctttc

SEQ ID NO: 198354 - DNA, 16 bp, Homo sapiens
agtctctccctggggt

SEQ ID NO: 198355 - DNA, 12 bp, Homo sapiens
agtctctctgtg

SEQ ID NO: 198356 - DNA, 14 bp, Homo sapiens
agtctctctgtgaa

SEQ ID NO: 198357 - DNA, 21 bp, Homo sapiens
agtctctctgtgaatacaatt

SEQ ID NO: 198358 - DNA, 22 bp, Homo sapiens
agtctctctgtgaatacaatta

SEQ ID NO: 198359 - DNA, 19 bp, Homo sapiens
agtctctgatttgcaaatg

SEQ ID NO: 198360 - DNA, 15 bp, Homo sapiens
agtctctgccaccca

SEQ ID NO: 198361 - DNA, 18 bp, Homo sapiens
agtctctgccacccactc

SEQ ID NO: 198362 - DNA, 19 bp, Homo sapiens
agtctctgccacccactca

SEQ ID NO: 198363 - DNA, 16 bp, Homo sapiens
agtctctgctggccca

SEQ ID NO: 198364 - DNA, 17 bp, Homo sapiens
agtctctgctggcccag

SEQ ID NO: 198365 - DNA, 17 bp, Homo sapiens
agtctcttaattctgat

SEQ ID NO: 198366 - DNA, 18 bp, Homo sapiens
agtctcttctccactgga

SEQ ID NO: 198367 - DNA, 19 bp, Homo sapiens
agtctcttctccactggat

SEQ ID NO: 198368 - DNA, 17 bp, Homo sapiens
agtctctttaatcttca

SEQ ID NO: 198369 - DNA, 21 bp, Homo sapiens
agtctctttaatcttcagttt

SEQ ID NO: 198370 - DNA, 22 bp, Homo sapiens
agtctctttaatcttcagtttt

SEQ ID NO: 198371 - DNA, 20 bp, Homo sapiens
agtctctttttttggcccag

SEQ ID NO: 198372 - DNA, 14 bp, Homo sapiens
caggaacagctatg

SEQ ID NO: 198373 - DNA, 20 bp, Homo sapiens
caggaacagctatgggagcc

SEQ ID NO: 198374 - DNA, 16 bp, Homo sapiens
caggaacagtggctgg

SEQ ID NO: 198375 - DNA, 17 bp, Homo sapiens
caggaacagtggctggg

SEQ ID NO: 198376 - DNA, 13 bp, Homo sapiens
caggaacgagcac

SEQ ID NO: 198377 - DNA, 21 bp, Homo sapiens
caggaacgagcactggccaga

SEQ ID NO: 198378 - DNA, 17 bp, Homo sapiens
agtctgagcccccggct

SEQ ID NO: 198379 - DNA, 22 bp, Homo sapiens
agtctgaggccccaggccctag

SEQ ID NO: 198380 - DNA, 22 bp, Homo sapiens
agtctgcgcccttgtgccctgc

SEQ ID NO: 198381 - DNA, 16 bp, Homo sapiens
agtctgctatattttc

SEQ ID NO: 198382 - DNA, 17 bp, Homo sapiens
agtctgctatattttca

SEQ ID NO: 198383 - DNA, 13 bp, Homo sapiens
agtctgctgccct

SEQ ID NO: 198384 - DNA, 15 bp, Homo sapiens
agtctgctgccctcc

SEQ ID NO: 198385 - DNA, 20 bp, Homo sapiens
agtctgcttgtcttagatgt

SEQ ID NO: 198386 - DNA, 19 bp, Homo sapiens
agtctggagaccaggactc

SEQ ID NO: 198387 - DNA, 21 bp, Homo sapiens
agtctggagaccaggactctg

SEQ ID NO: 198388 - DNA, 22 bp, Homo sapiens
agtctggaggggcatggccagc

SEQ ID NO: 198389 - DNA, 19 bp, Homo sapiens
agtctggccaatatggaga

SEQ ID NO: 198390 - DNA, 16 bp, Homo sapiens
agtctggcctgccagg

SEQ ID NO: 198391 - DNA, 22 bp, Homo sapiens
agtctgggaaggggcgtgtccc

SEQ ID NO: 198392 - DNA, 14 bp, Homo sapiens
agtctgggcctctg

SEQ ID NO: 198393 - DNA, 17 bp, Homo sapiens
agtctgggcctctgact

SEQ ID NO: 198394 - DNA, 23 bp, Homo sapiens
agtctgggcctctgactctgagt

SEQ ID NO: 198395 - DNA, 13 bp, Homo sapiens
agtctgtcatgaa

SEQ ID NO: 198396 - DNA, 13 bp, Homo sapiens
agtctgtctactg

SEQ ID NO: 198397 - DNA, 18 bp, Homo sapiens
agtctgtctactgtggtg

SEQ ID NO: 198398 - DNA, 21 bp, Homo sapiens
agtctgtctactgtggtgatc

SEQ ID NO: 198399 - DNA, 18 bp, Homo sapiens
agtctgtggacactgtgg

SEQ ID NO: 198400 - DNA, 11 bp, Homo sapiens
agtctgtgtgc

SEQ ID NO: 198401 - DNA, 23 bp, Homo sapiens
agtctgtgtgctgtggttcctgg

SEQ ID NO: 198402 - DNA, 18 bp, Homo sapiens
agtctgtgtgtagccagg

SEQ ID NO: 198403 - DNA, 19 bp, Homo sapiens
agtctgtgtgtagccagga

SEQ ID NO: 198404 - DNA, 14 bp, Homo sapiens
agtcttaattttct

SEQ ID NO: 198405 - DNA, 15 bp, Homo sapiens
agtcttactgttttg

SEQ ID NO: 198406 - DNA, 19 bp, Homo sapiens
agtcttactgttttgtgcg

SEQ ID NO: 198407 - DNA, 19 bp, Homo sapiens
agtcttcactctctgaaga

SEQ ID NO: 198408 - DNA, 17 bp, Homo sapiens
agtcttccctagggctg

SEQ ID NO: 198409 - DNA, 20 bp, Homo sapiens
agtcttccctagggctgggt

SEQ ID NO: 198410 - DNA, 22 bp, Homo sapiens
agtcttctaccaaatgtgtaat

SEQ ID NO: 198411 - DNA, 14 bp, Homo sapiens
agtcttctccctgt

SEQ ID NO: 198412 - DNA, 23 bp, Homo sapiens
agtcttgagtgggccccctctct

SEQ ID NO: 198413 - DNA, 13 bp, Homo sapiens
agtcttgcctagg

SEQ ID NO: 198414 - DNA, 20 bp, Homo sapiens
agtcttgtgactagtgctga

SEQ ID NO: 198415 - DNA, 21 bp, Homo sapiens
agtcttgtgactagtgctgaa

SEQ ID NO: 198416 - DNA, 12 bp, Homo sapiens
agtcttgtgctt

SEQ ID NO: 198417 - DNA, 15 bp, Homo sapiens
agtcttgtgcttttc

SEQ ID NO: 198418 - DNA, 16 bp, Homo sapiens
agtctttgctcagtgg

SEQ ID NO: 198419 - DNA, 21 bp, Homo sapiens
agtctttgggggattcaaatg

SEQ ID NO: 198420 - DNA, 23 bp, Homo sapiens
agtctttgggggattcaaatgca

SEQ ID NO: 198421 - DNA, 23 bp, Homo sapiens
agtctttgtaagtaaactgccct

SEQ ID NO: 198422 - DNA, 14 bp, Homo sapiens
agtctttgtacaga

SEQ ID NO: 198423 - DNA, 14 bp, Homo sapiens
agtcttttctgtca

SEQ ID NO: 198424 - DNA, 14 bp, Homo sapiens
agtgaaaaatatgt

SEQ ID NO: 198425 - DNA, 17 bp, Homo sapiens
agtgaaaaatatgttga

SEQ ID NO: 198426 - DNA, 14 bp, Homo sapiens
agtgaaaagtagag

SEQ ID NO: 198427 - DNA, 15 bp, Homo sapiens
agtgaaaccatgact

SEQ ID NO: 198428 - DNA, 13 bp, Homo sapiens
agtgaaacttgtg

SEQ ID NO: 198429 - DNA, 13 bp, Homo sapiens
agtgaaagtactt

SEQ ID NO: 198430 - DNA, 19 bp, Homo sapiens
agtgaacacccccagctgg

SEQ ID NO: 198431 - DNA, 15 bp, Homo sapiens
agtgaacagtttgga

SEQ ID NO: 198432 - DNA, 18 bp, Homo sapiens
agtgaacagtttggatgt

SEQ ID NO: 198433 - DNA, 15 bp, Homo sapiens
agtgaacataactgt

SEQ ID NO: 198434 - DNA, 12 bp, Homo sapiens
agtgaacatttc

SEQ ID NO: 198435 - DNA, 18 bp, Homo sapiens
agtgaacatttgggtaaa

SEQ ID NO: 198436 - DNA, 23 bp, Homo sapiens
agtgaacttacacttggagcccg

SEQ ID NO: 198437 - DNA, 15 bp, Homo sapiens
agtgaagcccaggag

SEQ ID NO: 198438 - DNA, 17 bp, Homo sapiens
agtgaaggccacagcaa

SEQ ID NO: 198439 - DNA, 22 bp, Homo sapiens
agtgaagtccttcagtgagccc

SEQ ID NO: 198440 - DNA, 15 bp, Homo sapiens
agtgaataaaaatta

SEQ ID NO: 198441 - DNA, 17 bp, Homo sapiens
agtgaatgagtaaataa

SEQ ID NO: 198442 - DNA, 13 bp, Homo sapiens
agtgacacagcag

SEQ ID NO: 198443 - DNA, 23 bp, Homo sapiens
agtgacacagcagcttcaccaga

SEQ ID NO: 198444 - DNA, 23 bp, Homo sapiens
agtgacacttcagagagctggta

SEQ ID NO: 198445 - DNA, 16 bp, Homo sapiens
agtgacagacaggctc

SEQ ID NO: 198446 - DNA, 15 bp, Homo sapiens
agtgacagagttcac

SEQ ID NO: 198447 - DNA, 21 bp, Homo sapiens
agtgacatcggttcaggagga

SEQ ID NO: 198448 - DNA, 19 bp, Homo sapiens
agtgaccataaaggcatgg

SEQ ID NO: 198449 - DNA, 17 bp, Homo sapiens
agtgacccggaggccac

SEQ ID NO: 198450 - DNA, 18 bp, Homo sapiens
agtgacccggaggccaca

SEQ ID NO: 198451 - DNA, 23 bp, Homo sapiens
agtgacccggaggccacatgagt

SEQ ID NO: 198452 - DNA, 16 bp, Homo sapiens
agtgacgtgagtgggg

SEQ ID NO: 198453 - DNA, 13 bp, Homo sapiens
agtgactccagga

SEQ ID NO: 198454 - DNA, 17 bp, Homo sapiens
agtgactggcaggtgca

SEQ ID NO: 198455 - DNA, 15 bp, Homo sapiens
agtgacttcctggtg

SEQ ID NO: 198456 - DNA, 13 bp, Homo sapiens
agtgacttctttt

SEQ ID NO: 198457 - DNA, 21 bp, Homo sapiens
agtgacttgaatgtacaaaga

SEQ ID NO: 198458 - DNA, 23 bp, Homo sapiens
agtgacttgaatgtacaaagata

SEQ ID NO: 198459 - DNA, 16 bp, Homo sapiens
agtgacttgtgtccca

SEQ ID NO: 198460 - DNA, 18 bp, Homo sapiens
agtgacttgtgtcccatg

SEQ ID NO: 198461 - DNA, 19 bp, Homo sapiens
agtgagaatctggctcctg

SEQ ID NO: 198462 - DNA, 13 bp, Homo sapiens
agtgagagagaca

SEQ ID NO: 198463 - DNA, 12 bp, Homo sapiens
agtgagagagag

SEQ ID NO: 198464 - DNA, 14 bp, Homo sapiens
agtgagagagagtg

SEQ ID NO: 198465 - DNA, 17 bp, Homo sapiens
agtgagagcacaaagat

SEQ ID NO: 198466 - DNA, 14 bp, Homo sapiens
agtgagatattttt

SEQ ID NO: 198467 - DNA, 19 bp, Homo sapiens
agtgagatttgtatttata

SEQ ID NO: 198468 - DNA, 18 bp, Homo sapiens
agtgagcaaacctgcccc

SEQ ID NO: 198469 - DNA, 13 bp, Homo sapiens
agtgagcagtaga

SEQ ID NO: 198470 - DNA, 12 bp, Homo sapiens
agtgagcatgct

SEQ ID NO: 198471 - DNA, 13 bp, Homo sapiens
agtgagcccctcc

SEQ ID NO: 198472 - DNA, 18 bp, Homo sapiens
agtgagccgagatagcac

SEQ ID NO: 198473 - DNA, 20 bp, Homo sapiens
agtgagctcaggagagagct

SEQ ID NO: 198474 - DNA, 15 bp, Homo sapiens
agtgaggcaagagaa

SEQ ID NO: 198475 - DNA, 15 bp, Homo sapiens
agtgaggcttccagg

SEQ ID NO: 198476 - DNA, 16 bp, Homo sapiens
agtgagggctttttaa

SEQ ID NO: 198477 - DNA, 18 bp, Homo sapiens
agtgagtaattctttgat

SEQ ID NO: 198478 - DNA, 16 bp, Homo sapiens
agtgagtggcatgtgg

SEQ ID NO: 198479 - DNA, 18 bp, Homo sapiens
agtgagtggcatgtgggt

SEQ ID NO: 198480 - DNA, 17 bp, Homo sapiens
agtgagtggtgttggca

SEQ ID NO: 198481 - DNA, 21 bp, Homo sapiens
agtgagtgtggctcccctcta

SEQ ID NO: 198482 - DNA, 16 bp, Homo sapiens
agtgatacactgtatc

SEQ ID NO: 198483 - DNA, 23 bp, Homo sapiens
agtgatatggcttgtagggtgag

SEQ ID NO: 198484 - DNA, 17 bp, Homo sapiens
agtgatcaataaaatgt

SEQ ID NO: 198485 - DNA, 13 bp, Homo sapiens
agtgatctccata

SEQ ID NO: 198486 - DNA, 14 bp, Homo sapiens
agtgatctccatat

SEQ ID NO: 198487 - DNA, 12 bp, Homo sapiens
agtgatgaaatt

SEQ ID NO: 198488 - DNA, 22 bp, Homo sapiens
agtgatgaaattataagtagat

SEQ ID NO: 198489 - DNA, 12 bp, Homo sapiens
agtgatgatttg

SEQ ID NO: 198490 - DNA, 21 bp, Homo sapiens
agtgatgctgtgctatgaatt

SEQ ID NO: 198491 - DNA, 12 bp, Homo sapiens
agtgatgggagt

SEQ ID NO: 198492 - DNA, 20 bp, Homo sapiens
agtgatgtgatttatgcatt

SEQ ID NO: 198493 - DNA, 19 bp, Homo sapiens
agtgattctctcttctctc

SEQ ID NO: 198494 - DNA, 16 bp, Homo sapiens
agtgattgaaccagct

SEQ ID NO: 198495 - DNA, 19 bp, Homo sapiens
agtgatttgctatcatata

SEQ ID NO: 198496 - DNA, 23 bp, Homo sapiens
agtgatttgggggtgcaatgata

SEQ ID NO: 198497 - DNA, 20 bp, Homo sapiens
agtgcaacagcactggctct

SEQ ID NO: 198498 - DNA, 16 bp, Homo sapiens
agtgcaaccacacacc

SEQ ID NO: 198499 - DNA, 18 bp, Homo sapiens
agtgcaaccacacacctc

SEQ ID NO: 198500 - DNA, 16 bp, Homo sapiens
agtgcaatgacacagt

SEQ ID NO: 198501 - DNA, 22 bp, Homo sapiens
agtgcaatggtataaatttcaa

SEQ ID NO: 198502 - DNA, 22 bp, Homo sapiens
caggagtgggtgggacacagag

SEQ ID NO: 198503 - DNA, 20 bp, Homo sapiens
caggagttgatacaccacct

SEQ ID NO: 198504 - DNA, 21 bp, Homo sapiens
caggagtttgagacaagccct

SEQ ID NO: 198505 - DNA, 16 bp, Homo sapiens
caggataaggagactg

SEQ ID NO: 198506 - DNA, 16 bp, Homo sapiens
caggatccgctgccac

SEQ ID NO: 198507 - DNA, 18 bp, Homo sapiens
caggatccgctgccacca

SEQ ID NO: 198508 - DNA, 13 bp, Homo sapiens
caggatcctcctg

SEQ ID NO: 198509 - DNA, 15 bp, Homo sapiens
caggatcctcctgga

SEQ ID NO: 198510 - DNA, 17 bp, Homo sapiens
caggatcctcctggagc

SEQ ID NO: 198511 - DNA, 18 bp, Homo sapiens
caggatcctcctggagca

SEQ ID NO: 198512 - DNA, 19 bp, Homo sapiens
caggatccttgcctccaac

SEQ ID NO: 198513 - DNA, 18 bp, Homo sapiens
caggatctcttagcattt

SEQ ID NO: 198514 - DNA, 23 bp, Homo sapiens
caggatctcttagcattttaatt

SEQ ID NO: 198515 - DNA, 15 bp, Homo sapiens
caggatgaaagttcc

SEQ ID NO: 198516 - DNA, 23 bp, Homo sapiens
agtgcagcccgtgtggccccttc

SEQ ID NO: 198517 - DNA, 15 bp, Homo sapiens
agtgcagctgatttt

SEQ ID NO: 198518 - DNA, 17 bp, Homo sapiens
agtgcagctgattttaa

SEQ ID NO: 198519 - DNA, 11 bp, Homo sapiens
agtgcaggctg

SEQ ID NO: 198520 - DNA, 13 bp, Homo sapiens
agtgcaggctggc

SEQ ID NO: 198521 - DNA, 17 bp, Homo sapiens
agtgcagtcaccctgtg

SEQ ID NO: 198522 - DNA, 20 bp, Homo sapiens
agtgcagtcaccctgtggca

SEQ ID NO: 198523 - DNA, 23 bp, Homo sapiens
agtgcagtggtgcgatcatggct

SEQ ID NO: 198524 - DNA, 20 bp, Homo sapiens
agtgcatggccacagccacc

SEQ ID NO: 198525 - DNA, 21 bp, Homo sapiens
agtgcatggccacagccacct

SEQ ID NO: 198526 - DNA, 22 bp, Homo sapiens
agtgcatgtgaagcatgctttg

SEQ ID NO: 198527 - DNA, 15 bp, Homo sapiens
agtgcatttctgaat

SEQ ID NO: 198528 - DNA, 21 bp, Homo sapiens
agtgcatttttatctgtgagt

SEQ ID NO: 198529 - DNA, 23 bp, Homo sapiens
agtgcatttttatctgtgagttc

SEQ ID NO: 198530 - DNA, 14 bp, Homo sapiens
agtgccaaaaacaa

SEQ ID NO: 198531 - DNA, 15 bp, Homo sapiens
agtgccacctatgcc

SEQ ID NO: 198532 - DNA, 22 bp, Homo sapiens
agtgccactgcccgagctggtg

SEQ ID NO: 198533 - DNA, 18 bp, Homo sapiens
agtgccacttgacattcc

SEQ ID NO: 198534 - DNA, 21 bp, Homo sapiens
agtgccacttgacattccttg

SEQ ID NO: 198535 - DNA, 10 bp, Homo sapiens
agtgccaggc

SEQ ID NO: 198536 - DNA, 16 bp, Homo sapiens
agtgccaggtggctca

SEQ ID NO: 198537 - DNA, 17 bp, Homo sapiens
agtgcccaaagtgggga

SEQ ID NO: 198538 - DNA, 18 bp, Homo sapiens
agtgcccagtgatggcat

SEQ ID NO: 198539 - DNA, 22 bp, Homo sapiens
agtgcccagtgatggcattact

SEQ ID NO: 198540 - DNA, 15 bp, Homo sapiens
agtgccccacctgcc

SEQ ID NO: 198541 - DNA, 17 bp, Homo sapiens
agtgccccacctgccac

SEQ ID NO: 198542 - DNA, 17 bp, Homo sapiens
agtgcccctcccatggc

SEQ ID NO: 198543 - DNA, 13 bp, Homo sapiens
agtgcccctgcag

SEQ ID NO: 198544 - DNA, 22 bp, Homo sapiens
agtgcccctgctgcctccccaa

SEQ ID NO: 198545 - DNA, 23 bp, Homo sapiens
agtgcccttaaaataatgattta

SEQ ID NO: 198546 - DNA, 18 bp, Homo sapiens
agtgcctcagcgctgccc

SEQ ID NO: 198547 - DNA, 14 bp, Homo sapiens
agtgcctcctggcc

SEQ ID NO: 198548 - DNA, 17 bp, Homo sapiens
agtgcctcgaggcaccg

SEQ ID NO: 198549 - DNA, 12 bp, Homo sapiens
agtgcctctggt

SEQ ID NO: 198550 - DNA, 14 bp, Homo sapiens
agtgcctctggtct

SEQ ID NO: 198551 - DNA, 14 bp, Homo sapiens
agtgcctgcagcat

SEQ ID NO: 198552 - DNA, 12 bp, Homo sapiens
agtgcctgccac

SEQ ID NO: 198553 - DNA, 23 bp, Homo sapiens
agtgcctgccactctctgggact

SEQ ID NO: 198554 - DNA, 22 bp, Homo sapiens
agtgcctggatcccctctgtct

SEQ ID NO: 198555 - DNA, 17 bp, Homo sapiens
agtgcctggcaaggcct

SEQ ID NO: 198556 - DNA, 18 bp, Homo sapiens
agtgcctgggaatgtatt

SEQ ID NO: 198557 - DNA, 22 bp, Homo sapiens
agtgcctgggaatgtattattc

SEQ ID NO: 198558 - DNA, 13 bp, Homo sapiens
agtgcctgtgatc

SEQ ID NO: 198559 - DNA, 15 bp, Homo sapiens
agtgccttacacaat

SEQ ID NO: 198560 - DNA, 24 bp, Homo sapiens
agtgccttccgtgggtcatcccag

SEQ ID NO: 198561 - DNA, 19 bp, Homo sapiens
agtgccttgagctgcctgc

SEQ ID NO: 198562 - DNA, 21 bp, Homo sapiens
agtgccttgagctgcctgctc

SEQ ID NO: 198563 - DNA, 22 bp, Homo sapiens
agtgccttggggaatttcctct

SEQ ID NO: 198564 - DNA, 23 bp, Homo sapiens
agtgcctttttccttatttcaag

SEQ ID NO: 198565 - DNA, 18 bp, Homo sapiens
agtgctacttgagagtgg

SEQ ID NO: 198566 - DNA, 23 bp, Homo sapiens
agtgctagtgagctgggcatggt

SEQ ID NO: 198567 - DNA, 20 bp, Homo sapiens
agtgctctttgtggcagtgg

SEQ ID NO: 198568 - DNA, 15 bp, Homo sapiens
agtgctgaagcttat

SEQ ID NO: 198569 - DNA, 17 bp, Homo sapiens
agtgctgaccccaggaa

SEQ ID NO: 198570 - DNA, 12 bp, Homo sapiens
agtgctgccatg

SEQ ID NO: 198571 - DNA, 18 bp, Homo sapiens
agtgctgccatgccactg

SEQ ID NO: 198572 - DNA, 23 bp, Homo sapiens
agtgctgccatgccactgccagg

SEQ ID NO: 198573 - DNA, 19 bp, Homo sapiens
agtgctgcttctcttggga

SEQ ID NO: 198574 - DNA, 15 bp, Homo sapiens
agtgctgctttgcca

SEQ ID NO: 198575 - DNA, 13 bp, Homo sapiens
agtgctggctcca

SEQ ID NO: 198576 - DNA, 19 bp, Homo sapiens
agtgctggctccacgccct

SEQ ID NO: 198577 - DNA, 21 bp, Homo sapiens
agtgctggctccacgccctgg

SEQ ID NO: 198578 - DNA, 17 bp, Homo sapiens
agtgctgggattacagg

SEQ ID NO: 198579 - DNA, 20 bp, Homo sapiens
agtgctgggattacaggtgt

SEQ ID NO: 198580 - DNA, 13 bp, Homo sapiens
agtgctgggccca

SEQ ID NO: 198581 - DNA, 16 bp, Homo sapiens
agtgctgggcccagcc

SEQ ID NO: 198582 - DNA, 17 bp, Homo sapiens
agtgctgggcccagccg

SEQ ID NO: 198583 - DNA, 22 bp, Homo sapiens
agtgctgttttgtcctttgaga

SEQ ID NO: 198584 - DNA, 23 bp, Homo sapiens
agtgctttacatgctgtgctctt

SEQ ID NO: 198585 - DNA, 22 bp, Homo sapiens
agtgcttttaaactggagaggc

SEQ ID NO: 198586 - DNA, 23 bp, Homo sapiens
agtggaaaaaagagaaaaaccaa

SEQ ID NO: 198587 - DNA, 16 bp, Homo sapiens
agtggaacagcgggag

SEQ ID NO: 198588 - DNA, 21 bp, Homo sapiens
agtggaacagtcacccttctg

SEQ ID NO: 198589 - DNA, 15 bp, Homo sapiens
agtggaagagcagcc

SEQ ID NO: 198590 - DNA, 16 bp, Homo sapiens
agtggaagagcagcct

SEQ ID NO: 198591 - DNA, 20 bp, Homo sapiens
agtggaagagcagcctgatg

SEQ ID NO: 198592 - DNA, 24 bp, Homo sapiens
agtggaagagcagcctgatggcca

SEQ ID NO: 198593 - DNA, 13 bp, Homo sapiens
agtggaagccact

SEQ ID NO: 198594 - DNA, 17 bp, Homo sapiens
agtggaaggacactctt

SEQ ID NO: 198595 - DNA, 17 bp, Homo sapiens
agtggaaggtctattgg

SEQ ID NO: 198596 - DNA, 11 bp, Homo sapiens
agtggaatcat

SEQ ID NO: 198597 - DNA, 15 bp, Homo sapiens
agtggaatgcaggga

SEQ ID NO: 198598 - DNA, 19 bp, Homo sapiens
agtggaatgcagggaagag

SEQ ID NO: 198599 - DNA, 16 bp, Homo sapiens
agtggactgtgtccct

SEQ ID NO: 198600 - DNA, 12 bp, Homo sapiens
agtggagaaatg

SEQ ID NO: 198601 - DNA, 16 bp, Homo sapiens
agtggagaattatata

SEQ ID NO: 198602 - DNA, 10 bp, Homo sapiens
agtggaggaa

SEQ ID NO: 198603 - DNA, 18 bp, Homo sapiens
agtggaggaaatgttgga

SEQ ID NO: 198604 - DNA, 13 bp, Homo sapiens
agtggaggcattg

SEQ ID NO: 198605 - DNA, 21 bp, Homo sapiens
agtggatctggagtctgaagg

SEQ ID NO: 198606 - DNA, 19 bp, Homo sapiens
agtggattgctcatctcag

SEQ ID NO: 198607 - DNA, 15 bp, Homo sapiens
agtggcagcaaagga

SEQ ID NO: 198608 - DNA, 17 bp, Homo sapiens
agtggcagcaaaggaag

SEQ ID NO: 198609 - DNA, 12 bp, Homo sapiens
agtggcagccat

SEQ ID NO: 198610 - DNA, 15 bp, Homo sapiens
agtggcagccatgcc

SEQ ID NO: 198611 - DNA, 16 bp, Homo sapiens
agtggcagccatgcct

SEQ ID NO: 198612 - DNA, 22 bp, Homo sapiens
agtggcagccatgcctcatgcc

SEQ ID NO: 198613 - DNA, 11 bp, Homo sapiens
agtggccagac

SEQ ID NO: 198614 - DNA, 23 bp, Homo sapiens
agtggccagaccagagctctgga

SEQ ID NO: 198615 - DNA, 20 bp, Homo sapiens
agtggccccatccagcatgt

SEQ ID NO: 198616 - DNA, 23 bp, Homo sapiens
agtggcccctcgtgacctacagg

SEQ ID NO: 198617 - DNA, 21 bp, Homo sapiens
agtggcctcaaccctccctca

SEQ ID NO: 198618 - DNA, 15 bp, Homo sapiens
agtggcctgagaaga

SEQ ID NO: 198619 - DNA, 16 bp, Homo sapiens
agtggcctgagaagag

SEQ ID NO: 198620 - DNA, 17 bp, Homo sapiens
agtggcctgagaagagt

SEQ ID NO: 198621 - DNA, 17 bp, Homo sapiens
agtggcctgcaggggcc

SEQ ID NO: 198622 - DNA, 23 bp, Homo sapiens
agtggcctgctaaggctcctcct

SEQ ID NO: 198623 - DNA, 19 bp, Homo sapiens
agtggcctggccaggagct

SEQ ID NO: 198624 - DNA, 13 bp, Homo sapiens
agtggcctggctc

SEQ ID NO: 198625 - DNA, 13 bp, Homo sapiens
agtggctcctccc

SEQ ID NO: 198626 - DNA, 12 bp, Homo sapiens
agtggctgggtg

SEQ ID NO: 198627 - DNA, 18 bp, Homo sapiens
agtggctggtccagggct

SEQ ID NO: 198628 - DNA, 19 bp, Homo sapiens
agtggcttactacatgtgg

SEQ ID NO: 198629 - DNA, 17 bp, Homo sapiens
agtggcttcagcccctg

SEQ ID NO: 198630 - DNA, 23 bp, Homo sapiens
agtggcttggagcagaggtgggg

SEQ ID NO: 198631 - DNA, 19 bp, Homo sapiens
caggcctgtatgaggcttt

SEQ ID NO: 198632 - DNA, 14 bp, Homo sapiens
caggcctgttgctt

SEQ ID NO: 198633 - DNA, 13 bp, Homo sapiens
caggcctttccta

SEQ ID NO: 198634 - DNA, 16 bp, Homo sapiens
caggcgatccacctgt

SEQ ID NO: 198635 - DNA, 13 bp, Homo sapiens
caggcgcagccct

SEQ ID NO: 198636 - DNA, 15 bp, Homo sapiens
caggcgcctgccatc

SEQ ID NO: 198637 - DNA, 17 bp, Homo sapiens
caggcgcgcaccgccca

SEQ ID NO: 198638 - DNA, 22 bp, Homo sapiens
caggcgcgcaccgcccaacccc

SEQ ID NO: 198639 - DNA, 19 bp, Homo sapiens
caggcggaggggcttggag

SEQ ID NO: 198640 - DNA, 19 bp, Homo sapiens
caggcgggagatggacccc

SEQ ID NO: 198641 - DNA, 16 bp, Homo sapiens
caggcggtatccagag

SEQ ID NO: 198642 - DNA, 20 bp, Homo sapiens
caggcggtatccagaggtga

SEQ ID NO: 198643 - DNA, 23 bp, Homo sapiens
caggcggtccccatccccaccag

SEQ ID NO: 198644 - DNA, 21 bp, Homo sapiens
caggcgtagggccagggctct

SEQ ID NO: 198645 - DNA, 22 bp, Homo sapiens
caggcgtagggccagggctctg

SEQ ID NO: 198646 - DNA, 15 bp, Homo sapiens
caggcgttggtgcca

SEQ ID NO: 198647 - DNA, 18 bp, Homo sapiens
caggcgttggtgccactt

SEQ ID NO: 198648 - DNA, 19 bp, Homo sapiens
caggcgttggtgccacttc

SEQ ID NO: 198649 - DNA, 14 bp, Homo sapiens
caggctcccctggt

SEQ ID NO: 198650 - DNA, 15 bp, Homo sapiens
caggctcccctggtc

SEQ ID NO: 198651 - DNA, 16 bp, Homo sapiens
caggctccgggctttc

SEQ ID NO: 198652 - DNA, 13 bp, Homo sapiens
caggctctccctc

SEQ ID NO: 198653 - DNA, 14 bp, Homo sapiens
caggctctccctct

SEQ ID NO: 198654 - DNA, 16 bp, Homo sapiens
caggctctgaatctct

SEQ ID NO: 198655 - DNA, 12 bp, Homo sapiens
caggctctgctg

SEQ ID NO: 198656 - DNA, 13 bp, Homo sapiens
caggctctgctga

SEQ ID NO: 198657 - DNA, 18 bp, Homo sapiens
caggctctgctgacttct

SEQ ID NO: 198658 - DNA, 14 bp, Homo sapiens
caggctctgggctc

SEQ ID NO: 198659 - DNA, 19 bp, Homo sapiens
caggctctgggctcagggc

SEQ ID NO: 198660 - DNA, 22 bp, Homo sapiens
caggctcttagcagcttccaga

SEQ ID NO: 198661 - DNA, 21 bp, Homo sapiens
caggctcttcctggacctgag

SEQ ID NO: 198662 - DNA, 23 bp, Homo sapiens
caggctcttcctggacctgagtc

SEQ ID NO: 198663 - DNA, 14 bp, Homo sapiens
caggctcttctcct

SEQ ID NO: 198664 - DNA, 18 bp, Homo sapiens
caggctcttctcctttca

SEQ ID NO: 198665 - DNA, 15 bp, Homo sapiens
caggctgactggggg

SEQ ID NO: 198666 - DNA, 21 bp, Homo sapiens
caggctgactgggggcctctg

SEQ ID NO: 198667 - DNA, 15 bp, Homo sapiens
caggctgcagcaggc

SEQ ID NO: 198668 - DNA, 11 bp, Homo sapiens
caggctgcccc

SEQ ID NO: 198669 - DNA, 13 bp, Homo sapiens
caggctgccccac

SEQ ID NO: 198670 - DNA, 14 bp, Homo sapiens
caggctgcgcctgc

SEQ ID NO: 198671 - DNA, 15 bp, Homo sapiens
caggctgcgcctgcc

SEQ ID NO: 198672 - DNA, 19 bp, Homo sapiens
caggctgcgcctgcccgcc

SEQ ID NO: 198673 - DNA, 12 bp, Homo sapiens
caggctgctgga

SEQ ID NO: 198674 - DNA, 15 bp, Homo sapiens
caggctgctggagga

SEQ ID NO: 198675 - DNA, 12 bp, Homo sapiens
caggctgcttgg

SEQ ID NO: 198676 - DNA, 21 bp, Homo sapiens
caggctggaggtaaggccttt

SEQ ID NO: 198677 - DNA, 16 bp, Homo sapiens
caggctggagtgcagt

SEQ ID NO: 198678 - DNA, 15 bp, Homo sapiens
caggctggcagctct

SEQ ID NO: 198679 - DNA, 16 bp, Homo sapiens
caggctggcagctctc

SEQ ID NO: 198680 - DNA, 18 bp, Homo sapiens
caggctggcagctctcca

SEQ ID NO: 198681 - DNA, 16 bp, Homo sapiens
caggctggctgttggc

SEQ ID NO: 198682 - DNA, 16 bp, Homo sapiens
caggctgggcacggct

SEQ ID NO: 198683 - DNA, 20 bp, Homo sapiens
caggctggttcttgggctag

SEQ ID NO: 198684 - DNA, 15 bp, Homo sapiens
caggctgtaagcatt

SEQ ID NO: 198685 - DNA, 22 bp, Homo sapiens
caggctgtaagcattctgagct

SEQ ID NO: 198686 - DNA, 22 bp, Homo sapiens
caggctgtgcgctgacaaccac

SEQ ID NO: 198687 - DNA, 16 bp, Homo sapiens
caggctgtgggcctca

SEQ ID NO: 198688 - DNA, 12 bp, Homo sapiens
caggctgtgtgt

SEQ ID NO: 198689 - DNA, 21 bp, Homo sapiens
caggcttatgaatatatttaa

SEQ ID NO: 198690 - DNA, 18 bp, Homo sapiens
caggcttggaatgaattc

SEQ ID NO: 198691 - DNA, 23 bp, Homo sapiens
caggcttgggctccattcccatc

SEQ ID NO: 198692 - DNA, 16 bp, Homo sapiens
cagggaaagctccacg

SEQ ID NO: 198693 - DNA, 17 bp, Homo sapiens
cagggaaagctccacgg

SEQ ID NO: 198694 - DNA, 14 bp, Homo sapiens
cagggaactgcttg

SEQ ID NO: 198695 - DNA, 16 bp, Homo sapiens
cagggaagagaaagtg

SEQ ID NO: 198696 - DNA, 23 bp, Homo sapiens
cagggaaggacttggagagaatc

SEQ ID NO: 198697 - DNA, 23 bp, Homo sapiens
cagggaatagtgggatcaaagct

SEQ ID NO: 198698 - DNA, 15 bp, Homo sapiens
cagggaatccagctc

SEQ ID NO: 198699 - DNA, 23 bp, Homo sapiens
cagggaattttcattggatgcag

SEQ ID NO: 198700 - DNA, 16 bp, Homo sapiens
cagggacacgggcagc

SEQ ID NO: 198701 - DNA, 21 bp, Homo sapiens
cagggacacgggcagcctggc

SEQ ID NO: 198702 - DNA, 20 bp, Homo sapiens
cagggacactacaaacatgg

SEQ ID NO: 198703 - DNA, 20 bp, Homo sapiens
cagggacagcagcctccctg

SEQ ID NO: 198704 - DNA, 15 bp, Homo sapiens
cagggaccaaggacc

SEQ ID NO: 198705 - DNA, 18 bp, Homo sapiens
cagggaccaaggacccct

SEQ ID NO: 198706 - DNA, 19 bp, Homo sapiens
cagggactgtacctgtagg

SEQ ID NO: 198707 - DNA, 22 bp, Homo sapiens
cagggactgtacctgtaggaaa

SEQ ID NO: 198708 - DNA, 21 bp, Homo sapiens
cagggagacaggcagggaggg

SEQ ID NO: 198709 - DNA, 19 bp, Homo sapiens
cagggagaccaggcttccc

SEQ ID NO: 198710 - DNA, 14 bp, Homo sapiens
cagggagaccctgg

SEQ ID NO: 198711 - DNA, 16 bp, Homo sapiens
cagggagaccctggga

SEQ ID NO: 198712 - DNA, 17 bp, Homo sapiens
cagggagaggccatgat

SEQ ID NO: 198713 - DNA, 18 bp, Homo sapiens
cagggagagttggggaag

SEQ ID NO: 198714 - DNA, 20 bp, Homo sapiens
cagggagcaactctccactc

SEQ ID NO: 198715 - DNA, 20 bp, Homo sapiens
cagggagctatgagagatgt

SEQ ID NO: 198716 - DNA, 23 bp, Homo sapiens
cagggaggaattggggtttctgg

SEQ ID NO: 198717 - DNA, 22 bp, Homo sapiens
cagggaggagaggggaagggcc

SEQ ID NO: 198718 - DNA, 23 bp, Homo sapiens
cagggaggagaggggaagggcca

SEQ ID NO: 198719 - DNA, 21 bp, Homo sapiens
cagggagggaaacccggggaa

SEQ ID NO: 198720 - DNA, 12 bp, Homo sapiens
cagggagggctt

SEQ ID NO: 198721 - DNA, 20 bp, Homo sapiens
cagggaggggctgagtctgg

SEQ ID NO: 198722 - DNA, 19 bp, Homo sapiens
cagggaggtcaggccctgg

SEQ ID NO: 198723 - DNA, 23 bp, Homo sapiens
cagggaggtcaggccctggaact

SEQ ID NO: 198724 - DNA, 17 bp, Homo sapiens
cagggagtgtctgcagt

SEQ ID NO: 198725 - DNA, 22 bp, Homo sapiens
cagggatctgtttgaacactta

SEQ ID NO: 198726 - DNA, 19 bp, Homo sapiens
cagggatgctatctcgcta

SEQ ID NO: 198727 - DNA, 17 bp, Homo sapiens
cagggatggggccacag

SEQ ID NO: 198728 - DNA, 19 bp, Homo sapiens
cagggatggggccacagcc

SEQ ID NO: 198729 - DNA, 18 bp, Homo sapiens
cagggattaacctctgca

SEQ ID NO: 198730 - DNA, 19 bp, Homo sapiens
cagggattaacctctgcac

SEQ ID NO: 198731 - DNA, 21 bp, Homo sapiens
cagggcaccaagcccacaggt

SEQ ID NO: 198732 - DNA, 13 bp, Homo sapiens
cagggcagcctgt

SEQ ID NO: 198733 - DNA, 15 bp, Homo sapiens
cagggcagcctgtgg

SEQ ID NO: 198734 - DNA, 20 bp, Homo sapiens
cagggcagcctgtgggagaa

SEQ ID NO: 198735 - DNA, 22 bp, Homo sapiens
cagggcagggtgggcagcctat

SEQ ID NO: 198736 - DNA, 16 bp, Homo sapiens
cagggcatctccagga

SEQ ID NO: 198737 - DNA, 18 bp, Homo sapiens
cagggcatctccaggaag

SEQ ID NO: 198738 - DNA, 14 bp, Homo sapiens
cagggcatctcctg

SEQ ID NO: 198739 - DNA, 19 bp, Homo sapiens
cagggcatgcattttgcag

SEQ ID NO: 198740 - DNA, 11 bp, Homo sapiens
cagggccagaa

SEQ ID NO: 198741 - DNA, 14 bp, Homo sapiens
cagggccagaagga

SEQ ID NO: 198742 - DNA, 20 bp, Homo sapiens
cagggccagaaggagggcag

SEQ ID NO: 198743 - DNA, 13 bp, Homo sapiens
cagggccagggtt

SEQ ID NO: 198744 - DNA, 17 bp, Homo sapiens
cagggccatgcctgccc

SEQ ID NO: 198745 - DNA, 16 bp, Homo sapiens
cagggcccacctcctc

SEQ ID NO: 198746 - DNA, 20 bp, Homo sapiens
cagggcccacctcctccagc

SEQ ID NO: 198747 - DNA, 19 bp, Homo sapiens
cagggcccaggcctggagc

SEQ ID NO: 198748 - DNA, 21 bp, Homo sapiens
cagggccccccaaatcccagg

SEQ ID NO: 198749 - DNA, 22 bp, Homo sapiens
cagggccccccaaatcccaggg

SEQ ID NO: 198750 - DNA, 11 bp, Homo sapiens
cagggcccctc

SEQ ID NO: 198751 - DNA, 18 bp, Homo sapiens
cagggcccctcaccctgc

SEQ ID NO: 198752 - DNA, 22 bp, Homo sapiens
cagggcccctccctctgcccca

SEQ ID NO: 198753 - DNA, 22 bp, Homo sapiens
cagggcccgacctggggctgag

SEQ ID NO: 198754 - DNA, 19 bp, Homo sapiens
cagggcccgagcgcgtgcc

SEQ ID NO: 198755 - DNA, 12 bp, Homo sapiens
cagggccctcag

SEQ ID NO: 198756 - DNA, 17 bp, Homo sapiens
cagggccctcagaggaa

SEQ ID NO: 198757 - DNA, 17 bp, Homo sapiens
cagggccctgctcaggc

SEQ ID NO: 198758 - DNA, 23 bp, Homo sapiens
cagggccctggggtctctgagca

SEQ ID NO: 198759 - DNA, 24 bp, Homo sapiens
cagggccctggggtctctgagcag

SEQ ID NO: 198760 - DNA, 20 bp, Homo sapiens
caggtgccaccaataaaaat

SEQ ID NO: 198761 - DNA, 21 bp, Homo sapiens
caggtgccactccctgagctt

SEQ ID NO: 198762 - DNA, 15 bp, Homo sapiens
caggtgccccgtggt

SEQ ID NO: 198763 - DNA, 13 bp, Homo sapiens
caggtgctgcctt

SEQ ID NO: 198764 - DNA, 20 bp, Homo sapiens
caggtgctggaggcagactc

SEQ ID NO: 198765 - DNA, 17 bp, Homo sapiens
caggtggccagggctcc

SEQ ID NO: 198766 - DNA, 16 bp, Homo sapiens
caggtggcctaaggct

SEQ ID NO: 198767 - DNA, 17 bp, Homo sapiens
caggtggcctaaggctg

SEQ ID NO: 198768 - DNA, 12 bp, Homo sapiens
caggtggggagt

SEQ ID NO: 198769 - DNA, 20 bp, Homo sapiens
caggtggggagtccagggct

SEQ ID NO: 198770 - DNA, 14 bp, Homo sapiens
caggtgtccccagc

SEQ ID NO: 198771 - DNA, 15 bp, Homo sapiens
caggtgtccccagcc

SEQ ID NO: 198772 - DNA, 21 bp, Homo sapiens
caggtgtccccagcccactgg

SEQ ID NO: 198773 - DNA, 16 bp, Homo sapiens
caggtgtggtggctca

SEQ ID NO: 198774 - DNA, 17 bp, Homo sapiens
caggtgtggtggctcat

SEQ ID NO: 198775 - DNA, 19 bp, Homo sapiens
caggtgttaaaaaccatta

SEQ ID NO: 198776 - DNA, 16 bp, Homo sapiens
caggtgttgggacctg

SEQ ID NO: 198777 - DNA, 18 bp, Homo sapiens
caggtgttgggacctgct

SEQ ID NO: 198778 - DNA, 16 bp, Homo sapiens
caggtgtttagttgca

SEQ ID NO: 198779 - DNA, 14 bp, Homo sapiens
caggttaccttggc

SEQ ID NO: 198780 - DNA, 19 bp, Homo sapiens
caggttatgtcagcagctc

SEQ ID NO: 198781 - DNA, 13 bp, Homo sapiens
caggttccagaac

SEQ ID NO: 198782 - DNA, 15 bp, Homo sapiens
caggttccatccacc

SEQ ID NO: 198783 - DNA, 18 bp, Homo sapiens
caggttccatccaccacc

SEQ ID NO: 198784 - DNA, 23 bp, Homo sapiens
caggttccatccaccaccttgcc

SEQ ID NO: 198785 - DNA, 18 bp, Homo sapiens
caggttcgtatagaaaaa

SEQ ID NO: 198786 - DNA, 22 bp, Homo sapiens
caggttcgtatagaaaaagcac

SEQ ID NO: 198787 - DNA, 23 bp, Homo sapiens
caggttctggttagctcagcccc

SEQ ID NO: 198788 - DNA, 13 bp, Homo sapiens
caggttgcagctg

SEQ ID NO: 198789 - DNA, 15 bp, Homo sapiens
caggttgcagctgct

SEQ ID NO: 198790 - DNA, 14 bp, Homo sapiens
caggttggaaaaga

SEQ ID NO: 198791 - DNA, 23 bp, Homo sapiens
agtgggccttcattaaatgtttg

SEQ ID NO: 198792 - DNA, 16 bp, Homo sapiens
agtgggctttccaggg

SEQ ID NO: 198793 - DNA, 18 bp, Homo sapiens
agtggggacgggggctgc

SEQ ID NO: 198794 - DNA, 21 bp, Homo sapiens
agtggggacgggggctgcttc

SEQ ID NO: 198795 - DNA, 19 bp, Homo sapiens
agtggggagacacctcaga

SEQ ID NO: 198796 - DNA, 23 bp, Homo sapiens
agtggggaggagactcaggccca

SEQ ID NO: 198797 - DNA, 17 bp, Homo sapiens
agtggggaggggcctgg

SEQ ID NO: 198798 - DNA, 19 bp, Homo sapiens
agtggggaggggcctggcc

SEQ ID NO: 198799 - DNA, 21 bp, Homo sapiens
agtggggcccatggccccagc

SEQ ID NO: 198800 - DNA, 23 bp, Homo sapiens
agtgggggagagcaggctggcag

SEQ ID NO: 198801 - DNA, 20 bp, Homo sapiens
agtggggtcccccctgagtg

SEQ ID NO: 198802 - DNA, 21 bp, Homo sapiens
agtggggtcccccctgagtgg

SEQ ID NO: 198803 - DNA, 17 bp, Homo sapiens
agtggggtcgtgaggca

SEQ ID NO: 198804 - DNA, 22 bp, Homo sapiens
agtgggtatttcttatttgaaa

SEQ ID NO: 198805 - DNA, 16 bp, Homo sapiens
agtgggtgggacacag

SEQ ID NO: 198806 - DNA, 22 bp, Homo sapiens
agtgggttttattgtccttcag

SEQ ID NO: 198807 - DNA, 22 bp, Homo sapiens
agtgggttttttagttgaattt

SEQ ID NO: 198808 - DNA, 14 bp, Homo sapiens
agtggtatgtctct

SEQ ID NO: 198809 - DNA, 15 bp, Homo sapiens
agtggtccacattct

SEQ ID NO: 198810 - DNA, 21 bp, Homo sapiens
agtggtggtgaacagaacaaa

SEQ ID NO: 198811 - DNA, 21 bp, Homo sapiens
agtggtgttggcagtgtttgt

SEQ ID NO: 198812 - DNA, 16 bp, Homo sapiens
agtgtaacagctgagg

SEQ ID NO: 198813 - DNA, 17 bp, Homo sapiens
agtgtaacccaagcatt

SEQ ID NO: 198814 - DNA, 19 bp, Homo sapiens
agtgtaattttaatggctg

SEQ ID NO: 198815 - DNA, 13 bp, Homo sapiens
agtgtacagaaga

SEQ ID NO: 198816 - DNA, 13 bp, Homo sapiens
agtgtactgcttt

SEQ ID NO: 198817 - DNA, 14 bp, Homo sapiens
agtgtactgctttc

SEQ ID NO: 198818 - DNA, 16 bp, Homo sapiens
agtgtactggatttaa

SEQ ID NO: 198819 - DNA, 17 bp, Homo sapiens
agtgtacttaactattc

SEQ ID NO: 198820 - DNA, 22 bp, Homo sapiens
agtgtagactggccatgcaagt

SEQ ID NO: 198821 - DNA, 16 bp, Homo sapiens
agtgtagccccaagaa

SEQ ID NO: 198822 - DNA, 19 bp, Homo sapiens
agtgtataccacctgtaca

SEQ ID NO: 198823 - DNA, 23 bp, Homo sapiens
agtgtatctcgaagtcttccatc

SEQ ID NO: 198824 - DNA, 16 bp, Homo sapiens
agtgtattttctgtgt

SEQ ID NO: 198825 - DNA, 15 bp, Homo sapiens
agtgtcaagttgtgc

SEQ ID NO: 198826 - DNA, 18 bp, Homo sapiens
agtgtcaagttgtgcttg

SEQ ID NO: 198827 - DNA, 20 bp, Homo sapiens
agtgtcacctttcttcttgt

SEQ ID NO: 198828 - DNA, 14 bp, Homo sapiens
agtgtcactgagct

SEQ ID NO: 198829 - DNA, 19 bp, Homo sapiens
agtgtcacttacctagatt

SEQ ID NO: 198830 - DNA, 22 bp, Homo sapiens
agtgtcacttttttcctgtcaa

SEQ ID NO: 198831 - DNA, 16 bp, Homo sapiens
agtgtcatcagaagat

SEQ ID NO: 198832 - DNA, 13 bp, Homo sapiens
agtgtcatttctt

SEQ ID NO: 198833 - DNA, 14 bp, Homo sapiens
agtgtcatttcttt

SEQ ID NO: 198834 - DNA, 17 bp, Homo sapiens
agtgtcatttcttttag

SEQ ID NO: 198835 - DNA, 21 bp, Homo sapiens
agtgtccagaagcggcctgtg

SEQ ID NO: 198836 - DNA, 13 bp, Homo sapiens
agtgtccccaggg

SEQ ID NO: 198837 - DNA, 15 bp, Homo sapiens
agtgtccccaggggc

SEQ ID NO: 198838 - DNA, 19 bp, Homo sapiens
agtgtccccaggggcacac

SEQ ID NO: 198839 - DNA, 23 bp, Homo sapiens
agtgtccccaggggcacacttcc

SEQ ID NO: 198840 - DNA, 14 bp, Homo sapiens
agtgtcctcatcta

SEQ ID NO: 198841 - DNA, 19 bp, Homo sapiens
agtgtcgccgtccctctgc

SEQ ID NO: 198842 - DNA, 16 bp, Homo sapiens
agtgtctaagttttgt

SEQ ID NO: 198843 - DNA, 16 bp, Homo sapiens
agtgtctacatgtgcc

SEQ ID NO: 198844 - DNA, 19 bp, Homo sapiens
agtgtctcagtccacctga

SEQ ID NO: 198845 - DNA, 17 bp, Homo sapiens
agtgtctgcagtcctgg

SEQ ID NO: 198846 - DNA, 15 bp, Homo sapiens
agtgtctgtgccatg

SEQ ID NO: 198847 - DNA, 16 bp, Homo sapiens
agtgtctgtgccatgg

SEQ ID NO: 198848 - DNA, 13 bp, Homo sapiens
agtgtctgtgtgc

SEQ ID NO: 198849 - DNA, 13 bp, Homo sapiens
agtgtgaagcctg

SEQ ID NO: 198850 - DNA, 14 bp, Homo sapiens
agtgtgaccaggca

SEQ ID NO: 198851 - DNA, 20 bp, Homo sapiens
agtgtgactgatctctcgtg

SEQ ID NO: 198852 - DNA, 13 bp, Homo sapiens
agtgtgagggcag

SEQ ID NO: 198853 - DNA, 15 bp, Homo sapiens
agtgtgagggcagca

SEQ ID NO: 198854 - DNA, 12 bp, Homo sapiens
agtgtgagtaag

SEQ ID NO: 198855 - DNA, 14 bp, Homo sapiens
agtgtgagtggcag

SEQ ID NO: 198856 - DNA, 17 bp, Homo sapiens
agtgtgagtggcagcca

SEQ ID NO: 198857 - DNA, 22 bp, Homo sapiens
agtgtgagtggcagccatgcct

SEQ ID NO: 198858 - DNA, 13 bp, Homo sapiens
agtgtgcaaagaa

SEQ ID NO: 198859 - DNA, 20 bp, Homo sapiens
agtgtgcctgctatccagcc

SEQ ID NO: 198860 - DNA, 19 bp, Homo sapiens
agtgtggaaaaaaaaagaa

SEQ ID NO: 198861 - DNA, 20 bp, Homo sapiens
agtgtggatgtaaattttat

SEQ ID NO: 198862 - DNA, 15 bp, Homo sapiens
agtgtggctggtgtc

SEQ ID NO: 198863 - DNA, 15 bp, Homo sapiens
agtgtggcttaaaca

SEQ ID NO: 198864 - DNA, 19 bp, Homo sapiens
agtgtggcttaaacatttt

SEQ ID NO: 198865 - DNA, 14 bp, Homo sapiens
agtgtgggaatgcg

SEQ ID NO: 198866 - DNA, 16 bp, Homo sapiens
agtgtgggactccagg

SEQ ID NO: 198867 - DNA, 15 bp, Homo sapiens
agtgtggtccctcca

SEQ ID NO: 198868 - DNA, 15 bp, Homo sapiens
agtgtgtattgttcc

SEQ ID NO: 198869 - DNA, 19 bp, Homo sapiens
agtgtgtattgttcccagt

SEQ ID NO: 198870 - DNA, 21 bp, Homo sapiens
agtgtgtattgttcccagtga

SEQ ID NO: 198871 - DNA, 14 bp, Homo sapiens
agtgtgtctcctgc

SEQ ID NO: 198872 - DNA, 20 bp, Homo sapiens
agtgtgtcttagtgtgtgca

SEQ ID NO: 198873 - DNA, 17 bp, Homo sapiens
agtgtgtgcaagtatgt

SEQ ID NO: 198874 - DNA, 18 bp, Homo sapiens
agtgtgtgcacatgtgtg

SEQ ID NO: 198875 - DNA, 19 bp, Homo sapiens
agtgtgtgcacatgtgtgc

SEQ ID NO: 198876 - DNA, 20 bp, Homo sapiens
agtgtgtgcacatgtgtgcg

SEQ ID NO: 198877 - DNA, 22 bp, Homo sapiens
agtgtgtgcacatgtgtgcgtg

SEQ ID NO: 198878 - DNA, 14 bp, Homo sapiens
agtgtgtgcatgtg

SEQ ID NO: 198879 - DNA, 17 bp, Homo sapiens
agtgtgtgcatgtgtgc

SEQ ID NO: 198880 - DNA, 13 bp, Homo sapiens
agtgtgttctgat

SEQ ID NO: 198881 - DNA, 20 bp, Homo sapiens
agtgtgttctgattagaaat

SEQ ID NO: 198882 - DNA, 15 bp, Homo sapiens
agtgtgttgttgctt

SEQ ID NO: 198883 - DNA, 22 bp, Homo sapiens
agtgtgttgttgctttaggctc

SEQ ID NO: 198884 - DNA, 14 bp, Homo sapiens
agtgtgtttgtgag

SEQ ID NO: 198885 - DNA, 15 bp, Homo sapiens
agtgtgtttgtgagt

SEQ ID NO: 198886 - DNA, 15 bp, Homo sapiens
agtgtgttttggtat

SEQ ID NO: 198887 - DNA, 14 bp, Homo sapiens
agtgttagtgggaa

SEQ ID NO: 198888 - DNA, 16 bp, Homo sapiens
agtgttagtgggaaga

SEQ ID NO: 198889 - DNA, 17 bp, Homo sapiens
agtgttcaagaaataaa

SEQ ID NO: 198890 - DNA, 20 bp, Homo sapiens
cagtcatgcgtccactttcc

SEQ ID NO: 198891 - DNA, 23 bp, Homo sapiens
cagtcattatgagaggcaatgat

SEQ ID NO: 198892 - DNA, 11 bp, Homo sapiens
cagtcatttaa

SEQ ID NO: 198893 - DNA, 17 bp, Homo sapiens
cagtccaaatgtcctcc

SEQ ID NO: 198894 - DNA, 14 bp, Homo sapiens
cagtccaataaatt

SEQ ID NO: 198895 - DNA, 22 bp, Homo sapiens
cagtccacccccattgtgaatg

SEQ ID NO: 198896 - DNA, 15 bp, Homo sapiens
cagtccacctgagct

SEQ ID NO: 198897 - DNA, 22 bp, Homo sapiens
cagtccactggggagtgctgga

SEQ ID NO: 198898 - DNA, 10 bp, Homo sapiens
cagtccagag

SEQ ID NO: 198899 - DNA, 13 bp, Homo sapiens
cagtccagagctt

SEQ ID NO: 198900 - DNA, 15 bp, Homo sapiens
cagtccagagctttt

SEQ ID NO: 198901 - DNA, 18 bp, Homo sapiens
cagtccagagcttttcag

SEQ ID NO: 198902 - DNA, 16 bp, Homo sapiens
cagtcccagcacattt

SEQ ID NO: 198903 - DNA, 17 bp, Homo sapiens
cagtccctccctcctgg

SEQ ID NO: 198904 - DNA, 21 bp, Homo sapiens
cagtccctccctcctggctca

SEQ ID NO: 198905 - DNA, 12 bp, Homo sapiens
cagtccctggag

SEQ ID NO: 198906 - DNA, 15 bp, Homo sapiens
cagtccctggagctg

SEQ ID NO: 198907 - DNA, 22 bp, Homo sapiens
cagtcctcacagcctctccctt

SEQ ID NO: 198908 - DNA, 20 bp, Homo sapiens
cagtcctccagaccaccagc

SEQ ID NO: 198909 - DNA, 22 bp, Homo sapiens
cagtcctccagaccaccagccg

SEQ ID NO: 198910 - DNA, 13 bp, Homo sapiens
cagtcctgcctgg

SEQ ID NO: 198911 - DNA, 21 bp, Homo sapiens
cagtcctgcctggccaggcag

SEQ ID NO: 198912 - DNA, 22 bp, Homo sapiens
cagtcctgctctctacccagcc

SEQ ID NO: 198913 - DNA, 21 bp, Homo sapiens
cagtcgcaggatccgctgcca

SEQ ID NO: 198914 - DNA, 22 bp, Homo sapiens
cagtcgcaggatccgctgccac

SEQ ID NO: 198915 - DNA, 15 bp, Homo sapiens
cagtcgccctctgtg

SEQ ID NO: 198916 - DNA, 18 bp, Homo sapiens
cagtcgccctctgtgcct

SEQ ID NO: 198917 - DNA, 23 bp, Homo sapiens
cagtcgccctctgtgcctaataa

SEQ ID NO: 198918 - DNA, 21 bp, Homo sapiens
cagtctacccacctcagcctc

SEQ ID NO: 198919 - DNA, 18 bp, Homo sapiens
cagtctacttctgtgtct

SEQ ID NO: 198920 - DNA, 19 bp, Homo sapiens
cagtctacttctgtgtctg

SEQ ID NO: 198921 - DNA, 14 bp, Homo sapiens
cagtctcaattttg

SEQ ID NO: 198922 - DNA, 13 bp, Homo sapiens
cagtctcacaata

SEQ ID NO: 198923 - DNA, 13 bp, Homo sapiens
cagtctcacccac

SEQ ID NO: 198924 - DNA, 17 bp, Homo sapiens
cagtctccaccaggaac

SEQ ID NO: 198925 - DNA, 13 bp, Homo sapiens
cagtctcccaggc

SEQ ID NO: 198926 - DNA, 18 bp, Homo sapiens
cagtctcccaggccccct

SEQ ID NO: 198927 - DNA, 15 bp, Homo sapiens
cagtctctccctggg

SEQ ID NO: 198928 - DNA, 14 bp, Homo sapiens
agttacagacaaag

SEQ ID NO: 198929 - DNA, 17 bp, Homo sapiens
agttacagacaaagcgt

SEQ ID NO: 198930 - DNA, 16 bp, Homo sapiens
agttacattaatgtta

SEQ ID NO: 198931 - DNA, 18 bp, Homo sapiens
agttacgttgcatccaca

SEQ ID NO: 198932 - DNA, 15 bp, Homo sapiens
agttactatcctggc

SEQ ID NO: 198933 - DNA, 19 bp, Homo sapiens
agttactcttcagttttag

SEQ ID NO: 198934 - DNA, 13 bp, Homo sapiens
agttactgttcat

SEQ ID NO: 198935 - DNA, 15 bp, Homo sapiens
agttactgttcatgg

SEQ ID NO: 198936 - DNA, 15 bp, Homo sapiens
agttacttcctatca

SEQ ID NO: 198937 - DNA, 15 bp, Homo sapiens
agttacttccttcct

SEQ ID NO: 198938 - DNA, 14 bp, Homo sapiens
agttacttgaattt

SEQ ID NO: 198939 - DNA, 17 bp, Homo sapiens
agttacttgtctgaggc

SEQ ID NO: 198940 - DNA, 19 bp, Homo sapiens
agttacttgtctgaggcct

SEQ ID NO: 198941 - DNA, 16 bp, Homo sapiens
agttagcccggccaag

SEQ ID NO: 198942 - DNA, 14 bp, Homo sapiens
agttaggaaataaa

SEQ ID NO: 198943 - DNA, 15 bp, Homo sapiens
agttaggaaataaaa

SEQ ID NO: 198944 - DNA, 15 bp, Homo sapiens
agttaggccacgctc

SEQ ID NO: 198945 - DNA, 18 bp, Homo sapiens
agttaggggagaggaaaa

SEQ ID NO: 198946 - DNA, 17 bp, Homo sapiens
agttagtagcatgttga

SEQ ID NO: 198947 - DNA, 12 bp, Homo sapiens
agttataaatca

SEQ ID NO: 198948 - DNA, 15 bp, Homo sapiens
agttataccagcaaa

SEQ ID NO: 198949 - DNA, 19 bp, Homo sapiens
agttatagtatatctggac

SEQ ID NO: 198950 - DNA, 18 bp, Homo sapiens
agttatagtttcagatat

SEQ ID NO: 198951 - DNA, 23 bp, Homo sapiens
agttatatgacttcttgttcatg

SEQ ID NO: 198952 - DNA, 12 bp, Homo sapiens
agttattaatag

SEQ ID NO: 198953 - DNA, 19 bp, Homo sapiens
agttattagaacttagttt

SEQ ID NO: 198954 - DNA, 23 bp, Homo sapiens
agttattagaacttagttttgtt

SEQ ID NO: 198955 - DNA, 22 bp, Homo sapiens
agttattcattctgtgatcatt

SEQ ID NO: 198956 - DNA, 18 bp, Homo sapiens
agttattgtacagctgtt

SEQ ID NO: 198957 - DNA, 18 bp, Homo sapiens
agttatttcttgtttgtt

SEQ ID NO: 198958 - DNA, 18 bp, Homo sapiens
agttatttgatctggtgc

SEQ ID NO: 198959 - DNA, 21 bp, Homo sapiens
agttattttaatacctttaaa

SEQ ID NO: 198960 - DNA, 12 bp, Homo sapiens
agttattttagg

SEQ ID NO: 198961 - DNA, 18 bp, Homo sapiens
agttattttaggagacag

SEQ ID NO: 198962 - DNA, 20 bp, Homo sapiens
agttattttaggagacagtc

SEQ ID NO: 198963 - DNA, 14 bp, Homo sapiens
agttcaaatacttt

SEQ ID NO: 198964 - DNA, 23 bp, Homo sapiens
agttcaagactgaaatggcttct

SEQ ID NO: 198965 - DNA, 22 bp, Homo sapiens
agttcaatgatctaggtttaac

SEQ ID NO: 198966 - DNA, 23 bp, Homo sapiens
agttcaatgatctaggtttaact

SEQ ID NO: 198967 - DNA, 19 bp, Homo sapiens
agttcaattgtgtctgtgg

SEQ ID NO: 198968 - DNA, 22 bp, Homo sapiens
agttcacgtaagatacaagttt

SEQ ID NO: 198969 - DNA, 15 bp, Homo sapiens
agttcagcaccaccc

SEQ ID NO: 198970 - DNA, 13 bp, Homo sapiens
agttcaggatttg

SEQ ID NO: 198971 - DNA, 17 bp, Homo sapiens
agttcagggaggggctg

SEQ ID NO: 198972 - DNA, 21 bp, Homo sapiens
agttcataaatttgttgtcat

SEQ ID NO: 198973 - DNA, 18 bp, Homo sapiens
agttcatatgtaccatgt

SEQ ID NO: 198974 - DNA, 22 bp, Homo sapiens
agttcatccaatcctcactggg

SEQ ID NO: 198975 - DNA, 12 bp, Homo sapiens
agttcatcccaa

SEQ ID NO: 198976 - DNA, 15 bp, Homo sapiens
agttcatctctgctg

SEQ ID NO: 198977 - DNA, 20 bp, Homo sapiens
agttcatctctgctgaacat

SEQ ID NO: 198978 - DNA, 19 bp, Homo sapiens
agttcatcttgaattgtaa

SEQ ID NO: 198979 - DNA, 15 bp, Homo sapiens
agttcatgtttgtaa

SEQ ID NO: 198980 - DNA, 14 bp, Homo sapiens
agttcattaaacag

SEQ ID NO: 198981 - DNA, 16 bp, Homo sapiens
agttcattacctccct

SEQ ID NO: 198982 - DNA, 19 bp, Homo sapiens
agttcattacctccctatc

SEQ ID NO: 198983 - DNA, 14 bp, Homo sapiens
agttccaatgtgcc

SEQ ID NO: 198984 - DNA, 19 bp, Homo sapiens
agttccacttagagaacaa

SEQ ID NO: 198985 - DNA, 16 bp, Homo sapiens
agttccagcttttgta

SEQ ID NO: 198986 - DNA, 13 bp, Homo sapiens
agttccattcttg

SEQ ID NO: 198987 - DNA, 18 bp, Homo sapiens
agttccattcttggtcaa

SEQ ID NO: 198988 - DNA, 18 bp, Homo sapiens
agttcccccaacctcaga

SEQ ID NO: 198989 - DNA, 19 bp, Homo sapiens
agttcccccagtacctcca

SEQ ID NO: 198990 - DNA, 15 bp, Homo sapiens
agttccctacttcct

SEQ ID NO: 198991 - DNA, 19 bp, Homo sapiens
agttccctcagtgtgaagc

SEQ ID NO: 198992 - DNA, 21 bp, Homo sapiens
agttccctgtctcttgaaaaa

SEQ ID NO: 198993 - DNA, 16 bp, Homo sapiens
agttcccttggcctca

SEQ ID NO: 198994 - DNA, 17 bp, Homo sapiens
agttcccttggcctcag

SEQ ID NO: 198995 - DNA, 13 bp, Homo sapiens
agttccgtctcct

SEQ ID NO: 198996 - DNA, 13 bp, Homo sapiens
agttctaaaattg

SEQ ID NO: 198997 - DNA, 22 bp, Homo sapiens
agttctactatggctgagttct

SEQ ID NO: 198998 - DNA, 23 bp, Homo sapiens
agttctaggggagaagagccctg

SEQ ID NO: 198999 - DNA, 18 bp, Homo sapiens
agttctatccccaagctg

SEQ ID NO: 199000 - DNA, 15 bp, Homo sapiens
agttctatttaagtg

SEQ ID NO: 199001 - DNA, 20 bp, Homo sapiens
agttctatttctatctgcaa

SEQ ID NO: 199002 - DNA, 17 bp, Homo sapiens
agttctcaatcactgct

SEQ ID NO: 199003 - DNA, 15 bp, Homo sapiens
agttctcaatgtgaa

SEQ ID NO: 199004 - DNA, 13 bp, Homo sapiens
agttctcactcct

SEQ ID NO: 199005 - DNA, 12 bp, Homo sapiens
agttctcactgt

SEQ ID NO: 199006 - DNA, 18 bp, Homo sapiens
agttctcactgttccctc

SEQ ID NO: 199007 - DNA, 19 bp, Homo sapiens
agttctcactgttccctct

SEQ ID NO: 199008 - DNA, 14 bp, Homo sapiens
agttctcatccaca

SEQ ID NO: 199009 - DNA, 16 bp, Homo sapiens
agttctctccttcttc

SEQ ID NO: 199010 - DNA, 17 bp, Homo sapiens
agttctgaaaactgttt

SEQ ID NO: 199011 - DNA, 19 bp, Homo sapiens
agttctgaactggaacatg

SEQ ID NO: 199012 - DNA, 16 bp, Homo sapiens
agttctgcaaatagaa

SEQ ID NO: 199013 - DNA, 16 bp, Homo sapiens
agttctggtcaaagaa

SEQ ID NO: 199014 - DNA, 21 bp, Homo sapiens
agttctgtagagccttctgat

SEQ ID NO: 199015 - DNA, 14 bp, Homo sapiens
agttctgtgcctcc

SEQ ID NO: 199016 - DNA, 18 bp, Homo sapiens
agttctgtgcctcccccc

SEQ ID NO: 199017 - DNA, 20 bp, Homo sapiens
agttctgtgcctccccccag

SEQ ID NO: 199018 - DNA, 22 bp, Homo sapiens
agttctgttgtgtttgtcaaaa

SEQ ID NO: 199019 - DNA, 19 bp, Homo sapiens
agttcttaagcatttgcgt

SEQ ID NO: 199020 - DNA, 17 bp, Homo sapiens
cagtggagaggggactt

SEQ ID NO: 199021 - DNA, 20 bp, Homo sapiens
cagtggaggaagagggacag

SEQ ID NO: 199022 - DNA, 19 bp, Homo sapiens
cagtggcacgatctcagct

SEQ ID NO: 199023 - DNA, 19 bp, Homo sapiens
cagtggcagcaaaggaaga

SEQ ID NO: 199024 - DNA, 16 bp, Homo sapiens
cagtggcatggctcca

SEQ ID NO: 199025 - DNA, 14 bp, Homo sapiens
cagtggccaggcag

SEQ ID NO: 199026 - DNA, 22 bp, Homo sapiens
cagtggccgaaccccccactcc

SEQ ID NO: 199027 - DNA, 23 bp, Homo sapiens
cagtggccgaaccccccactccc

SEQ ID NO: 199028 - DNA, 21 bp, Homo sapiens
cagtggcctcaaccctccctc

SEQ ID NO: 199029 - DNA, 15 bp, Homo sapiens
cagtggcctggctcc

SEQ ID NO: 199030 - DNA, 18 bp, Homo sapiens
cagtggcctggctccgct

SEQ ID NO: 199031 - DNA, 23 bp, Homo sapiens
cagtggcctggctccgctgtgtg

SEQ ID NO: 199032 - DNA, 19 bp, Homo sapiens
cagtggctgggggtgctag

SEQ ID NO: 199033 - DNA, 13 bp, Homo sapiens
cagtggctgggtg

SEQ ID NO: 199034 - DNA, 20 bp, Homo sapiens
cagtggctggtccagggcta

SEQ ID NO: 199035 - DNA, 20 bp, Homo sapiens
cagtgggaatgcagtgggtg

SEQ ID NO: 199036 - DNA, 13 bp, Homo sapiens
cagtgggagccct

SEQ ID NO: 199037 - DNA, 14 bp, Homo sapiens
cagtgggagccctg

SEQ ID NO: 199038 - DNA, 17 bp, Homo sapiens
cagtgggagccctgacc

SEQ ID NO: 199039 - DNA, 22 bp, Homo sapiens
cagtgggagccctgaccttggc

SEQ ID NO: 199040 - DNA, 12 bp, Homo sapiens
cagtgggaggcg

SEQ ID NO: 199041 - DNA, 22 bp, Homo sapiens
cagtgggaggtgagaccacctc

SEQ ID NO: 199042 - DNA, 22 bp, Homo sapiens
cagtgggccggccccaggctcc

SEQ ID NO: 199043 - DNA, 14 bp, Homo sapiens
cagtgggctgtgtt

SEQ ID NO: 199044 - DNA, 21 bp, Homo sapiens
cagtgggctgtgttgactgct

SEQ ID NO: 199045 - DNA, 20 bp, Homo sapiens
cagtggggcccatggcccca

SEQ ID NO: 199046 - DNA, 21 bp, Homo sapiens
cagtggggcccatggccccag

SEQ ID NO: 199047 - DNA, 15 bp, Homo sapiens
cagtgggggtgcctg

SEQ ID NO: 199048 - DNA, 19 bp, Homo sapiens
cagtgggggtgcctggtgc

SEQ ID NO: 199049 - DNA, 15 bp, Homo sapiens
cagtggggtctcagt

SEQ ID NO: 199050 - DNA, 15 bp, Homo sapiens
cagtgggtggggctg

SEQ ID NO: 199051 - DNA, 19 bp, Homo sapiens
cagtgtaatccaggggtgt

SEQ ID NO: 199052 - DNA, 14 bp, Homo sapiens
cagtgtactgcttt

SEQ ID NO: 199053 - DNA, 22 bp, Homo sapiens
cagtgtactgctttcaacttaa

SEQ ID NO: 199054 - DNA, 22 bp, Homo sapiens
cagtgtagccccaagaaggctg

SEQ ID NO: 199055 - DNA, 18 bp, Homo sapiens
cagtgtattttaaattct

SEQ ID NO: 199056 - DNA, 17 bp, Homo sapiens
cagtgtattttctgtgt

SEQ ID NO: 199057 - DNA, 12 bp, Homo sapiens
cagtgtattttg

SEQ ID NO: 199058 - DNA, 20 bp, Homo sapiens
cagtgtcatttatgaaaaga

SEQ ID NO: 199059 - DNA, 20 bp, Homo sapiens
cagtgtccccaggggcacac

SEQ ID NO: 199060 - DNA, 18 bp, Homo sapiens
cagtgtcctcttgctcaa

SEQ ID NO: 199061 - DNA, 19 bp, Homo sapiens
cagtgtcctcttgctcaaa

SEQ ID NO: 199062 - DNA, 18 bp, Homo sapiens
cagtgtcctgtgctttct

SEQ ID NO: 199063 - DNA, 15 bp, Homo sapiens
cagtgtctgtgccat

SEQ ID NO: 199064 - DNA, 17 bp, Homo sapiens
cagtgtctgtgccatgg

SEQ ID NO: 199065 - DNA, 15 bp, Homo sapiens
cagtgtcttccataa

SEQ ID NO: 199066 - DNA, 18 bp, Homo sapiens
agttggctggatgaaatt

SEQ ID NO: 199067 - DNA, 18 bp, Homo sapiens
agttggggaaggcaagat

SEQ ID NO: 199068 - DNA, 12 bp, Homo sapiens
agttggggctgc

SEQ ID NO: 199069 - DNA, 18 bp, Homo sapiens
agttgggtctgaaaggaa

SEQ ID NO: 199070 - DNA, 20 bp, Homo sapiens
agttgggtctgaaaggaaaa

SEQ ID NO: 199071 - DNA, 21 bp, Homo sapiens
agttggtcttactttgtgcaa

SEQ ID NO: 199072 - DNA, 14 bp, Homo sapiens
agttgtaatgtgta

SEQ ID NO: 199073 - DNA, 20 bp, Homo sapiens
agttgtagcaggtttcacta

SEQ ID NO: 199074 - DNA, 13 bp, Homo sapiens
agttgtctttctt

SEQ ID NO: 199075 - DNA, 15 bp, Homo sapiens
agttgtctttctttg

SEQ ID NO: 199076 - DNA, 18 bp, Homo sapiens
agttgtctttctttgctg

SEQ ID NO: 199077 - DNA, 20 bp, Homo sapiens
agttgtctttctttgctgct

SEQ ID NO: 199078 - DNA, 15 bp, Homo sapiens
agttgtgcctttcac

SEQ ID NO: 199079 - DNA, 18 bp, Homo sapiens
agttgtgccttttatagc

SEQ ID NO: 199080 - DNA, 22 bp, Homo sapiens
agttgtgccttttatagctatt

SEQ ID NO: 199081 - DNA, 16 bp, Homo sapiens
agttgttagtgatttg

SEQ ID NO: 199082 - DNA, 14 bp, Homo sapiens
agttgttggcctcc

SEQ ID NO: 199083 - DNA, 15 bp, Homo sapiens
agttgttggcctccg

SEQ ID NO: 199084 - DNA, 18 bp, Homo sapiens
agttgtttcaaacagcat

SEQ ID NO: 199085 - DNA, 16 bp, Homo sapiens
agttgtttctgaccca

SEQ ID NO: 199086 - DNA, 20 bp, Homo sapiens
agttgtttctgacccactga

SEQ ID NO: 199087 - DNA, 12 bp, Homo sapiens
agtttaaagcaa

SEQ ID NO: 199088 - DNA, 16 bp, Homo sapiens
agtttaaataccagta

SEQ ID NO: 199089 - DNA, 17 bp, Homo sapiens
agtttacaagtgtatat

SEQ ID NO: 199090 - DNA, 19 bp, Homo sapiens
agtttacaagtgtatatca

SEQ ID NO: 199091 - DNA, 23 bp, Homo sapiens
agtttacaagtgtatatcagaaa

SEQ ID NO: 199092 - DNA, 18 bp, Homo sapiens
agtttacagaaaaatctt

SEQ ID NO: 199093 - DNA, 19 bp, Homo sapiens
agtttacagaaaaatcttg

SEQ ID NO: 199094 - DNA, 13 bp, Homo sapiens
agtttacagtaaa

SEQ ID NO: 199095 - DNA, 15 bp, Homo sapiens
agtttacattgtaaa

SEQ ID NO: 199096 - DNA, 17 bp, Homo sapiens
agtttacattgtaaata

SEQ ID NO: 199097 - DNA, 16 bp, Homo sapiens
agtttaccaatcaaca

SEQ ID NO: 199098 - DNA, 20 bp, Homo sapiens
agtttaccaatcaacagcat

SEQ ID NO: 199099 - DNA, 17 bp, Homo sapiens
agtttagaaattacaag

SEQ ID NO: 199100 - DNA, 23 bp, Homo sapiens
agtttagaaattacaagtttcag

SEQ ID NO: 199101 - DNA, 21 bp, Homo sapiens
agtttagggattgggtcgtgg

SEQ ID NO: 199102 - DNA, 15 bp, Homo sapiens
agtttatgtctaaag

SEQ ID NO: 199103 - DNA, 22 bp, Homo sapiens
agtttattgccctcaaaatctt

SEQ ID NO: 199104 - DNA, 14 bp, Homo sapiens
agtttattgtaaaa

SEQ ID NO: 199105 - DNA, 20 bp, Homo sapiens
agtttatttttttgatggct

SEQ ID NO: 199106 - DNA, 13 bp, Homo sapiens
agtttcaaatgag

SEQ ID NO: 199107 - DNA, 22 bp, Homo sapiens
agtttcaagtatccttgttgac

SEQ ID NO: 199108 - DNA, 22 bp, Homo sapiens
agtttcaatgtgattctaatgt

SEQ ID NO: 199109 - DNA, 19 bp, Homo sapiens
agtttcacatatttgtagc

SEQ ID NO: 199110 - DNA, 15 bp, Homo sapiens
agtttcagacagggt

SEQ ID NO: 199111 - DNA, 14 bp, Homo sapiens
agtttcagatatat

SEQ ID NO: 199112 - DNA, 17 bp, Homo sapiens
agtttcagcttaaaata

SEQ ID NO: 199113 - DNA, 22 bp, Homo sapiens
agtttcagcttaaaataaacag

SEQ ID NO: 199114 - DNA, 12 bp, Homo sapiens
agtttcaggcaa

SEQ ID NO: 199115 - DNA, 18 bp, Homo sapiens
agtttcaggtgtttagtt

SEQ ID NO: 199116 - DNA, 21 bp, Homo sapiens
agtttcagtaaataatgaaaa

SEQ ID NO: 199117 - DNA, 13 bp, Homo sapiens
agtttcagtaata

SEQ ID NO: 199118 - DNA, 14 bp, Homo sapiens
agtttcagtaatag

SEQ ID NO: 199119 - DNA, 21 bp, Homo sapiens
agtttcatttatgatacaaaa

SEQ ID NO: 199120 - DNA, 17 bp, Homo sapiens
agtttccccaccagtga

SEQ ID NO: 199121 - DNA, 16 bp, Homo sapiens
agtttcctaatcagaa

SEQ ID NO: 199122 - DNA, 18 bp, Homo sapiens
agtttcctatgactaatt

SEQ ID NO: 199123 - DNA, 15 bp, Homo sapiens
agtttctagaggcct

SEQ ID NO: 199124 - DNA, 18 bp, Homo sapiens
agtttctagaggcctcag

SEQ ID NO: 199125 - DNA, 16 bp, Homo sapiens
agtttctagctagaaa

SEQ ID NO: 199126 - DNA, 22 bp, Homo sapiens
agtttctgattcactattagag

SEQ ID NO: 199127 - DNA, 13 bp, Homo sapiens
agtttctgtaatt

SEQ ID NO: 199128 - DNA, 19 bp, Homo sapiens
agtttctgtaattggcttt

SEQ ID NO: 199129 - DNA, 15 bp, Homo sapiens
agtttcttctaaaga

SEQ ID NO: 199130 - DNA, 12 bp, Homo sapiens
agtttgacattt

SEQ ID NO: 199131 - DNA, 13 bp, Homo sapiens
agtttgacattta

SEQ ID NO: 199132 - DNA, 11 bp, Homo sapiens
agtttgaggcc

SEQ ID NO: 199133 - DNA, 13 bp, Homo sapiens
agtttgcagagga

SEQ ID NO: 199134 - DNA, 20 bp, Homo sapiens
agtttgctaagtaaattagt

SEQ ID NO: 199135 - DNA, 20 bp, Homo sapiens
agtttgctgtatacaaacag

SEQ ID NO: 199136 - DNA, 15 bp, Homo sapiens
agtttgtacatgcat

SEQ ID NO: 199137 - DNA, 15 bp, Homo sapiens
agtttgtagtttttg

SEQ ID NO: 199138 - DNA, 19 bp, Homo sapiens
agtttgtattaaacttgaa

SEQ ID NO: 199139 - DNA, 16 bp, Homo sapiens
agtttgtgaagtgatt

SEQ ID NO: 199140 - DNA, 21 bp, Homo sapiens
agtttgtgaagtgattgacat

SEQ ID NO: 199141 - DNA, 13 bp, Homo sapiens
agtttgttaattg

SEQ ID NO: 199142 - DNA, 13 bp, Homo sapiens
agtttgttctgca

SEQ ID NO: 199143 - DNA, 16 bp, Homo sapiens
agttttaacttccagt

SEQ ID NO: 199144 - DNA, 21 bp, Homo sapiens
agttttacagattgcctcctt

SEQ ID NO: 199145 - DNA, 23 bp, Homo sapiens
agttttactcttgttgcccaggc

SEQ ID NO: 199146 - DNA, 14 bp, Homo sapiens
agttttagacctca

SEQ ID NO: 199147 - DNA, 15 bp, Homo sapiens
agttttagttgcaga

SEQ ID NO: 199148 - DNA, 16 bp, Homo sapiens
agttttatgtactttg

SEQ ID NO: 199149 - DNA, 14 bp, Homo sapiens
agttttatgtttct

SEQ ID NO: 199150 - DNA, 22 bp, Homo sapiens
cagtttaggacccaaggtggtc

SEQ ID NO: 199151 - DNA, 22 bp, Homo sapiens
cagtttcccaaaaaccccagtg

SEQ ID NO: 199152 - DNA, 15 bp, Homo sapiens
cagtttctgttgttt

SEQ ID NO: 199153 - DNA, 17 bp, Homo sapiens
cagtttctgttgtttct

SEQ ID NO: 199154 - DNA, 22 bp, Homo sapiens
cagtttcttgaagtccagtgtt

SEQ ID NO: 199155 - DNA, 18 bp, Homo sapiens
cagtttgaaaatattttg

SEQ ID NO: 199156 - DNA, 18 bp, Homo sapiens
cagtttgagacaggagac

SEQ ID NO: 199157 - DNA, 20 bp, Homo sapiens
cagtttgataactagggaag

SEQ ID NO: 199158 - DNA, 16 bp, Homo sapiens
cagtttgatattttga

SEQ ID NO: 199159 - DNA, 13 bp, Homo sapiens
cagtttgatgctg

SEQ ID NO: 199160 - DNA, 21 bp, Homo sapiens
cagtttgatgctgagtcatgc

SEQ ID NO: 199161 - DNA, 20 bp, Homo sapiens
cagtttgctatttgctttag

SEQ ID NO: 199162 - DNA, 21 bp, Homo sapiens
cagtttgctttgtatgcactt

SEQ ID NO: 199163 - DNA, 12 bp, Homo sapiens
cagtttgtgaag

SEQ ID NO: 199164 - DNA, 22 bp, Homo sapiens
cagtttgtgaagtgattgacat

SEQ ID NO: 199165 - DNA, 23 bp, Homo sapiens
cagtttgtgaagtgattgacatt

SEQ ID NO: 199166 - DNA, 12 bp, Homo sapiens
cagttttaaaga

SEQ ID NO: 199167 - DNA, 13 bp, Homo sapiens
cagttttaagaat

SEQ ID NO: 199168 - DNA, 15 bp, Homo sapiens
cagttttccaggagg

SEQ ID NO: 199169 - DNA, 14 bp, Homo sapiens
cagttttccatgaa

SEQ ID NO: 199170 - DNA, 16 bp, Homo sapiens
cagttttccatgaaaa

SEQ ID NO: 199171 - DNA, 17 bp, Homo sapiens
cagttttccatgaaaac

SEQ ID NO: 199172 - DNA, 18 bp, Homo sapiens
cagttttccatgaaaacg

SEQ ID NO: 199173 - DNA, 13 bp, Homo sapiens
cagttttgctgct

SEQ ID NO: 199174 - DNA, 15 bp, Homo sapiens
cagttttgctgctat

SEQ ID NO: 199175 - DNA, 23 bp, Homo sapiens
cagttttgtatcaaactcgtctg

SEQ ID NO: 199176 - DNA, 20 bp, Homo sapiens
cagtttttgttccttcctgc

SEQ ID NO: 199177 - DNA, 21 bp, Homo sapiens
cagttttttgccactgcaaac

SEQ ID NO: 199178 - DNA, 22 bp, Homo sapiens
cataaaaagttaaaaaaaataa

SEQ ID NO: 199179 - DNA, 13 bp, Homo sapiens
cataaaaataacc

SEQ ID NO: 199180 - DNA, 21 bp, Homo sapiens
cataaaaataaccaaaaaatg

SEQ ID NO: 199181 - DNA, 22 bp, Homo sapiens
cataaaacaaaaccaagccttg

SEQ ID NO: 199182 - DNA, 21 bp, Homo sapiens
cataaaaggtgacccttctgt

SEQ ID NO: 199183 - DNA, 19 bp, Homo sapiens
cataaaataaagtatatat

SEQ ID NO: 199184 - DNA, 12 bp, Homo sapiens
cataaaatctgt

SEQ ID NO: 199185 - DNA, 17 bp, Homo sapiens
cataaaatctgtgaatt

SEQ ID NO: 199186 - DNA, 19 bp, Homo sapiens
cataaacccatctgtaata

SEQ ID NO: 199187 - DNA, 17 bp, Homo sapiens
cataaactgactttatc

SEQ ID NO: 199188 - DNA, 22 bp, Homo sapiens
cataaagtaaatgctacctctg

SEQ ID NO: 199189 - DNA, 13 bp, Homo sapiens
cataaagtgtaat

SEQ ID NO: 199190 - DNA, 20 bp, Homo sapiens
cataaatctgtctgattcta

SEQ ID NO: 199191 - DNA, 21 bp, Homo sapiens
cataaatctgtctgattctat

SEQ ID NO: 199192 - DNA, 12 bp, Homo sapiens
cataaattggct

SEQ ID NO: 199193 - DNA, 18 bp, Homo sapiens
cataaattggctcctttc

SEQ ID NO: 199194 - DNA, 20 bp, Homo sapiens
cataaattggctcctttccc

SEQ ID NO: 199195 - DNA, 22 bp, Homo sapiens
cataaattggctcctttcccac

SEQ ID NO: 199196 - DNA, 22 bp, Homo sapiens
cataaatttccacccaatttcc

SEQ ID NO: 199197 - DNA, 21 bp, Homo sapiens
cataacagagtagttttggtt

SEQ ID NO: 199198 - DNA, 13 bp, Homo sapiens
cataacaggcatt

SEQ ID NO: 199199 - DNA, 17 bp, Homo sapiens
cataacaggcattgcac

SEQ ID NO: 199200 - DNA, 22 bp, Homo sapiens
cataacaggcattgcactaaaa

SEQ ID NO: 199201 - DNA, 19 bp, Homo sapiens
cataacagggtaaattatt

SEQ ID NO: 199202 - DNA, 12 bp, Homo sapiens
cataacctctat

SEQ ID NO: 199203 - DNA, 22 bp, Homo sapiens
cataactggcttctgcttgtca

SEQ ID NO: 199204 - DNA, 17 bp, Homo sapiens
ataaaactcagttaaaa

SEQ ID NO: 199205 - DNA, 18 bp, Homo sapiens
ataaaactcagttaaaat

SEQ ID NO: 199206 - DNA, 13 bp, Homo sapiens
ataaaactgcaca

SEQ ID NO: 199207 - DNA, 19 bp, Homo sapiens
ataaaacttatgctagttt

SEQ ID NO: 199208 - DNA, 17 bp, Homo sapiens
ataaaactttgctgcca

SEQ ID NO: 199209 - DNA, 18 bp, Homo sapiens
ataaaagatacatttgta

SEQ ID NO: 199210 - DNA, 12 bp, Homo sapiens
ataaaagccttg

SEQ ID NO: 199211 - DNA, 17 bp, Homo sapiens
ataaaaggaatctggca

SEQ ID NO: 199212 - DNA, 18 bp, Homo sapiens
ataaaaggataggaaaag

SEQ ID NO: 199213 - DNA, 19 bp, Homo sapiens
ataaaaggataggaaaaga

SEQ ID NO: 199214 - DNA, 18 bp, Homo sapiens
ataaaagggcaaatctgc

SEQ ID NO: 199215 - DNA, 12 bp, Homo sapiens
ataaaagtaatt

SEQ ID NO: 199216 - DNA, 13 bp, Homo sapiens
ataaaagtgactc

SEQ ID NO: 199217 - DNA, 18 bp, Homo sapiens
ataaaagtgatcaataaa

SEQ ID NO: 199218 - DNA, 14 bp, Homo sapiens
ataaaagttaacat

SEQ ID NO: 199219 - DNA, 16 bp, Homo sapiens
ataaaagttgcaaagg

SEQ ID NO: 199220 - DNA, 14 bp, Homo sapiens
ataaaataaatata

SEQ ID NO: 199221 - DNA, 15 bp, Homo sapiens
ataaaataaatatac

SEQ ID NO: 199222 - DNA, 17 bp, Homo sapiens
ataaaataaatatacta

SEQ ID NO: 199223 - DNA, 19 bp, Homo sapiens
ataaaataaatatactaat

SEQ ID NO: 199224 - DNA, 21 bp, Homo sapiens
ataaaataaatatactaataa

SEQ ID NO: 199225 - DNA, 12 bp, Homo sapiens
ataaaataagtc

SEQ ID NO: 199226 - DNA, 16 bp, Homo sapiens
ataaaatatcattcag

SEQ ID NO: 199227 - DNA, 18 bp, Homo sapiens
ataaaatatcattcagca

SEQ ID NO: 199228 - DNA, 18 bp, Homo sapiens
ataaaatgaggacatgtt

SEQ ID NO: 199229 - DNA, 12 bp, Homo sapiens
ataaaatgatgt

SEQ ID NO: 199230 - DNA, 14 bp, Homo sapiens
ataaaatggaaagg

SEQ ID NO: 199231 - DNA, 22 bp, Homo sapiens
ataaaatggtgttttcatgtaa

SEQ ID NO: 199232 - DNA, 13 bp, Homo sapiens
ataaaatgtattc

SEQ ID NO: 199233 - DNA, 12 bp, Homo sapiens
ataaaattacag

SEQ ID NO: 199234 - DNA, 15 bp, Homo sapiens
ataaaattatggtga

SEQ ID NO: 199235 - DNA, 13 bp, Homo sapiens
ataaaatttacct

SEQ ID NO: 199236 - DNA, 16 bp, Homo sapiens
ataaacaatccaaatg

SEQ ID NO: 199237 - DNA, 24 bp, Homo sapiens
ataaacacatagattcacctgtaa

SEQ ID NO: 199238 - DNA, 15 bp, Homo sapiens
ataaacactttttct

SEQ ID NO: 199239 - DNA, 15 bp, Homo sapiens
ataaacatccttgta

SEQ ID NO: 199240 - DNA, 12 bp, Homo sapiens
ataaacattaaa

SEQ ID NO: 199241 - DNA, 21 bp, Homo sapiens
ataaaccaggtttagacagta

SEQ ID NO: 199242 - DNA, 16 bp, Homo sapiens
ataaacccatctgtaa

SEQ ID NO: 199243 - DNA, 17 bp, Homo sapiens
ataaacccatctgtaat

SEQ ID NO: 199244 - DNA, 15 bp, Homo sapiens
ataaacctgggcaag

SEQ ID NO: 199245 - DNA, 23 bp, Homo sapiens
ataaacctgggcaagtgaggcaa

SEQ ID NO: 199246 - DNA, 20 bp, Homo sapiens
ataaaccttgtttctttctg

SEQ ID NO: 199247 - DNA, 19 bp, Homo sapiens
ataaactaattttgtacgt

SEQ ID NO: 199248 - DNA, 20 bp, Homo sapiens
ataaactaattttgtacgta

SEQ ID NO: 199249 - DNA, 15 bp, Homo sapiens
ataaactagatctcc

SEQ ID NO: 199250 - DNA, 14 bp, Homo sapiens
ataaactatcagtt

SEQ ID NO: 199251 - DNA, 18 bp, Homo sapiens
ataaactattggaaagta

SEQ ID NO: 199252 - DNA, 13 bp, Homo sapiens
ataaactccttaa

SEQ ID NO: 199253 - DNA, 19 bp, Homo sapiens
ataaactctaagtgtaaaa

SEQ ID NO: 199254 - DNA, 15 bp, Homo sapiens
ataaactcttcaagg

SEQ ID NO: 199255 - DNA, 18 bp, Homo sapiens
ataaactcttcaaggcca

SEQ ID NO: 199256 - DNA, 15 bp, Homo sapiens
ataaactgactttat

SEQ ID NO: 199257 - DNA, 18 bp, Homo sapiens
ataaactgactttatcct

SEQ ID NO: 199258 - DNA, 20 bp, Homo sapiens
ataaactgtgagataaatat

SEQ ID NO: 199259 - DNA, 19 bp, Homo sapiens
ataaactgttatgagtagt

SEQ ID NO: 199260 - DNA, 14 bp, Homo sapiens
ataaacttagaata

SEQ ID NO: 199261 - DNA, 23 bp, Homo sapiens
ataaacttagtgcggacaagttt

SEQ ID NO: 199262 - DNA, 18 bp, Homo sapiens
ataaagaaaaaaatagtt

SEQ ID NO: 199263 - DNA, 14 bp, Homo sapiens
ataaagaaaccttt

SEQ ID NO: 199264 - DNA, 12 bp, Homo sapiens
ataaagaagaaa

SEQ ID NO: 199265 - DNA, 15 bp, Homo sapiens
ataaagaagaaaata

SEQ ID NO: 199266 - DNA, 11 bp, Homo sapiens
ataaagatgat

SEQ ID NO: 199267 - DNA, 19 bp, Homo sapiens
ataaagatgatctactcag

SEQ ID NO: 199268 - DNA, 20 bp, Homo sapiens
ataaagatgatctactcaga

SEQ ID NO: 199269 - DNA, 23 bp, Homo sapiens
ataaagatgtcaaatatctcaga

SEQ ID NO: 199270 - DNA, 21 bp, Homo sapiens
ataaagcataagtatacagtt

SEQ ID NO: 199271 - DNA, 12 bp, Homo sapiens
ataaagccacat

SEQ ID NO: 199272 - DNA, 19 bp, Homo sapiens
ataaagcgatatacagatg

SEQ ID NO: 199273 - DNA, 22 bp, Homo sapiens
ataaagcgatatacagatgaaa

SEQ ID NO: 199274 - DNA, 21 bp, Homo sapiens
ataaagctggacaagaagctg

SEQ ID NO: 199275 - DNA, 22 bp, Homo sapiens
ataaagctggacaagaagctgc

SEQ ID NO: 199276 - DNA, 20 bp, Homo sapiens
ataaaggcttaggacttcaa

SEQ ID NO: 199277 - DNA, 16 bp, Homo sapiens
ataaaggtcccttagc

SEQ ID NO: 199278 - DNA, 13 bp, Homo sapiens
ataaaggtttcgt

SEQ ID NO: 199279 - DNA, 21 bp, Homo sapiens
ataaaggtttcgttgcatggt

SEQ ID NO: 199280 - DNA, 16 bp, Homo sapiens
catagcagattttaat

SEQ ID NO: 199281 - DNA, 17 bp, Homo sapiens
catagcagattttaatt

SEQ ID NO: 199282 - DNA, 18 bp, Homo sapiens
catagcagattttaattt

SEQ ID NO: 199283 - DNA, 15 bp, Homo sapiens
catagccaggaaact

SEQ ID NO: 199284 - DNA, 11 bp, Homo sapiens
catagccatac

SEQ ID NO: 199285 - DNA, 16 bp, Homo sapiens
catagcccctgccccg

SEQ ID NO: 199286 - DNA, 15 bp, Homo sapiens
catagccctcctgag

SEQ ID NO: 199287 - DNA, 15 bp, Homo sapiens
catagctactatatg

SEQ ID NO: 199288 - DNA, 20 bp, Homo sapiens
catagctactatatgcataa

SEQ ID NO: 199289 - DNA, 23 bp, Homo sapiens
catagctggttatttctcccttg

SEQ ID NO: 199290 - DNA, 16 bp, Homo sapiens
catagtaccaatcatt

SEQ ID NO: 199291 - DNA, 22 bp, Homo sapiens
catagtaccaatcattttaatt

SEQ ID NO: 199292 - DNA, 18 bp, Homo sapiens
catagtcaatcaaacagg

SEQ ID NO: 199293 - DNA, 19 bp, Homo sapiens
catagtcaatcaaacaggg

SEQ ID NO: 199294 - DNA, 14 bp, Homo sapiens
catagtctttgttt

SEQ ID NO: 199295 - DNA, 15 bp, Homo sapiens
catagtgagatccca

SEQ ID NO: 199296 - DNA, 18 bp, Homo sapiens
catagtgatggttcccct

SEQ ID NO: 199297 - DNA, 19 bp, Homo sapiens
catagtgatggttcccctg

SEQ ID NO: 199298 - DNA, 11 bp, Homo sapiens
catagtgctgg

SEQ ID NO: 199299 - DNA, 18 bp, Homo sapiens
catagttttaaactcatt

SEQ ID NO: 199300 - DNA, 17 bp, Homo sapiens
catagtttttactgaac

SEQ ID NO: 199301 - DNA, 11 bp, Homo sapiens
catataaatgt

SEQ ID NO: 199302 - DNA, 16 bp, Homo sapiens
catataaatgtttata

SEQ ID NO: 199303 - DNA, 22 bp, Homo sapiens
catataaatgtttatattgttt

SEQ ID NO: 199304 - DNA, 18 bp, Homo sapiens
catataaattaatacata

SEQ ID NO: 199305 - DNA, 16 bp, Homo sapiens
catataatatatgttt

SEQ ID NO: 199306 - DNA, 19 bp, Homo sapiens
catataatatatgttttaa

SEQ ID NO: 199307 - DNA, 14 bp, Homo sapiens
catataatgcaaca

SEQ ID NO: 199308 - DNA, 17 bp, Homo sapiens
catataatgttgttatt

SEQ ID NO: 199309 - DNA, 13 bp, Homo sapiens
catataattttca

SEQ ID NO: 199310 - DNA, 12 bp, Homo sapiens
catatataaaac

SEQ ID NO: 199311 - DNA, 12 bp, Homo sapiens
catatataaatt

SEQ ID NO: 199312 - DNA, 13 bp, Homo sapiens
catatataaatta

SEQ ID NO: 199313 - DNA, 19 bp, Homo sapiens
catatataaattattactt

SEQ ID NO: 199314 - DNA, 19 bp, Homo sapiens
catatatgctactagaaaa

SEQ ID NO: 199315 - DNA, 22 bp, Homo sapiens
catatatggggggccaacacca

SEQ ID NO: 199316 - DNA, 21 bp, Homo sapiens
catatattataagatttttag

SEQ ID NO: 199317 - DNA, 18 bp, Homo sapiens
catatattcatacctgtt

SEQ ID NO: 199318 - DNA, 17 bp, Homo sapiens
catatattttattttca

SEQ ID NO: 199319 - DNA, 18 bp, Homo sapiens
catatattttattttcat

SEQ ID NO: 199320 - DNA, 21 bp, Homo sapiens
catatcaagtcccgaggcagc

SEQ ID NO: 199321 - DNA, 18 bp, Homo sapiens
catatcagacctctgatc

SEQ ID NO: 199322 - DNA, 21 bp, Homo sapiens
catatcctccgccctttttgt

SEQ ID NO: 199323 - DNA, 23 bp, Homo sapiens
catatcctccgccctttttgtcc

SEQ ID NO: 199324 - DNA, 16 bp, Homo sapiens
catatctagatttcta

SEQ ID NO: 199325 - DNA, 20 bp, Homo sapiens
catatctctagtccctgtgt

SEQ ID NO: 199326 - DNA, 12 bp, Homo sapiens
catatctctccc

SEQ ID NO: 199327 - DNA, 19 bp, Homo sapiens
catatctctcccttcttta

SEQ ID NO: 199328 - DNA, 23 bp, Homo sapiens
catatcttaaagaaacagctttc

SEQ ID NO: 199329 - DNA, 18 bp, Homo sapiens
catatgaaaatacaactt

SEQ ID NO: 199330 - DNA, 20 bp, Homo sapiens
catatgaattagccaaaaga

SEQ ID NO: 199331 - DNA, 16 bp, Homo sapiens
catatgacaatttcaa

SEQ ID NO: 199332 - DNA, 18 bp, Homo sapiens
catatgacaatttcaaaa

SEQ ID NO: 199333 - DNA, 19 bp, Homo sapiens
catatgataggcagcactg

SEQ ID NO: 199334 - DNA, 17 bp, Homo sapiens
catatgattgaaaagaa

SEQ ID NO: 199335 - DNA, 20 bp, Homo sapiens
catatgattgaaaagaagaa

SEQ ID NO: 199336 - DNA, 22 bp, Homo sapiens
catatgattgaaaagaagaaag

SEQ ID NO: 199337 - DNA, 13 bp, Homo sapiens
catatgcatgcca

SEQ ID NO: 199338 - DNA, 16 bp, Homo sapiens
catatgcatgccaggc

SEQ ID NO: 199339 - DNA, 19 bp, Homo sapiens
catatgcatgccaggctgg

SEQ ID NO: 199340 - DNA, 20 bp, Homo sapiens
catatgcatgccaggctggg

SEQ ID NO: 199341 - DNA, 13 bp, Homo sapiens
catatgctatgtt

SEQ ID NO: 199342 - DNA, 23 bp, Homo sapiens
catatgctgtatatcctttctaa

SEQ ID NO: 199343 - DNA, 14 bp, Homo sapiens
ataacagcaaataa

SEQ ID NO: 199344 - DNA, 18 bp, Homo sapiens
ataacagggtaaattatt

SEQ ID NO: 199345 - DNA, 22 bp, Homo sapiens
ataacagggtaaattattcagt

SEQ ID NO: 199346 - DNA, 16 bp, Homo sapiens
ataacataaaagtgct

SEQ ID NO: 199347 - DNA, 18 bp, Homo sapiens
ataacataaaagtgctac

SEQ ID NO: 199348 - DNA, 15 bp, Homo sapiens
ataacatattcttgc

SEQ ID NO: 199349 - DNA, 17 bp, Homo sapiens
ataacatattcttgctt

SEQ ID NO: 199350 - DNA, 14 bp, Homo sapiens
ataacatctgaaaa

SEQ ID NO: 199351 - DNA, 20 bp, Homo sapiens
ataacatctgaaaagaaatg

SEQ ID NO: 199352 - DNA, 18 bp, Homo sapiens
ataacattcatgagattg

SEQ ID NO: 199353 - DNA, 13 bp, Homo sapiens
ataacattgtaaa

SEQ ID NO: 199354 - DNA, 17 bp, Homo sapiens
ataacattgtaaatgat

SEQ ID NO: 199355 - DNA, 20 bp, Homo sapiens
ataaccaaaaaatgtgagct

SEQ ID NO: 199356 - DNA, 17 bp, Homo sapiens
ataaccatcagttactg

SEQ ID NO: 199357 - DNA, 18 bp, Homo sapiens
ataaccatcagttactgg

SEQ ID NO: 199358 - DNA, 19 bp, Homo sapiens
ataaccatcagttactggt

SEQ ID NO: 199359 - DNA, 20 bp, Homo sapiens
ataaccatcagttactggtt

SEQ ID NO: 199360 - DNA, 12 bp, Homo sapiens
ataaccccacct

SEQ ID NO: 199361 - DNA, 14 bp, Homo sapiens
ataaccccagcctg

SEQ ID NO: 199362 - DNA, 16 bp, Homo sapiens
ataacccctgcctgga

SEQ ID NO: 199363 - DNA, 22 bp, Homo sapiens
ataacccctgcctggatttctt

SEQ ID NO: 199364 - DNA, 15 bp, Homo sapiens
ataacgcaggagaga

SEQ ID NO: 199365 - DNA, 16 bp, Homo sapiens
ataacgcaggagagag

SEQ ID NO: 199366 - DNA, 14 bp, Homo sapiens
ataactaaataaag

SEQ ID NO: 199367 - DNA, 20 bp, Homo sapiens
ataactaccaggaataatga

SEQ ID NO: 199368 - DNA, 17 bp, Homo sapiens
ataactagatctcctgt

SEQ ID NO: 199369 - DNA, 19 bp, Homo sapiens
ataactagatctcctgtaa

SEQ ID NO: 199370 - DNA, 22 bp, Homo sapiens
ataactagatctcctgtaattt

SEQ ID NO: 199371 - DNA, 15 bp, Homo sapiens
ataactcatcataaa

SEQ ID NO: 199372 - DNA, 10 bp, Homo sapiens
ataactcatg

SEQ ID NO: 199373 - DNA, 15 bp, Homo sapiens
ataactcctcattgt

SEQ ID NO: 199374 - DNA, 16 bp, Homo sapiens
ataactgacttagttc

SEQ ID NO: 199375 - DNA, 17 bp, Homo sapiens
ataactggttactcagc

SEQ ID NO: 199376 - DNA, 17 bp, Homo sapiens
ataactgtgcagagact

SEQ ID NO: 199377 - DNA, 16 bp, Homo sapiens
ataacttcaagcaaac

SEQ ID NO: 199378 - DNA, 15 bp, Homo sapiens
ataacttcagagaag

SEQ ID NO: 199379 - DNA, 16 bp, Homo sapiens
ataacttcagagaagt

SEQ ID NO: 199380 - DNA, 12 bp, Homo sapiens
ataacttcataa

SEQ ID NO: 199381 - DNA, 19 bp, Homo sapiens
ataacttccttcacatctc

SEQ ID NO: 199382 - DNA, 17 bp, Homo sapiens
ataacttggggaggcaa

SEQ ID NO: 199383 - DNA, 18 bp, Homo sapiens
ataacttggggaggcaag

SEQ ID NO: 199384 - DNA, 23 bp, Homo sapiens
ataactttgctggaaaatctgta

SEQ ID NO: 199385 - DNA, 23 bp, Homo sapiens
ataagaaccttttgagtgcctta

SEQ ID NO: 199386 - DNA, 21 bp, Homo sapiens
ataagaatgctggttttccta

SEQ ID NO: 199387 - DNA, 22 bp, Homo sapiens
ataagaatgctggttttcctaa

SEQ ID NO: 199388 - DNA, 22 bp, Homo sapiens
ataagacatatctctaattcca

SEQ ID NO: 199389 - DNA, 10 bp, Homo sapiens
ataagactgg

SEQ ID NO: 199390 - DNA, 14 bp, Homo sapiens
ataagactgtcatg

SEQ ID NO: 199391 - DNA, 18 bp, Homo sapiens
ataagacttgtttctttc

SEQ ID NO: 199392 - DNA, 14 bp, Homo sapiens
ataagagaaagaaa

SEQ ID NO: 199393 - DNA, 18 bp, Homo sapiens
ataagagttacttccctt

SEQ ID NO: 199394 - DNA, 15 bp, Homo sapiens
ataagatattcttta

SEQ ID NO: 199395 - DNA, 18 bp, Homo sapiens
ataagatattctttacaa

SEQ ID NO: 199396 - DNA, 21 bp, Homo sapiens
ataagattcatatttacttct

SEQ ID NO: 199397 - DNA, 13 bp, Homo sapiens
ataagatttaatt

SEQ ID NO: 199398 - DNA, 10 bp, Homo sapiens
ataagcaaaa

SEQ ID NO: 199399 - DNA, 21 bp, Homo sapiens
ataagcagaggtggaaaatga

SEQ ID NO: 199400 - DNA, 14 bp, Homo sapiens
ataaggaagagggc

SEQ ID NO: 199401 - DNA, 11 bp, Homo sapiens
ataaggactgc

SEQ ID NO: 199402 - DNA, 21 bp, Homo sapiens
ataaggcttaggtgccaggct

SEQ ID NO: 199403 - DNA, 13 bp, Homo sapiens
ataagggagaggg

SEQ ID NO: 199404 - DNA, 19 bp, Homo sapiens
ataagtaatatctttcagt

SEQ ID NO: 199405 - DNA, 14 bp, Homo sapiens
ataagtggaaaaaa

SEQ ID NO: 199406 - DNA, 22 bp, Homo sapiens
ataagtggaaaaaagagaaaaa

SEQ ID NO: 199407 - DNA, 14 bp, Homo sapiens
ataagttaaaggca

SEQ ID NO: 199408 - DNA, 17 bp, Homo sapiens
ataagttaacttccaat

SEQ ID NO: 199409 - DNA, 22 bp, Homo sapiens
ataagttaacttccaatttaca

SEQ ID NO: 199410 - DNA, 23 bp, Homo sapiens
catcagttactggtttcagttga

SEQ ID NO: 199411 - DNA, 15 bp, Homo sapiens
catcagttattcatt

SEQ ID NO: 199412 - DNA, 14 bp, Homo sapiens
catcataaaataaa

SEQ ID NO: 199413 - DNA, 18 bp, Homo sapiens
catcataaaataaagtat

SEQ ID NO: 199414 - DNA, 22 bp, Homo sapiens
catcataggctgacaccaagaa

SEQ ID NO: 199415 - DNA, 18 bp, Homo sapiens
catcatatgcctgacccc

SEQ ID NO: 199416 - DNA, 21 bp, Homo sapiens
catcatcaggcttggaatgaa

SEQ ID NO: 199417 - DNA, 11 bp, Homo sapiens
catcatctctg

SEQ ID NO: 199418 - DNA, 22 bp, Homo sapiens
catcatctctgcctttgagtgt

SEQ ID NO: 199419 - DNA, 18 bp, Homo sapiens
catcatctgtagatacta

SEQ ID NO: 199420 - DNA, 21 bp, Homo sapiens
catcatggattcattacagct

SEQ ID NO: 199421 - DNA, 23 bp, Homo sapiens
catcatgggggatttttcattct

SEQ ID NO: 199422 - DNA, 18 bp, Homo sapiens
catcatgtaccaagtgct

SEQ ID NO: 199423 - DNA, 16 bp, Homo sapiens
catcatgttattttat

SEQ ID NO: 199424 - DNA, 20 bp, Homo sapiens
catcatttctgtctttaaga

SEQ ID NO: 199425 - DNA, 20 bp, Homo sapiens
catcatttctttttgggaga

SEQ ID NO: 199426 - DNA, 19 bp, Homo sapiens
catccaaggcaaacaatcc

SEQ ID NO: 199427 - DNA, 15 bp, Homo sapiens
catccaatcctcact

SEQ ID NO: 199428 - DNA, 22 bp, Homo sapiens
catccacacaacaccaggactt

SEQ ID NO: 199429 - DNA, 14 bp, Homo sapiens
catccacattttaa

SEQ ID NO: 199430 - DNA, 17 bp, Homo sapiens
catccacattttaacag

SEQ ID NO: 199431 - DNA, 18 bp, Homo sapiens
catccacccagtgctgcc

SEQ ID NO: 199432 - DNA, 19 bp, Homo sapiens
catccacccagtgctgcca

SEQ ID NO: 199433 - DNA, 23 bp, Homo sapiens
catccacccagtgctgccatgcc

SEQ ID NO: 199434 - DNA, 20 bp, Homo sapiens
catccactaggtgcccagtc

SEQ ID NO: 199435 - DNA, 14 bp, Homo sapiens
catccactctaccc

SEQ ID NO: 199436 - DNA, 19 bp, Homo sapiens
catccactctaccctccca

SEQ ID NO: 199437 - DNA, 21 bp, Homo sapiens
catccagcatgtgtgtgtctc

SEQ ID NO: 199438 - DNA, 16 bp, Homo sapiens
catccagcctgtgtgt

SEQ ID NO: 199439 - DNA, 15 bp, Homo sapiens
catccaggcctgagg

SEQ ID NO: 199440 - DNA, 15 bp, Homo sapiens
catccaggtcctttc

SEQ ID NO: 199441 - DNA, 12 bp, Homo sapiens
catccataaatc

SEQ ID NO: 199442 - DNA, 17 bp, Homo sapiens
catccataaatccagtt

SEQ ID NO: 199443 - DNA, 16 bp, Homo sapiens
catccatctccaggga

SEQ ID NO: 199444 - DNA, 22 bp, Homo sapiens
catccatggagcacgaggcctt

SEQ ID NO: 199445 - DNA, 16 bp, Homo sapiens
catccatgtgtggact

SEQ ID NO: 199446 - DNA, 18 bp, Homo sapiens
catccatgtgtggactca

SEQ ID NO: 199447 - DNA, 15 bp, Homo sapiens
catccatgtttgtaa

SEQ ID NO: 199448 - DNA, 17 bp, Homo sapiens
catcccaacagccaaga

SEQ ID NO: 199449 - DNA, 14 bp, Homo sapiens
catcccacaccctg

SEQ ID NO: 199450 - DNA, 13 bp, Homo sapiens
catcccactgata

SEQ ID NO: 199451 - DNA, 17 bp, Homo sapiens
catcccagcctgtggtt

SEQ ID NO: 199452 - DNA, 19 bp, Homo sapiens
catcccaggaggggcctct

SEQ ID NO: 199453 - DNA, 22 bp, Homo sapiens
catcccaggaggggcctctgaa

SEQ ID NO: 199454 - DNA, 20 bp, Homo sapiens
catcccagtggcctcaaccc

SEQ ID NO: 199455 - DNA, 12 bp, Homo sapiens
catcccatcatc

SEQ ID NO: 199456 - DNA, 15 bp, Homo sapiens
catccccaactccat

SEQ ID NO: 199457 - DNA, 20 bp, Homo sapiens
catccccaactccatggggt

SEQ ID NO: 199458 - DNA, 12 bp, Homo sapiens
catccccagccc

SEQ ID NO: 199459 - DNA, 15 bp, Homo sapiens
catccccagccccct

SEQ ID NO: 199460 - DNA, 15 bp, Homo sapiens
catccccatcctcca

SEQ ID NO: 199461 - DNA, 21 bp, Homo sapiens
catccccatcctccagcttct

SEQ ID NO: 199462 - DNA, 12 bp, Homo sapiens
catcccccaaag

SEQ ID NO: 199463 - DNA, 11 bp, Homo sapiens
catccccctcc

SEQ ID NO: 199464 - DNA, 13 bp, Homo sapiens
catccccctcctt

SEQ ID NO: 199465 - DNA, 17 bp, Homo sapiens
catcccctccctgcctg

SEQ ID NO: 199466 - DNA, 20 bp, Homo sapiens
catcccctccctgcctgctc

SEQ ID NO: 199467 - DNA, 21 bp, Homo sapiens
catcccctccctgcctgctcc

SEQ ID NO: 199468 - DNA, 16 bp, Homo sapiens
catcccctcctagcac

SEQ ID NO: 199469 - DNA, 20 bp, Homo sapiens
catcccctcgtcctgtccca

SEQ ID NO: 199470 - DNA, 15 bp, Homo sapiens
catcccctttattaa

SEQ ID NO: 199471 - DNA, 13 bp, Homo sapiens
catcccggcctct

SEQ ID NO: 199472 - DNA, 16 bp, Homo sapiens
catcccggtgcatgca

SEQ ID NO: 199473 - DNA, 15 bp, Homo sapiens
catccctgaaacatt

SEQ ID NO: 199474 - DNA, 12 bp, Homo sapiens
catccctgccaa

SEQ ID NO: 199475 - DNA, 13 bp, Homo sapiens
catccctgtgagc

SEQ ID NO: 199476 - DNA, 18 bp, Homo sapiens
catcccttggcccctctc

SEQ ID NO: 199477 - DNA, 18 bp, Homo sapiens
catccgcctctgagccag

SEQ ID NO: 199478 - DNA, 16 bp, Homo sapiens
catcctaaaagccacc

SEQ ID NO: 199479 - DNA, 17 bp, Homo sapiens
catcctactcctacctg

SEQ ID NO: 199480 - DNA, 21 bp, Homo sapiens
catcctatcgatctggaaaga

SEQ ID NO: 199481 - DNA, 19 bp, Homo sapiens
ataattgtgtacaaagtag

SEQ ID NO: 199482 - DNA, 15 bp, Homo sapiens
ataatttattttgta

SEQ ID NO: 199483 - DNA, 18 bp, Homo sapiens
ataatttcttactaaaca

SEQ ID NO: 199484 - DNA, 12 bp, Homo sapiens
ataatttgcata

SEQ ID NO: 199485 - DNA, 18 bp, Homo sapiens
ataatttgcatattctat

SEQ ID NO: 199486 - DNA, 11 bp, Homo sapiens
ataattttaaa

SEQ ID NO: 199487 - DNA, 15 bp, Homo sapiens
ataattttaaaattg

SEQ ID NO: 199488 - DNA, 16 bp, Homo sapiens
ataattttaaaattgc

SEQ ID NO: 199489 - DNA, 14 bp, Homo sapiens
ataattttaagaaa

SEQ ID NO: 199490 - DNA, 15 bp, Homo sapiens
ataattttaagaaat

SEQ ID NO: 199491 - DNA, 16 bp, Homo sapiens
ataattttgcataaaa

SEQ ID NO: 199492 - DNA, 21 bp, Homo sapiens
ataattttgcataaaattgga

SEQ ID NO: 199493 - DNA, 22 bp, Homo sapiens
ataattttttagttaaaatcta

SEQ ID NO: 199494 - DNA, 23 bp, Homo sapiens
ataatttttttattactgatttt

SEQ ID NO: 199495 - DNA, 21 bp, Homo sapiens
ataatttttttcaatatttat

SEQ ID NO: 199496 - DNA, 16 bp, Homo sapiens
atacaaaaatatatta

SEQ ID NO: 199497 - DNA, 13 bp, Homo sapiens
atacaaacaggtg

SEQ ID NO: 199498 - DNA, 15 bp, Homo sapiens
atacaaacaggtgct

SEQ ID NO: 199499 - DNA, 14 bp, Homo sapiens
atacaaactttgtt

SEQ ID NO: 199500 - DNA, 15 bp, Homo sapiens
atacaaactttgttt

SEQ ID NO: 199501 - DNA, 22 bp, Homo sapiens
atacaaatgggggcggctggaa

SEQ ID NO: 199502 - DNA, 19 bp, Homo sapiens
atacaaattttcagaaggt

SEQ ID NO: 199503 - DNA, 18 bp, Homo sapiens
atacaagccaagctagaa

SEQ ID NO: 199504 - DNA, 22 bp, Homo sapiens
atacaaggagggcctctggtgt

SEQ ID NO: 199505 - DNA, 17 bp, Homo sapiens
atacaagttctatttaa

SEQ ID NO: 199506 - DNA, 12 bp, Homo sapiens
atacaagtttca

SEQ ID NO: 199507 - DNA, 18 bp, Homo sapiens
atacaagtttcagacagg

SEQ ID NO: 199508 - DNA, 10 bp, Homo sapiens
atacaataaa

SEQ ID NO: 199509 - DNA, 20 bp, Homo sapiens
atacaataaactattggaaa

SEQ ID NO: 199510 - DNA, 12 bp, Homo sapiens
atacaatcagct

SEQ ID NO: 199511 - DNA, 13 bp, Homo sapiens
atacaatcagctg

SEQ ID NO: 199512 - DNA, 21 bp, Homo sapiens
atacaatcagctgctttgtta

SEQ ID NO: 199513 - DNA, 17 bp, Homo sapiens
atacaatggtttctgaa

SEQ ID NO: 199514 - DNA, 20 bp, Homo sapiens
atacaatggtttctgaaaga

SEQ ID NO: 199515 - DNA, 15 bp, Homo sapiens
atacaattaaaggtc

SEQ ID NO: 199516 - DNA, 23 bp, Homo sapiens
atacaattaaaggtcctgccctc

SEQ ID NO: 199517 - DNA, 13 bp, Homo sapiens
atacaattcagtt

SEQ ID NO: 199518 - DNA, 17 bp, Homo sapiens
atacaattcagttttag

SEQ ID NO: 199519 - DNA, 18 bp, Homo sapiens
atacacaagagggactgt

SEQ ID NO: 199520 - DNA, 21 bp, Homo sapiens
atacacaagagggactgtatt

SEQ ID NO: 199521 - DNA, 22 bp, Homo sapiens
atacacaagagggactgtattt

SEQ ID NO: 199522 - DNA, 20 bp, Homo sapiens
atacaccacctcactcctgt

SEQ ID NO: 199523 - DNA, 18 bp, Homo sapiens
atacaccgggcctggaga

SEQ ID NO: 199524 - DNA, 19 bp, Homo sapiens
atacactaattcctttcta

SEQ ID NO: 199525 - DNA, 13 bp, Homo sapiens
atacactacaaat

SEQ ID NO: 199526 - DNA, 15 bp, Homo sapiens
atacactacaaatgt

SEQ ID NO: 199527 - DNA, 12 bp, Homo sapiens
atacactcctgc

SEQ ID NO: 199528 - DNA, 15 bp, Homo sapiens
atacactcctgctgt

SEQ ID NO: 199529 - DNA, 14 bp, Homo sapiens
atacactgtatcta

SEQ ID NO: 199530 - DNA, 15 bp, Homo sapiens
atacactgtatctaa

SEQ ID NO: 199531 - DNA, 16 bp, Homo sapiens
atacactgtatctaaa

SEQ ID NO: 199532 - DNA, 15 bp, Homo sapiens
atacagacactaagt

SEQ ID NO: 199533 - DNA, 19 bp, Homo sapiens
atacagacactaagttata

SEQ ID NO: 199534 - DNA, 16 bp, Homo sapiens
atacagacctaatatc

SEQ ID NO: 199535 - DNA, 19 bp, Homo sapiens
atacagatccgcatgtgtc

SEQ ID NO: 199536 - DNA, 14 bp, Homo sapiens
atacagatgaaaat

SEQ ID NO: 199537 - DNA, 17 bp, Homo sapiens
atacaggaaaaacaaaa

SEQ ID NO: 199538 - DNA, 12 bp, Homo sapiens
atacagtacaca

SEQ ID NO: 199539 - DNA, 15 bp, Homo sapiens
atacagtacagtggt

SEQ ID NO: 199540 - DNA, 15 bp, Homo sapiens
atacagtattctgta

SEQ ID NO: 199541 - DNA, 21 bp, Homo sapiens
atagatcttctgaaatgaaac

SEQ ID NO: 199542 - DNA, 19 bp, Homo sapiens
atagatgtccctttcttgg

SEQ ID NO: 199543 - DNA, 23 bp, Homo sapiens
atagattagattatattgagaca

SEQ ID NO: 199544 - DNA, 19 bp, Homo sapiens
atagattcacctgtaaaac

SEQ ID NO: 199545 - DNA, 22 bp, Homo sapiens
atagattcacctgtaaaacttt

SEQ ID NO: 199546 - DNA, 23 bp, Homo sapiens
atagattcacctgtaaaacttta

SEQ ID NO: 199547 - DNA, 14 bp, Homo sapiens
atagatttttagat

SEQ ID NO: 199548 - DNA, 18 bp, Homo sapiens
atagcaacctatttgact

SEQ ID NO: 199549 - DNA, 22 bp, Homo sapiens
atagcagattttaattttgaat

SEQ ID NO: 199550 - DNA, 22 bp, Homo sapiens
atagcagggctgggctctgtct

SEQ ID NO: 199551 - DNA, 20 bp, Homo sapiens
atagcatgtaatattaaatt

SEQ ID NO: 199552 - DNA, 13 bp, Homo sapiens
atagcatgtaatg

SEQ ID NO: 199553 - DNA, 12 bp, Homo sapiens
atagcattgctt

SEQ ID NO: 199554 - DNA, 19 bp, Homo sapiens
atagcatttttgatttatg

SEQ ID NO: 199555 - DNA, 13 bp, Homo sapiens
atagccagagagg

SEQ ID NO: 199556 - DNA, 22 bp, Homo sapiens
atagccagagaggagcacctga

SEQ ID NO: 199557 - DNA, 15 bp, Homo sapiens
atagccatttgcccc

SEQ ID NO: 199558 - DNA, 20 bp, Homo sapiens
atagcgggttactttcacat

SEQ ID NO: 199559 - DNA, 21 bp, Homo sapiens
atagcgttggaattaaaacaa

SEQ ID NO: 199560 - DNA, 16 bp, Homo sapiens
atagctacaggaagca

SEQ ID NO: 199561 - DNA, 14 bp, Homo sapiens
atagctacccacag

SEQ ID NO: 199562 - DNA, 21 bp, Homo sapiens
atagctacccacagagcaagt

SEQ ID NO: 199563 - DNA, 16 bp, Homo sapiens
atagctactatatgca

SEQ ID NO: 199564 - DNA, 23 bp, Homo sapiens
atagctactatatgcataaacaa

SEQ ID NO: 199565 - DNA, 14 bp, Homo sapiens
atagctataaatag

SEQ ID NO: 199566 - DNA, 17 bp, Homo sapiens
atagctataaatagtga

SEQ ID NO: 199567 - DNA, 18 bp, Homo sapiens
atagctataaatagtgaa

SEQ ID NO: 199568 - DNA, 23 bp, Homo sapiens
atagctatatccatgtactgtag

SEQ ID NO: 199569 - DNA, 18 bp, Homo sapiens
atagctattactgtctgg

SEQ ID NO: 199570 - DNA, 22 bp, Homo sapiens
atagctcagtttatccaaggtg

SEQ ID NO: 199571 - DNA, 23 bp, Homo sapiens
atagctccccgcttctgcctgca

SEQ ID NO: 199572 - DNA, 19 bp, Homo sapiens
atagctctacacaacatgt

SEQ ID NO: 199573 - DNA, 20 bp, Homo sapiens
atagctctacacaacatgta

SEQ ID NO: 199574 - DNA, 22 bp, Homo sapiens
atagctctacacaacatgtatg

SEQ ID NO: 199575 - DNA, 22 bp, Homo sapiens
atagctggtcttatttgtaaag

SEQ ID NO: 199576 - DNA, 21 bp, Homo sapiens
atagctgtatatttgaaactg

SEQ ID NO: 199577 - DNA, 16 bp, Homo sapiens
atagcttaactaattt

SEQ ID NO: 199578 - DNA, 20 bp, Homo sapiens
atagcttaactaatttgaat

SEQ ID NO: 199579 - DNA, 22 bp, Homo sapiens
atagcttacaagccagctggag

SEQ ID NO: 199580 - DNA, 18 bp, Homo sapiens
atagcttcatcttgagcc

SEQ ID NO: 199581 - DNA, 14 bp, Homo sapiens
atagcttgaaacat

SEQ ID NO: 199582 - DNA, 17 bp, Homo sapiens
atagcttgtatagtgta

SEQ ID NO: 199583 - DNA, 23 bp, Homo sapiens
atagctttattttttaagtattt

SEQ ID NO: 199584 - DNA, 15 bp, Homo sapiens
atagcttttattgta

SEQ ID NO: 199585 - DNA, 22 bp, Homo sapiens
ataggaaagatttaatgttaca

SEQ ID NO: 199586 - DNA, 13 bp, Homo sapiens
ataggaattcatc

SEQ ID NO: 199587 - DNA, 16 bp, Homo sapiens
ataggagacttgtaca

SEQ ID NO: 199588 - DNA, 15 bp, Homo sapiens
ataggagcttccaga

SEQ ID NO: 199589 - DNA, 16 bp, Homo sapiens
ataggcaaggatgaaa

SEQ ID NO: 199590 - DNA, 17 bp, Homo sapiens
ataggcaaggatgaaag

SEQ ID NO: 199591 - DNA, 21 bp, Homo sapiens
ataggcaaggatgaaagacaa

SEQ ID NO: 199592 - DNA, 20 bp, Homo sapiens
ataggcagcactgaaatatc

SEQ ID NO: 199593 - DNA, 22 bp, Homo sapiens
ataggcccaaggtcccctccac

SEQ ID NO: 199594 - DNA, 11 bp, Homo sapiens
ataggctctgc

SEQ ID NO: 199595 - DNA, 15 bp, Homo sapiens
ataggctctgcacag

SEQ ID NO: 199596 - DNA, 18 bp, Homo sapiens
atagggtggacagaagct

SEQ ID NO: 199597 - DNA, 16 bp, Homo sapiens
ataggtaatcaatgaa

SEQ ID NO: 199598 - DNA, 23 bp, Homo sapiens
ataggtaatcaatgaatattgaa

SEQ ID NO: 199599 - DNA, 17 bp, Homo sapiens
ataggtaattaaggcag

SEQ ID NO: 199600 - DNA, 12 bp, Homo sapiens
ataggtttagag

SEQ ID NO: 199601 - DNA, 15 bp, Homo sapiens
atagtaagcctccct

SEQ ID NO: 199602 - DNA, 23 bp, Homo sapiens
atagtaagttactgggcattctc

SEQ ID NO: 199603 - DNA, 18 bp, Homo sapiens
atagtaccttcaatactt

SEQ ID NO: 199604 - DNA, 18 bp, Homo sapiens
atagtacctttgctcttg

SEQ ID NO: 199605 - DNA, 20 bp, Homo sapiens
atagtagcagagtcattgtt

SEQ ID NO: 199606 - DNA, 23 bp, Homo sapiens
atagtagcagagtcattgttaca

SEQ ID NO: 199607 - DNA, 16 bp, Homo sapiens
atagtagcatacattt

SEQ ID NO: 199608 - DNA, 17 bp, Homo sapiens
atagtagcatacattta

SEQ ID NO: 199609 - DNA, 15 bp, Homo sapiens
atagtagtaaaatta

SEQ ID NO: 199610 - DNA, 13 bp, Homo sapiens
atagtattaacta

SEQ ID NO: 199611 - DNA, 22 bp, Homo sapiens
atagtattccattgtgtgagtg

SEQ ID NO: 199612 - DNA, 17 bp, Homo sapiens
atagtcaatcaaacagg

SEQ ID NO: 199613 - DNA, 18 bp, Homo sapiens
atagtcaatcaaacaggg

SEQ ID NO: 199614 - DNA, 17 bp, Homo sapiens
atagtcaatttctactt

SEQ ID NO: 199615 - DNA, 12 bp, Homo sapiens
atagtcccagca

SEQ ID NO: 199616 - DNA, 20 bp, Homo sapiens
atagtctctacctatagaaa

SEQ ID NO: 199617 - DNA, 13 bp, Homo sapiens
atagtctttcagt

SEQ ID NO: 199618 - DNA, 16 bp, Homo sapiens
atagtgaaaagtagag

SEQ ID NO: 199619 - DNA, 12 bp, Homo sapiens
atagtgaatttt

SEQ ID NO: 199620 - DNA, 20 bp, Homo sapiens
atagtgaattttaaaatgta

SEQ ID NO: 199621 - DNA, 13 bp, Homo sapiens
atagtgccaggtg

SEQ ID NO: 199622 - DNA, 18 bp, Homo sapiens
atagtgccaggtggctca

SEQ ID NO: 199623 - DNA, 16 bp, Homo sapiens
catgaaaatcctacca

SEQ ID NO: 199624 - DNA, 16 bp, Homo sapiens
catgaaaatgtgtgtt

SEQ ID NO: 199625 - DNA, 19 bp, Homo sapiens
catgaaaggtaatctgaaa

SEQ ID NO: 199626 - DNA, 15 bp, Homo sapiens
catgaaatatgcatc

SEQ ID NO: 199627 - DNA, 12 bp, Homo sapiens
catgaacaaaat

SEQ ID NO: 199628 - DNA, 16 bp, Homo sapiens
catgaacatgttcctg

SEQ ID NO: 199629 - DNA, 14 bp, Homo sapiens
catgaagaatgcat

SEQ ID NO: 199630 - DNA, 18 bp, Homo sapiens
catgaagaatgcattcaa

SEQ ID NO: 199631 - DNA, 15 bp, Homo sapiens
catgaagattttctt

SEQ ID NO: 199632 - DNA, 13 bp, Homo sapiens
catgaagccttgc

SEQ ID NO: 199633 - DNA, 17 bp, Homo sapiens
catgaagctcagtttgg

SEQ ID NO: 199634 - DNA, 14 bp, Homo sapiens
catgaatctgtctc

SEQ ID NO: 199635 - DNA, 15 bp, Homo sapiens
catgaatgaatgaac

SEQ ID NO: 199636 - DNA, 22 bp, Homo sapiens
catgaatgtaaatttgtactat

SEQ ID NO: 199637 - DNA, 13 bp, Homo sapiens
catgaatgtatca

SEQ ID NO: 199638 - DNA, 18 bp, Homo sapiens
catgaatgtatcaggaaa

SEQ ID NO: 199639 - DNA, 15 bp, Homo sapiens
catgaattaagaact

SEQ ID NO: 199640 - DNA, 16 bp, Homo sapiens
catgaattcatactct

SEQ ID NO: 199641 - DNA, 17 bp, Homo sapiens
catgaattcatactctg

SEQ ID NO: 199642 - DNA, 20 bp, Homo sapiens
catgaattcatactctgttg

SEQ ID NO: 199643 - DNA, 16 bp, Homo sapiens
catgaatttaatgtct

SEQ ID NO: 199644 - DNA, 14 bp, Homo sapiens
catgaatttctgcc

SEQ ID NO: 199645 - DNA, 13 bp, Homo sapiens
catgaattttaca

SEQ ID NO: 199646 - DNA, 21 bp, Homo sapiens
catgacaactttgccagcttt

SEQ ID NO: 199647 - DNA, 17 bp, Homo sapiens
catgacaagccccaggc

SEQ ID NO: 199648 - DNA, 20 bp, Homo sapiens
catgacaagccccaggcagg

SEQ ID NO: 199649 - DNA, 16 bp, Homo sapiens
catgacagctactaac

SEQ ID NO: 199650 - DNA, 18 bp, Homo sapiens
catgacagtagcatactg

SEQ ID NO: 199651 - DNA, 16 bp, Homo sapiens
catgacatgttatata

SEQ ID NO: 199652 - DNA, 17 bp, Homo sapiens
catgacatgttatatat

SEQ ID NO: 199653 - DNA, 18 bp, Homo sapiens
catgaccactgggcctgc

SEQ ID NO: 199654 - DNA, 12 bp, Homo sapiens
catgaccaggcc

SEQ ID NO: 199655 - DNA, 15 bp, Homo sapiens
catgaccctggagcc

SEQ ID NO: 199656 - DNA, 14 bp, Homo sapiens
catgacctgtgacc

SEQ ID NO: 199657 - DNA, 22 bp, Homo sapiens
catgaccttttggcctttgtaa

SEQ ID NO: 199658 - DNA, 23 bp, Homo sapiens
catgactcgtatatgtctcaggt

SEQ ID NO: 199659 - DNA, 18 bp, Homo sapiens
catgactgcacccagctc

SEQ ID NO: 199660 - DNA, 20 bp, Homo sapiens
catgactgcacccagctcca

SEQ ID NO: 199661 - DNA, 16 bp, Homo sapiens
catgactgcattttac

SEQ ID NO: 199662 - DNA, 21 bp, Homo sapiens
catgactgccccttgcttctc

SEQ ID NO: 199663 - DNA, 18 bp, Homo sapiens
catgactggctgtctgcc

SEQ ID NO: 199664 - DNA, 22 bp, Homo sapiens
catgactggctgtctgcctgta

SEQ ID NO: 199665 - DNA, 20 bp, Homo sapiens
catgactgggcctcccttgg

SEQ ID NO: 199666 - DNA, 13 bp, Homo sapiens
catgactgtgacc

SEQ ID NO: 199667 - DNA, 15 bp, Homo sapiens
catgacttttccatg

SEQ ID NO: 199668 - DNA, 21 bp, Homo sapiens
catgacttttccatgtatcta

SEQ ID NO: 199669 - DNA, 14 bp, Homo sapiens
catgagacacatct

SEQ ID NO: 199670 - DNA, 19 bp, Homo sapiens
catgagcacctccagctgt

SEQ ID NO: 199671 - DNA, 19 bp, Homo sapiens
attaaacacctgacacatc

SEQ ID NO: 199672 - DNA, 16 bp, Homo sapiens
attaaacccacaagct

SEQ ID NO: 199673 - DNA, 16 bp, Homo sapiens
attaaacgtcattcag

SEQ ID NO: 199674 - DNA, 14 bp, Homo sapiens
attaaactctcctt

SEQ ID NO: 199675 - DNA, 15 bp, Homo sapiens
attaaactgtatgtc

SEQ ID NO: 199676 - DNA, 16 bp, Homo sapiens
attaaactgtatgtct

SEQ ID NO: 199677 - DNA, 12 bp, Homo sapiens
attaaacttcac

SEQ ID NO: 199678 - DNA, 14 bp, Homo sapiens
attaaacttcacct

SEQ ID NO: 199679 - DNA, 21 bp, Homo sapiens
attaaagaaaaaccacagata

SEQ ID NO: 199680 - DNA, 17 bp, Homo sapiens
attaaagggcagatatt

SEQ ID NO: 199681 - DNA, 12 bp, Homo sapiens
attaaataattt

SEQ ID NO: 199682 - DNA, 14 bp, Homo sapiens
attaaataatttta

SEQ ID NO: 199683 - DNA, 12 bp, Homo sapiens
attaaatacaga

SEQ ID NO: 199684 - DNA, 14 bp, Homo sapiens
attaaatacagaca

SEQ ID NO: 199685 - DNA, 19 bp, Homo sapiens
attaaatacagacactaag

SEQ ID NO: 199686 - DNA, 17 bp, Homo sapiens
attaaatactattttgc

SEQ ID NO: 199687 - DNA, 12 bp, Homo sapiens
attaaatattta

SEQ ID NO: 199688 - DNA, 13 bp, Homo sapiens
attaaatgaaata

SEQ ID NO: 199689 - DNA, 11 bp, Homo sapiens
attaaatggca

SEQ ID NO: 199690 - DNA, 24 bp, Homo sapiens
attaaattatatctgaggcactga

SEQ ID NO: 199691 - DNA, 24 bp, Homo sapiens
attaaattctctctaacataacaa

SEQ ID NO: 199692 - DNA, 19 bp, Homo sapiens
attaaatttaatatactgc

SEQ ID NO: 199693 - DNA, 17 bp, Homo sapiens
attaaatttctggattt

SEQ ID NO: 199694 - DNA, 18 bp, Homo sapiens
attaaattttgagttcta

SEQ ID NO: 199695 - DNA, 20 bp, Homo sapiens
attaaattttttaaaaagca

SEQ ID NO: 199696 - DNA, 20 bp, Homo sapiens
attaacaatttaacagagaa

SEQ ID NO: 199697 - DNA, 16 bp, Homo sapiens
attaacaggtctttga

SEQ ID NO: 199698 - DNA, 16 bp, Homo sapiens
attaacagttttccat

SEQ ID NO: 199699 - DNA, 23 bp, Homo sapiens
attaacagttttccatgaaaacg

SEQ ID NO: 199700 - DNA, 17 bp, Homo sapiens
attaaccaaagaaagtg

SEQ ID NO: 199701 - DNA, 20 bp, Homo sapiens
attaaccagctgatttttct

SEQ ID NO: 199702 - DNA, 14 bp, Homo sapiens
attaacctacctgt

SEQ ID NO: 199703 - DNA, 15 bp, Homo sapiens
attaacctacctgtg

SEQ ID NO: 199704 - DNA, 13 bp, Homo sapiens
attaacctctgca

SEQ ID NO: 199705 - DNA, 16 bp, Homo sapiens
attaacctgcatgcag

SEQ ID NO: 199706 - DNA, 18 bp, Homo sapiens
attaactccgtttccaaa

SEQ ID NO: 199707 - DNA, 19 bp, Homo sapiens
attaactgaagcaaatacc

SEQ ID NO: 199708 - DNA, 18 bp, Homo sapiens
attaacttctattttcaa

SEQ ID NO: 199709 - DNA, 17 bp, Homo sapiens
attaagaatagtctctg

SEQ ID NO: 199710 - DNA, 11 bp, Homo sapiens
attaagacttt

SEQ ID NO: 199711 - DNA, 23 bp, Homo sapiens
attaagatggattctcagatatt

SEQ ID NO: 199712 - DNA, 15 bp, Homo sapiens
attaagattttacaa

SEQ ID NO: 199713 - DNA, 16 bp, Homo sapiens
attaagctccttcagt

SEQ ID NO: 199714 - DNA, 14 bp, Homo sapiens
attaaggatcatag

SEQ ID NO: 199715 - DNA, 21 bp, Homo sapiens
attaaggcaactgaacaaaaa

SEQ ID NO: 199716 - DNA, 23 bp, Homo sapiens
attaaggtctgggagtgttctgt

SEQ ID NO: 199717 - DNA, 13 bp, Homo sapiens
attaagttatctt

SEQ ID NO: 199718 - DNA, 20 bp, Homo sapiens
attaagttctcaatgtgaaa

SEQ ID NO: 199719 - DNA, 16 bp, Homo sapiens
attaataaaaaatgga

SEQ ID NO: 199720 - DNA, 19 bp, Homo sapiens
attaataaaaaatggaaag

SEQ ID NO: 199721 - DNA, 22 bp, Homo sapiens
attaatacttacggttttaaat

SEQ ID NO: 199722 - DNA, 13 bp, Homo sapiens
attaatagctttt

SEQ ID NO: 199723 - DNA, 22 bp, Homo sapiens
attaatagtaggattattccta

SEQ ID NO: 199724 - DNA, 13 bp, Homo sapiens
attaatatgagtt

SEQ ID NO: 199725 - DNA, 15 bp, Homo sapiens
attaatattattatg

SEQ ID NO: 199726 - DNA, 23 bp, Homo sapiens
attaatcaatcatctgtgtgaaa

SEQ ID NO: 199727 - DNA, 18 bp, Homo sapiens
attaatcacctctctgta

SEQ ID NO: 199728 - DNA, 20 bp, Homo sapiens
attaatctctaaaattctag

SEQ ID NO: 199729 - DNA, 22 bp, Homo sapiens
attaatctctaaaattctagtc

SEQ ID NO: 199730 - DNA, 17 bp, Homo sapiens
attaatctgggaaggca

SEQ ID NO: 199731 - DNA, 23 bp, Homo sapiens
attaatctttctttacctgagac

SEQ ID NO: 199732 - DNA, 18 bp, Homo sapiens
attaatgaactgtgacag

SEQ ID NO: 199733 - DNA, 22 bp, Homo sapiens
attaatgaactgtgacaggaag

SEQ ID NO: 199734 - DNA, 17 bp, Homo sapiens
attaatggcatgtaata

SEQ ID NO: 199735 - DNA, 12 bp, Homo sapiens
attaatgttaat

SEQ ID NO: 199736 - DNA, 15 bp, Homo sapiens
attaatgtttcttaa

SEQ ID NO: 199737 - DNA, 17 bp, Homo sapiens
attaatgtttcttaaat

SEQ ID NO: 199738 - DNA, 14 bp, Homo sapiens
attaattattgaaa

SEQ ID NO: 199739 - DNA, 19 bp, Homo sapiens
attaattcaccttccagtg

SEQ ID NO: 199740 - DNA, 18 bp, Homo sapiens
attaattgttttgcactt

SEQ ID NO: 199741 - DNA, 15 bp, Homo sapiens
attaatttatatttg

SEQ ID NO: 199742 - DNA, 15 bp, Homo sapiens
attaatttatcagat

SEQ ID NO: 199743 - DNA, 19 bp, Homo sapiens
attaatttatcagattgct

SEQ ID NO: 199744 - DNA, 18 bp, Homo sapiens
attaatttctctcaattt

SEQ ID NO: 199745 - DNA, 14 bp, Homo sapiens
attaatttcttcac

SEQ ID NO: 199746 - DNA, 16 bp, Homo sapiens
attaatttgtgtagat

SEQ ID NO: 199747 - DNA, 23 bp, Homo sapiens
attaatttttgtactttgcttct

SEQ ID NO: 199748 - DNA, 22 bp, Homo sapiens
attacaaacaaaggatttgaaa

SEQ ID NO: 199749 - DNA, 20 bp, Homo sapiens
attacaaatagaagcttctt

SEQ ID NO: 199750 - DNA, 14 bp, Homo sapiens
attacaacagcacg

SEQ ID NO: 199751 - DNA, 16 bp, Homo sapiens
attacaagtttcagta

SEQ ID NO: 199752 - DNA, 20 bp, Homo sapiens
attacacacgtgtgatgtat

SEQ ID NO: 199753 - DNA, 18 bp, Homo sapiens
attacactgtatttgtat

SEQ ID NO: 199754 - DNA, 17 bp, Homo sapiens
ccatgtggccccaggtg

SEQ ID NO: 199755 - DNA, 20 bp, Homo sapiens
ccatgtggccccaggtgcca

SEQ ID NO: 199756 - DNA, 13 bp, Homo sapiens
ccatgtggccttg

SEQ ID NO: 199757 - DNA, 15 bp, Homo sapiens
ccatgtggctgaaga

SEQ ID NO: 199758 - DNA, 15 bp, Homo sapiens
ccatgtgtggactca

SEQ ID NO: 199759 - DNA, 17 bp, Homo sapiens
ccatgtgttttgctttt

SEQ ID NO: 199760 - DNA, 15 bp, Homo sapiens
ccatgttgcatgcct

SEQ ID NO: 199761 - DNA, 19 bp, Homo sapiens
ccatgttgcatgcctatgt

SEQ ID NO: 199762 - DNA, 22 bp, Homo sapiens
ccatgttgggaaaaactggctt

SEQ ID NO: 199763 - DNA, 13 bp, Homo sapiens
ccatgtttgtaaa

SEQ ID NO: 199764 - DNA, 14 bp, Homo sapiens
ccatgtttgtaaaa

SEQ ID NO: 199765 - DNA, 14 bp, Homo sapiens
ccattaaaactgct

SEQ ID NO: 199766 - DNA, 23 bp, Homo sapiens
ccattaaccagggcaccaagccc

SEQ ID NO: 199767 - DNA, 13 bp, Homo sapiens
ccattaatttcaa

SEQ ID NO: 199768 - DNA, 12 bp, Homo sapiens
ccattcagaact

SEQ ID NO: 199769 - DNA, 21 bp, Homo sapiens
ccattcaggaacctggaccaa

SEQ ID NO: 199770 - DNA, 14 bp, Homo sapiens
ccattcagtctgca

SEQ ID NO: 199771 - DNA, 16 bp, Homo sapiens
ccattcagtctgcagc

SEQ ID NO: 199772 - DNA, 19 bp, Homo sapiens
ccattcatctgggctggca

SEQ ID NO: 199773 - DNA, 21 bp, Homo sapiens
ccattcatctgggctggcaga

SEQ ID NO: 199774 - DNA, 11 bp, Homo sapiens
ccattccctgt

SEQ ID NO: 199775 - DNA, 13 bp, Homo sapiens
ccattccctgtag

SEQ ID NO: 199776 - DNA, 20 bp, Homo sapiens
ccattcctttaaattctcca

SEQ ID NO: 199777 - DNA, 22 bp, Homo sapiens
ccattcctttaaattctccaac

SEQ ID NO: 199778 - DNA, 19 bp, Homo sapiens
ccattcgtctgtcccagag

SEQ ID NO: 199779 - DNA, 12 bp, Homo sapiens
ccattctagatc

SEQ ID NO: 199780 - DNA, 18 bp, Homo sapiens
ccattctagatcctgcac

SEQ ID NO: 199781 - DNA, 16 bp, Homo sapiens
ccattctataaattca

SEQ ID NO: 199782 - DNA, 12 bp, Homo sapiens
ccattctccctc

SEQ ID NO: 199783 - DNA, 20 bp, Homo sapiens
ccattctccctccatggcag

SEQ ID NO: 199784 - DNA, 22 bp, Homo sapiens
ccattctccctccatggcagga

SEQ ID NO: 199785 - DNA, 18 bp, Homo sapiens
ccattctcccttctctct

SEQ ID NO: 199786 - DNA, 22 bp, Homo sapiens
ccattctgctttcttgccacac

SEQ ID NO: 199787 - DNA, 22 bp, Homo sapiens
ccattcttggtcaagtttttct

SEQ ID NO: 199788 - DNA, 14 bp, Homo sapiens
ccattgacctcagc

SEQ ID NO: 199789 - DNA, 22 bp, Homo sapiens
ccattgacctcagctgcacatt

SEQ ID NO: 199790 - DNA, 22 bp, Homo sapiens
ccattgcaaaaggttaagccat

SEQ ID NO: 199791 - DNA, 17 bp, Homo sapiens
ccattgccaccaggaga

SEQ ID NO: 199792 - DNA, 17 bp, Homo sapiens
ccattggttaatctgga

SEQ ID NO: 199793 - DNA, 14 bp, Homo sapiens
ccattgtctcattg

SEQ ID NO: 199794 - DNA, 20 bp, Homo sapiens
ccattgtctttcctcccttc

SEQ ID NO: 199795 - DNA, 19 bp, Homo sapiens
ccattgtgaagcacctact

SEQ ID NO: 199796 - DNA, 21 bp, Homo sapiens
ccattgtgaatgttgtcctgt

SEQ ID NO: 199797 - DNA, 12 bp, Homo sapiens
ccattgtgtgag

SEQ ID NO: 199798 - DNA, 21 bp, Homo sapiens
ccatttaatcatttccagcaa

SEQ ID NO: 199799 - DNA, 18 bp, Homo sapiens
ccatttagtcctcacctt

SEQ ID NO: 199800 - DNA, 20 bp, Homo sapiens
ccatttattattttaatatt

SEQ ID NO: 199801 - DNA, 16 bp, Homo sapiens
attagaagaaaacata

SEQ ID NO: 199802 - DNA, 17 bp, Homo sapiens
attagaagaaaacatat

SEQ ID NO: 199803 - DNA, 18 bp, Homo sapiens
attagaagaaaacatata

SEQ ID NO: 199804 - DNA, 19 bp, Homo sapiens
attagaagaaaacatatat

SEQ ID NO: 199805 - DNA, 13 bp, Homo sapiens
attagaagaaaat

SEQ ID NO: 199806 - DNA, 20 bp, Homo sapiens
attagaagccaagacagtgg

SEQ ID NO: 199807 - DNA, 14 bp, Homo sapiens
attagacaatgtgg

SEQ ID NO: 199808 - DNA, 19 bp, Homo sapiens
attagacaatgtggaatta

SEQ ID NO: 199809 - DNA, 19 bp, Homo sapiens
attagactttagaaataaa

SEQ ID NO: 199810 - DNA, 12 bp, Homo sapiens
attagagatatt

SEQ ID NO: 199811 - DNA, 14 bp, Homo sapiens
attagattatattg

SEQ ID NO: 199812 - DNA, 16 bp, Homo sapiens
attagcaaggctgggt

SEQ ID NO: 199813 - DNA, 15 bp, Homo sapiens
attagcatgaaaggt

SEQ ID NO: 199814 - DNA, 19 bp, Homo sapiens
attagctagactaggagac

SEQ ID NO: 199815 - DNA, 15 bp, Homo sapiens
attaggaaaatatgg

SEQ ID NO: 199816 - DNA, 21 bp, Homo sapiens
attaggaagtgtaacagctga

SEQ ID NO: 199817 - DNA, 22 bp, Homo sapiens
attaggaagtgtaacagctgag

SEQ ID NO: 199818 - DNA, 18 bp, Homo sapiens
attagggctacattgtaa

SEQ ID NO: 199819 - DNA, 20 bp, Homo sapiens
attaggtctgcattttctca

SEQ ID NO: 199820 - DNA, 23 bp, Homo sapiens
attagtccaaatgtgatcaactg

SEQ ID NO: 199821 - DNA, 18 bp, Homo sapiens
attagtcctcacagccta

SEQ ID NO: 199822 - DNA, 17 bp, Homo sapiens
attagtgagatttgtat

SEQ ID NO: 199823 - DNA, 20 bp, Homo sapiens
attagtgagatttgtattta

SEQ ID NO: 199824 - DNA, 14 bp, Homo sapiens
attagttaatatat

SEQ ID NO: 199825 - DNA, 18 bp, Homo sapiens
attagttccctgtctctt

SEQ ID NO: 199826 - DNA, 21 bp, Homo sapiens
attagttccctgtctcttgaa

SEQ ID NO: 199827 - DNA, 19 bp, Homo sapiens
attataaaaatatcaaaaa

SEQ ID NO: 199828 - DNA, 17 bp, Homo sapiens
attataagcattgaaat

SEQ ID NO: 199829 - DNA, 10 bp, Homo sapiens
attataagga

SEQ ID NO: 199830 - DNA, 14 bp, Homo sapiens
attataaggactgc

SEQ ID NO: 199831 - DNA, 15 bp, Homo sapiens
attataaggactgca

SEQ ID NO: 199832 - DNA, 16 bp, Homo sapiens
attataaggactgcat

SEQ ID NO: 199833 - DNA, 15 bp, Homo sapiens
attataagtagattt

SEQ ID NO: 199834 - DNA, 15 bp, Homo sapiens
attataagtcacaaa

SEQ ID NO: 199835 - DNA, 11 bp, Homo sapiens
attataagttg

SEQ ID NO: 199836 - DNA, 13 bp, Homo sapiens
attataagttgac

SEQ ID NO: 199837 - DNA, 22 bp, Homo sapiens
attataatatactatatttatg

SEQ ID NO: 199838 - DNA, 22 bp, Homo sapiens
attataccaagagtatgagaaa

SEQ ID NO: 199839 - DNA, 15 bp, Homo sapiens
attatactaagaaaa

SEQ ID NO: 199840 - DNA, 17 bp, Homo sapiens
attatactaagaaaaga

SEQ ID NO: 199841 - DNA, 13 bp, Homo sapiens
attatagcatgta

SEQ ID NO: 199842 - DNA, 21 bp, Homo sapiens
attataggtaatcaatgaata

SEQ ID NO: 199843 - DNA, 13 bp, Homo sapiens
attatataggttg

SEQ ID NO: 199844 - DNA, 20 bp, Homo sapiens
attatataggttgtgcaaat

SEQ ID NO: 199845 - DNA, 23 bp, Homo sapiens
attatataggttgtgcaaattaa

SEQ ID NO: 199846 - DNA, 11 bp, Homo sapiens
attatatataa

SEQ ID NO: 199847 - DNA, 18 bp, Homo sapiens
attatatcagactgcttt

SEQ ID NO: 199848 - DNA, 16 bp, Homo sapiens
attatatctaattatt

SEQ ID NO: 199849 - DNA, 16 bp, Homo sapiens
attatatgatatgcat

SEQ ID NO: 199850 - DNA, 18 bp, Homo sapiens
attatatgatatgcatgt

SEQ ID NO: 199851 - DNA, 13 bp, Homo sapiens
attatatgtatta

SEQ ID NO: 199852 - DNA, 14 bp, Homo sapiens
attatattaaaata

SEQ ID NO: 199853 - DNA, 22 bp, Homo sapiens
attatcaagctaataaaatatc

SEQ ID NO: 199854 - DNA, 18 bp, Homo sapiens
attatcgccttttgacag

SEQ ID NO: 199855 - DNA, 20 bp, Homo sapiens
attatcgggaacagtgtttc

SEQ ID NO: 199856 - DNA, 12 bp, Homo sapiens
attatctgctgt

SEQ ID NO: 199857 - DNA, 19 bp, Homo sapiens
attatcttctggtgcatgt

SEQ ID NO: 199858 - DNA, 16 bp, Homo sapiens
attatgacagttatac

SEQ ID NO: 199859 - DNA, 17 bp, Homo sapiens
attatgacagttatact

SEQ ID NO: 199860 - DNA, 19 bp, Homo sapiens
attatgacagttatactgt

SEQ ID NO: 199861 - DNA, 20 bp, Homo sapiens
attatgagaggcaatgattg

SEQ ID NO: 199862 - DNA, 23 bp, Homo sapiens
attatgattttatttaaactatt

SEQ ID NO: 199863 - DNA, 19 bp, Homo sapiens
attatgccttttaaaaata

SEQ ID NO: 199864 - DNA, 22 bp, Homo sapiens
attatggacatcgatatgaaaa

SEQ ID NO: 199865 - DNA, 21 bp, Homo sapiens
attatgggaacaagtgtacag

SEQ ID NO: 199866 - DNA, 22 bp, Homo sapiens
attatgggaacaagtgtacaga

SEQ ID NO: 199867 - DNA, 15 bp, Homo sapiens
attatgggtcacagg

SEQ ID NO: 199868 - DNA, 11 bp, Homo sapiens
attatggtgaa

SEQ ID NO: 199869 - DNA, 15 bp, Homo sapiens
attatgtatgtttac

SEQ ID NO: 199870 - DNA, 17 bp, Homo sapiens
attatgtatgtttacat

SEQ ID NO: 199871 - DNA, 16 bp, Homo sapiens
attatgtcaaatggat

SEQ ID NO: 199872 - DNA, 15 bp, Homo sapiens
attatgtgacaacct

SEQ ID NO: 199873 - DNA, 21 bp, Homo sapiens
attatgtgacaacctttgtgt

SEQ ID NO: 199874 - DNA, 23 bp, Homo sapiens
attatgtgacaacctttgtgtaa

SEQ ID NO: 199875 - DNA, 22 bp, Homo sapiens
attatgttattgaaaaaaattg

SEQ ID NO: 199876 - DNA, 18 bp, Homo sapiens
attattaaatcagttttg

SEQ ID NO: 199877 - DNA, 20 bp, Homo sapiens
attattaactacatttatga

SEQ ID NO: 199878 - DNA, 20 bp, Homo sapiens
attattcaccatgtaaaaca

SEQ ID NO: 199879 - DNA, 15 bp, Homo sapiens
attattcagttaaga

SEQ ID NO: 199880 - DNA, 15 bp, Homo sapiens
attattcatagctgt

SEQ ID NO: 199881 - DNA, 19 bp, Homo sapiens
attattcatagctgtatat

SEQ ID NO: 199882 - DNA, 15 bp, Homo sapiens
attattcatttaaaa

SEQ ID NO: 199883 - DNA, 15 bp, Homo sapiens
attattccctgaatt

SEQ ID NO: 199884 - DNA, 16 bp, Homo sapiens
attattccctgaattg

SEQ ID NO: 199885 - DNA, 13 bp, Homo sapiens
attattcctccag

SEQ ID NO: 199886 - DNA, 12 bp, Homo sapiens
attattcctgca

SEQ ID NO: 199887 - DNA, 18 bp, Homo sapiens
attattctagtcaactgc

SEQ ID NO: 199888 - DNA, 22 bp, Homo sapiens
attattgaatgttatatcatca

SEQ ID NO: 199889 - DNA, 15 bp, Homo sapiens
attattggcttgcac

SEQ ID NO: 199890 - DNA, 12 bp, Homo sapiens
attattgtaaac

SEQ ID NO: 199891 - DNA, 15 bp, Homo sapiens
attattgtaaacttt

SEQ ID NO: 199892 - DNA, 22 bp, Homo sapiens
attattgttcccctaagtggat

SEQ ID NO: 199893 - DNA, 11 bp, Homo sapiens
cccaatcactg

SEQ ID NO: 199894 - DNA, 21 bp, Homo sapiens
cccaatcagcttttgttctag

SEQ ID NO: 199895 - DNA, 18 bp, Homo sapiens
cccaatccaacccatgca

SEQ ID NO: 199896 - DNA, 17 bp, Homo sapiens
cccaatcgggtccagag

SEQ ID NO: 199897 - DNA, 19 bp, Homo sapiens
cccaatcgggtccagagac

SEQ ID NO: 199898 - DNA, 22 bp, Homo sapiens
cccaattactattccctttgac

SEQ ID NO: 199899 - DNA, 14 bp, Homo sapiens
cccaattaggaagt

SEQ ID NO: 199900 - DNA, 15 bp, Homo sapiens
cccaattaggaagtg

SEQ ID NO: 199901 - DNA, 19 bp, Homo sapiens
cccaattaggaagtgtaac

SEQ ID NO: 199902 - DNA, 17 bp, Homo sapiens
cccaatttaagagtcct

SEQ ID NO: 199903 - DNA, 19 bp, Homo sapiens
cccacaaaatatttctaag

SEQ ID NO: 199904 - DNA, 14 bp, Homo sapiens
cccacaatgatgat

SEQ ID NO: 199905 - DNA, 13 bp, Homo sapiens
cccacacacccca

SEQ ID NO: 199906 - DNA, 13 bp, Homo sapiens
cccacacactcgc

SEQ ID NO: 199907 - DNA, 12 bp, Homo sapiens
cccacacaggcc

SEQ ID NO: 199908 - DNA, 14 bp, Homo sapiens
cccacacaggcctg

SEQ ID NO: 199909 - DNA, 18 bp, Homo sapiens
cccacacaggcctggccc

SEQ ID NO: 199910 - DNA, 12 bp, Homo sapiens
cccacacatatt

SEQ ID NO: 199911 - DNA, 13 bp, Homo sapiens
cccacaccccagc

SEQ ID NO: 199912 - DNA, 17 bp, Homo sapiens
cccacaccccgtctgcc

SEQ ID NO: 199913 - DNA, 13 bp, Homo sapiens
cccacacctcagt

SEQ ID NO: 199914 - DNA, 22 bp, Homo sapiens
cccacacctcagttcccttggc

SEQ ID NO: 199915 - DNA, 14 bp, Homo sapiens
cccacacctgcctc

SEQ ID NO: 199916 - DNA, 16 bp, Homo sapiens
cccacacgccggggct

SEQ ID NO: 199917 - DNA, 20 bp, Homo sapiens
cccacacgccggggctggcc

SEQ ID NO: 199918 - DNA, 22 bp, Homo sapiens
cccacacgccggggctggccct

SEQ ID NO: 199919 - DNA, 14 bp, Homo sapiens
cccacactaacctg

SEQ ID NO: 199920 - DNA, 15 bp, Homo sapiens
cccacactgctacac

SEQ ID NO: 199921 - DNA, 17 bp, Homo sapiens
cccacacttgttccagc

SEQ ID NO: 199922 - DNA, 14 bp, Homo sapiens
cccacagctacctg

SEQ ID NO: 199923 - DNA, 17 bp, Homo sapiens
cccacagcttcctgagg

SEQ ID NO: 199924 - DNA, 16 bp, Homo sapiens
cccacaggaggcaagc

SEQ ID NO: 199925 - DNA, 20 bp, Homo sapiens
cccacaggccacacgctgcc

SEQ ID NO: 199926 - DNA, 16 bp, Homo sapiens
cccacagggcctgact

SEQ ID NO: 199927 - DNA, 22 bp, Homo sapiens
cccacagtcctcacagcctctc

SEQ ID NO: 199928 - DNA, 15 bp, Homo sapiens
cccacatccagtggg

SEQ ID NO: 199929 - DNA, 14 bp, Homo sapiens
cccacatcccaggc

SEQ ID NO: 199930 - DNA, 22 bp, Homo sapiens
cccaccaaatgcctctgccttg

SEQ ID NO: 199931 - DNA, 15 bp, Homo sapiens
cccaccacacacacc

SEQ ID NO: 199932 - DNA, 15 bp, Homo sapiens
cccaccaccccagct

SEQ ID NO: 199933 - DNA, 18 bp, Homo sapiens
cccaccaccccagctgct

SEQ ID NO: 199934 - DNA, 22 bp, Homo sapiens
cccaccagaacgcaccccactg

SEQ ID NO: 199935 - DNA, 13 bp, Homo sapiens
cccaccagcagca

SEQ ID NO: 199936 - DNA, 14 bp, Homo sapiens
cccaccagggctca

SEQ ID NO: 199937 - DNA, 20 bp, Homo sapiens
cccaccagtcagggacagca

SEQ ID NO: 199938 - DNA, 23 bp, Homo sapiens
cccaccagtcagggacagcagcc

SEQ ID NO: 199939 - DNA, 13 bp, Homo sapiens
cccaccagtgcct

SEQ ID NO: 199940 - DNA, 18 bp, Homo sapiens
cccaccattccacatccc

SEQ ID NO: 199941 - DNA, 16 bp, Homo sapiens
cccacccacaccccgt

SEQ ID NO: 199942 - DNA, 13 bp, Homo sapiens
cccacccacctcc

SEQ ID NO: 199943 - DNA, 14 bp, Homo sapiens
cccacccacctcca

SEQ ID NO: 199944 - DNA, 15 bp, Homo sapiens
cccacccatcttcct

SEQ ID NO: 199945 - DNA, 17 bp, Homo sapiens
cccacccatcttcctgc

SEQ ID NO: 199946 - DNA, 20 bp, Homo sapiens
cccacccatcttcctgctgc

SEQ ID NO: 199947 - DNA, 14 bp, Homo sapiens
cccaccccaactct

SEQ ID NO: 199948 - DNA, 14 bp, Homo sapiens
cccaccccagccta

SEQ ID NO: 199949 - DNA, 14 bp, Homo sapiens
cccacccccgggtg

SEQ ID NO: 199950 - DNA, 21 bp, Homo sapiens
cccacccccgggtgcctgtga

SEQ ID NO: 199951 - DNA, 16 bp, Homo sapiens
cccacccctaagtgcc

SEQ ID NO: 199952 - DNA, 20 bp, Homo sapiens
cccacccctaagtgcccaaa

SEQ ID NO: 199953 - DNA, 16 bp, Homo sapiens
cccacccctacagcct

SEQ ID NO: 199954 - DNA, 15 bp, Homo sapiens
cccacccctccatga

SEQ ID NO: 199955 - DNA, 22 bp, Homo sapiens
cccacccctcctgggcccaggc

SEQ ID NO: 199956 - DNA, 17 bp, Homo sapiens
cccaccctaatttgccc

SEQ ID NO: 199957 - DNA, 20 bp, Homo sapiens
cccaccctaatttgcccttc

SEQ ID NO: 199958 - DNA, 19 bp, Homo sapiens
cccaccctcaaaccctgtg

SEQ ID NO: 199959 - DNA, 15 bp, Homo sapiens
cccaccctccatgct

SEQ ID NO: 199960 - DNA, 16 bp, Homo sapiens
cccaccctccatgctc

SEQ ID NO: 199961 - DNA, 22 bp, Homo sapiens
cccaccctcgtggacacctgcc

SEQ ID NO: 199962 - DNA, 12 bp, Homo sapiens
cccaccctctgg

SEQ ID NO: 199963 - DNA, 21 bp, Homo sapiens
cccaccctgctcctcctgccc

SEQ ID NO: 199964 - DNA, 14 bp, Homo sapiens
cccaccctgctgcc

SEQ ID NO: 199965 - DNA, 22 bp, Homo sapiens
cccaccctgggatgggccaccc

SEQ ID NO: 199966 - DNA, 19 bp, Homo sapiens
cccacccttctcccctgcc

SEQ ID NO: 199967 - DNA, 20 bp, Homo sapiens
cccacccttctcccctgccc

SEQ ID NO: 199968 - DNA, 20 bp, Homo sapiens
cccaccgatggagcccccag

SEQ ID NO: 199969 - DNA, 23 bp, Homo sapiens
cccaccgggctgggagctctgca

SEQ ID NO: 199970 - DNA, 19 bp, Homo sapiens
cccaccggttgcttctggg

SEQ ID NO: 199971 - DNA, 23 bp, Homo sapiens
cccaccggttgcttctgggaagg

SEQ ID NO: 199972 - DNA, 23 bp, Homo sapiens
cccacctaagggctaaggcctct

SEQ ID NO: 199973 - DNA, 13 bp, Homo sapiens
cccacctccaccc

SEQ ID NO: 199974 - DNA, 12 bp, Homo sapiens
cccacctccagc

SEQ ID NO: 199975 - DNA, 14 bp, Homo sapiens
cccacctccctgcc

SEQ ID NO: 199976 - DNA, 16 bp, Homo sapiens
cccacctccctgccca

SEQ ID NO: 199977 - DNA, 17 bp, Homo sapiens
cccacctccctgcccag

SEQ ID NO: 199978 - DNA, 19 bp, Homo sapiens
cccacctccctgcccaggc

SEQ ID NO: 199979 - DNA, 14 bp, Homo sapiens
cccacctcctccag

SEQ ID NO: 199980 - DNA, 23 bp, Homo sapiens
cccacctcgcggcgcagcccctg

SEQ ID NO: 199981 - DNA, 14 bp, Homo sapiens
cccacctgaaagcc

SEQ ID NO: 199982 - DNA, 18 bp, Homo sapiens
cccacctgaaagcctgtc

SEQ ID NO: 199983 - DNA, 21 bp, Homo sapiens
cccacctgacaatggcagcta

SEQ ID NO: 199984 - DNA, 13 bp, Homo sapiens
cccacctgagctt

SEQ ID NO: 199985 - DNA, 24 bp, Homo sapiens
cccacctgcatcagcctctggcca

SEQ ID NO: 199986 - DNA, 21 bp, Homo sapiens
cccacctgccactaggctggg

SEQ ID NO: 199987 - DNA, 13 bp, Homo sapiens
cccacctgcccag

SEQ ID NO: 199988 - DNA, 14 bp, Homo sapiens
cccacctgcccagt

SEQ ID NO: 199989 - DNA, 16 bp, Homo sapiens
cccacctgcccagtta

SEQ ID NO: 199990 - DNA, 20 bp, Homo sapiens
cccacctgcccatcacaggg

SEQ ID NO: 199991 - DNA, 23 bp, Homo sapiens
cccacctgcccatcacagggttg

SEQ ID NO: 199992 - DNA, 13 bp, Homo sapiens
cccacctgcctga

SEQ ID NO: 199993 - DNA, 13 bp, Homo sapiens
cccacctgggccc

SEQ ID NO: 199994 - DNA, 16 bp, Homo sapiens
cccacctgggctgggc

SEQ ID NO: 199995 - DNA, 20 bp, Homo sapiens
cccaccttgccaagctttct

SEQ ID NO: 199996 - DNA, 19 bp, Homo sapiens
cccaccttgttggagcctg

SEQ ID NO: 199997 - DNA, 20 bp, Homo sapiens
cccaccttgttggagcctgc

SEQ ID NO: 199998 - DNA, 21 bp, Homo sapiens
cccacctttgggatcagcctc

SEQ ID NO: 199999 - DNA, 22 bp, Homo sapiens
cccacctttgggatcagcctcc

SEQ ID NO: 200000 - DNA, 17 bp, Homo sapiens
cccacgagtcacctgca

SEQ ID NO: 200001 - DNA, 18 bp, Homo sapiens
cccacgagtcacctgcaa

SEQ ID NO: 200002 - DNA, 20 bp, Homo sapiens
cccacgagtcacctgcaagc

SEQ ID NO: 200003 - DNA, 22 bp, Homo sapiens
cccacgagtcacctgcaagccc

SEQ ID NO: 200004 - DNA, 19 bp, Homo sapiens
cccacgcagagccccggag

SEQ ID NO: 200005 - DNA, 20 bp, Homo sapiens
cccacgcagagccccggagc

SEQ ID NO: 200006 - DNA, 23 bp, Homo sapiens
cccacgcagagccccggagcacc

SEQ ID NO: 200007 - DNA, 13 bp, Homo sapiens
cccacggccaccc

SEQ ID NO: 200008 - DNA, 17 bp, Homo sapiens
cccacggccacccaccc

SEQ ID NO: 200009 - DNA, 19 bp, Homo sapiens
cccacggccacccaccctt

SEQ ID NO: 200010 - DNA, 13 bp, Homo sapiens
cccacggccactg

SEQ ID NO: 200011 - DNA, 20 bp, Homo sapiens
cccacggccactgcagtcac

SEQ ID NO: 200012 - DNA, 22 bp, Homo sapiens
cccacggccctgtcagagccgc

SEQ ID NO: 200013 - DNA, 19 bp, Homo sapiens
cccacggccgtccctgact

SEQ ID NO: 200014 - DNA, 23 bp, Homo sapiens
cccacggccgtccctgacttccc

SEQ ID NO: 200015 - DNA, 18 bp, Homo sapiens
cccacggctaagaggctg

SEQ ID NO: 200016 - DNA, 23 bp, Homo sapiens
cccacggctctcgtccctctgct

SEQ ID NO: 200017 - DNA, 19 bp, Homo sapiens
cccacgtctggccaggcac

SEQ ID NO: 200018 - DNA, 22 bp, Homo sapiens
cccacgttgacaccaagaaacc

SEQ ID NO: 200019 - DNA, 14 bp, Homo sapiens
cccactagccctct

SEQ ID NO: 200020 - DNA, 19 bp, Homo sapiens
cccactccctgccaccgtc

SEQ ID NO: 200021 - DNA, 22 bp, Homo sapiens
cccactccctgccaccgtcaca

SEQ ID NO: 200022 - DNA, 15 bp, Homo sapiens
cccactccctgtcca

SEQ ID NO: 200023 - DNA, 18 bp, Homo sapiens
cccactctgctcccagcc

SEQ ID NO: 200024 - DNA, 21 bp, Homo sapiens
cccactctgctttgactgagc

SEQ ID NO: 200025 - DNA, 10 bp, Homo sapiens
cccactgcac

SEQ ID NO: 200026 - DNA, 22 bp, Homo sapiens
cccactgccaggattttgtatt

SEQ ID NO: 200027 - DNA, 15 bp, Homo sapiens
attatttaaagaaag

SEQ ID NO: 200028 - DNA, 15 bp, Homo sapiens
attatttaaagcaca

SEQ ID NO: 200029 - DNA, 14 bp, Homo sapiens
attatttaactaat

SEQ ID NO: 200030 - DNA, 13 bp, Homo sapiens
attatttaataaa

SEQ ID NO: 200031 - DNA, 20 bp, Homo sapiens
attatttaatatgcatcttt

SEQ ID NO: 200032 - DNA, 22 bp, Homo sapiens
attatttgagtttgacatttaa

SEQ ID NO: 200033 - DNA, 12 bp, Homo sapiens
attatttgcttt

SEQ ID NO: 200034 - DNA, 14 bp, Homo sapiens
attatttgcttttc

SEQ ID NO: 200035 - DNA, 20 bp, Homo sapiens
attatttgcttttcatgtag

SEQ ID NO: 200036 - DNA, 18 bp, Homo sapiens
attatttgtgtaatagaa

SEQ ID NO: 200037 - DNA, 14 bp, Homo sapiens
attattttaaaaat

SEQ ID NO: 200038 - DNA, 13 bp, Homo sapiens
attattttaaaca

SEQ ID NO: 200039 - DNA, 16 bp, Homo sapiens
attattttaaattata

SEQ ID NO: 200040 - DNA, 16 bp, Homo sapiens
attattttaatattta

SEQ ID NO: 200041 - DNA, 17 bp, Homo sapiens
attattttaatatttat

SEQ ID NO: 200042 - DNA, 17 bp, Homo sapiens
attattttgtggttcta

SEQ ID NO: 200043 - DNA, 22 bp, Homo sapiens
attattttgtggttctatttta

SEQ ID NO: 200044 - DNA, 17 bp, Homo sapiens
attattttgttactgtc

SEQ ID NO: 200045 - DNA, 19 bp, Homo sapiens
attatttttccactttgtt

SEQ ID NO: 200046 - DNA, 22 bp, Homo sapiens
attatttttccactttgttctt

SEQ ID NO: 200047 - DNA, 17 bp, Homo sapiens
attatttttgtgtttct

SEQ ID NO: 200048 - DNA, 14 bp, Homo sapiens
attattttttatga

SEQ ID NO: 200049 - DNA, 14 bp, Homo sapiens
attcaaaaagtgtt

SEQ ID NO: 200050 - DNA, 14 bp, Homo sapiens
attcaaaactttca

SEQ ID NO: 200051 - DNA, 18 bp, Homo sapiens
attcaaaataaacaataa

SEQ ID NO: 200052 - DNA, 22 bp, Homo sapiens
attcaaaatagttctatttcta

SEQ ID NO: 200053 - DNA, 13 bp, Homo sapiens
attcaaacacaca

SEQ ID NO: 200054 - DNA, 14 bp, Homo sapiens
attcaaacacacag

SEQ ID NO: 200055 - DNA, 16 bp, Homo sapiens
attcaaacacacagta

SEQ ID NO: 200056 - DNA, 16 bp, Homo sapiens
attcaaacctgcatat

SEQ ID NO: 200057 - DNA, 12 bp, Homo sapiens
attcaaatgcat

SEQ ID NO: 200058 - DNA, 22 bp, Homo sapiens
attcaaatgcatgatattgtat

SEQ ID NO: 200059 - DNA, 18 bp, Homo sapiens
attcaacacttattttct

SEQ ID NO: 200060 - DNA, 19 bp, Homo sapiens
attcaaccactgtaaaatg

SEQ ID NO: 200061 - DNA, 22 bp, Homo sapiens
attcaaccactgtaaaatgaaa

SEQ ID NO: 200062 - DNA, 17 bp, Homo sapiens
attcaaccccagaaatt

SEQ ID NO: 200063 - DNA, 21 bp, Homo sapiens
attcaactctgtgtcccagca

SEQ ID NO: 200064 - DNA, 22 bp, Homo sapiens
attcaagaaaacaacttcaata

SEQ ID NO: 200065 - DNA, 18 bp, Homo sapiens
attcaagaaagatatcta

SEQ ID NO: 200066 - DNA, 13 bp, Homo sapiens
attcaagcaaaca

SEQ ID NO: 200067 - DNA, 22 bp, Homo sapiens
attcaagcaaacatcaaataaa

SEQ ID NO: 200068 - DNA, 16 bp, Homo sapiens
attcaagcctgtgaat

SEQ ID NO: 200069 - DNA, 22 bp, Homo sapiens
attcaagcctgtgaataaaaac

SEQ ID NO: 200070 - DNA, 15 bp, Homo sapiens
attcaagttattgta

SEQ ID NO: 200071 - DNA, 19 bp, Homo sapiens
attcaataaaatgcactga

SEQ ID NO: 200072 - DNA, 18 bp, Homo sapiens
attcaataactattgctg

SEQ ID NO: 200073 - DNA, 13 bp, Homo sapiens
attcaatatctga

SEQ ID NO: 200074 - DNA, 19 bp, Homo sapiens
attcaatcaacctgcactt

SEQ ID NO: 200075 - DNA, 14 bp, Homo sapiens
attcaattcctctg

SEQ ID NO: 200076 - DNA, 18 bp, Homo sapiens
attcaattcctctgggaa

SEQ ID NO: 200077 - DNA, 20 bp, Homo sapiens
attcaatttctcacaataga

SEQ ID NO: 200078 - DNA, 17 bp, Homo sapiens
attcacaaaaaaagtaa

SEQ ID NO: 200079 - DNA, 15 bp, Homo sapiens
attcacaagctgcct

SEQ ID NO: 200080 - DNA, 20 bp, Homo sapiens
attcacaagtcctgccaagt

SEQ ID NO: 200081 - DNA, 20 bp, Homo sapiens
attcacacacagcctggcct

SEQ ID NO: 200082 - DNA, 18 bp, Homo sapiens
attcacacagggctcttt

SEQ ID NO: 200083 - DNA, 20 bp, Homo sapiens
attcacacctcacgctctgg

SEQ ID NO: 200084 - DNA, 13 bp, Homo sapiens
attcacactgtgc

SEQ ID NO: 200085 - DNA, 21 bp, Homo sapiens
attcacagcacgggcacagct

SEQ ID NO: 200086 - DNA, 14 bp, Homo sapiens
attcaccaccctgg

SEQ ID NO: 200087 - DNA, 14 bp, Homo sapiens
attcaccatcatgt

SEQ ID NO: 200088 - DNA, 21 bp, Homo sapiens
attcaccatgtaaaacaaaaa

SEQ ID NO: 200089 - DNA, 14 bp, Homo sapiens
attcacctgtaaaa

SEQ ID NO: 200090 - DNA, 16 bp, Homo sapiens
attcacctgtaaaact

SEQ ID NO: 200091 - DNA, 18 bp, Homo sapiens
attcacctgtaaaacttt

SEQ ID NO: 200092 - DNA, 20 bp, Homo sapiens
attcactgaagttctcctga

SEQ ID NO: 200093 - DNA, 15 bp, Homo sapiens
attcactgcccccag

SEQ ID NO: 200094 - DNA, 20 bp, Homo sapiens
attcacttgtgtttgtatat

SEQ ID NO: 200095 - DNA, 22 bp, Homo sapiens
attcactttaccttcagcagtt

SEQ ID NO: 200096 - DNA, 19 bp, Homo sapiens
attcagaactctcagactc

SEQ ID NO: 200097 - DNA, 15 bp, Homo sapiens
attcagaacttgtaa

SEQ ID NO: 200098 - DNA, 17 bp, Homo sapiens
attcagagatgtaccat

SEQ ID NO: 200099 - DNA, 21 bp, Homo sapiens
attcagattaggacacagtgt

SEQ ID NO: 200100 - DNA, 20 bp, Homo sapiens
attcagcaccctgggtgcca

SEQ ID NO: 200101 - DNA, 21 bp, Homo sapiens
attcagcaccctgggtgccat

SEQ ID NO: 200102 - DNA, 21 bp, Homo sapiens
attcagcactgatttcacaac

SEQ ID NO: 200103 - DNA, 20 bp, Homo sapiens
attcagcccatttcacacct

SEQ ID NO: 200104 - DNA, 12 bp, Homo sapiens
attcagcttcat

SEQ ID NO: 200105 - DNA, 14 bp, Homo sapiens
attcaggaaaaatg

SEQ ID NO: 200106 - DNA, 18 bp, Homo sapiens
attcaggaacctggacca

SEQ ID NO: 200107 - DNA, 21 bp, Homo sapiens
attcaggacttaacggctcca

SEQ ID NO: 200108 - DNA, 16 bp, Homo sapiens
attcaggctgcttggg

SEQ ID NO: 200109 - DNA, 15 bp, Homo sapiens
attcagtactttatg

SEQ ID NO: 200110 - DNA, 13 bp, Homo sapiens
attcagtctgcag

SEQ ID NO: 200111 - DNA, 15 bp, Homo sapiens
attcagtgagggtct

SEQ ID NO: 200112 - DNA, 16 bp, Homo sapiens
attcagtgagggtctt

SEQ ID NO: 200113 - DNA, 21 bp, Homo sapiens
attcagtgagggtcttcttac

SEQ ID NO: 200114 - DNA, 14 bp, Homo sapiens
attcagttaagaaa

SEQ ID NO: 200115 - DNA, 17 bp, Homo sapiens
attcagttaagaaaaaa

SEQ ID NO: 200116 - DNA, 14 bp, Homo sapiens
attcatacagcact

SEQ ID NO: 200117 - DNA, 14 bp, Homo sapiens
attcatactctgtt

SEQ ID NO: 200118 - DNA, 21 bp, Homo sapiens
attcatactctgttgcctcct

SEQ ID NO: 200119 - DNA, 22 bp, Homo sapiens
attcatactctgttgcctcctc

SEQ ID NO: 200120 - DNA, 16 bp, Homo sapiens
attcatagaagggcta

SEQ ID NO: 200121 - DNA, 17 bp, Homo sapiens
attcatagcatcctgat

SEQ ID NO: 200122 - DNA, 18 bp, Homo sapiens
attcatagcatcctgatt

SEQ ID NO: 200123 - DNA, 19 bp, Homo sapiens
attcatagcatcctgatta

SEQ ID NO: 200124 - DNA, 21 bp, Homo sapiens
attcatagcatcctgattatt

SEQ ID NO: 200125 - DNA, 15 bp, Homo sapiens
attcatattcctgcc

SEQ ID NO: 200126 - DNA, 14 bp, Homo sapiens
attcatatttactt

SEQ ID NO: 200127 - DNA, 18 bp, Homo sapiens
attcatatttacttctta

SEQ ID NO: 200128 - DNA, 19 bp, Homo sapiens
attcatatttacttcttat

SEQ ID NO: 200129 - DNA, 14 bp, Homo sapiens
attcatatttgcaa

SEQ ID NO: 200130 - DNA, 20 bp, Homo sapiens
attcatatttgcaataaaaa

SEQ ID NO: 200131 - DNA, 11 bp, Homo sapiens
attcatctgca

SEQ ID NO: 200132 - DNA, 23 bp, Homo sapiens
attcatgagattggtcattaaat

SEQ ID NO: 200133 - DNA, 19 bp, Homo sapiens
attcatggctttgtatcca

SEQ ID NO: 200134 - DNA, 14 bp, Homo sapiens
attcatgtccagag

SEQ ID NO: 200135 - DNA, 17 bp, Homo sapiens
attcattaaaagtttta

SEQ ID NO: 200136 - DNA, 16 bp, Homo sapiens
attcattaaagaaaaa

SEQ ID NO: 200137 - DNA, 22 bp, Homo sapiens
attcattcctgatggaattgtt

SEQ ID NO: 200138 - DNA, 22 bp, Homo sapiens
attcattctgtgatcatttatt

SEQ ID NO: 200139 - DNA, 13 bp, Homo sapiens
attcatttaaaat

SEQ ID NO: 200140 - DNA, 16 bp, Homo sapiens
attcatttaaaatgat

SEQ ID NO: 200141 - DNA, 17 bp, Homo sapiens
attcatttaaaatgatt

SEQ ID NO: 200142 - DNA, 14 bp, Homo sapiens
attccaaaattcca

SEQ ID NO: 200143 - DNA, 15 bp, Homo sapiens
attccaaaattccat

SEQ ID NO: 200144 - DNA, 23 bp, Homo sapiens
attccaaataaaacttgagccca

SEQ ID NO: 200145 - DNA, 14 bp, Homo sapiens
attccaacagtgag

SEQ ID NO: 200146 - DNA, 16 bp, Homo sapiens
attccaccttaaatta

SEQ ID NO: 200147 - DNA, 17 bp, Homo sapiens
attccagaccaaaataa

SEQ ID NO: 200148 - DNA, 14 bp, Homo sapiens
attccatcacagcc

SEQ ID NO: 200149 - DNA, 19 bp, Homo sapiens
attccatcacagccagccc

SEQ ID NO: 200150 - DNA, 20 bp, Homo sapiens
attccatcacagccagccca

SEQ ID NO: 200151 - DNA, 22 bp, Homo sapiens
attccatcacagccagcccagc

SEQ ID NO: 200152 - DNA, 15 bp, Homo sapiens
attccatccataaat

SEQ ID NO: 200153 - DNA, 16 bp, Homo sapiens
attccatgaatgtatc

SEQ ID NO: 200154 - DNA, 17 bp, Homo sapiens
attccatgaatgtatca

SEQ ID NO: 200155 - DNA, 23 bp, Homo sapiens
attccatgaatgtatcaggaaat

SEQ ID NO: 200156 - DNA, 15 bp, Homo sapiens
attccattgtgtgag

SEQ ID NO: 200157 - DNA, 16 bp, Homo sapiens
attccattgtgtgagt

SEQ ID NO: 200158 - DNA, 18 bp, Homo sapiens
attccatttaaaaaacaa

SEQ ID NO: 200159 - DNA, 14 bp, Homo sapiens
attccattttggaa

SEQ ID NO: 200160 - DNA, 23 bp, Homo sapiens
attccatttttactaaagcagtg

SEQ ID NO: 200161 - DNA, 16 bp, Homo sapiens
cccactgcctgcccac

SEQ ID NO: 200162 - DNA, 13 bp, Homo sapiens
cccactgtcctgg

SEQ ID NO: 200163 - DNA, 14 bp, Homo sapiens
cccactgtcctggg

SEQ ID NO: 200164 - DNA, 15 bp, Homo sapiens
cccactgtcctgggc

SEQ ID NO: 200165 - DNA, 22 bp, Homo sapiens
cccactgtcctgggcgccctgg

SEQ ID NO: 200166 - DNA, 23 bp, Homo sapiens
cccactgtcctgggcgccctgga

SEQ ID NO: 200167 - DNA, 15 bp, Homo sapiens
cccactgtcctttct

SEQ ID NO: 200168 - DNA, 16 bp, Homo sapiens
cccactgtcctttctc

SEQ ID NO: 200169 - DNA, 23 bp, Homo sapiens
cccactgtcctttctccaggccc

SEQ ID NO: 200170 - DNA, 20 bp, Homo sapiens
cccacttagccgtccatggc

SEQ ID NO: 200171 - DNA, 21 bp, Homo sapiens
cccacttagccgtccatggca

SEQ ID NO: 200172 - DNA, 23 bp, Homo sapiens
cccacttagccgtccatggcacc

SEQ ID NO: 200173 - DNA, 18 bp, Homo sapiens
cccacttatgctgctgtg

SEQ ID NO: 200174 - DNA, 19 bp, Homo sapiens
cccacttatgctgctgtga

SEQ ID NO: 200175 - DNA, 20 bp, Homo sapiens
cccacttatgctgctgtgaa

SEQ ID NO: 200176 - DNA, 14 bp, Homo sapiens
cccacttccattgt

SEQ ID NO: 200177 - DNA, 22 bp, Homo sapiens
cccagaaagcctcctgccccct

SEQ ID NO: 200178 - DNA, 16 bp, Homo sapiens
cccagaaatgccgctg

SEQ ID NO: 200179 - DNA, 20 bp, Homo sapiens
cccagaaatgccgctgtgtc

SEQ ID NO: 200180 - DNA, 21 bp, Homo sapiens
cccagaaatgccgctgtgtcc

SEQ ID NO: 200181 - DNA, 18 bp, Homo sapiens
cccagaaccccaactccc

SEQ ID NO: 200182 - DNA, 14 bp, Homo sapiens
cccagaacgggcct

SEQ ID NO: 200183 - DNA, 15 bp, Homo sapiens
cccagaacgggcctc

SEQ ID NO: 200184 - DNA, 15 bp, Homo sapiens
cccagaactgccccc

SEQ ID NO: 200185 - DNA, 17 bp, Homo sapiens
cccagaactgcccccac

SEQ ID NO: 200186 - DNA, 23 bp, Homo sapiens
cccagaaggaacccggtcccagg

SEQ ID NO: 200187 - DNA, 16 bp, Homo sapiens
cccagaatggaaaaaa

SEQ ID NO: 200188 - DNA, 23 bp, Homo sapiens
cccagaatggaaaaaaaaatcag

SEQ ID NO: 200189 - DNA, 20 bp, Homo sapiens
cccagacagacatctctgca

SEQ ID NO: 200190 - DNA, 16 bp, Homo sapiens
cccagacccccagtgt

SEQ ID NO: 200191 - DNA, 14 bp, Homo sapiens
cccagaccccgccc

SEQ ID NO: 200192 - DNA, 21 bp, Homo sapiens
cccagaccccgcccctgggga

SEQ ID NO: 200193 - DNA, 18 bp, Homo sapiens
cccagacccctctggcca

SEQ ID NO: 200194 - DNA, 20 bp, Homo sapiens
cccagacccctctggccagg

SEQ ID NO: 200195 - DNA, 16 bp, Homo sapiens
cccagactcagagacc

SEQ ID NO: 200196 - DNA, 15 bp, Homo sapiens
cccagacttgtttcc

SEQ ID NO: 200197 - DNA, 16 bp, Homo sapiens
cccagacttgtttcct

SEQ ID NO: 200198 - DNA, 19 bp, Homo sapiens
cccagactttctacacctg

SEQ ID NO: 200199 - DNA, 13 bp, Homo sapiens
cccagagaacaat

SEQ ID NO: 200200 - DNA, 22 bp, Homo sapiens
cccagagaacaatcactattct

SEQ ID NO: 200201 - DNA, 17 bp, Homo sapiens
cccagagaagcctcagt

SEQ ID NO: 200202 - DNA, 20 bp, Homo sapiens
cccagagaagcctcagtccc

SEQ ID NO: 200203 - DNA, 13 bp, Homo sapiens
cccagagactgcc

SEQ ID NO: 200204 - DNA, 22 bp, Homo sapiens
cccagagactgcccaccctggg

SEQ ID NO: 200205 - DNA, 15 bp, Homo sapiens
cccagagagaaaaag

SEQ ID NO: 200206 - DNA, 15 bp, Homo sapiens
cccagagagaccctg

SEQ ID NO: 200207 - DNA, 18 bp, Homo sapiens
cccagagagaccctgcca

SEQ ID NO: 200208 - DNA, 18 bp, Homo sapiens
cccagagagagctctgca

SEQ ID NO: 200209 - DNA, 20 bp, Homo sapiens
cccagagatgggactgggag

SEQ ID NO: 200210 - DNA, 18 bp, Homo sapiens
cccagagccactaccttt

SEQ ID NO: 200211 - DNA, 12 bp, Homo sapiens
cccagagccagg

SEQ ID NO: 200212 - DNA, 22 bp, Homo sapiens
cccagagccagggctgtcctta

SEQ ID NO: 200213 - DNA, 19 bp, Homo sapiens
cccagagcccgcttttgtt

SEQ ID NO: 200214 - DNA, 18 bp, Homo sapiens
cccagagctgggtgagtg

SEQ ID NO: 200215 - DNA, 22 bp, Homo sapiens
cccagagcttattggccactgg

SEQ ID NO: 200216 - DNA, 18 bp, Homo sapiens
cccagaggcacagccggg

SEQ ID NO: 200217 - DNA, 13 bp, Homo sapiens
cccagaggctccc

SEQ ID NO: 200218 - DNA, 23 bp, Homo sapiens
cccagaggctcccaatcagcttt

SEQ ID NO: 200219 - DNA, 17 bp, Homo sapiens
cccagaggctcctggag

SEQ ID NO: 200220 - DNA, 12 bp, Homo sapiens
cccagaggctga

SEQ ID NO: 200221 - DNA, 20 bp, Homo sapiens
cccagagggaccagctgggg

SEQ ID NO: 200222 - DNA, 23 bp, Homo sapiens
cccagaggggcggggccaggatg

SEQ ID NO: 200223 - DNA, 22 bp, Homo sapiens
cccagaggtggggaagagagcc

SEQ ID NO: 200224 - DNA, 23 bp, Homo sapiens
cccagaggttatctgcctggcct

SEQ ID NO: 200225 - DNA, 14 bp, Homo sapiens
cccagagtgactga

SEQ ID NO: 200226 - DNA, 14 bp, Homo sapiens
cccagataccagcc

SEQ ID NO: 200227 - DNA, 19 bp, Homo sapiens
cccagatagagctgggtgg

SEQ ID NO: 200228 - DNA, 14 bp, Homo sapiens
cccagatcccagaa

SEQ ID NO: 200229 - DNA, 19 bp, Homo sapiens
cccagatctgcctgggcct

SEQ ID NO: 200230 - DNA, 12 bp, Homo sapiens
cccagattccct

SEQ ID NO: 200231 - DNA, 19 bp, Homo sapiens
cccagcaaccctcctatca

SEQ ID NO: 200232 - DNA, 16 bp, Homo sapiens
cccagcaactccaact

SEQ ID NO: 200233 - DNA, 18 bp, Homo sapiens
cccagcaaggcacaggct

SEQ ID NO: 200234 - DNA, 18 bp, Homo sapiens
cccagcacatttcctctc

SEQ ID NO: 200235 - DNA, 15 bp, Homo sapiens
cccagcacccagcaa

SEQ ID NO: 200236 - DNA, 14 bp, Homo sapiens
cccagcacctgcca

SEQ ID NO: 200237 - DNA, 15 bp, Homo sapiens
cccagcactttggga

SEQ ID NO: 200238 - DNA, 19 bp, Homo sapiens
cccagcactttgggaggcc

SEQ ID NO: 200239 - DNA, 20 bp, Homo sapiens
cccagcactttgggaggcca

SEQ ID NO: 200240 - DNA, 13 bp, Homo sapiens
cccagcagagccg

SEQ ID NO: 200241 - DNA, 16 bp, Homo sapiens
cccagcagcggcccag

SEQ ID NO: 200242 - DNA, 14 bp, Homo sapiens
cccagcagcttggc

SEQ ID NO: 200243 - DNA, 15 bp, Homo sapiens
cccagcagcttggct

SEQ ID NO: 200244 - DNA, 17 bp, Homo sapiens
cccagcagcttggctga

SEQ ID NO: 200245 - DNA, 18 bp, Homo sapiens
cccagcattccagctctg

SEQ ID NO: 200246 - DNA, 19 bp, Homo sapiens
cccagcattccagctctgc

SEQ ID NO: 200247 - DNA, 17 bp, Homo sapiens
cccagccaaaccctgtc

SEQ ID NO: 200248 - DNA, 14 bp, Homo sapiens
cccagccaagtgcc

SEQ ID NO: 200249 - DNA, 18 bp, Homo sapiens
cccagccaagtgccttcc

SEQ ID NO: 200250 - DNA, 12 bp, Homo sapiens
cccagccacccc

SEQ ID NO: 200251 - DNA, 12 bp, Homo sapiens
cccagccacctt

SEQ ID NO: 200252 - DNA, 16 bp, Homo sapiens
cccagccaccttcctg

SEQ ID NO: 200253 - DNA, 22 bp, Homo sapiens
cccagccacggacgctggctcc

SEQ ID NO: 200254 - DNA, 15 bp, Homo sapiens
cccagccacgtgtct

SEQ ID NO: 200255 - DNA, 20 bp, Homo sapiens
cccagccagcccttcccagg

SEQ ID NO: 200256 - DNA, 12 bp, Homo sapiens
cccagccatggg

SEQ ID NO: 200257 - DNA, 18 bp, Homo sapiens
cccagccatgggccctct

SEQ ID NO: 200258 - DNA, 22 bp, Homo sapiens
cccagcccaaccgggaaaggca

SEQ ID NO: 200259 - DNA, 13 bp, Homo sapiens
cccagcccaataa

SEQ ID NO: 200260 - DNA, 11 bp, Homo sapiens
cccagcccacc

SEQ ID NO: 200261 - DNA, 12 bp, Homo sapiens
cccagcccagct

SEQ ID NO: 200262 - DNA, 18 bp, Homo sapiens
cccagcccagctgctctg

SEQ ID NO: 200263 - DNA, 16 bp, Homo sapiens
cccagcccatcttgcc

SEQ ID NO: 200264 - DNA, 21 bp, Homo sapiens
cccagcccatcttgcctccat

SEQ ID NO: 200265 - DNA, 14 bp, Homo sapiens
cccagccccaactc

SEQ ID NO: 200266 - DNA, 15 bp, Homo sapiens
cccagccccaactcc

SEQ ID NO: 200267 - DNA, 21 bp, Homo sapiens
cccagccccacccctaagtgc

SEQ ID NO: 200268 - DNA, 14 bp, Homo sapiens
cccagccccagcga

SEQ ID NO: 200269 - DNA, 16 bp, Homo sapiens
cccagccccctggccc

SEQ ID NO: 200270 - DNA, 15 bp, Homo sapiens
cccagcccctacctt

SEQ ID NO: 200271 - DNA, 20 bp, Homo sapiens
cccagccccttctcccagca

SEQ ID NO: 200272 - DNA, 14 bp, Homo sapiens
cccagcccggctga

SEQ ID NO: 200273 - DNA, 16 bp, Homo sapiens
cccagcccggctgacc

SEQ ID NO: 200274 - DNA, 14 bp, Homo sapiens
cccagccctcccag

SEQ ID NO: 200275 - DNA, 16 bp, Homo sapiens
cccagccctgtcctgg

SEQ ID NO: 200276 - DNA, 15 bp, Homo sapiens
cccagccctgtggaa

SEQ ID NO: 200277 - DNA, 16 bp, Homo sapiens
cccagccctgtggaag

SEQ ID NO: 200278 - DNA, 15 bp, Homo sapiens
cccagcccttctgcc

SEQ ID NO: 200279 - DNA, 18 bp, Homo sapiens
cccagcctccaagctcca

SEQ ID NO: 200280 - DNA, 16 bp, Homo sapiens
cccagcctcccccagg

SEQ ID NO: 200281 - DNA, 19 bp, Homo sapiens
cccagcctcccccaggctg

SEQ ID NO: 200282 - DNA, 13 bp, Homo sapiens
cccagcctgacct

SEQ ID NO: 200283 - DNA, 16 bp, Homo sapiens
cccagcctgacctgag

SEQ ID NO: 200284 - DNA, 19 bp, Homo sapiens
cccagcctgctgagagccc

SEQ ID NO: 200285 - DNA, 20 bp, Homo sapiens
cccagcctggccacgcagcc

SEQ ID NO: 200286 - DNA, 23 bp, Homo sapiens
cccagcctggccacgcagccagg

SEQ ID NO: 200287 - DNA, 14 bp, Homo sapiens
cccagcctgtcctg

SEQ ID NO: 200288 - DNA, 19 bp, Homo sapiens
cccagcctgtcctggtaca

SEQ ID NO: 200289 - DNA, 23 bp, Homo sapiens
cccagcgttcttcaggagatgat

SEQ ID NO: 200290 - DNA, 24 bp, Homo sapiens
cccagcgtttagtttctagaggcc

SEQ ID NO: 200291 - DNA, 18 bp, Homo sapiens
cccagctaaagaggtggg

SEQ ID NO: 200292 - DNA, 20 bp, Homo sapiens
cccagctaaagaggtggggt

SEQ ID NO: 200293 - DNA, 23 bp, Homo sapiens
cccagctaatctgtagggctgga

SEQ ID NO: 200294 - DNA, 14 bp, Homo sapiens
cccagctacattcc

SEQ ID NO: 200295 - DNA, 22 bp, Homo sapiens
attcccactaagctttctcctt

SEQ ID NO: 200296 - DNA, 23 bp, Homo sapiens
attcccactaagctttctccttt

SEQ ID NO: 200297 - DNA, 15 bp, Homo sapiens
attcccagaggtggg

SEQ ID NO: 200298 - DNA, 21 bp, Homo sapiens
attcccatggtagactgtgac

SEQ ID NO: 200299 - DNA, 23 bp, Homo sapiens
attcccattttgcaaaatttcca

SEQ ID NO: 200300 - DNA, 14 bp, Homo sapiens
attccccggagctg

SEQ ID NO: 200301 - DNA, 15 bp, Homo sapiens
attccccggagctgg

SEQ ID NO: 200302 - DNA, 15 bp, Homo sapiens
attcccctcccacct

SEQ ID NO: 200303 - DNA, 22 bp, Homo sapiens
attcccctggaccacacctccg

SEQ ID NO: 200304 - DNA, 22 bp, Homo sapiens
attccctatcttttagttttag

SEQ ID NO: 200305 - DNA, 18 bp, Homo sapiens
attccctctcctgcccag

SEQ ID NO: 200306 - DNA, 19 bp, Homo sapiens
attccctctcctgcccaga

SEQ ID NO: 200307 - DNA, 21 bp, Homo sapiens
attccctgaattgtttgatat

SEQ ID NO: 200308 - DNA, 19 bp, Homo sapiens
attccctggaccagatgct

SEQ ID NO: 200309 - DNA, 20 bp, Homo sapiens
attccctttgacttcagctg

SEQ ID NO: 200310 - DNA, 21 bp, Homo sapiens
attccgaaaaaaaaatgttca

SEQ ID NO: 200311 - DNA, 15 bp, Homo sapiens
attccgaagagggaa

SEQ ID NO: 200312 - DNA, 21 bp, Homo sapiens
attccgacaaccgatgctcca

SEQ ID NO: 200313 - DNA, 14 bp, Homo sapiens
attccgttaggaat

SEQ ID NO: 200314 - DNA, 22 bp, Homo sapiens
attccgttaggaataacactgc

SEQ ID NO: 200315 - DNA, 20 bp, Homo sapiens
attccgtttacattttagac

SEQ ID NO: 200316 - DNA, 20 bp, Homo sapiens
attcctaacacagcatgtgt

SEQ ID NO: 200317 - DNA, 14 bp, Homo sapiens
attcctaagcagtg

SEQ ID NO: 200318 - DNA, 21 bp, Homo sapiens
attcctaagcagtgcttgtaa

SEQ ID NO: 200319 - DNA, 18 bp, Homo sapiens
attcctacaatatatatt

SEQ ID NO: 200320 - DNA, 17 bp, Homo sapiens
attcctacttaaacaaa

SEQ ID NO: 200321 - DNA, 19 bp, Homo sapiens
attcctcatgaatgtaaat

SEQ ID NO: 200322 - DNA, 20 bp, Homo sapiens
attcctccagcctcccctcc

SEQ ID NO: 200323 - DNA, 13 bp, Homo sapiens
attcctcctgtct

SEQ ID NO: 200324 - DNA, 22 bp, Homo sapiens
attcctcctgtctcctctgtca

SEQ ID NO: 200325 - DNA, 23 bp, Homo sapiens
attcctcctgtctcctctgtcag

SEQ ID NO: 200326 - DNA, 22 bp, Homo sapiens
attcctctgggaatgttacatt

SEQ ID NO: 200327 - DNA, 19 bp, Homo sapiens
attcctcttgcctctctca

SEQ ID NO: 200328 - DNA, 19 bp, Homo sapiens
attcctgaatgaaatatca

SEQ ID NO: 200329 - DNA, 23 bp, Homo sapiens
attcctgagattctgggaaaggt

SEQ ID NO: 200330 - DNA, 15 bp, Homo sapiens
attcctgcagcctgg

SEQ ID NO: 200331 - DNA, 17 bp, Homo sapiens
attcctggccccgggct

SEQ ID NO: 200332 - DNA, 11 bp, Homo sapiens
attcctgggcc

SEQ ID NO: 200333 - DNA, 18 bp, Homo sapiens
attccttagcagctcagg

SEQ ID NO: 200334 - DNA, 16 bp, Homo sapiens
attccttcctgttctg

SEQ ID NO: 200335 - DNA, 19 bp, Homo sapiens
attccttctaagtgtactt

SEQ ID NO: 200336 - DNA, 14 bp, Homo sapiens
attccttctggcct

SEQ ID NO: 200337 - DNA, 22 bp, Homo sapiens
attccttctggcctttcctctc

SEQ ID NO: 200338 - DNA, 15 bp, Homo sapiens
attccttggcccagc

SEQ ID NO: 200339 - DNA, 18 bp, Homo sapiens
attccttggcccagcagc

SEQ ID NO: 200340 - DNA, 21 bp, Homo sapiens
attccttgtcaccagcaacat

SEQ ID NO: 200341 - DNA, 16 bp, Homo sapiens
attcctttacaactaa

SEQ ID NO: 200342 - DNA, 17 bp, Homo sapiens
attcctttctcatccca

SEQ ID NO: 200343 - DNA, 19 bp, Homo sapiens
attcgatctcattcagtat

SEQ ID NO: 200344 - DNA, 18 bp, Homo sapiens
attcgcagtgcccagtga

SEQ ID NO: 200345 - DNA, 19 bp, Homo sapiens
attcgtctgtcccagagct

SEQ ID NO: 200346 - DNA, 16 bp, Homo sapiens
attctaaaacattctt

SEQ ID NO: 200347 - DNA, 21 bp, Homo sapiens
attctaaacagatgtccctga

SEQ ID NO: 200348 - DNA, 18 bp, Homo sapiens
attctaaatgaatgttta

SEQ ID NO: 200349 - DNA, 15 bp, Homo sapiens
attctaaatgttcat

SEQ ID NO: 200350 - DNA, 18 bp, Homo sapiens
attctaagccagttttca

SEQ ID NO: 200351 - DNA, 20 bp, Homo sapiens
attctaagccagttttcatt

SEQ ID NO: 200352 - DNA, 15 bp, Homo sapiens
attctaagtgaaatt

SEQ ID NO: 200353 - DNA, 21 bp, Homo sapiens
attctaagttatttactttta

SEQ ID NO: 200354 - DNA, 20 bp, Homo sapiens
attctaataaatatactatg

SEQ ID NO: 200355 - DNA, 14 bp, Homo sapiens
attctaatgtcttc

SEQ ID NO: 200356 - DNA, 16 bp, Homo sapiens
attctaatgtcttcat

SEQ ID NO: 200357 - DNA, 15 bp, Homo sapiens
attctacacctggac

SEQ ID NO: 200358 - DNA, 15 bp, Homo sapiens
attctactcttgtca

SEQ ID NO: 200359 - DNA, 15 bp, Homo sapiens
attctacttcagctt

SEQ ID NO: 200360 - DNA, 16 bp, Homo sapiens
attctacttcagcttt

SEQ ID NO: 200361 - DNA, 17 bp, Homo sapiens
attctactttaagcact

SEQ ID NO: 200362 - DNA, 21 bp, Homo sapiens
attctagatcctgcaccccag

SEQ ID NO: 200363 - DNA, 20 bp, Homo sapiens
attctagcacatcatggcag

SEQ ID NO: 200364 - DNA, 13 bp, Homo sapiens
attctagcacctt

SEQ ID NO: 200365 - DNA, 14 bp, Homo sapiens
attctagcagggaa

SEQ ID NO: 200366 - DNA, 17 bp, Homo sapiens
attctagtcaactgctg

SEQ ID NO: 200367 - DNA, 22 bp, Homo sapiens
attctagtcaactgctgtttta

SEQ ID NO: 200368 - DNA, 17 bp, Homo sapiens
attctatatgaatttaa

SEQ ID NO: 200369 - DNA, 23 bp, Homo sapiens
attctatatgaatttaaatataa

SEQ ID NO: 200370 - DNA, 16 bp, Homo sapiens
attctatgcctgtatt

SEQ ID NO: 200371 - DNA, 17 bp, Homo sapiens
attctatgcctgtattt

SEQ ID NO: 200372 - DNA, 22 bp, Homo sapiens
attctattgcagttatagaaaa

SEQ ID NO: 200373 - DNA, 17 bp, Homo sapiens
attctattgtattattt

SEQ ID NO: 200374 - DNA, 18 bp, Homo sapiens
attctattgtattatttg

SEQ ID NO: 200375 - DNA, 23 bp, Homo sapiens
attctattgtattatttggagtt

SEQ ID NO: 200376 - DNA, 20 bp, Homo sapiens
attctcagcccctagcagag

SEQ ID NO: 200377 - DNA, 16 bp, Homo sapiens
attctcattatttcat

SEQ ID NO: 200378 - DNA, 18 bp, Homo sapiens
attctcattgcagaataa

SEQ ID NO: 200379 - DNA, 18 bp, Homo sapiens
attctccctccatggcag

SEQ ID NO: 200380 - DNA, 14 bp, Homo sapiens
attctccctgacct

SEQ ID NO: 200381 - DNA, 21 bp, Homo sapiens
attctcccttctctcttttct

SEQ ID NO: 200382 - DNA, 17 bp, Homo sapiens
attctcccttgattcca

SEQ ID NO: 200383 - DNA, 23 bp, Homo sapiens
attctccgttgtcattgacttca

SEQ ID NO: 200384 - DNA, 14 bp, Homo sapiens
attctcctctccca

SEQ ID NO: 200385 - DNA, 13 bp, Homo sapiens
attctcctgcctc

SEQ ID NO: 200386 - DNA, 17 bp, Homo sapiens
attctcctgcctcagcc

SEQ ID NO: 200387 - DNA, 18 bp, Homo sapiens
attctcctgcctcagcct

SEQ ID NO: 200388 - DNA, 19 bp, Homo sapiens
attctcctgcctcagcctt

SEQ ID NO: 200389 - DNA, 15 bp, Homo sapiens
attctctctatgcaa

SEQ ID NO: 200390 - DNA, 15 bp, Homo sapiens
attctctcttctctc

SEQ ID NO: 200391 - DNA, 12 bp, Homo sapiens
attctcttatcc

SEQ ID NO: 200392 - DNA, 15 bp, Homo sapiens
attctcttatccaac

SEQ ID NO: 200393 - DNA, 20 bp, Homo sapiens
attctcttggctggcttcct

SEQ ID NO: 200394 - DNA, 14 bp, Homo sapiens
attctctttcaaag

SEQ ID NO: 200395 - DNA, 10 bp, Homo sapiens
attctgaatg

SEQ ID NO: 200396 - DNA, 23 bp, Homo sapiens
attctgaatttgtagacatactt

SEQ ID NO: 200397 - DNA, 22 bp, Homo sapiens
attctgagcacgggcaaagaaa

SEQ ID NO: 200398 - DNA, 14 bp, Homo sapiens
attctgagccttga

SEQ ID NO: 200399 - DNA, 15 bp, Homo sapiens
attctgataatgtat

SEQ ID NO: 200400 - DNA, 16 bp, Homo sapiens
attctgcaactagcca

SEQ ID NO: 200401 - DNA, 13 bp, Homo sapiens
attctgcagcatg

SEQ ID NO: 200402 - DNA, 14 bp, Homo sapiens
attctgcctgcctg

SEQ ID NO: 200403 - DNA, 16 bp, Homo sapiens
attctgcctgcctggg

SEQ ID NO: 200404 - DNA, 20 bp, Homo sapiens
attctggatggccgggctgc

SEQ ID NO: 200405 - DNA, 16 bp, Homo sapiens
attctgggaaaggtgc

SEQ ID NO: 200406 - DNA, 19 bp, Homo sapiens
attctgggctcctggaacc

SEQ ID NO: 200407 - DNA, 18 bp, Homo sapiens
attctgggcttggggtgt

SEQ ID NO: 200408 - DNA, 18 bp, Homo sapiens
attctggggtggggcttg

SEQ ID NO: 200409 - DNA, 12 bp, Homo sapiens
attctgtccctg

SEQ ID NO: 200410 - DNA, 22 bp, Homo sapiens
attctgtccctgtccctgcccc

SEQ ID NO: 200411 - DNA, 15 bp, Homo sapiens
attctgtggattcta

SEQ ID NO: 200412 - DNA, 16 bp, Homo sapiens
attctgtggattctat

SEQ ID NO: 200413 - DNA, 17 bp, Homo sapiens
attctgtggtgggaaca

SEQ ID NO: 200414 - DNA, 17 bp, Homo sapiens
attctgtgtgttttcat

SEQ ID NO: 200415 - DNA, 21 bp, Homo sapiens
attctgtgtgttttcataata

SEQ ID NO: 200416 - DNA, 19 bp, Homo sapiens
attctgttctgatattaat

SEQ ID NO: 200417 - DNA, 15 bp, Homo sapiens
attctgttgcccagg

SEQ ID NO: 200418 - DNA, 16 bp, Homo sapiens
attctgttgcccaggc

SEQ ID NO: 200419 - DNA, 22 bp, Homo sapiens
attcttaaaattcaagaaaata

SEQ ID NO: 200420 - DNA, 17 bp, Homo sapiens
attcttaccctttcttt

SEQ ID NO: 200421 - DNA, 16 bp, Homo sapiens
attcttagctcttggg

SEQ ID NO: 200422 - DNA, 16 bp, Homo sapiens
attcttagtaaaatgc

SEQ ID NO: 200423 - DNA, 13 bp, Homo sapiens
attcttatttccc

SEQ ID NO: 200424 - DNA, 10 bp, Homo sapiens
attcttcaaa

SEQ ID NO: 200425 - DNA, 15 bp, Homo sapiens
attcttcaatttgaa

SEQ ID NO: 200426 - DNA, 13 bp, Homo sapiens
attcttcactgtc

SEQ ID NO: 200427 - DNA, 15 bp, Homo sapiens
attcttcggaggagg

SEQ ID NO: 200428 - DNA, 23 bp, Homo sapiens
cccagctacattcctcagctgcc

SEQ ID NO: 200429 - DNA, 24 bp, Homo sapiens
cccagctacattcctcagctgcca

SEQ ID NO: 200430 - DNA, 17 bp, Homo sapiens
cccagctactctgtcca

SEQ ID NO: 200431 - DNA, 19 bp, Homo sapiens
cccagctactctgtccagg

SEQ ID NO: 200432 - DNA, 20 bp, Homo sapiens
cccagctactctgtccaggc

SEQ ID NO: 200433 - DNA, 20 bp, Homo sapiens
cccagctacttgggagcctg

SEQ ID NO: 200434 - DNA, 21 bp, Homo sapiens
cccagctacttgggagcctga

SEQ ID NO: 200435 - DNA, 22 bp, Homo sapiens
cccagctacttgggagcctgag

SEQ ID NO: 200436 - DNA, 16 bp, Homo sapiens
cccagctcaggggcag

SEQ ID NO: 200437 - DNA, 20 bp, Homo sapiens
cccagctcaggggcagctca

SEQ ID NO: 200438 - DNA, 16 bp, Homo sapiens
cccagctccactcagg

SEQ ID NO: 200439 - DNA, 18 bp, Homo sapiens
cccagctccaggggccct

SEQ ID NO: 200440 - DNA, 21 bp, Homo sapiens
cccagctccttttgtccccag

SEQ ID NO: 200441 - DNA, 23 bp, Homo sapiens
cccagctctagacaaccctgcaa

SEQ ID NO: 200442 - DNA, 15 bp, Homo sapiens
cccagctgacatgga

SEQ ID NO: 200443 - DNA, 14 bp, Homo sapiens
cccagctgctcccc

SEQ ID NO: 200444 - DNA, 15 bp, Homo sapiens
cccagctgctctgcc

SEQ ID NO: 200445 - DNA, 19 bp, Homo sapiens
cccagctgctctgcccaga

SEQ ID NO: 200446 - DNA, 23 bp, Homo sapiens
cccagctgctctgcccagagctg

SEQ ID NO: 200447 - DNA, 13 bp, Homo sapiens
cccagctggcagc

SEQ ID NO: 200448 - DNA, 18 bp, Homo sapiens
cccagctggcagcgcctc

SEQ ID NO: 200449 - DNA, 13 bp, Homo sapiens
cccagctgggctc

SEQ ID NO: 200450 - DNA, 18 bp, Homo sapiens
cccagctgggctctgcca

SEQ ID NO: 200451 - DNA, 24 bp, Homo sapiens
cccagctgggctctgccaccctac

SEQ ID NO: 200452 - DNA, 22 bp, Homo sapiens
cccagctggggcccctcggcta

SEQ ID NO: 200453 - DNA, 22 bp, Homo sapiens
cccagctggtgtcactctgcct

SEQ ID NO: 200454 - DNA, 24 bp, Homo sapiens
cccagctgtagccatggctcaggc

SEQ ID NO: 200455 - DNA, 15 bp, Homo sapiens
cccagcttcctggtg

SEQ ID NO: 200456 - DNA, 16 bp, Homo sapiens
cccagcttcctggtgt

SEQ ID NO: 200457 - DNA, 12 bp, Homo sapiens
cccaggaaaaac

SEQ ID NO: 200458 - DNA, 18 bp, Homo sapiens
cccaggaaaaacctgtgg

SEQ ID NO: 200459 - DNA, 22 bp, Homo sapiens
cccaggaatgaagataccatca

SEQ ID NO: 200460 - DNA, 13 bp, Homo sapiens
cccaggaccctga

SEQ ID NO: 200461 - DNA, 13 bp, Homo sapiens
cccaggacgcagg

SEQ ID NO: 200462 - DNA, 20 bp, Homo sapiens
cccaggacgcttctgaatgc

SEQ ID NO: 200463 - DNA, 22 bp, Homo sapiens
cccaggagagaacacggggagg

SEQ ID NO: 200464 - DNA, 18 bp, Homo sapiens
cccaggagagcccccacc

SEQ ID NO: 200465 - DNA, 18 bp, Homo sapiens
cccaggagctgagtcacc

SEQ ID NO: 200466 - DNA, 21 bp, Homo sapiens
cccaggagctgagtcacctcc

SEQ ID NO: 200467 - DNA, 23 bp, Homo sapiens
cccaggattgtacgtgggagagg

SEQ ID NO: 200468 - DNA, 13 bp, Homo sapiens
cccaggcagcacc

SEQ ID NO: 200469 - DNA, 13 bp, Homo sapiens
cccaggcaggctg

SEQ ID NO: 200470 - DNA, 13 bp, Homo sapiens
cccaggcagtctt

SEQ ID NO: 200471 - DNA, 13 bp, Homo sapiens
cccaggccagcga

SEQ ID NO: 200472 - DNA, 16 bp, Homo sapiens
cccaggccagcgaggc

SEQ ID NO: 200473 - DNA, 16 bp, Homo sapiens
cccaggccaggtccct

SEQ ID NO: 200474 - DNA, 15 bp, Homo sapiens
cccaggccgcatggc

SEQ ID NO: 200475 - DNA, 12 bp, Homo sapiens
cccaggccggcc

SEQ ID NO: 200476 - DNA, 21 bp, Homo sapiens
cccaggccggccagcctcacc

SEQ ID NO: 200477 - DNA, 21 bp, Homo sapiens
cccaggccgttccccttggct

SEQ ID NO: 200478 - DNA, 18 bp, Homo sapiens
cccaggcctccagcctct

SEQ ID NO: 200479 - DNA, 12 bp, Homo sapiens
cccaggcctggc

SEQ ID NO: 200480 - DNA, 15 bp, Homo sapiens
cccaggcggaggggc

SEQ ID NO: 200481 - DNA, 23 bp, Homo sapiens
cccaggcggaggggcttggagca

SEQ ID NO: 200482 - DNA, 18 bp, Homo sapiens
cccaggctcccctgcccg

SEQ ID NO: 200483 - DNA, 17 bp, Homo sapiens
cccaggctcccctggtc

SEQ ID NO: 200484 - DNA, 24 bp, Homo sapiens
cccaggctcccctggtctcctccc

SEQ ID NO: 200485 - DNA, 14 bp, Homo sapiens
cccaggctctgctg

SEQ ID NO: 200486 - DNA, 19 bp, Homo sapiens
cccaggctctgctgacttc

SEQ ID NO: 200487 - DNA, 14 bp, Homo sapiens
cccaggctgcactg

SEQ ID NO: 200488 - DNA, 18 bp, Homo sapiens
cccaggctgcactgcagt

SEQ ID NO: 200489 - DNA, 13 bp, Homo sapiens
cccaggctgcgcc

SEQ ID NO: 200490 - DNA, 16 bp, Homo sapiens
cccaggctgcgcctgc

SEQ ID NO: 200491 - DNA, 17 bp, Homo sapiens
cccaggctgcgcctgcc

SEQ ID NO: 200492 - DNA, 18 bp, Homo sapiens
cccaggctgcgcctgccc

SEQ ID NO: 200493 - DNA, 16 bp, Homo sapiens
cccaggctggtctcaa

SEQ ID NO: 200494 - DNA, 14 bp, Homo sapiens
cccagggagaggcc

SEQ ID NO: 200495 - DNA, 18 bp, Homo sapiens
cccagggagaggccatga

SEQ ID NO: 200496 - DNA, 14 bp, Homo sapiens
cccagggcagtgtg

SEQ ID NO: 200497 - DNA, 19 bp, Homo sapiens
cccagggcagtgtggtggg

SEQ ID NO: 200498 - DNA, 17 bp, Homo sapiens
cccagggccctgctcag

SEQ ID NO: 200499 - DNA, 18 bp, Homo sapiens
cccagggccctgctcagg

SEQ ID NO: 200500 - DNA, 23 bp, Homo sapiens
cccagggccctgctcaggcctca

SEQ ID NO: 200501 - DNA, 16 bp, Homo sapiens
cccagggcctgggggc

SEQ ID NO: 200502 - DNA, 20 bp, Homo sapiens
cccagggcctgggggcagtg

SEQ ID NO: 200503 - DNA, 17 bp, Homo sapiens
cccaggggaaaatgaag

SEQ ID NO: 200504 - DNA, 22 bp, Homo sapiens
cccaggggcatgtattggcctg

SEQ ID NO: 200505 - DNA, 13 bp, Homo sapiens
cccaggggctttg

SEQ ID NO: 200506 - DNA, 16 bp, Homo sapiens
cccaggggctttggtg

SEQ ID NO: 200507 - DNA, 19 bp, Homo sapiens
cccaggggtcccagccacc

SEQ ID NO: 200508 - DNA, 20 bp, Homo sapiens
cccaggggtcccagccaccc

SEQ ID NO: 200509 - DNA, 17 bp, Homo sapiens
cccaggggtctccctga

SEQ ID NO: 200510 - DNA, 23 bp, Homo sapiens
cccaggggtctccctgagcctgc

SEQ ID NO: 200511 - DNA, 14 bp, Homo sapiens
cccagggtcctgtg

SEQ ID NO: 200512 - DNA, 16 bp, Homo sapiens
cccagggtcctgtgcc

SEQ ID NO: 200513 - DNA, 23 bp, Homo sapiens
cccagggtcttccctacctcagg

SEQ ID NO: 200514 - DNA, 12 bp, Homo sapiens
cccagggtgcag

SEQ ID NO: 200515 - DNA, 14 bp, Homo sapiens
cccagggtgcaggc

SEQ ID NO: 200516 - DNA, 16 bp, Homo sapiens
cccagggtgcaggcgc

SEQ ID NO: 200517 - DNA, 14 bp, Homo sapiens
cccagggtgcagtg

SEQ ID NO: 200518 - DNA, 21 bp, Homo sapiens
cccaggtaccacccttcagac

SEQ ID NO: 200519 - DNA, 18 bp, Homo sapiens
cccaggtgccaccaataa

SEQ ID NO: 200520 - DNA, 20 bp, Homo sapiens
cccaggtgccaccaataaaa

SEQ ID NO: 200521 - DNA, 17 bp, Homo sapiens
cccaggtgctggaggca

SEQ ID NO: 200522 - DNA, 13 bp, Homo sapiens
cccaggttggagg

SEQ ID NO: 200523 - DNA, 15 bp, Homo sapiens
cccaggttggaggcc

SEQ ID NO: 200524 - DNA, 20 bp, Homo sapiens
cccagtagccattttgtaac

SEQ ID NO: 200525 - DNA, 23 bp, Homo sapiens
cccagtattctaggtagtgccct

SEQ ID NO: 200526 - DNA, 21 bp, Homo sapiens
cccagtcatgacatttctcaa

SEQ ID NO: 200527 - DNA, 23 bp, Homo sapiens
cccagtccaaatgtcctccagaa

SEQ ID NO: 200528 - DNA, 17 bp, Homo sapiens
cccagtccactggggag

SEQ ID NO: 200529 - DNA, 21 bp, Homo sapiens
cccagtcccagaaccacactg

SEQ ID NO: 200530 - DNA, 15 bp, Homo sapiens
cccagtccccgggaa

SEQ ID NO: 200531 - DNA, 15 bp, Homo sapiens
cccagtccctggagc

SEQ ID NO: 200532 - DNA, 16 bp, Homo sapiens
cccagtccctggagct

SEQ ID NO: 200533 - DNA, 17 bp, Homo sapiens
cccagtccctggagctg

SEQ ID NO: 200534 - DNA, 16 bp, Homo sapiens
cccagtcctggttcag

SEQ ID NO: 200535 - DNA, 17 bp, Homo sapiens
cccagtcttgagtgggc

SEQ ID NO: 200536 - DNA, 15 bp, Homo sapiens
cccagtgaaaactag

SEQ ID NO: 200537 - DNA, 19 bp, Homo sapiens
cccagtgacacttcagaga

SEQ ID NO: 200538 - DNA, 14 bp, Homo sapiens
cccagtgcacccac

SEQ ID NO: 200539 - DNA, 16 bp, Homo sapiens
cccagtgccaaacttg

SEQ ID NO: 200540 - DNA, 19 bp, Homo sapiens
cccagtgccattggcttca

SEQ ID NO: 200541 - DNA, 12 bp, Homo sapiens
cccagtgcctgc

SEQ ID NO: 200542 - DNA, 14 bp, Homo sapiens
cccagtgcctgcca

SEQ ID NO: 200543 - DNA, 15 bp, Homo sapiens
cccagtgcctgccac

SEQ ID NO: 200544 - DNA, 19 bp, Homo sapiens
cccagtgcctgccactctc

SEQ ID NO: 200545 - DNA, 16 bp, Homo sapiens
cccagtgcctgtctgg

SEQ ID NO: 200546 - DNA, 16 bp, Homo sapiens
cccagtgctgccatgc

SEQ ID NO: 200547 - DNA, 18 bp, Homo sapiens
cccagtgctgccatgcca

SEQ ID NO: 200548 - DNA, 19 bp, Homo sapiens
cccagtgctgccatgccac

SEQ ID NO: 200549 - DNA, 21 bp, Homo sapiens
cccagtgctgccatgccactg

SEQ ID NO: 200550 - DNA, 13 bp, Homo sapiens
cccagtggcctca

SEQ ID NO: 200551 - DNA, 14 bp, Homo sapiens
cccagtgggctgtg

SEQ ID NO: 200552 - DNA, 16 bp, Homo sapiens
cccagtgggctgtgtt

SEQ ID NO: 200553 - DNA, 20 bp, Homo sapiens
cccagtgtccccaggggcac

SEQ ID NO: 200554 - DNA, 18 bp, Homo sapiens
cccagtgttgtttgtaaa

SEQ ID NO: 200555 - DNA, 21 bp, Homo sapiens
cccagtgttgtttgtaaataa

SEQ ID NO: 200556 - DNA, 17 bp, Homo sapiens
cccagttagcccggcca

SEQ ID NO: 200557 - DNA, 19 bp, Homo sapiens
cccagttcatctctgctga

SEQ ID NO: 200558 - DNA, 23 bp, Homo sapiens
cccagttctctagggaaggccac

SEQ ID NO: 200559 - DNA, 22 bp, Homo sapiens
cccagttctgaataacttgaag

SEQ ID NO: 200560 - DNA, 13 bp, Homo sapiens
cccagttggggct

SEQ ID NO: 200561 - DNA, 19 bp, Homo sapiens
attcttcggaggaggtgga

SEQ ID NO: 200562 - DNA, 15 bp, Homo sapiens
attcttcttctcaag

SEQ ID NO: 200563 - DNA, 15 bp, Homo sapiens
attcttgaaggaaaa

SEQ ID NO: 200564 - DNA, 14 bp, Homo sapiens
attcttgatgtaaa

SEQ ID NO: 200565 - DNA, 17 bp, Homo sapiens
attcttgatgtaaaatc

SEQ ID NO: 200566 - DNA, 16 bp, Homo sapiens
attcttgattttcaag

SEQ ID NO: 200567 - DNA, 16 bp, Homo sapiens
attcttgcactgtatc

SEQ ID NO: 200568 - DNA, 21 bp, Homo sapiens
attcttgctgggcatactttc

SEQ ID NO: 200569 - DNA, 17 bp, Homo sapiens
attcttggtatttggat

SEQ ID NO: 200570 - DNA, 14 bp, Homo sapiens
attcttgtccacat

SEQ ID NO: 200571 - DNA, 22 bp, Homo sapiens
attcttgtccacattctacttc

SEQ ID NO: 200572 - DNA, 13 bp, Homo sapiens
attctttaaacta

SEQ ID NO: 200573 - DNA, 12 bp, Homo sapiens
attctttacaaa

SEQ ID NO: 200574 - DNA, 22 bp, Homo sapiens
attctttcaatccacagtattg

SEQ ID NO: 200575 - DNA, 23 bp, Homo sapiens
attctttcaatccacagtattgt

SEQ ID NO: 200576 - DNA, 15 bp, Homo sapiens
attctttccatgcag

SEQ ID NO: 200577 - DNA, 16 bp, Homo sapiens
attctttccattatga

SEQ ID NO: 200578 - DNA, 13 bp, Homo sapiens
attctttctgcta

SEQ ID NO: 200579 - DNA, 22 bp, Homo sapiens
attctttggagttgtcacatca

SEQ ID NO: 200580 - DNA, 14 bp, Homo sapiens
attctttgtatctt

SEQ ID NO: 200581 - DNA, 13 bp, Homo sapiens
attctttgtttcc

SEQ ID NO: 200582 - DNA, 14 bp, Homo sapiens
attctttgtttcct

SEQ ID NO: 200583 - DNA, 13 bp, Homo sapiens
attcttttaaatg

SEQ ID NO: 200584 - DNA, 20 bp, Homo sapiens
attcttttcagcttgtttct

SEQ ID NO: 200585 - DNA, 22 bp, Homo sapiens
attcttttcagcttgtttctat

SEQ ID NO: 200586 - DNA, 14 bp, Homo sapiens
attcttttccagaa

SEQ ID NO: 200587 - DNA, 19 bp, Homo sapiens
attgaaaaaaattggcatt

SEQ ID NO: 200588 - DNA, 14 bp, Homo sapiens
attgaaaacttcaa

SEQ ID NO: 200589 - DNA, 17 bp, Homo sapiens
attgaaaacttcaaagc

SEQ ID NO: 200590 - DNA, 15 bp, Homo sapiens
attgaaaagaagaaa

SEQ ID NO: 200591 - DNA, 18 bp, Homo sapiens
attgaaaagaagaaagtc

SEQ ID NO: 200592 - DNA, 21 bp, Homo sapiens
attgaaaagaagaaagtctat

SEQ ID NO: 200593 - DNA, 21 bp, Homo sapiens
attgaaaatagtaaatgcttt

SEQ ID NO: 200594 - DNA, 20 bp, Homo sapiens
attgaaaatgtaagtaaatg

SEQ ID NO: 200595 - DNA, 15 bp, Homo sapiens
attgaaagagaacca

SEQ ID NO: 200596 - DNA, 12 bp, Homo sapiens
attgaaattata

SEQ ID NO: 200597 - DNA, 15 bp, Homo sapiens
attgaagatacacaa

SEQ ID NO: 200598 - DNA, 14 bp, Homo sapiens
attgaagtaatgaa

SEQ ID NO: 200599 - DNA, 15 bp, Homo sapiens
attgaagtaatgaat

SEQ ID NO: 200600 - DNA, 18 bp, Homo sapiens
attgaagtcatcataaaa

SEQ ID NO: 200601 - DNA, 19 bp, Homo sapiens
attgaatactttatgggaa

SEQ ID NO: 200602 - DNA, 13 bp, Homo sapiens
attgaatgctgcc

SEQ ID NO: 200603 - DNA, 21 bp, Homo sapiens
attgaatgttatatcatcaat

SEQ ID NO: 200604 - DNA, 15 bp, Homo sapiens
attgaattattttgt

SEQ ID NO: 200605 - DNA, 21 bp, Homo sapiens
attgaattattttgttactgt

SEQ ID NO: 200606 - DNA, 15 bp, Homo sapiens
attgacaacatttta

SEQ ID NO: 200607 - DNA, 16 bp, Homo sapiens
attgacaacattttat

SEQ ID NO: 200608 - DNA, 12 bp, Homo sapiens
attgacaagttt

SEQ ID NO: 200609 - DNA, 14 bp, Homo sapiens
attgacaagtttaa

SEQ ID NO: 200610 - DNA, 17 bp, Homo sapiens
attgaccaagaactgca

SEQ ID NO: 200611 - DNA, 16 bp, Homo sapiens
attgaccatgtgatta

SEQ ID NO: 200612 - DNA, 19 bp, Homo sapiens
attgacctcagctgcacat

SEQ ID NO: 200613 - DNA, 16 bp, Homo sapiens
attgacttcaagatgc

SEQ ID NO: 200614 - DNA, 15 bp, Homo sapiens
attgacttcagcagg

SEQ ID NO: 200615 - DNA, 16 bp, Homo sapiens
attgacttcgactgtg

SEQ ID NO: 200616 - DNA, 16 bp, Homo sapiens
attgagaaagaaacta

SEQ ID NO: 200617 - DNA, 15 bp, Homo sapiens
attgagacaaaaatt

SEQ ID NO: 200618 - DNA, 18 bp, Homo sapiens
attgagacaaaaattatc

SEQ ID NO: 200619 - DNA, 19 bp, Homo sapiens
attgagacaaaaattatct

SEQ ID NO: 200620 - DNA, 16 bp, Homo sapiens
attgagacactgtcaa

SEQ ID NO: 200621 - DNA, 17 bp, Homo sapiens
attgagacactgtcaag

SEQ ID NO: 200622 - DNA, 22 bp, Homo sapiens
attgagatcagcattcaaaata

SEQ ID NO: 200623 - DNA, 15 bp, Homo sapiens
attgagcgtgattct

SEQ ID NO: 200624 - DNA, 22 bp, Homo sapiens
attgagtcattttatatatgaa

SEQ ID NO: 200625 - DNA, 18 bp, Homo sapiens
attgagttctgaaggttg

SEQ ID NO: 200626 - DNA, 22 bp, Homo sapiens
attgagttggttacctattgct

SEQ ID NO: 200627 - DNA, 17 bp, Homo sapiens
attgatatgcttataca

SEQ ID NO: 200628 - DNA, 15 bp, Homo sapiens
attgatcaaattcat

SEQ ID NO: 200629 - DNA, 17 bp, Homo sapiens
attgatcacagatgtgc

SEQ ID NO: 200630 - DNA, 19 bp, Homo sapiens
attgatcggagcctcctct

SEQ ID NO: 200631 - DNA, 22 bp, Homo sapiens
attgatgaaaagatttaagcac

SEQ ID NO: 200632 - DNA, 19 bp, Homo sapiens
attgatgagcactcctgat

SEQ ID NO: 200633 - DNA, 18 bp, Homo sapiens
attgatgggtgggctagt

SEQ ID NO: 200634 - DNA, 21 bp, Homo sapiens
attgatgtacagtctgtcatg

SEQ ID NO: 200635 - DNA, 21 bp, Homo sapiens
attgatgtgaaattaaattct

SEQ ID NO: 200636 - DNA, 12 bp, Homo sapiens
attgatgtgttt

SEQ ID NO: 200637 - DNA, 16 bp, Homo sapiens
attgattaaactgtat

SEQ ID NO: 200638 - DNA, 21 bp, Homo sapiens
attgattgaaaaaagagaaag

SEQ ID NO: 200639 - DNA, 14 bp, Homo sapiens
attgatttgaagtg

SEQ ID NO: 200640 - DNA, 21 bp, Homo sapiens
attgcaaaaggttaagccata

SEQ ID NO: 200641 - DNA, 13 bp, Homo sapiens
attgcaaggaagg

SEQ ID NO: 200642 - DNA, 14 bp, Homo sapiens
attgcaaggaagga

SEQ ID NO: 200643 - DNA, 17 bp, Homo sapiens
attgcacgtggcctctt

SEQ ID NO: 200644 - DNA, 14 bp, Homo sapiens
attgcactgctgtt

SEQ ID NO: 200645 - DNA, 15 bp, Homo sapiens
attgcactgctgttc

SEQ ID NO: 200646 - DNA, 20 bp, Homo sapiens
attgcactgctgttcctgct

SEQ ID NO: 200647 - DNA, 16 bp, Homo sapiens
attgcactttataaac

SEQ ID NO: 200648 - DNA, 20 bp, Homo sapiens
attgcagataactttgactt

SEQ ID NO: 200649 - DNA, 17 bp, Homo sapiens
attgcagatatttgatg

SEQ ID NO: 200650 - DNA, 16 bp, Homo sapiens
attgcagcagttgcta

SEQ ID NO: 200651 - DNA, 22 bp, Homo sapiens
attgcagctaagctcaaatgta

SEQ ID NO: 200652 - DNA, 13 bp, Homo sapiens
attgcataaagca

SEQ ID NO: 200653 - DNA, 14 bp, Homo sapiens
attgcataaagcat

SEQ ID NO: 200654 - DNA, 21 bp, Homo sapiens
attgcataagtggacccagct

SEQ ID NO: 200655 - DNA, 13 bp, Homo sapiens
attgcatcatgaa

SEQ ID NO: 200656 - DNA, 15 bp, Homo sapiens
attgcatgctgcttt

SEQ ID NO: 200657 - DNA, 17 bp, Homo sapiens
attgcatgctgctttaa

SEQ ID NO: 200658 - DNA, 9 bp, Homo sapiens
attgcattt

SEQ ID NO: 200659 - DNA, 17 bp, Homo sapiens
attgcatttcctgacag

SEQ ID NO: 200660 - DNA, 15 bp, Homo sapiens
attgccaccaggaga

SEQ ID NO: 200661 - DNA, 14 bp, Homo sapiens
attgccacctctgg

SEQ ID NO: 200662 - DNA, 18 bp, Homo sapiens
attgccacctctggccaa

SEQ ID NO: 200663 - DNA, 14 bp, Homo sapiens
attgccagtgacat

SEQ ID NO: 200664 - DNA, 20 bp, Homo sapiens
attgccatcgggtgccaaat

SEQ ID NO: 200665 - DNA, 20 bp, Homo sapiens
attgcccacacctgcctctg

SEQ ID NO: 200666 - DNA, 22 bp, Homo sapiens
attgcccacacctgcctctgaa

SEQ ID NO: 200667 - DNA, 16 bp, Homo sapiens
attgccccaagatagg

SEQ ID NO: 200668 - DNA, 15 bp, Homo sapiens
attgccccagagccc

SEQ ID NO: 200669 - DNA, 19 bp, Homo sapiens
attgccccagagccccact

SEQ ID NO: 200670 - DNA, 12 bp, Homo sapiens
attgccctgcca

SEQ ID NO: 200671 - DNA, 13 bp, Homo sapiens
attgccctgccag

SEQ ID NO: 200672 - DNA, 14 bp, Homo sapiens
attgccctgccagg

SEQ ID NO: 200673 - DNA, 15 bp, Homo sapiens
attgccctgccaggc

SEQ ID NO: 200674 - DNA, 16 bp, Homo sapiens
attgcctcaaaattgt

SEQ ID NO: 200675 - DNA, 14 bp, Homo sapiens
attgcctcccttcc

SEQ ID NO: 200676 - DNA, 16 bp, Homo sapiens
attgccttgcatttgt

SEQ ID NO: 200677 - DNA, 22 bp, Homo sapiens
attgcctttggcaattcttctt

SEQ ID NO: 200678 - DNA, 21 bp, Homo sapiens
attgctcagagaaatatgcag

SEQ ID NO: 200679 - DNA, 22 bp, Homo sapiens
attgctcatctcagtcctcaaa

SEQ ID NO: 200680 - DNA, 20 bp, Homo sapiens
attgctcccagtgccaaact

SEQ ID NO: 200681 - DNA, 22 bp, Homo sapiens
attgctcctgcatgcaactaat

SEQ ID NO: 200682 - DNA, 12 bp, Homo sapiens
attgctccttga

SEQ ID NO: 200683 - DNA, 19 bp, Homo sapiens
attgctctggaagcctgct

SEQ ID NO: 200684 - DNA, 21 bp, Homo sapiens
attgctctggaagcctgctga

SEQ ID NO: 200685 - DNA, 21 bp, Homo sapiens
attgctctggggcttgctatt

SEQ ID NO: 200686 - DNA, 22 bp, Homo sapiens
attgctgagatgtttagtagct

SEQ ID NO: 200687 - DNA, 15 bp, Homo sapiens
attgctgctggtaat

SEQ ID NO: 200688 - DNA, 21 bp, Homo sapiens
attgctgtaaataaaaatagc

SEQ ID NO: 200689 - DNA, 17 bp, Homo sapiens
attgcttaaaagacatt

SEQ ID NO: 200690 - DNA, 13 bp, Homo sapiens
attgcttacattt

SEQ ID NO: 200691 - DNA, 20 bp, Homo sapiens
attgcttacatttttacaat

SEQ ID NO: 200692 - DNA, 21 bp, Homo sapiens
attgcttacatttttacaata

SEQ ID NO: 200693 - DNA, 13 bp, Homo sapiens
attgctttactgg

SEQ ID NO: 200694 - DNA, 14 bp, Homo sapiens
attgcttttgtgca

SEQ ID NO: 200695 - DNA, 19 bp, Homo sapiens
attgcttttgttgtgactt

SEQ ID NO: 200696 - DNA, 14 bp, Homo sapiens
cccataactaccag

SEQ ID NO: 200697 - DNA, 20 bp, Homo sapiens
cccataatagttagccctca

SEQ ID NO: 200698 - DNA, 18 bp, Homo sapiens
cccatactctgtctccct

SEQ ID NO: 200699 - DNA, 13 bp, Homo sapiens
cccatagcttcca

SEQ ID NO: 200700 - DNA, 19 bp, Homo sapiens
cccatagtgaccggctgct

SEQ ID NO: 200701 - DNA, 23 bp, Homo sapiens
cccatagtgctgggattcaattt

SEQ ID NO: 200702 - DNA, 16 bp, Homo sapiens
cccatatttcatcgtg

SEQ ID NO: 200703 - DNA, 21 bp, Homo sapiens
cccatcacagggttgggccca

SEQ ID NO: 200704 - DNA, 16 bp, Homo sapiens
cccatcaccccttccc

SEQ ID NO: 200705 - DNA, 12 bp, Homo sapiens
cccatcatctct

SEQ ID NO: 200706 - DNA, 12 bp, Homo sapiens
cccatccagcgt

SEQ ID NO: 200707 - DNA, 15 bp, Homo sapiens
cccatccatcagctc

SEQ ID NO: 200708 - DNA, 15 bp, Homo sapiens
cccatcccacaccct

SEQ ID NO: 200709 - DNA, 12 bp, Homo sapiens
cccatccccacc

SEQ ID NO: 200710 - DNA, 15 bp, Homo sapiens
cccatccccaccagc

SEQ ID NO: 200711 - DNA, 16 bp, Homo sapiens
cccatccccaccagct

SEQ ID NO: 200712 - DNA, 17 bp, Homo sapiens
cccatccccttcctaaa

SEQ ID NO: 200713 - DNA, 12 bp, Homo sapiens
cccatccctgct

SEQ ID NO: 200714 - DNA, 13 bp, Homo sapiens
cccatccctgctt

SEQ ID NO: 200715 - DNA, 17 bp, Homo sapiens
cccatcctaccaatgca

SEQ ID NO: 200716 - DNA, 14 bp, Homo sapiens
cccatcctcccctt

SEQ ID NO: 200717 - DNA, 22 bp, Homo sapiens
cccatcctccccttccctgcaa

SEQ ID NO: 200718 - DNA, 21 bp, Homo sapiens
cccatccttcccgcagcacca

SEQ ID NO: 200719 - DNA, 19 bp, Homo sapiens
cccatcgctggaaaacagc

SEQ ID NO: 200720 - DNA, 13 bp, Homo sapiens
cccatcggaagtt

SEQ ID NO: 200721 - DNA, 19 bp, Homo sapiens
cccatcggtgtccatttat

SEQ ID NO: 200722 - DNA, 17 bp, Homo sapiens
cccatctcacctctagg

SEQ ID NO: 200723 - DNA, 16 bp, Homo sapiens
cccatctcagcctcct

SEQ ID NO: 200724 - DNA, 20 bp, Homo sapiens
cccatctcagcctcctgagc

SEQ ID NO: 200725 - DNA, 15 bp, Homo sapiens
cccatctcaggtgcc

SEQ ID NO: 200726 - DNA, 19 bp, Homo sapiens
cccatctcaggtgccactc

SEQ ID NO: 200727 - DNA, 16 bp, Homo sapiens
cccatctccccaggcc

SEQ ID NO: 200728 - DNA, 20 bp, Homo sapiens
cccatctcctcccatggcct

SEQ ID NO: 200729 - DNA, 13 bp, Homo sapiens
cccatctctgctg

SEQ ID NO: 200730 - DNA, 18 bp, Homo sapiens
cccatctcttcctaccca

SEQ ID NO: 200731 - DNA, 13 bp, Homo sapiens
cccatctgctgag

SEQ ID NO: 200732 - DNA, 19 bp, Homo sapiens
cccatgaccatactgaggg

SEQ ID NO: 200733 - DNA, 17 bp, Homo sapiens
cccatgactgcacccag

SEQ ID NO: 200734 - DNA, 15 bp, Homo sapiens
cccatgagcctgccc

SEQ ID NO: 200735 - DNA, 16 bp, Homo sapiens
cccatgagcctgcccg

SEQ ID NO: 200736 - DNA, 20 bp, Homo sapiens
cccatgagttgtcagctttg

SEQ ID NO: 200737 - DNA, 22 bp, Homo sapiens
cccatgcacacaaacacctcct

SEQ ID NO: 200738 - DNA, 14 bp, Homo sapiens
cccatgcatggcct

SEQ ID NO: 200739 - DNA, 15 bp, Homo sapiens
cccatgcccacctgc

SEQ ID NO: 200740 - DNA, 17 bp, Homo sapiens
cccatgccctgccaagc

SEQ ID NO: 200741 - DNA, 20 bp, Homo sapiens
cccatgccctgccaagcctg

SEQ ID NO: 200742 - DNA, 16 bp, Homo sapiens
cccatgcctgtccagc

SEQ ID NO: 200743 - DNA, 13 bp, Homo sapiens
cccatgctctgcc

SEQ ID NO: 200744 - DNA, 16 bp, Homo sapiens
cccatgctctgcccca

SEQ ID NO: 200745 - DNA, 19 bp, Homo sapiens
cccatggcccagcagcttg

SEQ ID NO: 200746 - DNA, 16 bp, Homo sapiens
cccatggccccagctg

SEQ ID NO: 200747 - DNA, 17 bp, Homo sapiens
cccatggccccagctgg

SEQ ID NO: 200748 - DNA, 21 bp, Homo sapiens
cccatgggcttggacttcctg

SEQ ID NO: 200749 - DNA, 14 bp, Homo sapiens
cccatggtccctag

SEQ ID NO: 200750 - DNA, 19 bp, Homo sapiens
cccatgtgtgagtgtgtgc

SEQ ID NO: 200751 - DNA, 14 bp, Homo sapiens
cccatgttgggaaa

SEQ ID NO: 200752 - DNA, 19 bp, Homo sapiens
cccattctagatcctgcac

SEQ ID NO: 200753 - DNA, 21 bp, Homo sapiens
cccattctagatcctgcaccc

SEQ ID NO: 200754 - DNA, 11 bp, Homo sapiens
cccattctcca

SEQ ID NO: 200755 - DNA, 12 bp, Homo sapiens
cccattgtctca

SEQ ID NO: 200756 - DNA, 20 bp, Homo sapiens
cccattgtctcattgccagt

SEQ ID NO: 200757 - DNA, 19 bp, Homo sapiens
cccattgtgaatgttgtcc

SEQ ID NO: 200758 - DNA, 19 bp, Homo sapiens
cccattgtggctcctatct

SEQ ID NO: 200759 - DNA, 15 bp, Homo sapiens
cccatttattatttt

SEQ ID NO: 200760 - DNA, 17 bp, Homo sapiens
cccatttattattttaa

SEQ ID NO: 200761 - DNA, 16 bp, Homo sapiens
cccatttcctcttcct

SEQ ID NO: 200762 - DNA, 21 bp, Homo sapiens
cccatttcctcttccttctct

SEQ ID NO: 200763 - DNA, 12 bp, Homo sapiens
cccattttgcaa

SEQ ID NO: 200764 - DNA, 22 bp, Homo sapiens
cccattttgcaaaatttccagt

SEQ ID NO: 200765 - DNA, 15 bp, Homo sapiens
ccccaaaaccacagc

SEQ ID NO: 200766 - DNA, 16 bp, Homo sapiens
ccccaaaattatcagt

SEQ ID NO: 200767 - DNA, 16 bp, Homo sapiens
ccccaaacatagcccc

SEQ ID NO: 200768 - DNA, 14 bp, Homo sapiens
ccccaaaccccagc

SEQ ID NO: 200769 - DNA, 17 bp, Homo sapiens
ccccaaagacctgcctg

SEQ ID NO: 200770 - DNA, 12 bp, Homo sapiens
ccccaaagcccc

SEQ ID NO: 200771 - DNA, 19 bp, Homo sapiens
ccccaaagctttcctgccc

SEQ ID NO: 200772 - DNA, 17 bp, Homo sapiens
ccccaaatctactgagc

SEQ ID NO: 200773 - DNA, 23 bp, Homo sapiens
ccccaaatctactgagccacgga

SEQ ID NO: 200774 - DNA, 22 bp, Homo sapiens
ccccaaccccgcggtgctctgg

SEQ ID NO: 200775 - DNA, 18 bp, Homo sapiens
ccccaaccctgcccctgc

SEQ ID NO: 200776 - DNA, 19 bp, Homo sapiens
ccccaacgtcccctccgcc

SEQ ID NO: 200777 - DNA, 15 bp, Homo sapiens
ccccaactccagggg

SEQ ID NO: 200778 - DNA, 19 bp, Homo sapiens
ccccaactccatggggttc

SEQ ID NO: 200779 - DNA, 14 bp, Homo sapiens
ccccaactctcccc

SEQ ID NO: 200780 - DNA, 20 bp, Homo sapiens
ccccaactctccccagtgcc

SEQ ID NO: 200781 - DNA, 17 bp, Homo sapiens
ccccaacttcaccaccc

SEQ ID NO: 200782 - DNA, 20 bp, Homo sapiens
ccccaacttcaccaccccct

SEQ ID NO: 200783 - DNA, 16 bp, Homo sapiens
ccccaagaaagcctca

SEQ ID NO: 200784 - DNA, 19 bp, Homo sapiens
ccccaagatgagctgcagc

SEQ ID NO: 200785 - DNA, 21 bp, Homo sapiens
ccccaagatgagctgcagccc

SEQ ID NO: 200786 - DNA, 15 bp, Homo sapiens
ccccaagcagccagc

SEQ ID NO: 200787 - DNA, 20 bp, Homo sapiens
ccccaagccctgcccctcct

SEQ ID NO: 200788 - DNA, 12 bp, Homo sapiens
ccccaaggaaga

SEQ ID NO: 200789 - DNA, 17 bp, Homo sapiens
ccccaaggaagaacaaa

SEQ ID NO: 200790 - DNA, 15 bp, Homo sapiens
ccccaaggggcagtc

SEQ ID NO: 200791 - DNA, 18 bp, Homo sapiens
ccccaatcgggtccagag

SEQ ID NO: 200792 - DNA, 16 bp, Homo sapiens
ccccaatgctctcctt

SEQ ID NO: 200793 - DNA, 14 bp, Homo sapiens
ccccacacaggcct

SEQ ID NO: 200794 - DNA, 20 bp, Homo sapiens
ccccacacaggcctggccca

SEQ ID NO: 200795 - DNA, 21 bp, Homo sapiens
ccccacacaggcctggcccag

SEQ ID NO: 200796 - DNA, 15 bp, Homo sapiens
ccccacaccccagcc

SEQ ID NO: 200797 - DNA, 16 bp, Homo sapiens
ccccacaccccagccc

SEQ ID NO: 200798 - DNA, 17 bp, Homo sapiens
ccccacaccccagccca

SEQ ID NO: 200799 - DNA, 14 bp, Homo sapiens
ccccacacgccggg

SEQ ID NO: 200800 - DNA, 19 bp, Homo sapiens
ccccacacgccggggctgg

SEQ ID NO: 200801 - DNA, 14 bp, Homo sapiens
ccccacagctacct

SEQ ID NO: 200802 - DNA, 23 bp, Homo sapiens
ccccacaggccacacgctgccca

SEQ ID NO: 200803 - DNA, 17 bp, Homo sapiens
ccccaccacacacaccc

SEQ ID NO: 200804 - DNA, 18 bp, Homo sapiens
ccccaccacacacaccct

SEQ ID NO: 200805 - DNA, 13 bp, Homo sapiens
ccccaccagcagc

SEQ ID NO: 200806 - DNA, 12 bp, Homo sapiens
ccccacccacct

SEQ ID NO: 200807 - DNA, 13 bp, Homo sapiens
ccccacccacctc

SEQ ID NO: 200808 - DNA, 20 bp, Homo sapiens
ccccacccacctccacccag

SEQ ID NO: 200809 - DNA, 13 bp, Homo sapiens
ccccacccaggag

SEQ ID NO: 200810 - DNA, 15 bp, Homo sapiens
ccccaccccacagat

SEQ ID NO: 200811 - DNA, 13 bp, Homo sapiens
ccccaccccagcc

SEQ ID NO: 200812 - DNA, 14 bp, Homo sapiens
ccccacccctaagt

SEQ ID NO: 200813 - DNA, 21 bp, Homo sapiens
ccccacccctaagtgcccaaa

SEQ ID NO: 200814 - DNA, 12 bp, Homo sapiens
ccccacccctcc

SEQ ID NO: 200815 - DNA, 13 bp, Homo sapiens
ccccacccctcca

SEQ ID NO: 200816 - DNA, 16 bp, Homo sapiens
ccccaccctcccctct

SEQ ID NO: 200817 - DNA, 18 bp, Homo sapiens
ccccacctcatgcctggc

SEQ ID NO: 200818 - DNA, 14 bp, Homo sapiens
ccccacctcttttc

SEQ ID NO: 200819 - DNA, 11 bp, Homo sapiens
ccccacctgcc

SEQ ID NO: 200820 - DNA, 15 bp, Homo sapiens
ccccacctgcctgac

SEQ ID NO: 200821 - DNA, 20 bp, Homo sapiens
ccccaccttccctccacctg

SEQ ID NO: 200822 - DNA, 23 bp, Homo sapiens
ccccaccttccctccacctgctt

SEQ ID NO: 200823 - DNA, 19 bp, Homo sapiens
ccccacgtggactctgtgc

SEQ ID NO: 200824 - DNA, 14 bp, Homo sapiens
ccccacgtggagct

SEQ ID NO: 200825 - DNA, 13 bp, Homo sapiens
ccccactcacaga

SEQ ID NO: 200826 - DNA, 21 bp, Homo sapiens
ccccactcacagagacacagg

SEQ ID NO: 200827 - DNA, 13 bp, Homo sapiens
ccccactcacccc

SEQ ID NO: 200828 - DNA, 15 bp, Homo sapiens
ccccactcaccccct

SEQ ID NO: 200829 - DNA, 16 bp, Homo sapiens
ccccactccctgccac

SEQ ID NO: 200830 - DNA, 15 bp, Homo sapiens
ccccactctccccac

SEQ ID NO: 200831 - DNA, 15 bp, Homo sapiens
ccccactgcctgccc

SEQ ID NO: 200832 - DNA, 21 bp, Homo sapiens
attgcttttgttgtgactttt

SEQ ID NO: 200833 - DNA, 17 bp, Homo sapiens
attggaaagacaggaag

SEQ ID NO: 200834 - DNA, 17 bp, Homo sapiens
attggaagagtgacctg

SEQ ID NO: 200835 - DNA, 20 bp, Homo sapiens
attggaagctgattcccaga

SEQ ID NO: 200836 - DNA, 15 bp, Homo sapiens
attggaattaacctg

SEQ ID NO: 200837 - DNA, 16 bp, Homo sapiens
attggaattaacctgg

SEQ ID NO: 200838 - DNA, 15 bp, Homo sapiens
attggaattctggat

SEQ ID NO: 200839 - DNA, 16 bp, Homo sapiens
attggacagacacaga

SEQ ID NO: 200840 - DNA, 15 bp, Homo sapiens
attggacagttttga

SEQ ID NO: 200841 - DNA, 22 bp, Homo sapiens
attggacagttttgatacaaac

SEQ ID NO: 200842 - DNA, 19 bp, Homo sapiens
attggacatggtctcctct

SEQ ID NO: 200843 - DNA, 19 bp, Homo sapiens
attggaggtgagatcacag

SEQ ID NO: 200844 - DNA, 21 bp, Homo sapiens
attggattattcatttaaaat

SEQ ID NO: 200845 - DNA, 23 bp, Homo sapiens
attggcatggctttatttgtttt

SEQ ID NO: 200846 - DNA, 16 bp, Homo sapiens
attggcattaaaactt

SEQ ID NO: 200847 - DNA, 17 bp, Homo sapiens
attggccgatgagctgg

SEQ ID NO: 200848 - DNA, 18 bp, Homo sapiens
attggccgatgagctggt

SEQ ID NO: 200849 - DNA, 12 bp, Homo sapiens
attggcctggag

SEQ ID NO: 200850 - DNA, 14 bp, Homo sapiens
attggcttgcactt

SEQ ID NO: 200851 - DNA, 18 bp, Homo sapiens
attggcttgcactttgtg

SEQ ID NO: 200852 - DNA, 12 bp, Homo sapiens
attggcttgttt

SEQ ID NO: 200853 - DNA, 17 bp, Homo sapiens
attgggcaagtgattga

SEQ ID NO: 200854 - DNA, 22 bp, Homo sapiens
attgggggctggtgccagcctt

SEQ ID NO: 200855 - DNA, 16 bp, Homo sapiens
attgggggggcttggg

SEQ ID NO: 200856 - DNA, 13 bp, Homo sapiens
attgggtgtgccc

SEQ ID NO: 200857 - DNA, 15 bp, Homo sapiens
attgggtgtgccctg

SEQ ID NO: 200858 - DNA, 13 bp, Homo sapiens
attgggttcatta

SEQ ID NO: 200859 - DNA, 14 bp, Homo sapiens
attggtagaggaag

SEQ ID NO: 200860 - DNA, 14 bp, Homo sapiens
attggtcattaaat

SEQ ID NO: 200861 - DNA, 15 bp, Homo sapiens
attggtcattaaata

SEQ ID NO: 200862 - DNA, 18 bp, Homo sapiens
attggtgataagtggaaa

SEQ ID NO: 200863 - DNA, 14 bp, Homo sapiens
attggtttctgttt

SEQ ID NO: 200864 - DNA, 17 bp, Homo sapiens
attgtaaaactgaggca

SEQ ID NO: 200865 - DNA, 21 bp, Homo sapiens
attgtaaaatagcttgtatag

SEQ ID NO: 200866 - DNA, 15 bp, Homo sapiens
attgtaaaattgtat

SEQ ID NO: 200867 - DNA, 14 bp, Homo sapiens
attgtaacatattt

SEQ ID NO: 200868 - DNA, 16 bp, Homo sapiens
attgtaagtggaaaat

SEQ ID NO: 200869 - DNA, 19 bp, Homo sapiens
attgtaagtggaaaatgca

SEQ ID NO: 200870 - DNA, 13 bp, Homo sapiens
attgtaatgttac

SEQ ID NO: 200871 - DNA, 20 bp, Homo sapiens
attgtaattcaagctttccg

SEQ ID NO: 200872 - DNA, 21 bp, Homo sapiens
attgtacagaatcattgctta

SEQ ID NO: 200873 - DNA, 15 bp, Homo sapiens
attgtacatatggaa

SEQ ID NO: 200874 - DNA, 15 bp, Homo sapiens
attgtactccagcct

SEQ ID NO: 200875 - DNA, 17 bp, Homo sapiens
attgtactccagcctgg

SEQ ID NO: 200876 - DNA, 16 bp, Homo sapiens
attgtagcatttcttg

SEQ ID NO: 200877 - DNA, 17 bp, Homo sapiens
attgtagcccagttggt

SEQ ID NO: 200878 - DNA, 13 bp, Homo sapiens
attgtataaacta

SEQ ID NO: 200879 - DNA, 15 bp, Homo sapiens
attgtatacattttg

SEQ ID NO: 200880 - DNA, 17 bp, Homo sapiens
attgtataggccatctg

SEQ ID NO: 200881 - DNA, 11 bp, Homo sapiens
attgtatatat

SEQ ID NO: 200882 - DNA, 15 bp, Homo sapiens
attgtatatatgtgt

SEQ ID NO: 200883 - DNA, 22 bp, Homo sapiens
attgtatatatgtgtgtttaaa

SEQ ID NO: 200884 - DNA, 16 bp, Homo sapiens
attgtatctagtgcag

SEQ ID NO: 200885 - DNA, 19 bp, Homo sapiens
attgtatctagtgcagctg

SEQ ID NO: 200886 - DNA, 14 bp, Homo sapiens
attgtatgatgtgt

SEQ ID NO: 200887 - DNA, 15 bp, Homo sapiens
attgtatgatgtgtt

SEQ ID NO: 200888 - DNA, 21 bp, Homo sapiens
attgtatgatgtgttgtgata

SEQ ID NO: 200889 - DNA, 20 bp, Homo sapiens
attgtattgtctgacacatg

SEQ ID NO: 200890 - DNA, 20 bp, Homo sapiens
attgtattttactttgtgca

SEQ ID NO: 200891 - DNA, 22 bp, Homo sapiens
attgtattttactttgtgcaat

SEQ ID NO: 200892 - DNA, 14 bp, Homo sapiens
attgtattttagta

SEQ ID NO: 200893 - DNA, 15 bp, Homo sapiens
attgtattttagtat

SEQ ID NO: 200894 - DNA, 23 bp, Homo sapiens
attgtcaaagtggtgagaggcat

SEQ ID NO: 200895 - DNA, 19 bp, Homo sapiens
attgtcagctactaatgat

SEQ ID NO: 200896 - DNA, 13 bp, Homo sapiens
attgtcatttata

SEQ ID NO: 200897 - DNA, 15 bp, Homo sapiens
attgtccacaaatgt

SEQ ID NO: 200898 - DNA, 14 bp, Homo sapiens
attgtccatgccta

SEQ ID NO: 200899 - DNA, 15 bp, Homo sapiens
attgtccttcagagc

SEQ ID NO: 200900 - DNA, 14 bp, Homo sapiens
attgtctcattgcc

SEQ ID NO: 200901 - DNA, 14 bp, Homo sapiens
attgtgaaatttgt

SEQ ID NO: 200902 - DNA, 17 bp, Homo sapiens
attgtgaaatttgttaa

SEQ ID NO: 200903 - DNA, 23 bp, Homo sapiens
attgtgaatgttgtcctgtgtca

SEQ ID NO: 200904 - DNA, 17 bp, Homo sapiens
attgtgaccaagttata

SEQ ID NO: 200905 - DNA, 12 bp, Homo sapiens
attgtgcatgca

SEQ ID NO: 200906 - DNA, 18 bp, Homo sapiens
attgtggagaggagagaa

SEQ ID NO: 200907 - DNA, 22 bp, Homo sapiens
attgtgtacaaagtagagaagt

SEQ ID NO: 200908 - DNA, 12 bp, Homo sapiens
attgtgtgatgt

SEQ ID NO: 200909 - DNA, 14 bp, Homo sapiens
attgtgttgtgaat

SEQ ID NO: 200910 - DNA, 19 bp, Homo sapiens
attgttaaaaccttactta

SEQ ID NO: 200911 - DNA, 18 bp, Homo sapiens
attgttataaataaaatt

SEQ ID NO: 200912 - DNA, 20 bp, Homo sapiens
attgttataaataaaattgt

SEQ ID NO: 200913 - DNA, 21 bp, Homo sapiens
attgttcagaagacctccctg

SEQ ID NO: 200914 - DNA, 12 bp, Homo sapiens
attgttccaaga

SEQ ID NO: 200915 - DNA, 16 bp, Homo sapiens
attgttccaagacatt

SEQ ID NO: 200916 - DNA, 20 bp, Homo sapiens
attgttccaagacattgtca

SEQ ID NO: 200917 - DNA, 22 bp, Homo sapiens
attgttccaagacattgtcaat

SEQ ID NO: 200918 - DNA, 12 bp, Homo sapiens
attgttcctctt

SEQ ID NO: 200919 - DNA, 18 bp, Homo sapiens
attgttctgggtgatttc

SEQ ID NO: 200920 - DNA, 20 bp, Homo sapiens
attgttctgggtgatttcta

SEQ ID NO: 200921 - DNA, 21 bp, Homo sapiens
attgttcttgtaaaactgtga

SEQ ID NO: 200922 - DNA, 22 bp, Homo sapiens
attgttcttgtaaaactgtgac

SEQ ID NO: 200923 - DNA, 16 bp, Homo sapiens
attgttgaaactaaag

SEQ ID NO: 200924 - DNA, 20 bp, Homo sapiens
attgttgaggtggtctgaat

SEQ ID NO: 200925 - DNA, 22 bp, Homo sapiens
attgttgaggtggtctgaatgt

SEQ ID NO: 200926 - DNA, 15 bp, Homo sapiens
attgttgtgggcttt

SEQ ID NO: 200927 - DNA, 21 bp, Homo sapiens
attgtttatttatcagtgaca

SEQ ID NO: 200928 - DNA, 13 bp, Homo sapiens
attgtttgcttat

SEQ ID NO: 200929 - DNA, 21 bp, Homo sapiens
attgtttgcttattgttccaa

SEQ ID NO: 200930 - DNA, 18 bp, Homo sapiens
attgttttatcatgacat

SEQ ID NO: 200931 - DNA, 15 bp, Homo sapiens
attgttttgcacttt

SEQ ID NO: 200932 - DNA, 22 bp, Homo sapiens
attgtttttaagaaaaacatgt

SEQ ID NO: 200933 - DNA, 23 bp, Homo sapiens
attgtttttagaaatttattctt

SEQ ID NO: 200934 - DNA, 16 bp, Homo sapiens
attgtttttatatatt

SEQ ID NO: 200935 - DNA, 17 bp, Homo sapiens
attgtttttatatatta

SEQ ID NO: 200936 - DNA, 19 bp, Homo sapiens
attgtttttgaatttaaat

SEQ ID NO: 200937 - DNA, 14 bp, Homo sapiens
atttaaaaaaaaac

SEQ ID NO: 200938 - DNA, 15 bp, Homo sapiens
atttaaaaaataact

SEQ ID NO: 200939 - DNA, 20 bp, Homo sapiens
atttaaaaaatgaatagtac

SEQ ID NO: 200940 - DNA, 16 bp, Homo sapiens
atttaaaaactggaac

SEQ ID NO: 200941 - DNA, 14 bp, Homo sapiens
atttaaaaatcttt

SEQ ID NO: 200942 - DNA, 19 bp, Homo sapiens
atttaaaaatgcatgataa

SEQ ID NO: 200943 - DNA, 15 bp, Homo sapiens
atttaaaaatgccaa

SEQ ID NO: 200944 - DNA, 11 bp, Homo sapiens
atttaaaacaa

SEQ ID NO: 200945 - DNA, 15 bp, Homo sapiens
atttaaaagacaaac

SEQ ID NO: 200946 - DNA, 19 bp, Homo sapiens
atttaaaagacaaacacct

SEQ ID NO: 200947 - DNA, 14 bp, Homo sapiens
atttaaaatggact

SEQ ID NO: 200948 - DNA, 13 bp, Homo sapiens
atttaaaattggc

SEQ ID NO: 200949 - DNA, 15 bp, Homo sapiens
atttaaaattggcac

SEQ ID NO: 200950 - DNA, 16 bp, Homo sapiens
atttaaaattggcacc

SEQ ID NO: 200951 - DNA, 15 bp, Homo sapiens
atttaaagaaagtga

SEQ ID NO: 200952 - DNA, 12 bp, Homo sapiens
atttaaagctgt

SEQ ID NO: 200953 - DNA, 17 bp, Homo sapiens
atttaaatagaacttga

SEQ ID NO: 200954 - DNA, 22 bp, Homo sapiens
atttaaatataattctgtaaat

SEQ ID NO: 200955 - DNA, 19 bp, Homo sapiens
atttaaatgtaaagacaaa

SEQ ID NO: 200956 - DNA, 18 bp, Homo sapiens
atttaacccattattcct

SEQ ID NO: 200957 - DNA, 22 bp, Homo sapiens
atttaactactaagaataaata

SEQ ID NO: 200958 - DNA, 17 bp, Homo sapiens
atttaactagcacttta

SEQ ID NO: 200959 - DNA, 13 bp, Homo sapiens
atttaactgacta

SEQ ID NO: 200960 - DNA, 18 bp, Homo sapiens
atttaacttgagggtaat

SEQ ID NO: 200961 - DNA, 18 bp, Homo sapiens
atttaagaaaaacaaaat

SEQ ID NO: 200962 - DNA, 21 bp, Homo sapiens
atttaagaaaatacaataaac

SEQ ID NO: 200963 - DNA, 16 bp, Homo sapiens
atttaagcaacatctt

SEQ ID NO: 200964 - DNA, 15 bp, Homo sapiens
atttaagcacaaact

SEQ ID NO: 200965 - DNA, 12 bp, Homo sapiens
atttaagcattg

SEQ ID NO: 200966 - DNA, 15 bp, Homo sapiens
atttaagcattgttt

SEQ ID NO: 200967 - DNA, 21 bp, Homo sapiens
ccccactgtccccctacccac

SEQ ID NO: 200968 - DNA, 16 bp, Homo sapiens
ccccacttatgctgct

SEQ ID NO: 200969 - DNA, 17 bp, Homo sapiens
ccccagaaagcctcctg

SEQ ID NO: 200970 - DNA, 15 bp, Homo sapiens
ccccagaaccccaac

SEQ ID NO: 200971 - DNA, 23 bp, Homo sapiens
ccccagaccccatccagccaggg

SEQ ID NO: 200972 - DNA, 21 bp, Homo sapiens
ccccagagactcagagggagg

SEQ ID NO: 200973 - DNA, 11 bp, Homo sapiens
ccccagagcca

SEQ ID NO: 200974 - DNA, 21 bp, Homo sapiens
atttaagtttgtagtttttgc

SEQ ID NO: 200975 - DNA, 16 bp, Homo sapiens
atttaataaaaaaaca

SEQ ID NO: 200976 - DNA, 16 bp, Homo sapiens
atttaataacaattgt

SEQ ID NO: 200977 - DNA, 21 bp, Homo sapiens
atttaataactttgctggaaa

SEQ ID NO: 200978 - DNA, 18 bp, Homo sapiens
atttaatatactgcatat

SEQ ID NO: 200979 - DNA, 21 bp, Homo sapiens
atttaatatactgcatatcct

SEQ ID NO: 200980 - DNA, 14 bp, Homo sapiens
atttaatatgcatc

SEQ ID NO: 200981 - DNA, 14 bp, Homo sapiens
atttaatcatttcc

SEQ ID NO: 200982 - DNA, 22 bp, Homo sapiens
atttaatgataagtaaatgcta

SEQ ID NO: 200983 - DNA, 24 bp, Homo sapiens
atttaatgatttttgtgtatccag

SEQ ID NO: 200984 - DNA, 22 bp, Homo sapiens
atttaatgtcgaggctctattt

SEQ ID NO: 200985 - DNA, 13 bp, Homo sapiens
atttaatgttaca

SEQ ID NO: 200986 - DNA, 15 bp, Homo sapiens
atttaattattaact

SEQ ID NO: 200987 - DNA, 18 bp, Homo sapiens
atttaattcctcttttta

SEQ ID NO: 200988 - DNA, 14 bp, Homo sapiens
atttaattgtaatt

SEQ ID NO: 200989 - DNA, 16 bp, Homo sapiens
atttaatttcataaat

SEQ ID NO: 200990 - DNA, 20 bp, Homo sapiens
atttaatttcataaattggc

SEQ ID NO: 200991 - DNA, 22 bp, Homo sapiens
atttacacaaaaagaaagctgt

SEQ ID NO: 200992 - DNA, 23 bp, Homo sapiens
atttacacaaaaagaaagctgtg

SEQ ID NO: 200993 - DNA, 20 bp, Homo sapiens
atttacatgaattgcatttt

SEQ ID NO: 200994 - DNA, 17 bp, Homo sapiens
atttacatgttcttcca

SEQ ID NO: 200995 - DNA, 23 bp, Homo sapiens
atttactaagccacaagaaattt

SEQ ID NO: 200996 - DNA, 21 bp, Homo sapiens
atttactgagcttctctgtga

SEQ ID NO: 200997 - DNA, 19 bp, Homo sapiens
atttacttcttatacattt

SEQ ID NO: 200998 - DNA, 14 bp, Homo sapiens
atttacttgatcat

SEQ ID NO: 200999 - DNA, 19 bp, Homo sapiens
atttactttttaaacagtg

SEQ ID NO: 201000 - DNA, 21 bp, Homo sapiens
atttagaaaatagagctttta

SEQ ID NO: 201001 - DNA, 21 bp, Homo sapiens
atttagacaatggctatatta

SEQ ID NO: 201002 - DNA, 17 bp, Homo sapiens
atttaggagaagttggt

SEQ ID NO: 201003 - DNA, 22 bp, Homo sapiens
atttaggcagattgaaaaggac

SEQ ID NO: 201004 - DNA, 16 bp, Homo sapiens
atttagggaataatta

SEQ ID NO: 201005 - DNA, 17 bp, Homo sapiens
atttagtcccttaaaaa

SEQ ID NO: 201006 - DNA, 16 bp, Homo sapiens
atttagtcctcacctt

SEQ ID NO: 201007 - DNA, 20 bp, Homo sapiens
atttagtgatattgtgggta

SEQ ID NO: 201008 - DNA, 17 bp, Homo sapiens
atttagttctttgttat

SEQ ID NO: 201009 - DNA, 23 bp, Homo sapiens
atttataaactaattttgtacgt

SEQ ID NO: 201010 - DNA, 16 bp, Homo sapiens
atttataacattgtaa

SEQ ID NO: 201011 - DNA, 14 bp, Homo sapiens
atttataactcatc

SEQ ID NO: 201012 - DNA, 14 bp, Homo sapiens
atttataatgttag

SEQ ID NO: 201013 - DNA, 14 bp, Homo sapiens
atttatagggcttt

SEQ ID NO: 201014 - DNA, 17 bp, Homo sapiens
atttatagggcttttat

SEQ ID NO: 201015 - DNA, 12 bp, Homo sapiens
atttatagtttg

SEQ ID NO: 201016 - DNA, 22 bp, Homo sapiens
atttatagtttgtacatgcatt

SEQ ID NO: 201017 - DNA, 16 bp, Homo sapiens
atttatataattatgt

SEQ ID NO: 201018 - DNA, 18 bp, Homo sapiens
atttatataattatgtta

SEQ ID NO: 201019 - DNA, 16 bp, Homo sapiens
atttatatatgaagta

SEQ ID NO: 201020 - DNA, 14 bp, Homo sapiens
atttatatatttat

SEQ ID NO: 201021 - DNA, 16 bp, Homo sapiens
atttatattagagtgc

SEQ ID NO: 201022 - DNA, 15 bp, Homo sapiens
atttatattcagaga

SEQ ID NO: 201023 - DNA, 19 bp, Homo sapiens
atttatattcagagatgta

SEQ ID NO: 201024 - DNA, 19 bp, Homo sapiens
atttatattgtcactcatt

SEQ ID NO: 201025 - DNA, 17 bp, Homo sapiens
atttatcacacaaagca

SEQ ID NO: 201026 - DNA, 16 bp, Homo sapiens
atttatcacacttctg

SEQ ID NO: 201027 - DNA, 14 bp, Homo sapiens
atttatcagtgaca

SEQ ID NO: 201028 - DNA, 15 bp, Homo sapiens
atttatcagtgacag

SEQ ID NO: 201029 - DNA, 23 bp, Homo sapiens
atttatcagtgacagagttcact

SEQ ID NO: 201030 - DNA, 16 bp, Homo sapiens
atttatcatatttaat

SEQ ID NO: 201031 - DNA, 13 bp, Homo sapiens
atttatcattctt

SEQ ID NO: 201032 - DNA, 21 bp, Homo sapiens
atttatccaaagcattgcaga

SEQ ID NO: 201033 - DNA, 14 bp, Homo sapiens
atttatctgtgaat

SEQ ID NO: 201034 - DNA, 14 bp, Homo sapiens
atttatcttatcta

SEQ ID NO: 201035 - DNA, 13 bp, Homo sapiens
atttatcttctgt

SEQ ID NO: 201036 - DNA, 20 bp, Homo sapiens
atttatcttctgtttttctc

SEQ ID NO: 201037 - DNA, 22 bp, Homo sapiens
atttatcttctgtttttctcaa

SEQ ID NO: 201038 - DNA, 18 bp, Homo sapiens
atttatgatcacttggaa

SEQ ID NO: 201039 - DNA, 16 bp, Homo sapiens
atttatgcatttatgc

SEQ ID NO: 201040 - DNA, 18 bp, Homo sapiens
atttatgcatttatgcat

SEQ ID NO: 201041 - DNA, 20 bp, Homo sapiens
atttatgcctctgtatttaa

SEQ ID NO: 201042 - DNA, 18 bp, Homo sapiens
atttatgtagatgtgcat

SEQ ID NO: 201043 - DNA, 13 bp, Homo sapiens
atttatgtgtgag

SEQ ID NO: 201044 - DNA, 18 bp, Homo sapiens
atttatgtgtgaggagct

SEQ ID NO: 201045 - DNA, 20 bp, Homo sapiens
atttatgtttaagtgcttgg

SEQ ID NO: 201046 - DNA, 21 bp, Homo sapiens
atttattaaaatgattgtaaa

SEQ ID NO: 201047 - DNA, 23 bp, Homo sapiens
atttattaaaatgattgtaaaat

SEQ ID NO: 201048 - DNA, 14 bp, Homo sapiens
atttattaaacttc

SEQ ID NO: 201049 - DNA, 15 bp, Homo sapiens
atttattaaacttca

SEQ ID NO: 201050 - DNA, 16 bp, Homo sapiens
atttattaagatggat

SEQ ID NO: 201051 - DNA, 22 bp, Homo sapiens
atttattaagatggattctcag

SEQ ID NO: 201052 - DNA, 15 bp, Homo sapiens
atttattaagtctgg

SEQ ID NO: 201053 - DNA, 16 bp, Homo sapiens
atttattaagtctggg

SEQ ID NO: 201054 - DNA, 10 bp, Homo sapiens
atttattatg

SEQ ID NO: 201055 - DNA, 18 bp, Homo sapiens
atttattattaaatcagt

SEQ ID NO: 201056 - DNA, 21 bp, Homo sapiens
atttattattaaatcagtttt

SEQ ID NO: 201057 - DNA, 21 bp, Homo sapiens
atttattattttcacctgttt

SEQ ID NO: 201058 - DNA, 20 bp, Homo sapiens
atttattcagcttcatttgt

SEQ ID NO: 201059 - DNA, 16 bp, Homo sapiens
atttattgaagatgtc

SEQ ID NO: 201060 - DNA, 19 bp, Homo sapiens
atttattgaattattttgt

SEQ ID NO: 201061 - DNA, 20 bp, Homo sapiens
atttattgaattattttgtt

SEQ ID NO: 201062 - DNA, 16 bp, Homo sapiens
atttattgtatatatg

SEQ ID NO: 201063 - DNA, 18 bp, Homo sapiens
atttattgtattttagta

SEQ ID NO: 201064 - DNA, 19 bp, Homo sapiens
atttattgtttatttatca

SEQ ID NO: 201065 - DNA, 12 bp, Homo sapiens
atttatttaata

SEQ ID NO: 201066 - DNA, 13 bp, Homo sapiens
atttatttaataa

SEQ ID NO: 201067 - DNA, 16 bp, Homo sapiens
atttatttaataacaa

SEQ ID NO: 201068 - DNA, 24 bp, Homo sapiens
atttatttactgagcttctctgtg

SEQ ID NO: 201069 - DNA, 15 bp, Homo sapiens
atttatttattatta

SEQ ID NO: 201070 - DNA, 13 bp, Homo sapiens
atttatttattga

SEQ ID NO: 201071 - DNA, 14 bp, Homo sapiens
atttatttgactaa

SEQ ID NO: 201072 - DNA, 12 bp, Homo sapiens
atttattttatt

SEQ ID NO: 201073 - DNA, 20 bp, Homo sapiens
atttattttattttagcagt

SEQ ID NO: 201074 - DNA, 13 bp, Homo sapiens
atttattttcctc

SEQ ID NO: 201075 - DNA, 17 bp, Homo sapiens
atttattttcctcccca

SEQ ID NO: 201076 - DNA, 19 bp, Homo sapiens
atttattttgtatttttga

SEQ ID NO: 201077 - DNA, 15 bp, Homo sapiens
atttatttttgtact

SEQ ID NO: 201078 - DNA, 17 bp, Homo sapiens
atttatttttgtactgt

SEQ ID NO: 201079 - DNA, 18 bp, Homo sapiens
atttattttttacattat

SEQ ID NO: 201080 - DNA, 19 bp, Homo sapiens
atttatttttttattcttc

SEQ ID NO: 201081 - DNA, 19 bp, Homo sapiens
atttcaaaaatataactta

SEQ ID NO: 201082 - DNA, 13 bp, Homo sapiens
atttcaaaatgca

SEQ ID NO: 201083 - DNA, 19 bp, Homo sapiens
atttcaaaatgcatgtgat

SEQ ID NO: 201084 - DNA, 20 bp, Homo sapiens
atttcacagataatttactt

SEQ ID NO: 201085 - DNA, 22 bp, Homo sapiens
atttcacctgtgacaaaggatg

SEQ ID NO: 201086 - DNA, 16 bp, Homo sapiens
atttcagatgctttag

SEQ ID NO: 201087 - DNA, 18 bp, Homo sapiens
atttcagctgtgagcttt

SEQ ID NO: 201088 - DNA, 15 bp, Homo sapiens
atttcaggagggatt

SEQ ID NO: 201089 - DNA, 18 bp, Homo sapiens
atttcaggcacatcattg

SEQ ID NO: 201090 - DNA, 21 bp, Homo sapiens
atttcagtaagatcaagctcc

SEQ ID NO: 201091 - DNA, 18 bp, Homo sapiens
atttcagtatcatctcca

SEQ ID NO: 201092 - DNA, 12 bp, Homo sapiens
atttcataaaaa

SEQ ID NO: 201093 - DNA, 18 bp, Homo sapiens
atttcataaacaacttaa

SEQ ID NO: 201094 - DNA, 15 bp, Homo sapiens
atttcatattgagat

SEQ ID NO: 201095 - DNA, 18 bp, Homo sapiens
atttcatccatatttctt

SEQ ID NO: 201096 - DNA, 16 bp, Homo sapiens
atttcatctttccaaa

SEQ ID NO: 201097 - DNA, 16 bp, Homo sapiens
atttcatgattagaca

SEQ ID NO: 201098 - DNA, 18 bp, Homo sapiens
atttcatgtgatctatta

SEQ ID NO: 201099 - DNA, 14 bp, Homo sapiens
atttcattcctaac

SEQ ID NO: 201100 - DNA, 17 bp, Homo sapiens
atttcattgaatacttt

SEQ ID NO: 201101 - DNA, 17 bp, Homo sapiens
atttcattgtatgatgt

SEQ ID NO: 201102 - DNA, 13 bp, Homo sapiens
atttccaaataaa

SEQ ID NO: 201103 - DNA, 17 bp, Homo sapiens
atttccaaataaaatga

SEQ ID NO: 201104 - DNA, 20 bp, Homo sapiens
cccctctcctgcatccctcc

SEQ ID NO: 201105 - DNA, 20 bp, Homo sapiens
cccctctcttaccccgtccc

SEQ ID NO: 201106 - DNA, 13 bp, Homo sapiens
cccctctgcccag

SEQ ID NO: 201107 - DNA, 17 bp, Homo sapiens
cccctctgcccagcttg

SEQ ID NO: 201108 - DNA, 18 bp, Homo sapiens
cccctctgcccagcttgg

SEQ ID NO: 201109 - DNA, 21 bp, Homo sapiens
atttccaccaagggtatctgc

SEQ ID NO: 201110 - DNA, 12 bp, Homo sapiens
atttccagagtc

SEQ ID NO: 201111 - DNA, 21 bp, Homo sapiens
atttccagagtccggaggcag

SEQ ID NO: 201112 - DNA, 18 bp, Homo sapiens
atttccagggcagcagcc

SEQ ID NO: 201113 - DNA, 21 bp, Homo sapiens
atttccatggattcccctgga

SEQ ID NO: 201114 - DNA, 15 bp, Homo sapiens
atttccattatttat

SEQ ID NO: 201115 - DNA, 15 bp, Homo sapiens
atttccattccagaa

SEQ ID NO: 201116 - DNA, 15 bp, Homo sapiens
atttccattctttta

SEQ ID NO: 201117 - DNA, 15 bp, Homo sapiens
atttccatttctgat

SEQ ID NO: 201118 - DNA, 19 bp, Homo sapiens
atttcccaaagcagtgcat

SEQ ID NO: 201119 - DNA, 18 bp, Homo sapiens
atttccctaaaatacatt

SEQ ID NO: 201120 - DNA, 20 bp, Homo sapiens
atttccctaaaatacattta

SEQ ID NO: 201121 - DNA, 13 bp, Homo sapiens
atttccctttttt

SEQ ID NO: 201122 - DNA, 18 bp, Homo sapiens
atttcccttttttcttcc

SEQ ID NO: 201123 - DNA, 23 bp, Homo sapiens
atttccgaagaccttctgaagat

SEQ ID NO: 201124 - DNA, 22 bp, Homo sapiens
atttccgttgtacatgttcctg

SEQ ID NO: 201125 - DNA, 22 bp, Homo sapiens
atttcctaatgagatatatctt

SEQ ID NO: 201126 - DNA, 23 bp, Homo sapiens
atttcctaatgagatatatcttt

SEQ ID NO: 201127 - DNA, 22 bp, Homo sapiens
atttcctcaacgttgctcccca

SEQ ID NO: 201128 - DNA, 11 bp, Homo sapiens
atttcctctat

SEQ ID NO: 201129 - DNA, 17 bp, Homo sapiens
atttcctctgagctgtt

SEQ ID NO: 201130 - DNA, 18 bp, Homo sapiens
atttcctctgagctgtta

SEQ ID NO: 201131 - DNA, 17 bp, Homo sapiens
atttcctcttccttctc

SEQ ID NO: 201132 - DNA, 18 bp, Homo sapiens
atttcctcttccttctct

SEQ ID NO: 201133 - DNA, 19 bp, Homo sapiens
atttcctcttccttctcta

SEQ ID NO: 201134 - DNA, 18 bp, Homo sapiens
atttccttaaactgtgtg

SEQ ID NO: 201135 - DNA, 18 bp, Homo sapiens
atttcctttgcgcaaact

SEQ ID NO: 201136 - DNA, 13 bp, Homo sapiens
atttcgtgtaata

SEQ ID NO: 201137 - DNA, 17 bp, Homo sapiens
atttcgtgtaatattct

SEQ ID NO: 201138 - DNA, 20 bp, Homo sapiens
atttcgtgtaatattctctg

SEQ ID NO: 201139 - DNA, 18 bp, Homo sapiens
atttctaaatcctcacta

SEQ ID NO: 201140 - DNA, 20 bp, Homo sapiens
atttctaactaaggacagga

SEQ ID NO: 201141 - DNA, 16 bp, Homo sapiens
atttctaagcttattt

SEQ ID NO: 201142 - DNA, 17 bp, Homo sapiens
atttctacctttctgag

SEQ ID NO: 201143 - DNA, 15 bp, Homo sapiens
atttctactttgact

SEQ ID NO: 201144 - DNA, 20 bp, Homo sapiens
atttctagaaaagcttccta

SEQ ID NO: 201145 - DNA, 20 bp, Homo sapiens
atttctagacagtattgcca

SEQ ID NO: 201146 - DNA, 23 bp, Homo sapiens
atttctagatatgagaaatataa

SEQ ID NO: 201147 - DNA, 14 bp, Homo sapiens
atttctagcaggca

SEQ ID NO: 201148 - DNA, 15 bp, Homo sapiens
atttctagcaggcag

SEQ ID NO: 201149 - DNA, 17 bp, Homo sapiens
atttctagcaggcagga

SEQ ID NO: 201150 - DNA, 15 bp, Homo sapiens
atttctatctgcaaa

SEQ ID NO: 201151 - DNA, 23 bp, Homo sapiens
atttctattcaaggtggccaaat

SEQ ID NO: 201152 - DNA, 20 bp, Homo sapiens
atttctcaaagatctgaatt

SEQ ID NO: 201153 - DNA, 13 bp, Homo sapiens
atttctcaaagtt

SEQ ID NO: 201154 - DNA, 19 bp, Homo sapiens
atttctcaacaaagcacag

SEQ ID NO: 201155 - DNA, 14 bp, Homo sapiens
atttctcatgtgct

SEQ ID NO: 201156 - DNA, 18 bp, Homo sapiens
atttctcatgtgctttgt

SEQ ID NO: 201157 - DNA, 15 bp, Homo sapiens
atttctccatacgca

SEQ ID NO: 201158 - DNA, 18 bp, Homo sapiens
atttctccatcccctccc

SEQ ID NO: 201159 - DNA, 20 bp, Homo sapiens
atttctctccccactgaaaa

SEQ ID NO: 201160 - DNA, 15 bp, Homo sapiens
atttctcttaagtac

SEQ ID NO: 201161 - DNA, 15 bp, Homo sapiens
atttctcttcagtgt

SEQ ID NO: 201162 - DNA, 21 bp, Homo sapiens
atttctcttcagtgtgttgac

SEQ ID NO: 201163 - DNA, 14 bp, Homo sapiens
atttctgatgtctc

SEQ ID NO: 201164 - DNA, 19 bp, Homo sapiens
atttctgtggaaaacaatt

SEQ ID NO: 201165 - DNA, 23 bp, Homo sapiens
atttctgtggaaaacaatttgca

SEQ ID NO: 201166 - DNA, 15 bp, Homo sapiens
atttctgtttctcat

SEQ ID NO: 201167 - DNA, 21 bp, Homo sapiens
atttcttccacgtaattcaat

SEQ ID NO: 201168 - DNA, 23 bp, Homo sapiens
atttcttcgctgctctagctggc

SEQ ID NO: 201169 - DNA, 11 bp, Homo sapiens
atttcttgctt

SEQ ID NO: 201170 - DNA, 12 bp, Homo sapiens
atttcttgcttt

SEQ ID NO: 201171 - DNA, 13 bp, Homo sapiens
atttcttgtgcct

SEQ ID NO: 201172 - DNA, 11 bp, Homo sapiens
atttctttaat

SEQ ID NO: 201173 - DNA, 16 bp, Homo sapiens
atttctttatttctgt

SEQ ID NO: 201174 - DNA, 17 bp, Homo sapiens
atttctttgattgtgaa

SEQ ID NO: 201175 - DNA, 22 bp, Homo sapiens
atttctttgttatcaaacttca

SEQ ID NO: 201176 - DNA, 10 bp, Homo sapiens
atttctttta

SEQ ID NO: 201177 - DNA, 11 bp, Homo sapiens
atttcttttat

SEQ ID NO: 201178 - DNA, 14 bp, Homo sapiens
atttcttttatata

SEQ ID NO: 201179 - DNA, 21 bp, Homo sapiens
atttcttttatatataaaata

SEQ ID NO: 201180 - DNA, 17 bp, Homo sapiens
atttgaaactgctaatt

SEQ ID NO: 201181 - DNA, 15 bp, Homo sapiens
atttgaactgagccg

SEQ ID NO: 201182 - DNA, 22 bp, Homo sapiens
atttgaagaaggaggaatttta

SEQ ID NO: 201183 - DNA, 16 bp, Homo sapiens
atttgaaggacctaaa

SEQ ID NO: 201184 - DNA, 14 bp, Homo sapiens
atttgaagtggaaa

SEQ ID NO: 201185 - DNA, 11 bp, Homo sapiens
atttgaatgaa

SEQ ID NO: 201186 - DNA, 16 bp, Homo sapiens
atttgaatgaaaaatt

SEQ ID NO: 201187 - DNA, 21 bp, Homo sapiens
atttgaatggattaaatggca

SEQ ID NO: 201188 - DNA, 22 bp, Homo sapiens
atttgaatggattaaatggcac

SEQ ID NO: 201189 - DNA, 13 bp, Homo sapiens
atttgacacactc

SEQ ID NO: 201190 - DNA, 14 bp, Homo sapiens
atttgacacactca

SEQ ID NO: 201191 - DNA, 14 bp, Homo sapiens
atttgacacataaa

SEQ ID NO: 201192 - DNA, 15 bp, Homo sapiens
atttgagacattcca

SEQ ID NO: 201193 - DNA, 23 bp, Homo sapiens
atttgaggagcagcttcagttgt

SEQ ID NO: 201194 - DNA, 13 bp, Homo sapiens
atttgaggtcaag

SEQ ID NO: 201195 - DNA, 15 bp, Homo sapiens
atttgatgaaagctg

SEQ ID NO: 201196 - DNA, 17 bp, Homo sapiens
atttgatggtgaatatt

SEQ ID NO: 201197 - DNA, 19 bp, Homo sapiens
atttgatggtgaatattac

SEQ ID NO: 201198 - DNA, 23 bp, Homo sapiens
atttgattctgtgtgttttcata

SEQ ID NO: 201199 - DNA, 22 bp, Homo sapiens
atttgatttcgatgtacagtct

SEQ ID NO: 201200 - DNA, 17 bp, Homo sapiens
atttgcagctgctggtt

SEQ ID NO: 201201 - DNA, 18 bp, Homo sapiens
atttgcatattctattgt

SEQ ID NO: 201202 - DNA, 13 bp, Homo sapiens
atttgcatggatt

SEQ ID NO: 201203 - DNA, 16 bp, Homo sapiens
atttgccagcacaggg

SEQ ID NO: 201204 - DNA, 23 bp, Homo sapiens
atttgccccaacttaagtttaga

SEQ ID NO: 201205 - DNA, 23 bp, Homo sapiens
atttgcccttcaggacccttcta

SEQ ID NO: 201206 - DNA, 15 bp, Homo sapiens
atttgccgatttcct

SEQ ID NO: 201207 - DNA, 22 bp, Homo sapiens
atttgccgatttcctaagctgt

SEQ ID NO: 201208 - DNA, 18 bp, Homo sapiens
atttgcctaattcctggc

SEQ ID NO: 201209 - DNA, 20 bp, Homo sapiens
atttgcctaattcctggcat

SEQ ID NO: 201210 - DNA, 17 bp, Homo sapiens
atttgccttaggaagtg

SEQ ID NO: 201211 - DNA, 13 bp, Homo sapiens
atttgccttttaa

SEQ ID NO: 201212 - DNA, 20 bp, Homo sapiens
atttgccttttaaattcttt

SEQ ID NO: 201213 - DNA, 19 bp, Homo sapiens
atttgctaatgaattttaa

SEQ ID NO: 201214 - DNA, 19 bp, Homo sapiens
atttgctgaataacaacaa

SEQ ID NO: 201215 - DNA, 12 bp, Homo sapiens
atttgctgctga

SEQ ID NO: 201216 - DNA, 13 bp, Homo sapiens
atttgcttattta

SEQ ID NO: 201217 - DNA, 14 bp, Homo sapiens
atttgcttatttat

SEQ ID NO: 201218 - DNA, 21 bp, Homo sapiens
atttggaagagaggcacctgc

SEQ ID NO: 201219 - DNA, 16 bp, Homo sapiens
atttggagttaggtcc

SEQ ID NO: 201220 - DNA, 16 bp, Homo sapiens
atttggatatctgtta

SEQ ID NO: 201221 - DNA, 15 bp, Homo sapiens
atttggatcctgtgt

SEQ ID NO: 201222 - DNA, 15 bp, Homo sapiens
atttgggactgtctt

SEQ ID NO: 201223 - DNA, 23 bp, Homo sapiens
atttgggggaggctttgggagca

SEQ ID NO: 201224 - DNA, 18 bp, Homo sapiens
atttgggggtgcaatgat

SEQ ID NO: 201225 - DNA, 22 bp, Homo sapiens
atttgggtacatggcccgcagt

SEQ ID NO: 201226 - DNA, 14 bp, Homo sapiens
atttggtcttagct

SEQ ID NO: 201227 - DNA, 21 bp, Homo sapiens
atttggtcttagctttacatt

SEQ ID NO: 201228 - DNA, 14 bp, Homo sapiens
atttggtggctcta

SEQ ID NO: 201229 - DNA, 15 bp, Homo sapiens
atttggtttttactc

SEQ ID NO: 201230 - DNA, 21 bp, Homo sapiens
atttgtaacctcagctctggg

SEQ ID NO: 201231 - DNA, 18 bp, Homo sapiens
atttgtaataaagtatat

SEQ ID NO: 201232 - DNA, 19 bp, Homo sapiens
atttgtaattgcttacatt

SEQ ID NO: 201233 - DNA, 20 bp, Homo sapiens
atttgtaattgcttacattt

SEQ ID NO: 201234 - DNA, 14 bp, Homo sapiens
cccgcctcagcctc

SEQ ID NO: 201235 - DNA, 19 bp, Homo sapiens
cccgcctccactctagttc

SEQ ID NO: 201236 - DNA, 16 bp, Homo sapiens
cccgcctgccgtgcat

SEQ ID NO: 201237 - DNA, 19 bp, Homo sapiens
cccgccttccctcactctt

SEQ ID NO: 201238 - DNA, 16 bp, Homo sapiens
cccgccttcctcctcc

SEQ ID NO: 201239 - DNA, 19 bp, Homo sapiens
cccgccttcctcctccaca

SEQ ID NO: 201240 - DNA, 20 bp, Homo sapiens
cccgccttcctcctccacag

SEQ ID NO: 201241 - DNA, 19 bp, Homo sapiens
cccgcgcgtgcccccagcg

SEQ ID NO: 201242 - DNA, 17 bp, Homo sapiens
cccgcgggttctagacg

SEQ ID NO: 201243 - DNA, 15 bp, Homo sapiens
cccgcggtgctctgg

SEQ ID NO: 201244 - DNA, 14 bp, Homo sapiens
cccgcgtccaaccc

SEQ ID NO: 201245 - DNA, 15 bp, Homo sapiens
cccgcgtccaacccc

SEQ ID NO: 201246 - DNA, 18 bp, Homo sapiens
cccgcgtccaaccccggg

SEQ ID NO: 201247 - DNA, 20 bp, Homo sapiens
atttgtatttatattagagt

SEQ ID NO: 201248 - DNA, 16 bp, Homo sapiens
atttgtcacagaaatc

SEQ ID NO: 201249 - DNA, 21 bp, Homo sapiens
atttgtcacagaaatcagagg

SEQ ID NO: 201250 - DNA, 15 bp, Homo sapiens
atttgtcactgaata

SEQ ID NO: 201251 - DNA, 13 bp, Homo sapiens
atttgtgtaatag

SEQ ID NO: 201252 - DNA, 21 bp, Homo sapiens
atttgtgtaatagaaaactga

SEQ ID NO: 201253 - DNA, 21 bp, Homo sapiens
atttgtgtccatttcaagtgt

SEQ ID NO: 201254 - DNA, 14 bp, Homo sapiens
atttgttaaaatac

SEQ ID NO: 201255 - DNA, 22 bp, Homo sapiens
atttgttaaaatacagttctgt

SEQ ID NO: 201256 - DNA, 17 bp, Homo sapiens
atttgttaatatatata

SEQ ID NO: 201257 - DNA, 14 bp, Homo sapiens
atttgttataatga

SEQ ID NO: 201258 - DNA, 22 bp, Homo sapiens
atttgttatatcagcagacact

SEQ ID NO: 201259 - DNA, 17 bp, Homo sapiens
atttgttatgataaaag

SEQ ID NO: 201260 - DNA, 11 bp, Homo sapiens
atttgttcatt

SEQ ID NO: 201261 - DNA, 14 bp, Homo sapiens
atttgttgaaatta

SEQ ID NO: 201262 - DNA, 16 bp, Homo sapiens
atttgttgaaattatg

SEQ ID NO: 201263 - DNA, 14 bp, Homo sapiens
atttgttgtcatgt

SEQ ID NO: 201264 - DNA, 21 bp, Homo sapiens
atttgttgtgactggcaccca

SEQ ID NO: 201265 - DNA, 14 bp, Homo sapiens
atttgttttcatgg

SEQ ID NO: 201266 - DNA, 18 bp, Homo sapiens
atttgttttgacggatga

SEQ ID NO: 201267 - DNA, 21 bp, Homo sapiens
atttgttttgtgttgtttgaa

SEQ ID NO: 201268 - DNA, 24 bp, Homo sapiens
attttaaaaaagatggatttgaca

SEQ ID NO: 201269 - DNA, 14 bp, Homo sapiens
attttaaaaaataa

SEQ ID NO: 201270 - DNA, 16 bp, Homo sapiens
attttaaaaaataaca

SEQ ID NO: 201271 - DNA, 17 bp, Homo sapiens
attttaaaaaataacat

SEQ ID NO: 201272 - DNA, 19 bp, Homo sapiens
attttaaaaagaagaaaaa

SEQ ID NO: 201273 - DNA, 14 bp, Homo sapiens
attttaaaaattgg

SEQ ID NO: 201274 - DNA, 17 bp, Homo sapiens
attttaaaacatggcaa

SEQ ID NO: 201275 - DNA, 13 bp, Homo sapiens
attttaaaagcat

SEQ ID NO: 201276 - DNA, 15 bp, Homo sapiens
attttaaaagcatat

SEQ ID NO: 201277 - DNA, 20 bp, Homo sapiens
attttaaaatcaacttttga

SEQ ID NO: 201278 - DNA, 22 bp, Homo sapiens
attttaaaatcaacttttgaaa

SEQ ID NO: 201279 - DNA, 12 bp, Homo sapiens
attttaaaatga

SEQ ID NO: 201280 - DNA, 15 bp, Homo sapiens
attttaaataaaaga

SEQ ID NO: 201281 - DNA, 21 bp, Homo sapiens
attttaaataaaagtgatcaa

SEQ ID NO: 201282 - DNA, 10 bp, Homo sapiens
attttaaatc

SEQ ID NO: 201283 - DNA, 11 bp, Homo sapiens
attttaaatta

SEQ ID NO: 201284 - DNA, 18 bp, Homo sapiens
attttaaattaaagcaaa

SEQ ID NO: 201285 - DNA, 13 bp, Homo sapiens
attttaaattata

SEQ ID NO: 201286 - DNA, 20 bp, Homo sapiens
attttaaattataaggactg

SEQ ID NO: 201287 - DNA, 16 bp, Homo sapiens
attttaacaataacta

SEQ ID NO: 201288 - DNA, 22 bp, Homo sapiens
attttaacaataactactgtgt

SEQ ID NO: 201289 - DNA, 22 bp, Homo sapiens
attttaacagtacctgtgcctg

SEQ ID NO: 201290 - DNA, 17 bp, Homo sapiens
attttaacctagatgtt

SEQ ID NO: 201291 - DNA, 22 bp, Homo sapiens
attttaacctagatgtttaaca

SEQ ID NO: 201292 - DNA, 14 bp, Homo sapiens
attttaagtgcttt

SEQ ID NO: 201293 - DNA, 17 bp, Homo sapiens
attttaagtgctttgta

SEQ ID NO: 201294 - DNA, 20 bp, Homo sapiens
attttaagtgctttgtaatg

SEQ ID NO: 201295 - DNA, 14 bp, Homo sapiens
attttaataccttt

SEQ ID NO: 201296 - DNA, 22 bp, Homo sapiens
attttaatacctttaaatatca

SEQ ID NO: 201297 - DNA, 15 bp, Homo sapiens
attttaatccttcta

SEQ ID NO: 201298 - DNA, 21 bp, Homo sapiens
attttaatccttctaactaaa

SEQ ID NO: 201299 - DNA, 12 bp, Homo sapiens
attttaatgtaa

SEQ ID NO: 201300 - DNA, 15 bp, Homo sapiens
attttaatgtaaaat

SEQ ID NO: 201301 - DNA, 22 bp, Homo sapiens
attttacacagcaattttgtat

SEQ ID NO: 201302 - DNA, 17 bp, Homo sapiens
attttaccactgctgtg

SEQ ID NO: 201303 - DNA, 18 bp, Homo sapiens
attttactgtctgtaaga

SEQ ID NO: 201304 - DNA, 16 bp, Homo sapiens
attttacttggaaata

SEQ ID NO: 201305 - DNA, 13 bp, Homo sapiens
attttagaagagg

SEQ ID NO: 201306 - DNA, 17 bp, Homo sapiens
attttagatttctttga

SEQ ID NO: 201307 - DNA, 19 bp, Homo sapiens
attttagatttctttgatt

SEQ ID NO: 201308 - DNA, 14 bp, Homo sapiens
attttagcagttct

SEQ ID NO: 201309 - DNA, 17 bp, Homo sapiens
attttaggcagggattt

SEQ ID NO: 201310 - DNA, 21 bp, Homo sapiens
attttaggcagggatttgagg

SEQ ID NO: 201311 - DNA, 16 bp, Homo sapiens
attttaggtgttgatt

SEQ ID NO: 201312 - DNA, 23 bp, Homo sapiens
attttaggtgttgattttctgtt

SEQ ID NO: 201313 - DNA, 17 bp, Homo sapiens
attttagtatatttata

SEQ ID NO: 201314 - DNA, 23 bp, Homo sapiens
attttagtatatttatataatta

SEQ ID NO: 201315 - DNA, 17 bp, Homo sapiens
attttatacaagaaggg

SEQ ID NO: 201316 - DNA, 19 bp, Homo sapiens
attttatacaagaagggag

SEQ ID NO: 201317 - DNA, 13 bp, Homo sapiens
attttatactgca

SEQ ID NO: 201318 - DNA, 18 bp, Homo sapiens
attttatactgcacttta

SEQ ID NO: 201319 - DNA, 22 bp, Homo sapiens
attttatactgcactttagtgt

SEQ ID NO: 201320 - DNA, 22 bp, Homo sapiens
attttatataataaagtattcc

SEQ ID NO: 201321 - DNA, 16 bp, Homo sapiens
attttatatctggatt

SEQ ID NO: 201322 - DNA, 20 bp, Homo sapiens
attttatctacccagtcatg

SEQ ID NO: 201323 - DNA, 22 bp, Homo sapiens
attttatctacccagtcatgta

SEQ ID NO: 201324 - DNA, 13 bp, Homo sapiens
attttatctgtga

SEQ ID NO: 201325 - DNA, 16 bp, Homo sapiens
attttattcacatatg

SEQ ID NO: 201326 - DNA, 15 bp, Homo sapiens
attttattgaatata

SEQ ID NO: 201327 - DNA, 23 bp, Homo sapiens
attttattgaatataatggcctc

SEQ ID NO: 201328 - DNA, 23 bp, Homo sapiens
attttatttcctggacatcctct

SEQ ID NO: 201329 - DNA, 15 bp, Homo sapiens
attttattttcaagc

SEQ ID NO: 201330 - DNA, 17 bp, Homo sapiens
attttatttttttctac

SEQ ID NO: 201331 - DNA, 14 bp, Homo sapiens
attttcaaaggctt

SEQ ID NO: 201332 - DNA, 17 bp, Homo sapiens
attttcaaagtacataa

SEQ ID NO: 201333 - DNA, 18 bp, Homo sapiens
attttcaaattgtatcta

SEQ ID NO: 201334 - DNA, 16 bp, Homo sapiens
attttcaagtggaaac

SEQ ID NO: 201335 - DNA, 15 bp, Homo sapiens
attttcaataaagaa

SEQ ID NO: 201336 - DNA, 19 bp, Homo sapiens
attttcaataatagactta

SEQ ID NO: 201337 - DNA, 14 bp, Homo sapiens
attttcagaaaata

SEQ ID NO: 201338 - DNA, 18 bp, Homo sapiens
attttcagcatgaaaatg

SEQ ID NO: 201339 - DNA, 23 bp, Homo sapiens
attttcagcccatatttcatcgt

SEQ ID NO: 201340 - DNA, 17 bp, Homo sapiens
attttcagtatactgtg

SEQ ID NO: 201341 - DNA, 12 bp, Homo sapiens
attttcagtatt

SEQ ID NO: 201342 - DNA, 14 bp, Homo sapiens
attttcagtatttt

SEQ ID NO: 201343 - DNA, 20 bp, Homo sapiens
attttcattggatgcagttg

SEQ ID NO: 201344 - DNA, 18 bp, Homo sapiens
attttccacggaaacaga

SEQ ID NO: 201345 - DNA, 15 bp, Homo sapiens
attttccattaattt

SEQ ID NO: 201346 - DNA, 21 bp, Homo sapiens
attttccatttttatttcaaa

SEQ ID NO: 201347 - DNA, 21 bp, Homo sapiens
attttccccccactctcccca

SEQ ID NO: 201348 - DNA, 12 bp, Homo sapiens
attttcctcccc

SEQ ID NO: 201349 - DNA, 20 bp, Homo sapiens
attttcctcgcctaggcctg

SEQ ID NO: 201350 - DNA, 21 bp, Homo sapiens
attttcctgaatattaatccc

SEQ ID NO: 201351 - DNA, 12 bp, Homo sapiens
attttcctggga

SEQ ID NO: 201352 - DNA, 17 bp, Homo sapiens
attttcctgtgtccaca

SEQ ID NO: 201353 - DNA, 16 bp, Homo sapiens
attttcctttctgtat

SEQ ID NO: 201354 - DNA, 16 bp, Homo sapiens
attttcgtgcatttgt

SEQ ID NO: 201355 - DNA, 18 bp, Homo sapiens
attttcgtgcatttgtga

SEQ ID NO: 201356 - DNA, 16 bp, Homo sapiens
attttcgttcattact

SEQ ID NO: 201357 - DNA, 13 bp, Homo sapiens
attttctaaactg

SEQ ID NO: 201358 - DNA, 17 bp, Homo sapiens
attttctaaactgtttt

SEQ ID NO: 201359 - DNA, 16 bp, Homo sapiens
attttctagactttct

SEQ ID NO: 201360 - DNA, 19 bp, Homo sapiens
attttctatatttgtaact

SEQ ID NO: 201361 - DNA, 20 bp, Homo sapiens
attttctattgttactctgg

SEQ ID NO: 201362 - DNA, 17 bp, Homo sapiens
attttctcaaaagcatt

SEQ ID NO: 201363 - DNA, 23 bp, Homo sapiens
attttctcccttaggaatataca

SEQ ID NO: 201364 - DNA, 21 bp, Homo sapiens
ccctaattctcttcgctgtga

SEQ ID NO: 201365 - DNA, 22 bp, Homo sapiens
ccctaattcttattttataatt

SEQ ID NO: 201366 - DNA, 15 bp, Homo sapiens
ccctacaactccagc

SEQ ID NO: 201367 - DNA, 15 bp, Homo sapiens
ccctacacctctggg

SEQ ID NO: 201368 - DNA, 13 bp, Homo sapiens
ccctacagcctgc

SEQ ID NO: 201369 - DNA, 20 bp, Homo sapiens
ccctaccactgagcccttgc

SEQ ID NO: 201370 - DNA, 22 bp, Homo sapiens
ccctaccactgagcccttgcac

SEQ ID NO: 201371 - DNA, 22 bp, Homo sapiens
ccctacccacagggcctgactt

SEQ ID NO: 201372 - DNA, 13 bp, Homo sapiens
ccctacccaccga

SEQ ID NO: 201373 - DNA, 14 bp, Homo sapiens
ccctacccaccgat

SEQ ID NO: 201374 - DNA, 21 bp, Homo sapiens
ccctaccccacaccaggccgt

SEQ ID NO: 201375 - DNA, 17 bp, Homo sapiens
ccctaccctcttctcag

SEQ ID NO: 201376 - DNA, 15 bp, Homo sapiens
ccctacctcaacctg

SEQ ID NO: 201377 - DNA, 20 bp, Homo sapiens
ccctacctcaacctgtaaat

SEQ ID NO: 201378 - DNA, 22 bp, Homo sapiens
ccctacctcaacctgtaaatta

SEQ ID NO: 201379 - DNA, 13 bp, Homo sapiens
ccctacctcaggc

SEQ ID NO: 201380 - DNA, 19 bp, Homo sapiens
ccctacctgttcagtgtcc

SEQ ID NO: 201381 - DNA, 12 bp, Homo sapiens
ccctactggctg

SEQ ID NO: 201382 - DNA, 13 bp, Homo sapiens
ccctactggctgt

SEQ ID NO: 201383 - DNA, 19 bp, Homo sapiens
ccctagaggcgagccaggc

SEQ ID NO: 201384 - DNA, 20 bp, Homo sapiens
ccctagaggcgagccaggca

SEQ ID NO: 201385 - DNA, 16 bp, Homo sapiens
attttcttttatatct

SEQ ID NO: 201386 - DNA, 14 bp, Homo sapiens
attttgaaaacact

SEQ ID NO: 201387 - DNA, 12 bp, Homo sapiens
attttgaatacc

SEQ ID NO: 201388 - DNA, 22 bp, Homo sapiens
attttgaataccattaaaactg

SEQ ID NO: 201389 - DNA, 22 bp, Homo sapiens
attttgaatgtcacaaattgat

SEQ ID NO: 201390 - DNA, 17 bp, Homo sapiens
attttgacctactctca

SEQ ID NO: 201391 - DNA, 18 bp, Homo sapiens
attttgacctactctcat

SEQ ID NO: 201392 - DNA, 22 bp, Homo sapiens
attttgagacaccaataaaagt

SEQ ID NO: 201393 - DNA, 15 bp, Homo sapiens
attttgataataaat

SEQ ID NO: 201394 - DNA, 17 bp, Homo sapiens
attttgataataaattg

SEQ ID NO: 201395 - DNA, 20 bp, Homo sapiens
attttgcacgaattttaaaa

SEQ ID NO: 201396 - DNA, 15 bp, Homo sapiens
attttgcagcagtga

SEQ ID NO: 201397 - DNA, 12 bp, Homo sapiens
attttgcataaa

SEQ ID NO: 201398 - DNA, 23 bp, Homo sapiens
attttgcattgtgtgagcttcta

SEQ ID NO: 201399 - DNA, 17 bp, Homo sapiens
attttgccacctttcct

SEQ ID NO: 201400 - DNA, 21 bp, Homo sapiens
attttgcctcttttctctgtg

SEQ ID NO: 201401 - DNA, 17 bp, Homo sapiens
attttgcgatgtgtttt

SEQ ID NO: 201402 - DNA, 18 bp, Homo sapiens
attttggacgtgtgagga

SEQ ID NO: 201403 - DNA, 19 bp, Homo sapiens
attttggataaatcatttc

SEQ ID NO: 201404 - DNA, 21 bp, Homo sapiens
attttggatctatcacctgtc

SEQ ID NO: 201405 - DNA, 20 bp, Homo sapiens
attttggcgctattacaaat

SEQ ID NO: 201406 - DNA, 18 bp, Homo sapiens
attttggtccaagttgtg

SEQ ID NO: 201407 - DNA, 21 bp, Homo sapiens
attttggtgaatgtgggtagt

SEQ ID NO: 201408 - DNA, 17 bp, Homo sapiens
attttggtgatgtaaaa

SEQ ID NO: 201409 - DNA, 15 bp, Homo sapiens
attttgtatgtatgt

SEQ ID NO: 201410 - DNA, 20 bp, Homo sapiens
attttgtattacatctaatg

SEQ ID NO: 201411 - DNA, 15 bp, Homo sapiens
attttgtattgccat

SEQ ID NO: 201412 - DNA, 20 bp, Homo sapiens
attttgtatttttgaataaa

SEQ ID NO: 201413 - DNA, 20 bp, Homo sapiens
attttgtcacagctcttgtt

SEQ ID NO: 201414 - DNA, 12 bp, Homo sapiens
attttgtctggc

SEQ ID NO: 201415 - DNA, 17 bp, Homo sapiens
attttgtctggctgtgg

SEQ ID NO: 201416 - DNA, 19 bp, Homo sapiens
attttgtgatatggagccc

SEQ ID NO: 201417 - DNA, 16 bp, Homo sapiens
attttgtgctctttcc

SEQ ID NO: 201418 - DNA, 16 bp, Homo sapiens
attttgtggcttcaat

SEQ ID NO: 201419 - DNA, 19 bp, Homo sapiens
attttgtggttaagagaat

SEQ ID NO: 201420 - DNA, 21 bp, Homo sapiens
attttgtggttctattttact

SEQ ID NO: 201421 - DNA, 20 bp, Homo sapiens
attttgtgtaaatttctcaa

SEQ ID NO: 201422 - DNA, 13 bp, Homo sapiens
attttgtgtctta

SEQ ID NO: 201423 - DNA, 12 bp, Homo sapiens
attttgttactg

SEQ ID NO: 201424 - DNA, 15 bp, Homo sapiens
attttgttactgtct

SEQ ID NO: 201425 - DNA, 17 bp, Homo sapiens
attttgttactgtctgt

SEQ ID NO: 201426 - DNA, 18 bp, Homo sapiens
attttgttactgtctgta

SEQ ID NO: 201427 - DNA, 19 bp, Homo sapiens
atttttaaaagactttgat

SEQ ID NO: 201428 - DNA, 20 bp, Homo sapiens
atttttaaaggacaaacagt

SEQ ID NO: 201429 - DNA, 14 bp, Homo sapiens
atttttaaagttta

SEQ ID NO: 201430 - DNA, 21 bp, Homo sapiens
atttttaaagtttaaatacca

SEQ ID NO: 201431 - DNA, 14 bp, Homo sapiens
atttttaaattata

SEQ ID NO: 201432 - DNA, 16 bp, Homo sapiens
atttttaaattctgct

SEQ ID NO: 201433 - DNA, 17 bp, Homo sapiens
atttttaaattctgctc

SEQ ID NO: 201434 - DNA, 17 bp, Homo sapiens
atttttaagtacaaaaa

SEQ ID NO: 201435 - DNA, 21 bp, Homo sapiens
atttttaagtacaaaaaagtt

SEQ ID NO: 201436 - DNA, 15 bp, Homo sapiens
atttttaatttatga

SEQ ID NO: 201437 - DNA, 14 bp, Homo sapiens
atttttacagaatt

SEQ ID NO: 201438 - DNA, 16 bp, Homo sapiens
atttttactaaagcag

SEQ ID NO: 201439 - DNA, 21 bp, Homo sapiens
atttttactaaagcagtgttt

SEQ ID NO: 201440 - DNA, 20 bp, Homo sapiens
atttttagagattaatttgt

SEQ ID NO: 201441 - DNA, 13 bp, Homo sapiens
atttttagtagag

SEQ ID NO: 201442 - DNA, 14 bp, Homo sapiens
atttttatatagct

SEQ ID NO: 201443 - DNA, 14 bp, Homo sapiens
atttttatttatat

SEQ ID NO: 201444 - DNA, 19 bp, Homo sapiens
atttttcatattgtgccaa

SEQ ID NO: 201445 - DNA, 19 bp, Homo sapiens
atttttccctgtttgccta

SEQ ID NO: 201446 - DNA, 13 bp, Homo sapiens
atttttgatttat

SEQ ID NO: 201447 - DNA, 21 bp, Homo sapiens
atttttgctgaattcctttac

SEQ ID NO: 201448 - DNA, 21 bp, Homo sapiens
atttttggacttagtgcaaca

SEQ ID NO: 201449 - DNA, 14 bp, Homo sapiens
atttttgtactgtg

SEQ ID NO: 201450 - DNA, 16 bp, Homo sapiens
atttttgtactgtgct

SEQ ID NO: 201451 - DNA, 17 bp, Homo sapiens
atttttgtatgttatga

SEQ ID NO: 201452 - DNA, 12 bp, Homo sapiens
atttttgtgtat

SEQ ID NO: 201453 - DNA, 14 bp, Homo sapiens
atttttgtttgttt

SEQ ID NO: 201454 - DNA, 17 bp, Homo sapiens
attttttaaaacaagaa

SEQ ID NO: 201455 - DNA, 13 bp, Homo sapiens
attttttaaacca

SEQ ID NO: 201456 - DNA, 19 bp, Homo sapiens
attttttaagtatttatat

SEQ ID NO: 201457 - DNA, 14 bp, Homo sapiens
attttttaagttca

SEQ ID NO: 201458 - DNA, 15 bp, Homo sapiens
attttttaattatta

SEQ ID NO: 201459 - DNA, 20 bp, Homo sapiens
attttttaattattatttat

SEQ ID NO: 201460 - DNA, 22 bp, Homo sapiens
attttttaatttgatgaaagct

SEQ ID NO: 201461 - DNA, 11 bp, Homo sapiens
attttttacaa

SEQ ID NO: 201462 - DNA, 12 bp, Homo sapiens
attttttattgt

SEQ ID NO: 201463 - DNA, 14 bp, Homo sapiens
attttttatttcta

SEQ ID NO: 201464 - DNA, 13 bp, Homo sapiens
atttttttaaaga

SEQ ID NO: 201465 - DNA, 23 bp, Homo sapiens
atttttttaactgaaaatgtaaa

SEQ ID NO: 201466 - DNA, 12 bp, Homo sapiens
atttttttaagc

SEQ ID NO: 201467 - DNA, 13 bp, Homo sapiens
atttttttaagct

SEQ ID NO: 201468 - DNA, 14 bp, Homo sapiens
atttttttatacta

SEQ ID NO: 201469 - DNA, 16 bp, Homo sapiens
atttttttattactga

SEQ ID NO: 201470 - DNA, 22 bp, Homo sapiens
atttttttcactggagttacat

SEQ ID NO: 201471 - DNA, 13 bp, Homo sapiens
atttttttctacc

SEQ ID NO: 201472 - DNA, 20 bp, Homo sapiens
atttttttctaccttgaggt

SEQ ID NO: 201473 - DNA, 17 bp, Homo sapiens
atttttttgatggctaa

SEQ ID NO: 201474 - DNA, 20 bp, Homo sapiens
attttttttaactgcattct

SEQ ID NO: 201475 - DNA, 16 bp, Homo sapiens
attttttttagaacaa

SEQ ID NO: 201476 - DNA, 21 bp, Homo sapiens
attttttttcaagtgctaaaa

SEQ ID NO: 201477 - DNA, 15 bp, Homo sapiens
attttttttctttta

SEQ ID NO: 201478 - DNA, 14 bp, Homo sapiens
attttttttggttg

SEQ ID NO: 201479 - DNA, 15 bp, Homo sapiens
atttttttttagaac

SEQ ID NO: 201480 - DNA, 20 bp, Homo sapiens
attttttttttccattagta

SEQ ID NO: 201481 - DNA, 22 bp, Homo sapiens
attttttttttttggtaattat

SEQ ID NO: 201482 - DNA, 17 bp, Homo sapiens
caaaaaaaatttaaaaa

SEQ ID NO: 201483 - DNA, 21 bp, Homo sapiens
caaaaaaacctttattcttta

SEQ ID NO: 201484 - DNA, 18 bp, Homo sapiens
caaaaaaatatatttaat

SEQ ID NO: 201485 - DNA, 23 bp, Homo sapiens
caaaaaacaatatttattgtatt

SEQ ID NO: 201486 - DNA, 18 bp, Homo sapiens
caaaaaataaaataagtc

SEQ ID NO: 201487 - DNA, 12 bp, Homo sapiens
caaaaaattgtc

SEQ ID NO: 201488 - DNA, 16 bp, Homo sapiens
caaaaacaagactgcc

SEQ ID NO: 201489 - DNA, 14 bp, Homo sapiens
caaaaacaataaac

SEQ ID NO: 201490 - DNA, 18 bp, Homo sapiens
caaaaacaataaacgaaa

SEQ ID NO: 201491 - DNA, 20 bp, Homo sapiens
caaaaacatggcctttgctt

SEQ ID NO: 201492 - DNA, 15 bp, Homo sapiens
caaaaaccagcaggt

SEQ ID NO: 201493 - DNA, 23 bp, Homo sapiens
caaaaactttccatgacagtagc

SEQ ID NO: 201494 - DNA, 16 bp, Homo sapiens
caaagaacccccctcc

SEQ ID NO: 201495 - DNA, 22 bp, Homo sapiens
caaagaactgccccatctcctc

SEQ ID NO: 201496 - DNA, 20 bp, Homo sapiens
caaagaacttgatttgcatg

SEQ ID NO: 201497 - DNA, 12 bp, Homo sapiens
caaagaaggaaa

SEQ ID NO: 201498 - DNA, 14 bp, Homo sapiens
caaagaatgccttg

SEQ ID NO: 201499 - DNA, 15 bp, Homo sapiens
caaagaatgccttga

SEQ ID NO: 201500 - DNA, 13 bp, Homo sapiens
caaagacctgcct

SEQ ID NO: 201501 - DNA, 17 bp, Homo sapiens
caaagacctgcctgtgt

SEQ ID NO: 201502 - DNA, 20 bp, Homo sapiens
caaagacctgcctgtgtgct

SEQ ID NO: 201503 - DNA, 15 bp, Homo sapiens
caaagacggtagaga

SEQ ID NO: 201504 - DNA, 19 bp, Homo sapiens
caaagactgagtgttcaaa

SEQ ID NO: 201505 - DNA, 13 bp, Homo sapiens
caaagactgtact

SEQ ID NO: 201506 - DNA, 14 bp, Homo sapiens
caaagactgtactg

SEQ ID NO: 201507 - DNA, 16 bp, Homo sapiens
caaagactgtactggc

SEQ ID NO: 201508 - DNA, 23 bp, Homo sapiens
caaagagaaaagattaaaattag

SEQ ID NO: 201509 - DNA, 16 bp, Homo sapiens
caaagagaaggcctgg

SEQ ID NO: 201510 - DNA, 16 bp, Homo sapiens
caaagagaatgccatt

SEQ ID NO: 201511 - DNA, 16 bp, Homo sapiens
caaagagagaaaataa

SEQ ID NO: 201512 - DNA, 19 bp, Homo sapiens
caaagataacgcaggagag

SEQ ID NO: 201513 - DNA, 21 bp, Homo sapiens
caaagataacgcaggagagag

SEQ ID NO: 201514 - DNA, 18 bp, Homo sapiens
caaagatacttgatgcac

SEQ ID NO: 201515 - DNA, 22 bp, Homo sapiens
caaagatacttgatgcacttat

SEQ ID NO: 201516 - DNA, 19 bp, Homo sapiens
caaagatattatttatcga

SEQ ID NO: 201517 - DNA, 13 bp, Homo sapiens
caaagatcaaaat

SEQ ID NO: 201518 - DNA, 20 bp, Homo sapiens
caaagatcaaaataaaaagt

SEQ ID NO: 201519 - DNA, 15 bp, Homo sapiens
caaagatgcagccgc

SEQ ID NO: 201520 - DNA, 12 bp, Homo sapiens
caaagatggctt

SEQ ID NO: 201521 - DNA, 14 bp, Homo sapiens
caaagatggcttcc

SEQ ID NO: 201522 - DNA, 12 bp, Homo sapiens
caaagatgtact

SEQ ID NO: 201523 - DNA, 14 bp, Homo sapiens
caaagatgtactga

SEQ ID NO: 201524 - DNA, 16 bp, Homo sapiens
caaagatgtactgaga

SEQ ID NO: 201525 - DNA, 17 bp, Homo sapiens
caaagcacattgaaaga

SEQ ID NO: 201526 - DNA, 20 bp, Homo sapiens
caaagcacgaaatgttattt

SEQ ID NO: 201527 - DNA, 13 bp, Homo sapiens
ccctcctctgccc

SEQ ID NO: 201528 - DNA, 14 bp, Homo sapiens
ccctcctctgcccc

SEQ ID NO: 201529 - DNA, 13 bp, Homo sapiens
ccctcctctgtgc

SEQ ID NO: 201530 - DNA, 13 bp, Homo sapiens
ccctcctcttccc

SEQ ID NO: 201531 - DNA, 22 bp, Homo sapiens
ccctcctcttcccttagcctct

SEQ ID NO: 201532 - DNA, 12 bp, Homo sapiens
ccctcctgcagg

SEQ ID NO: 201533 - DNA, 17 bp, Homo sapiens
ccctcctgctggctgag

SEQ ID NO: 201534 - DNA, 23 bp, Homo sapiens
ccctcctgctggctgaggcttgg

SEQ ID NO: 201535 - DNA, 18 bp, Homo sapiens
ccctcctggctcacagcc

SEQ ID NO: 201536 - DNA, 19 bp, Homo sapiens
ccctcctggctcacagcca

SEQ ID NO: 201537 - DNA, 22 bp, Homo sapiens
ccctcctggctcacagccacca

SEQ ID NO: 201538 - DNA, 13 bp, Homo sapiens
ccctcctgggccc

SEQ ID NO: 201539 - DNA, 20 bp, Homo sapiens
ccctcctgggcccaggcagc

SEQ ID NO: 201540 - DNA, 15 bp, Homo sapiens
ccctccttccagcct

SEQ ID NO: 201541 - DNA, 18 bp, Homo sapiens
ccctccttccctggtcca

SEQ ID NO: 201542 - DNA, 15 bp, Homo sapiens
ccctccttgccaccc

SEQ ID NO: 201543 - DNA, 16 bp, Homo sapiens
ccctcgaaccaaggca

SEQ ID NO: 201544 - DNA, 20 bp, Homo sapiens
ccctcgaaccaaggcagcct

SEQ ID NO: 201545 - DNA, 17 bp, Homo sapiens
ccctcgctgctgctact

SEQ ID NO: 201546 - DNA, 15 bp, Homo sapiens
ccctcgctgcttctg

SEQ ID NO: 201547 - DNA, 15 bp, Homo sapiens
ccctcgctgtatgat

SEQ ID NO: 201548 - DNA, 19 bp, Homo sapiens
ccctcgcttcataggcaga

SEQ ID NO: 201549 - DNA, 21 bp, Homo sapiens
ccctcggaagccgtctgactc

SEQ ID NO: 201550 - DNA, 23 bp, Homo sapiens
ccctcggaagccgtctgactcca

SEQ ID NO: 201551 - DNA, 17 bp, Homo sapiens
ccctcggggcaggaagt

SEQ ID NO: 201552 - DNA, 22 bp, Homo sapiens
ccctcggtcacctgtgctacct

SEQ ID NO: 201553 - DNA, 20 bp, Homo sapiens
ccctcggtgcagaaactacc

SEQ ID NO: 201554 - DNA, 13 bp, Homo sapiens
ccctcgtccacag

SEQ ID NO: 201555 - DNA, 19 bp, Homo sapiens
ccctcgtccacaggggcag

SEQ ID NO: 201556 - DNA, 24 bp, Homo sapiens
ccctcgtccacaggggcaggcctg

SEQ ID NO: 201557 - DNA, 17 bp, Homo sapiens
ccctcgtcctgtcccag

SEQ ID NO: 201558 - DNA, 19 bp, Homo sapiens
ccctcgtctccctggccac

SEQ ID NO: 201559 - DNA, 17 bp, Homo sapiens
ccctcgtggacacctgc

SEQ ID NO: 201560 - DNA, 18 bp, Homo sapiens
ccctcgtggacacctgcc

SEQ ID NO: 201561 - DNA, 19 bp, Homo sapiens
ccctcgtggacacctgccc

SEQ ID NO: 201562 - DNA, 15 bp, Homo sapiens
ccctcgtttgatagt

SEQ ID NO: 201563 - DNA, 15 bp, Homo sapiens
ccctctatttagcat

SEQ ID NO: 201564 - DNA, 22 bp, Homo sapiens
ccctctcaggcatgcctgtgtg

SEQ ID NO: 201565 - DNA, 16 bp, Homo sapiens
ccctctcccaggcccg

SEQ ID NO: 201566 - DNA, 11 bp, Homo sapiens
ccctctccctg

SEQ ID NO: 201567 - DNA, 23 bp, Homo sapiens
ccctctcctatgtggcagctggg

SEQ ID NO: 201568 - DNA, 13 bp, Homo sapiens
ccctctcctgccc

SEQ ID NO: 201569 - DNA, 15 bp, Homo sapiens
ccctctcgccccatc

SEQ ID NO: 201570 - DNA, 21 bp, Homo sapiens
ccctctcgccccatccctgct

SEQ ID NO: 201571 - DNA, 19 bp, Homo sapiens
ccctctcgctcccctctgc

SEQ ID NO: 201572 - DNA, 14 bp, Homo sapiens
ccctctctcttctg

SEQ ID NO: 201573 - DNA, 17 bp, Homo sapiens
ccctctctcttctgctc

SEQ ID NO: 201574 - DNA, 14 bp, Homo sapiens
ccctctcttccggg

SEQ ID NO: 201575 - DNA, 18 bp, Homo sapiens
ccctctcttccgggagct

SEQ ID NO: 201576 - DNA, 14 bp, Homo sapiens
ccctctctttgagt

SEQ ID NO: 201577 - DNA, 23 bp, Homo sapiens
ccctctgagcaactgtgcagcac

SEQ ID NO: 201578 - DNA, 21 bp, Homo sapiens
ccctctgcagggcagcctgtg

SEQ ID NO: 201579 - DNA, 12 bp, Homo sapiens
ccctctgcccag

SEQ ID NO: 201580 - DNA, 14 bp, Homo sapiens
ccctctgcccagct

SEQ ID NO: 201581 - DNA, 15 bp, Homo sapiens
ccctctgcccagctt

SEQ ID NO: 201582 - DNA, 19 bp, Homo sapiens
ccctctgcccagcttgggc

SEQ ID NO: 201583 - DNA, 23 bp, Homo sapiens
ccctctgcccagcttgggcccag

SEQ ID NO: 201584 - DNA, 17 bp, Homo sapiens
ccctctgccccaagcag

SEQ ID NO: 201585 - DNA, 20 bp, Homo sapiens
ccctctgccccaagcagcca

SEQ ID NO: 201586 - DNA, 21 bp, Homo sapiens
ccctctgccccaagcagccag

SEQ ID NO: 201587 - DNA, 23 bp, Homo sapiens
ccctctgccccaagcagccagcc

SEQ ID NO: 201588 - DNA, 14 bp, Homo sapiens
ccctctgcccccag

SEQ ID NO: 201589 - DNA, 18 bp, Homo sapiens
ccctctgcccccagctgc

SEQ ID NO: 201590 - DNA, 21 bp, Homo sapiens
ccctctgccgaccgcctgctt

SEQ ID NO: 201591 - DNA, 13 bp, Homo sapiens
ccctctgcctgtc

SEQ ID NO: 201592 - DNA, 16 bp, Homo sapiens
ccctctgcctgtccct

SEQ ID NO: 201593 - DNA, 14 bp, Homo sapiens
ccctctgccttgca

SEQ ID NO: 201594 - DNA, 19 bp, Homo sapiens
ccctctgctatgtctgtga

SEQ ID NO: 201595 - DNA, 19 bp, Homo sapiens
ccctctgctccgtgtgtct

SEQ ID NO: 201596 - DNA, 16 bp, Homo sapiens
ccctctgctctcatag

SEQ ID NO: 201597 - DNA, 14 bp, Homo sapiens
ccctctgctgcttt

SEQ ID NO: 201598 - DNA, 13 bp, Homo sapiens
ccctctggccagg

SEQ ID NO: 201599 - DNA, 14 bp, Homo sapiens
ccctctgtagctcc

SEQ ID NO: 201600 - DNA, 22 bp, Homo sapiens
ccctctgtagctccctcctccc

SEQ ID NO: 201601 - DNA, 23 bp, Homo sapiens
ccctctgtagctccctcctccca

SEQ ID NO: 201602 - DNA, 21 bp, Homo sapiens
ccctctgtcatcactccctgg

SEQ ID NO: 201603 - DNA, 12 bp, Homo sapiens
ccctctgtgcct

SEQ ID NO: 201604 - DNA, 18 bp, Homo sapiens
ccctctgtgcctaataaa

SEQ ID NO: 201605 - DNA, 17 bp, Homo sapiens
ccctcttcccccttccc

SEQ ID NO: 201606 - DNA, 23 bp, Homo sapiens
ccctcttccctgtcttccccacc

SEQ ID NO: 201607 - DNA, 16 bp, Homo sapiens
ccctcttcctccaaag

SEQ ID NO: 201608 - DNA, 22 bp, Homo sapiens
ccctcttcctggagccccagaa

SEQ ID NO: 201609 - DNA, 16 bp, Homo sapiens
ccctcttctcaagtgc

SEQ ID NO: 201610 - DNA, 17 bp, Homo sapiens
ccctcttctcagctcca

SEQ ID NO: 201611 - DNA, 14 bp, Homo sapiens
ccctcttctctggg

SEQ ID NO: 201612 - DNA, 21 bp, Homo sapiens
ccctcttctctgggcccagag

SEQ ID NO: 201613 - DNA, 22 bp, Homo sapiens
ccctcttcttgcggcaccgccc

SEQ ID NO: 201614 - DNA, 16 bp, Homo sapiens
ccctcttgccccccac

SEQ ID NO: 201615 - DNA, 22 bp, Homo sapiens
ccctcttgccccccaccccagc

SEQ ID NO: 201616 - DNA, 20 bp, Homo sapiens
ccctcttgtccctttcccta

SEQ ID NO: 201617 - DNA, 16 bp, Homo sapiens
ccctctttctctctgt

SEQ ID NO: 201618 - DNA, 20 bp, Homo sapiens
ccctctttctctctgtgtgg

SEQ ID NO: 201619 - DNA, 22 bp, Homo sapiens
ccctctttgtgtacttcagtct

SEQ ID NO: 201620 - DNA, 14 bp, Homo sapiens
ccctcttttggcct

SEQ ID NO: 201621 - DNA, 24 bp, Homo sapiens
ccctgaaaatgtttttctgccagg

SEQ ID NO: 201622 - DNA, 17 bp, Homo sapiens
ccctgaagctgtgcgga

SEQ ID NO: 201623 - DNA, 23 bp, Homo sapiens
ccctgaaggaacattccttagtc

SEQ ID NO: 201624 - DNA, 16 bp, Homo sapiens
ccctgaagtcttgcat

SEQ ID NO: 201625 - DNA, 16 bp, Homo sapiens
ccctgacccctgcacc

SEQ ID NO: 201626 - DNA, 14 bp, Homo sapiens
ccctgacctgtcca

SEQ ID NO: 201627 - DNA, 14 bp, Homo sapiens
ccctgaccttggct

SEQ ID NO: 201628 - DNA, 16 bp, Homo sapiens
ccctgacttcccagct

SEQ ID NO: 201629 - DNA, 17 bp, Homo sapiens
ccctgacttcccagctg

SEQ ID NO: 201630 - DNA, 18 bp, Homo sapiens
ccctgacttcccagctgg

SEQ ID NO: 201631 - DNA, 21 bp, Homo sapiens
ccctgacttcccagctggcag

SEQ ID NO: 201632 - DNA, 10 bp, Homo sapiens
ccctgagact

SEQ ID NO: 201633 - DNA, 13 bp, Homo sapiens
ccctgagactcca

SEQ ID NO: 201634 - DNA, 16 bp, Homo sapiens
ccctgagactccagaa

SEQ ID NO: 201635 - DNA, 17 bp, Homo sapiens
ccctgagagcatgtggg

SEQ ID NO: 201636 - DNA, 23 bp, Homo sapiens
ccctgagagcatgtgggggaagg

SEQ ID NO: 201637 - DNA, 19 bp, Homo sapiens
ccctgagcctgccccagct

SEQ ID NO: 201638 - DNA, 19 bp, Homo sapiens
ccctgagctttccggggag

SEQ ID NO: 201639 - DNA, 22 bp, Homo sapiens
ccctgagctttccggggaggag

SEQ ID NO: 201640 - DNA, 13 bp, Homo sapiens
ccctgagctttgg

SEQ ID NO: 201641 - DNA, 14 bp, Homo sapiens
ccctgaggactgga

SEQ ID NO: 201642 - DNA, 16 bp, Homo sapiens
ccctgaggactggaga

SEQ ID NO: 201643 - DNA, 14 bp, Homo sapiens
ccctgaggagccag

SEQ ID NO: 201644 - DNA, 19 bp, Homo sapiens
ccctgaggagccaggccgg

SEQ ID NO: 201645 - DNA, 22 bp, Homo sapiens
ccctgagggtttccaccttggc

SEQ ID NO: 201646 - DNA, 20 bp, Homo sapiens
ccctgaggtgaaagggagct

SEQ ID NO: 201647 - DNA, 21 bp, Homo sapiens
ccctgagttgcaccattcttt

SEQ ID NO: 201648 - DNA, 14 bp, Homo sapiens
ccctgatgcttaat

SEQ ID NO: 201649 - DNA, 15 bp, Homo sapiens
ccctgatttgctgtt

SEQ ID NO: 201650 - DNA, 16 bp, Homo sapiens
ccctgcaaaggactgt

SEQ ID NO: 201651 - DNA, 17 bp, Homo sapiens
ccctgcaaggcccacag

SEQ ID NO: 201652 - DNA, 21 bp, Homo sapiens
ccctgcaaggcccacaggagg

SEQ ID NO: 201653 - DNA, 23 bp, Homo sapiens
ccctgcaccagcccttccctgct

SEQ ID NO: 201654 - DNA, 21 bp, Homo sapiens
ccctgcacccacccctgccca

SEQ ID NO: 201655 - DNA, 23 bp, Homo sapiens
ccctgcacccacccctgcccagg

SEQ ID NO: 201656 - DNA, 14 bp, Homo sapiens
ccctgcaccctgga

SEQ ID NO: 201657 - DNA, 17 bp, Homo sapiens
ccctgcactgtaaaatg

SEQ ID NO: 201658 - DNA, 20 bp, Homo sapiens
ccctgcactgtaaaatgtgg

SEQ ID NO: 201659 - DNA, 18 bp, Homo sapiens
ccctgcaggaggcctggg

SEQ ID NO: 201660 - DNA, 22 bp, Homo sapiens
caaagcacttggactcttgctc

SEQ ID NO: 201661 - DNA, 13 bp, Homo sapiens
caaagcaggagtg

SEQ ID NO: 201662 - DNA, 21 bp, Homo sapiens
caaagcagtgcatgctgtccc

SEQ ID NO: 201663 - DNA, 21 bp, Homo sapiens
caaagccaccaagggcctcac

SEQ ID NO: 201664 - DNA, 14 bp, Homo sapiens
caaagccagacagc

SEQ ID NO: 201665 - DNA, 15 bp, Homo sapiens
caaagccagacagca

SEQ ID NO: 201666 - DNA, 21 bp, Homo sapiens
caaagccatatcaccagtctt

SEQ ID NO: 201667 - DNA, 11 bp, Homo sapiens
caaagcccagc

SEQ ID NO: 201668 - DNA, 15 bp, Homo sapiens
caaagcccagcccgg

SEQ ID NO: 201669 - DNA, 18 bp, Homo sapiens
caaagccttatcaagtgt

SEQ ID NO: 201670 - DNA, 13 bp, Homo sapiens
caaagcgggggga

SEQ ID NO: 201671 - DNA, 18 bp, Homo sapiens
caaagctaggaaaggcag

SEQ ID NO: 201672 - DNA, 21 bp, Homo sapiens
caaagctagggtggcccttgc

SEQ ID NO: 201673 - DNA, 22 bp, Homo sapiens
caaagctgacgaggctgggcca

SEQ ID NO: 201674 - DNA, 15 bp, Homo sapiens
caaagctgatttccc

SEQ ID NO: 201675 - DNA, 18 bp, Homo sapiens
caaagctgatttcccttt

SEQ ID NO: 201676 - DNA, 18 bp, Homo sapiens
caaagcttctatcccagg

SEQ ID NO: 201677 - DNA, 20 bp, Homo sapiens
caaagcttctatcccaggag

SEQ ID NO: 201678 - DNA, 19 bp, Homo sapiens
caaagcttgaagatcgtta

SEQ ID NO: 201679 - DNA, 16 bp, Homo sapiens
caaagcttgttaagat

SEQ ID NO: 201680 - DNA, 16 bp, Homo sapiens
caaagctttcctgccc

SEQ ID NO: 201681 - DNA, 15 bp, Homo sapiens
caaagctttcctgga

SEQ ID NO: 201682 - DNA, 17 bp, Homo sapiens
caaagctttcctggaga

SEQ ID NO: 201683 - DNA, 23 bp, Homo sapiens
caaaggaagctttctctgcttca

SEQ ID NO: 201684 - DNA, 17 bp, Homo sapiens
caaaggaagtagcaggc

SEQ ID NO: 201685 - DNA, 20 bp, Homo sapiens
caaaggagacaaagcaggag

SEQ ID NO: 201686 - DNA, 18 bp, Homo sapiens
caaaggagggcctcagag

SEQ ID NO: 201687 - DNA, 20 bp, Homo sapiens
caaaggagtgcatggccaca

SEQ ID NO: 201688 - DNA, 22 bp, Homo sapiens
caaaggagtgcatggccacagc

SEQ ID NO: 201689 - DNA, 22 bp, Homo sapiens
caaaggatagtgcgatgtttca

SEQ ID NO: 201690 - DNA, 12 bp, Homo sapiens
caaaggcccaga

SEQ ID NO: 201691 - DNA, 12 bp, Homo sapiens
caaagggccagg

SEQ ID NO: 201692 - DNA, 14 bp, Homo sapiens
caaaggggctgctg

SEQ ID NO: 201693 - DNA, 17 bp, Homo sapiens
caaaggggctgctgggg

SEQ ID NO: 201694 - DNA, 13 bp, Homo sapiens
caaagggtggaat

SEQ ID NO: 201695 - DNA, 16 bp, Homo sapiens
caaaggttgtacatag

SEQ ID NO: 201696 - DNA, 16 bp, Homo sapiens
caaagtaccaactgag

SEQ ID NO: 201697 - DNA, 20 bp, Homo sapiens
caaagtataaatttgtgtaa

SEQ ID NO: 201698 - DNA, 13 bp, Homo sapiens
caaagtctaaagt

SEQ ID NO: 201699 - DNA, 15 bp, Homo sapiens
caaagtctaaagttt

SEQ ID NO: 201700 - DNA, 17 bp, Homo sapiens
caaagtctaaagtttac

SEQ ID NO: 201701 - DNA, 15 bp, Homo sapiens
caaagtctctcattt

SEQ ID NO: 201702 - DNA, 13 bp, Homo sapiens
caaagtctgtgtg

SEQ ID NO: 201703 - DNA, 14 bp, Homo sapiens
caaagtctgtgtga

SEQ ID NO: 201704 - DNA, 19 bp, Homo sapiens
caaagtgaaagacatttca

SEQ ID NO: 201705 - DNA, 16 bp, Homo sapiens
caaagtgcagcccttc

SEQ ID NO: 201706 - DNA, 17 bp, Homo sapiens
caaagtgcagcccttcc

SEQ ID NO: 201707 - DNA, 18 bp, Homo sapiens
caaagtgcagcccttcct

SEQ ID NO: 201708 - DNA, 23 bp, Homo sapiens
caaagtgcagcccttcctcctga

SEQ ID NO: 201709 - DNA, 19 bp, Homo sapiens
caaagtgctgggattacag

SEQ ID NO: 201710 - DNA, 20 bp, Homo sapiens
caaagtgctgggattacagg

SEQ ID NO: 201711 - DNA, 14 bp, Homo sapiens
caaagtggggaggg

SEQ ID NO: 201712 - DNA, 16 bp, Homo sapiens
caaagtggtgagaggc

SEQ ID NO: 201713 - DNA, 17 bp, Homo sapiens
caaagtggtgagaggca

SEQ ID NO: 201714 - DNA, 19 bp, Homo sapiens
caaagtggtgagaggcatc

SEQ ID NO: 201715 - DNA, 20 bp, Homo sapiens
caaagtgtctacatgtgcca

SEQ ID NO: 201716 - DNA, 21 bp, Homo sapiens
caaagttaaacgtgatgtgct

SEQ ID NO: 201717 - DNA, 20 bp, Homo sapiens
caaagttaacctacctgtaa

SEQ ID NO: 201718 - DNA, 13 bp, Homo sapiens
caaagttccagtt

SEQ ID NO: 201719 - DNA, 21 bp, Homo sapiens
caaagttccagttttgttttg

SEQ ID NO: 201720 - DNA, 14 bp, Homo sapiens
caaagttttatcaa

SEQ ID NO: 201721 - DNA, 14 bp, Homo sapiens
caaagttttcagat

SEQ ID NO: 201722 - DNA, 17 bp, Homo sapiens
caaagtttttacagtgt

SEQ ID NO: 201723 - DNA, 18 bp, Homo sapiens
caaataaaattggcacca

SEQ ID NO: 201724 - DNA, 18 bp, Homo sapiens
caaataaactctaaacat

SEQ ID NO: 201725 - DNA, 14 bp, Homo sapiens
caaataaagttcaa

SEQ ID NO: 201726 - DNA, 14 bp, Homo sapiens
caaataaatttata

SEQ ID NO: 201727 - DNA, 14 bp, Homo sapiens
caaataaatttctg

SEQ ID NO: 201728 - DNA, 15 bp, Homo sapiens
caaataaatttctgg

SEQ ID NO: 201729 - DNA, 13 bp, Homo sapiens
caaataccaaagc

SEQ ID NO: 201730 - DNA, 17 bp, Homo sapiens
caaatagaaaacaggaa

SEQ ID NO: 201731 - DNA, 21 bp, Homo sapiens
caaatagaagcttcttgctcc

SEQ ID NO: 201732 - DNA, 22 bp, Homo sapiens
caaatagaagcttcttgctcct

SEQ ID NO: 201733 - DNA, 21 bp, Homo sapiens
caaatagagtttttatatttg

SEQ ID NO: 201734 - DNA, 19 bp, Homo sapiens
caaatagtgttgatcagat

SEQ ID NO: 201735 - DNA, 22 bp, Homo sapiens
caaatatgattctcctctccca

SEQ ID NO: 201736 - DNA, 13 bp, Homo sapiens
caaatatgcactt

SEQ ID NO: 201737 - DNA, 15 bp, Homo sapiens
caaatatgcactttc

SEQ ID NO: 201738 - DNA, 22 bp, Homo sapiens
caaatatgcactttccctagaa

SEQ ID NO: 201739 - DNA, 18 bp, Homo sapiens
caaatatgcccctcccca

SEQ ID NO: 201740 - DNA, 13 bp, Homo sapiens
caaatatgtcctg

SEQ ID NO: 201741 - DNA, 14 bp, Homo sapiens
caaatatttcactt

SEQ ID NO: 201742 - DNA, 15 bp, Homo sapiens
caaatatttcactta

SEQ ID NO: 201743 - DNA, 22 bp, Homo sapiens
caaatatttcacttaaactttg

SEQ ID NO: 201744 - DNA, 16 bp, Homo sapiens
caaatcaaagcaaggg

SEQ ID NO: 201745 - DNA, 13 bp, Homo sapiens
caaatcagacaca

SEQ ID NO: 201746 - DNA, 14 bp, Homo sapiens
caaatcagacacaa

SEQ ID NO: 201747 - DNA, 15 bp, Homo sapiens
caaatccacaagcca

SEQ ID NO: 201748 - DNA, 22 bp, Homo sapiens
caaatccataccccctgcccca

SEQ ID NO: 201749 - DNA, 20 bp, Homo sapiens
caaatctactgagccacgga

SEQ ID NO: 201750 - DNA, 16 bp, Homo sapiens
caaatcttgaatttct

SEQ ID NO: 201751 - DNA, 18 bp, Homo sapiens
caaatcttgaatttctgc

SEQ ID NO: 201752 - DNA, 15 bp, Homo sapiens
caaatctttaagaat

SEQ ID NO: 201753 - DNA, 15 bp, Homo sapiens
caaatgacttcattt

SEQ ID NO: 201754 - DNA, 15 bp, Homo sapiens
ccctggccagaggct

SEQ ID NO: 201755 - DNA, 13 bp, Homo sapiens
ccctggccatctc

SEQ ID NO: 201756 - DNA, 14 bp, Homo sapiens
ccctggccatctct

SEQ ID NO: 201757 - DNA, 19 bp, Homo sapiens
ccctggctcccacaggccc

SEQ ID NO: 201758 - DNA, 20 bp, Homo sapiens
ccctggctcccacaggccct

SEQ ID NO: 201759 - DNA, 15 bp, Homo sapiens
ccctggctcccatga

SEQ ID NO: 201760 - DNA, 20 bp, Homo sapiens
ccctggctggtaagggccaa

SEQ ID NO: 201761 - DNA, 22 bp, Homo sapiens
ccctggctggtaagggccaagt

SEQ ID NO: 201762 - DNA, 16 bp, Homo sapiens
ccctggcttgcttgcc

SEQ ID NO: 201763 - DNA, 13 bp, Homo sapiens
ccctggcttttca

SEQ ID NO: 201764 - DNA, 19 bp, Homo sapiens
ccctgggcacccacctcca

SEQ ID NO: 201765 - DNA, 15 bp, Homo sapiens
ccctgggcaggcggt

SEQ ID NO: 201766 - DNA, 12 bp, Homo sapiens
ccctgggccacc

SEQ ID NO: 201767 - DNA, 13 bp, Homo sapiens
ccctgggccaccc

SEQ ID NO: 201768 - DNA, 14 bp, Homo sapiens
ccctgggccaccct

SEQ ID NO: 201769 - DNA, 15 bp, Homo sapiens
ccctgggccaccctt

SEQ ID NO: 201770 - DNA, 11 bp, Homo sapiens
ccctgggccag

SEQ ID NO: 201771 - DNA, 18 bp, Homo sapiens
ccctgggccagcccagga

SEQ ID NO: 201772 - DNA, 14 bp, Homo sapiens
ccctgggcctcccg

SEQ ID NO: 201773 - DNA, 18 bp, Homo sapiens
ccctgggcctgtctcaga

SEQ ID NO: 201774 - DNA, 22 bp, Homo sapiens
ccctgggcctgtctcagattgg

SEQ ID NO: 201775 - DNA, 11 bp, Homo sapiens
ccctgggctgg

SEQ ID NO: 201776 - DNA, 16 bp, Homo sapiens
ccctgggctggactgg

SEQ ID NO: 201777 - DNA, 19 bp, Homo sapiens
ccctggggaagaggccttg

SEQ ID NO: 201778 - DNA, 22 bp, Homo sapiens
ccctggggaagaggccttgggg

SEQ ID NO: 201779 - DNA, 18 bp, Homo sapiens
ccctggggaccaggagct

SEQ ID NO: 201780 - DNA, 20 bp, Homo sapiens
ccctggggaccaggagctag

SEQ ID NO: 201781 - DNA, 18 bp, Homo sapiens
ccctggggcctggacctg

SEQ ID NO: 201782 - DNA, 14 bp, Homo sapiens
ccctggggctgggc

SEQ ID NO: 201783 - DNA, 22 bp, Homo sapiens
ccctggggctgggccccccagc

SEQ ID NO: 201784 - DNA, 15 bp, Homo sapiens
ccctggggcttctcc

SEQ ID NO: 201785 - DNA, 16 bp, Homo sapiens
ccctgggggtcccagg

SEQ ID NO: 201786 - DNA, 15 bp, Homo sapiens
ccctggggtctctga

SEQ ID NO: 201787 - DNA, 23 bp, Homo sapiens
ccctggggtctctgagcagtggg

SEQ ID NO: 201788 - DNA, 24 bp, Homo sapiens
ccctggggtggcgtctgcctagga

SEQ ID NO: 201789 - DNA, 13 bp, Homo sapiens
ccctgggtgccat

SEQ ID NO: 201790 - DNA, 23 bp, Homo sapiens
ccctggtactcccccagccctca

SEQ ID NO: 201791 - DNA, 14 bp, Homo sapiens
ccctggtgaggaag

SEQ ID NO: 201792 - DNA, 21 bp, Homo sapiens
ccctggtgcactggccccacc

SEQ ID NO: 201793 - DNA, 16 bp, Homo sapiens
ccctggtgctgccaca

SEQ ID NO: 201794 - DNA, 21 bp, Homo sapiens
ccctggtgtcacatggggcct

SEQ ID NO: 201795 - DNA, 21 bp, Homo sapiens
ccctggttcccccaggaccct

SEQ ID NO: 201796 - DNA, 15 bp, Homo sapiens
ccctggttctccatc

SEQ ID NO: 201797 - DNA, 15 bp, Homo sapiens
ccctggtttcactgg

SEQ ID NO: 201798 - DNA, 20 bp, Homo sapiens
ccctggtttcactggcccaa

SEQ ID NO: 201799 - DNA, 19 bp, Homo sapiens
ccctggttttaccccagct

SEQ ID NO: 201800 - DNA, 20 bp, Homo sapiens
ccctggttttaccccagctc

SEQ ID NO: 201801 - DNA, 22 bp, Homo sapiens
ccctggttttaccccagctcca

SEQ ID NO: 201802 - DNA, 15 bp, Homo sapiens
ccctgtacccagcca

SEQ ID NO: 201803 - DNA, 19 bp, Homo sapiens
ccctgtacccagccacctt

SEQ ID NO: 201804 - DNA, 20 bp, Homo sapiens
ccctgtacccagccaccttc

SEQ ID NO: 201805 - DNA, 16 bp, Homo sapiens
ccctgtacccagctcc

SEQ ID NO: 201806 - DNA, 13 bp, Homo sapiens
ccctgtacctctc

SEQ ID NO: 201807 - DNA, 14 bp, Homo sapiens
ccctgtaggttgct

SEQ ID NO: 201808 - DNA, 18 bp, Homo sapiens
ccctgtcaagttaacaag

SEQ ID NO: 201809 - DNA, 21 bp, Homo sapiens
ccctgtcaagttaacaaggaa

SEQ ID NO: 201810 - DNA, 16 bp, Homo sapiens
ccctgtcccaccaact

SEQ ID NO: 201811 - DNA, 18 bp, Homo sapiens
ccctgtcccaccaactct

SEQ ID NO: 201812 - DNA, 24 bp, Homo sapiens
ccctgtcccaccaactctgcactc

SEQ ID NO: 201813 - DNA, 18 bp, Homo sapiens
ccctgtccttcccacggc

SEQ ID NO: 201814 - DNA, 15 bp, Homo sapiens
ccctgtcgagacact

SEQ ID NO: 201815 - DNA, 13 bp, Homo sapiens
ccctgtctaatga

SEQ ID NO: 201816 - DNA, 16 bp, Homo sapiens
ccctgtctaatgaaac

SEQ ID NO: 201817 - DNA, 23 bp, Homo sapiens
ccctgtctctactaaaaatgcaa

SEQ ID NO: 201818 - DNA, 19 bp, Homo sapiens
ccctgtctgctaggcgctg

SEQ ID NO: 201819 - DNA, 13 bp, Homo sapiens
ccctgtctggaag

SEQ ID NO: 201820 - DNA, 16 bp, Homo sapiens
ccctgtcttccccacc

SEQ ID NO: 201821 - DNA, 14 bp, Homo sapiens
ccctgtgatgcctg

SEQ ID NO: 201822 - DNA, 16 bp, Homo sapiens
ccctgtgcccacccag

SEQ ID NO: 201823 - DNA, 21 bp, Homo sapiens
ccctgtgcccacccagggccc

SEQ ID NO: 201824 - DNA, 20 bp, Homo sapiens
ccctgtgcctaacaccagcg

SEQ ID NO: 201825 - DNA, 21 bp, Homo sapiens
ccctgtgcctaacaccagcgt

SEQ ID NO: 201826 - DNA, 21 bp, Homo sapiens
ccctgtggaagggactaggag

SEQ ID NO: 201827 - DNA, 12 bp, Homo sapiens
ccctgtgggagt

SEQ ID NO: 201828 - DNA, 15 bp, Homo sapiens
ccctgtggggcctga

SEQ ID NO: 201829 - DNA, 16 bp, Homo sapiens
ccctgtggtaccctgg

SEQ ID NO: 201830 - DNA, 19 bp, Homo sapiens
ccctgtggtaccctggcag

SEQ ID NO: 201831 - DNA, 23 bp, Homo sapiens
ccctgtgtccgctctctcatgtg

SEQ ID NO: 201832 - DNA, 15 bp, Homo sapiens
ccctgtgtggaccat

SEQ ID NO: 201833 - DNA, 19 bp, Homo sapiens
ccctgtgtgtcgttccctt

SEQ ID NO: 201834 - DNA, 16 bp, Homo sapiens
ccctgtgttgtctcta

SEQ ID NO: 201835 - DNA, 21 bp, Homo sapiens
ccctgtgttgtctctagagca

SEQ ID NO: 201836 - DNA, 12 bp, Homo sapiens
ccctgttcattg

SEQ ID NO: 201837 - DNA, 13 bp, Homo sapiens
ccctgttcattgt

SEQ ID NO: 201838 - DNA, 12 bp, Homo sapiens
ccctgttcttta

SEQ ID NO: 201839 - DNA, 14 bp, Homo sapiens
ccctgtttgcctat

SEQ ID NO: 201840 - DNA, 15 bp, Homo sapiens
cccttacacgtacct

SEQ ID NO: 201841 - DNA, 16 bp, Homo sapiens
cccttacacgtacctc

SEQ ID NO: 201842 - DNA, 17 bp, Homo sapiens
cccttaccccttagcct

SEQ ID NO: 201843 - DNA, 22 bp, Homo sapiens
cccttaccccttagcctccctg

SEQ ID NO: 201844 - DNA, 18 bp, Homo sapiens
cccttagagattgcccca

SEQ ID NO: 201845 - DNA, 23 bp, Homo sapiens
cccttagagattgccccagagcc

SEQ ID NO: 201846 - DNA, 16 bp, Homo sapiens
cccttagcctctccca

SEQ ID NO: 201847 - DNA, 19 bp, Homo sapiens
cccttcacaccataactag

SEQ ID NO: 201848 - DNA, 18 bp, Homo sapiens
cccttcacgctggcttcc

SEQ ID NO: 201849 - DNA, 21 bp, Homo sapiens
cccttcacgctggcttccagc

SEQ ID NO: 201850 - DNA, 16 bp, Homo sapiens
cccttcactgccatga

SEQ ID NO: 201851 - DNA, 15 bp, Homo sapiens
cccttcagaccccag

SEQ ID NO: 201852 - DNA, 14 bp, Homo sapiens
cccttcagggccag

SEQ ID NO: 201853 - DNA, 12 bp, Homo sapiens
cccttccacctc

SEQ ID NO: 201854 - DNA, 20 bp, Homo sapiens
cccttccactgcctctgcct

SEQ ID NO: 201855 - DNA, 12 bp, Homo sapiens
cccttccagtgg

SEQ ID NO: 201856 - DNA, 18 bp, Homo sapiens
cccttcccatctcttcct

SEQ ID NO: 201857 - DNA, 22 bp, Homo sapiens
cccttccccaagaaggtgagtg

SEQ ID NO: 201858 - DNA, 15 bp, Homo sapiens
cccttccccactctg

SEQ ID NO: 201859 - DNA, 20 bp, Homo sapiens
cccttccccatttcctcttc

SEQ ID NO: 201860 - DNA, 21 bp, Homo sapiens
cccttccccatttcctcttcc

SEQ ID NO: 201861 - DNA, 15 bp, Homo sapiens
cccttcccctccctg

SEQ ID NO: 201862 - DNA, 22 bp, Homo sapiens
cccttcccctccctggctccca

SEQ ID NO: 201863 - DNA, 14 bp, Homo sapiens
cccttcccctgcgc

SEQ ID NO: 201864 - DNA, 20 bp, Homo sapiens
cccttcccctgcgccctccc

SEQ ID NO: 201865 - DNA, 23 bp, Homo sapiens
cccttcccctgtgactcctccct

SEQ ID NO: 201866 - DNA, 14 bp, Homo sapiens
cccttccctctgtt

SEQ ID NO: 201867 - DNA, 15 bp, Homo sapiens
cccttccctgcaaac

SEQ ID NO: 201868 - DNA, 15 bp, Homo sapiens
cccttccctggcccc

SEQ ID NO: 201869 - DNA, 12 bp, Homo sapiens
cccttccctggt

SEQ ID NO: 201870 - DNA, 17 bp, Homo sapiens
cccttcccttccactgc

SEQ ID NO: 201871 - DNA, 13 bp, Homo sapiens
cccttcctccgct

SEQ ID NO: 201872 - DNA, 14 bp, Homo sapiens
cccttcctccgctc

SEQ ID NO: 201873 - DNA, 21 bp, Homo sapiens
cccttcctctccactgccttc

SEQ ID NO: 201874 - DNA, 16 bp, Homo sapiens
cccttcctctctcctt

SEQ ID NO: 201875 - DNA, 23 bp, Homo sapiens
cccttcctggcctcactggctgg

SEQ ID NO: 201876 - DNA, 13 bp, Homo sapiens
cccttcctgtcct

SEQ ID NO: 201877 - DNA, 14 bp, Homo sapiens
cccttcctgtcctg

SEQ ID NO: 201878 - DNA, 17 bp, Homo sapiens
cccttcctgtcctgctc

SEQ ID NO: 201879 - DNA, 18 bp, Homo sapiens
cccttcctgtctggccca

SEQ ID NO: 201880 - DNA, 18 bp, Homo sapiens
cccttctacactctcctg

SEQ ID NO: 201881 - DNA, 23 bp, Homo sapiens
cccttctacactctcctgggccc

SEQ ID NO: 201882 - DNA, 15 bp, Homo sapiens
cccttctcacagcac

SEQ ID NO: 201883 - DNA, 15 bp, Homo sapiens
cccttctcccagcac

SEQ ID NO: 201884 - DNA, 19 bp, Homo sapiens
ccgccactaggtgtcccca

SEQ ID NO: 201885 - DNA, 20 bp, Homo sapiens
ccgccactaggtgtccccaa

SEQ ID NO: 201886 - DNA, 14 bp, Homo sapiens
ccgccagcctcagt

SEQ ID NO: 201887 - DNA, 14 bp, Homo sapiens
ccgccattgccacc

SEQ ID NO: 201888 - DNA, 15 bp, Homo sapiens
ccgcccacccacacc

SEQ ID NO: 201889 - DNA, 12 bp, Homo sapiens
ccgcccaccccg

SEQ ID NO: 201890 - DNA, 13 bp, Homo sapiens
ccgcccacctctg

SEQ ID NO: 201891 - DNA, 15 bp, Homo sapiens
ccgcccacctctgct

SEQ ID NO: 201892 - DNA, 18 bp, Homo sapiens
ccgcccacctctgctgcc

SEQ ID NO: 201893 - DNA, 14 bp, Homo sapiens
ccgcccacctgcat

SEQ ID NO: 201894 - DNA, 17 bp, Homo sapiens
ccgcccacctgcatcag

SEQ ID NO: 201895 - DNA, 13 bp, Homo sapiens
ccgcccactgtcc

SEQ ID NO: 201896 - DNA, 13 bp, Homo sapiens
ccgcccagcctct

SEQ ID NO: 201897 - DNA, 14 bp, Homo sapiens
ccgcccagcctctc

SEQ ID NO: 201898 - DNA, 15 bp, Homo sapiens
ccgcccagctctccc

SEQ ID NO: 201899 - DNA, 14 bp, Homo sapiens
ccgcccccacccct

SEQ ID NO: 201900 - DNA, 18 bp, Homo sapiens
ccgccccccagagccagg

SEQ ID NO: 201901 - DNA, 20 bp, Homo sapiens
ccgccccgtgtccccccagg

SEQ ID NO: 201902 - DNA, 13 bp, Homo sapiens
ccgcccgcccacc

SEQ ID NO: 201903 - DNA, 18 bp, Homo sapiens
ccgcccgcccaccccgct

SEQ ID NO: 201904 - DNA, 14 bp, Homo sapiens
ccgcccgcccccgc

SEQ ID NO: 201905 - DNA, 15 bp, Homo sapiens
ccgcccgcccccgcc

SEQ ID NO: 201906 - DNA, 14 bp, Homo sapiens
ccgcccgccctcct

SEQ ID NO: 201907 - DNA, 14 bp, Homo sapiens
ccgcccgggcccag

SEQ ID NO: 201908 - DNA, 15 bp, Homo sapiens
ccgcccgggcccaga

SEQ ID NO: 201909 - DNA, 16 bp, Homo sapiens
ccgcccgggcccagag

SEQ ID NO: 201910 - DNA, 17 bp, Homo sapiens
ccgccctcctctgcccc

SEQ ID NO: 201911 - DNA, 17 bp, Homo sapiens
ccgccctgatttgctgt

SEQ ID NO: 201912 - DNA, 19 bp, Homo sapiens
ccgccctgatttgctgttt

SEQ ID NO: 201913 - DNA, 16 bp, Homo sapiens
ccgccctttccttgcc

SEQ ID NO: 201914 - DNA, 17 bp, Homo sapiens
ccgccctttccttgcct

SEQ ID NO: 201915 - DNA, 13 bp, Homo sapiens
ccgccgcccgacc

SEQ ID NO: 201916 - DNA, 13 bp, Homo sapiens
ccgccggcagggg

SEQ ID NO: 201917 - DNA, 22 bp, Homo sapiens
ccgccggttggccggctggccg

SEQ ID NO: 201918 - DNA, 13 bp, Homo sapiens
ccgcctagtgcag

SEQ ID NO: 201919 - DNA, 13 bp, Homo sapiens
ccgcctccactct

SEQ ID NO: 201920 - DNA, 15 bp, Homo sapiens
ccgcctcccagcctg

SEQ ID NO: 201921 - DNA, 16 bp, Homo sapiens
ccgcctcccccgcagg

SEQ ID NO: 201922 - DNA, 13 bp, Homo sapiens
ccgcctcctccag

SEQ ID NO: 201923 - DNA, 15 bp, Homo sapiens
ccgcctcctccagac

SEQ ID NO: 201924 - DNA, 14 bp, Homo sapiens
ccgcctctgcccgc

SEQ ID NO: 201925 - DNA, 16 bp, Homo sapiens
ccgcctctgcccgcag

SEQ ID NO: 201926 - DNA, 17 bp, Homo sapiens
ccgcctctgcccgcaga

SEQ ID NO: 201927 - DNA, 18 bp, Homo sapiens
ccgcctctgcccgcagag

SEQ ID NO: 201928 - DNA, 11 bp, Homo sapiens
ccgcctctgct

SEQ ID NO: 201929 - DNA, 14 bp, Homo sapiens
ccgcctctgctggc

SEQ ID NO: 201930 - DNA, 13 bp, Homo sapiens
ccgcctgcttcac

SEQ ID NO: 201931 - DNA, 16 bp, Homo sapiens
ccgcctgcttcacacc

SEQ ID NO: 201932 - DNA, 17 bp, Homo sapiens
ccgcctggggctccggt

SEQ ID NO: 201933 - DNA, 13 bp, Homo sapiens
ccgcctgtccttg

SEQ ID NO: 201934 - DNA, 22 bp, Homo sapiens
ccgcctgtgcccttgctgggtc

SEQ ID NO: 201935 - DNA, 14 bp, Homo sapiens
ccgccttccctcac

SEQ ID NO: 201936 - DNA, 15 bp, Homo sapiens
ccgccttccctcact

SEQ ID NO: 201937 - DNA, 12 bp, Homo sapiens
ccgccttccttg

SEQ ID NO: 201938 - DNA, 18 bp, Homo sapiens
ccgcgagactgagaggca

SEQ ID NO: 201939 - DNA, 20 bp, Homo sapiens
caaatttgtacctctaagta

SEQ ID NO: 201940 - DNA, 19 bp, Homo sapiens
caaattttcactgctgctc

SEQ ID NO: 201941 - DNA, 19 bp, Homo sapiens
caaattttgaggtctttta

SEQ ID NO: 201942 - DNA, 23 bp, Homo sapiens
caacaaaaatttgaaccaaaaca

SEQ ID NO: 201943 - DNA, 13 bp, Homo sapiens
caacaaagaagaa

SEQ ID NO: 201944 - DNA, 21 bp, Homo sapiens
caacaaagaagaaccatcttt

SEQ ID NO: 201945 - DNA, 14 bp, Homo sapiens
caacaaagcatgct

SEQ ID NO: 201946 - DNA, 19 bp, Homo sapiens
caacaaagcatgctcagta

SEQ ID NO: 201947 - DNA, 22 bp, Homo sapiens
caacaaagcatgctcagtattg

SEQ ID NO: 201948 - DNA, 12 bp, Homo sapiens
caacaacaaagc

SEQ ID NO: 201949 - DNA, 13 bp, Homo sapiens
caacaacagaaca

SEQ ID NO: 201950 - DNA, 19 bp, Homo sapiens
caacaacagaacaacaaca

SEQ ID NO: 201951 - DNA, 18 bp, Homo sapiens
caacaactccaggaaaac

SEQ ID NO: 201952 - DNA, 13 bp, Homo sapiens
caacaactttgtt

SEQ ID NO: 201953 - DNA, 15 bp, Homo sapiens
caacaaggaaataga

SEQ ID NO: 201954 - DNA, 18 bp, Homo sapiens
caacaagggagagacctc

SEQ ID NO: 201955 - DNA, 14 bp, Homo sapiens
caacaataaaaaaa

SEQ ID NO: 201956 - DNA, 17 bp, Homo sapiens
caacaataaaaaaaaac

SEQ ID NO: 201957 - DNA, 13 bp, Homo sapiens
caacaataacact

SEQ ID NO: 201958 - DNA, 16 bp, Homo sapiens
caacaataataaatgt

SEQ ID NO: 201959 - DNA, 16 bp, Homo sapiens
caacaatactttgtgt

SEQ ID NO: 201960 - DNA, 20 bp, Homo sapiens
caacaatactttgtgtcttt

SEQ ID NO: 201961 - DNA, 16 bp, Homo sapiens
caacaatggggtgggc

SEQ ID NO: 201962 - DNA, 19 bp, Homo sapiens
caacaattaggtctgcatt

SEQ ID NO: 201963 - DNA, 14 bp, Homo sapiens
caacacaaggtggg

SEQ ID NO: 201964 - DNA, 18 bp, Homo sapiens
caacacacacacacacaa

SEQ ID NO: 201965 - DNA, 13 bp, Homo sapiens
caacaccacaaac

SEQ ID NO: 201966 - DNA, 12 bp, Homo sapiens
caacaccacaga

SEQ ID NO: 201967 - DNA, 17 bp, Homo sapiens
caacaccacagacacac

SEQ ID NO: 201968 - DNA, 22 bp, Homo sapiens
caacaccactaggaatcccaga

SEQ ID NO: 201969 - DNA, 16 bp, Homo sapiens
caacacccaagtccac

SEQ ID NO: 201970 - DNA, 17 bp, Homo sapiens
caacaccttcttggctt

SEQ ID NO: 201971 - DNA, 22 bp, Homo sapiens
caacacttgtgttgctttctga

SEQ ID NO: 201972 - DNA, 10 bp, Homo sapiens
caacagaaac

SEQ ID NO: 201973 - DNA, 16 bp, Homo sapiens
caacagaacaacaaca

SEQ ID NO: 201974 - DNA, 16 bp, Homo sapiens
caacagaagcttcaga

SEQ ID NO: 201975 - DNA, 17 bp, Homo sapiens
caacagaagcttcagaa

SEQ ID NO: 201976 - DNA, 16 bp, Homo sapiens
caacagagcaagactc

SEQ ID NO: 201977 - DNA, 13 bp, Homo sapiens
caacagagtggac

SEQ ID NO: 201978 - DNA, 21 bp, Homo sapiens
caacagagtggactcttccct

SEQ ID NO: 201979 - DNA, 14 bp, Homo sapiens
caacagatactgga

SEQ ID NO: 201980 - DNA, 18 bp, Homo sapiens
caacagcaacaacaacag

SEQ ID NO: 201981 - DNA, 17 bp, Homo sapiens
caacagcatgtctactg

SEQ ID NO: 201982 - DNA, 23 bp, Homo sapiens
caacagcttcttgcttgtaaaaa

SEQ ID NO: 201983 - DNA, 14 bp, Homo sapiens
caacaggaactgtg

SEQ ID NO: 201984 - DNA, 16 bp, Homo sapiens
caacaggaccaggagc

SEQ ID NO: 201985 - DNA, 20 bp, Homo sapiens
caacaggaccaggagccagg

SEQ ID NO: 201986 - DNA, 20 bp, Homo sapiens
caacaggcttatgaatatat

SEQ ID NO: 201987 - DNA, 12 bp, Homo sapiens
caacagtgagtc

SEQ ID NO: 201988 - DNA, 16 bp, Homo sapiens
caacagtgttctgagc

SEQ ID NO: 201989 - DNA, 17 bp, Homo sapiens
caacagtgttctgagcc

SEQ ID NO: 201990 - DNA, 18 bp, Homo sapiens
caacagtgttctgagccc

SEQ ID NO: 201991 - DNA, 18 bp, Homo sapiens
caacagtttgatgctgag

SEQ ID NO: 201992 - DNA, 22 bp, Homo sapiens
caacagttttttatgctaatca

SEQ ID NO: 201993 - DNA, 22 bp, Homo sapiens
caacataaaacaaaaccaagcc

SEQ ID NO: 201994 - DNA, 16 bp, Homo sapiens
caacataatctagttt

SEQ ID NO: 201995 - DNA, 12 bp, Homo sapiens
caacatcaagaa

SEQ ID NO: 201996 - DNA, 13 bp, Homo sapiens
caacatcaatgtt

SEQ ID NO: 201997 - DNA, 22 bp, Homo sapiens
caacatcaatgttcattgtaat

SEQ ID NO: 201998 - DNA, 22 bp, Homo sapiens
caacatcttggtcagatttgaa

SEQ ID NO: 201999 - DNA, 13 bp, Homo sapiens
caacatcttttta

SEQ ID NO: 202000 - DNA, 17 bp, Homo sapiens
caacatgaattaagaac

SEQ ID NO: 202001 - DNA, 22 bp, Homo sapiens
caacatgcttcatgaaaatcct

SEQ ID NO: 202002 - DNA, 17 bp, Homo sapiens
caacatgttactgacca

SEQ ID NO: 202003 - DNA, 18 bp, Homo sapiens
caacatgttactgaccag

SEQ ID NO: 202004 - DNA, 11 bp, Homo sapiens
caacattacaa

SEQ ID NO: 202005 - DNA, 19 bp, Homo sapiens
caacattcaaaagcacaaa

SEQ ID NO: 202006 - DNA, 23 bp, Homo sapiens
caacatttcctcaggcaattcct

SEQ ID NO: 202007 - DNA, 16 bp, Homo sapiens
caaccacctctggccc

SEQ ID NO: 202008 - DNA, 18 bp, Homo sapiens
caaccactgcgaccacaa

SEQ ID NO: 202009 - DNA, 14 bp, Homo sapiens
caaccactggtctg

SEQ ID NO: 202010 - DNA, 17 bp, Homo sapiens
caaccactgtaaaatga

SEQ ID NO: 202011 - DNA, 21 bp, Homo sapiens
caaccactgtaaaatgaaatt

SEQ ID NO: 202012 - DNA, 13 bp, Homo sapiens
caaccacttgcta

SEQ ID NO: 202013 - DNA, 12 bp, Homo sapiens
caaccagagccc

SEQ ID NO: 202014 - DNA, 21 bp, Homo sapiens
caaccaggaggggtctgcctc

SEQ ID NO: 202015 - DNA, 22 bp, Homo sapiens
caaccaggaggggtctgcctcc

SEQ ID NO: 202016 - DNA, 13 bp, Homo sapiens
ccggcctgcagcc

SEQ ID NO: 202017 - DNA, 17 bp, Homo sapiens
ccggcctgcagcccaga

SEQ ID NO: 202018 - DNA, 18 bp, Homo sapiens
ccggcctggggccgggct

SEQ ID NO: 202019 - DNA, 15 bp, Homo sapiens
ccggcgctgcaggta

SEQ ID NO: 202020 - DNA, 17 bp, Homo sapiens
ccggctatgggggcact

SEQ ID NO: 202021 - DNA, 22 bp, Homo sapiens
ccggctatgggggcactgagga

SEQ ID NO: 202022 - DNA, 19 bp, Homo sapiens
ccggctccccctgccagca

SEQ ID NO: 202023 - DNA, 20 bp, Homo sapiens
ccggctccccctgccagcaa

SEQ ID NO: 202024 - DNA, 17 bp, Homo sapiens
ccggctctttccttgct

SEQ ID NO: 202025 - DNA, 21 bp, Homo sapiens
ccggctggccggtccaccccg

SEQ ID NO: 202026 - DNA, 22 bp, Homo sapiens
ccggctgggtcggccctgccca

SEQ ID NO: 202027 - DNA, 15 bp, Homo sapiens
ccggctgtggagcaa

SEQ ID NO: 202028 - DNA, 23 bp, Homo sapiens
ccggctgtggagcaaaaggcagc

SEQ ID NO: 202029 - DNA, 22 bp, Homo sapiens
ccggctttgcagggagaccagg

SEQ ID NO: 202030 - DNA, 16 bp, Homo sapiens
ccgggaccacagctgc

SEQ ID NO: 202031 - DNA, 17 bp, Homo sapiens
ccgggaccacagctgct

SEQ ID NO: 202032 - DNA, 17 bp, Homo sapiens
ccgggaccattgacctc

SEQ ID NO: 202033 - DNA, 23 bp, Homo sapiens
ccgggagatccgccctgggctct

SEQ ID NO: 202034 - DNA, 13 bp, Homo sapiens
ccgggaggaggat

SEQ ID NO: 202035 - DNA, 22 bp, Homo sapiens
ccgggatggtcttgatctcctg

SEQ ID NO: 202036 - DNA, 17 bp, Homo sapiens
ccgggccacgccccagc

SEQ ID NO: 202037 - DNA, 18 bp, Homo sapiens
ccgggccacgccccagcc

SEQ ID NO: 202038 - DNA, 10 bp, Homo sapiens
ccgggcccag

SEQ ID NO: 202039 - DNA, 14 bp, Homo sapiens
ccgggccctccctt

SEQ ID NO: 202040 - DNA, 22 bp, Homo sapiens
ccgggccctctgtagctccctc

SEQ ID NO: 202041 - DNA, 14 bp, Homo sapiens
ccgggcctggactg

SEQ ID NO: 202042 - DNA, 13 bp, Homo sapiens
ccgggcctggggc

SEQ ID NO: 202043 - DNA, 13 bp, Homo sapiens
ccgggctctggcc

SEQ ID NO: 202044 - DNA, 16 bp, Homo sapiens
ccgggctctggccacc

SEQ ID NO: 202045 - DNA, 15 bp, Homo sapiens
ccgggctgctgctga

SEQ ID NO: 202046 - DNA, 19 bp, Homo sapiens
ccgggctggcttctccctg

SEQ ID NO: 202047 - DNA, 20 bp, Homo sapiens
ccgggctggcttctccctgg

SEQ ID NO: 202048 - DNA, 13 bp, Homo sapiens
ccgggctgggagc

SEQ ID NO: 202049 - DNA, 17 bp, Homo sapiens
ccggggaggagccttgg

SEQ ID NO: 202050 - DNA, 17 bp, Homo sapiens
ccggggcaagagggaag

SEQ ID NO: 202051 - DNA, 23 bp, Homo sapiens
ccggggcaaggtctccttactct

SEQ ID NO: 202052 - DNA, 18 bp, Homo sapiens
ccggggcactggctgctc

SEQ ID NO: 202053 - DNA, 20 bp, Homo sapiens
ccggggcagctgccagagaa

SEQ ID NO: 202054 - DNA, 13 bp, Homo sapiens
ccggggcagctgg

SEQ ID NO: 202055 - DNA, 14 bp, Homo sapiens
ccggggcatggaca

SEQ ID NO: 202056 - DNA, 19 bp, Homo sapiens
ccggggctggcaagcaggg

SEQ ID NO: 202057 - DNA, 12 bp, Homo sapiens
ccggggctggcc

SEQ ID NO: 202058 - DNA, 14 bp, Homo sapiens
ccggggctggccct

SEQ ID NO: 202059 - DNA, 15 bp, Homo sapiens
ccggggctggccctg

SEQ ID NO: 202060 - DNA, 18 bp, Homo sapiens
ccggggctggccctgccc

SEQ ID NO: 202061 - DNA, 22 bp, Homo sapiens
ccggggctggccctgccctccc

SEQ ID NO: 202062 - DNA, 13 bp, Homo sapiens
ccggggggagcag

SEQ ID NO: 202063 - DNA, 13 bp, Homo sapiens
ccggggtctgtgc

SEQ ID NO: 202064 - DNA, 21 bp, Homo sapiens
ccggggtggggtgcctgagcc

SEQ ID NO: 202065 - DNA, 16 bp, Homo sapiens
ccgggtcaccctgtga

SEQ ID NO: 202066 - DNA, 15 bp, Homo sapiens
ccgggtgggcctggc

SEQ ID NO: 202067 - DNA, 17 bp, Homo sapiens
ccgggtgggcctggcct

SEQ ID NO: 202068 - DNA, 20 bp, Homo sapiens
ccgggtgggcctggcctgag

SEQ ID NO: 202069 - DNA, 21 bp, Homo sapiens
ccgggtgtggcacgcacctgt

SEQ ID NO: 202070 - DNA, 22 bp, Homo sapiens
ccgggtttggcgggccaaggac

SEQ ID NO: 202071 - DNA, 13 bp, Homo sapiens
ccggtccaccccg

SEQ ID NO: 202072 - DNA, 11 bp, Homo sapiens
ccggtcccagg

SEQ ID NO: 202073 - DNA, 15 bp, Homo sapiens
ccggtgtgagcccac

SEQ ID NO: 202074 - DNA, 16 bp, Homo sapiens
ccggttgcttctggga

SEQ ID NO: 202075 - DNA, 18 bp, Homo sapiens
ccggttggccggctggcc

SEQ ID NO: 202076 - DNA, 14 bp, Homo sapiens
ccggtttgggagag

SEQ ID NO: 202077 - DNA, 17 bp, Homo sapiens
caacgtggggcagcaca

SEQ ID NO: 202078 - DNA, 18 bp, Homo sapiens
caacgtggggcagcacag

SEQ ID NO: 202079 - DNA, 17 bp, Homo sapiens
caactaaataacacaga

SEQ ID NO: 202080 - DNA, 23 bp, Homo sapiens
caactaagtagactttaattctt

SEQ ID NO: 202081 - DNA, 17 bp, Homo sapiens
caactaattcaataaaa

SEQ ID NO: 202082 - DNA, 15 bp, Homo sapiens
caactagccaaggct

SEQ ID NO: 202083 - DNA, 15 bp, Homo sapiens
caactagtggagaga

SEQ ID NO: 202084 - DNA, 13 bp, Homo sapiens
caactcactgtgc

SEQ ID NO: 202085 - DNA, 17 bp, Homo sapiens
caactcactgtgctcct

SEQ ID NO: 202086 - DNA, 18 bp, Homo sapiens
caactcactgtgctccta

SEQ ID NO: 202087 - DNA, 14 bp, Homo sapiens
caactccaaggcaa

SEQ ID NO: 202088 - DNA, 16 bp, Homo sapiens
caactccaaggcaaat

SEQ ID NO: 202089 - DNA, 20 bp, Homo sapiens
caactccaaggcaaatgtcc

SEQ ID NO: 202090 - DNA, 22 bp, Homo sapiens
caactccaaggcaaatgtccaa

SEQ ID NO: 202091 - DNA, 14 bp, Homo sapiens
caactccaggggca

SEQ ID NO: 202092 - DNA, 15 bp, Homo sapiens
caactccatgaccag

SEQ ID NO: 202093 - DNA, 16 bp, Homo sapiens
caactccatgaccagg

SEQ ID NO: 202094 - DNA, 17 bp, Homo sapiens
caactccatgaccaggc

SEQ ID NO: 202095 - DNA, 12 bp, Homo sapiens
caactccatgcc

SEQ ID NO: 202096 - DNA, 13 bp, Homo sapiens
caactccatgcct

SEQ ID NO: 202097 - DNA, 15 bp, Homo sapiens
caactcccagccacc

SEQ ID NO: 202098 - DNA, 17 bp, Homo sapiens
caactccgcccagcctc

SEQ ID NO: 202099 - DNA, 17 bp, Homo sapiens
caactccttcctctttg

SEQ ID NO: 202100 - DNA, 20 bp, Homo sapiens
caactctccccagtgcctgc

SEQ ID NO: 202101 - DNA, 13 bp, Homo sapiens
caactctgactgt

SEQ ID NO: 202102 - DNA, 18 bp, Homo sapiens
caactctgtgtcccagca

SEQ ID NO: 202103 - DNA, 21 bp, Homo sapiens
caactcttccccctctcccag

SEQ ID NO: 202104 - DNA, 15 bp, Homo sapiens
caactgaacaaaaaa

SEQ ID NO: 202105 - DNA, 19 bp, Homo sapiens
caactgaacgacaaagcat

SEQ ID NO: 202106 - DNA, 21 bp, Homo sapiens
caactgaaggcaacctggaag

SEQ ID NO: 202107 - DNA, 15 bp, Homo sapiens
caactgatatacttg

SEQ ID NO: 202108 - DNA, 16 bp, Homo sapiens
caactgatcatttgca

SEQ ID NO: 202109 - DNA, 20 bp, Homo sapiens
caactgcatccaggcctgag

SEQ ID NO: 202110 - DNA, 17 bp, Homo sapiens
caactgctgttttatgt

SEQ ID NO: 202111 - DNA, 13 bp, Homo sapiens
caactgggcccaa

SEQ ID NO: 202112 - DNA, 17 bp, Homo sapiens
caactgtgcagcaccct

SEQ ID NO: 202113 - DNA, 17 bp, Homo sapiens
caactgtttttgaagaa

SEQ ID NO: 202114 - DNA, 19 bp, Homo sapiens
caacttaaaaagtctgcat

SEQ ID NO: 202115 - DNA, 14 bp, Homo sapiens
caacttaagtttag

SEQ ID NO: 202116 - DNA, 15 bp, Homo sapiens
caacttaagtttaga

SEQ ID NO: 202117 - DNA, 17 bp, Homo sapiens
caacttcaccaccccct

SEQ ID NO: 202118 - DNA, 18 bp, Homo sapiens
caacttcagcagtaccta

SEQ ID NO: 202119 - DNA, 19 bp, Homo sapiens
caacttcatgtcaacttct

SEQ ID NO: 202120 - DNA, 16 bp, Homo sapiens
caacttcattgctaca

SEQ ID NO: 202121 - DNA, 15 bp, Homo sapiens
caacttccctgttct

SEQ ID NO: 202122 - DNA, 16 bp, Homo sapiens
caacttctaattgcca

SEQ ID NO: 202123 - DNA, 16 bp, Homo sapiens
caacttgagatgtatg

SEQ ID NO: 202124 - DNA, 22 bp, Homo sapiens
caacttgagatgtatgaaggct

SEQ ID NO: 202125 - DNA, 19 bp, Homo sapiens
caacttgagcatgttactg

SEQ ID NO: 202126 - DNA, 20 bp, Homo sapiens
caacttgagcatgttactga

SEQ ID NO: 202127 - DNA, 16 bp, Homo sapiens
caacttgtaaatacac

SEQ ID NO: 202128 - DNA, 19 bp, Homo sapiens
caacttgtctttttctgga

SEQ ID NO: 202129 - DNA, 22 bp, Homo sapiens
caacttgtctttttctggactg

SEQ ID NO: 202130 - DNA, 18 bp, Homo sapiens
caactttagctagtatct

SEQ ID NO: 202131 - DNA, 11 bp, Homo sapiens
caactttctgt

SEQ ID NO: 202132 - DNA, 13 bp, Homo sapiens
caacttttctatt

SEQ ID NO: 202133 - DNA, 13 bp, Homo sapiens
caacttttgaaat

SEQ ID NO: 202134 - DNA, 17 bp, Homo sapiens
caagaaaaaagtacaga

SEQ ID NO: 202135 - DNA, 15 bp, Homo sapiens
caagaaaacaacttc

SEQ ID NO: 202136 - DNA, 18 bp, Homo sapiens
caagaaaacaacttcaat

SEQ ID NO: 202137 - DNA, 20 bp, Homo sapiens
caagaaaccaagtgggctgg

SEQ ID NO: 202138 - DNA, 16 bp, Homo sapiens
caagaaagctggtaaa

SEQ ID NO: 202139 - DNA, 20 bp, Homo sapiens
caagaaattcattaaagaaa

SEQ ID NO: 202140 - DNA, 23 bp, Homo sapiens
caagaaattcattaaagaaaaac

SEQ ID NO: 202141 - DNA, 13 bp, Homo sapiens
caagaacagcagg

SEQ ID NO: 202142 - DNA, 21 bp, Homo sapiens
caagaacagcaggcccaccta

SEQ ID NO: 202143 - DNA, 17 bp, Homo sapiens
caagaacattatcttag

SEQ ID NO: 202144 - DNA, 13 bp, Homo sapiens
caagaactctggg

SEQ ID NO: 202145 - DNA, 12 bp, Homo sapiens
caagaactgcat

SEQ ID NO: 202146 - DNA, 13 bp, Homo sapiens
caagaactgcatg

SEQ ID NO: 202147 - DNA, 14 bp, Homo sapiens
ccgttccccttggc

SEQ ID NO: 202148 - DNA, 14 bp, Homo sapiens
ccgttccctgtcag

SEQ ID NO: 202149 - DNA, 15 bp, Homo sapiens
ccgttctccattctg

SEQ ID NO: 202150 - DNA, 15 bp, Homo sapiens
ccgttctgctggcct

SEQ ID NO: 202151 - DNA, 18 bp, Homo sapiens
ccgttctgctggcctgga

SEQ ID NO: 202152 - DNA, 19 bp, Homo sapiens
ccgttgccgggcctggact

SEQ ID NO: 202153 - DNA, 16 bp, Homo sapiens
ccgtttatgggccttg

SEQ ID NO: 202154 - DNA, 16 bp, Homo sapiens
ccgtttccaagcctgg

SEQ ID NO: 202155 - DNA, 14 bp, Homo sapiens
ccgttttcatcctg

SEQ ID NO: 202156 - DNA, 12 bp, Homo sapiens
cctaaaacaaat

SEQ ID NO: 202157 - DNA, 15 bp, Homo sapiens
cctaaaatacattta

SEQ ID NO: 202158 - DNA, 23 bp, Homo sapiens
cctaaacagatataaatggctgg

SEQ ID NO: 202159 - DNA, 20 bp, Homo sapiens
cctaaagatggcgcacccgg

SEQ ID NO: 202160 - DNA, 19 bp, Homo sapiens
cctaaagtagacttcattt

SEQ ID NO: 202161 - DNA, 14 bp, Homo sapiens
cctaaatatccaaa

SEQ ID NO: 202162 - DNA, 17 bp, Homo sapiens
cctaaatccattttcta

SEQ ID NO: 202163 - DNA, 17 bp, Homo sapiens
cctaacattcgatctca

SEQ ID NO: 202164 - DNA, 20 bp, Homo sapiens
cctaactcttgctcactccc

SEQ ID NO: 202165 - DNA, 13 bp, Homo sapiens
cctaactgagctg

SEQ ID NO: 202166 - DNA, 14 bp, Homo sapiens
cctaactgagctgc

SEQ ID NO: 202167 - DNA, 23 bp, Homo sapiens
cctaacttattgcctgggcagtg

SEQ ID NO: 202168 - DNA, 21 bp, Homo sapiens
cctaagagtgtcactgagctg

SEQ ID NO: 202169 - DNA, 18 bp, Homo sapiens
cctaagagttgagctctc

SEQ ID NO: 202170 - DNA, 21 bp, Homo sapiens
cctaagatttattttgttaaa

SEQ ID NO: 202171 - DNA, 21 bp, Homo sapiens
cctaagccactcccgccacac

SEQ ID NO: 202172 - DNA, 15 bp, Homo sapiens
cctaaggacacacta

SEQ ID NO: 202173 - DNA, 16 bp, Homo sapiens
cctaaggatctctcag

SEQ ID NO: 202174 - DNA, 19 bp, Homo sapiens
cctaaggatctctcaggag

SEQ ID NO: 202175 - DNA, 13 bp, Homo sapiens
cctaaggctgctg

SEQ ID NO: 202176 - DNA, 19 bp, Homo sapiens
cctaagtaaatctaaatta

SEQ ID NO: 202177 - DNA, 11 bp, Homo sapiens
cctaatatcat

SEQ ID NO: 202178 - DNA, 14 bp, Homo sapiens
cctaatatcatttt

SEQ ID NO: 202179 - DNA, 17 bp, Homo sapiens
cctaatatcattttatt

SEQ ID NO: 202180 - DNA, 16 bp, Homo sapiens
cctaatccccttctcc

SEQ ID NO: 202181 - DNA, 18 bp, Homo sapiens
cctaatccccttctcccc

SEQ ID NO: 202182 - DNA, 13 bp, Homo sapiens
cctaatgaaggcc

SEQ ID NO: 202183 - DNA, 18 bp, Homo sapiens
cctaatgagaagtcaaca

SEQ ID NO: 202184 - DNA, 18 bp, Homo sapiens
cctaatgtttatgagcca

SEQ ID NO: 202185 - DNA, 13 bp, Homo sapiens
cctaatttacaag

SEQ ID NO: 202186 - DNA, 17 bp, Homo sapiens
cctacaagagcagcctg

SEQ ID NO: 202187 - DNA, 18 bp, Homo sapiens
cctacaagagcagcctgt

SEQ ID NO: 202188 - DNA, 19 bp, Homo sapiens
cctacaagagcagcctgtg

SEQ ID NO: 202189 - DNA, 21 bp, Homo sapiens
cctacaagagcagcctgtggc

SEQ ID NO: 202190 - DNA, 18 bp, Homo sapiens
cctacaagatttagaaaa

SEQ ID NO: 202191 - DNA, 22 bp, Homo sapiens
cctacaatatcattttcctggg

SEQ ID NO: 202192 - DNA, 23 bp, Homo sapiens
cctacaatatcattttcctggga

SEQ ID NO: 202193 - DNA, 20 bp, Homo sapiens
cctacacccttggacttgag

SEQ ID NO: 202194 - DNA, 18 bp, Homo sapiens
cctacacctctgggccct

SEQ ID NO: 202195 - DNA, 21 bp, Homo sapiens
cctacagataatttattttgt

SEQ ID NO: 202196 - DNA, 14 bp, Homo sapiens
cctacagccccttt

SEQ ID NO: 202197 - DNA, 22 bp, Homo sapiens
cctacagcctgcacacacctgc

SEQ ID NO: 202198 - DNA, 21 bp, Homo sapiens
cctacagggaactgggaagat

SEQ ID NO: 202199 - DNA, 15 bp, Homo sapiens
cctacagggggtgga

SEQ ID NO: 202200 - DNA, 13 bp, Homo sapiens
cctacagtatata

SEQ ID NO: 202201 - DNA, 15 bp, Homo sapiens
cctacagtatataag

SEQ ID NO: 202202 - DNA, 18 bp, Homo sapiens
cctacagtatataagctt

SEQ ID NO: 202203 - DNA, 22 bp, Homo sapiens
cctacagtatataagctttttt

SEQ ID NO: 202204 - DNA, 15 bp, Homo sapiens
cctacattccctctc

SEQ ID NO: 202205 - DNA, 23 bp, Homo sapiens
cctacattccctctcctgcccag

SEQ ID NO: 202206 - DNA, 12 bp, Homo sapiens
cctaccaatgca

SEQ ID NO: 202207 - DNA, 16 bp, Homo sapiens
cctaccacagtgtctg

SEQ ID NO: 202208 - DNA, 14 bp, Homo sapiens
cctaccactgagcc

SEQ ID NO: 202209 - DNA, 18 bp, Homo sapiens
cctaccactgagcccttg

SEQ ID NO: 202210 - DNA, 22 bp, Homo sapiens
cctaccagcgcccgctgggctg

SEQ ID NO: 202211 - DNA, 22 bp, Homo sapiens
cctaccagtcgccctctgtgcc

SEQ ID NO: 202212 - DNA, 15 bp, Homo sapiens
cctacccaaccactc

SEQ ID NO: 202213 - DNA, 17 bp, Homo sapiens
cctacccacagggcctg

SEQ ID NO: 202214 - DNA, 11 bp, Homo sapiens
cctaccccaca

SEQ ID NO: 202215 - DNA, 20 bp, Homo sapiens
cctaccccacaccaggccgt

SEQ ID NO: 202216 - DNA, 18 bp, Homo sapiens
caagatcacgccactgca

SEQ ID NO: 202217 - DNA, 22 bp, Homo sapiens
caagatccaaatgctgtgcaaa

SEQ ID NO: 202218 - DNA, 18 bp, Homo sapiens
caagatcttcaaccatga

SEQ ID NO: 202219 - DNA, 23 bp, Homo sapiens
caagatgagattggcatggcttt

SEQ ID NO: 202220 - DNA, 22 bp, Homo sapiens
caagatgatttttaagtacaaa

SEQ ID NO: 202221 - DNA, 18 bp, Homo sapiens
caagatgccatctgtgtc

SEQ ID NO: 202222 - DNA, 15 bp, Homo sapiens
caagatgcctcttct

SEQ ID NO: 202223 - DNA, 16 bp, Homo sapiens
caagatgcctcttcta

SEQ ID NO: 202224 - DNA, 12 bp, Homo sapiens
caagatgctctg

SEQ ID NO: 202225 - DNA, 16 bp, Homo sapiens
caagatggaaaggatt

SEQ ID NO: 202226 - DNA, 20 bp, Homo sapiens
caagatgtcaaataaagcaa

SEQ ID NO: 202227 - DNA, 14 bp, Homo sapiens
caagattaaatgta

SEQ ID NO: 202228 - DNA, 21 bp, Homo sapiens
caagattaagttataccagca

SEQ ID NO: 202229 - DNA, 20 bp, Homo sapiens
caagattgaagtctgatatt

SEQ ID NO: 202230 - DNA, 11 bp, Homo sapiens
caagcaaacat

SEQ ID NO: 202231 - DNA, 15 bp, Homo sapiens
caagcaaaccttctc

SEQ ID NO: 202232 - DNA, 15 bp, Homo sapiens
caagcaagctctctt

SEQ ID NO: 202233 - DNA, 14 bp, Homo sapiens
caagcaatcctcct

SEQ ID NO: 202234 - DNA, 17 bp, Homo sapiens
caagcacatctgcattt

SEQ ID NO: 202235 - DNA, 20 bp, Homo sapiens
caagcacatctgcattttca

SEQ ID NO: 202236 - DNA, 19 bp, Homo sapiens
caagcactcgagaccatcc

SEQ ID NO: 202237 - DNA, 21 bp, Homo sapiens
caagcactcgagaccatcctg

SEQ ID NO: 202238 - DNA, 11 bp, Homo sapiens
caagcagccag

SEQ ID NO: 202239 - DNA, 12 bp, Homo sapiens
caagcagccagc

SEQ ID NO: 202240 - DNA, 14 bp, Homo sapiens
caagcagccagcca

SEQ ID NO: 202241 - DNA, 15 bp, Homo sapiens
caagcagccagccag

SEQ ID NO: 202242 - DNA, 13 bp, Homo sapiens
caagcatgcccca

SEQ ID NO: 202243 - DNA, 18 bp, Homo sapiens
caagcatgccccacccac

SEQ ID NO: 202244 - DNA, 22 bp, Homo sapiens
caagcatgccccacccacccct

SEQ ID NO: 202245 - DNA, 15 bp, Homo sapiens
caagccaaccttagc

SEQ ID NO: 202246 - DNA, 15 bp, Homo sapiens
caagccaacttgtaa

SEQ ID NO: 202247 - DNA, 18 bp, Homo sapiens
caagccaacttgtaaata

SEQ ID NO: 202248 - DNA, 12 bp, Homo sapiens
caagccacagaa

SEQ ID NO: 202249 - DNA, 22 bp, Homo sapiens
caagccagggatggggccacag

SEQ ID NO: 202250 - DNA, 23 bp, Homo sapiens
caagccagggatggggccacagc

SEQ ID NO: 202251 - DNA, 24 bp, Homo sapiens
caagccagggatggggccacagcc

SEQ ID NO: 202252 - DNA, 20 bp, Homo sapiens
caagccagggttccagacag

SEQ ID NO: 202253 - DNA, 15 bp, Homo sapiens
caagccatcttcccg

SEQ ID NO: 202254 - DNA, 23 bp, Homo sapiens
caagccatcttcccgcctcagcc

SEQ ID NO: 202255 - DNA, 20 bp, Homo sapiens
caagccattttttgaggaga

SEQ ID NO: 202256 - DNA, 21 bp, Homo sapiens
caagccattttttgaggagag

SEQ ID NO: 202257 - DNA, 17 bp, Homo sapiens
caagccccagggcctgg

SEQ ID NO: 202258 - DNA, 18 bp, Homo sapiens
caagccccagggcctggg

SEQ ID NO: 202259 - DNA, 14 bp, Homo sapiens
caagcccctcagcc

SEQ ID NO: 202260 - DNA, 16 bp, Homo sapiens
caagcccctcagccct

SEQ ID NO: 202261 - DNA, 21 bp, Homo sapiens
caagcccgacttgctgttttg

SEQ ID NO: 202262 - DNA, 14 bp, Homo sapiens
caagccctgcaaat

SEQ ID NO: 202263 - DNA, 19 bp, Homo sapiens
caagcccttccctctgttg

SEQ ID NO: 202264 - DNA, 14 bp, Homo sapiens
caagccggtgccca

SEQ ID NO: 202265 - DNA, 15 bp, Homo sapiens
caagccggtgcccac

SEQ ID NO: 202266 - DNA, 18 bp, Homo sapiens
caagccgtggcttcccgc

SEQ ID NO: 202267 - DNA, 16 bp, Homo sapiens
caagcctcttctgaag

SEQ ID NO: 202268 - DNA, 19 bp, Homo sapiens
caagcctgcagctttctgg

SEQ ID NO: 202269 - DNA, 19 bp, Homo sapiens
caagcctgggccactggca

SEQ ID NO: 202270 - DNA, 14 bp, Homo sapiens
caagcgagcacagt

SEQ ID NO: 202271 - DNA, 15 bp, Homo sapiens
caagcgttattttgg

SEQ ID NO: 202272 - DNA, 17 bp, Homo sapiens
caagcgttcctggcctt

SEQ ID NO: 202273 - DNA, 17 bp, Homo sapiens
caagctaataaaatatc

SEQ ID NO: 202274 - DNA, 21 bp, Homo sapiens
caagctaataaaatatcattc

SEQ ID NO: 202275 - DNA, 22 bp, Homo sapiens
caagctaataaaatatcattca

SEQ ID NO: 202276 - DNA, 18 bp, Homo sapiens
caagctcacttgctttag

SEQ ID NO: 202277 - DNA, 19 bp, Homo sapiens
cagttcaatctcccgctgc

SEQ ID NO: 202278 - DNA, 20 bp, Homo sapiens
cagttcacaaacagtaaagg

SEQ ID NO: 202279 - DNA, 15 bp, Homo sapiens
cagttcacaccctgc

SEQ ID NO: 202280 - DNA, 23 bp, Homo sapiens
cagttcacttcctagagcatctg

SEQ ID NO: 202281 - DNA, 13 bp, Homo sapiens
cagttcagcacca

SEQ ID NO: 202282 - DNA, 16 bp, Homo sapiens
cagttcagcaccaccc

SEQ ID NO: 202283 - DNA, 17 bp, Homo sapiens
cagttcaggaatttttg

SEQ ID NO: 202284 - DNA, 23 bp, Homo sapiens
cagttcagtaataaactgtgttt

SEQ ID NO: 202285 - DNA, 21 bp, Homo sapiens
cagttcatctctgctgaacat

SEQ ID NO: 202286 - DNA, 14 bp, Homo sapiens
cagttcatgttgct

SEQ ID NO: 202287 - DNA, 22 bp, Homo sapiens
cagttcatgttgctcagaagag

SEQ ID NO: 202288 - DNA, 14 bp, Homo sapiens
cagttccagctttt

SEQ ID NO: 202289 - DNA, 19 bp, Homo sapiens
cagttcccggagcacagcc

SEQ ID NO: 202290 - DNA, 21 bp, Homo sapiens
cagttcccggagcacagccct

SEQ ID NO: 202291 - DNA, 22 bp, Homo sapiens
cagttcccggagcacagccctg

SEQ ID NO: 202292 - DNA, 21 bp, Homo sapiens
cagttccctacgaggagtgtt

SEQ ID NO: 202293 - DNA, 13 bp, Homo sapiens
cagttcccttggc

SEQ ID NO: 202294 - DNA, 20 bp, Homo sapiens
cagttcccttggcctcagaa

SEQ ID NO: 202295 - DNA, 15 bp, Homo sapiens
cagttcctctttgca

SEQ ID NO: 202296 - DNA, 19 bp, Homo sapiens
cagttcctgcagcagagcc

SEQ ID NO: 202297 - DNA, 20 bp, Homo sapiens
cagttccttaggagatgtca

SEQ ID NO: 202298 - DNA, 16 bp, Homo sapiens
cagttctcactcctag

SEQ ID NO: 202299 - DNA, 23 bp, Homo sapiens
cagttctctcccttcctctctcc

SEQ ID NO: 202300 - DNA, 13 bp, Homo sapiens
cagttctctcctt

SEQ ID NO: 202301 - DNA, 14 bp, Homo sapiens
cagttctctccttc

SEQ ID NO: 202302 - DNA, 22 bp, Homo sapiens
cagttctctccttcttcccccc

SEQ ID NO: 202303 - DNA, 19 bp, Homo sapiens
cagttctgaataacttgaa

SEQ ID NO: 202304 - DNA, 12 bp, Homo sapiens
cagttctgcaaa

SEQ ID NO: 202305 - DNA, 13 bp, Homo sapiens
cagttctgcaaat

SEQ ID NO: 202306 - DNA, 18 bp, Homo sapiens
cagttctgcaaatagaaa

SEQ ID NO: 202307 - DNA, 13 bp, Homo sapiens
cagttctgcagct

SEQ ID NO: 202308 - DNA, 17 bp, Homo sapiens
cagttcttcgggaagag

SEQ ID NO: 202309 - DNA, 20 bp, Homo sapiens
cagttcttcgggaagagagg

SEQ ID NO: 202310 - DNA, 15 bp, Homo sapiens
cagttcttggacccc

SEQ ID NO: 202311 - DNA, 22 bp, Homo sapiens
cagttgaaaagaggtggattca

SEQ ID NO: 202312 - DNA, 17 bp, Homo sapiens
cagttgaacagaactgc

SEQ ID NO: 202313 - DNA, 20 bp, Homo sapiens
cagttgaatgacaacagaag

SEQ ID NO: 202314 - DNA, 21 bp, Homo sapiens
cagttgaatgacaacagaagc

SEQ ID NO: 202315 - DNA, 15 bp, Homo sapiens
cagttgactggcttt

SEQ ID NO: 202316 - DNA, 19 bp, Homo sapiens
cagttgactggctttcctc

SEQ ID NO: 202317 - DNA, 11 bp, Homo sapiens
cagttgattaa

SEQ ID NO: 202318 - DNA, 22 bp, Homo sapiens
cagttgattagcagttgaggcc

SEQ ID NO: 202319 - DNA, 22 bp, Homo sapiens
cagttgcgcgttctgaaatatt

SEQ ID NO: 202320 - DNA, 14 bp, Homo sapiens
cagttggacagtaa

SEQ ID NO: 202321 - DNA, 19 bp, Homo sapiens
cagttggactctcagggat

SEQ ID NO: 202322 - DNA, 22 bp, Homo sapiens
cagttggactgtggcctcagga

SEQ ID NO: 202323 - DNA, 18 bp, Homo sapiens
cagttggagaaaatgaag

SEQ ID NO: 202324 - DNA, 17 bp, Homo sapiens
cagttggccagagagcc

SEQ ID NO: 202325 - DNA, 14 bp, Homo sapiens
cagttgggagcact

SEQ ID NO: 202326 - DNA, 23 bp, Homo sapiens
cagttgggagtacatatggtaga

SEQ ID NO: 202327 - DNA, 14 bp, Homo sapiens
cagttggtgatttt

SEQ ID NO: 202328 - DNA, 19 bp, Homo sapiens
cataggctcactctttccc

SEQ ID NO: 202329 - DNA, 21 bp, Homo sapiens
catagtgaattttaaaatgta

SEQ ID NO: 202330 - DNA, 14 bp, Homo sapiens
catagtgccttttt

SEQ ID NO: 202331 - DNA, 15 bp, Homo sapiens
catagtgctgggatt

SEQ ID NO: 202332 - DNA, 22 bp, Homo sapiens
catagtgtctgctgctgcctcc

SEQ ID NO: 202333 - DNA, 13 bp, Homo sapiens
catagttctgtta

SEQ ID NO: 202334 - DNA, 18 bp, Homo sapiens
catagttctgttaaatat

SEQ ID NO: 202335 - DNA, 20 bp, Homo sapiens
catagtttacaatattatgt

SEQ ID NO: 202336 - DNA, 14 bp, Homo sapiens
catagtttctgtaa

SEQ ID NO: 202337 - DNA, 14 bp, Homo sapiens
catagttttaaact

SEQ ID NO: 202338 - DNA, 19 bp, Homo sapiens
catagttttaaactcattt

SEQ ID NO: 202339 - DNA, 14 bp, Homo sapiens
catataaattaata

SEQ ID NO: 202340 - DNA, 20 bp, Homo sapiens
catataaattaatacataag

SEQ ID NO: 202341 - DNA, 22 bp, Homo sapiens
catataaattaatacataagtt

SEQ ID NO: 202342 - DNA, 14 bp, Homo sapiens
catataaattcccc

SEQ ID NO: 202343 - DNA, 14 bp, Homo sapiens
catataatatatgt

SEQ ID NO: 202344 - DNA, 17 bp, Homo sapiens
catataatatatgtttt

SEQ ID NO: 202345 - DNA, 20 bp, Homo sapiens
catataatatatgttttaaa

SEQ ID NO: 202346 - DNA, 13 bp, Homo sapiens
catatacacaaag

SEQ ID NO: 202347 - DNA, 20 bp, Homo sapiens
catatagccctttccccact

SEQ ID NO: 202348 - DNA, 17 bp, Homo sapiens
catatataaaacaaaac

SEQ ID NO: 202349 - DNA, 14 bp, Homo sapiens
catatataaattat

SEQ ID NO: 202350 - DNA, 23 bp, Homo sapiens
catatatgagggagtatgacgtt

SEQ ID NO: 202351 - DNA, 21 bp, Homo sapiens
catatattgttatttttgtct

SEQ ID NO: 202352 - DNA, 16 bp, Homo sapiens
catatattttttacaa

SEQ ID NO: 202353 - DNA, 14 bp, Homo sapiens
catatcaacttaat

SEQ ID NO: 202354 - DNA, 18 bp, Homo sapiens
catatcaagtcccgaggc

SEQ ID NO: 202355 - DNA, 17 bp, Homo sapiens
catatcagctctctgca

SEQ ID NO: 202356 - DNA, 20 bp, Homo sapiens
catatctagatttctagaaa

SEQ ID NO: 202357 - DNA, 18 bp, Homo sapiens
catatctgtttaggagtg

SEQ ID NO: 202358 - DNA, 21 bp, Homo sapiens
catatgacaatttcaaaatgc

SEQ ID NO: 202359 - DNA, 22 bp, Homo sapiens
catatgacaatttcaaaatgca

SEQ ID NO: 202360 - DNA, 20 bp, Homo sapiens
catatgactcacatgatgca

SEQ ID NO: 202361 - DNA, 21 bp, Homo sapiens
catatgattgaaaagaagaaa

SEQ ID NO: 202362 - DNA, 21 bp, Homo sapiens
catatgcctgaccccttgctc

SEQ ID NO: 202363 - DNA, 15 bp, Homo sapiens
catatggaggcctga

SEQ ID NO: 202364 - DNA, 23 bp, Homo sapiens
catatggtagacaatttgcctta

SEQ ID NO: 202365 - DNA, 19 bp, Homo sapiens
catatgtacataaattgca

SEQ ID NO: 202366 - DNA, 15 bp, Homo sapiens
catatgtaccatgta

SEQ ID NO: 202367 - DNA, 21 bp, Homo sapiens
catatgtaccatgtacatgaa

SEQ ID NO: 202368 - DNA, 21 bp, Homo sapiens
catatgtcttactactttaaa

SEQ ID NO: 202369 - DNA, 15 bp, Homo sapiens
catatgttacactaa

SEQ ID NO: 202370 - DNA, 15 bp, Homo sapiens
catatgttgctcagt

SEQ ID NO: 202371 - DNA, 21 bp, Homo sapiens
catattactgttgcatttact

SEQ ID NO: 202372 - DNA, 23 bp, Homo sapiens
catattactgttgcatttacttt

SEQ ID NO: 202373 - DNA, 20 bp, Homo sapiens
catattaggaaaatatgggt

SEQ ID NO: 202374 - DNA, 14 bp, Homo sapiens
catattcaaatcag

SEQ ID NO: 202375 - DNA, 14 bp, Homo sapiens
catattccagcagt

SEQ ID NO: 202376 - DNA, 17 bp, Homo sapiens
catattcctgcagcctg

SEQ ID NO: 202377 - DNA, 12 bp, Homo sapiens
catattcctgcc

SEQ ID NO: 202378 - DNA, 20 bp, Homo sapiens
catattctattgtattattt

SEQ ID NO: 202379 - DNA, 12 bp, Homo sapiens
catattcttgct

SEQ ID NO: 202380 - DNA, 21 bp, Homo sapiens
catattcttgctttcacaaat

SEQ ID NO: 202381 - DNA, 21 bp, Homo sapiens
catattgagatcagcattcaa

SEQ ID NO: 202382 - DNA, 22 bp, Homo sapiens
catattgagatcagcattcaaa

SEQ ID NO: 202383 - DNA, 16 bp, Homo sapiens
catattgatgaaaaga

SEQ ID NO: 202384 - DNA, 16 bp, Homo sapiens
catattggtattcact

SEQ ID NO: 202385 - DNA, 15 bp, Homo sapiens
catattgtgatttta

SEQ ID NO: 202386 - DNA, 13 bp, Homo sapiens
catattgtgccaa

SEQ ID NO: 202387 - DNA, 20 bp, Homo sapiens
catattgtgccaatatgtat

SEQ ID NO: 202388 - DNA, 22 bp, Homo sapiens
catattgtgccaatatgtattg

SEQ ID NO: 202389 - DNA, 15 bp, Homo sapiens
catattgtttgatct

SEQ ID NO: 202390 - DNA, 22 bp, Homo sapiens
catattgttttaaaataagaat

SEQ ID NO: 202391 - DNA, 17 bp, Homo sapiens
catatttacttcttata

SEQ ID NO: 202392 - DNA, 13 bp, Homo sapiens
catattttgtata

SEQ ID NO: 202393 - DNA, 13 bp, Homo sapiens
catcaaacatgaa

SEQ ID NO: 202394 - DNA, 16 bp, Homo sapiens
catcaaataaaccttg

SEQ ID NO: 202395 - DNA, 21 bp, Homo sapiens
catcaaataaatttctgggat

SEQ ID NO: 202396 - DNA, 16 bp, Homo sapiens
catcaaataatacatc

SEQ ID NO: 202397 - DNA, 21 bp, Homo sapiens
catcaacaaaagggagaacat

SEQ ID NO: 202398 - DNA, 14 bp, Homo sapiens
catcaacatcttgg

SEQ ID NO: 202399 - DNA, 15 bp, Homo sapiens
catcaaccaggaaga

SEQ ID NO: 202400 - DNA, 16 bp, Homo sapiens
catcaagatacacttg

SEQ ID NO: 202401 - DNA, 23 bp, Homo sapiens
catcaataaaggggaattgtgtt

SEQ ID NO: 202402 - DNA, 19 bp, Homo sapiens
catcaataaatactttaac

SEQ ID NO: 202403 - DNA, 14 bp, Homo sapiens
catcaatgttcatt

SEQ ID NO: 202404 - DNA, 18 bp, Homo sapiens
catcaatgttcattgtaa

SEQ ID NO: 202405 - DNA, 16 bp, Homo sapiens
catcaattctctatca

SEQ ID NO: 202406 - DNA, 20 bp, Homo sapiens
catcaattttaacatttgat

SEQ ID NO: 202407 - DNA, 12 bp, Homo sapiens
catcacagccag

SEQ ID NO: 202408 - DNA, 14 bp, Homo sapiens
catcacagccagcc

SEQ ID NO: 202409 - DNA, 19 bp, Homo sapiens
catcacagccagcccagct

SEQ ID NO: 202410 - DNA, 15 bp, Homo sapiens
catcacagcttgttt

SEQ ID NO: 202411 - DNA, 12 bp, Homo sapiens
catcaccccttc

SEQ ID NO: 202412 - DNA, 21 bp, Homo sapiens
catcacctttttgacttttcc

SEQ ID NO: 202413 - DNA, 16 bp, Homo sapiens
catcactatccatgca

SEQ ID NO: 202414 - DNA, 13 bp, Homo sapiens
ctgggaagctgga

SEQ ID NO: 202415 - DNA, 15 bp, Homo sapiens
ctgggaagctggagt

SEQ ID NO: 202416 - DNA, 19 bp, Homo sapiens
ctgggaagctggagtgctg

SEQ ID NO: 202417 - DNA, 19 bp, Homo sapiens
ctgggaagctgtactcaga

SEQ ID NO: 202418 - DNA, 23 bp, Homo sapiens
ctgggaagctgtactcagagcag

SEQ ID NO: 202419 - DNA, 19 bp, Homo sapiens
ctgggaagcttgagcctcc

SEQ ID NO: 202420 - DNA, 21 bp, Homo sapiens
ctgggaaggagggagctgctc

SEQ ID NO: 202421 - DNA, 22 bp, Homo sapiens
ctgggaaggagggagctgctca

SEQ ID NO: 202422 - DNA, 14 bp, Homo sapiens
ctgggaaggctaag

SEQ ID NO: 202423 - DNA, 19 bp, Homo sapiens
ctgggaaggctactcacct

SEQ ID NO: 202424 - DNA, 14 bp, Homo sapiens
ctgggaagggagag

SEQ ID NO: 202425 - DNA, 15 bp, Homo sapiens
ctgggaagggagagt

SEQ ID NO: 202426 - DNA, 23 bp, Homo sapiens
ctgggaatgtattattctgcagc

SEQ ID NO: 202427 - DNA, 20 bp, Homo sapiens
ctgggacacaaccactaatt

SEQ ID NO: 202428 - DNA, 19 bp, Homo sapiens
ctgggacccagctactctg

SEQ ID NO: 202429 - DNA, 12 bp, Homo sapiens
ctgggacccctc

SEQ ID NO: 202430 - DNA, 14 bp, Homo sapiens
ctgggacctcctta

SEQ ID NO: 202431 - DNA, 18 bp, Homo sapiens
ctgggactacaggtgccc

SEQ ID NO: 202432 - DNA, 16 bp, Homo sapiens
ctgggactctcctcct

SEQ ID NO: 202433 - DNA, 18 bp, Homo sapiens
ctgggactctcctcctcc

SEQ ID NO: 202434 - DNA, 14 bp, Homo sapiens
ctgggactgagcca

SEQ ID NO: 202435 - DNA, 16 bp, Homo sapiens
ctgggactgagccagt

SEQ ID NO: 202436 - DNA, 20 bp, Homo sapiens
ctgggactgagccagtccca

SEQ ID NO: 202437 - DNA, 20 bp, Homo sapiens
ctgggacttccttgctctcc

SEQ ID NO: 202438 - DNA, 17 bp, Homo sapiens
ctgggagaaaagccaga

SEQ ID NO: 202439 - DNA, 19 bp, Homo sapiens
ctgggagaaaagccagatg

SEQ ID NO: 202440 - DNA, 20 bp, Homo sapiens
ctgggagagccaaggcctat

SEQ ID NO: 202441 - DNA, 23 bp, Homo sapiens
ctgggagaggcagagtgccccac

SEQ ID NO: 202442 - DNA, 14 bp, Homo sapiens
ctgggagagtgagg

SEQ ID NO: 202443 - DNA, 15 bp, Homo sapiens
ctgggagatgctggg

SEQ ID NO: 202444 - DNA, 21 bp, Homo sapiens
ctgggagatgctgggaccctc

SEQ ID NO: 202445 - DNA, 20 bp, Homo sapiens
ctgggagccacttctcccca

SEQ ID NO: 202446 - DNA, 19 bp, Homo sapiens
ctgggagccgggccgcaga

SEQ ID NO: 202447 - DNA, 20 bp, Homo sapiens
ctgggagcctcgcccctcca

SEQ ID NO: 202448 - DNA, 13 bp, Homo sapiens
ctgggagctctgc

SEQ ID NO: 202449 - DNA, 13 bp, Homo sapiens
ctgggaggcaggt

SEQ ID NO: 202450 - DNA, 23 bp, Homo sapiens
ctgggagggatagaggggggctg

SEQ ID NO: 202451 - DNA, 16 bp, Homo sapiens
ctgggagggggccctt

SEQ ID NO: 202452 - DNA, 18 bp, Homo sapiens
ctgggagggggcccttcc

SEQ ID NO: 202453 - DNA, 13 bp, Homo sapiens
ctgggagggggct

SEQ ID NO: 202454 - DNA, 18 bp, Homo sapiens
ctgggaggtattggaggg

SEQ ID NO: 202455 - DNA, 13 bp, Homo sapiens
ctgggagtcagag

SEQ ID NO: 202456 - DNA, 13 bp, Homo sapiens
ctgggagtgggag

SEQ ID NO: 202457 - DNA, 19 bp, Homo sapiens
ctgggagtgggtggaggca

SEQ ID NO: 202458 - DNA, 15 bp, Homo sapiens
ctgggatagaggggt

SEQ ID NO: 202459 - DNA, 21 bp, Homo sapiens
ctgggatatatggaggattct

SEQ ID NO: 202460 - DNA, 15 bp, Homo sapiens
ctgggatgtagagag

SEQ ID NO: 202461 - DNA, 21 bp, Homo sapiens
ctgggattacaggcgtgagcc

SEQ ID NO: 202462 - DNA, 18 bp, Homo sapiens
ctgggattctactttaag

SEQ ID NO: 202463 - DNA, 20 bp, Homo sapiens
ctgggatttcttcgctgctc

SEQ ID NO: 202464 - DNA, 21 bp, Homo sapiens
ctgggatttcttcgctgctct

SEQ ID NO: 202465 - DNA, 23 bp, Homo sapiens
ctgggatttcttcgctgctctag

SEQ ID NO: 202466 - DNA, 21 bp, Homo sapiens
ctgggcaaagccacaaggctg

SEQ ID NO: 202467 - DNA, 23 bp, Homo sapiens
ctgggcaaagccacaaggctggc

SEQ ID NO: 202468 - DNA, 16 bp, Homo sapiens
ctgggcaacagagcaa

SEQ ID NO: 202469 - DNA, 16 bp, Homo sapiens
ctgggcaaggtgaggg

SEQ ID NO: 202470 - DNA, 16 bp, Homo sapiens
ctgggcaccctcccac

SEQ ID NO: 202471 - DNA, 21 bp, Homo sapiens
ctgggcaccctcccacccggc

SEQ ID NO: 202472 - DNA, 15 bp, Homo sapiens
ctgggcactcctccc

SEQ ID NO: 202473 - DNA, 12 bp, Homo sapiens
ctgggcactttt

SEQ ID NO: 202474 - DNA, 15 bp, Homo sapiens
ctgggcagagcctgt

SEQ ID NO: 202475 - DNA, 16 bp, Homo sapiens
atctatttgagattga

SEQ ID NO: 202476 - DNA, 12 bp, Homo sapiens
atctatttgtat

SEQ ID NO: 202477 - DNA, 14 bp, Homo sapiens
atctattttctcag

SEQ ID NO: 202478 - DNA, 16 bp, Homo sapiens
atctcacaggagttgg

SEQ ID NO: 202479 - DNA, 13 bp, Homo sapiens
atctcaccccatc

SEQ ID NO: 202480 - DNA, 22 bp, Homo sapiens
atctcaccccatcccacaccct

SEQ ID NO: 202481 - DNA, 18 bp, Homo sapiens
atctcacttaatacagat

SEQ ID NO: 202482 - DNA, 20 bp, Homo sapiens
atctcactttaataataaaa

SEQ ID NO: 202483 - DNA, 18 bp, Homo sapiens
atctcagcctcctgagcc

SEQ ID NO: 202484 - DNA, 11 bp, Homo sapiens
atctcagctca

SEQ ID NO: 202485 - DNA, 15 bp, Homo sapiens
atctcaggccacctg

SEQ ID NO: 202486 - DNA, 20 bp, Homo sapiens
atctcaggccacctgccccc

SEQ ID NO: 202487 - DNA, 17 bp, Homo sapiens
atctcataggttgccaa

SEQ ID NO: 202488 - DNA, 23 bp, Homo sapiens
atctcataggttgccaataatac

SEQ ID NO: 202489 - DNA, 15 bp, Homo sapiens
atctccactccagat

SEQ ID NO: 202490 - DNA, 12 bp, Homo sapiens
atctccaggccc

SEQ ID NO: 202491 - DNA, 15 bp, Homo sapiens
atctccaggcccagc

SEQ ID NO: 202492 - DNA, 14 bp, Homo sapiens
atctccagggagca

SEQ ID NO: 202493 - DNA, 22 bp, Homo sapiens
atctccagggagcaagacagag

SEQ ID NO: 202494 - DNA, 23 bp, Homo sapiens
atctccagggagcaagacagaga

SEQ ID NO: 202495 - DNA, 15 bp, Homo sapiens
atctccagtattctt

SEQ ID NO: 202496 - DNA, 19 bp, Homo sapiens
atctccatcatatgcctga

SEQ ID NO: 202497 - DNA, 14 bp, Homo sapiens
atctccccactcta

SEQ ID NO: 202498 - DNA, 12 bp, Homo sapiens
atctccccaggc

SEQ ID NO: 202499 - DNA, 13 bp, Homo sapiens
atctccccaggcc

SEQ ID NO: 202500 - DNA, 19 bp, Homo sapiens
atctccccaggcctccagc

SEQ ID NO: 202501 - DNA, 13 bp, Homo sapiens
atctcccctcctc

SEQ ID NO: 202502 - DNA, 16 bp, Homo sapiens
atctcccctcctcaca

SEQ ID NO: 202503 - DNA, 23 bp, Homo sapiens
atctccccttgcactaaagtatg

SEQ ID NO: 202504 - DNA, 22 bp, Homo sapiens
atctccctcgaacccacactgc

SEQ ID NO: 202505 - DNA, 18 bp, Homo sapiens
atctcccttccacctcac

SEQ ID NO: 202506 - DNA, 20 bp, Homo sapiens
atctcctatcttttatttca

SEQ ID NO: 202507 - DNA, 20 bp, Homo sapiens
atctcctatttttcagaatg

SEQ ID NO: 202508 - DNA, 18 bp, Homo sapiens
atctcctcaccccagtgc

SEQ ID NO: 202509 - DNA, 22 bp, Homo sapiens
atctcctcccatggccttccct

SEQ ID NO: 202510 - DNA, 13 bp, Homo sapiens
atctcctctcccc

SEQ ID NO: 202511 - DNA, 11 bp, Homo sapiens
atctcctgctc

SEQ ID NO: 202512 - DNA, 13 bp, Homo sapiens
atctcctgtaatt

SEQ ID NO: 202513 - DNA, 20 bp, Homo sapiens
atctcctgtaattttgtagt

SEQ ID NO: 202514 - DNA, 13 bp, Homo sapiens
atctccttccccc

SEQ ID NO: 202515 - DNA, 14 bp, Homo sapiens
atctccttccccca

SEQ ID NO: 202516 - DNA, 17 bp, Homo sapiens
atctccttcccccagcc

SEQ ID NO: 202517 - DNA, 18 bp, Homo sapiens
atctccttcccccagccc

SEQ ID NO: 202518 - DNA, 19 bp, Homo sapiens
atctccttcccccagccca

SEQ ID NO: 202519 - DNA, 20 bp, Homo sapiens
atctccttcccccagcccaa

SEQ ID NO: 202520 - DNA, 22 bp, Homo sapiens
atctccttcccccagcccaata

SEQ ID NO: 202521 - DNA, 19 bp, Homo sapiens
atctccttgattacataat

SEQ ID NO: 202522 - DNA, 13 bp, Homo sapiens
atctcgctagcca

SEQ ID NO: 202523 - DNA, 19 bp, Homo sapiens
atctcggctcactgcaacc

SEQ ID NO: 202524 - DNA, 15 bp, Homo sapiens
atctctaaaattcta

SEQ ID NO: 202525 - DNA, 16 bp, Homo sapiens
atctctaaaattctag

SEQ ID NO: 202526 - DNA, 17 bp, Homo sapiens
atctctaaaattctagt

SEQ ID NO: 202527 - DNA, 18 bp, Homo sapiens
atctctaaaattctagtc

SEQ ID NO: 202528 - DNA, 21 bp, Homo sapiens
atctctactaccacaaggaaa

SEQ ID NO: 202529 - DNA, 15 bp, Homo sapiens
atctctcaaaatgtg

SEQ ID NO: 202530 - DNA, 18 bp, Homo sapiens
agacaccctaatgtggca

SEQ ID NO: 202531 - DNA, 14 bp, Homo sapiens
agacacctcagagc

SEQ ID NO: 202532 - DNA, 14 bp, Homo sapiens
agacactagtagag

SEQ ID NO: 202533 - DNA, 14 bp, Homo sapiens
agacactgaaggca

SEQ ID NO: 202534 - DNA, 17 bp, Homo sapiens
agacactgaaggcaaat

SEQ ID NO: 202535 - DNA, 13 bp, Homo sapiens
agacactgtcaag

SEQ ID NO: 202536 - DNA, 16 bp, Homo sapiens
agacacttcaatggga

SEQ ID NO: 202537 - DNA, 15 bp, Homo sapiens
agacacttgccttct

SEQ ID NO: 202538 - DNA, 15 bp, Homo sapiens
agacactttggaagt

SEQ ID NO: 202539 - DNA, 15 bp, Homo sapiens
agacagaagcaggct

SEQ ID NO: 202540 - DNA, 12 bp, Homo sapiens
agacagaaggca

SEQ ID NO: 202541 - DNA, 14 bp, Homo sapiens
agacagacacacac

SEQ ID NO: 202542 - DNA, 16 bp, Homo sapiens
agacagacacacacac

SEQ ID NO: 202543 - DNA, 24 bp, Homo sapiens
agacagacggacgggacagcggcc

SEQ ID NO: 202544 - DNA, 18 bp, Homo sapiens
agacagagacgcaggaat

SEQ ID NO: 202545 - DNA, 23 bp, Homo sapiens
agacagagtctcgctctgtcgcc

SEQ ID NO: 202546 - DNA, 16 bp, Homo sapiens
agacagatgccccaga

SEQ ID NO: 202547 - DNA, 12 bp, Homo sapiens
agacagcaagtt

SEQ ID NO: 202548 - DNA, 23 bp, Homo sapiens
agacagcctaatgaaggccatca

SEQ ID NO: 202549 - DNA, 21 bp, Homo sapiens
agacaggaagaccaaggcctc

SEQ ID NO: 202550 - DNA, 19 bp, Homo sapiens
agacaggcagggagggctt

SEQ ID NO: 202551 - DNA, 12 bp, Homo sapiens
agacaggccctc

SEQ ID NO: 202552 - DNA, 15 bp, Homo sapiens
agacaggctcttagc

SEQ ID NO: 202553 - DNA, 15 bp, Homo sapiens
agacagggtcctgct

SEQ ID NO: 202554 - DNA, 17 bp, Homo sapiens
agacagggtcctgctat

SEQ ID NO: 202555 - DNA, 13 bp, Homo sapiens
agacagggtgggg

SEQ ID NO: 202556 - DNA, 19 bp, Homo sapiens
agacagggtggggcttaga

SEQ ID NO: 202557 - DNA, 15 bp, Homo sapiens
agacagtattgccac

SEQ ID NO: 202558 - DNA, 18 bp, Homo sapiens
agacagtattgccacctc

SEQ ID NO: 202559 - DNA, 21 bp, Homo sapiens
agacagtgatctccatatgtt

SEQ ID NO: 202560 - DNA, 18 bp, Homo sapiens
agacagtggatcatgaaa

SEQ ID NO: 202561 - DNA, 21 bp, Homo sapiens
agacagtggcagcaaaggaag

SEQ ID NO: 202562 - DNA, 12 bp, Homo sapiens
agacagtggggg

SEQ ID NO: 202563 - DNA, 20 bp, Homo sapiens
agacagttgggtgagaacaa

SEQ ID NO: 202564 - DNA, 13 bp, Homo sapiens
agacataatgcac

SEQ ID NO: 202565 - DNA, 14 bp, Homo sapiens
agacataatgcact

SEQ ID NO: 202566 - DNA, 22 bp, Homo sapiens
agacatccatgtttgtaaaact

SEQ ID NO: 202567 - DNA, 18 bp, Homo sapiens
agacatggagactcctgc

SEQ ID NO: 202568 - DNA, 18 bp, Homo sapiens
agacatgggcctcccact

SEQ ID NO: 202569 - DNA, 14 bp, Homo sapiens
agacattaaataat

SEQ ID NO: 202570 - DNA, 15 bp, Homo sapiens
agacattatcttttg

SEQ ID NO: 202571 - DNA, 19 bp, Homo sapiens
agacattcaccaacaacag

SEQ ID NO: 202572 - DNA, 17 bp, Homo sapiens
agacattccaaaacgaa

SEQ ID NO: 202573 - DNA, 16 bp, Homo sapiens
agacattgtcaataaa

SEQ ID NO: 202574 - DNA, 14 bp, Homo sapiens
agacatttacatgt

SEQ ID NO: 202575 - DNA, 21 bp, Homo sapiens
agaccaaattttgaggtcttt

SEQ ID NO: 202576 - DNA, 15 bp, Homo sapiens
agaccaagccggtgc

SEQ ID NO: 202577 - DNA, 16 bp, Homo sapiens
agaccaagtcctggct

SEQ ID NO: 202578 - DNA, 15 bp, Homo sapiens
agaccaatgtgaaga

SEQ ID NO: 202579 - DNA, 22 bp, Homo sapiens
agaccacaaggctgaaaagtgc

SEQ ID NO: 202580 - DNA, 21 bp, Homo sapiens
agaccaccagccgccccagcc

SEQ ID NO: 202581 - DNA, 17 bp, Homo sapiens
agaccacctctcaatat

SEQ ID NO: 202582 - DNA, 21 bp, Homo sapiens
agaccagaagtgaatgggaaa

SEQ ID NO: 202583 - DNA, 12 bp, Homo sapiens
agaccagagctc

SEQ ID NO: 202584 - DNA, 14 bp, Homo sapiens
agaccagagctctg

SEQ ID NO: 202585 - DNA, 16 bp, Homo sapiens
agaccagagctctgga

SEQ ID NO: 202586 - DNA, 18 bp, Homo sapiens
agaccagagctctggagc

SEQ ID NO: 202587 - DNA, 14 bp, Homo sapiens
agaccagcctttct

SEQ ID NO: 202588 - DNA, 22 bp, Homo sapiens
agaccaggactctgccttccag

SEQ ID NO: 202589 - DNA, 23 bp, Homo sapiens
agaccaggactctgccttccagg

SEQ ID NO: 202590 - DNA, 13 bp, Homo sapiens
agaccaggcttcc

SEQ ID NO: 202591 - DNA, 17 bp, Homo sapiens
agaccagtactgggaag

SEQ ID NO: 202592 - DNA, 22 bp, Homo sapiens
agaccagtcacagccatttcaa

SEQ ID NO: 202593 - DNA, 13 bp, Homo sapiens
agaccatcctggc

SEQ ID NO: 202594 - DNA, 15 bp, Homo sapiens
agaccatcctggccc

SEQ ID NO: 202595 - DNA, 12 bp, Homo sapiens
agaccatctcct

SEQ ID NO: 202596 - DNA, 14 bp, Homo sapiens
agacccaataaaga

SEQ ID NO: 202597 - DNA, 15 bp, Homo sapiens
agacccaataaagaa

SEQ ID NO: 202598 - DNA, 16 bp, Homo sapiens
agacccaataaagaat

SEQ ID NO: 202599 - DNA, 12 bp, Homo sapiens
agaccccaccca

SEQ ID NO: 202600 - DNA, 15 bp, Homo sapiens
agaccccacccaagc

SEQ ID NO: 202601 - DNA, 23 bp, Homo sapiens
agaccccacccaagcttggcagc

SEQ ID NO: 202602 - DNA, 19 bp, Homo sapiens
agaccccatccagccaggg

SEQ ID NO: 202603 - DNA, 12 bp, Homo sapiens
agacccccaccc

SEQ ID NO: 202604 - DNA, 17 bp, Homo sapiens
agaccctcgcaaaatga

SEQ ID NO: 202605 - DNA, 12 bp, Homo sapiens
agaccctcttct

SEQ ID NO: 202606 - DNA, 15 bp, Homo sapiens
atctgctgagctctg

SEQ ID NO: 202607 - DNA, 18 bp, Homo sapiens
atctgctgagctctgacc

SEQ ID NO: 202608 - DNA, 13 bp, Homo sapiens
atctgctgcatag

SEQ ID NO: 202609 - DNA, 15 bp, Homo sapiens
atctgctgcctctga

SEQ ID NO: 202610 - DNA, 21 bp, Homo sapiens
atctgctgcctctgaaaatat

SEQ ID NO: 202611 - DNA, 20 bp, Homo sapiens
atctgctgttgccatagccc

SEQ ID NO: 202612 - DNA, 22 bp, Homo sapiens
atctggagtctgaaggagagga

SEQ ID NO: 202613 - DNA, 23 bp, Homo sapiens
atctggagtctgaaggagaggag

SEQ ID NO: 202614 - DNA, 20 bp, Homo sapiens
atctggcattctacacctgg

SEQ ID NO: 202615 - DNA, 21 bp, Homo sapiens
atctggcattctacacctgga

SEQ ID NO: 202616 - DNA, 15 bp, Homo sapiens
atctggcctggcctg

SEQ ID NO: 202617 - DNA, 16 bp, Homo sapiens
atctggcctggcctgg

SEQ ID NO: 202618 - DNA, 17 bp, Homo sapiens
atctggcctggcctggc

SEQ ID NO: 202619 - DNA, 18 bp, Homo sapiens
atctggcctggcctggcc

SEQ ID NO: 202620 - DNA, 15 bp, Homo sapiens
atctggctaaggcat

SEQ ID NO: 202621 - DNA, 13 bp, Homo sapiens
atctggctcctgt

SEQ ID NO: 202622 - DNA, 17 bp, Homo sapiens
atctggctcctgtttcc

SEQ ID NO: 202623 - DNA, 18 bp, Homo sapiens
atctggctcctgtttcca

SEQ ID NO: 202624 - DNA, 16 bp, Homo sapiens
atctggcttacagggg

SEQ ID NO: 202625 - DNA, 14 bp, Homo sapiens
atctggcttctgca

SEQ ID NO: 202626 - DNA, 19 bp, Homo sapiens
atctggcttctgcattact

SEQ ID NO: 202627 - DNA, 14 bp, Homo sapiens
atctgggccagaag

SEQ ID NO: 202628 - DNA, 14 bp, Homo sapiens
atctgggcctgggc

SEQ ID NO: 202629 - DNA, 17 bp, Homo sapiens
atctggggaaggaccaa

SEQ ID NO: 202630 - DNA, 16 bp, Homo sapiens
atctggggatggagaa

SEQ ID NO: 202631 - DNA, 16 bp, Homo sapiens
atctggggctctggga

SEQ ID NO: 202632 - DNA, 13 bp, Homo sapiens
atctggtgcgtgt

SEQ ID NO: 202633 - DNA, 14 bp, Homo sapiens
atctgtaaaaaaga

SEQ ID NO: 202634 - DNA, 19 bp, Homo sapiens
atctgtaaatatcccagag

SEQ ID NO: 202635 - DNA, 17 bp, Homo sapiens
atctgtaaatttaactg

SEQ ID NO: 202636 - DNA, 23 bp, Homo sapiens
atctgtaacccttgaatttctag

SEQ ID NO: 202637 - DNA, 16 bp, Homo sapiens
atctgtaagctctttg

SEQ ID NO: 202638 - DNA, 13 bp, Homo sapiens
atctgtagaggag

SEQ ID NO: 202639 - DNA, 21 bp, Homo sapiens
atctgtagaggagcctggagt

SEQ ID NO: 202640 - DNA, 18 bp, Homo sapiens
atctgtagggctggacct

SEQ ID NO: 202641 - DNA, 20 bp, Homo sapiens
atctgtatatgttgtaataa

SEQ ID NO: 202642 - DNA, 13 bp, Homo sapiens
atctgtatgcctc

SEQ ID NO: 202643 - DNA, 15 bp, Homo sapiens
atctgtcagcttccc

SEQ ID NO: 202644 - DNA, 22 bp, Homo sapiens
atctgtcagcttcccaacaata

SEQ ID NO: 202645 - DNA, 20 bp, Homo sapiens
atctgtctcccagttatgaa

SEQ ID NO: 202646 - DNA, 15 bp, Homo sapiens
atctgtctgagccct

SEQ ID NO: 202647 - DNA, 13 bp, Homo sapiens
atctgtctgattc

SEQ ID NO: 202648 - DNA, 13 bp, Homo sapiens
atctgtctttatg

SEQ ID NO: 202649 - DNA, 19 bp, Homo sapiens
atctgtctttatgatttca

SEQ ID NO: 202650 - DNA, 19 bp, Homo sapiens
atctgtgaatcctttgtac

SEQ ID NO: 202651 - DNA, 13 bp, Homo sapiens
atctgtgaattaa

SEQ ID NO: 202652 - DNA, 17 bp, Homo sapiens
atctgtgaattcagatt

SEQ ID NO: 202653 - DNA, 13 bp, Homo sapiens
atctgtgagttct

SEQ ID NO: 202654 - DNA, 12 bp, Homo sapiens
atctgtgatgat

SEQ ID NO: 202655 - DNA, 17 bp, Homo sapiens
atctgtgcccagagatg

SEQ ID NO: 202656 - DNA, 23 bp, Homo sapiens
atctgtgccccatgcctgtccag

SEQ ID NO: 202657 - DNA, 18 bp, Homo sapiens
atctgtgcgtgaaacaca

SEQ ID NO: 202658 - DNA, 16 bp, Homo sapiens
atctgtggagaatgta

SEQ ID NO: 202659 - DNA, 18 bp, Homo sapiens
atctgttaaccaaataaa

SEQ ID NO: 202660 - DNA, 18 bp, Homo sapiens
atctgttacggttaatga

SEQ ID NO: 202661 - DNA, 15 bp, Homo sapiens
atcttaaaagtgtaa

SEQ ID NO: 202662 - DNA, 18 bp, Homo sapiens
atcttaaagaaacagctt

SEQ ID NO: 202663 - DNA, 15 bp, Homo sapiens
atcttaaatttctaa

SEQ ID NO: 202664 - DNA, 12 bp, Homo sapiens
atcttaatcttt

SEQ ID NO: 202665 - DNA, 14 bp, Homo sapiens
atcttaatctttat

SEQ ID NO: 202666 - DNA, 13 bp, Homo sapiens
atcttacatctgc

SEQ ID NO: 202667 - DNA, 14 bp, Homo sapiens
atcttaccagatgc

SEQ ID NO: 202668 - DNA, 16 bp, Homo sapiens
atcttaccagatgcta

SEQ ID NO: 202669 - DNA, 18 bp, Homo sapiens
atcttacctgtaaagtct

SEQ ID NO: 202670 - DNA, 22 bp, Homo sapiens
agactcctttcctgcatctttc

SEQ ID NO: 202671 - DNA, 19 bp, Homo sapiens
agactcgagagggctgagc

SEQ ID NO: 202672 - DNA, 20 bp, Homo sapiens
agactcgagagggctgagcc

SEQ ID NO: 202673 - DNA, 21 bp, Homo sapiens
agactctaggacataaattag

SEQ ID NO: 202674 - DNA, 17 bp, Homo sapiens
agactctctcctctctc

SEQ ID NO: 202675 - DNA, 20 bp, Homo sapiens
agactctgtgagattctaaa

SEQ ID NO: 202676 - DNA, 12 bp, Homo sapiens
agactgaattta

SEQ ID NO: 202677 - DNA, 23 bp, Homo sapiens
agactgaccttgatgtcttgaga

SEQ ID NO: 202678 - DNA, 21 bp, Homo sapiens
agactgataacttggggaggc

SEQ ID NO: 202679 - DNA, 13 bp, Homo sapiens
agactgcagagga

SEQ ID NO: 202680 - DNA, 14 bp, Homo sapiens
agactgcagaggag

SEQ ID NO: 202681 - DNA, 23 bp, Homo sapiens
agactgcatcccgtacctcttcc

SEQ ID NO: 202682 - DNA, 13 bp, Homo sapiens
agactgcccaccc

SEQ ID NO: 202683 - DNA, 14 bp, Homo sapiens
agactgcccaccct

SEQ ID NO: 202684 - DNA, 18 bp, Homo sapiens
agactgcccaccctgggc

SEQ ID NO: 202685 - DNA, 22 bp, Homo sapiens
agactgcccaccctgggcctcc

SEQ ID NO: 202686 - DNA, 13 bp, Homo sapiens
agactgcctccct

SEQ ID NO: 202687 - DNA, 14 bp, Homo sapiens
agactgcctccctc

SEQ ID NO: 202688 - DNA, 16 bp, Homo sapiens
agactggaaaatagtc

SEQ ID NO: 202689 - DNA, 23 bp, Homo sapiens
agactggaggggacgctggtaga

SEQ ID NO: 202690 - DNA, 16 bp, Homo sapiens
agactggagtgaggct

SEQ ID NO: 202691 - DNA, 15 bp, Homo sapiens
agactggatactgcc

SEQ ID NO: 202692 - DNA, 16 bp, Homo sapiens
agactggcagccaggg

SEQ ID NO: 202693 - DNA, 17 bp, Homo sapiens
agactggcagccaggga

SEQ ID NO: 202694 - DNA, 17 bp, Homo sapiens
agactggctgcacagcc

SEQ ID NO: 202695 - DNA, 18 bp, Homo sapiens
agactggctgcacagccc

SEQ ID NO: 202696 - DNA, 20 bp, Homo sapiens
agactggctgcacagcccaa

SEQ ID NO: 202697 - DNA, 17 bp, Homo sapiens
agactgggtgaaagtga

SEQ ID NO: 202698 - DNA, 15 bp, Homo sapiens
agactggtcctgtgt

SEQ ID NO: 202699 - DNA, 17 bp, Homo sapiens
agactggtcctgtgtgc

SEQ ID NO: 202700 - DNA, 23 bp, Homo sapiens
agactggtgagcagactggtggg

SEQ ID NO: 202701 - DNA, 19 bp, Homo sapiens
agactgtccacttctagct

SEQ ID NO: 202702 - DNA, 21 bp, Homo sapiens
agactgtcggagaggctgtct

SEQ ID NO: 202703 - DNA, 18 bp, Homo sapiens
agactgtgaggcggcagc

SEQ ID NO: 202704 - DNA, 18 bp, Homo sapiens
agactgttccctccaagg

SEQ ID NO: 202705 - DNA, 19 bp, Homo sapiens
agacttaagattaaattat

SEQ ID NO: 202706 - DNA, 17 bp, Homo sapiens
agacttaatcatatcaa

SEQ ID NO: 202707 - DNA, 16 bp, Homo sapiens
agacttaatctttgct

SEQ ID NO: 202708 - DNA, 15 bp, Homo sapiens
agacttaccaggaag

SEQ ID NO: 202709 - DNA, 13 bp, Homo sapiens
agacttagatctg

SEQ ID NO: 202710 - DNA, 22 bp, Homo sapiens
agacttagatctgagccctccc

SEQ ID NO: 202711 - DNA, 18 bp, Homo sapiens
agacttagtatattttct

SEQ ID NO: 202712 - DNA, 22 bp, Homo sapiens
agacttagtatattttcttttc

SEQ ID NO: 202713 - DNA, 17 bp, Homo sapiens
agacttcgaaaacagat

SEQ ID NO: 202714 - DNA, 14 bp, Homo sapiens
agacttctaaatca

SEQ ID NO: 202715 - DNA, 16 bp, Homo sapiens
agacttctaaatcata

SEQ ID NO: 202716 - DNA, 17 bp, Homo sapiens
agacttctaaatcataa

SEQ ID NO: 202717 - DNA, 16 bp, Homo sapiens
agacttctggaaggct

SEQ ID NO: 202718 - DNA, 20 bp, Homo sapiens
agacttctggaaggctggct

SEQ ID NO: 202719 - DNA, 21 bp, Homo sapiens
agacttctggaaggctggctg

SEQ ID NO: 202720 - DNA, 23 bp, Homo sapiens
agacttctggaaggctggctgag

SEQ ID NO: 202721 - DNA, 17 bp, Homo sapiens
agacttgaaagaaaggg

SEQ ID NO: 202722 - DNA, 12 bp, Homo sapiens
agacttgaaagt

SEQ ID NO: 202723 - DNA, 19 bp, Homo sapiens
agacttgatgaataaacac

SEQ ID NO: 202724 - DNA, 12 bp, Homo sapiens
agacttgccaac

SEQ ID NO: 202725 - DNA, 17 bp, Homo sapiens
agacttggcaacagaag

SEQ ID NO: 202726 - DNA, 18 bp, Homo sapiens
agacttggcccaggaaaa

SEQ ID NO: 202727 - DNA, 18 bp, Homo sapiens
agacttgtttcctgtgcc

SEQ ID NO: 202728 - DNA, 18 bp, Homo sapiens
agactttaaaagatgaaa

SEQ ID NO: 202729 - DNA, 23 bp, Homo sapiens
agactttaatcccggtttcagaa

SEQ ID NO: 202730 - DNA, 17 bp, Homo sapiens
agactttagaaataaat

SEQ ID NO: 202731 - DNA, 18 bp, Homo sapiens
agactttgtttttaaaat

SEQ ID NO: 202732 - DNA, 13 bp, Homo sapiens
agacttttctttg

SEQ ID NO: 202733 - DNA, 19 bp, Homo sapiens
agactttttaaattcctgc

SEQ ID NO: 202734 - DNA, 13 bp, Homo sapiens
agagaaaaaagaa

SEQ ID NO: 202735 - DNA, 15 bp, Homo sapiens
agagaaaaagagaga

SEQ ID NO: 202736 - DNA, 17 bp, Homo sapiens
agagaaaaagtgcccct

SEQ ID NO: 202737 - DNA, 14 bp, Homo sapiens
atcttttagagtaa

SEQ ID NO: 202738 - DNA, 16 bp, Homo sapiens
atcttttcatttatca

SEQ ID NO: 202739 - DNA, 16 bp, Homo sapiens
atcttttgggaagcca

SEQ ID NO: 202740 - DNA, 18 bp, Homo sapiens
atctttttccagcttgag

SEQ ID NO: 202741 - DNA, 16 bp, Homo sapiens
atctttttctccaccc

SEQ ID NO: 202742 - DNA, 17 bp, Homo sapiens
atgaaaaaaatatattt

SEQ ID NO: 202743 - DNA, 16 bp, Homo sapiens
atgaaaaatttaagca

SEQ ID NO: 202744 - DNA, 19 bp, Homo sapiens
atgaaaaatttaagcattg

SEQ ID NO: 202745 - DNA, 22 bp, Homo sapiens
atgaaaaatttaagcattgttt

SEQ ID NO: 202746 - DNA, 11 bp, Homo sapiens
atgaaaacatt

SEQ ID NO: 202747 - DNA, 14 bp, Homo sapiens
atgaaaacattgat

SEQ ID NO: 202748 - DNA, 19 bp, Homo sapiens
atgaaaaccaccctatcat

SEQ ID NO: 202749 - DNA, 16 bp, Homo sapiens
atgaaaagagaattac

SEQ ID NO: 202750 - DNA, 13 bp, Homo sapiens
atgaaaagattta

SEQ ID NO: 202751 - DNA, 21 bp, Homo sapiens
atgaaaaggttgcctgaaaaa

SEQ ID NO: 202752 - DNA, 15 bp, Homo sapiens
atgaaaataaaataa

SEQ ID NO: 202753 - DNA, 13 bp, Homo sapiens
atgaaaatacaac

SEQ ID NO: 202754 - DNA, 17 bp, Homo sapiens
atgaaaatacaacttaa

SEQ ID NO: 202755 - DNA, 22 bp, Homo sapiens
atgaaaatacaacttaaataat

SEQ ID NO: 202756 - DNA, 19 bp, Homo sapiens
atgaaaatcctaccaacct

SEQ ID NO: 202757 - DNA, 12 bp, Homo sapiens
atgaaaatcctt

SEQ ID NO: 202758 - DNA, 16 bp, Homo sapiens
atgaaaatccttttaa

SEQ ID NO: 202759 - DNA, 16 bp, Homo sapiens
atgaaaatgagcatca

SEQ ID NO: 202760 - DNA, 12 bp, Homo sapiens
atgaaaatgtca

SEQ ID NO: 202761 - DNA, 14 bp, Homo sapiens
atgaaaattacaac

SEQ ID NO: 202762 - DNA, 19 bp, Homo sapiens
atgaaaatttgagactatt

SEQ ID NO: 202763 - DNA, 15 bp, Homo sapiens
atgaaaccttcctct

SEQ ID NO: 202764 - DNA, 17 bp, Homo sapiens
atgaaactcctgatttt

SEQ ID NO: 202765 - DNA, 18 bp, Homo sapiens
atgaaactcctgattttg

SEQ ID NO: 202766 - DNA, 14 bp, Homo sapiens
atgaaagacaaaga

SEQ ID NO: 202767 - DNA, 20 bp, Homo sapiens
atgaaagatggctgtgcctc

SEQ ID NO: 202768 - DNA, 23 bp, Homo sapiens
atgaaagatggctgtgcctctgc

SEQ ID NO: 202769 - DNA, 15 bp, Homo sapiens
atgaaagcaacaact

SEQ ID NO: 202770 - DNA, 19 bp, Homo sapiens
atgaaagcaacaactttgt

SEQ ID NO: 202771 - DNA, 21 bp, Homo sapiens
atgaaagcagggaatttctat

SEQ ID NO: 202772 - DNA, 21 bp, Homo sapiens
atgaaagctgattactgtcaa

SEQ ID NO: 202773 - DNA, 16 bp, Homo sapiens
atgaaagtcagtttaa

SEQ ID NO: 202774 - DNA, 20 bp, Homo sapiens
atgaaataaattggtgataa

SEQ ID NO: 202775 - DNA, 21 bp, Homo sapiens
atgaaatataaactgtgagat

SEQ ID NO: 202776 - DNA, 13 bp, Homo sapiens
atgaaatatcaga

SEQ ID NO: 202777 - DNA, 19 bp, Homo sapiens
atgaaatatcagactagtg

SEQ ID NO: 202778 - DNA, 15 bp, Homo sapiens
atgaaatatttgctt

SEQ ID NO: 202779 - DNA, 22 bp, Homo sapiens
atgaaatatttgcttatttata

SEQ ID NO: 202780 - DNA, 14 bp, Homo sapiens
atgaaatgactgtc

SEQ ID NO: 202781 - DNA, 18 bp, Homo sapiens
atgaaatgggctttaaca

SEQ ID NO: 202782 - DNA, 22 bp, Homo sapiens
atgaaattttaccattttgcga

SEQ ID NO: 202783 - DNA, 23 bp, Homo sapiens
atgaaattttaccattttgcgat

SEQ ID NO: 202784 - DNA, 15 bp, Homo sapiens
atgaacaaaatgaag

SEQ ID NO: 202785 - DNA, 18 bp, Homo sapiens
atgaacaaaatgaagtta

SEQ ID NO: 202786 - DNA, 14 bp, Homo sapiens
atgaacaatgtgtg

SEQ ID NO: 202787 - DNA, 17 bp, Homo sapiens
atgaacatgcagttcat

SEQ ID NO: 202788 - DNA, 21 bp, Homo sapiens
atgaacccaggacgcttctga

SEQ ID NO: 202789 - DNA, 15 bp, Homo sapiens
atgaactgaagtttc

SEQ ID NO: 202790 - DNA, 16 bp, Homo sapiens
atgaactgaagtttca

SEQ ID NO: 202791 - DNA, 20 bp, Homo sapiens
atgaactgaagtttcacatg

SEQ ID NO: 202792 - DNA, 13 bp, Homo sapiens
atgaactgcatgt

SEQ ID NO: 202793 - DNA, 20 bp, Homo sapiens
atgaactgcatgtataaatg

SEQ ID NO: 202794 - DNA, 15 bp, Homo sapiens
atgaactgtgacagg

SEQ ID NO: 202795 - DNA, 17 bp, Homo sapiens
atgaactgtgacaggaa

SEQ ID NO: 202796 - DNA, 13 bp, Homo sapiens
atgaacttgagga

SEQ ID NO: 202797 - DNA, 16 bp, Homo sapiens
atgaacttgaggacac

SEQ ID NO: 202798 - DNA, 22 bp, Homo sapiens
atgaacttgaggacacatgtcc

SEQ ID NO: 202799 - DNA, 19 bp, Homo sapiens
atgaagaaagatactaata

SEQ ID NO: 202800 - DNA, 17 bp, Homo sapiens
atgaagaacacagcatg

SEQ ID NO: 202801 - DNA, 12 bp, Homo sapiens
atgaagaatgca

SEQ ID NO: 202802 - DNA, 18 bp, Homo sapiens
atgaagactacttttaga

SEQ ID NO: 202803 - DNA, 17 bp, Homo sapiens
atgaagcaaacacacag

SEQ ID NO: 202804 - DNA, 12 bp, Homo sapiens
atgaagcatgta

SEQ ID NO: 202805 - DNA, 13 bp, Homo sapiens
atgaagcatgtag

SEQ ID NO: 202806 - DNA, 20 bp, Homo sapiens
atgaagccctaagtaaatct

SEQ ID NO: 202807 - DNA, 17 bp, Homo sapiens
atgaagggtcatttctc

SEQ ID NO: 202808 - DNA, 14 bp, Homo sapiens
agagagatgttttg

SEQ ID NO: 202809 - DNA, 20 bp, Homo sapiens
agagagcaaagatggcttcc

SEQ ID NO: 202810 - DNA, 18 bp, Homo sapiens
agagagccttaatggatg

SEQ ID NO: 202811 - DNA, 17 bp, Homo sapiens
agagagcgcgggagaga

SEQ ID NO: 202812 - DNA, 18 bp, Homo sapiens
agagagcgcgggagagag

SEQ ID NO: 202813 - DNA, 19 bp, Homo sapiens
agagagcgcgggagagagt

SEQ ID NO: 202814 - DNA, 21 bp, Homo sapiens
agagagcgcgggagagagtga

SEQ ID NO: 202815 - DNA, 11 bp, Homo sapiens
agagagctggt

SEQ ID NO: 202816 - DNA, 14 bp, Homo sapiens
agagagcttcctgt

SEQ ID NO: 202817 - DNA, 18 bp, Homo sapiens
agagagcttcctgtttct

SEQ ID NO: 202818 - DNA, 14 bp, Homo sapiens
agagaggagaaaca

SEQ ID NO: 202819 - DNA, 16 bp, Homo sapiens
agagaggagaaacaca

SEQ ID NO: 202820 - DNA, 15 bp, Homo sapiens
agagaggagcacctg

SEQ ID NO: 202821 - DNA, 18 bp, Homo sapiens
agagaggaggcagccccc

SEQ ID NO: 202822 - DNA, 15 bp, Homo sapiens
agagaggcacctgct

SEQ ID NO: 202823 - DNA, 20 bp, Homo sapiens
agagaggcgcgtctgcccca

SEQ ID NO: 202824 - DNA, 14 bp, Homo sapiens
agagagggcccagc

SEQ ID NO: 202825 - DNA, 21 bp, Homo sapiens
agagaggggcctctggctgcc

SEQ ID NO: 202826 - DNA, 24 bp, Homo sapiens
agagaggggcctctggctgcctgg

SEQ ID NO: 202827 - DNA, 14 bp, Homo sapiens
agagagggggccac

SEQ ID NO: 202828 - DNA, 15 bp, Homo sapiens
agagagggggctctc

SEQ ID NO: 202829 - DNA, 22 bp, Homo sapiens
agagaggtcaagcccaggagga

SEQ ID NO: 202830 - DNA, 23 bp, Homo sapiens
agagaggtcaagcccaggaggac

SEQ ID NO: 202831 - DNA, 20 bp, Homo sapiens
agagaggttatagagtagaa

SEQ ID NO: 202832 - DNA, 16 bp, Homo sapiens
agagagtcttccaggt

SEQ ID NO: 202833 - DNA, 16 bp, Homo sapiens
agagagtgagagagag

SEQ ID NO: 202834 - DNA, 13 bp, Homo sapiens
agagagtgagagc

SEQ ID NO: 202835 - DNA, 14 bp, Homo sapiens
agagagtggctcct

SEQ ID NO: 202836 - DNA, 21 bp, Homo sapiens
agagataaaccaataaatcca

SEQ ID NO: 202837 - DNA, 19 bp, Homo sapiens
agagataccaagatgccat

SEQ ID NO: 202838 - DNA, 20 bp, Homo sapiens
agagatacccacagagtgtg

SEQ ID NO: 202839 - DNA, 13 bp, Homo sapiens
agagatatttaaa

SEQ ID NO: 202840 - DNA, 15 bp, Homo sapiens
agagatgagctttct

SEQ ID NO: 202841 - DNA, 22 bp, Homo sapiens
agagatggacagttcacaccct

SEQ ID NO: 202842 - DNA, 15 bp, Homo sapiens
agagatggaggagga

SEQ ID NO: 202843 - DNA, 13 bp, Homo sapiens
agagatgtgtcca

SEQ ID NO: 202844 - DNA, 20 bp, Homo sapiens
agagattcccctggaccaca

SEQ ID NO: 202845 - DNA, 12 bp, Homo sapiens
agagattcttag

SEQ ID NO: 202846 - DNA, 19 bp, Homo sapiens
agagattcttagctcttgg

SEQ ID NO: 202847 - DNA, 19 bp, Homo sapiens
agagattgccccagagccc

SEQ ID NO: 202848 - DNA, 23 bp, Homo sapiens
agagatttatataaatgtaaaaa

SEQ ID NO: 202849 - DNA, 13 bp, Homo sapiens
agagatttcatag

SEQ ID NO: 202850 - DNA, 16 bp, Homo sapiens
agagatttcatagcta

SEQ ID NO: 202851 - DNA, 14 bp, Homo sapiens
agagcaaaattgat

SEQ ID NO: 202852 - DNA, 18 bp, Homo sapiens
agagcaaagatggcttcc

SEQ ID NO: 202853 - DNA, 13 bp, Homo sapiens
agagcaaaggaga

SEQ ID NO: 202854 - DNA, 22 bp, Homo sapiens
agagcaaaggagacaaagcagg

SEQ ID NO: 202855 - DNA, 18 bp, Homo sapiens
agagcaagaaaaaagtac

SEQ ID NO: 202856 - DNA, 22 bp, Homo sapiens
agagcacaagaggaagagagag

SEQ ID NO: 202857 - DNA, 18 bp, Homo sapiens
agagcacctagtccagtg

SEQ ID NO: 202858 - DNA, 21 bp, Homo sapiens
agagcaccttcctcacttcca

SEQ ID NO: 202859 - DNA, 18 bp, Homo sapiens
agagcagagtctgggcct

SEQ ID NO: 202860 - DNA, 18 bp, Homo sapiens
agagcagcctgatggcca

SEQ ID NO: 202861 - DNA, 19 bp, Homo sapiens
agagcagcctgatggccaa

SEQ ID NO: 202862 - DNA, 12 bp, Homo sapiens
agagcagcctgg

SEQ ID NO: 202863 - DNA, 12 bp, Homo sapiens
agagcagctggc

SEQ ID NO: 202864 - DNA, 13 bp, Homo sapiens
agagcagctggct

SEQ ID NO: 202865 - DNA, 18 bp, Homo sapiens
agagcagctggctctcca

SEQ ID NO: 202866 - DNA, 22 bp, Homo sapiens
agagcaggaggcccctggccca

SEQ ID NO: 202867 - DNA, 23 bp, Homo sapiens
agagcaggaggcccctggcccag

SEQ ID NO: 202868 - DNA, 20 bp, Homo sapiens
catcactgctgtccctcctg

SEQ ID NO: 202869 - DNA, 17 bp, Homo sapiens
catcacttttcagtgat

SEQ ID NO: 202870 - DNA, 22 bp, Homo sapiens
catcagacctgtcttccaagga

SEQ ID NO: 202871 - DNA, 23 bp, Homo sapiens
catcagacctgtcttccaaggag

SEQ ID NO: 202872 - DNA, 21 bp, Homo sapiens
catcagagagtgtacatcatg

SEQ ID NO: 202873 - DNA, 14 bp, Homo sapiens
catcagcagtgatt

SEQ ID NO: 202874 - DNA, 23 bp, Homo sapiens
catcagcagtgattgaagtatct

SEQ ID NO: 202875 - DNA, 13 bp, Homo sapiens
catcagcccctgc

SEQ ID NO: 202876 - DNA, 21 bp, Homo sapiens
catcagcccctgctgctcctc

SEQ ID NO: 202877 - DNA, 14 bp, Homo sapiens
catcagcctctggc

SEQ ID NO: 202878 - DNA, 17 bp, Homo sapiens
catcagcctctggccag

SEQ ID NO: 202879 - DNA, 11 bp, Homo sapiens
catcagctccc

SEQ ID NO: 202880 - DNA, 15 bp, Homo sapiens
catcagcttaattta

SEQ ID NO: 202881 - DNA, 14 bp, Homo sapiens
catcagctttccct

SEQ ID NO: 202882 - DNA, 16 bp, Homo sapiens
catcagctttccctgg

SEQ ID NO: 202883 - DNA, 21 bp, Homo sapiens
catcagctttccctggctcag

SEQ ID NO: 202884 - DNA, 23 bp, Homo sapiens
catcagctttccctggctcaggg

SEQ ID NO: 202885 - DNA, 22 bp, Homo sapiens
catcaggcactgcgccacctgc

SEQ ID NO: 202886 - DNA, 14 bp, Homo sapiens
catcaggcactggt

SEQ ID NO: 202887 - DNA, 16 bp, Homo sapiens
catcaggcactggtgg

SEQ ID NO: 202888 - DNA, 23 bp, Homo sapiens
catcagtattgtgtaaaggaaca

SEQ ID NO: 202889 - DNA, 22 bp, Homo sapiens
catcagtccacccccattgtga

SEQ ID NO: 202890 - DNA, 15 bp, Homo sapiens
catcagtgttaaaaa

SEQ ID NO: 202891 - DNA, 18 bp, Homo sapiens
catcagtgttaaaaaatt

SEQ ID NO: 202892 - DNA, 13 bp, Homo sapiens
catcagttactgg

SEQ ID NO: 202893 - DNA, 18 bp, Homo sapiens
catcagttcccccagtac

SEQ ID NO: 202894 - DNA, 13 bp, Homo sapiens
catcataaaataa

SEQ ID NO: 202895 - DNA, 23 bp, Homo sapiens
catcataaaataaagtatatata

SEQ ID NO: 202896 - DNA, 24 bp, Homo sapiens
catcataactggcttctgcttgtc

SEQ ID NO: 202897 - DNA, 21 bp, Homo sapiens
catcatacgcatggtcctgga

SEQ ID NO: 202898 - DNA, 16 bp, Homo sapiens
catcatagaaggagag

SEQ ID NO: 202899 - DNA, 17 bp, Homo sapiens
catcatagaaggagagc

SEQ ID NO: 202900 - DNA, 22 bp, Homo sapiens
catcatagaggatgatgtaatt

SEQ ID NO: 202901 - DNA, 13 bp, Homo sapiens
catcatatgcctg

SEQ ID NO: 202902 - DNA, 23 bp, Homo sapiens
catcatcaggcttggaatgaatt

SEQ ID NO: 202903 - DNA, 14 bp, Homo sapiens
catcatcctcactg

SEQ ID NO: 202904 - DNA, 13 bp, Homo sapiens
catcatctctgcc

SEQ ID NO: 202905 - DNA, 16 bp, Homo sapiens
catcatctctgccttt

SEQ ID NO: 202906 - DNA, 23 bp, Homo sapiens
ctttaacaaaacaagaaagaaac

SEQ ID NO: 202907 - DNA, 14 bp, Homo sapiens
ctttaactctgcgg

SEQ ID NO: 202908 - DNA, 17 bp, Homo sapiens
ctttaagcgaggcagaa

SEQ ID NO: 202909 - DNA, 13 bp, Homo sapiens
ctttaataagtaa

SEQ ID NO: 202910 - DNA, 18 bp, Homo sapiens
ctttaatactcacctcct

SEQ ID NO: 202911 - DNA, 17 bp, Homo sapiens
ctttaatagtttctgat

SEQ ID NO: 202912 - DNA, 22 bp, Homo sapiens
ctttaatggacttatttcttca

SEQ ID NO: 202913 - DNA, 19 bp, Homo sapiens
ctttaattctctttcaaag

SEQ ID NO: 202914 - DNA, 15 bp, Homo sapiens
ctttaattgtatctc

SEQ ID NO: 202915 - DNA, 21 bp, Homo sapiens
ctttacaaactgaagataatg

SEQ ID NO: 202916 - DNA, 16 bp, Homo sapiens
ctttacaggatcatgt

SEQ ID NO: 202917 - DNA, 22 bp, Homo sapiens
ctttacaggatcatgtaaatgc

SEQ ID NO: 202918 - DNA, 22 bp, Homo sapiens
ctttacatgctgtgctctttga

SEQ ID NO: 202919 - DNA, 14 bp, Homo sapiens
ctttacgtagtgta

SEQ ID NO: 202920 - DNA, 23 bp, Homo sapiens
ctttactactgcaagttcaagac

SEQ ID NO: 202921 - DNA, 21 bp, Homo sapiens
ctttactcccttcctggcctc

SEQ ID NO: 202922 - DNA, 15 bp, Homo sapiens
ctttagaaataaatg

SEQ ID NO: 202923 - DNA, 16 bp, Homo sapiens
ctttagcttctctgcc

SEQ ID NO: 202924 - DNA, 20 bp, Homo sapiens
ctttaggcagcctgccgccg

SEQ ID NO: 202925 - DNA, 22 bp, Homo sapiens
ctttaggcaggaagtcaggagc

SEQ ID NO: 202926 - DNA, 20 bp, Homo sapiens
ctttagggagacccaataaa

SEQ ID NO: 202927 - DNA, 23 bp, Homo sapiens
ctttagggagacccaataaagaa

SEQ ID NO: 202928 - DNA, 20 bp, Homo sapiens
ctttagggggtgggaggggg

SEQ ID NO: 202929 - DNA, 15 bp, Homo sapiens
ctttagtcgctgagg

SEQ ID NO: 202930 - DNA, 18 bp, Homo sapiens
ctttagtctacataggca

SEQ ID NO: 202931 - DNA, 13 bp, Homo sapiens
ctttataattcta

SEQ ID NO: 202932 - DNA, 19 bp, Homo sapiens
ctttataattctactttga

SEQ ID NO: 202933 - DNA, 19 bp, Homo sapiens
ctttataatttctacccat

SEQ ID NO: 202934 - DNA, 22 bp, Homo sapiens
ctttatattttctatatttgta

SEQ ID NO: 202935 - DNA, 23 bp, Homo sapiens
ctttatcacaaccaccgttacaa

SEQ ID NO: 202936 - DNA, 19 bp, Homo sapiens
ctttatcattaaacatgaa

SEQ ID NO: 202937 - DNA, 19 bp, Homo sapiens
ctttatccctgcttatctg

SEQ ID NO: 202938 - DNA, 16 bp, Homo sapiens
ctttatctatgggaga

SEQ ID NO: 202939 - DNA, 14 bp, Homo sapiens
ctttatgatttcat

SEQ ID NO: 202940 - DNA, 16 bp, Homo sapiens
ctttatgatttcatga

SEQ ID NO: 202941 - DNA, 19 bp, Homo sapiens
ctttatggctctaacatta

SEQ ID NO: 202942 - DNA, 16 bp, Homo sapiens
ctttattaacctcagc

SEQ ID NO: 202943 - DNA, 15 bp, Homo sapiens
ctttattaatgaact

SEQ ID NO: 202944 - DNA, 23 bp, Homo sapiens
ctttattaatgaactgtgacagg

SEQ ID NO: 202945 - DNA, 12 bp, Homo sapiens
ctttattcttta

SEQ ID NO: 202946 - DNA, 15 bp, Homo sapiens
ctttattctttaatt

SEQ ID NO: 202947 - DNA, 18 bp, Homo sapiens
ctttattgcccatgggat

SEQ ID NO: 202948 - DNA, 16 bp, Homo sapiens
ctttatttaatttcat

SEQ ID NO: 202949 - DNA, 11 bp, Homo sapiens
ctttatttctg

SEQ ID NO: 202950 - DNA, 22 bp, Homo sapiens
ctttattttttaagtatttata

SEQ ID NO: 202951 - DNA, 21 bp, Homo sapiens
ctttcaaaagaagagttttag

SEQ ID NO: 202952 - DNA, 16 bp, Homo sapiens
ctttcaaatcctccct

SEQ ID NO: 202953 - DNA, 15 bp, Homo sapiens
ctttcaaatttcaca

SEQ ID NO: 202954 - DNA, 18 bp, Homo sapiens
ctttcaacttaaatcact

SEQ ID NO: 202955 - DNA, 13 bp, Homo sapiens
ctttcaagatctt

SEQ ID NO: 202956 - DNA, 23 bp, Homo sapiens
ctttcaagtgcctttctgcagtt

SEQ ID NO: 202957 - DNA, 20 bp, Homo sapiens
ctttcaatccacagtattgt

SEQ ID NO: 202958 - DNA, 14 bp, Homo sapiens
ctttcacaaccttc

SEQ ID NO: 202959 - DNA, 14 bp, Homo sapiens
ctttcacagcttct

SEQ ID NO: 202960 - DNA, 16 bp, Homo sapiens
ctttcacatagatgtc

SEQ ID NO: 202961 - DNA, 15 bp, Homo sapiens
ctttcactggggatc

SEQ ID NO: 202962 - DNA, 20 bp, Homo sapiens
ctttcagagaggtctcaggt

SEQ ID NO: 202963 - DNA, 15 bp, Homo sapiens
ctttcagagccagtg

SEQ ID NO: 202964 - DNA, 21 bp, Homo sapiens
ctttcagatgtcttctgcctg

SEQ ID NO: 202965 - DNA, 12 bp, Homo sapiens
ctttcagatgtt

SEQ ID NO: 202966 - DNA, 23 bp, Homo sapiens
ctttcagccaagaattcttaaat

SEQ ID NO: 202967 - DNA, 14 bp, Homo sapiens
ctttcagcctgctt

SEQ ID NO: 202968 - DNA, 13 bp, Homo sapiens
ctttcagctgtga

SEQ ID NO: 202969 - DNA, 12 bp, Homo sapiens
ctttcaggaagg

SEQ ID NO: 202970 - DNA, 20 bp, Homo sapiens
ctttcaggaagggagaggag

SEQ ID NO: 202971 - DNA, 15 bp, Homo sapiens
ctttcagtattaaac

SEQ ID NO: 202972 - DNA, 22 bp, Homo sapiens
ctttcagtattaaactctcctt

SEQ ID NO: 202973 - DNA, 23 bp, Homo sapiens
ctttcagtattaaactctccttt

SEQ ID NO: 202974 - DNA, 17 bp, Homo sapiens
ctttcagtcccaaagcg

SEQ ID NO: 202975 - DNA, 14 bp, Homo sapiens
ctttcatagttctg

SEQ ID NO: 202976 - DNA, 17 bp, Homo sapiens
ctttcatagttctgtta

SEQ ID NO: 202977 - DNA, 22 bp, Homo sapiens
ctttcatagttctgttaaatat

SEQ ID NO: 202978 - DNA, 13 bp, Homo sapiens
ctttcatcctcag

SEQ ID NO: 202979 - DNA, 14 bp, Homo sapiens
ctttcatcctcagc

SEQ ID NO: 202980 - DNA, 12 bp, Homo sapiens
ctttcatcctgt

SEQ ID NO: 202981 - DNA, 21 bp, Homo sapiens
ctttcatgaccactgggcctg

SEQ ID NO: 202982 - DNA, 15 bp, Homo sapiens
ctttccaaaggttgt

SEQ ID NO: 202983 - DNA, 15 bp, Homo sapiens
ctttccaacacacaa

SEQ ID NO: 202984 - DNA, 18 bp, Homo sapiens
ctttccaacttttcatcc

SEQ ID NO: 202985 - DNA, 14 bp, Homo sapiens
ctttccaattccaa

SEQ ID NO: 202986 - DNA, 21 bp, Homo sapiens
ctttccaattccaaaattcca

SEQ ID NO: 202987 - DNA, 18 bp, Homo sapiens
ctttccacatttgtcaca

SEQ ID NO: 202988 - DNA, 14 bp, Homo sapiens
tacaactgagtcct

SEQ ID NO: 202989 - DNA, 17 bp, Homo sapiens
tacaagataaaaaacga

SEQ ID NO: 202990 - DNA, 18 bp, Homo sapiens
tacaagccagctggagaa

SEQ ID NO: 202991 - DNA, 20 bp, Homo sapiens
tacaaggcaggcctttccta

SEQ ID NO: 202992 - DNA, 13 bp, Homo sapiens
tacaaggtatgta

SEQ ID NO: 202993 - DNA, 13 bp, Homo sapiens
tacaagtaatgaa

SEQ ID NO: 202994 - DNA, 15 bp, Homo sapiens
tacaagtaattttgc

SEQ ID NO: 202995 - DNA, 20 bp, Homo sapiens
tacaagtaggggttgtgggt

SEQ ID NO: 202996 - DNA, 22 bp, Homo sapiens
tacaagtgctcagttccaatgt

SEQ ID NO: 202997 - DNA, 14 bp, Homo sapiens
tacaagtgtatatc

SEQ ID NO: 202998 - DNA, 21 bp, Homo sapiens
tacaagtgtatatcagaaaag

SEQ ID NO: 202999 - DNA, 13 bp, Homo sapiens
tacaataaactat

SEQ ID NO: 203000 - DNA, 19 bp, Homo sapiens
tacaataaactattggaaa

SEQ ID NO: 203001 - DNA, 15 bp, Homo sapiens
tacaataaataatct

SEQ ID NO: 203002 - DNA, 13 bp, Homo sapiens
tacaataagcaga

SEQ ID NO: 203003 - DNA, 13 bp, Homo sapiens
tacaatcagctgc

SEQ ID NO: 203004 - DNA, 22 bp, Homo sapiens
tacaatcagctgctttgttacc

SEQ ID NO: 203005 - DNA, 23 bp, Homo sapiens
tacaatcagctgctttgttacct

SEQ ID NO: 203006 - DNA, 15 bp, Homo sapiens
tacaatggcctttat

SEQ ID NO: 203007 - DNA, 22 bp, Homo sapiens
tacaatggctgggtttgggcag

SEQ ID NO: 203008 - DNA, 12 bp, Homo sapiens
tacaattaaagg

SEQ ID NO: 203009 - DNA, 21 bp, Homo sapiens
tacaattaaaggtcctgccct

SEQ ID NO: 203010 - DNA, 18 bp, Homo sapiens
tacaattactaaattgta

SEQ ID NO: 203011 - DNA, 22 bp, Homo sapiens
tacaattcagttttagtttcaa

SEQ ID NO: 203012 - DNA, 19 bp, Homo sapiens
tacaattcctggcaaacac

SEQ ID NO: 203013 - DNA, 18 bp, Homo sapiens
tacaattgcactgctgtt

SEQ ID NO: 203014 - DNA, 21 bp, Homo sapiens
tacacaaaaagaaagctgtga

SEQ ID NO: 203015 - DNA, 23 bp, Homo sapiens
tacacaaaaagaaagctgtgaaa

SEQ ID NO: 203016 - DNA, 18 bp, Homo sapiens
tacacaaagatattattt

SEQ ID NO: 203017 - DNA, 17 bp, Homo sapiens
tacacaacatgtatgtg

SEQ ID NO: 203018 - DNA, 22 bp, Homo sapiens
tacacaagactttccccatact

SEQ ID NO: 203019 - DNA, 22 bp, Homo sapiens
tacacaagagggactgtatttc

SEQ ID NO: 203020 - DNA, 15 bp, Homo sapiens
tacacacatccacgc

SEQ ID NO: 203021 - DNA, 17 bp, Homo sapiens
tacacacgtttgtttct

SEQ ID NO: 203022 - DNA, 18 bp, Homo sapiens
tacacccagttctgaata

SEQ ID NO: 203023 - DNA, 14 bp, Homo sapiens
tacacccttggact

SEQ ID NO: 203024 - DNA, 15 bp, Homo sapiens
tacaccgaatgacca

SEQ ID NO: 203025 - DNA, 14 bp, Homo sapiens
tacacctctgggcc

SEQ ID NO: 203026 - DNA, 21 bp, Homo sapiens
tacacctctgggccctgcagg

SEQ ID NO: 203027 - DNA, 12 bp, Homo sapiens
tacacctggacc

SEQ ID NO: 203028 - DNA, 14 bp, Homo sapiens
tacactacaaatgt

SEQ ID NO: 203029 - DNA, 12 bp, Homo sapiens
tacactcctgct

SEQ ID NO: 203030 - DNA, 15 bp, Homo sapiens
tacactctcctgggc

SEQ ID NO: 203031 - DNA, 17 bp, Homo sapiens
tacactctcctgggccc

SEQ ID NO: 203032 - DNA, 17 bp, Homo sapiens
tacactgaatatttata

SEQ ID NO: 203033 - DNA, 18 bp, Homo sapiens
tacactgaatatttatat

SEQ ID NO: 203034 - DNA, 15 bp, Homo sapiens
tacactgacttggtg

SEQ ID NO: 203035 - DNA, 16 bp, Homo sapiens
tacactgtattacata

SEQ ID NO: 203036 - DNA, 21 bp, Homo sapiens
tacattgtataggccatctgt

SEQ ID NO: 203037 - DNA, 13 bp, Homo sapiens
tacatttaataca

SEQ ID NO: 203038 - DNA, 16 bp, Homo sapiens
tacatttatcttctgt

SEQ ID NO: 203039 - DNA, 18 bp, Homo sapiens
tacatttatcttctgttt

SEQ ID NO: 203040 - DNA, 15 bp, Homo sapiens
tacatttatgtgtga

SEQ ID NO: 203041 - DNA, 23 bp, Homo sapiens
tacatttggagacacaactattt

SEQ ID NO: 203042 - DNA, 17 bp, Homo sapiens
tacatttgtatgttgtg

SEQ ID NO: 203043 - DNA, 19 bp, Homo sapiens
tacattttatatctggatt

SEQ ID NO: 203044 - DNA, 16 bp, Homo sapiens
tacattttatatgtga

SEQ ID NO: 203045 - DNA, 17 bp, Homo sapiens
tacattttcagtaccaa

SEQ ID NO: 203046 - DNA, 18 bp, Homo sapiens
tacattttcagtaccaaa

SEQ ID NO: 203047 - DNA, 22 bp, Homo sapiens
tacattttgcttgcgtgctggg

SEQ ID NO: 203048 - DNA, 12 bp, Homo sapiens
tacattttgtta

SEQ ID NO: 203049 - DNA, 16 bp, Homo sapiens
tacatttttacaataa

SEQ ID NO: 203050 - DNA, 17 bp, Homo sapiens
tacatttttacaataaa

SEQ ID NO: 203051 - DNA, 17 bp, Homo sapiens
taccaaagttttatcaa

SEQ ID NO: 203052 - DNA, 15 bp, Homo sapiens
taccaagacataatg

SEQ ID NO: 203053 - DNA, 18 bp, Homo sapiens
taccaagatcacaaatag

SEQ ID NO: 203054 - DNA, 15 bp, Homo sapiens
taccaatcattttaa

SEQ ID NO: 203055 - DNA, 19 bp, Homo sapiens
taccaatcattttaattat

SEQ ID NO: 203056 - DNA, 11 bp, Homo sapiens
taccaatgcat

SEQ ID NO: 203057 - DNA, 14 bp, Homo sapiens
taccaatgctgttg

SEQ ID NO: 203058 - DNA, 18 bp, Homo sapiens
taccaatgctgttgtaaa

SEQ ID NO: 203059 - DNA, 14 bp, Homo sapiens
taccacaaggaaaa

SEQ ID NO: 203060 - DNA, 23 bp, Homo sapiens
taccacatggtccatttcatgtg

SEQ ID NO: 203061 - DNA, 13 bp, Homo sapiens
taccacctgtaca

SEQ ID NO: 203062 - DNA, 15 bp, Homo sapiens
taccactatttaagt

SEQ ID NO: 203063 - DNA, 16 bp, Homo sapiens
taccactatttaagtt

SEQ ID NO: 203064 - DNA, 19 bp, Homo sapiens
taccactgctaataaatga

SEQ ID NO: 203065 - DNA, 20 bp, Homo sapiens
taccactgctaataaatgac

SEQ ID NO: 203066 - DNA, 21 bp, Homo sapiens
taccactgctaataaatgacc

SEQ ID NO: 203067 - DNA, 23 bp, Homo sapiens
taccactgctaataaatgaccag

SEQ ID NO: 203068 - DNA, 15 bp, Homo sapiens
taccacttatttcta

SEQ ID NO: 203069 - DNA, 16 bp, Homo sapiens
taccacttatttctaa

SEQ ID NO: 203070 - DNA, 15 bp, Homo sapiens
taccagaaagtgagg

SEQ ID NO: 203071 - DNA, 21 bp, Homo sapiens
taccagactgcaggttggacc

SEQ ID NO: 203072 - DNA, 15 bp, Homo sapiens
taccagatgctactg

SEQ ID NO: 203073 - DNA, 19 bp, Homo sapiens
taccagatgctactggact

SEQ ID NO: 203074 - DNA, 16 bp, Homo sapiens
taccagccctggggct

SEQ ID NO: 203075 - DNA, 21 bp, Homo sapiens
taccagccctggggctgggcc

SEQ ID NO: 203076 - DNA, 18 bp, Homo sapiens
taccagcgcccgctgggc

SEQ ID NO: 203077 - DNA, 19 bp, Homo sapiens
taccagcgcccgctgggct

SEQ ID NO: 203078 - DNA, 20 bp, Homo sapiens
taccaggccgccccagcctc

SEQ ID NO: 203079 - DNA, 14 bp, Homo sapiens
taccaggtgttcta

SEQ ID NO: 203080 - DNA, 14 bp, Homo sapiens
taccaggttgaaag

SEQ ID NO: 203081 - DNA, 19 bp, Homo sapiens
taccagtcgccctctgtgc

SEQ ID NO: 203082 - DNA, 18 bp, Homo sapiens
taccagtgttagtgggaa

SEQ ID NO: 203083 - DNA, 20 bp, Homo sapiens
taccagtgttagtgggaaga

SEQ ID NO: 203084 - DNA, 17 bp, Homo sapiens
taccagttgtatttaat

SEQ ID NO: 203085 - DNA, 17 bp, Homo sapiens
taccataagggactgtg

SEQ ID NO: 203086 - DNA, 17 bp, Homo sapiens
taccatcggtcagcagg

SEQ ID NO: 203087 - DNA, 13 bp, Homo sapiens
taccatctccctc

SEQ ID NO: 203088 - DNA, 14 bp, Homo sapiens
taccatcttaatct

SEQ ID NO: 203089 - DNA, 15 bp, Homo sapiens
taccatgaagtgaaa

SEQ ID NO: 203090 - DNA, 12 bp, Homo sapiens
taccatgctgct

SEQ ID NO: 203091 - DNA, 16 bp, Homo sapiens
taccattaaaactgct

SEQ ID NO: 203092 - DNA, 19 bp, Homo sapiens
taccattaaaactgctttt

SEQ ID NO: 203093 - DNA, 17 bp, Homo sapiens
taccatttgtaataaag

SEQ ID NO: 203094 - DNA, 22 bp, Homo sapiens
taccatttgtaataaagtatat

SEQ ID NO: 203095 - DNA, 23 bp, Homo sapiens
taccatttgtaataaagtatata

SEQ ID NO: 203096 - DNA, 15 bp, Homo sapiens
taccattttctggtt

SEQ ID NO: 203097 - DNA, 13 bp, Homo sapiens
tacccaaccactc

SEQ ID NO: 203098 - DNA, 14 bp, Homo sapiens
tacccacagggcct

SEQ ID NO: 203099 - DNA, 18 bp, Homo sapiens
tacccaccgatggagccc

SEQ ID NO: 203100 - DNA, 23 bp, Homo sapiens
tacccacctgagctttggacaca

SEQ ID NO: 203101 - DNA, 12 bp, Homo sapiens
tacccactgcat

SEQ ID NO: 203102 - DNA, 16 bp, Homo sapiens
tacccagaaccttttt

SEQ ID NO: 203103 - DNA, 13 bp, Homo sapiens
tacccagagagaa

SEQ ID NO: 203104 - DNA, 19 bp, Homo sapiens
tacccagagagaaaaagag

SEQ ID NO: 203105 - DNA, 21 bp, Homo sapiens
tacccagccaccttcctgact

SEQ ID NO: 203106 - DNA, 13 bp, Homo sapiens
tacccagcccatc

SEQ ID NO: 203107 - DNA, 14 bp, Homo sapiens
tacccagcccatct

SEQ ID NO: 203108 - DNA, 13 bp, Homo sapiens
tacccagctcctt

SEQ ID NO: 203109 - DNA, 15 bp, Homo sapiens
tacccaggctggttc

SEQ ID NO: 203110 - DNA, 17 bp, Homo sapiens
tacccatgagcctgccc

SEQ ID NO: 203111 - DNA, 17 bp, Homo sapiens
tacccatgttgggaaaa

SEQ ID NO: 203112 - DNA, 18 bp, Homo sapiens
taccccacctcatgcctg

SEQ ID NO: 203113 - DNA, 22 bp, Homo sapiens
taccccagttcatctctgctga

SEQ ID NO: 203114 - DNA, 14 bp, Homo sapiens
taccccatttgatt

SEQ ID NO: 203115 - DNA, 17 bp, Homo sapiens
tacccccaacaccaccc

SEQ ID NO: 203116 - DNA, 13 bp, Homo sapiens
tacccccctgaga

SEQ ID NO: 203117 - DNA, 14 bp, Homo sapiens
taccccctgcccca

SEQ ID NO: 203118 - DNA, 16 bp, Homo sapiens
taccccctgccccaga

SEQ ID NO: 203119 - DNA, 13 bp, Homo sapiens
tacccgagcccag

SEQ ID NO: 203120 - DNA, 14 bp, Homo sapiens
tacccgagcccagc

SEQ ID NO: 203121 - DNA, 20 bp, Homo sapiens
tacccgcccgcgtccaaccc

SEQ ID NO: 203122 - DNA, 20 bp, Homo sapiens
taccctacacctctgggccc

SEQ ID NO: 203123 - DNA, 17 bp, Homo sapiens
taccctaggtctccacc

SEQ ID NO: 203124 - DNA, 18 bp, Homo sapiens
taccctaggtctccaccc

SEQ ID NO: 203125 - DNA, 20 bp, Homo sapiens
taccctaggtctccacccct

SEQ ID NO: 203126 - DNA, 23 bp, Homo sapiens
taccctaggtctccacccctcaa

SEQ ID NO: 203127 - DNA, 23 bp, Homo sapiens
taccctcaggcataggcctgggt

SEQ ID NO: 203128 - DNA, 12 bp, Homo sapiens
taccctcccacc

SEQ ID NO: 203129 - DNA, 18 bp, Homo sapiens
ctttgcatgatctgtcaa

SEQ ID NO: 203130 - DNA, 19 bp, Homo sapiens
ctttgcatgatctgtcaaa

SEQ ID NO: 203131 - DNA, 14 bp, Homo sapiens
ctttgcatgttctt

SEQ ID NO: 203132 - DNA, 16 bp, Homo sapiens
ctttgcatgttcttgt

SEQ ID NO: 203133 - DNA, 18 bp, Homo sapiens
ctttgcatgttcttgttt

SEQ ID NO: 203134 - DNA, 16 bp, Homo sapiens
ctttgccaaggctctc

SEQ ID NO: 203135 - DNA, 13 bp, Homo sapiens
ctttgccagcttt

SEQ ID NO: 203136 - DNA, 20 bp, Homo sapiens
ctttgccatgggcctgctgc

SEQ ID NO: 203137 - DNA, 23 bp, Homo sapiens
ctttgcccatggaagtctcaaag

SEQ ID NO: 203138 - DNA, 23 bp, Homo sapiens
ctttgcctgtagagccagccttg

SEQ ID NO: 203139 - DNA, 13 bp, Homo sapiens
ctttgccttctct

SEQ ID NO: 203140 - DNA, 18 bp, Homo sapiens
ctttgccttgatgttgtg

SEQ ID NO: 203141 - DNA, 20 bp, Homo sapiens
ctttgcgcaaactttaacag

SEQ ID NO: 203142 - DNA, 16 bp, Homo sapiens
ctttgcgtggatcaag

SEQ ID NO: 203143 - DNA, 18 bp, Homo sapiens
ctttgcgtggatcaagct

SEQ ID NO: 203144 - DNA, 11 bp, Homo sapiens
ctttgctctga

SEQ ID NO: 203145 - DNA, 13 bp, Homo sapiens
ctttgctctggat

SEQ ID NO: 203146 - DNA, 19 bp, Homo sapiens
ctttgctgaatgtcattat

SEQ ID NO: 203147 - DNA, 15 bp, Homo sapiens
ctttgctgcccctgt

SEQ ID NO: 203148 - DNA, 14 bp, Homo sapiens
ctttgctgccttaa

SEQ ID NO: 203149 - DNA, 21 bp, Homo sapiens
ctttgctgctaccgccctggg

SEQ ID NO: 203150 - DNA, 17 bp, Homo sapiens
ctttgctggagtcctgt

SEQ ID NO: 203151 - DNA, 21 bp, Homo sapiens
ctttgctggttgctgggcctc

SEQ ID NO: 203152 - DNA, 13 bp, Homo sapiens
ctttgctgtgcca

SEQ ID NO: 203153 - DNA, 22 bp, Homo sapiens
ctttgctgtttagcttcctcca

SEQ ID NO: 203154 - DNA, 15 bp, Homo sapiens
ctttgcttctttttc

SEQ ID NO: 203155 - DNA, 14 bp, Homo sapiens
ctttgcttgaaaga

SEQ ID NO: 203156 - DNA, 15 bp, Homo sapiens
ctttggaatttgaag

SEQ ID NO: 203157 - DNA, 23 bp, Homo sapiens
ctttggcaattcttcttctcaag

SEQ ID NO: 203158 - DNA, 15 bp, Homo sapiens
ctttggctcgggact

SEQ ID NO: 203159 - DNA, 16 bp, Homo sapiens
ctttgggaacactggc

SEQ ID NO: 203160 - DNA, 18 bp, Homo sapiens
ctttgggaggccaaggca

SEQ ID NO: 203161 - DNA, 19 bp, Homo sapiens
ctttgggaggccaaggcag

SEQ ID NO: 203162 - DNA, 19 bp, Homo sapiens
ctttgggctgccctggtgc

SEQ ID NO: 203163 - DNA, 21 bp, Homo sapiens
ctttgggctgccctggtgctg

SEQ ID NO: 203164 - DNA, 22 bp, Homo sapiens
ctttggggaactcaaaggactg

SEQ ID NO: 203165 - DNA, 19 bp, Homo sapiens
ctttggggacagttggcag

SEQ ID NO: 203166 - DNA, 20 bp, Homo sapiens
ctttggggacagttggcaga

SEQ ID NO: 203167 - DNA, 13 bp, Homo sapiens
tagtggaaagtga

SEQ ID NO: 203168 - DNA, 23 bp, Homo sapiens
tagtggaaagtgatttgtaatat

SEQ ID NO: 203169 - DNA, 14 bp, Homo sapiens
tagtggaagagcag

SEQ ID NO: 203170 - DNA, 21 bp, Homo sapiens
tagtggaagagcagcctgatg

SEQ ID NO: 203171 - DNA, 16 bp, Homo sapiens
tagtggccagaccaga

SEQ ID NO: 203172 - DNA, 16 bp, Homo sapiens
tagtggcttcagcccc

SEQ ID NO: 203173 - DNA, 18 bp, Homo sapiens
tagtggcttcagcccctg

SEQ ID NO: 203174 - DNA, 22 bp, Homo sapiens
tagtggcttcagcccctggggt

SEQ ID NO: 203175 - DNA, 14 bp, Homo sapiens
tagtgggcaggtgg

SEQ ID NO: 203176 - DNA, 20 bp, Homo sapiens
tagtggggaggggcctggcc

SEQ ID NO: 203177 - DNA, 21 bp, Homo sapiens
tagtggtcatttggtggctct

SEQ ID NO: 203178 - DNA, 13 bp, Homo sapiens
tagtggtctgatt

SEQ ID NO: 203179 - DNA, 22 bp, Homo sapiens
tagtggtgttttaaagagaatg

SEQ ID NO: 203180 - DNA, 18 bp, Homo sapiens
tagtggttcttggaaaaa

SEQ ID NO: 203181 - DNA, 13 bp, Homo sapiens
tagtgtaaaataa

SEQ ID NO: 203182 - DNA, 22 bp, Homo sapiens
tagtgtataccacctgtacata

SEQ ID NO: 203183 - DNA, 15 bp, Homo sapiens
tagtgtcacctttct

SEQ ID NO: 203184 - DNA, 13 bp, Homo sapiens
tagtgtctgtcca

SEQ ID NO: 203185 - DNA, 20 bp, Homo sapiens
tagtgtgagtggcagccatg

SEQ ID NO: 203186 - DNA, 21 bp, Homo sapiens
tagtgtgagtggcagccatgc

SEQ ID NO: 203187 - DNA, 17 bp, Homo sapiens
tagtgttttgtacttgt

SEQ ID NO: 203188 - DNA, 15 bp, Homo sapiens
tagttaaattggctt

SEQ ID NO: 203189 - DNA, 12 bp, Homo sapiens
tagttaaatttc

SEQ ID NO: 203190 - DNA, 15 bp, Homo sapiens
tagttaaatttctgg

SEQ ID NO: 203191 - DNA, 20 bp, Homo sapiens
tagttaagtcgctgaacaat

SEQ ID NO: 203192 - DNA, 23 bp, Homo sapiens
tagttaatattgtgaagaaaaat

SEQ ID NO: 203193 - DNA, 18 bp, Homo sapiens
tagttaattgtggcttta

SEQ ID NO: 203194 - DNA, 13 bp, Homo sapiens
tagttaatttatt

SEQ ID NO: 203195 - DNA, 18 bp, Homo sapiens
tagttattttaatacctt

SEQ ID NO: 203196 - DNA, 19 bp, Homo sapiens
tagttattttaataccttt

SEQ ID NO: 203197 - DNA, 15 bp, Homo sapiens
tagttcagacacttt

SEQ ID NO: 203198 - DNA, 14 bp, Homo sapiens
tagttcaggatttg

SEQ ID NO: 203199 - DNA, 18 bp, Homo sapiens
tagttcatccaatcctca

SEQ ID NO: 203200 - DNA, 15 bp, Homo sapiens
tagttcgtagctttc

SEQ ID NO: 203201 - DNA, 22 bp, Homo sapiens
tagttctatcaggaaaacaaat

SEQ ID NO: 203202 - DNA, 15 bp, Homo sapiens
tagttctatttctat

SEQ ID NO: 203203 - DNA, 22 bp, Homo sapiens
tagttctcaatcactgctcccc

SEQ ID NO: 203204 - DNA, 16 bp, Homo sapiens
tagttctgtgcctccc

SEQ ID NO: 203205 - DNA, 19 bp, Homo sapiens
tagttctgttaaatatttt

SEQ ID NO: 203206 - DNA, 23 bp, Homo sapiens
tagttcttgggggaggccacccc

SEQ ID NO: 203207 - DNA, 18 bp, Homo sapiens
tagttctttgttcctgct

SEQ ID NO: 203208 - DNA, 21 bp, Homo sapiens
tagttctttgttcctgctttc

SEQ ID NO: 203209 - DNA, 16 bp, Homo sapiens
tagttgaaaaaagaag

SEQ ID NO: 203210 - DNA, 19 bp, Homo sapiens
tagttgaaaaaagaagttt

SEQ ID NO: 203211 - DNA, 20 bp, Homo sapiens
tagttgaacaagatttccct

SEQ ID NO: 203212 - DNA, 21 bp, Homo sapiens
tagttgaacaagatttcccta

SEQ ID NO: 203213 - DNA, 23 bp, Homo sapiens
tagttgaacaagatttccctaaa

SEQ ID NO: 203214 - DNA, 23 bp, Homo sapiens
tagttgaattttttttaacattc

SEQ ID NO: 203215 - DNA, 19 bp, Homo sapiens
tagttgagacgctgttgca

SEQ ID NO: 203216 - DNA, 20 bp, Homo sapiens
tagttgatgaccaatctctg

SEQ ID NO: 203217 - DNA, 23 bp, Homo sapiens
tagttgatgaccaatctctgtga

SEQ ID NO: 203218 - DNA, 15 bp, Homo sapiens
tagttgcaaagcatt

SEQ ID NO: 203219 - DNA, 16 bp, Homo sapiens
tagttgctccgcctct

SEQ ID NO: 203220 - DNA, 21 bp, Homo sapiens
tagttgtaatgtgtatgtctg

SEQ ID NO: 203221 - DNA, 21 bp, Homo sapiens
tagttgtctttctttgctgct

SEQ ID NO: 203222 - DNA, 14 bp, Homo sapiens
tagttgttaagttt

SEQ ID NO: 203223 - DNA, 18 bp, Homo sapiens
tagtttaggtgtttggga

SEQ ID NO: 203224 - DNA, 16 bp, Homo sapiens
tagaaagatacactga

SEQ ID NO: 203225 - DNA, 23 bp, Homo sapiens
tagaaagcctgttcccctcactg

SEQ ID NO: 203226 - DNA, 20 bp, Homo sapiens
tagaaagctggcaacatgaa

SEQ ID NO: 203227 - DNA, 23 bp, Homo sapiens
tagaaaggttgattctcatgcac

SEQ ID NO: 203228 - DNA, 17 bp, Homo sapiens
tagaaagtgaataaaaa

SEQ ID NO: 203229 - DNA, 20 bp, Homo sapiens
tagaaagtgaataaaaatta

SEQ ID NO: 203230 - DNA, 16 bp, Homo sapiens
tagaaataaagcatct

SEQ ID NO: 203231 - DNA, 18 bp, Homo sapiens
tagaaataaatgaaaaca

SEQ ID NO: 203232 - DNA, 11 bp, Homo sapiens
tagaaataagt

SEQ ID NO: 203233 - DNA, 23 bp, Homo sapiens
tagaaataagtggttatttctca

SEQ ID NO: 203234 - DNA, 18 bp, Homo sapiens
tagaaatgaccaatatta

SEQ ID NO: 203235 - DNA, 14 bp, Homo sapiens
tagaaattactgga

SEQ ID NO: 203236 - DNA, 17 bp, Homo sapiens
tagaacagataatcagt

SEQ ID NO: 203237 - DNA, 15 bp, Homo sapiens
tagaacatattttcc

SEQ ID NO: 203238 - DNA, 14 bp, Homo sapiens
tagaacattcagat

SEQ ID NO: 203239 - DNA, 20 bp, Homo sapiens
tagaactgtcccacaaaata

SEQ ID NO: 203240 - DNA, 21 bp, Homo sapiens
tagaactttctgctttgcaca

SEQ ID NO: 203241 - DNA, 15 bp, Homo sapiens
tagaagaacagcaga

SEQ ID NO: 203242 - DNA, 16 bp, Homo sapiens
tagaagaacagcagat

SEQ ID NO: 203243 - DNA, 22 bp, Homo sapiens
tagaagagggagaaggagaggc

SEQ ID NO: 203244 - DNA, 14 bp, Homo sapiens
tagaagatgaatca

SEQ ID NO: 203245 - DNA, 14 bp, Homo sapiens
tagaagatgtttgc

SEQ ID NO: 203246 - DNA, 15 bp, Homo sapiens
tagaagatgtttgct

SEQ ID NO: 203247 - DNA, 16 bp, Homo sapiens
tagaagccaagacagt

SEQ ID NO: 203248 - DNA, 18 bp, Homo sapiens
tagaagcttcttgctcct

SEQ ID NO: 203249 - DNA, 21 bp, Homo sapiens
tagaaggaaagcatgtctctg

SEQ ID NO: 203250 - DNA, 22 bp, Homo sapiens
tagaaggaagcacctatgaaag

SEQ ID NO: 203251 - DNA, 13 bp, Homo sapiens
tagaaggagagcc

SEQ ID NO: 203252 - DNA, 21 bp, Homo sapiens
tagaaggagagcccaggcctg

SEQ ID NO: 203253 - DNA, 22 bp, Homo sapiens
tagaagggccagtcctgcctgg

SEQ ID NO: 203254 - DNA, 21 bp, Homo sapiens
tagaataatgtgggaagaaac

SEQ ID NO: 203255 - DNA, 23 bp, Homo sapiens
tagaataatgtgggaagaaacaa

SEQ ID NO: 203256 - DNA, 20 bp, Homo sapiens
tagaatactgtattgttaca

SEQ ID NO: 203257 - DNA, 18 bp, Homo sapiens
tagaatataaacacataa

SEQ ID NO: 203258 - DNA, 18 bp, Homo sapiens
tagaatataattatcgga

SEQ ID NO: 203259 - DNA, 17 bp, Homo sapiens
tagaatatactgtcttg

SEQ ID NO: 203260 - DNA, 21 bp, Homo sapiens
tagaatcagcctaggggtcag

SEQ ID NO: 203261 - DNA, 13 bp, Homo sapiens
tagaatcctgctt

SEQ ID NO: 203262 - DNA, 15 bp, Homo sapiens
tagaatcctgcttta

SEQ ID NO: 203263 - DNA, 14 bp, Homo sapiens
tagaatctcagcac

SEQ ID NO: 203264 - DNA, 20 bp, Homo sapiens
tagaatgcatgtaaggtctt

SEQ ID NO: 203265 - DNA, 16 bp, Homo sapiens
tagaatgctgtagaat

SEQ ID NO: 203266 - DNA, 20 bp, Homo sapiens
tagaatggaaaactgcctgt

SEQ ID NO: 203267 - DNA, 22 bp, Homo sapiens
tagaattccttttataagattt

SEQ ID NO: 203268 - DNA, 20 bp, Homo sapiens
tagaatttattcaattcctc

SEQ ID NO: 203269 - DNA, 13 bp, Homo sapiens
tagaatttcctaa

SEQ ID NO: 203270 - DNA, 14 bp, Homo sapiens
tagacaaaggcctt

SEQ ID NO: 203271 - DNA, 15 bp, Homo sapiens
tagacaaaggcctta

SEQ ID NO: 203272 - DNA, 19 bp, Homo sapiens
tagacaaccatagaactgt

SEQ ID NO: 203273 - DNA, 20 bp, Homo sapiens
tagacaaggttgctgttgtg

SEQ ID NO: 203274 - DNA, 17 bp, Homo sapiens
tagacaatgtggaatta

SEQ ID NO: 203275 - DNA, 17 bp, Homo sapiens
tagacacccattttcac

SEQ ID NO: 203276 - DNA, 18 bp, Homo sapiens
tagacagtattgccacct

SEQ ID NO: 203277 - DNA, 20 bp, Homo sapiens
tagacagtattgccacctct

SEQ ID NO: 203278 - DNA, 20 bp, Homo sapiens
tagacatccccctccttgcc

SEQ ID NO: 203279 - DNA, 16 bp, Homo sapiens
tagaccccaagcattc

SEQ ID NO: 203280 - DNA, 18 bp, Homo sapiens
tagaccctcccccaccat

SEQ ID NO: 203281 - DNA, 17 bp, Homo sapiens
tagacctcatctccaag

SEQ ID NO: 203282 - DNA, 18 bp, Homo sapiens
tagacgcccctcccaagc

SEQ ID NO: 203283 - DNA, 14 bp, Homo sapiens
tagactaggagacc

SEQ ID NO: 203284 - DNA, 20 bp, Homo sapiens
tagactaggagaccagaagt

SEQ ID NO: 203285 - DNA, 19 bp, Homo sapiens
tagactctgtaacatcact

SEQ ID NO: 203286 - DNA, 20 bp, Homo sapiens
tagactctgtaaccacctct

SEQ ID NO: 203287 - DNA, 21 bp, Homo sapiens
tagactggagtgaggcttcca

SEQ ID NO: 203288 - DNA, 15 bp, Homo sapiens
tagacttcccaacag

SEQ ID NO: 203289 - DNA, 19 bp, Homo sapiens
tagacttcccaacagcctt

SEQ ID NO: 203290 - DNA, 17 bp, Homo sapiens
tagacttccccatcccg

SEQ ID NO: 203291 - DNA, 18 bp, Homo sapiens
tagacttcgaaaacagat

SEQ ID NO: 203292 - DNA, 21 bp, Homo sapiens
tagacttcgaaaacagatgag

SEQ ID NO: 203293 - DNA, 22 bp, Homo sapiens
tagacttcgactcaggatccag

SEQ ID NO: 203294 - DNA, 21 bp, Homo sapiens
tagacttgaaagttttccagt

SEQ ID NO: 203295 - DNA, 18 bp, Homo sapiens
tagacttgtgctgatcgt

SEQ ID NO: 203296 - DNA, 20 bp, Homo sapiens
tagactttaattcttctctt

SEQ ID NO: 203297 - DNA, 17 bp, Homo sapiens
tagactttagaaataaa

SEQ ID NO: 203298 - DNA, 18 bp, Homo sapiens
tagactttagaaataaat

SEQ ID NO: 203299 - DNA, 11 bp, Homo sapiens
tagactttctg

SEQ ID NO: 203300 - DNA, 20 bp, Homo sapiens
tagagaaaataaatttaact

SEQ ID NO: 203301 - DNA, 15 bp, Homo sapiens
tagagaacccagatg

SEQ ID NO: 203302 - DNA, 22 bp, Homo sapiens
tagagaaggacccggaggggcc

SEQ ID NO: 203303 - DNA, 15 bp, Homo sapiens
tagagacagaagcag

SEQ ID NO: 203304 - DNA, 24 bp, Homo sapiens
tagagacagggactgtataaacaa

SEQ ID NO: 203305 - DNA, 18 bp, Homo sapiens
tagagactagacaaataa

SEQ ID NO: 203306 - DNA, 19 bp, Homo sapiens
tagagacttctaaatcata

SEQ ID NO: 203307 - DNA, 14 bp, Homo sapiens
tagagagagagaga

SEQ ID NO: 203308 - DNA, 17 bp, Homo sapiens
tagagaggtagcgagct

SEQ ID NO: 203309 - DNA, 18 bp, Homo sapiens
tagagaggtagcgagctg

SEQ ID NO: 203310 - DNA, 20 bp, Homo sapiens
tagagatatatatacttgtg

SEQ ID NO: 203311 - DNA, 20 bp, Homo sapiens
tagagatatgcagaaggaag

SEQ ID NO: 203312 - DNA, 19 bp, Homo sapiens
tagagatatttaaaagaca

SEQ ID NO: 203313 - DNA, 17 bp, Homo sapiens
tagagatattttccatt

SEQ ID NO: 203314 - DNA, 17 bp, Homo sapiens
tagagatatttttatat

SEQ ID NO: 203315 - DNA, 22 bp, Homo sapiens
tagagatctcagccctaaacct

SEQ ID NO: 203316 - DNA, 21 bp, Homo sapiens
tagagatgagctttcttttta

SEQ ID NO: 203317 - DNA, 14 bp, Homo sapiens
tagagatgcctccc

SEQ ID NO: 203318 - DNA, 17 bp, Homo sapiens
tagccaggaagccccgc

SEQ ID NO: 203319 - DNA, 23 bp, Homo sapiens
tagccaggaagccccgctcaggt

SEQ ID NO: 203320 - DNA, 19 bp, Homo sapiens
tagccaggagtctgtgctc

SEQ ID NO: 203321 - DNA, 15 bp, Homo sapiens
tagccagtcattgta

SEQ ID NO: 203322 - DNA, 20 bp, Homo sapiens
tagccatggctcaggcaagc

SEQ ID NO: 203323 - DNA, 18 bp, Homo sapiens
tagccattgtcgtttcat

SEQ ID NO: 203324 - DNA, 17 bp, Homo sapiens
tagccattttgtaactg

SEQ ID NO: 203325 - DNA, 13 bp, Homo sapiens
tagcccaccctgc

SEQ ID NO: 203326 - DNA, 20 bp, Homo sapiens
tagcccagtccctggagctg

SEQ ID NO: 203327 - DNA, 14 bp, Homo sapiens
tagccccagggtga

SEQ ID NO: 203328 - DNA, 18 bp, Homo sapiens
tagcccccaggctgctgg

SEQ ID NO: 203329 - DNA, 18 bp, Homo sapiens
tagcccggatgcccaccc

SEQ ID NO: 203330 - DNA, 15 bp, Homo sapiens
tagcccggccaagga

SEQ ID NO: 203331 - DNA, 18 bp, Homo sapiens
tagccctccccctcaacc

SEQ ID NO: 203332 - DNA, 13 bp, Homo sapiens
tagccctcctgag

SEQ ID NO: 203333 - DNA, 16 bp, Homo sapiens
tagccctcctgagcac

SEQ ID NO: 203334 - DNA, 16 bp, Homo sapiens
tagccctggccagagg

SEQ ID NO: 203335 - DNA, 23 bp, Homo sapiens
tagccgggtgtggcacgcacctg

SEQ ID NO: 203336 - DNA, 18 bp, Homo sapiens
tagccgtccatggcacca

SEQ ID NO: 203337 - DNA, 22 bp, Homo sapiens
tagcctccgtttatgggccttg

SEQ ID NO: 203338 - DNA, 16 bp, Homo sapiens
tagcctctcccacccg

SEQ ID NO: 203339 - DNA, 15 bp, Homo sapiens
tagccttgctgtaga

SEQ ID NO: 203340 - DNA, 15 bp, Homo sapiens
tagccttgtgccctg

SEQ ID NO: 203341 - DNA, 18 bp, Homo sapiens
tagcgagctgctctgcta

SEQ ID NO: 203342 - DNA, 17 bp, Homo sapiens
tagcgtcctgaggaata

SEQ ID NO: 203343 - DNA, 20 bp, Homo sapiens
tagctaacattttaaataaa

SEQ ID NO: 203344 - DNA, 12 bp, Homo sapiens
tagctaatgtaa

SEQ ID NO: 203345 - DNA, 17 bp, Homo sapiens
tagctacacagcatctg

SEQ ID NO: 203346 - DNA, 23 bp, Homo sapiens
tagctagactaggagaccagaag

SEQ ID NO: 203347 - DNA, 15 bp, Homo sapiens
tagctagctatttct

SEQ ID NO: 203348 - DNA, 17 bp, Homo sapiens
tagctagctatttctat

SEQ ID NO: 203349 - DNA, 18 bp, Homo sapiens
tagctagttatgtgagaa

SEQ ID NO: 203350 - DNA, 20 bp, Homo sapiens
tagctagttatgtgagaaag

SEQ ID NO: 203351 - DNA, 17 bp, Homo sapiens
tagctagtttaaaatta

SEQ ID NO: 203352 - DNA, 14 bp, Homo sapiens
tagctatatccatg

SEQ ID NO: 203353 - DNA, 16 bp, Homo sapiens
tagctatatccatgta

SEQ ID NO: 203354 - DNA, 18 bp, Homo sapiens
tagctatatccatgtact

SEQ ID NO: 203355 - DNA, 21 bp, Homo sapiens
tagctatatccatgtactgta

SEQ ID NO: 203356 - DNA, 16 bp, Homo sapiens
tagctatgtgaccttg

SEQ ID NO: 203357 - DNA, 18 bp, Homo sapiens
tagctcagccccagccca

SEQ ID NO: 203358 - DNA, 20 bp, Homo sapiens
tagctcagccccagcccagc

SEQ ID NO: 203359 - DNA, 11 bp, Homo sapiens
tagctcagttt

SEQ ID NO: 203360 - DNA, 12 bp, Homo sapiens
tagctcagttta

SEQ ID NO: 203361 - DNA, 16 bp, Homo sapiens
tagctccctcctccca

SEQ ID NO: 203362 - DNA, 17 bp, Homo sapiens
tagctccctcctcccat

SEQ ID NO: 203363 - DNA, 18 bp, Homo sapiens
tagctccctcctcccatc

SEQ ID NO: 203364 - DNA, 22 bp, Homo sapiens
cctccaagctccatctccactc

SEQ ID NO: 203365 - DNA, 22 bp, Homo sapiens
cctccaatcccaccaaccctca

SEQ ID NO: 203366 - DNA, 19 bp, Homo sapiens
cctccaatcctttccaccc

SEQ ID NO: 203367 - DNA, 17 bp, Homo sapiens
cctccaattctactagt

SEQ ID NO: 203368 - DNA, 13 bp, Homo sapiens
cctccacaccagt

SEQ ID NO: 203369 - DNA, 18 bp, Homo sapiens
cctccacacctccacccg

SEQ ID NO: 203370 - DNA, 15 bp, Homo sapiens
cctccacatcccagc

SEQ ID NO: 203371 - DNA, 19 bp, Homo sapiens
cctccacatcccagcagcc

SEQ ID NO: 203372 - DNA, 22 bp, Homo sapiens
cctccaccacaagagctccttg

SEQ ID NO: 203373 - DNA, 19 bp, Homo sapiens
cctccacccagcccctggc

SEQ ID NO: 203374 - DNA, 15 bp, Homo sapiens
cctccaccccagtcc

SEQ ID NO: 203375 - DNA, 19 bp, Homo sapiens
cctccaccccagtccccgg

SEQ ID NO: 203376 - DNA, 19 bp, Homo sapiens
cctccacccccgccacggc

SEQ ID NO: 203377 - DNA, 15 bp, Homo sapiens
cctccacccgtcctg

SEQ ID NO: 203378 - DNA, 17 bp, Homo sapiens
cctccaccgagccagct

SEQ ID NO: 203379 - DNA, 12 bp, Homo sapiens
cctccacctcct

SEQ ID NO: 203380 - DNA, 18 bp, Homo sapiens
cctccacctgggagatgc

SEQ ID NO: 203381 - DNA, 14 bp, Homo sapiens
cctccaccttccag

SEQ ID NO: 203382 - DNA, 15 bp, Homo sapiens
cctccaccttccagg

SEQ ID NO: 203383 - DNA, 14 bp, Homo sapiens
cctccactcactcc

SEQ ID NO: 203384 - DNA, 12 bp, Homo sapiens
cctccactcccc

SEQ ID NO: 203385 - DNA, 20 bp, Homo sapiens
cctccactcccccacctgac

SEQ ID NO: 203386 - DNA, 12 bp, Homo sapiens
cctccactcctc

SEQ ID NO: 203387 - DNA, 16 bp, Homo sapiens
cctccactcctcccaa

SEQ ID NO: 203388 - DNA, 20 bp, Homo sapiens
cctccactctagttctagat

SEQ ID NO: 203389 - DNA, 12 bp, Homo sapiens
cctccagaagcc

SEQ ID NO: 203390 - DNA, 21 bp, Homo sapiens
cctccagaagcctctggctag

SEQ ID NO: 203391 - DNA, 22 bp, Homo sapiens
cctccagaagcctctggctaga

SEQ ID NO: 203392 - DNA, 10 bp, Homo sapiens
cctccagacc

SEQ ID NO: 203393 - DNA, 17 bp, Homo sapiens
cctccagaccaccagcc

SEQ ID NO: 203394 - DNA, 15 bp, Homo sapiens
cctccagacccctac

SEQ ID NO: 203395 - DNA, 22 bp, Homo sapiens
cctccagacccctaccctttcc

SEQ ID NO: 203396 - DNA, 16 bp, Homo sapiens
cctccagaccctgcct

SEQ ID NO: 203397 - DNA, 19 bp, Homo sapiens
cctccagaccctgcctgag

SEQ ID NO: 203398 - DNA, 11 bp, Homo sapiens
cctccagagcc

SEQ ID NO: 203399 - DNA, 15 bp, Homo sapiens
cctccagagccagcc

SEQ ID NO: 203400 - DNA, 16 bp, Homo sapiens
cctccagagccagcct

SEQ ID NO: 203401 - DNA, 18 bp, Homo sapiens
cctccagagccagcctgg

SEQ ID NO: 203402 - DNA, 22 bp, Homo sapiens
cctccagagccagcctgggact

SEQ ID NO: 203403 - DNA, 17 bp, Homo sapiens
cctccagcaatgcctgc

SEQ ID NO: 203404 - DNA, 13 bp, Homo sapiens
cctccagcacaga

SEQ ID NO: 203405 - DNA, 15 bp, Homo sapiens
cctccagcacagact

SEQ ID NO: 203406 - DNA, 14 bp, Homo sapiens
cctccagcccacag

SEQ ID NO: 203407 - DNA, 21 bp, Homo sapiens
cctccagcccacagtgctcag

SEQ ID NO: 203408 - DNA, 21 bp, Homo sapiens
cctccagcgagtaccccagcc

SEQ ID NO: 203409 - DNA, 16 bp, Homo sapiens
cctccagctctttcct

SEQ ID NO: 203410 - DNA, 16 bp, Homo sapiens
cctccaggcatgctgg

SEQ ID NO: 203411 - DNA, 18 bp, Homo sapiens
cctccaggcatgctggcc

SEQ ID NO: 203412 - DNA, 13 bp, Homo sapiens
cctccaggctggg

SEQ ID NO: 203413 - DNA, 14 bp, Homo sapiens
cctccaggctgggg

SEQ ID NO: 203414 - DNA, 17 bp, Homo sapiens
cctccaggctggggcct

SEQ ID NO: 203415 - DNA, 20 bp, Homo sapiens
cctccaggctggggcctggc

SEQ ID NO: 203416 - DNA, 12 bp, Homo sapiens
cctccagggccc

SEQ ID NO: 203417 - DNA, 14 bp, Homo sapiens
cctccagggccccc

SEQ ID NO: 203418 - DNA, 18 bp, Homo sapiens
cctccagggggcctgcag

SEQ ID NO: 203419 - DNA, 22 bp, Homo sapiens
cctccagggggcctgcaggccc

SEQ ID NO: 203420 - DNA, 23 bp, Homo sapiens
cctccagtacgtcccgctgctgt

SEQ ID NO: 203421 - DNA, 15 bp, Homo sapiens
cctccagtctgttct

SEQ ID NO: 203422 - DNA, 19 bp, Homo sapiens
cctccagtctgttctcaca

SEQ ID NO: 203423 - DNA, 18 bp, Homo sapiens
cctccagtgcttggctgc

SEQ ID NO: 203424 - DNA, 21 bp, Homo sapiens
cctccagtgcttggctgcccc

SEQ ID NO: 203425 - DNA, 15 bp, Homo sapiens
cctccatcccgacat

SEQ ID NO: 203426 - DNA, 15 bp, Homo sapiens
cctccatctttctac

SEQ ID NO: 203427 - DNA, 16 bp, Homo sapiens
cctccatctttctaca

SEQ ID NO: 203428 - DNA, 17 bp, Homo sapiens
cctccatgattccaagg

SEQ ID NO: 203429 - DNA, 19 bp, Homo sapiens
cctccatgctcctcacctg

SEQ ID NO: 203430 - DNA, 13 bp, Homo sapiens
cctccatgtggcc

SEQ ID NO: 203431 - DNA, 14 bp, Homo sapiens
cctccatgtggccc

SEQ ID NO: 203432 - DNA, 15 bp, Homo sapiens
cctcccaaagtgctg

SEQ ID NO: 203433 - DNA, 13 bp, Homo sapiens
cctcccaacccag

SEQ ID NO: 203434 - DNA, 12 bp, Homo sapiens
cctcccaacctc

SEQ ID NO: 203435 - DNA, 16 bp, Homo sapiens
cctcccaacctcaatg

SEQ ID NO: 203436 - DNA, 21 bp, Homo sapiens
cctcccaagcgttcctggcct

SEQ ID NO: 203437 - DNA, 18 bp, Homo sapiens
cctcccaaggtcctctca

SEQ ID NO: 203438 - DNA, 20 bp, Homo sapiens
cctcccaaggtcctctcagt

SEQ ID NO: 203439 - DNA, 11 bp, Homo sapiens
cctcccacaca

SEQ ID NO: 203440 - DNA, 15 bp, Homo sapiens
cctcccacatccccc

SEQ ID NO: 203441 - DNA, 15 bp, Homo sapiens
cctcccaccacagca

SEQ ID NO: 203442 - DNA, 20 bp, Homo sapiens
cctcccacccccttctctgc

SEQ ID NO: 203443 - DNA, 15 bp, Homo sapiens
cctcccacgctggga

SEQ ID NO: 203444 - DNA, 20 bp, Homo sapiens
cctcccacgctgggacacag

SEQ ID NO: 203445 - DNA, 23 bp, Homo sapiens
cctcccacgctgggacacagacc

SEQ ID NO: 203446 - DNA, 17 bp, Homo sapiens
cctcccagacaggccct

SEQ ID NO: 203447 - DNA, 12 bp, Homo sapiens
cctcccagccac

SEQ ID NO: 203448 - DNA, 15 bp, Homo sapiens
cctcccatctccttc

SEQ ID NO: 203449 - DNA, 21 bp, Homo sapiens
cctcccatctccttcccccag

SEQ ID NO: 203450 - DNA, 23 bp, Homo sapiens
cctcccatctccttcccccagcc

SEQ ID NO: 203451 - DNA, 19 bp, Homo sapiens
cctcccatggccttccctc

SEQ ID NO: 203452 - DNA, 19 bp, Homo sapiens
cctcccatgttgcatgcct

SEQ ID NO: 203453 - DNA, 22 bp, Homo sapiens
cctccccaccagtctcacccac

SEQ ID NO: 203454 - DNA, 20 bp, Homo sapiens
cctccccaccccaaccactc

SEQ ID NO: 203455 - DNA, 14 bp, Homo sapiens
cgctgcccagccct

SEQ ID NO: 203456 - DNA, 16 bp, Homo sapiens
cgctgcccagccctcc

SEQ ID NO: 203457 - DNA, 18 bp, Homo sapiens
cgctgcccaggctctgct

SEQ ID NO: 203458 - DNA, 17 bp, Homo sapiens
cgctgcctcctggtaac

SEQ ID NO: 203459 - DNA, 17 bp, Homo sapiens
cgctgcctggcgggcag

SEQ ID NO: 203460 - DNA, 22 bp, Homo sapiens
cgctgcctggcgggcagcccct

SEQ ID NO: 203461 - DNA, 18 bp, Homo sapiens
cgctgctctagctggcag

SEQ ID NO: 203462 - DNA, 20 bp, Homo sapiens
cgctgctcttatgccatttg

SEQ ID NO: 203463 - DNA, 20 bp, Homo sapiens
cgctgctgctgctgcgccct

SEQ ID NO: 203464 - DNA, 12 bp, Homo sapiens
cgctgctgcttt

SEQ ID NO: 203465 - DNA, 17 bp, Homo sapiens
cgctgctgtgctctggg

SEQ ID NO: 203466 - DNA, 19 bp, Homo sapiens
cgctgctgtgctctgggga

SEQ ID NO: 203467 - DNA, 20 bp, Homo sapiens
cgctggaatccagaaggaag

SEQ ID NO: 203468 - DNA, 22 bp, Homo sapiens
cgctggaatccagaaggaagct

SEQ ID NO: 203469 - DNA, 23 bp, Homo sapiens
cgctgggagaaaagccagatgac

SEQ ID NO: 203470 - DNA, 13 bp, Homo sapiens
cgctgggagagcc

SEQ ID NO: 203471 - DNA, 14 bp, Homo sapiens
cgctgggagagcca

SEQ ID NO: 203472 - DNA, 21 bp, Homo sapiens
cgctgggatttcttcgctgct

SEQ ID NO: 203473 - DNA, 16 bp, Homo sapiens
cgctgtctccagaccc

SEQ ID NO: 203474 - DNA, 19 bp, Homo sapiens
cgctgtgatgcatgagctc

SEQ ID NO: 203475 - DNA, 20 bp, Homo sapiens
cgctgttgcaaattccaccc

SEQ ID NO: 203476 - DNA, 16 bp, Homo sapiens
cgcttcacccctgcac

SEQ ID NO: 203477 - DNA, 15 bp, Homo sapiens
cgcttcataggcaga

SEQ ID NO: 203478 - DNA, 17 bp, Homo sapiens
cgcttctgaatgctgct

SEQ ID NO: 203479 - DNA, 14 bp, Homo sapiens
cgcttctgcctgca

SEQ ID NO: 203480 - DNA, 15 bp, Homo sapiens
cgcttctgccttttc

SEQ ID NO: 203481 - DNA, 11 bp, Homo sapiens
cgcttcttttt

SEQ ID NO: 203482 - DNA, 14 bp, Homo sapiens
cgcttgagcccagg

SEQ ID NO: 203483 - DNA, 15 bp, Homo sapiens
cgcttgagcccagga

SEQ ID NO: 203484 - DNA, 16 bp, Homo sapiens
cgcttgagcccaggag

SEQ ID NO: 203485 - DNA, 20 bp, Homo sapiens
cgcttgccgggcctgggcct

SEQ ID NO: 203486 - DNA, 21 bp, Homo sapiens
cgcttggctccatgctcctca

SEQ ID NO: 203487 - DNA, 19 bp, Homo sapiens
cgcttttgctggtcactgc

SEQ ID NO: 203488 - DNA, 11 bp, Homo sapiens
cggaaacagaa

SEQ ID NO: 203489 - DNA, 14 bp, Homo sapiens
cggaagcagtgcct

SEQ ID NO: 203490 - DNA, 16 bp, Homo sapiens
cggaagcctgtcctca

SEQ ID NO: 203491 - DNA, 14 bp, Homo sapiens
cggaagctcctggt

SEQ ID NO: 203492 - DNA, 21 bp, Homo sapiens
cggaagtggcctgagaagagt

SEQ ID NO: 203493 - DNA, 15 bp, Homo sapiens
cggaagtggtgggga

SEQ ID NO: 203494 - DNA, 15 bp, Homo sapiens
cggaatcctgtcctc

SEQ ID NO: 203495 - DNA, 20 bp, Homo sapiens
cggacccaccaaactgcaca

SEQ ID NO: 203496 - DNA, 23 bp, Homo sapiens
cggacccaccccaactctcccca

SEQ ID NO: 203497 - DNA, 24 bp, Homo sapiens
cggacccaccccaactctccccag

SEQ ID NO: 203498 - DNA, 16 bp, Homo sapiens
cggaccgcatcctcca

SEQ ID NO: 203499 - DNA, 20 bp, Homo sapiens
cggaccgcatcctccagggg

SEQ ID NO: 203500 - DNA, 13 bp, Homo sapiens
cggaccgcgtaga

SEQ ID NO: 203501 - DNA, 19 bp, Homo sapiens
cggaccggagcggctgagg

SEQ ID NO: 203502 - DNA, 13 bp, Homo sapiens
cggacgctggctc

SEQ ID NO: 203503 - DNA, 13 bp, Homo sapiens
cggacgggacagc

SEQ ID NO: 203504 - DNA, 17 bp, Homo sapiens
cggacgggacagcggcc

SEQ ID NO: 203505 - DNA, 15 bp, Homo sapiens
cggacgtttccatca

SEQ ID NO: 203506 - DNA, 21 bp, Homo sapiens
cggactccatggcccttcctg

SEQ ID NO: 203507 - DNA, 15 bp, Homo sapiens
cggactcccgggcca

SEQ ID NO: 203508 - DNA, 18 bp, Homo sapiens
cggactcccgggccacgc

SEQ ID NO: 203509 - DNA, 23 bp, Homo sapiens
cggactcccgggccacgccccag

SEQ ID NO: 203510 - DNA, 15 bp, Homo sapiens
cggagacagtgatct

SEQ ID NO: 203511 - DNA, 15 bp, Homo sapiens
cggagacgggaccgg

SEQ ID NO: 203512 - DNA, 13 bp, Homo sapiens
cggagagaaaaaa

SEQ ID NO: 203513 - DNA, 12 bp, Homo sapiens
cggagaggctgt

SEQ ID NO: 203514 - DNA, 19 bp, Homo sapiens
cggagaggctgtctggggc

SEQ ID NO: 203515 - DNA, 15 bp, Homo sapiens
cggagagggagtcag

SEQ ID NO: 203516 - DNA, 19 bp, Homo sapiens
cggagattggacggcctga

SEQ ID NO: 203517 - DNA, 14 bp, Homo sapiens
cggagcctttggaa

SEQ ID NO: 203518 - DNA, 18 bp, Homo sapiens
cggagctaacactggccc

SEQ ID NO: 203519 - DNA, 19 bp, Homo sapiens
cggagctaacactggcccc

SEQ ID NO: 203520 - DNA, 23 bp, Homo sapiens
cggagctgcagcgcctcctggac

SEQ ID NO: 203521 - DNA, 19 bp, Homo sapiens
cggagctgcatggacgcct

SEQ ID NO: 203522 - DNA, 23 bp, Homo sapiens
cggagctgcatggacgcctggct

SEQ ID NO: 203523 - DNA, 19 bp, Homo sapiens
cggagctgggaaggtcccg

SEQ ID NO: 203524 - DNA, 12 bp, Homo sapiens
cggaggaggtgg

SEQ ID NO: 203525 - DNA, 21 bp, Homo sapiens
cggaggcaaaaggcagtgggg

SEQ ID NO: 203526 - DNA, 14 bp, Homo sapiens
cggaggccaggccc

SEQ ID NO: 203527 - DNA, 15 bp, Homo sapiens
cggaggccaggccct

SEQ ID NO: 203528 - DNA, 14 bp, Homo sapiens
cggaggcgcccacc

SEQ ID NO: 203529 - DNA, 16 bp, Homo sapiens
cggaggcgcccacctg

SEQ ID NO: 203530 - DNA, 17 bp, Homo sapiens
cggaggcgcccacctgc

SEQ ID NO: 203531 - DNA, 21 bp, Homo sapiens
cggaggcgcccacctgcccag

SEQ ID NO: 203532 - DNA, 17 bp, Homo sapiens
cggaggcttgggaccgc

SEQ ID NO: 203533 - DNA, 23 bp, Homo sapiens
cggaggcttgtcagagctgggag

SEQ ID NO: 203534 - DNA, 12 bp, Homo sapiens
cggagggaccag

SEQ ID NO: 203535 - DNA, 22 bp, Homo sapiens
cggagggcccctgcgtgggggc

SEQ ID NO: 203536 - DNA, 15 bp, Homo sapiens
cggaggggcttggag

SEQ ID NO: 203537 - DNA, 18 bp, Homo sapiens
cggaggggcttggagcag

SEQ ID NO: 203538 - DNA, 20 bp, Homo sapiens
cggaggggcttggagcagag

SEQ ID NO: 203539 - DNA, 13 bp, Homo sapiens
cggaggtggcagc

SEQ ID NO: 203540 - DNA, 13 bp, Homo sapiens
cggagttcagagg

SEQ ID NO: 203541 - DNA, 17 bp, Homo sapiens
cggagttcctaacagga

SEQ ID NO: 203542 - DNA, 20 bp, Homo sapiens
cggatctagccatggctggc

SEQ ID NO: 203543 - DNA, 14 bp, Homo sapiens
cggatgaggtcatt

SEQ ID NO: 203544 - DNA, 18 bp, Homo sapiens
cggatgaggtcatttcta

SEQ ID NO: 203545 - DNA, 15 bp, Homo sapiens
cggatggaaggagag

SEQ ID NO: 203546 - DNA, 17 bp, Homo sapiens
cggattccggccctggc

SEQ ID NO: 203547 - DNA, 20 bp, Homo sapiens
cggattccggccctggctgg

SEQ ID NO: 203548 - DNA, 14 bp, Homo sapiens
cggcacagggtctg

SEQ ID NO: 203549 - DNA, 19 bp, Homo sapiens
cggcacagggtctgctctt

SEQ ID NO: 203550 - DNA, 21 bp, Homo sapiens
cggcacagggtctgctctttc

SEQ ID NO: 203551 - DNA, 15 bp, Homo sapiens
cggcaccgcccaccc

SEQ ID NO: 203552 - DNA, 16 bp, Homo sapiens
cggcaccgcccaccca

SEQ ID NO: 203553 - DNA, 15 bp, Homo sapiens
cggcactgtggcctt

SEQ ID NO: 203554 - DNA, 16 bp, Homo sapiens
cggcagaactctctgt

SEQ ID NO: 203555 - DNA, 16 bp, Homo sapiens
cggcagaggcagggcc

SEQ ID NO: 203556 - DNA, 16 bp, Homo sapiens
cggcagccccacttca

SEQ ID NO: 203557 - DNA, 12 bp, Homo sapiens
cggcagcccccc

SEQ ID NO: 203558 - DNA, 19 bp, Homo sapiens
cggcagccccccagtgtcc

SEQ ID NO: 203559 - DNA, 13 bp, Homo sapiens
cggcagcctggtt

SEQ ID NO: 203560 - DNA, 21 bp, Homo sapiens
cggcagctcttctgggcagag

SEQ ID NO: 203561 - DNA, 13 bp, Homo sapiens
ttttactcccctt

SEQ ID NO: 203562 - DNA, 13 bp, Homo sapiens
ttttactgaacaa

SEQ ID NO: 203563 - DNA, 15 bp, Homo sapiens
ttttactgcttttaa

SEQ ID NO: 203564 - DNA, 13 bp, Homo sapiens
ttttactgtctgt

SEQ ID NO: 203565 - DNA, 18 bp, Homo sapiens
ttttacttgttcatttct

SEQ ID NO: 203566 - DNA, 18 bp, Homo sapiens
ttttactttgtgcaatat

SEQ ID NO: 203567 - DNA, 18 bp, Homo sapiens
ttttagaacagaaaacaa

SEQ ID NO: 203568 - DNA, 18 bp, Homo sapiens
ttttagagattaatttgt

SEQ ID NO: 203569 - DNA, 16 bp, Homo sapiens
ttttagaggtgagttt

SEQ ID NO: 203570 - DNA, 19 bp, Homo sapiens
ttttagatgagattgtttt

SEQ ID NO: 203571 - DNA, 13 bp, Homo sapiens
ttttagattccta

SEQ ID NO: 203572 - DNA, 21 bp, Homo sapiens
ttttagcaatttatacaatat

SEQ ID NO: 203573 - DNA, 20 bp, Homo sapiens
ttttagcagttctgcaaata

SEQ ID NO: 203574 - DNA, 19 bp, Homo sapiens
ttttagcctagttcatcca

SEQ ID NO: 203575 - DNA, 15 bp, Homo sapiens
ttttaggagacagtc

SEQ ID NO: 203576 - DNA, 19 bp, Homo sapiens
ttttaggcagggatttgag

SEQ ID NO: 203577 - DNA, 23 bp, Homo sapiens
ttttagggagaagggcttttctt

SEQ ID NO: 203578 - DNA, 20 bp, Homo sapiens
ttttaggtcatccaacctct

SEQ ID NO: 203579 - DNA, 21 bp, Homo sapiens
ttttaggtcatccaacctctt

SEQ ID NO: 203580 - DNA, 16 bp, Homo sapiens
ttttaggtgttgattt

SEQ ID NO: 203581 - DNA, 22 bp, Homo sapiens
ttttaggtgttgattttctgtt

SEQ ID NO: 203582 - DNA, 21 bp, Homo sapiens
ttttagtacccacctgagctt

SEQ ID NO: 203583 - DNA, 22 bp, Homo sapiens
ttttagtgcaatttcttctgta

SEQ ID NO: 203584 - DNA, 14 bp, Homo sapiens
ttttagttggaatg

SEQ ID NO: 203585 - DNA, 22 bp, Homo sapiens
ttttagtttgctaagagttttc

SEQ ID NO: 203586 - DNA, 12 bp, Homo sapiens
ttttataaatta

SEQ ID NO: 203587 - DNA, 13 bp, Homo sapiens
ttttataaattaa

SEQ ID NO: 203588 - DNA, 13 bp, Homo sapiens
ttttataactcat

SEQ ID NO: 203589 - DNA, 13 bp, Homo sapiens
ttttatacaagaa

SEQ ID NO: 203590 - DNA, 22 bp, Homo sapiens
ttttatagcttaactaatttga

SEQ ID NO: 203591 - DNA, 20 bp, Homo sapiens
ttttatatataaaataaata

SEQ ID NO: 203592 - DNA, 15 bp, Homo sapiens
ttttatatctgtaaa

SEQ ID NO: 203593 - DNA, 13 bp, Homo sapiens
ttttatatttagt

SEQ ID NO: 203594 - DNA, 17 bp, Homo sapiens
ttttatcatgacatgtt

SEQ ID NO: 203595 - DNA, 19 bp, Homo sapiens
ttttatcatgacatgttat

SEQ ID NO: 203596 - DNA, 23 bp, Homo sapiens
ttttatctgttaaccaaataaaa

SEQ ID NO: 203597 - DNA, 11 bp, Homo sapiens
ttttatctttt

SEQ ID NO: 203598 - DNA, 21 bp, Homo sapiens
ttttatgaggagtgaacattt

SEQ ID NO: 203599 - DNA, 13 bp, Homo sapiens
ttttatgtacttt

SEQ ID NO: 203600 - DNA, 16 bp, Homo sapiens
ttttatgtcatactct

SEQ ID NO: 203601 - DNA, 18 bp, Homo sapiens
ttttatgtgcctttttgt

SEQ ID NO: 203602 - DNA, 14 bp, Homo sapiens
ttttattcaagtta

SEQ ID NO: 203603 - DNA, 20 bp, Homo sapiens
ttttattcacttgtgtttgt

SEQ ID NO: 203604 - DNA, 21 bp, Homo sapiens
ttttattgatgtgaaattaaa

SEQ ID NO: 203605 - DNA, 18 bp, Homo sapiens
ttttattgcctttagaaa

SEQ ID NO: 203606 - DNA, 13 bp, Homo sapiens
ttttattgctgga

SEQ ID NO: 203607 - DNA, 17 bp, Homo sapiens
ttttatttataaatgag

SEQ ID NO: 203608 - DNA, 12 bp, Homo sapiens
ttttatttcagt

SEQ ID NO: 203609 - DNA, 13 bp, Homo sapiens
ttttatttctaag

SEQ ID NO: 203610 - DNA, 11 bp, Homo sapiens
ttttattttat

SEQ ID NO: 203611 - DNA, 14 bp, Homo sapiens
ttttattttcctgt

SEQ ID NO: 203612 - DNA, 18 bp, Homo sapiens
ttttcaaaatacttcttt

SEQ ID NO: 203613 - DNA, 14 bp, Homo sapiens
ttttcaaaatggag

SEQ ID NO: 203614 - DNA, 14 bp, Homo sapiens
ttttcaaattgtat

SEQ ID NO: 203615 - DNA, 21 bp, Homo sapiens
ttttcaacgcagccctgcttt

SEQ ID NO: 203616 - DNA, 15 bp, Homo sapiens
ttttcaagcaaatat

SEQ ID NO: 203617 - DNA, 16 bp, Homo sapiens
ttttcaatatttatta

SEQ ID NO: 203618 - DNA, 20 bp, Homo sapiens
ttttcacagtatgggctaca

SEQ ID NO: 203619 - DNA, 18 bp, Homo sapiens
ttttcaccatctttctaa

SEQ ID NO: 203620 - DNA, 20 bp, Homo sapiens
ttttcactgctggctgcctt

SEQ ID NO: 203621 - DNA, 21 bp, Homo sapiens
ttttcacttgtcttgctctta

SEQ ID NO: 203622 - DNA, 22 bp, Homo sapiens
ttttcagaaaatattatgtgtt

SEQ ID NO: 203623 - DNA, 22 bp, Homo sapiens
ttttcagaacctcttccccaga

SEQ ID NO: 203624 - DNA, 21 bp, Homo sapiens
ttttcagcacccccacccacc

SEQ ID NO: 203625 - DNA, 22 bp, Homo sapiens
ttttcaggtaggcccttgtcct

SEQ ID NO: 203626 - DNA, 23 bp, Homo sapiens
ttttcagtcaagttccgtctcct

SEQ ID NO: 203627 - DNA, 13 bp, Homo sapiens
ttttcatattgtg

SEQ ID NO: 203628 - DNA, 14 bp, Homo sapiens
ttttcatattgtgc

SEQ ID NO: 203629 - DNA, 15 bp, Homo sapiens
ttttcatcctggcct

SEQ ID NO: 203630 - DNA, 19 bp, Homo sapiens
ttttcatggaagtggcagt

SEQ ID NO: 203631 - DNA, 20 bp, Homo sapiens
ttttcattccatgtgcccag

SEQ ID NO: 203632 - DNA, 21 bp, Homo sapiens
ttttcattccatgtgcccagt

SEQ ID NO: 203633 - DNA, 18 bp, Homo sapiens
ttttccacggaaacagaa

SEQ ID NO: 203634 - DNA, 12 bp, Homo sapiens
ttttccagcaag

SEQ ID NO: 203635 - DNA, 14 bp, Homo sapiens
ttttccatctaaaa

SEQ ID NO: 203636 - DNA, 15 bp, Homo sapiens
ttttccatctaaaat

SEQ ID NO: 203637 - DNA, 18 bp, Homo sapiens
ttttccatctaaaatact

SEQ ID NO: 203638 - DNA, 17 bp, Homo sapiens
ttttcccacacatattc

SEQ ID NO: 203639 - DNA, 10 bp, Homo sapiens
ttttcccagc

SEQ ID NO: 203640 - DNA, 18 bp, Homo sapiens
ttttcccaggacaggaaa

SEQ ID NO: 203641 - DNA, 19 bp, Homo sapiens
ttttccccccactctcccc

SEQ ID NO: 203642 - DNA, 14 bp, Homo sapiens
ttttccccctaatt

SEQ ID NO: 203643 - DNA, 16 bp, Homo sapiens
ttttcccctgtcctga

SEQ ID NO: 203644 - DNA, 15 bp, Homo sapiens
ttttccctcctgaca

SEQ ID NO: 203645 - DNA, 18 bp, Homo sapiens
ttttcctattttcagccc

SEQ ID NO: 203646 - DNA, 16 bp, Homo sapiens
ttttcctgggccttct

SEQ ID NO: 203647 - DNA, 13 bp, Homo sapiens
ttttcctgtcaat

SEQ ID NO: 203648 - DNA, 18 bp, Homo sapiens
ttttccttatttcaaggg

SEQ ID NO: 203649 - DNA, 10 bp, Homo sapiens
ttttcctttg

SEQ ID NO: 203650 - DNA, 16 bp, Homo sapiens
ttttcctttgtcatca

SEQ ID NO: 203651 - DNA, 12 bp, Homo sapiens
ttttcgtttgtt

SEQ ID NO: 203652 - DNA, 21 bp, Homo sapiens
ttttctaagcaatttcttgct

SEQ ID NO: 203653 - DNA, 23 bp, Homo sapiens
ttttctacagccagtaaggcagc

SEQ ID NO: 203654 - DNA, 23 bp, Homo sapiens
ttttctacctttttttctctcct

SEQ ID NO: 203655 - DNA, 20 bp, Homo sapiens
ttttctactcgagttacaga

SEQ ID NO: 203656 - DNA, 14 bp, Homo sapiens
ttttctagactttc

SEQ ID NO: 203657 - DNA, 18 bp, Homo sapiens
ttttctagactttctgtt

SEQ ID NO: 203658 - DNA, 24 bp, Homo sapiens
ttttctagcaactgttggataata

SEQ ID NO: 203659 - DNA, 14 bp, Homo sapiens
ttttctatatttgt

SEQ ID NO: 203660 - DNA, 23 bp, Homo sapiens
ttttctattgttactctggttct

SEQ ID NO: 203661 - DNA, 12 bp, Homo sapiens
ttttctcaaata

SEQ ID NO: 203662 - DNA, 21 bp, Homo sapiens
ttttctcgagtccaaaatcat

SEQ ID NO: 203663 - DNA, 19 bp, Homo sapiens
ttttctctcaaatgataca

SEQ ID NO: 203664 - DNA, 23 bp, Homo sapiens
ttttctctttcctctaactcatt

SEQ ID NO: 203665 - DNA, 15 bp, Homo sapiens
ttttctctttctctc

SEQ ID NO: 203666 - DNA, 16 bp, Homo sapiens
ttttctgaattcataa

SEQ ID NO: 203667 - DNA, 23 bp, Homo sapiens
ttttctgatgggaggaaagtagc

SEQ ID NO: 203668 - DNA, 19 bp, Homo sapiens
ttttctgcccaactttcat

SEQ ID NO: 203669 - DNA, 20 bp, Homo sapiens
ttttctggtagatagaaata

SEQ ID NO: 203670 - DNA, 22 bp, Homo sapiens
ttttctgtgaagccctttgcct

SEQ ID NO: 203671 - DNA, 13 bp, Homo sapiens
ttttcttacataa

SEQ ID NO: 203672 - DNA, 16 bp, Homo sapiens
ttttcttaccctctct

SEQ ID NO: 203673 - DNA, 15 bp, Homo sapiens
ttttcttcccatttg

SEQ ID NO: 203674 - DNA, 21 bp, Homo sapiens
ttttcttgccaatgaggtctg

SEQ ID NO: 203675 - DNA, 15 bp, Homo sapiens
ttttctttccttaaa

SEQ ID NO: 203676 - DNA, 16 bp, Homo sapiens
ttttctttccttaaaa

SEQ ID NO: 203677 - DNA, 14 bp, Homo sapiens
ttttctttctatgt

SEQ ID NO: 203678 - DNA, 22 bp, Homo sapiens
ttttctttctatgtagaactgt

SEQ ID NO: 203679 - DNA, 15 bp, Homo sapiens
ccagagtagcccagg

SEQ ID NO: 203680 - DNA, 23 bp, Homo sapiens
ccagagtctgagcccccggctag

SEQ ID NO: 203681 - DNA, 21 bp, Homo sapiens
ccagagtgaaagggctatggc

SEQ ID NO: 203682 - DNA, 19 bp, Homo sapiens
ccagagtggcctggccagg

SEQ ID NO: 203683 - DNA, 20 bp, Homo sapiens
ccagataccagcccctgtat

SEQ ID NO: 203684 - DNA, 14 bp, Homo sapiens
ccagatagagctgg

SEQ ID NO: 203685 - DNA, 21 bp, Homo sapiens
ccagatatgaacagggcccag

SEQ ID NO: 203686 - DNA, 18 bp, Homo sapiens
ccagatccagactgtaag

SEQ ID NO: 203687 - DNA, 16 bp, Homo sapiens
ccagatcccagaagga

SEQ ID NO: 203688 - DNA, 13 bp, Homo sapiens
ccagatctgcctg

SEQ ID NO: 203689 - DNA, 18 bp, Homo sapiens
ccagatctgcctgggcct

SEQ ID NO: 203690 - DNA, 22 bp, Homo sapiens
ccagatctgcctgggcctgtgc

SEQ ID NO: 203691 - DNA, 23 bp, Homo sapiens
ccagatgaactgagaaggtcaga

SEQ ID NO: 203692 - DNA, 16 bp, Homo sapiens
ccagatgacaccctaa

SEQ ID NO: 203693 - DNA, 16 bp, Homo sapiens
ccagatgacagggagc

SEQ ID NO: 203694 - DNA, 14 bp, Homo sapiens
ccagatgagaagtt

SEQ ID NO: 203695 - DNA, 17 bp, Homo sapiens
ccagatgctactggact

SEQ ID NO: 203696 - DNA, 18 bp, Homo sapiens
ccagattgacgacaagtg

SEQ ID NO: 203697 - DNA, 21 bp, Homo sapiens
ccagattgacgacaagtgctg

SEQ ID NO: 203698 - DNA, 17 bp, Homo sapiens
ccagattgggggccctg

SEQ ID NO: 203699 - DNA, 19 bp, Homo sapiens
ccagattgggggccctggg

SEQ ID NO: 203700 - DNA, 13 bp, Homo sapiens
ccagattgtagct

SEQ ID NO: 203701 - DNA, 16 bp, Homo sapiens
ccagattgtagctctt

SEQ ID NO: 203702 - DNA, 24 bp, Homo sapiens
ccagattttttacagctgcctgca

SEQ ID NO: 203703 - DNA, 13 bp, Homo sapiens
ccagcaacatctc

SEQ ID NO: 203704 - DNA, 22 bp, Homo sapiens
ccagcaacatctcgagccccct

SEQ ID NO: 203705 - DNA, 18 bp, Homo sapiens
ccagcaaccctcctatca

SEQ ID NO: 203706 - DNA, 15 bp, Homo sapiens
ccagcaactccaact

SEQ ID NO: 203707 - DNA, 18 bp, Homo sapiens
ccagcaacttgtcttttt

SEQ ID NO: 203708 - DNA, 18 bp, Homo sapiens
ccagcaagagcacaagag

SEQ ID NO: 203709 - DNA, 19 bp, Homo sapiens
ccagcaaggcacaggctcc

SEQ ID NO: 203710 - DNA, 14 bp, Homo sapiens
ccagcaaggcaggt

SEQ ID NO: 203711 - DNA, 16 bp, Homo sapiens
ccagcaagtcccagac

SEQ ID NO: 203712 - DNA, 17 bp, Homo sapiens
ccagcaatgcctgcctg

SEQ ID NO: 203713 - DNA, 12 bp, Homo sapiens
ccagcacagact

SEQ ID NO: 203714 - DNA, 18 bp, Homo sapiens
ccagcacagagcgtcctt

SEQ ID NO: 203715 - DNA, 12 bp, Homo sapiens
ccagcacagggg

SEQ ID NO: 203716 - DNA, 14 bp, Homo sapiens
ccagcacaggggcc

SEQ ID NO: 203717 - DNA, 15 bp, Homo sapiens
ccagcacaggggccc

SEQ ID NO: 203718 - DNA, 18 bp, Homo sapiens
ccagcacaggggccccag

SEQ ID NO: 203719 - DNA, 15 bp, Homo sapiens
ccagcacatctctga

SEQ ID NO: 203720 - DNA, 14 bp, Homo sapiens
ccagcacccagcaa

SEQ ID NO: 203721 - DNA, 18 bp, Homo sapiens
ccagcacccagcaactcc

SEQ ID NO: 203722 - DNA, 14 bp, Homo sapiens
ccagcacctgccag

SEQ ID NO: 203723 - DNA, 15 bp, Homo sapiens
ccagcacctgccagg

SEQ ID NO: 203724 - DNA, 17 bp, Homo sapiens
ccagcacctgccagggc

SEQ ID NO: 203725 - DNA, 13 bp, Homo sapiens
ccagcactcccag

SEQ ID NO: 203726 - DNA, 14 bp, Homo sapiens
ccagcactcccagg

SEQ ID NO: 203727 - DNA, 19 bp, Homo sapiens
ccagcactcccagggcccg

SEQ ID NO: 203728 - DNA, 15 bp, Homo sapiens
ccagcactgtctcag

SEQ ID NO: 203729 - DNA, 15 bp, Homo sapiens
ccagcactttgggag

SEQ ID NO: 203730 - DNA, 22 bp, Homo sapiens
ccagcactttgggaggccaagg

SEQ ID NO: 203731 - DNA, 16 bp, Homo sapiens
ccagcagacttgagtc

SEQ ID NO: 203732 - DNA, 12 bp, Homo sapiens
ccagcagagccg

SEQ ID NO: 203733 - DNA, 20 bp, Homo sapiens
ccagcagagccgttcctggg

SEQ ID NO: 203734 - DNA, 13 bp, Homo sapiens
ccagcagcacaat

SEQ ID NO: 203735 - DNA, 15 bp, Homo sapiens
ccagcagcacaattc

SEQ ID NO: 203736 - DNA, 16 bp, Homo sapiens
ccagcagcacaattct

SEQ ID NO: 203737 - DNA, 24 bp, Homo sapiens
ccagcagcacaattctgtccctgt

SEQ ID NO: 203738 - DNA, 12 bp, Homo sapiens
ccagcagcagaa

SEQ ID NO: 203739 - DNA, 21 bp, Homo sapiens
ccagcagccctaaggatctct

SEQ ID NO: 203740 - DNA, 15 bp, Homo sapiens
ccagcagcggcccag

SEQ ID NO: 203741 - DNA, 16 bp, Homo sapiens
ccagcagcggcccaga

SEQ ID NO: 203742 - DNA, 17 bp, Homo sapiens
ccagcagctgaagtctc

SEQ ID NO: 203743 - DNA, 12 bp, Homo sapiens
ccagcagctgcg

SEQ ID NO: 203744 - DNA, 12 bp, Homo sapiens
ccagcagcttgg

SEQ ID NO: 203745 - DNA, 18 bp, Homo sapiens
ccagcagcttggctgagc

SEQ ID NO: 203746 - DNA, 15 bp, Homo sapiens
ccagcagggctgtga

SEQ ID NO: 203747 - DNA, 14 bp, Homo sapiens
ccagcaggggcaga

SEQ ID NO: 203748 - DNA, 22 bp, Homo sapiens
ccagcaggggcagaaggaggaa

SEQ ID NO: 203749 - DNA, 23 bp, Homo sapiens
ccagcaggtgtggtggctcatgg

SEQ ID NO: 203750 - DNA, 20 bp, Homo sapiens
ccagcagtgaaacttgtgct

SEQ ID NO: 203751 - DNA, 15 bp, Homo sapiens
ccagcagtgctgggc

SEQ ID NO: 203752 - DNA, 20 bp, Homo sapiens
ccagcagtgctgggcccagc

SEQ ID NO: 203753 - DNA, 22 bp, Homo sapiens
ccagcagtgctgggcccagccg

SEQ ID NO: 203754 - DNA, 20 bp, Homo sapiens
ccagcatccatgcggccggc

SEQ ID NO: 203755 - DNA, 17 bp, Homo sapiens
ccagcatcccttctgcc

SEQ ID NO: 203756 - DNA, 12 bp, Homo sapiens
ccagcatgtgtg

SEQ ID NO: 203757 - DNA, 15 bp, Homo sapiens
ccagcatgtgtgtgt

SEQ ID NO: 203758 - DNA, 21 bp, Homo sapiens
ccagcatgtgtgtgtctctat

SEQ ID NO: 203759 - DNA, 21 bp, Homo sapiens
ctgccaggcgttggtgccact

SEQ ID NO: 203760 - DNA, 23 bp, Homo sapiens
ctgccaggcgttggtgccacttc

SEQ ID NO: 203761 - DNA, 13 bp, Homo sapiens
ctgccagggcccg

SEQ ID NO: 203762 - DNA, 18 bp, Homo sapiens
ctgccagggcccgacctg

SEQ ID NO: 203763 - DNA, 21 bp, Homo sapiens
ctgccagtccccctgccccag

SEQ ID NO: 203764 - DNA, 21 bp, Homo sapiens
ctgccagtgaagtccttcagt

SEQ ID NO: 203765 - DNA, 23 bp, Homo sapiens
ctgccagtgacagacaggctctt

SEQ ID NO: 203766 - DNA, 21 bp, Homo sapiens
ctgccatgatagctggggctt

SEQ ID NO: 203767 - DNA, 19 bp, Homo sapiens
ctgccatgattttggccac

SEQ ID NO: 203768 - DNA, 20 bp, Homo sapiens
ctgccatgattttggccact

SEQ ID NO: 203769 - DNA, 21 bp, Homo sapiens
ctgccatggaggcacacagct

SEQ ID NO: 203770 - DNA, 23 bp, Homo sapiens
ctgccatggaggcacacagctgc

SEQ ID NO: 203771 - DNA, 23 bp, Homo sapiens
ctgccatgtggcagaagtgctct

SEQ ID NO: 203772 - DNA, 23 bp, Homo sapiens
ctgccattaaatccgcaaacagc

SEQ ID NO: 203773 - DNA, 13 bp, Homo sapiens
ctgcccaaagcag

SEQ ID NO: 203774 - DNA, 16 bp, Homo sapiens
ctgcccaactttcatt

SEQ ID NO: 203775 - DNA, 19 bp, Homo sapiens
ctgcccaagggcctcccac

SEQ ID NO: 203776 - DNA, 17 bp, Homo sapiens
ctgcccacaccaccgcc

SEQ ID NO: 203777 - DNA, 13 bp, Homo sapiens
ctgcccaccctgg

SEQ ID NO: 203778 - DNA, 15 bp, Homo sapiens
ctgcccaccctgggc

SEQ ID NO: 203779 - DNA, 16 bp, Homo sapiens
ctgcccaccctgggcc

SEQ ID NO: 203780 - DNA, 17 bp, Homo sapiens
ctgcccaccgaccccct

SEQ ID NO: 203781 - DNA, 15 bp, Homo sapiens
ctgcccacgctcctg

SEQ ID NO: 203782 - DNA, 19 bp, Homo sapiens
ctgcccacgctcctgccct

SEQ ID NO: 203783 - DNA, 14 bp, Homo sapiens
ctgcccacggccac

SEQ ID NO: 203784 - DNA, 15 bp, Homo sapiens
ctgcccacggccacc

SEQ ID NO: 203785 - DNA, 18 bp, Homo sapiens
ctgcccacggccacccac

SEQ ID NO: 203786 - DNA, 23 bp, Homo sapiens
ctgcccacggccacccacccttc

SEQ ID NO: 203787 - DNA, 24 bp, Homo sapiens
ctgcccacttagccgtccatggca

SEQ ID NO: 203788 - DNA, 18 bp, Homo sapiens
ctgcccagacccctctgg

SEQ ID NO: 203789 - DNA, 13 bp, Homo sapiens
ctgcccagagctg

SEQ ID NO: 203790 - DNA, 14 bp, Homo sapiens
ctgcccagagctgg

SEQ ID NO: 203791 - DNA, 15 bp, Homo sapiens
ctgcccagagctggg

SEQ ID NO: 203792 - DNA, 18 bp, Homo sapiens
ctgcccagagctgggtga

SEQ ID NO: 203793 - DNA, 20 bp, Homo sapiens
ctgcccagccctcccagctg

SEQ ID NO: 203794 - DNA, 16 bp, Homo sapiens
ctgcccagcttgggcc

SEQ ID NO: 203795 - DNA, 18 bp, Homo sapiens
ctgcccaggcagtctttg

SEQ ID NO: 203796 - DNA, 13 bp, Homo sapiens
ctgcccaggctct

SEQ ID NO: 203797 - DNA, 16 bp, Homo sapiens
ctgcccaggctctgct

SEQ ID NO: 203798 - DNA, 17 bp, Homo sapiens
ctgcccaggctctgctg

SEQ ID NO: 203799 - DNA, 19 bp, Homo sapiens
ctgcccaggctctgctgac

SEQ ID NO: 203800 - DNA, 11 bp, Homo sapiens
ctgcccagtgt

SEQ ID NO: 203801 - DNA, 12 bp, Homo sapiens
ctgcccagtgtt

SEQ ID NO: 203802 - DNA, 20 bp, Homo sapiens
ctgcccagttagcccggcca

SEQ ID NO: 203803 - DNA, 21 bp, Homo sapiens
ctgcccagttagcccggccaa

SEQ ID NO: 203804 - DNA, 18 bp, Homo sapiens
ctgcccatcacagggttg

SEQ ID NO: 203805 - DNA, 22 bp, Homo sapiens
ctgcccatcacagggttgggcc

SEQ ID NO: 203806 - DNA, 16 bp, Homo sapiens
ctgccccaaaattata

SEQ ID NO: 203807 - DNA, 15 bp, Homo sapiens
ctgccccaagcagcc

SEQ ID NO: 203808 - DNA, 14 bp, Homo sapiens
ctgccccaagcccc

SEQ ID NO: 203809 - DNA, 16 bp, Homo sapiens
ctgccccaagccccca

SEQ ID NO: 203810 - DNA, 21 bp, Homo sapiens
ctgccccaatcgggtccagag

SEQ ID NO: 203811 - DNA, 16 bp, Homo sapiens
ctgccccacacggact

SEQ ID NO: 203812 - DNA, 15 bp, Homo sapiens
ctgccccacaggcca

SEQ ID NO: 203813 - DNA, 16 bp, Homo sapiens
ctgccccacaggccac

SEQ ID NO: 203814 - DNA, 20 bp, Homo sapiens
ctgccccagagaagcctcag

SEQ ID NO: 203815 - DNA, 15 bp, Homo sapiens
ctgccccagctgggc

SEQ ID NO: 203816 - DNA, 16 bp, Homo sapiens
ctgccccagctgggct

SEQ ID NO: 203817 - DNA, 15 bp, Homo sapiens
ctgccccaggcctga

SEQ ID NO: 203818 - DNA, 12 bp, Homo sapiens
ctgccccatccc

SEQ ID NO: 203819 - DNA, 13 bp, Homo sapiens
ctgccccatctcc

SEQ ID NO: 203820 - DNA, 17 bp, Homo sapiens
ctgcccccactcagcat

SEQ ID NO: 203821 - DNA, 23 bp, Homo sapiens
ctgcccccagctcttctccccag

SEQ ID NO: 203822 - DNA, 16 bp, Homo sapiens
ctgcccccagctgctc

SEQ ID NO: 203823 - DNA, 18 bp, Homo sapiens
ctgcccccatctccccag

SEQ ID NO: 203824 - DNA, 19 bp, Homo sapiens
ctgcccccatctccccagg

SEQ ID NO: 203825 - DNA, 20 bp, Homo sapiens
ctgccccccttcccacccct

SEQ ID NO: 203826 - DNA, 23 bp, Homo sapiens
ctgcccccgctctgccatcagcc

SEQ ID NO: 203827 - DNA, 17 bp, Homo sapiens
ctgcccccgtcccacct

SEQ ID NO: 203828 - DNA, 12 bp, Homo sapiens
ctgccccctccc

SEQ ID NO: 203829 - DNA, 16 bp, Homo sapiens
ctgccccctcccccgc

SEQ ID NO: 203830 - DNA, 18 bp, Homo sapiens
ctgccccctccccttcac

SEQ ID NO: 203831 - DNA, 17 bp, Homo sapiens
ctgcccccttctcccac

SEQ ID NO: 203832 - DNA, 18 bp, Homo sapiens
ctgccccgccccccagag

SEQ ID NO: 203833 - DNA, 19 bp, Homo sapiens
ctgccccgccccccagagc

SEQ ID NO: 203834 - DNA, 22 bp, Homo sapiens
ctgccccgccccccagagccag

SEQ ID NO: 203835 - DNA, 23 bp, Homo sapiens
ctgccccgccccccagagccagg

SEQ ID NO: 203836 - DNA, 18 bp, Homo sapiens
ctgccccgtcaccatctc

SEQ ID NO: 203837 - DNA, 21 bp, Homo sapiens
ctgccccgtcaccatctcagg

SEQ ID NO: 203838 - DNA, 23 bp, Homo sapiens
ctgccccgtcaccatctcaggcc

SEQ ID NO: 203839 - DNA, 14 bp, Homo sapiens
ctgccccgtcccct

SEQ ID NO: 203840 - DNA, 19 bp, Homo sapiens
ctgccccgtcccctgggcc

SEQ ID NO: 203841 - DNA, 22 bp, Homo sapiens
ctgccccgtcggactgccccca

SEQ ID NO: 203842 - DNA, 22 bp, Homo sapiens
ctgccccgtgcagactggaggg

SEQ ID NO: 203843 - DNA, 19 bp, Homo sapiens
ctgccccgttccctgtcag

SEQ ID NO: 203844 - DNA, 20 bp, Homo sapiens
ctgccccgttccctgtcaga

SEQ ID NO: 203845 - DNA, 21 bp, Homo sapiens
ctgccccgttccctgtcagag

SEQ ID NO: 203846 - DNA, 23 bp, Homo sapiens
ctgccccgttccctgtcagaggc

SEQ ID NO: 203847 - DNA, 13 bp, Homo sapiens
gcctcagcctctc

SEQ ID NO: 203848 - DNA, 15 bp, Homo sapiens
gcctcagcgctgccc

SEQ ID NO: 203849 - DNA, 19 bp, Homo sapiens
gcctcagcgctgcccacac

SEQ ID NO: 203850 - DNA, 19 bp, Homo sapiens
gcctcagctgcctcacttc

SEQ ID NO: 203851 - DNA, 20 bp, Homo sapiens
gcctcagctgcctcacttcc

SEQ ID NO: 203852 - DNA, 16 bp, Homo sapiens
gcctcaggaggcagtg

SEQ ID NO: 203853 - DNA, 23 bp, Homo sapiens
gcctcaggaggcagtggcttgga

SEQ ID NO: 203854 - DNA, 12 bp, Homo sapiens
gcctcagtccct

SEQ ID NO: 203855 - DNA, 21 bp, Homo sapiens
gcctcagtccctccctcctgg

SEQ ID NO: 203856 - DNA, 23 bp, Homo sapiens
gcctcagtccctccctcctggct

SEQ ID NO: 203857 - DNA, 12 bp, Homo sapiens
gcctcatccctc

SEQ ID NO: 203858 - DNA, 13 bp, Homo sapiens
gcctcatccctcg

SEQ ID NO: 203859 - DNA, 22 bp, Homo sapiens
gcctcatcctcctggacccagc

SEQ ID NO: 203860 - DNA, 12 bp, Homo sapiens
gcctccaagaaa

SEQ ID NO: 203861 - DNA, 17 bp, Homo sapiens
gcctccaagcctgcctc

SEQ ID NO: 203862 - DNA, 18 bp, Homo sapiens
gcctccaccgagccagct

SEQ ID NO: 203863 - DNA, 13 bp, Homo sapiens
gcctccactcccc

SEQ ID NO: 203864 - DNA, 19 bp, Homo sapiens
gcctccactcccccacctg

SEQ ID NO: 203865 - DNA, 22 bp, Homo sapiens
gcctccactctagttctagatg

SEQ ID NO: 203866 - DNA, 12 bp, Homo sapiens
gcctccagagcc

SEQ ID NO: 203867 - DNA, 15 bp, Homo sapiens
gcctccagagccagc

SEQ ID NO: 203868 - DNA, 19 bp, Homo sapiens
gcctccagagccagcctgg

SEQ ID NO: 203869 - DNA, 24 bp, Homo sapiens
gcctccagagccagcctgggactc

SEQ ID NO: 203870 - DNA, 19 bp, Homo sapiens
gcctccagcctctcccggc

SEQ ID NO: 203871 - DNA, 22 bp, Homo sapiens
gcctccagcctctcccggctgc

SEQ ID NO: 203872 - DNA, 11 bp, Homo sapiens
gcctccaggag

SEQ ID NO: 203873 - DNA, 17 bp, Homo sapiens
gcctccaggctggggcc

SEQ ID NO: 203874 - DNA, 14 bp, Homo sapiens
gcctccatggtgcc

SEQ ID NO: 203875 - DNA, 17 bp, Homo sapiens
gcctccatggtgcctct

SEQ ID NO: 203876 - DNA, 18 bp, Homo sapiens
gcctccatggtgcctctg

SEQ ID NO: 203877 - DNA, 21 bp, Homo sapiens
gcctcccaaatatgcccctcc

SEQ ID NO: 203878 - DNA, 12 bp, Homo sapiens
gcctcccacact

SEQ ID NO: 203879 - DNA, 16 bp, Homo sapiens
gcctcccacacttgct

SEQ ID NO: 203880 - DNA, 18 bp, Homo sapiens
gcctcccacacttgctgg

SEQ ID NO: 203881 - DNA, 12 bp, Homo sapiens
gcctcccacccc

SEQ ID NO: 203882 - DNA, 22 bp, Homo sapiens
gcctcccacgctgggacacaga

SEQ ID NO: 203883 - DNA, 13 bp, Homo sapiens
gcctcccagccac

SEQ ID NO: 203884 - DNA, 19 bp, Homo sapiens
gcctcccatagtgctggga

SEQ ID NO: 203885 - DNA, 17 bp, Homo sapiens
gcctccccaaccctgcc

SEQ ID NO: 203886 - DNA, 13 bp, Homo sapiens
gcctcccccaggc

SEQ ID NO: 203887 - DNA, 20 bp, Homo sapiens
gcctcccccaggctgcgcct

SEQ ID NO: 203888 - DNA, 20 bp, Homo sapiens
gcctccccccagaccccgcc

SEQ ID NO: 203889 - DNA, 18 bp, Homo sapiens
gcctccccgaaacaggct

SEQ ID NO: 203890 - DNA, 15 bp, Homo sapiens
gcctccccgggggtc

SEQ ID NO: 203891 - DNA, 19 bp, Homo sapiens
gcctcccctcccctgggga

SEQ ID NO: 203892 - DNA, 22 bp, Homo sapiens
gcctcccctcccctggggacgc

SEQ ID NO: 203893 - DNA, 15 bp, Homo sapiens
gcctcccctgctgaa

SEQ ID NO: 203894 - DNA, 16 bp, Homo sapiens
gcctccctcccctgcc

SEQ ID NO: 203895 - DNA, 19 bp, Homo sapiens
gcctccctcccctgccctc

SEQ ID NO: 203896 - DNA, 13 bp, Homo sapiens
gcctccctcctcg

SEQ ID NO: 203897 - DNA, 14 bp, Homo sapiens
gcctccctcctcgt

SEQ ID NO: 203898 - DNA, 16 bp, Homo sapiens
gcctccctctctcttc

SEQ ID NO: 203899 - DNA, 23 bp, Homo sapiens
gcctccctctctcttctgctcca

SEQ ID NO: 203900 - DNA, 19 bp, Homo sapiens
gcctccctgaccctgcaga

SEQ ID NO: 203901 - DNA, 22 bp, Homo sapiens
gcctccctgtcactcagctgag

SEQ ID NO: 203902 - DNA, 18 bp, Homo sapiens
gcctcccttcccagtggg

SEQ ID NO: 203903 - DNA, 20 bp, Homo sapiens
gcctcccttccgctgcgggc

SEQ ID NO: 203904 - DNA, 17 bp, Homo sapiens
gcctcccttcctccgct

SEQ ID NO: 203905 - DNA, 14 bp, Homo sapiens
gcctcccttgggct

SEQ ID NO: 203906 - DNA, 14 bp, Homo sapiens
gcctccctttctgg

SEQ ID NO: 203907 - DNA, 17 bp, Homo sapiens
gcctccgaggctccccg

SEQ ID NO: 203908 - DNA, 23 bp, Homo sapiens
gcctccggccctgccccacacag

SEQ ID NO: 203909 - DNA, 22 bp, Homo sapiens
gcctccgttcccacctctgagg

SEQ ID NO: 203910 - DNA, 23 bp, Homo sapiens
gcctccgtttatgggccttgctt

SEQ ID NO: 203911 - DNA, 13 bp, Homo sapiens
gcctcctccagac

SEQ ID NO: 203912 - DNA, 16 bp, Homo sapiens
gcctcctcccatccag

SEQ ID NO: 203913 - DNA, 21 bp, Homo sapiens
gcctcctcccatccagcgtct

SEQ ID NO: 203914 - DNA, 13 bp, Homo sapiens
gcctcctctgtcc

SEQ ID NO: 203915 - DNA, 14 bp, Homo sapiens
gcctcctgagcctg

SEQ ID NO: 203916 - DNA, 17 bp, Homo sapiens
gcctcctgccccctgcc

SEQ ID NO: 203917 - DNA, 13 bp, Homo sapiens
gcctcctgctgag

SEQ ID NO: 203918 - DNA, 23 bp, Homo sapiens
gcctcctgggaaggagggagctg

SEQ ID NO: 203919 - DNA, 17 bp, Homo sapiens
gcctccttatttatcaa

SEQ ID NO: 203920 - DNA, 20 bp, Homo sapiens
gcctccttccacctccctcc

SEQ ID NO: 203921 - DNA, 17 bp, Homo sapiens
gcctccttcccatgcct

SEQ ID NO: 203922 - DNA, 21 bp, Homo sapiens
gcctccttttgctgtttggat

SEQ ID NO: 203923 - DNA, 15 bp, Homo sapiens
gcctcgaactcctgg

SEQ ID NO: 203924 - DNA, 20 bp, Homo sapiens
gcctcgaactcctgggctca

SEQ ID NO: 203925 - DNA, 14 bp, Homo sapiens
gcctcgaggcaccg

SEQ ID NO: 203926 - DNA, 21 bp, Homo sapiens
gcctcgaggcaccggcgctgc

SEQ ID NO: 203927 - DNA, 23 bp, Homo sapiens
gcctcgaggcaccggcgctgcag

SEQ ID NO: 203928 - DNA, 21 bp, Homo sapiens
gcctcggcagaactctctgtc

SEQ ID NO: 203929 - DNA, 16 bp, Homo sapiens
gcctcggcctcccaaa

SEQ ID NO: 203930 - DNA, 17 bp, Homo sapiens
gcctcgggccgcctcct

SEQ ID NO: 203931 - DNA, 17 bp, Homo sapiens
gcctcggggcagggcag

SEQ ID NO: 203932 - DNA, 21 bp, Homo sapiens
gcctcgtgggttcttcctctg

SEQ ID NO: 203933 - DNA, 22 bp, Homo sapiens
gcctcgtggttattagcaaggc

SEQ ID NO: 203934 - DNA, 16 bp, Homo sapiens
gcctctaagagtgccc

SEQ ID NO: 203935 - DNA, 19 bp, Homo sapiens
gcctctccccgctctggat

SEQ ID NO: 203936 - DNA, 14 bp, Homo sapiens
gcctctcccggctg

SEQ ID NO: 203937 - DNA, 15 bp, Homo sapiens
gcctctcccggctgc

SEQ ID NO: 203938 - DNA, 22 bp, Homo sapiens
gcctctcccggctgcctgccgc

SEQ ID NO: 203939 - DNA, 23 bp, Homo sapiens
gcctctcccggctgcctgccgcc

SEQ ID NO: 203940 - DNA, 17 bp, Homo sapiens
gcctctccttgccccag

SEQ ID NO: 203941 - DNA, 14 bp, Homo sapiens
gcctctctcaggag

SEQ ID NO: 203942 - DNA, 19 bp, Homo sapiens
gcctctgaaatttcccaca

SEQ ID NO: 203943 - DNA, 16 bp, Homo sapiens
gccgcctagtgcagag

SEQ ID NO: 203944 - DNA, 15 bp, Homo sapiens
gccgcctcccagcct

SEQ ID NO: 203945 - DNA, 16 bp, Homo sapiens
gccgcctcccagcctg

SEQ ID NO: 203946 - DNA, 19 bp, Homo sapiens
gccgcctcccagcctgggg

SEQ ID NO: 203947 - DNA, 12 bp, Homo sapiens
gccgcctcctcc

SEQ ID NO: 203948 - DNA, 14 bp, Homo sapiens
gccgcctcctccag

SEQ ID NO: 203949 - DNA, 16 bp, Homo sapiens
gccgcctcgggccgcc

SEQ ID NO: 203950 - DNA, 23 bp, Homo sapiens
gccgcctcgggccgcctcctcca

SEQ ID NO: 203951 - DNA, 19 bp, Homo sapiens
gccgcctgcgggctgcccc

SEQ ID NO: 203952 - DNA, 14 bp, Homo sapiens
gccgcctggcaggt

SEQ ID NO: 203953 - DNA, 15 bp, Homo sapiens
gccgcctggcaggtg

SEQ ID NO: 203954 - DNA, 13 bp, Homo sapiens
gccgcctggggct

SEQ ID NO: 203955 - DNA, 20 bp, Homo sapiens
gccgcctgtgcccttgctgg

SEQ ID NO: 203956 - DNA, 14 bp, Homo sapiens
gccgcgctctgccc

SEQ ID NO: 203957 - DNA, 16 bp, Homo sapiens
gccgcgctctgcccct

SEQ ID NO: 203958 - DNA, 17 bp, Homo sapiens
gccgcgctctgcccctc

SEQ ID NO: 203959 - DNA, 20 bp, Homo sapiens
gccgcggtaggtaagggccg

SEQ ID NO: 203960 - DNA, 20 bp, Homo sapiens
gccgcgtgacggacatccag

SEQ ID NO: 203961 - DNA, 13 bp, Homo sapiens
gccgctagaggcc

SEQ ID NO: 203962 - DNA, 15 bp, Homo sapiens
gccgctagaggcctg

SEQ ID NO: 203963 - DNA, 14 bp, Homo sapiens
gccgctgggagagc

SEQ ID NO: 203964 - DNA, 16 bp, Homo sapiens
gccgctgggagagcca

SEQ ID NO: 203965 - DNA, 21 bp, Homo sapiens
gccgctgggagagccaaggcc

SEQ ID NO: 203966 - DNA, 18 bp, Homo sapiens
gccgcttccctacccaca

SEQ ID NO: 203967 - DNA, 21 bp, Homo sapiens
gccgcttccctacccacaggg

SEQ ID NO: 203968 - DNA, 16 bp, Homo sapiens
gccggaagtggctccg

SEQ ID NO: 203969 - DNA, 23 bp, Homo sapiens
gccggaccgcgtagagagccggg

SEQ ID NO: 203970 - DNA, 23 bp, Homo sapiens
gccggagaacatctgccttgctg

SEQ ID NO: 203971 - DNA, 12 bp, Homo sapiens
gccggccagctc

SEQ ID NO: 203972 - DNA, 15 bp, Homo sapiens
gccggccccaggctc

SEQ ID NO: 203973 - DNA, 16 bp, Homo sapiens
gccggccgcccagaca

SEQ ID NO: 203974 - DNA, 23 bp, Homo sapiens
gccggccttggccttggggccag

SEQ ID NO: 203975 - DNA, 16 bp, Homo sapiens
gccgggcacagctgtg

SEQ ID NO: 203976 - DNA, 15 bp, Homo sapiens
gccgggccgcagact

SEQ ID NO: 203977 - DNA, 12 bp, Homo sapiens
gccgggcctgga

SEQ ID NO: 203978 - DNA, 22 bp, Homo sapiens
gccgggcctgggcctcctggga

SEQ ID NO: 203979 - DNA, 13 bp, Homo sapiens
gccgggctgctgc

SEQ ID NO: 203980 - DNA, 15 bp, Homo sapiens
gccgggctgctgctg

SEQ ID NO: 203981 - DNA, 17 bp, Homo sapiens
gccgggctggcttctcc

SEQ ID NO: 203982 - DNA, 16 bp, Homo sapiens
gccgggctttccagaa

SEQ ID NO: 203983 - DNA, 17 bp, Homo sapiens
gccggggcctgcctagc

SEQ ID NO: 203984 - DNA, 14 bp, Homo sapiens
gccggggctggccc

SEQ ID NO: 203985 - DNA, 15 bp, Homo sapiens
gccggggctggccct

SEQ ID NO: 203986 - DNA, 17 bp, Homo sapiens
gccggggctggccctgc

SEQ ID NO: 203987 - DNA, 18 bp, Homo sapiens
gccggggctggccctgcc

SEQ ID NO: 203988 - DNA, 23 bp, Homo sapiens
gccgggggtgggggcctgctgtg

SEQ ID NO: 203989 - DNA, 22 bp, Homo sapiens
gccggggtggggtgcctgagcc

SEQ ID NO: 203990 - DNA, 17 bp, Homo sapiens
gccgggtgctcagggct

SEQ ID NO: 203991 - DNA, 21 bp, Homo sapiens
gccgggtgtggcacgcacctg

SEQ ID NO: 203992 - DNA, 19 bp, Homo sapiens
gccgggttggaggcctcac

SEQ ID NO: 203993 - DNA, 24 bp, Homo sapiens
gccgggttggaggcctcaccctgc

SEQ ID NO: 203994 - DNA, 13 bp, Homo sapiens
gccggtccacccc

SEQ ID NO: 203995 - DNA, 23 bp, Homo sapiens
gccggtccaccccgtcccggccc

SEQ ID NO: 203996 - DNA, 13 bp, Homo sapiens
gccggtcccccat

SEQ ID NO: 203997 - DNA, 19 bp, Homo sapiens
gccggttggccggctggcc

SEQ ID NO: 203998 - DNA, 20 bp, Homo sapiens
gccgtagggagtacctgctg

SEQ ID NO: 203999 - DNA, 21 bp, Homo sapiens
gccgtagggagtacctgctgc

SEQ ID NO: 204000 - DNA, 16 bp, Homo sapiens
gccgtcacccctgcct

SEQ ID NO: 204001 - DNA, 17 bp, Homo sapiens
gccgtcagggtggctgg

SEQ ID NO: 204002 - DNA, 16 bp, Homo sapiens
gccgtccatggcacca

SEQ ID NO: 204003 - DNA, 19 bp, Homo sapiens
gccgtccatggcaccagcc

SEQ ID NO: 204004 - DNA, 13 bp, Homo sapiens
gccgtccctctgc

SEQ ID NO: 204005 - DNA, 14 bp, Homo sapiens
gccgtcctcccggg

SEQ ID NO: 204006 - DNA, 19 bp, Homo sapiens
gccgtcctcccgggccctc

SEQ ID NO: 204007 - DNA, 13 bp, Homo sapiens
gccgtctcctccc

SEQ ID NO: 204008 - DNA, 17 bp, Homo sapiens
gccgtctcctccctcag

SEQ ID NO: 204009 - DNA, 19 bp, Homo sapiens
gccgtcttcactcgccccc

SEQ ID NO: 204010 - DNA, 11 bp, Homo sapiens
gccgtgagagc

SEQ ID NO: 204011 - DNA, 23 bp, Homo sapiens
gccgtgagagcccaatcactgcc

SEQ ID NO: 204012 - DNA, 13 bp, Homo sapiens
gccgtgcagctgg

SEQ ID NO: 204013 - DNA, 15 bp, Homo sapiens
gccgtgccttcagct

SEQ ID NO: 204014 - DNA, 19 bp, Homo sapiens
gccgtgccttcagctctac

SEQ ID NO: 204015 - DNA, 22 bp, Homo sapiens
gccgtggattgcacgtggcctc

SEQ ID NO: 204016 - DNA, 14 bp, Homo sapiens
gccgtggctgcggc

SEQ ID NO: 204017 - DNA, 18 bp, Homo sapiens
gccgtggctgcggcaccc

SEQ ID NO: 204018 - DNA, 22 bp, Homo sapiens
gccgtggcttcccgctcagccc

SEQ ID NO: 204019 - DNA, 14 bp, Homo sapiens
gccgtgtccccttg

SEQ ID NO: 204020 - DNA, 18 bp, Homo sapiens
gccgtgtgttgcatgcag

SEQ ID NO: 204021 - DNA, 13 bp, Homo sapiens
gccgttcctggga

SEQ ID NO: 204022 - DNA, 23 bp, Homo sapiens
gccgttgccaagaactgaaaaca

SEQ ID NO: 204023 - DNA, 23 bp, Homo sapiens
gccgtttgaatatattttatctt

SEQ ID NO: 204024 - DNA, 17 bp, Homo sapiens
gcctaaaattaaataaa

SEQ ID NO: 204025 - DNA, 19 bp, Homo sapiens
gcctaagaaaatcatcttg

SEQ ID NO: 204026 - DNA, 14 bp, Homo sapiens
gcctaatttacaag

SEQ ID NO: 204027 - DNA, 20 bp, Homo sapiens
gcctaccagtcgccctctgt

SEQ ID NO: 204028 - DNA, 22 bp, Homo sapiens
gcctaccggcaatttccggcca

SEQ ID NO: 204029 - DNA, 17 bp, Homo sapiens
gcctactctttgttttc

SEQ ID NO: 204030 - DNA, 19 bp, Homo sapiens
gcctactgaaaatgcattt

SEQ ID NO: 204031 - DNA, 12 bp, Homo sapiens
gcctactgtctc

SEQ ID NO: 204032 - DNA, 16 bp, Homo sapiens
gcctactgtctccttc

SEQ ID NO: 204033 - DNA, 18 bp, Homo sapiens
gcctactgtctccttccc

SEQ ID NO: 204034 - DNA, 22 bp, Homo sapiens
ggctacagttgaacagaactgc

SEQ ID NO: 204035 - DNA, 22 bp, Homo sapiens
ggctacatcccagcctgtggtt

SEQ ID NO: 204036 - DNA, 20 bp, Homo sapiens
ggctaccccccgtctcctgc

SEQ ID NO: 204037 - DNA, 18 bp, Homo sapiens
ggctactgcagctttaca

SEQ ID NO: 204038 - DNA, 13 bp, Homo sapiens
aaaaaaaaaaaga

SEQ ID NO: 204039 - DNA, 13 bp, Homo sapiens
aaaaaaaaatatg

SEQ ID NO: 204040 - DNA, 12 bp, Homo sapiens
aaaaaaaacaaa

SEQ ID NO: 204041 - DNA, 12 bp, Homo sapiens
aaaaaaaatata

SEQ ID NO: 204042 - DNA, 11 bp, Homo sapiens
aaaaaaacttt

SEQ ID NO: 204043 - DNA, 12 bp, Homo sapiens
aaaaaaataata

SEQ ID NO: 204044 - DNA, 14 bp, Homo sapiens
aaaaaaatatattt

SEQ ID NO: 204045 - DNA, 13 bp, Homo sapiens
aaaaaacaagaaa

SEQ ID NO: 204046 - DNA, 12 bp, Homo sapiens
aaaaaagagaaa

SEQ ID NO: 204047 - DNA, 18 bp, Homo sapiens
aaaaaagttttgatgaaa

SEQ ID NO: 204048 - DNA, 12 bp, Homo sapiens
aaaaaataatat

SEQ ID NO: 204049 - DNA, 13 bp, Homo sapiens
aaaaaatatgaga

SEQ ID NO: 204050 - DNA, 12 bp, Homo sapiens
aaaaaatatttt

SEQ ID NO: 204051 - DNA, 12 bp, Homo sapiens
aaaaaatgaata

SEQ ID NO: 204052 - DNA, 18 bp, Homo sapiens
aaaaaatgatctattgca

SEQ ID NO: 204053 - DNA, 14 bp, Homo sapiens
aaaaaatgctcaca

SEQ ID NO: 204054 - DNA, 14 bp, Homo sapiens
aaaaacatgtcatg

SEQ ID NO: 204055 - DNA, 13 bp, Homo sapiens
aaaaacatttgta

SEQ ID NO: 204056 - DNA, 15 bp, Homo sapiens
aaaaacatttgtaca

SEQ ID NO: 204057 - DNA, 22 bp, Homo sapiens
aaaaactggaacggtgaaggtg

SEQ ID NO: 204058 - DNA, 19 bp, Homo sapiens
aaaaacttccattctttct

SEQ ID NO: 204059 - DNA, 22 bp, Homo sapiens
aaaaactttccatgacagtagc

SEQ ID NO: 204060 - DNA, 24 bp, Homo sapiens
aaaaactttccatgacagtagcat

SEQ ID NO: 204061 - DNA, 12 bp, Homo sapiens
aaaaacttttat

SEQ ID NO: 204062 - DNA, 17 bp, Homo sapiens
aaaaacttttataaatt

SEQ ID NO: 204063 - DNA, 18 bp, Homo sapiens
aaaaacttttataaatta

SEQ ID NO: 204064 - DNA, 13 bp, Homo sapiens
aaaaagaaaaaca

SEQ ID NO: 204065 - DNA, 12 bp, Homo sapiens
aaaaagaaaact

SEQ ID NO: 204066 - DNA, 14 bp, Homo sapiens
aaaaagaaaagata

SEQ ID NO: 204067 - DNA, 12 bp, Homo sapiens
cgtggacacctg

SEQ ID NO: 204068 - DNA, 17 bp, Homo sapiens
cgtggagagctggtgcc

SEQ ID NO: 204069 - DNA, 21 bp, Homo sapiens
cgtggagagggatgaggtgct

SEQ ID NO: 204070 - DNA, 13 bp, Homo sapiens
cgtggagatagtg

SEQ ID NO: 204071 - DNA, 15 bp, Homo sapiens
cgtggagatagtgcc

SEQ ID NO: 204072 - DNA, 18 bp, Homo sapiens
cgtggagatagtgccagg

SEQ ID NO: 204073 - DNA, 21 bp, Homo sapiens
cgtggagatagtgccaggtgg

SEQ ID NO: 204074 - DNA, 18 bp, Homo sapiens
cgtggaggaatgctcccc

SEQ ID NO: 204075 - DNA, 22 bp, Homo sapiens
cgtggccaacgtggacctgcct

SEQ ID NO: 204076 - DNA, 12 bp, Homo sapiens
cgtggcctgggg

SEQ ID NO: 204077 - DNA, 23 bp, Homo sapiens
cgtggctagggttccactggaga

SEQ ID NO: 204078 - DNA, 17 bp, Homo sapiens
cgtggctctgggtgagg

SEQ ID NO: 204079 - DNA, 21 bp, Homo sapiens
cgtggctgcccacacacccca

SEQ ID NO: 204080 - DNA, 13 bp, Homo sapiens
cgtggctgtggca

SEQ ID NO: 204081 - DNA, 20 bp, Homo sapiens
cgtggcttcccgctcagccc

SEQ ID NO: 204082 - DNA, 14 bp, Homo sapiens
cgtgggagaggcag

SEQ ID NO: 204083 - DNA, 14 bp, Homo sapiens
cgtgggatccagag

SEQ ID NO: 204084 - DNA, 21 bp, Homo sapiens
cgtgggatccagagagaagca

SEQ ID NO: 204085 - DNA, 17 bp, Homo sapiens
cgtgggctctggctccc

SEQ ID NO: 204086 - DNA, 12 bp, Homo sapiens
cgtggggcagca

SEQ ID NO: 204087 - DNA, 16 bp, Homo sapiens
cgtggggggagctctg

SEQ ID NO: 204088 - DNA, 18 bp, Homo sapiens
cgtggggggagctctggt

SEQ ID NO: 204089 - DNA, 17 bp, Homo sapiens
cgtgggtacccaggctg

SEQ ID NO: 204090 - DNA, 17 bp, Homo sapiens
cgtggtagaagccagta

SEQ ID NO: 204091 - DNA, 22 bp, Homo sapiens
cgtggtatgtgaattgaagtca

SEQ ID NO: 204092 - DNA, 14 bp, Homo sapiens
cgtggtcccgagga

SEQ ID NO: 204093 - DNA, 22 bp, Homo sapiens
cgtggtcccgaggaagggccag

SEQ ID NO: 204094 - DNA, 23 bp, Homo sapiens
cgtggttattagcaaggctgggt

SEQ ID NO: 204095 - DNA, 17 bp, Homo sapiens
cgtggttcactttggtc

SEQ ID NO: 204096 - DNA, 18 bp, Homo sapiens
cgtgtagcgtcctgagga

SEQ ID NO: 204097 - DNA, 20 bp, Homo sapiens
cgtgtagtggaagagcagcc

SEQ ID NO: 204098 - DNA, 21 bp, Homo sapiens
cgtgtagtggaagagcagcct

SEQ ID NO: 204099 - DNA, 22 bp, Homo sapiens
cgtgtatagtgcctaaaattgt

SEQ ID NO: 204100 - DNA, 14 bp, Homo sapiens
cgtgtatcctgggg

SEQ ID NO: 204101 - DNA, 23 bp, Homo sapiens
cgtgtccacagagtttgtagtaa

SEQ ID NO: 204102 - DNA, 14 bp, Homo sapiens
cgtgtcccaaggag

SEQ ID NO: 204103 - DNA, 17 bp, Homo sapiens
cgtgtcccaaggagctg

SEQ ID NO: 204104 - DNA, 18 bp, Homo sapiens
cgtgtcccaaggagctga

SEQ ID NO: 204105 - DNA, 18 bp, Homo sapiens
cgtgtccctcctcttcct

SEQ ID NO: 204106 - DNA, 23 bp, Homo sapiens
cgtgtctctcccaccccggcctc

SEQ ID NO: 204107 - DNA, 15 bp, Homo sapiens
cgtgtctctgccatg

SEQ ID NO: 204108 - DNA, 21 bp, Homo sapiens
cgtgtctctgccatgtggcag

SEQ ID NO: 204109 - DNA, 12 bp, Homo sapiens
cgtgtctgaatc

SEQ ID NO: 204110 - DNA, 14 bp, Homo sapiens
cgtgtctgtattta

SEQ ID NO: 204111 - DNA, 15 bp, Homo sapiens
cgtgtgatgtatgtt

SEQ ID NO: 204112 - DNA, 17 bp, Homo sapiens
cgtgtgccccaagaggc

SEQ ID NO: 204113 - DNA, 22 bp, Homo sapiens
cgtgtgccccaagaggctagcc

SEQ ID NO: 204114 - DNA, 16 bp, Homo sapiens
cgtgtggccctgtggg

SEQ ID NO: 204115 - DNA, 20 bp, Homo sapiens
cgtgtggctcacgtgtgtga

SEQ ID NO: 204116 - DNA, 10 bp, Homo sapiens
cgtgtgtctc

SEQ ID NO: 204117 - DNA, 17 bp, Homo sapiens
cgtgtgtctcatgccag

SEQ ID NO: 204118 - DNA, 22 bp, Homo sapiens
cgtgtgtctcatgccagcagca

SEQ ID NO: 204119 - DNA, 22 bp, Homo sapiens
cgtgtgtgcaagtgtctgtgtg

SEQ ID NO: 204120 - DNA, 15 bp, Homo sapiens
cgtgttatgactcca

SEQ ID NO: 204121 - DNA, 21 bp, Homo sapiens
cgtgttctctccccttgcact

SEQ ID NO: 204122 - DNA, 15 bp, Homo sapiens
cgttaaaagacagtg

SEQ ID NO: 204123 - DNA, 22 bp, Homo sapiens
cgttaacattgaccaagaactg

SEQ ID NO: 204124 - DNA, 22 bp, Homo sapiens
cgttaatttaaagctgtttcta

SEQ ID NO: 204125 - DNA, 21 bp, Homo sapiens
cgttaggaataacactgcagc

SEQ ID NO: 204126 - DNA, 18 bp, Homo sapiens
cgttaggcccgggcccct

SEQ ID NO: 204127 - DNA, 19 bp, Homo sapiens
cgttaggcccgggcccctg

SEQ ID NO: 204128 - DNA, 23 bp, Homo sapiens
cgttaggcccgggcccctggcac

SEQ ID NO: 204129 - DNA, 16 bp, Homo sapiens
cgttatctcattgcaa

SEQ ID NO: 204130 - DNA, 13 bp, Homo sapiens
cgttcacttcccc

SEQ ID NO: 204131 - DNA, 14 bp, Homo sapiens
cgttcattttctgt

SEQ ID NO: 204132 - DNA, 22 bp, Homo sapiens
cgttcctgccaggctctccctc

SEQ ID NO: 204133 - DNA, 12 bp, Homo sapiens
cgttcctggcct

SEQ ID NO: 204134 - DNA, 13 bp, Homo sapiens
cgttcctggcctt

SEQ ID NO: 204135 - DNA, 18 bp, Homo sapiens
cgttcctgggactgtcag

SEQ ID NO: 204136 - DNA, 22 bp, Homo sapiens
cgttctccacccaccagtcagg

SEQ ID NO: 204137 - DNA, 13 bp, Homo sapiens
cgttctcctgctt

SEQ ID NO: 204138 - DNA, 22 bp, Homo sapiens
cgttctctgccccgtttcttgc

SEQ ID NO: 204139 - DNA, 20 bp, Homo sapiens
cgttctgccacttgcactgt

SEQ ID NO: 204140 - DNA, 17 bp, Homo sapiens
cgttctgctggcctgga

SEQ ID NO: 204141 - DNA, 19 bp, Homo sapiens
cgttctggactctgcccca

SEQ ID NO: 204142 - DNA, 23 bp, Homo sapiens
cgttctgggtcagcttgaatgtc

SEQ ID NO: 204143 - DNA, 16 bp, Homo sapiens
cgttgacatgcacagt

SEQ ID NO: 204144 - DNA, 19 bp, Homo sapiens
cgttgaggatgaggccgct

SEQ ID NO: 204145 - DNA, 15 bp, Homo sapiens
cgttgatctcctggt

SEQ ID NO: 204146 - DNA, 18 bp, Homo sapiens
cgttgatctcctggtagc

SEQ ID NO: 204147 - DNA, 20 bp, Homo sapiens
cgttgcatccacaggattcc

SEQ ID NO: 204148 - DNA, 11 bp, Homo sapiens
cgttggagcca

SEQ ID NO: 204149 - DNA, 16 bp, Homo sapiens
cgttggttgtttctct

SEQ ID NO: 204150 - DNA, 16 bp, Homo sapiens
cgtttacattttagac

SEQ ID NO: 204151 - DNA, 20 bp, Homo sapiens
cgtttacttatcttatgcca

SEQ ID NO: 204152 - DNA, 17 bp, Homo sapiens
cgtttcagtaataaaac

SEQ ID NO: 204153 - DNA, 10 bp, Homo sapiens
cgtttccaag

SEQ ID NO: 204154 - DNA, 15 bp, Homo sapiens
cgtttgtttgttttg

SEQ ID NO: 204155 - DNA, 17 bp, Homo sapiens
cgtttgtttgttttgtt

SEQ ID NO: 204156 - DNA, 12 bp, Homo sapiens
cgttttattgtg

SEQ ID NO: 204157 - DNA, 14 bp, Homo sapiens
cgttttattgtgtt

SEQ ID NO: 204158 - DNA, 18 bp, Homo sapiens
cgttttctttgctgtgcc

SEQ ID NO: 204159 - DNA, 20 bp, Homo sapiens
cgttttctttgctgtgccaa

SEQ ID NO: 204160 - DNA, 15 bp, Homo sapiens
cgtttttatattact

SEQ ID NO: 204161 - DNA, 21 bp, Homo sapiens
cgtttttatattacttttgta

SEQ ID NO: 204162 - DNA, 23 bp, Homo sapiens
cgtttttcagcacccccacccac

SEQ ID NO: 204163 - DNA, 15 bp, Homo sapiens
cgtttttttcattcc

SEQ ID NO: 204164 - DNA, 22 bp, Homo sapiens
ctaaaaaacataaatttcttta

SEQ ID NO: 204165 - DNA, 22 bp, Homo sapiens
ctaaaaaataactgtgcactat

SEQ ID NO: 204166 - DNA, 16 bp, Homo sapiens
ctaaaaacattttaaa

SEQ ID NO: 204167 - DNA, 13 bp, Homo sapiens
ctaaaaagtcaat

SEQ ID NO: 204168 - DNA, 13 bp, Homo sapiens
ctaaaaataagaa

SEQ ID NO: 204169 - DNA, 12 bp, Homo sapiens
ctaaaaatatat

SEQ ID NO: 204170 - DNA, 18 bp, Homo sapiens
ctaaaacaaaatctgaac

SEQ ID NO: 204171 - DNA, 20 bp, Homo sapiens
ctaaaactagataacttaaa

SEQ ID NO: 204172 - DNA, 21 bp, Homo sapiens
ctaaaagattctttaaactac

SEQ ID NO: 204173 - DNA, 12 bp, Homo sapiens
ctaaaaggagga

SEQ ID NO: 204174 - DNA, 18 bp, Homo sapiens
ctaaaaggaggacaggga

SEQ ID NO: 204175 - DNA, 12 bp, Homo sapiens
ctaaaagtgatg

SEQ ID NO: 204176 - DNA, 16 bp, Homo sapiens
ctaaaagtgatgtgat

SEQ ID NO: 204177 - DNA, 14 bp, Homo sapiens
ctaaaataaaattt

SEQ ID NO: 204178 - DNA, 11 bp, Homo sapiens
ctaaaatacaa

SEQ ID NO: 204179 - DNA, 12 bp, Homo sapiens
ctaaaatacaag

SEQ ID NO: 204180 - DNA, 21 bp, Homo sapiens
ctaaaatactcaccaaaatat

SEQ ID NO: 204181 - DNA, 22 bp, Homo sapiens
ctaaaatactcaccaaaatata

SEQ ID NO: 204182 - DNA, 14 bp, Homo sapiens
ctaaaatgatttta

SEQ ID NO: 204183 - DNA, 17 bp, Homo sapiens
ctaaaattgtatgaaaa

SEQ ID NO: 204184 - DNA, 18 bp, Homo sapiens
ctaaacagactatttaac

SEQ ID NO: 204185 - DNA, 15 bp, Homo sapiens
ctaaaccaaaacaga

SEQ ID NO: 204186 - DNA, 16 bp, Homo sapiens
ctaaagagagaatgta

SEQ ID NO: 204187 - DNA, 19 bp, Homo sapiens
ctaaagaggaagccttgcc

SEQ ID NO: 204188 - DNA, 23 bp, Homo sapiens
ctaaagaggaagccttgcccagc

SEQ ID NO: 204189 - DNA, 19 bp, Homo sapiens
ctaaagcacttcttttcca

SEQ ID NO: 204190 - DNA, 13 bp, Homo sapiens
ctaaaggcctctt

SEQ ID NO: 204191 - DNA, 20 bp, Homo sapiens
ctaaagggacaataactctg

SEQ ID NO: 204192 - DNA, 18 bp, Homo sapiens
ctaaaggggagaaactga

SEQ ID NO: 204193 - DNA, 17 bp, Homo sapiens
ctaaagtagacttcatt

SEQ ID NO: 204194 - DNA, 16 bp, Homo sapiens
ctaaagtatttaaaga

SEQ ID NO: 204195 - DNA, 18 bp, Homo sapiens
ctaaagtgcctaccccag

SEQ ID NO: 204196 - DNA, 15 bp, Homo sapiens
ctaaagtgttggtct

SEQ ID NO: 204197 - DNA, 13 bp, Homo sapiens
ctaaagtttacag

SEQ ID NO: 204198 - DNA, 19 bp, Homo sapiens
ctaaagtttacagtaaata

SEQ ID NO: 204199 - DNA, 24 bp, Homo sapiens
ctaaagtttacagtaaataaattg

SEQ ID NO: 204200 - DNA, 22 bp, Homo sapiens
ctaaataaacacatagattcac

SEQ ID NO: 204201 - DNA, 17 bp, Homo sapiens
ggcactgttagtgacag

SEQ ID NO: 204202 - DNA, 18 bp, Homo sapiens
ggcacttatcgaagctga

SEQ ID NO: 204203 - DNA, 23 bp, Homo sapiens
ggcacttttgaactcacgagcct

SEQ ID NO: 204204 - DNA, 20 bp, Homo sapiens
ggcagaaacacaaccactca

SEQ ID NO: 204205 - DNA, 23 bp, Homo sapiens
ggcagaaacacaaccactcacca

SEQ ID NO: 204206 - DNA, 16 bp, Homo sapiens
ggcagaaaggagatca

SEQ ID NO: 204207 - DNA, 15 bp, Homo sapiens
ggcagaacctggtgg

SEQ ID NO: 204208 - DNA, 24 bp, Homo sapiens
ggcagaacctggtggctggaggca

SEQ ID NO: 204209 - DNA, 15 bp, Homo sapiens
ggcagaactctctgt

SEQ ID NO: 204210 - DNA, 19 bp, Homo sapiens
ggcagaactctctgtcttc

SEQ ID NO: 204211 - DNA, 14 bp, Homo sapiens
ggcagaactgagct

SEQ ID NO: 204212 - DNA, 16 bp, Homo sapiens
ggcagaagtgctcttt

SEQ ID NO: 204213 - DNA, 18 bp, Homo sapiens
ggcagaataagaaaacaa

SEQ ID NO: 204214 - DNA, 18 bp, Homo sapiens
ggcagacacatgctgttg

SEQ ID NO: 204215 - DNA, 13 bp, Homo sapiens
ggcagagaagaga

SEQ ID NO: 204216 - DNA, 16 bp, Homo sapiens
ggcagagaagagacca

SEQ ID NO: 204217 - DNA, 14 bp, Homo sapiens
ggcagagccaggat

SEQ ID NO: 204218 - DNA, 22 bp, Homo sapiens
ggcagagccatgggcctgggcc

SEQ ID NO: 204219 - DNA, 22 bp, Homo sapiens
ggcagagcccgcccacctgggc

SEQ ID NO: 204220 - DNA, 22 bp, Homo sapiens
ggcagagctgagtcggctgggc

SEQ ID NO: 204221 - DNA, 15 bp, Homo sapiens
ggcagaggcagggcc

SEQ ID NO: 204222 - DNA, 16 bp, Homo sapiens
ggcagaggggacagag

SEQ ID NO: 204223 - DNA, 19 bp, Homo sapiens
ggcagaggggagaggaagc

SEQ ID NO: 204224 - DNA, 20 bp, Homo sapiens
ggcagaggggagaggaagca

SEQ ID NO: 204225 - DNA, 18 bp, Homo sapiens
ggcagaggttgtggtgag

SEQ ID NO: 204226 - DNA, 18 bp, Homo sapiens
ggcagataatcagcctct

SEQ ID NO: 204227 - DNA, 19 bp, Homo sapiens
ggcagataatcagcctctt

SEQ ID NO: 204228 - DNA, 20 bp, Homo sapiens
ggcagatctgtgccccatgc

SEQ ID NO: 204229 - DNA, 16 bp, Homo sapiens
ggcagatggagcccat

SEQ ID NO: 204230 - DNA, 13 bp, Homo sapiens
ggcagattgaaaa

SEQ ID NO: 204231 - DNA, 21 bp, Homo sapiens
ggcagcaacaaaggatttgaa

SEQ ID NO: 204232 - DNA, 17 bp, Homo sapiens
ggcagcacctggagccc

SEQ ID NO: 204233 - DNA, 21 bp, Homo sapiens
ggcagcaggcctgttgctttt

SEQ ID NO: 204234 - DNA, 17 bp, Homo sapiens
ggcagcatggagagcct

SEQ ID NO: 204235 - DNA, 12 bp, Homo sapiens
ggcagccaggct

SEQ ID NO: 204236 - DNA, 19 bp, Homo sapiens
ggcagccaggctgccaagg

SEQ ID NO: 204237 - DNA, 17 bp, Homo sapiens
ggcagccagggagcccg

SEQ ID NO: 204238 - DNA, 14 bp, Homo sapiens
ggcagccatgagaa

SEQ ID NO: 204239 - DNA, 11 bp, Homo sapiens
ggcagccatgc

SEQ ID NO: 204240 - DNA, 12 bp, Homo sapiens
ggcagccatgcc

SEQ ID NO: 204241 - DNA, 13 bp, Homo sapiens
ggcagccatgcct

SEQ ID NO: 204242 - DNA, 15 bp, Homo sapiens
ggcagccatgcctca

SEQ ID NO: 204243 - DNA, 23 bp, Homo sapiens
ggcagcccagagagaccctgcca

SEQ ID NO: 204244 - DNA, 15 bp, Homo sapiens
ggcagccccatcctt

SEQ ID NO: 204245 - DNA, 19 bp, Homo sapiens
ggcagccccatccttcccg

SEQ ID NO: 204246 - DNA, 18 bp, Homo sapiens
ggcagccccccagtgtcc

SEQ ID NO: 204247 - DNA, 18 bp, Homo sapiens
ggcagccccgttttgggg

SEQ ID NO: 204248 - DNA, 11 bp, Homo sapiens
ggcagcccctc

SEQ ID NO: 204249 - DNA, 15 bp, Homo sapiens
ggcagcccctgctgg

SEQ ID NO: 204250 - DNA, 18 bp, Homo sapiens
ggcagccgtgccttcagc

SEQ ID NO: 204251 - DNA, 22 bp, Homo sapiens
ggcagcctatgggggctctcgg

SEQ ID NO: 204252 - DNA, 13 bp, Homo sapiens
ggcagcctccaga

SEQ ID NO: 204253 - DNA, 14 bp, Homo sapiens
ggcagcctgccgcc

SEQ ID NO: 204254 - DNA, 20 bp, Homo sapiens
ggcagcctggctcccaggac

SEQ ID NO: 204255 - DNA, 21 bp, Homo sapiens
ggcagcctggctcccaggaca

SEQ ID NO: 204256 - DNA, 20 bp, Homo sapiens
ggcagcgcctcccgccgcct

SEQ ID NO: 204257 - DNA, 21 bp, Homo sapiens
ggcagcgcctcccgccgcctc

SEQ ID NO: 204258 - DNA, 23 bp, Homo sapiens
ggcagctaaaagcatccctgtga

SEQ ID NO: 204259 - DNA, 15 bp, Homo sapiens
ggcagctagactgga

SEQ ID NO: 204260 - DNA, 18 bp, Homo sapiens
ggcagctagactggagtg

SEQ ID NO: 204261 - DNA, 18 bp, Homo sapiens
ggcagctcacccctgggc

SEQ ID NO: 204262 - DNA, 19 bp, Homo sapiens
ggcagctcacccctgggca

SEQ ID NO: 204263 - DNA, 13 bp, Homo sapiens
ggcagctctgtcg

SEQ ID NO: 204264 - DNA, 11 bp, Homo sapiens
ggcagctgcca

SEQ ID NO: 204265 - DNA, 14 bp, Homo sapiens
ggcagctgccagag

SEQ ID NO: 204266 - DNA, 16 bp, Homo sapiens
ggcagctgccagagaa

SEQ ID NO: 204267 - DNA, 17 bp, Homo sapiens
ggcagctgccagagaag

SEQ ID NO: 204268 - DNA, 17 bp, Homo sapiens
ggcagctggcaggagag

SEQ ID NO: 204269 - DNA, 11 bp, Homo sapiens
ggcagctgggc

SEQ ID NO: 204270 - DNA, 12 bp, Homo sapiens
ggcagctgggcc

SEQ ID NO: 204271 - DNA, 14 bp, Homo sapiens
ggcagctgggcccc

SEQ ID NO: 204272 - DNA, 18 bp, Homo sapiens
ggcagctgggccccacct

SEQ ID NO: 204273 - DNA, 19 bp, Homo sapiens
ggcagctgggccccaccta

SEQ ID NO: 204274 - DNA, 16 bp, Homo sapiens
ggcagctggggggctg

SEQ ID NO: 204275 - DNA, 22 bp, Homo sapiens
ggcagctggggggctgtcctga

SEQ ID NO: 204276 - DNA, 22 bp, Homo sapiens
ggcagctgtcccctctccctgg

SEQ ID NO: 204277 - DNA, 13 bp, Homo sapiens
ggcagcttcaaaa

SEQ ID NO: 204278 - DNA, 15 bp, Homo sapiens
ggcaggaaggagagc

SEQ ID NO: 204279 - DNA, 15 bp, Homo sapiens
ggcaggaagtcagga

SEQ ID NO: 204280 - DNA, 19 bp, Homo sapiens
ggcaggaagtcaggagcca

SEQ ID NO: 204281 - DNA, 21 bp, Homo sapiens
ggcaggaagtcaggagccagc

SEQ ID NO: 204282 - DNA, 14 bp, Homo sapiens
ggcaggaagtccct

SEQ ID NO: 204283 - DNA, 18 bp, Homo sapiens
ggcaggaatcaaggagcc

SEQ ID NO: 204284 - DNA, 21 bp, Homo sapiens
ggcaggacacatcccggcctc

SEQ ID NO: 204285 - DNA, 15 bp, Homo sapiens
ggcaggacctcagag

SEQ ID NO: 204286 - DNA, 19 bp, Homo sapiens
ggcaggagaatcagcctgg

SEQ ID NO: 204287 - DNA, 14 bp, Homo sapiens
ggcaggagctcaga

SEQ ID NO: 204288 - DNA, 23 bp, Homo sapiens
ggcaggaggccattccaggagtg

SEQ ID NO: 204289 - DNA, 14 bp, Homo sapiens
ggcaggagggaggt

SEQ ID NO: 204290 - DNA, 15 bp, Homo sapiens
ggcaggaggtgggtg

SEQ ID NO: 204291 - DNA, 19 bp, Homo sapiens
ggcaggagtgggctctgag

SEQ ID NO: 204292 - DNA, 21 bp, Homo sapiens
ggcaggcagagctcagcacag

SEQ ID NO: 204293 - DNA, 22 bp, Homo sapiens
ggcaggcagagctcagcacagc

SEQ ID NO: 204294 - DNA, 23 bp, Homo sapiens
ggcaggccagcttcgtgctggag

SEQ ID NO: 204295 - DNA, 19 bp, Homo sapiens
ggcaggcctgggacccagc

SEQ ID NO: 204296 - DNA, 13 bp, Homo sapiens
ggcaggcctttcc

SEQ ID NO: 204297 - DNA, 14 bp, Homo sapiens
ggcaggcctttcct

SEQ ID NO: 204298 - DNA, 18 bp, Homo sapiens
ggcagggagggcttgggg

SEQ ID NO: 204299 - DNA, 22 bp, Homo sapiens
ggcagggaggtcaggccctgga

SEQ ID NO: 204300 - DNA, 19 bp, Homo sapiens
ggcagggagtgtctgcagt

SEQ ID NO: 204301 - DNA, 22 bp, Homo sapiens
ggcagggagtgtctgcagtcct

SEQ ID NO: 204302 - DNA, 11 bp, Homo sapiens
ggcagggccct

SEQ ID NO: 204303 - DNA, 17 bp, Homo sapiens
ggcagggccgcagggcg

SEQ ID NO: 204304 - DNA, 22 bp, Homo sapiens
ggcagggccgcccgggcccaga

SEQ ID NO: 204305 - DNA, 16 bp, Homo sapiens
ggcagggcctggcctg

SEQ ID NO: 204306 - DNA, 17 bp, Homo sapiens
ggcaggggagccagggt

SEQ ID NO: 204307 - DNA, 14 bp, Homo sapiens
ggcaggggagtctg

SEQ ID NO: 204308 - DNA, 14 bp, Homo sapiens
ggcaggggcccctc

SEQ ID NO: 204309 - DNA, 22 bp, Homo sapiens
ggcaggggcccctcctctgtgc

SEQ ID NO: 204310 - DNA, 13 bp, Homo sapiens
ggcagggttctag

SEQ ID NO: 204311 - DNA, 17 bp, Homo sapiens
ggcagggttctagaagg

SEQ ID NO: 204312 - DNA, 20 bp, Homo sapiens
ggcagggttttatctctgtc

SEQ ID NO: 204313 - DNA, 21 bp, Homo sapiens
ggcaggtagatcgcttgagcc

SEQ ID NO: 204314 - DNA, 12 bp, Homo sapiens
ggcaggtgcaga

SEQ ID NO: 204315 - DNA, 16 bp, Homo sapiens
ggcaggtggccacagc

SEQ ID NO: 204316 - DNA, 16 bp, Homo sapiens
ggcaggttggatggga

SEQ ID NO: 204317 - DNA, 14 bp, Homo sapiens
ggcagtacctggga

SEQ ID NO: 204318 - DNA, 15 bp, Homo sapiens
ggcagtattcccttt

SEQ ID NO: 204319 - DNA, 16 bp, Homo sapiens
ggcagtcacactgctg

SEQ ID NO: 204320 - DNA, 18 bp, Homo sapiens
ggcagtcacactgctggg

SEQ ID NO: 204321 - DNA, 14 bp, Homo sapiens
ggcagtccagagct

SEQ ID NO: 204322 - DNA, 15 bp, Homo sapiens
ggcagtccagagctt

SEQ ID NO: 204323 - DNA, 13 bp, Homo sapiens
ggcagtctggagg

SEQ ID NO: 204324 - DNA, 16 bp, Homo sapiens
ggcagtgactggcagg

SEQ ID NO: 204325 - DNA, 20 bp, Homo sapiens
ggcagtgactggcaggtgca

SEQ ID NO: 204326 - DNA, 22 bp, Homo sapiens
ggcagtgcccaccatgcacccc

SEQ ID NO: 204327 - DNA, 17 bp, Homo sapiens
ggcagtgcgggaggaat

SEQ ID NO: 204328 - DNA, 24 bp, Homo sapiens
ggcagtgctagtgagctgggcatg

SEQ ID NO: 204329 - DNA, 13 bp, Homo sapiens
ggcagtggccagg

SEQ ID NO: 204330 - DNA, 16 bp, Homo sapiens
ggcagtggccaggcag

SEQ ID NO: 204331 - DNA, 19 bp, Homo sapiens
ggcagtggccaggcaggga

SEQ ID NO: 204332 - DNA, 20 bp, Homo sapiens
ggcagtggcttggagcagag

SEQ ID NO: 204333 - DNA, 21 bp, Homo sapiens
ggcagtgggacagggcatggc

SEQ ID NO: 204334 - DNA, 15 bp, Homo sapiens
ggcagtggggctggg

SEQ ID NO: 204335 - DNA, 15 bp, Homo sapiens
ctaaatagatacttt

SEQ ID NO: 204336 - DNA, 13 bp, Homo sapiens
ctaaatatccaaa

SEQ ID NO: 204337 - DNA, 19 bp, Homo sapiens
ctaaatatccaaagactgt

SEQ ID NO: 204338 - DNA, 22 bp, Homo sapiens
ctaaatatccaaagactgtact

SEQ ID NO: 204339 - DNA, 14 bp, Homo sapiens
ctaaatatttcctt

SEQ ID NO: 204340 - DNA, 21 bp, Homo sapiens
ctaaatcctttactgttagtc

SEQ ID NO: 204341 - DNA, 15 bp, Homo sapiens
ctaaatgaaaagaga

SEQ ID NO: 204342 - DNA, 21 bp, Homo sapiens
ctaaatgaaaagagaattact

SEQ ID NO: 204343 - DNA, 15 bp, Homo sapiens
ctaaatgaatgttta

SEQ ID NO: 204344 - DNA, 16 bp, Homo sapiens
ctaaatgacttattga

SEQ ID NO: 204345 - DNA, 13 bp, Homo sapiens
ctaaatgccctgc

SEQ ID NO: 204346 - DNA, 14 bp, Homo sapiens
ctaaatgccctgct

SEQ ID NO: 204347 - DNA, 20 bp, Homo sapiens
ctaaatggcaacaaacacat

SEQ ID NO: 204348 - DNA, 12 bp, Homo sapiens
ctaaatgttcat

SEQ ID NO: 204349 - DNA, 14 bp, Homo sapiens
ctaaatgttcatgt

SEQ ID NO: 204350 - DNA, 19 bp, Homo sapiens
ctaaattacaattgtcatt

SEQ ID NO: 204351 - DNA, 14 bp, Homo sapiens
ctaaattccacact

SEQ ID NO: 204352 - DNA, 12 bp, Homo sapiens
ctaaattgtata

SEQ ID NO: 204353 - DNA, 14 bp, Homo sapiens
ctaaattgtataca

SEQ ID NO: 204354 - DNA, 23 bp, Homo sapiens
ctaaatttgaatgttaagcagat

SEQ ID NO: 204355 - DNA, 13 bp, Homo sapiens
ctaaattttctga

SEQ ID NO: 204356 - DNA, 18 bp, Homo sapiens
ctaacaatgccttgttgt

SEQ ID NO: 204357 - DNA, 12 bp, Homo sapiens
ctaacaccacac

SEQ ID NO: 204358 - DNA, 13 bp, Homo sapiens
ctaacactggccc

SEQ ID NO: 204359 - DNA, 16 bp, Homo sapiens
ctaacactggccccta

SEQ ID NO: 204360 - DNA, 17 bp, Homo sapiens
ctaacactggcccctag

SEQ ID NO: 204361 - DNA, 19 bp, Homo sapiens
ctaacaggggctggtgggc

SEQ ID NO: 204362 - DNA, 20 bp, Homo sapiens
ctaacatgttatcaaatctg

SEQ ID NO: 204363 - DNA, 17 bp, Homo sapiens
ctaacattactgccttc

SEQ ID NO: 204364 - DNA, 15 bp, Homo sapiens
ctaacattatttatt

SEQ ID NO: 204365 - DNA, 19 bp, Homo sapiens
ctaaccagttctctttgta

SEQ ID NO: 204366 - DNA, 18 bp, Homo sapiens
ctaaccatccccaactcc

SEQ ID NO: 204367 - DNA, 19 bp, Homo sapiens
ctaaccatccccaactcca

SEQ ID NO: 204368 - DNA, 18 bp, Homo sapiens
ctaaccccctaagctcca

SEQ ID NO: 204369 - DNA, 19 bp, Homo sapiens
ctaacctacgaccccagag

SEQ ID NO: 204370 - DNA, 14 bp, Homo sapiens
ctaacctggagaca

SEQ ID NO: 204371 - DNA, 20 bp, Homo sapiens
ctaacgacttcagggcaggg

SEQ ID NO: 204372 - DNA, 14 bp, Homo sapiens
ctaactaaggacag

SEQ ID NO: 204373 - DNA, 14 bp, Homo sapiens
ctaactcaaggaat

SEQ ID NO: 204374 - DNA, 21 bp, Homo sapiens
ctaactctagtttgcagagga

SEQ ID NO: 204375 - DNA, 15 bp, Homo sapiens
ctaactcttgctcac

SEQ ID NO: 204376 - DNA, 15 bp, Homo sapiens
ctaactgagctgcca

SEQ ID NO: 204377 - DNA, 13 bp, Homo sapiens
ctaactggcccca

SEQ ID NO: 204378 - DNA, 17 bp, Homo sapiens
ctaactggccccaggcg

SEQ ID NO: 204379 - DNA, 20 bp, Homo sapiens
ctaactgtgctcaagaggtt

SEQ ID NO: 204380 - DNA, 14 bp, Homo sapiens
ctaacttaacattg

SEQ ID NO: 204381 - DNA, 23 bp, Homo sapiens
ctaactttagaagtgcatttctg

SEQ ID NO: 204382 - DNA, 15 bp, Homo sapiens
ctaactttcttgctt

SEQ ID NO: 204383 - DNA, 22 bp, Homo sapiens
ctaagaaaagatacgactttat

SEQ ID NO: 204384 - DNA, 17 bp, Homo sapiens
ctaagaataaataaaga

SEQ ID NO: 204385 - DNA, 20 bp, Homo sapiens
ctaagaataaataaagaaga

SEQ ID NO: 204386 - DNA, 15 bp, Homo sapiens
ctaagagcagagtct

SEQ ID NO: 204387 - DNA, 11 bp, Homo sapiens
ctaagagccat

SEQ ID NO: 204388 - DNA, 11 bp, Homo sapiens
ctaagaggctg

SEQ ID NO: 204389 - DNA, 19 bp, Homo sapiens
ctaagagtgtcactgagct

SEQ ID NO: 204390 - DNA, 19 bp, Homo sapiens
ctaagatactgctgatgct

SEQ ID NO: 204391 - DNA, 17 bp, Homo sapiens
ctaagatgaaattgcca

SEQ ID NO: 204392 - DNA, 24 bp, Homo sapiens
ctaagatgagatttgccagcacag

SEQ ID NO: 204393 - DNA, 12 bp, Homo sapiens
ctaagattgtac

SEQ ID NO: 204394 - DNA, 14 bp, Homo sapiens
ctaagattgtacat

SEQ ID NO: 204395 - DNA, 20 bp, Homo sapiens
ctaagatttattttgttaaa

SEQ ID NO: 204396 - DNA, 12 bp, Homo sapiens
ctaagcaatttc

SEQ ID NO: 204397 - DNA, 13 bp, Homo sapiens
ctaagcaatttct

SEQ ID NO: 204398 - DNA, 24 bp, Homo sapiens
ctaagcatgtgtcccaggagcagg

SEQ ID NO: 204399 - DNA, 18 bp, Homo sapiens
ctaagccaagggcctctt

SEQ ID NO: 204400 - DNA, 19 bp, Homo sapiens
ctaagccactcccgccaca

SEQ ID NO: 204401 - DNA, 15 bp, Homo sapiens
ctaagccaggaggct

SEQ ID NO: 204402 - DNA, 14 bp, Homo sapiens
ctaagcctgttgct

SEQ ID NO: 204403 - DNA, 23 bp, Homo sapiens
ctaagcctgttgctgaagtcatt

SEQ ID NO: 204404 - DNA, 16 bp, Homo sapiens
ctaagcctttccataa

SEQ ID NO: 204405 - DNA, 17 bp, Homo sapiens
ctaagcctttccataag

SEQ ID NO: 204406 - DNA, 22 bp, Homo sapiens
ctaagcgcacattcatgtgggc

SEQ ID NO: 204407 - DNA, 13 bp, Homo sapiens
ctaagctccagcc

SEQ ID NO: 204408 - DNA, 14 bp, Homo sapiens
ctaagctccagccc

SEQ ID NO: 204409 - DNA, 23 bp, Homo sapiens
ctaagctccaggtgccctgtggg

SEQ ID NO: 204410 - DNA, 15 bp, Homo sapiens
ctaagcttaaaaaaa

SEQ ID NO: 204411 - DNA, 12 bp, Homo sapiens
ctaagcttattt

SEQ ID NO: 204412 - DNA, 13 bp, Homo sapiens
ctaagcttatttc

SEQ ID NO: 204413 - DNA, 16 bp, Homo sapiens
ctaagcttatttctaa

SEQ ID NO: 204414 - DNA, 16 bp, Homo sapiens
ctaaggacacactaat

SEQ ID NO: 204415 - DNA, 16 bp, Homo sapiens
ctaaggatagcctttg

SEQ ID NO: 204416 - DNA, 17 bp, Homo sapiens
ctaaggatagcctttgt

SEQ ID NO: 204417 - DNA, 11 bp, Homo sapiens
ctaaggccaag

SEQ ID NO: 204418 - DNA, 22 bp, Homo sapiens
ctaaggccaaggcctcaggaga

SEQ ID NO: 204419 - DNA, 19 bp, Homo sapiens
ctaaggccgaagaagggtc

SEQ ID NO: 204420 - DNA, 17 bp, Homo sapiens
ctaaggcctcttgctgg

SEQ ID NO: 204421 - DNA, 21 bp, Homo sapiens
ctaaggcctcttgctggtgca

SEQ ID NO: 204422 - DNA, 14 bp, Homo sapiens
ctaaggctcctcct

SEQ ID NO: 204423 - DNA, 19 bp, Homo sapiens
ctaagggaaataacagtat

SEQ ID NO: 204424 - DNA, 23 bp, Homo sapiens
ctaaggggcaggaatcaaggagc

SEQ ID NO: 204425 - DNA, 18 bp, Homo sapiens
ctaagtaaatctaaatta

SEQ ID NO: 204426 - DNA, 21 bp, Homo sapiens
ctaagtaacctctacaggcat

SEQ ID NO: 204427 - DNA, 16 bp, Homo sapiens
ctaagtatttaaatgt

SEQ ID NO: 204428 - DNA, 16 bp, Homo sapiens
ctaagtcgcgagccag

SEQ ID NO: 204429 - DNA, 16 bp, Homo sapiens
ctaagtgacatttgta

SEQ ID NO: 204430 - DNA, 17 bp, Homo sapiens
ctaagtgacatttgtag

SEQ ID NO: 204431 - DNA, 13 bp, Homo sapiens
ctaagtgcccaaa

SEQ ID NO: 204432 - DNA, 14 bp, Homo sapiens
ctaagtgcccaaag

SEQ ID NO: 204433 - DNA, 12 bp, Homo sapiens
ctaagtgggaga

SEQ ID NO: 204434 - DNA, 20 bp, Homo sapiens
ctaagtgttgactttttaaa

SEQ ID NO: 204435 - DNA, 15 bp, Homo sapiens
ctaataaaaaggttt

SEQ ID NO: 204436 - DNA, 10 bp, Homo sapiens
ctaataaaac

SEQ ID NO: 204437 - DNA, 22 bp, Homo sapiens
ctaataaaatatcattcagcaa

SEQ ID NO: 204438 - DNA, 15 bp, Homo sapiens
ctaataaatgaccag

SEQ ID NO: 204439 - DNA, 21 bp, Homo sapiens
ctaataaatgaccagtttacc

SEQ ID NO: 204440 - DNA, 17 bp, Homo sapiens
ctaatacccaaacccta

SEQ ID NO: 204441 - DNA, 22 bp, Homo sapiens
ctaatagaagtccatgagttga

SEQ ID NO: 204442 - DNA, 12 bp, Homo sapiens
ctaatatatttt

SEQ ID NO: 204443 - DNA, 19 bp, Homo sapiens
ctaatatcattttattcac

SEQ ID NO: 204444 - DNA, 19 bp, Homo sapiens
ctaatattcagtcctgtat

SEQ ID NO: 204445 - DNA, 14 bp, Homo sapiens
ctaatattttatgt

SEQ ID NO: 204446 - DNA, 23 bp, Homo sapiens
ctaatcagaaatttttatcagtt

SEQ ID NO: 204447 - DNA, 17 bp, Homo sapiens
ctaatcagcattctcac

SEQ ID NO: 204448 - DNA, 21 bp, Homo sapiens
ctaatcagcattctcactcct

SEQ ID NO: 204449 - DNA, 20 bp, Homo sapiens
ctaatcatgtgggtgagcca

SEQ ID NO: 204450 - DNA, 21 bp, Homo sapiens
ctaatcatgtgggtgagccag

SEQ ID NO: 204451 - DNA, 18 bp, Homo sapiens
ctaatccatgtgctgctg

SEQ ID NO: 204452 - DNA, 12 bp, Homo sapiens
ctaatcctccaa

SEQ ID NO: 204453 - DNA, 18 bp, Homo sapiens
ctaatctattgggttcat

SEQ ID NO: 204454 - DNA, 22 bp, Homo sapiens
ctaatctattgggttcattatt

SEQ ID NO: 204455 - DNA, 15 bp, Homo sapiens
ctaatctcttattct

SEQ ID NO: 204456 - DNA, 13 bp, Homo sapiens
ctaatctgtaggg

SEQ ID NO: 204457 - DNA, 18 bp, Homo sapiens
ctaatctgtagggctgga

SEQ ID NO: 204458 - DNA, 15 bp, Homo sapiens
ctaatcttcagggca

SEQ ID NO: 204459 - DNA, 19 bp, Homo sapiens
ctaatgaattttaaaagca

SEQ ID NO: 204460 - DNA, 22 bp, Homo sapiens
ctaatgaattttaaaagcatat

SEQ ID NO: 204461 - DNA, 19 bp, Homo sapiens
ctaatgagatatatcttta

SEQ ID NO: 204462 - DNA, 13 bp, Homo sapiens
ctaatgatgtttt

SEQ ID NO: 204463 - DNA, 12 bp, Homo sapiens
ctaatgctcctt

SEQ ID NO: 204464 - DNA, 19 bp, Homo sapiens
ctaatgctcgtatctcctt

SEQ ID NO: 204465 - DNA, 24 bp, Homo sapiens
ctaatgctgcacaccagttactgt

SEQ ID NO: 204466 - DNA, 21 bp, Homo sapiens
ctaatggtacgtgggtaccca

SEQ ID NO: 204467 - DNA, 21 bp, Homo sapiens
ctaatgttagaattgatttcc

SEQ ID NO: 204468 - DNA, 17 bp, Homo sapiens
ctaatgtttatgagcca

SEQ ID NO: 204469 - DNA, 20 bp, Homo sapiens
ctaatgtttatgagccagac

SEQ ID NO: 204470 - DNA, 15 bp, Homo sapiens
ggcagtgtggtggga

SEQ ID NO: 204471 - DNA, 15 bp, Homo sapiens
ggcagtgtttgtata

SEQ ID NO: 204472 - DNA, 18 bp, Homo sapiens
ggcagttctcactcctag

SEQ ID NO: 204473 - DNA, 23 bp, Homo sapiens
ggcataccgtttggtgtctgatg

SEQ ID NO: 204474 - DNA, 15 bp, Homo sapiens
ggcatactctccagg

SEQ ID NO: 204475 - DNA, 15 bp, Homo sapiens
ggcatagccctcctg

SEQ ID NO: 204476 - DNA, 15 bp, Homo sapiens
ggcataggcctgggt

SEQ ID NO: 204477 - DNA, 20 bp, Homo sapiens
ggcatcagctttccctggct

SEQ ID NO: 204478 - DNA, 23 bp, Homo sapiens
ggcatcagctttccctggctcag

SEQ ID NO: 204479 - DNA, 18 bp, Homo sapiens
ggcatcaggcactggtgg

SEQ ID NO: 204480 - DNA, 13 bp, Homo sapiens
ggcatccacccag

SEQ ID NO: 204481 - DNA, 16 bp, Homo sapiens
ggcatccacccagtgc

SEQ ID NO: 204482 - DNA, 13 bp, Homo sapiens
ggcatccccagcc

SEQ ID NO: 204483 - DNA, 19 bp, Homo sapiens
ggcatccccagccccctgg

SEQ ID NO: 204484 - DNA, 16 bp, Homo sapiens
ggcatccttctgcctt

SEQ ID NO: 204485 - DNA, 13 bp, Homo sapiens
ggcatctccagga

SEQ ID NO: 204486 - DNA, 22 bp, Homo sapiens
ggcatctctggagtgtgtgggg

SEQ ID NO: 204487 - DNA, 19 bp, Homo sapiens
ggcatctgcccctccccca

SEQ ID NO: 204488 - DNA, 17 bp, Homo sapiens
ggcatctttgccttggg

SEQ ID NO: 204489 - DNA, 19 bp, Homo sapiens
ggcatctttgccttgggct

SEQ ID NO: 204490 - DNA, 22 bp, Homo sapiens
ggcatctttgccttgggctgct

SEQ ID NO: 204491 - DNA, 22 bp, Homo sapiens
ggcatgattttggctcactgca

SEQ ID NO: 204492 - DNA, 17 bp, Homo sapiens
ggcatgccaccctcaca

SEQ ID NO: 204493 - DNA, 16 bp, Homo sapiens
ggcatgcctgtgtgac

SEQ ID NO: 204494 - DNA, 13 bp, Homo sapiens
ggcatgctggcct

SEQ ID NO: 204495 - DNA, 18 bp, Homo sapiens
ggcatggacagggccagg

SEQ ID NO: 204496 - DNA, 20 bp, Homo sapiens
ggcatggcccagcctggagc

SEQ ID NO: 204497 - DNA, 22 bp, Homo sapiens
ggcatggcccagcctggagccg

SEQ ID NO: 204498 - DNA, 14 bp, Homo sapiens
ggcatgggggaggc

SEQ ID NO: 204499 - DNA, 18 bp, Homo sapiens
ggcatgggggaggctctg

SEQ ID NO: 204500 - DNA, 20 bp, Homo sapiens
ggcatggggtgggcctctgg

SEQ ID NO: 204501 - DNA, 13 bp, Homo sapiens
ggcatgggtggag

SEQ ID NO: 204502 - DNA, 15 bp, Homo sapiens
ggcatgggtggaggg

SEQ ID NO: 204503 - DNA, 21 bp, Homo sapiens
ggcatggttccttccctggga

SEQ ID NO: 204504 - DNA, 22 bp, Homo sapiens
ggcatggttccttccctgggaa

SEQ ID NO: 204505 - DNA, 20 bp, Homo sapiens
ggcatgtattagccagtcat

SEQ ID NO: 204506 - DNA, 16 bp, Homo sapiens
ggcatgtattggcctg

SEQ ID NO: 204507 - DNA, 16 bp, Homo sapiens
ggcatgtgaaaagtaa

SEQ ID NO: 204508 - DNA, 21 bp, Homo sapiens
ggcatgtgaaaagtaaaacag

SEQ ID NO: 204509 - DNA, 17 bp, Homo sapiens
ggcatgtgatattttca

SEQ ID NO: 204510 - DNA, 18 bp, Homo sapiens
ggcatgtgggttgtgata

SEQ ID NO: 204511 - DNA, 17 bp, Homo sapiens
ggcatgtgtgcctgtgg

SEQ ID NO: 204512 - DNA, 18 bp, Homo sapiens
ggcatgttgggataaata

SEQ ID NO: 204513 - DNA, 15 bp, Homo sapiens
ggcattactctgcac

SEQ ID NO: 204514 - DNA, 18 bp, Homo sapiens
ggcattagtttcaggcaa

SEQ ID NO: 204515 - DNA, 18 bp, Homo sapiens
ggcattcacacacagcct

SEQ ID NO: 204516 - DNA, 19 bp, Homo sapiens
ggcattcacacacagcctg

SEQ ID NO: 204517 - DNA, 20 bp, Homo sapiens
ggcattcacacacagcctgg

SEQ ID NO: 204518 - DNA, 16 bp, Homo sapiens
ggcattctacacctgg

SEQ ID NO: 204519 - DNA, 16 bp, Homo sapiens
ggcattgcactaaaag

SEQ ID NO: 204520 - DNA, 13 bp, Homo sapiens
ggcattgggctga

SEQ ID NO: 204521 - DNA, 18 bp, Homo sapiens
ggcattgggctgacacct

SEQ ID NO: 204522 - DNA, 13 bp, Homo sapiens
ggcatttgctgaa

SEQ ID NO: 204523 - DNA, 19 bp, Homo sapiens
ggcatttgtaaatattaaa

SEQ ID NO: 204524 - DNA, 17 bp, Homo sapiens
ggcattttcctcgccta

SEQ ID NO: 204525 - DNA, 17 bp, Homo sapiens
ggcattttgaatgtgat

SEQ ID NO: 204526 - DNA, 20 bp, Homo sapiens
ggcattttgaatgtgatcat

SEQ ID NO: 204527 - DNA, 13 bp, Homo sapiens
ggccaaagtgtta

SEQ ID NO: 204528 - DNA, 12 bp, Homo sapiens
ggccaaatatgc

SEQ ID NO: 204529 - DNA, 19 bp, Homo sapiens
ggccaaatgcacaagctca

SEQ ID NO: 204530 - DNA, 22 bp, Homo sapiens
ggccaaatgcacaagctcagaa

SEQ ID NO: 204531 - DNA, 19 bp, Homo sapiens
ggccaacatcgtgaaaccc

SEQ ID NO: 204532 - DNA, 16 bp, Homo sapiens
ggccaacgtggacctg

SEQ ID NO: 204533 - DNA, 15 bp, Homo sapiens
ggccaagacttggca

SEQ ID NO: 204534 - DNA, 21 bp, Homo sapiens
ggccaagccagggttccagac

SEQ ID NO: 204535 - DNA, 14 bp, Homo sapiens
ggccaagcctgcag

SEQ ID NO: 204536 - DNA, 12 bp, Homo sapiens
ggccaaggacac

SEQ ID NO: 204537 - DNA, 13 bp, Homo sapiens
ggccaaggcaggt

SEQ ID NO: 204538 - DNA, 17 bp, Homo sapiens
ggccaaggcctcaggag

SEQ ID NO: 204539 - DNA, 18 bp, Homo sapiens
ggccaaggccttctcctc

SEQ ID NO: 204540 - DNA, 21 bp, Homo sapiens
ggccaaggggccagctgcccc

SEQ ID NO: 204541 - DNA, 16 bp, Homo sapiens
ggccaagtcccaccgg

SEQ ID NO: 204542 - DNA, 22 bp, Homo sapiens
ggccacaaatcaaagcaagggc

SEQ ID NO: 204543 - DNA, 23 bp, Homo sapiens
ggccacaaatcaaagcaagggct

SEQ ID NO: 204544 - DNA, 18 bp, Homo sapiens
ggccacaatcctccccac

SEQ ID NO: 204545 - DNA, 17 bp, Homo sapiens
ggccacacccaggaagg

SEQ ID NO: 204546 - DNA, 15 bp, Homo sapiens
ggccacacgctgccc

SEQ ID NO: 204547 - DNA, 16 bp, Homo sapiens
ggccacacgctgccca

SEQ ID NO: 204548 - DNA, 22 bp, Homo sapiens
ggccacacgctgcccaggctct

SEQ ID NO: 204549 - DNA, 14 bp, Homo sapiens
ggccacagccacct

SEQ ID NO: 204550 - DNA, 12 bp, Homo sapiens
ggccacagccag

SEQ ID NO: 204551 - DNA, 20 bp, Homo sapiens
ggccacagggcgagactccg

SEQ ID NO: 204552 - DNA, 18 bp, Homo sapiens
ggccacatccaacatttc

SEQ ID NO: 204553 - DNA, 22 bp, Homo sapiens
ggccaccagctccactggcctg

SEQ ID NO: 204554 - DNA, 17 bp, Homo sapiens
ggccacccaccagggct

SEQ ID NO: 204555 - DNA, 19 bp, Homo sapiens
ggccaccccctatcctctg

SEQ ID NO: 204556 - DNA, 24 bp, Homo sapiens
ggccacccgttctgctggcctgga

SEQ ID NO: 204557 - DNA, 13 bp, Homo sapiens
ggccaccctggcc

SEQ ID NO: 204558 - DNA, 13 bp, Homo sapiens
ggccacccttggc

SEQ ID NO: 204559 - DNA, 12 bp, Homo sapiens
ggccacctgcag

SEQ ID NO: 204560 - DNA, 13 bp, Homo sapiens
ggccacctgcccc

SEQ ID NO: 204561 - DNA, 15 bp, Homo sapiens
ggccacgcagccagg

SEQ ID NO: 204562 - DNA, 19 bp, Homo sapiens
ggccacgcagccaggacac

SEQ ID NO: 204563 - DNA, 14 bp, Homo sapiens
ggccacgccccagc

SEQ ID NO: 204564 - DNA, 16 bp, Homo sapiens
ggccacggcctgggag

SEQ ID NO: 204565 - DNA, 17 bp, Homo sapiens
ggccactccagacccct

SEQ ID NO: 204566 - DNA, 14 bp, Homo sapiens
ggccactctcagag

SEQ ID NO: 204567 - DNA, 23 bp, Homo sapiens
ggccactctcagagactcccagg

SEQ ID NO: 204568 - DNA, 23 bp, Homo sapiens
ggccactgcaaaccctgctgcct

SEQ ID NO: 204569 - DNA, 13 bp, Homo sapiens
ggccactgcagtc

SEQ ID NO: 204570 - DNA, 12 bp, Homo sapiens
ggccactgggcc

SEQ ID NO: 204571 - DNA, 22 bp, Homo sapiens
ggccactgggtctcactcctga

SEQ ID NO: 204572 - DNA, 14 bp, Homo sapiens
ggccactgtggcca

SEQ ID NO: 204573 - DNA, 19 bp, Homo sapiens
ggccactgtggccagagct

SEQ ID NO: 204574 - DNA, 21 bp, Homo sapiens
ggccactgtggccagagctgg

SEQ ID NO: 204575 - DNA, 19 bp, Homo sapiens
ggccactttgcagacctgg

SEQ ID NO: 204576 - DNA, 22 bp, Homo sapiens
ggccactttgcagacctgggac

SEQ ID NO: 204577 - DNA, 15 bp, Homo sapiens
ggccagaaggagggc

SEQ ID NO: 204578 - DNA, 19 bp, Homo sapiens
ggccagaaggagggcagag

SEQ ID NO: 204579 - DNA, 23 bp, Homo sapiens
ggccagaaggagggcagagccat

SEQ ID NO: 204580 - DNA, 16 bp, Homo sapiens
ggccagaccagagctc

SEQ ID NO: 204581 - DNA, 19 bp, Homo sapiens
ggccagaccagagctctgg

SEQ ID NO: 204582 - DNA, 12 bp, Homo sapiens
ggccagactggc

SEQ ID NO: 204583 - DNA, 23 bp, Homo sapiens
ggccagagaagataatgttcttt

SEQ ID NO: 204584 - DNA, 20 bp, Homo sapiens
ggccagagagggcccagctg

SEQ ID NO: 204585 - DNA, 21 bp, Homo sapiens
ggccagagagggcccagctgt

SEQ ID NO: 204586 - DNA, 23 bp, Homo sapiens
ggccagagagggcccagctgtag

SEQ ID NO: 204587 - DNA, 17 bp, Homo sapiens
ggccagagcacctcagg

SEQ ID NO: 204588 - DNA, 18 bp, Homo sapiens
ggccagagcacctcagga

SEQ ID NO: 204589 - DNA, 14 bp, Homo sapiens
ggccagaggcagct

SEQ ID NO: 204590 - DNA, 15 bp, Homo sapiens
ggccagagtggcctg

SEQ ID NO: 204591 - DNA, 19 bp, Homo sapiens
ggccagagtggcctggcca

SEQ ID NO: 204592 - DNA, 20 bp, Homo sapiens
ggccagagtggcctggccag

SEQ ID NO: 204593 - DNA, 21 bp, Homo sapiens
ggccagatctgttaagtggtt

SEQ ID NO: 204594 - DNA, 14 bp, Homo sapiens
ggccagcaaggcag

SEQ ID NO: 204595 - DNA, 13 bp, Homo sapiens
ggccagcccagga

SEQ ID NO: 204596 - DNA, 20 bp, Homo sapiens
ggccagccccacccaggagg

SEQ ID NO: 204597 - DNA, 15 bp, Homo sapiens
ggccagcccctccca

SEQ ID NO: 204598 - DNA, 16 bp, Homo sapiens
ggccagcccctcccac

SEQ ID NO: 204599 - DNA, 17 bp, Homo sapiens
ggccagcctcacccttg

SEQ ID NO: 204600 - DNA, 20 bp, Homo sapiens
ggccagcctggggcctggca

SEQ ID NO: 204601 - DNA, 21 bp, Homo sapiens
ggccagcctggggcctggcag

SEQ ID NO: 204602 - DNA, 20 bp, Homo sapiens
ggccagcgaggcgaggctgc

SEQ ID NO: 204603 - DNA, 12 bp, Homo sapiens
ggccagctcccc

SEQ ID NO: 204604 - DNA, 17 bp, Homo sapiens
ctaattaaaaaaataat

SEQ ID NO: 204605 - DNA, 17 bp, Homo sapiens
ctaattaacatataata

SEQ ID NO: 204606 - DNA, 13 bp, Homo sapiens
ctaattaatttca

SEQ ID NO: 204607 - DNA, 14 bp, Homo sapiens
ctaattaatttcag

SEQ ID NO: 204608 - DNA, 21 bp, Homo sapiens
ctaattacacacgtgtgatgt

SEQ ID NO: 204609 - DNA, 17 bp, Homo sapiens
ctaattcccattttgca

SEQ ID NO: 204610 - DNA, 20 bp, Homo sapiens
ctaattcccattttgcaaaa

SEQ ID NO: 204611 - DNA, 15 bp, Homo sapiens
ctaattcctttctat

SEQ ID NO: 204612 - DNA, 15 bp, Homo sapiens
ctaattctcttcgct

SEQ ID NO: 204613 - DNA, 12 bp, Homo sapiens
ctaatttaaaaa

SEQ ID NO: 204614 - DNA, 14 bp, Homo sapiens
ctaatttaaaaaat

SEQ ID NO: 204615 - DNA, 22 bp, Homo sapiens
ctaatttctgtccagaaaatag

SEQ ID NO: 204616 - DNA, 17 bp, Homo sapiens
ctaatttgtatgtttcc

SEQ ID NO: 204617 - DNA, 20 bp, Homo sapiens
ctaattttctcaaaagcatt

SEQ ID NO: 204618 - DNA, 14 bp, Homo sapiens
ctaattttgtgctc

SEQ ID NO: 204619 - DNA, 16 bp, Homo sapiens
ctaattttgtgctctt

SEQ ID NO: 204620 - DNA, 20 bp, Homo sapiens
ctaattttgtgctctttcct

SEQ ID NO: 204621 - DNA, 22 bp, Homo sapiens
ctaattttgtgctctttcctgc

SEQ ID NO: 204622 - DNA, 23 bp, Homo sapiens
ctaattttgtgctctttcctgcc

SEQ ID NO: 204623 - DNA, 12 bp, Homo sapiens
ctaatttttcct

SEQ ID NO: 204624 - DNA, 23 bp, Homo sapiens
ctacaaaaaaaatcaaaaaatta

SEQ ID NO: 204625 - DNA, 15 bp, Homo sapiens
ctacaaaaatacaat

SEQ ID NO: 204626 - DNA, 21 bp, Homo sapiens
ctacaaaacctgatgttaaaa

SEQ ID NO: 204627 - DNA, 16 bp, Homo sapiens
ctacaaaatgtgtgct

SEQ ID NO: 204628 - DNA, 10 bp, Homo sapiens
ctacaaacat

SEQ ID NO: 204629 - DNA, 16 bp, Homo sapiens
ctacaacaagagttta

SEQ ID NO: 204630 - DNA, 14 bp, Homo sapiens
ctacaaccagagcc

SEQ ID NO: 204631 - DNA, 19 bp, Homo sapiens
ctacaaccagagcccccca

SEQ ID NO: 204632 - DNA, 15 bp, Homo sapiens
ctacaagagcagcct

SEQ ID NO: 204633 - DNA, 18 bp, Homo sapiens
ctacaagagcagcctgtg

SEQ ID NO: 204634 - DNA, 19 bp, Homo sapiens
ctacaagagcagcctgtgg

SEQ ID NO: 204635 - DNA, 23 bp, Homo sapiens
ctacaagagcagcctgtggcatc

SEQ ID NO: 204636 - DNA, 21 bp, Homo sapiens
ctacaatatcattttcctggg

SEQ ID NO: 204637 - DNA, 22 bp, Homo sapiens
ctacaatatcattttcctggga

SEQ ID NO: 204638 - DNA, 18 bp, Homo sapiens
ctacacaacatgtatgtg

SEQ ID NO: 204639 - DNA, 13 bp, Homo sapiens
ctacacacacaca

SEQ ID NO: 204640 - DNA, 19 bp, Homo sapiens
ctacacctctgggccctgc

SEQ ID NO: 204641 - DNA, 19 bp, Homo sapiens
ctacacctgttgcacctca

SEQ ID NO: 204642 - DNA, 12 bp, Homo sapiens
ctacactctcct

SEQ ID NO: 204643 - DNA, 14 bp, Homo sapiens
ctacactctcctgg

SEQ ID NO: 204644 - DNA, 17 bp, Homo sapiens
ctacactctcctgggcc

SEQ ID NO: 204645 - DNA, 22 bp, Homo sapiens
ctacagaaagcaaatcagacac

SEQ ID NO: 204646 - DNA, 14 bp, Homo sapiens
ctacagacattaaa

SEQ ID NO: 204647 - DNA, 16 bp, Homo sapiens
ctacagagcagctccc

SEQ ID NO: 204648 - DNA, 17 bp, Homo sapiens
ctacagagcagctcccc

SEQ ID NO: 204649 - DNA, 18 bp, Homo sapiens
ctacagagcagctcccca

SEQ ID NO: 204650 - DNA, 18 bp, Homo sapiens
ctacagccagtaaggcag

SEQ ID NO: 204651 - DNA, 22 bp, Homo sapiens
ctacagccagtaaggcagctct

SEQ ID NO: 204652 - DNA, 20 bp, Homo sapiens
ctacagccgtcccgcgttca

SEQ ID NO: 204653 - DNA, 14 bp, Homo sapiens
ctacagcctgcaca

SEQ ID NO: 204654 - DNA, 18 bp, Homo sapiens
ctacagctaatcagcatt

SEQ ID NO: 204655 - DNA, 22 bp, Homo sapiens
ctacagctaatcagcattctca

SEQ ID NO: 204656 - DNA, 19 bp, Homo sapiens
ctacagctcacctctgaag

SEQ ID NO: 204657 - DNA, 20 bp, Homo sapiens
ctacaggcccggcccagcct

SEQ ID NO: 204658 - DNA, 22 bp, Homo sapiens
ctacaggtgaaggctctcaccc

SEQ ID NO: 204659 - DNA, 15 bp, Homo sapiens
ctacagtagctgtgg

SEQ ID NO: 204660 - DNA, 20 bp, Homo sapiens
ctacagtagctgtggggagc

SEQ ID NO: 204661 - DNA, 21 bp, Homo sapiens
ctacagtagctgtggggagct

SEQ ID NO: 204662 - DNA, 22 bp, Homo sapiens
ctacataaactgactttatcct

SEQ ID NO: 204663 - DNA, 22 bp, Homo sapiens
ctacataagtaattcaagaaaa

SEQ ID NO: 204664 - DNA, 23 bp, Homo sapiens
ctacataagtaattcaagaaaac

SEQ ID NO: 204665 - DNA, 22 bp, Homo sapiens
ctacataattaaattttaatgt

SEQ ID NO: 204666 - DNA, 19 bp, Homo sapiens
ctacatatgataggcagca

SEQ ID NO: 204667 - DNA, 14 bp, Homo sapiens
ctacatcccagcct

SEQ ID NO: 204668 - DNA, 12 bp, Homo sapiens
ctacatgactgg

SEQ ID NO: 204669 - DNA, 15 bp, Homo sapiens
ctacatgactgggcc

SEQ ID NO: 204670 - DNA, 18 bp, Homo sapiens
ctacatgactgggcctcc

SEQ ID NO: 204671 - DNA, 15 bp, Homo sapiens
ctacatgcagcccat

SEQ ID NO: 204672 - DNA, 20 bp, Homo sapiens
ctacattccctctcctgccc

SEQ ID NO: 204673 - DNA, 21 bp, Homo sapiens
ctacattccctctcctgccca

SEQ ID NO: 204674 - DNA, 13 bp, Homo sapiens
ctacattcctcag

SEQ ID NO: 204675 - DNA, 17 bp, Homo sapiens
ctacattcctcagctgc

SEQ ID NO: 204676 - DNA, 12 bp, Homo sapiens
ctacattctcta

SEQ ID NO: 204677 - DNA, 16 bp, Homo sapiens
ctacattctctatttt

SEQ ID NO: 204678 - DNA, 15 bp, Homo sapiens
ctaccaaatgtgtaa

SEQ ID NO: 204679 - DNA, 19 bp, Homo sapiens
ctaccaaatgtgtaatgga

SEQ ID NO: 204680 - DNA, 16 bp, Homo sapiens
ctaccacaaggaaaat

SEQ ID NO: 204681 - DNA, 17 bp, Homo sapiens
ctaccagcgcccgctgg

SEQ ID NO: 204682 - DNA, 19 bp, Homo sapiens
ctaccagcgcccgctgggc

SEQ ID NO: 204683 - DNA, 22 bp, Homo sapiens
ctaccagcgcccgctgggctga

SEQ ID NO: 204684 - DNA, 15 bp, Homo sapiens
ctaccaggtgttcta

SEQ ID NO: 204685 - DNA, 21 bp, Homo sapiens
ctaccagtcgccctctgtgcc

SEQ ID NO: 204686 - DNA, 14 bp, Homo sapiens
ctaccatgctgctt

SEQ ID NO: 204687 - DNA, 14 bp, Homo sapiens
ctacccaaccactc

SEQ ID NO: 204688 - DNA, 14 bp, Homo sapiens
ctacccacagggcc

SEQ ID NO: 204689 - DNA, 16 bp, Homo sapiens
ctacccacagggcctg

SEQ ID NO: 204690 - DNA, 18 bp, Homo sapiens
ctacccacagggcctgac

SEQ ID NO: 204691 - DNA, 22 bp, Homo sapiens
ctacccacagggcctgactttt

SEQ ID NO: 204692 - DNA, 13 bp, Homo sapiens
ctacccagcccat

SEQ ID NO: 204693 - DNA, 17 bp, Homo sapiens
ctacccatgagcctgcc

SEQ ID NO: 204694 - DNA, 18 bp, Homo sapiens
ctacccatgttgggaaaa

SEQ ID NO: 204695 - DNA, 21 bp, Homo sapiens
ctaccccacaccaggccgtcc

SEQ ID NO: 204696 - DNA, 19 bp, Homo sapiens
ctaccccagttcatctctg

SEQ ID NO: 204697 - DNA, 21 bp, Homo sapiens
ctaccccagttcatctctgct

SEQ ID NO: 204698 - DNA, 21 bp, Homo sapiens
ctaccccccgtctcctgccgg

SEQ ID NO: 204699 - DNA, 16 bp, Homo sapiens
ctacccccttgtctgc

SEQ ID NO: 204700 - DNA, 20 bp, Homo sapiens
ctacccccttgtctgctgct

SEQ ID NO: 204701 - DNA, 21 bp, Homo sapiens
ctacccccttgtctgctgctc

SEQ ID NO: 204702 - DNA, 15 bp, Homo sapiens
ctacccctgtcctgg

SEQ ID NO: 204703 - DNA, 13 bp, Homo sapiens
ctacccgagccca

SEQ ID NO: 204704 - DNA, 18 bp, Homo sapiens
ctaccctacacctctggg

SEQ ID NO: 204705 - DNA, 22 bp, Homo sapiens
ctaccctacacctctgggccct

SEQ ID NO: 204706 - DNA, 15 bp, Homo sapiens
ctaccctcaaagtag

SEQ ID NO: 204707 - DNA, 12 bp, Homo sapiens
ctaccctcccac

SEQ ID NO: 204708 - DNA, 14 bp, Homo sapiens
ctaccctcccaccc

SEQ ID NO: 204709 - DNA, 16 bp, Homo sapiens
ctaccctcccaccccc

SEQ ID NO: 204710 - DNA, 22 bp, Homo sapiens
ctaccctcttctcagctccact

SEQ ID NO: 204711 - DNA, 18 bp, Homo sapiens
ctacccttgccaaggccg

SEQ ID NO: 204712 - DNA, 19 bp, Homo sapiens
ctaccctttcccaaaccct

SEQ ID NO: 204713 - DNA, 12 bp, Homo sapiens
ctaccgccctgg

SEQ ID NO: 204714 - DNA, 17 bp, Homo sapiens
ctaccgccctgggctgg

SEQ ID NO: 204715 - DNA, 21 bp, Homo sapiens
ctaccgccctgggctggactg

SEQ ID NO: 204716 - DNA, 17 bp, Homo sapiens
ctacctataaatggact

SEQ ID NO: 204717 - DNA, 22 bp, Homo sapiens
ctacctataaatggacttgctt

SEQ ID NO: 204718 - DNA, 20 bp, Homo sapiens
ctacctatagaaatgtattt

SEQ ID NO: 204719 - DNA, 23 bp, Homo sapiens
ctacctatgcttctagaaagccc

SEQ ID NO: 204720 - DNA, 13 bp, Homo sapiens
ctacctcagcctc

SEQ ID NO: 204721 - DNA, 13 bp, Homo sapiens
ctacctcaggcag

SEQ ID NO: 204722 - DNA, 20 bp, Homo sapiens
ctacctcaggcaggaagggc

SEQ ID NO: 204723 - DNA, 24 bp, Homo sapiens
ctacctctaacaccacactgacca

SEQ ID NO: 204724 - DNA, 19 bp, Homo sapiens
ctacctcttccaggaagca

SEQ ID NO: 204725 - DNA, 23 bp, Homo sapiens
ctacctcttccaggaagcacagg

SEQ ID NO: 204726 - DNA, 17 bp, Homo sapiens
ctacctcttttgagact

SEQ ID NO: 204727 - DNA, 16 bp, Homo sapiens
ctacctgatcccactc

SEQ ID NO: 204728 - DNA, 17 bp, Homo sapiens
ctacctgatcccactcc

SEQ ID NO: 204729 - DNA, 21 bp, Homo sapiens
ctacctggtcaacccgctgct

SEQ ID NO: 204730 - DNA, 23 bp, Homo sapiens
ctacctggtcaacccgctgcttc

SEQ ID NO: 204731 - DNA, 20 bp, Homo sapiens
ctacctgttcagtgtcccgg

SEQ ID NO: 204732 - DNA, 22 bp, Homo sapiens
ctacctgttcagtgtcccgggc

SEQ ID NO: 204733 - DNA, 23 bp, Homo sapiens
ctacctttatatttggggtcctt

SEQ ID NO: 204734 - DNA, 20 bp, Homo sapiens
ctacctttggcttaattcca

SEQ ID NO: 204735 - DNA, 14 bp, Homo sapiens
ctacctttttttct

SEQ ID NO: 204736 - DNA, 19 bp, Homo sapiens
ctacctttttttctctcct

SEQ ID NO: 204737 - DNA, 21 bp, Homo sapiens
ggccagctcccccttgcccgc

SEQ ID NO: 204738 - DNA, 19 bp, Homo sapiens
ggccagctccttttctgtg

SEQ ID NO: 204739 - DNA, 21 bp, Homo sapiens
ggccagcttcgtgctggagga

SEQ ID NO: 204740 - DNA, 15 bp, Homo sapiens
ggccaggagctcttc

SEQ ID NO: 204741 - DNA, 20 bp, Homo sapiens
ggccaggatttggttgttta

SEQ ID NO: 204742 - DNA, 14 bp, Homo sapiens
ggccaggcactgcc

SEQ ID NO: 204743 - DNA, 22 bp, Homo sapiens
ggccaggcagatctgtgcccca

SEQ ID NO: 204744 - DNA, 23 bp, Homo sapiens
ggccaggcatggcccagcctgga

SEQ ID NO: 204745 - DNA, 16 bp, Homo sapiens
ggccaggccatggcca

SEQ ID NO: 204746 - DNA, 23 bp, Homo sapiens
ggccagggcccctcaccctgcct

SEQ ID NO: 204747 - DNA, 15 bp, Homo sapiens
ggccagggctctggc

SEQ ID NO: 204748 - DNA, 21 bp, Homo sapiens
ggccagggtagacttggagct

SEQ ID NO: 204749 - DNA, 14 bp, Homo sapiens
ggccaggtgcacag

SEQ ID NO: 204750 - DNA, 19 bp, Homo sapiens
ggccaggtggccactccag

SEQ ID NO: 204751 - DNA, 14 bp, Homo sapiens
ggccagtaaaagta

SEQ ID NO: 204752 - DNA, 18 bp, Homo sapiens
ggccagtcctgcctggcc

SEQ ID NO: 204753 - DNA, 21 bp, Homo sapiens
ggccagtcctgcctggccagg

SEQ ID NO: 204754 - DNA, 22 bp, Homo sapiens
ggccagtcctgcctggccaggc

SEQ ID NO: 204755 - DNA, 18 bp, Homo sapiens
ggccagtctgaacctgag

SEQ ID NO: 204756 - DNA, 16 bp, Homo sapiens
ggccagtggacagagg

SEQ ID NO: 204757 - DNA, 14 bp, Homo sapiens
ggccagtggctggg

SEQ ID NO: 204758 - DNA, 21 bp, Homo sapiens
ggccagtgtcattttattttt

SEQ ID NO: 204759 - DNA, 13 bp, Homo sapiens
ggccataccaggt

SEQ ID NO: 204760 - DNA, 16 bp, Homo sapiens
ggccatcccaaggtct

SEQ ID NO: 204761 - DNA, 22 bp, Homo sapiens
ggccatccggcccccagagcgc

SEQ ID NO: 204762 - DNA, 15 bp, Homo sapiens
ggccatctgtaaata

SEQ ID NO: 204763 - DNA, 18 bp, Homo sapiens
ggccatgctcaacccccc

SEQ ID NO: 204764 - DNA, 22 bp, Homo sapiens
ggccatgctcaacccccctccc

SEQ ID NO: 204765 - DNA, 22 bp, Homo sapiens
ggccatggctttcatcctgtgt

SEQ ID NO: 204766 - DNA, 17 bp, Homo sapiens
ggccatgggggcccctc

SEQ ID NO: 204767 - DNA, 14 bp, Homo sapiens
ggccatgtgagcca

SEQ ID NO: 204768 - DNA, 23 bp, Homo sapiens
ggccatgtgagccaccgctgcca

SEQ ID NO: 204769 - DNA, 18 bp, Homo sapiens
ggcccaagcatgccccac

SEQ ID NO: 204770 - DNA, 22 bp, Homo sapiens
ggcccaagcatgccccacccac

SEQ ID NO: 204771 - DNA, 22 bp, Homo sapiens
ggcccacattgcccacacctgc

SEQ ID NO: 204772 - DNA, 20 bp, Homo sapiens
ggcccaccagggactgcagc

SEQ ID NO: 204773 - DNA, 21 bp, Homo sapiens
ggcccaccagggactgcagct

SEQ ID NO: 204774 - DNA, 16 bp, Homo sapiens
ggcccacgcagagccc

SEQ ID NO: 204775 - DNA, 12 bp, Homo sapiens
ggcccagaactg

SEQ ID NO: 204776 - DNA, 18 bp, Homo sapiens
ggcccagaactgccccca

SEQ ID NO: 204777 - DNA, 22 bp, Homo sapiens
ggcccagaggagctgggagccg

SEQ ID NO: 204778 - DNA, 16 bp, Homo sapiens
ggcccagaggcacagc

SEQ ID NO: 204779 - DNA, 18 bp, Homo sapiens
ggcccagcagcggcccag

SEQ ID NO: 204780 - DNA, 12 bp, Homo sapiens
ggcccagcagct

SEQ ID NO: 204781 - DNA, 11 bp, Homo sapiens
ggcccagccag

SEQ ID NO: 204782 - DNA, 14 bp, Homo sapiens
ggcccagccagcag

SEQ ID NO: 204783 - DNA, 18 bp, Homo sapiens
ggcccagccatgggccct

SEQ ID NO: 204784 - DNA, 16 bp, Homo sapiens
ggcccagcctggcccc

SEQ ID NO: 204785 - DNA, 18 bp, Homo sapiens
ggcccagcctggccccaa

SEQ ID NO: 204786 - DNA, 18 bp, Homo sapiens
ggcccagcggcccctccc

SEQ ID NO: 204787 - DNA, 15 bp, Homo sapiens
ggcccagctgggctc

SEQ ID NO: 204788 - DNA, 20 bp, Homo sapiens
ggcccagctgtagccatggc

SEQ ID NO: 204789 - DNA, 20 bp, Homo sapiens
ggcccaggcagcacctggag

SEQ ID NO: 204790 - DNA, 21 bp, Homo sapiens
ggcccaggcagcacctggagc

SEQ ID NO: 204791 - DNA, 12 bp, Homo sapiens
ggcccaggcctg

SEQ ID NO: 204792 - DNA, 13 bp, Homo sapiens
ggcccaggggctt

SEQ ID NO: 204793 - DNA, 20 bp, Homo sapiens
ggcccagtccactggggagt

SEQ ID NO: 204794 - DNA, 21 bp, Homo sapiens
ggcccataatagttagccctc

SEQ ID NO: 204795 - DNA, 24 bp, Homo sapiens
ggcccatatctgtgaaatgctggc

SEQ ID NO: 204796 - DNA, 19 bp, Homo sapiens
ggcccatcactcggctgtg

SEQ ID NO: 204797 - DNA, 13 bp, Homo sapiens
ggcccatctcagg

SEQ ID NO: 204798 - DNA, 21 bp, Homo sapiens
ggcccatctcaggtgccactc

SEQ ID NO: 204799 - DNA, 14 bp, Homo sapiens
ggcccatgccctcc

SEQ ID NO: 204800 - DNA, 19 bp, Homo sapiens
ggcccatggccccagctgg

SEQ ID NO: 204801 - DNA, 21 bp, Homo sapiens
ggcccatggccccagctggct

SEQ ID NO: 204802 - DNA, 17 bp, Homo sapiens
ggcccatgggcagaaga

SEQ ID NO: 204803 - DNA, 21 bp, Homo sapiens
ggccccaaaaccacagccctg

SEQ ID NO: 204804 - DNA, 19 bp, Homo sapiens
ggccccacccaccctctgg

SEQ ID NO: 204805 - DNA, 22 bp, Homo sapiens
ggccccacccaccctctggtcc

SEQ ID NO: 204806 - DNA, 21 bp, Homo sapiens
ggccccacctacttgtgactg

SEQ ID NO: 204807 - DNA, 20 bp, Homo sapiens
ggccccagaccccagggcag

SEQ ID NO: 204808 - DNA, 11 bp, Homo sapiens
ggccccagaga

SEQ ID NO: 204809 - DNA, 20 bp, Homo sapiens
ggccccagatctgcctgggc

SEQ ID NO: 204810 - DNA, 22 bp, Homo sapiens
ggccccagatctgcctgggcct

SEQ ID NO: 204811 - DNA, 13 bp, Homo sapiens
ggccccagccaag

SEQ ID NO: 204812 - DNA, 13 bp, Homo sapiens
ggccccagccgtg

SEQ ID NO: 204813 - DNA, 18 bp, Homo sapiens
ggccccagctggctgggt

SEQ ID NO: 204814 - DNA, 14 bp, Homo sapiens
ggccccatgctctg

SEQ ID NO: 204815 - DNA, 18 bp, Homo sapiens
ggccccatgctctgcccc

SEQ ID NO: 204816 - DNA, 19 bp, Homo sapiens
ggccccatgctctgcccca

SEQ ID NO: 204817 - DNA, 21 bp, Homo sapiens
ggccccatgctctgccccaag

SEQ ID NO: 204818 - DNA, 22 bp, Homo sapiens
ggccccattcagaactctcaga

SEQ ID NO: 204819 - DNA, 15 bp, Homo sapiens
ggcccccagagcgcc

SEQ ID NO: 204820 - DNA, 17 bp, Homo sapiens
ggcccccagagcgcccc

SEQ ID NO: 204821 - DNA, 19 bp, Homo sapiens
ggcccccagagcgcccctc

SEQ ID NO: 204822 - DNA, 23 bp, Homo sapiens
ggccccccagctcaggggcagct

SEQ ID NO: 204823 - DNA, 12 bp, Homo sapiens
ggcccccctcca

SEQ ID NO: 204824 - DNA, 16 bp, Homo sapiens
ggcccccctccaggca

SEQ ID NO: 204825 - DNA, 18 bp, Homo sapiens
ggcccccctccaggcatg

SEQ ID NO: 204826 - DNA, 23 bp, Homo sapiens
ggcccccctccaggcatgctggc

SEQ ID NO: 204827 - DNA, 17 bp, Homo sapiens
ggcccccgccctctgcc

SEQ ID NO: 204828 - DNA, 14 bp, Homo sapiens
ggccccgcgcgtgc

SEQ ID NO: 204829 - DNA, 19 bp, Homo sapiens
ggccccgggctctggccac

SEQ ID NO: 204830 - DNA, 22 bp, Homo sapiens
ggccccgggctctggccaccct

SEQ ID NO: 204831 - DNA, 23 bp, Homo sapiens
ggccccgggctctggccaccctg

SEQ ID NO: 204832 - DNA, 13 bp, Homo sapiens
ggccccggggctg

SEQ ID NO: 204833 - DNA, 14 bp, Homo sapiens
ggccccggggctgg

SEQ ID NO: 204834 - DNA, 21 bp, Homo sapiens
ggcccctcagagccctgccct

SEQ ID NO: 204835 - DNA, 20 bp, Homo sapiens
ggcccctccagaccctgcct

SEQ ID NO: 204836 - DNA, 16 bp, Homo sapiens
ggcccctcccacatcc

SEQ ID NO: 204837 - DNA, 12 bp, Homo sapiens
ggcccctcccca

SEQ ID NO: 204838 - DNA, 17 bp, Homo sapiens
ggcccctccctacctca

SEQ ID NO: 204839 - DNA, 19 bp, Homo sapiens
ggcccctccctctgcccca

SEQ ID NO: 204840 - DNA, 19 bp, Homo sapiens
ggcccctcctctgtgctcc

SEQ ID NO: 204841 - DNA, 21 bp, Homo sapiens
ggcccctcggcattcacacac

SEQ ID NO: 204842 - DNA, 11 bp, Homo sapiens
ggcccctctct

SEQ ID NO: 204843 - DNA, 15 bp, Homo sapiens
ggcccctctgcccag

SEQ ID NO: 204844 - DNA, 16 bp, Homo sapiens
ggcccctctgcccagc

SEQ ID NO: 204845 - DNA, 17 bp, Homo sapiens
ggcccctctgctgtcct

SEQ ID NO: 204846 - DNA, 23 bp, Homo sapiens
ggcccctctgttctggtggcccc

SEQ ID NO: 204847 - DNA, 22 bp, Homo sapiens
ggcccctggcacgtcctccacc

SEQ ID NO: 204848 - DNA, 14 bp, Homo sapiens
ggcccctggcccag

SEQ ID NO: 204849 - DNA, 21 bp, Homo sapiens
ggccccttcacttctgaccac

SEQ ID NO: 204850 - DNA, 19 bp, Homo sapiens
ggcccctttttactcccct

SEQ ID NO: 204851 - DNA, 15 bp, Homo sapiens
ggcccgacagcctgg

SEQ ID NO: 204852 - DNA, 17 bp, Homo sapiens
ggcccgacagcctggca

SEQ ID NO: 204853 - DNA, 21 bp, Homo sapiens
ggcccgcccctcgctgctgct

SEQ ID NO: 204854 - DNA, 16 bp, Homo sapiens
ggcccgccgtgcctgc

SEQ ID NO: 204855 - DNA, 15 bp, Homo sapiens
ggcccgcctggcaga

SEQ ID NO: 204856 - DNA, 19 bp, Homo sapiens
ggcccgcctggcagaactg

SEQ ID NO: 204857 - DNA, 14 bp, Homo sapiens
ggcccggcccacgc

SEQ ID NO: 204858 - DNA, 15 bp, Homo sapiens
ggcccgggaggagga

SEQ ID NO: 204859 - DNA, 15 bp, Homo sapiens
ggcccgggcaggcca

SEQ ID NO: 204860 - DNA, 18 bp, Homo sapiens
ggcccgtgcgcagccgcg

SEQ ID NO: 204861 - DNA, 20 bp, Homo sapiens
ggcccgttgaggatgaggcc

SEQ ID NO: 204862 - DNA, 22 bp, Homo sapiens
ggcccgttgaggatgaggccgc

SEQ ID NO: 204863 - DNA, 16 bp, Homo sapiens
ggccctaccagcgccc

SEQ ID NO: 204864 - DNA, 14 bp, Homo sapiens
ggccctaggcatac

SEQ ID NO: 204865 - DNA, 21 bp, Homo sapiens
ggccctaggggtcactgtact

SEQ ID NO: 204866 - DNA, 13 bp, Homo sapiens
ggccctcagagga

SEQ ID NO: 204867 - DNA, 13 bp, Homo sapiens
ggccctcctgctg

SEQ ID NO: 204868 - DNA, 18 bp, Homo sapiens
ggccctcctgctggctga

SEQ ID NO: 204869 - DNA, 22 bp, Homo sapiens
ggccctcctgctggctgaggct

SEQ ID NO: 204870 - DNA, 17 bp, Homo sapiens
aaaaagaaattctgtta

SEQ ID NO: 204871 - DNA, 14 bp, Homo sapiens
aaaaagacttcaaa

SEQ ID NO: 204872 - DNA, 13 bp, Homo sapiens
aaaaagagagagc

SEQ ID NO: 204873 - DNA, 12 bp, Homo sapiens
aaaaagaggcta

SEQ ID NO: 204874 - DNA, 19 bp, Homo sapiens
aaaaagagtcttaattttc

SEQ ID NO: 204875 - DNA, 14 bp, Homo sapiens
aaaaagatcccaaa

SEQ ID NO: 204876 - DNA, 23 bp, Homo sapiens
aaaaagattttcagaaaatatta

SEQ ID NO: 204877 - DNA, 17 bp, Homo sapiens
aaaaagcaactttccaa

SEQ ID NO: 204878 - DNA, 13 bp, Homo sapiens
aaaaagcacagct

SEQ ID NO: 204879 - DNA, 21 bp, Homo sapiens
aaaaagcagacagaagtcact

SEQ ID NO: 204880 - DNA, 13 bp, Homo sapiens
aaaaagcagctac

SEQ ID NO: 204881 - DNA, 15 bp, Homo sapiens
aaaaagcctaagaaa

SEQ ID NO: 204882 - DNA, 18 bp, Homo sapiens
aaaaagctcatattttgt

SEQ ID NO: 204883 - DNA, 19 bp, Homo sapiens
aaaaagctcatattttgta

SEQ ID NO: 204884 - DNA, 11 bp, Homo sapiens
aaaaaggaaaa

SEQ ID NO: 204885 - DNA, 14 bp, Homo sapiens
aaaaaggagctctt

SEQ ID NO: 204886 - DNA, 16 bp, Homo sapiens
aaaaaggcaagccaca

SEQ ID NO: 204887 - DNA, 13 bp, Homo sapiens
aaaaaggcctttg

SEQ ID NO: 204888 - DNA, 16 bp, Homo sapiens
aaaaagtcaattcatc

SEQ ID NO: 204889 - DNA, 13 bp, Homo sapiens
aaaaagtgacaca

SEQ ID NO: 204890 - DNA, 13 bp, Homo sapiens
aaaaagtggctaa

SEQ ID NO: 204891 - DNA, 22 bp, Homo sapiens
aaaaagtgggttttttagttga

SEQ ID NO: 204892 - DNA, 20 bp, Homo sapiens
aaaaagttaaaaaaaataat

SEQ ID NO: 204893 - DNA, 14 bp, Homo sapiens
aaaaagtttccata

SEQ ID NO: 204894 - DNA, 16 bp, Homo sapiens
aaaaataaaaatggaa

SEQ ID NO: 204895 - DNA, 12 bp, Homo sapiens
aaaaataaaagt

SEQ ID NO: 204896 - DNA, 15 bp, Homo sapiens
aaaaataaaatgatg

SEQ ID NO: 204897 - DNA, 17 bp, Homo sapiens
aaaaataaaatgcattt

SEQ ID NO: 204898 - DNA, 16 bp, Homo sapiens
aaaaataataataatg

SEQ ID NO: 204899 - DNA, 18 bp, Homo sapiens
aaaaatagctataaatag

SEQ ID NO: 204900 - DNA, 16 bp, Homo sapiens
aaaaatagttttacat

SEQ ID NO: 204901 - DNA, 17 bp, Homo sapiens
aaaaatagttttacatt

SEQ ID NO: 204902 - DNA, 11 bp, Homo sapiens
aaaaatataaa

SEQ ID NO: 204903 - DNA, 12 bp, Homo sapiens
aaaaatataaag

SEQ ID NO: 204904 - DNA, 14 bp, Homo sapiens
aaaaatatcaaaaa

SEQ ID NO: 204905 - DNA, 20 bp, Homo sapiens
aaaaatatcaaaaaggagct

SEQ ID NO: 204906 - DNA, 16 bp, Homo sapiens
aaaaatatcaggagct

SEQ ID NO: 204907 - DNA, 20 bp, Homo sapiens
aaaaatatggaacttctaat

SEQ ID NO: 204908 - DNA, 18 bp, Homo sapiens
aaaaatcaaaaaattatc

SEQ ID NO: 204909 - DNA, 16 bp, Homo sapiens
aaaaatcagtgtttaa

SEQ ID NO: 204910 - DNA, 21 bp, Homo sapiens
aaaaatgcacgtagctgaggc

SEQ ID NO: 204911 - DNA, 20 bp, Homo sapiens
aaaaatgggagacagcctct

SEQ ID NO: 204912 - DNA, 16 bp, Homo sapiens
aaaaatgtaaaacaca

SEQ ID NO: 204913 - DNA, 17 bp, Homo sapiens
aaaaatgtgagctataa

SEQ ID NO: 204914 - DNA, 13 bp, Homo sapiens
aaaaatgttcatt

SEQ ID NO: 204915 - DNA, 22 bp, Homo sapiens
aaaaatgttttatggtagcttt

SEQ ID NO: 204916 - DNA, 19 bp, Homo sapiens
aaaaattaaaagaaggaat

SEQ ID NO: 204917 - DNA, 17 bp, Homo sapiens
aaaaattaaaccaagca

SEQ ID NO: 204918 - DNA, 22 bp, Homo sapiens
aaaaattatctatttgtatata

SEQ ID NO: 204919 - DNA, 21 bp, Homo sapiens
aaaaattatttgccttttaaa

SEQ ID NO: 204920 - DNA, 18 bp, Homo sapiens
aaaaatttaagcattgtt

SEQ ID NO: 204921 - DNA, 12 bp, Homo sapiens
aaaaatttgaac

SEQ ID NO: 204922 - DNA, 18 bp, Homo sapiens
aaaacaaaaaaatttaaa

SEQ ID NO: 204923 - DNA, 14 bp, Homo sapiens
aaaacaaaaaacaa

SEQ ID NO: 204924 - DNA, 17 bp, Homo sapiens
aaaacaaaaccaagcct

SEQ ID NO: 204925 - DNA, 14 bp, Homo sapiens
aaaacaaaatcctt

SEQ ID NO: 204926 - DNA, 12 bp, Homo sapiens
aaaacaaatctc

SEQ ID NO: 204927 - DNA, 15 bp, Homo sapiens
aaaacaacagcaaca

SEQ ID NO: 204928 - DNA, 13 bp, Homo sapiens
aaaacaagaaaga

SEQ ID NO: 204929 - DNA, 14 bp, Homo sapiens
aaaacaagaaagaa

SEQ ID NO: 204930 - DNA, 16 bp, Homo sapiens
aaaacaatcacactca

SEQ ID NO: 204931 - DNA, 13 bp, Homo sapiens
aaaacaatctgta

SEQ ID NO: 204932 - DNA, 21 bp, Homo sapiens
aaaacacacgctcctctgccc

SEQ ID NO: 204933 - DNA, 16 bp, Homo sapiens
aaaacacctaagtgac

SEQ ID NO: 204934 - DNA, 14 bp, Homo sapiens
aaaacactagtttt

SEQ ID NO: 204935 - DNA, 23 bp, Homo sapiens
aaaacacttattttacacagcaa

SEQ ID NO: 204936 - DNA, 16 bp, Homo sapiens
aaaacagaacatttct

SEQ ID NO: 204937 - DNA, 15 bp, Homo sapiens
aaaacagaatattga

SEQ ID NO: 204938 - DNA, 19 bp, Homo sapiens
aaaacagaggatgctgaag

SEQ ID NO: 204939 - DNA, 19 bp, Homo sapiens
aaaacagatgagaagacta

SEQ ID NO: 204940 - DNA, 17 bp, Homo sapiens
aaaacagtgaatcttat

SEQ ID NO: 204941 - DNA, 14 bp, Homo sapiens
aaaacataagacga

SEQ ID NO: 204942 - DNA, 21 bp, Homo sapiens
aaaacataatagaatttccta

SEQ ID NO: 204943 - DNA, 19 bp, Homo sapiens
aaaacatggcaataaatgg

SEQ ID NO: 204944 - DNA, 20 bp, Homo sapiens
aaaacatggcaataaatggc

SEQ ID NO: 204945 - DNA, 12 bp, Homo sapiens
aaaacatgtcat

SEQ ID NO: 204946 - DNA, 15 bp, Homo sapiens
aaaacattagaagaa

SEQ ID NO: 204947 - DNA, 21 bp, Homo sapiens
aaaacattagaagaaaacata

SEQ ID NO: 204948 - DNA, 15 bp, Homo sapiens
aaaacatttcaaagc

SEQ ID NO: 204949 - DNA, 13 bp, Homo sapiens
aaaacatttgtac

SEQ ID NO: 204950 - DNA, 15 bp, Homo sapiens
aaaacatttgtacat

SEQ ID NO: 204951 - DNA, 21 bp, Homo sapiens
aaaacatttgtacattcctga

SEQ ID NO: 204952 - DNA, 17 bp, Homo sapiens
aaaaccattctgcttgg

SEQ ID NO: 204953 - DNA, 13 bp, Homo sapiens
aaaaccattgctt

SEQ ID NO: 204954 - DNA, 16 bp, Homo sapiens
aaaaccattgcttcac

SEQ ID NO: 204955 - DNA, 18 bp, Homo sapiens
aaaaccggcaacctgtaa

SEQ ID NO: 204956 - DNA, 20 bp, Homo sapiens
aaaaccggcaacctgtaact

SEQ ID NO: 204957 - DNA, 14 bp, Homo sapiens
aaaacctttattct

SEQ ID NO: 204958 - DNA, 20 bp, Homo sapiens
aaaacctttcaaatttcaca

SEQ ID NO: 204959 - DNA, 16 bp, Homo sapiens
aaaacgatttaattta

SEQ ID NO: 204960 - DNA, 13 bp, Homo sapiens
aaaacgcatggag

SEQ ID NO: 204961 - DNA, 18 bp, Homo sapiens
aaaacgcatggagtgtgt

SEQ ID NO: 204962 - DNA, 13 bp, Homo sapiens
aaaacgcctcttt

SEQ ID NO: 204963 - DNA, 23 bp, Homo sapiens
aaaacgcctcttttccctctcta

SEQ ID NO: 204964 - DNA, 18 bp, Homo sapiens
aaaacgggttactaagat

SEQ ID NO: 204965 - DNA, 21 bp, Homo sapiens
aaaacgggttactaagatgaa

SEQ ID NO: 204966 - DNA, 16 bp, Homo sapiens
aaaacggttaaaactg

SEQ ID NO: 204967 - DNA, 18 bp, Homo sapiens
aaaacggttaaaactgtc

SEQ ID NO: 204968 - DNA, 19 bp, Homo sapiens
aaaacgttttattgtgttt

SEQ ID NO: 204969 - DNA, 23 bp, Homo sapiens
aaaacgttttgtttgaaaaagca

SEQ ID NO: 204970 - DNA, 18 bp, Homo sapiens
aaaactaaatctctaata

SEQ ID NO: 204971 - DNA, 13 bp, Homo sapiens
aaaactaatgtga

SEQ ID NO: 204972 - DNA, 18 bp, Homo sapiens
aaaactaggcatttgtaa

SEQ ID NO: 204973 - DNA, 21 bp, Homo sapiens
aaaactaggcatttgtaaata

SEQ ID NO: 204974 - DNA, 17 bp, Homo sapiens
aaaactatccaattaaa

SEQ ID NO: 204975 - DNA, 13 bp, Homo sapiens
aaaactcaccatt

SEQ ID NO: 204976 - DNA, 15 bp, Homo sapiens
aaaactcaccatttc

SEQ ID NO: 204977 - DNA, 13 bp, Homo sapiens
aaaactcaggatt

SEQ ID NO: 204978 - DNA, 16 bp, Homo sapiens
aaaactcccatttacg

SEQ ID NO: 204979 - DNA, 11 bp, Homo sapiens
aaaactgcctg

SEQ ID NO: 204980 - DNA, 12 bp, Homo sapiens
aaaactgctttt

SEQ ID NO: 204981 - DNA, 10 bp, Homo sapiens
aaaactgtga

SEQ ID NO: 204982 - DNA, 15 bp, Homo sapiens
aaaactgtgacattc

SEQ ID NO: 204983 - DNA, 17 bp, Homo sapiens
aaaactgtgacattcca

SEQ ID NO: 204984 - DNA, 16 bp, Homo sapiens
aaaacttaaaagtatt

SEQ ID NO: 204985 - DNA, 15 bp, Homo sapiens
aaaacttatttgagt

SEQ ID NO: 204986 - DNA, 15 bp, Homo sapiens
aaaacttctcttctg

SEQ ID NO: 204987 - DNA, 12 bp, Homo sapiens
aaaactttattt

SEQ ID NO: 204988 - DNA, 13 bp, Homo sapiens
aaaactttatttt

SEQ ID NO: 204989 - DNA, 19 bp, Homo sapiens
aaaactttattttatataa

SEQ ID NO: 204990 - DNA, 20 bp, Homo sapiens
aaaactttattttatataat

SEQ ID NO: 204991 - DNA, 22 bp, Homo sapiens
aaaactttccatgacagtagca

SEQ ID NO: 204992 - DNA, 15 bp, Homo sapiens
aaaacttttataaat

SEQ ID NO: 204993 - DNA, 14 bp, Homo sapiens
aaaagaaacacaag

SEQ ID NO: 204994 - DNA, 21 bp, Homo sapiens
aaaagaagaaagtctatgctt

SEQ ID NO: 204995 - DNA, 15 bp, Homo sapiens
aaaagaagactggaa

SEQ ID NO: 204996 - DNA, 11 bp, Homo sapiens
aaaagaaggaa

SEQ ID NO: 204997 - DNA, 14 bp, Homo sapiens
aaaagaatgtacat

SEQ ID NO: 204998 - DNA, 13 bp, Homo sapiens
aaaagacacttca

SEQ ID NO: 204999 - DNA, 19 bp, Homo sapiens
aaaagaccctgagactcca

SEQ ID NO: 205000 - DNA, 15 bp, Homo sapiens
aaaagactgaccttg

SEQ ID NO: 205001 - DNA, 16 bp, Homo sapiens
aaaagagaaaaaccaa

SEQ ID NO: 205002 - DNA, 14 bp, Homo sapiens
aaaagagagagcag

SEQ ID NO: 205003 - DNA, 21 bp, Homo sapiens
aaaagagccaagttcaaagaa

SEQ ID NO: 205004 - DNA, 15 bp, Homo sapiens
aaaagaggagcactt

SEQ ID NO: 205005 - DNA, 12 bp, Homo sapiens
aaaagagggggg

SEQ ID NO: 205006 - DNA, 12 bp, Homo sapiens
aaaagagtatgt

SEQ ID NO: 205007 - DNA, 13 bp, Homo sapiens
ggccctctgagca

SEQ ID NO: 205008 - DNA, 14 bp, Homo sapiens
ggccctctgtagct

SEQ ID NO: 205009 - DNA, 16 bp, Homo sapiens
ggccctctgtccacat

SEQ ID NO: 205010 - DNA, 15 bp, Homo sapiens
ggccctgcaagggcg

SEQ ID NO: 205011 - DNA, 22 bp, Homo sapiens
ggccctgcaatgtatcccttct

SEQ ID NO: 205012 - DNA, 13 bp, Homo sapiens
ggccctgcaggag

SEQ ID NO: 205013 - DNA, 14 bp, Homo sapiens
ggccctgcaggagg

SEQ ID NO: 205014 - DNA, 18 bp, Homo sapiens
ggccctgcaggaggcctg

SEQ ID NO: 205015 - DNA, 21 bp, Homo sapiens
ggccctgcaggaggcctggga

SEQ ID NO: 205016 - DNA, 14 bp, Homo sapiens
ggccctgccctgag

SEQ ID NO: 205017 - DNA, 18 bp, Homo sapiens
ggccctgccctgaggaag

SEQ ID NO: 205018 - DNA, 19 bp, Homo sapiens
ggccctgccctgaggaagg

SEQ ID NO: 205019 - DNA, 16 bp, Homo sapiens
ggccctgctcaggcct

SEQ ID NO: 205020 - DNA, 24 bp, Homo sapiens
ggccctgctcaggcctcacctggc

SEQ ID NO: 205021 - DNA, 15 bp, Homo sapiens
ggccctggaactcta

SEQ ID NO: 205022 - DNA, 11 bp, Homo sapiens
ggccctgggga

SEQ ID NO: 205023 - DNA, 18 bp, Homo sapiens
ggccctggggtccccact

SEQ ID NO: 205024 - DNA, 20 bp, Homo sapiens
ggccctggggtccccactcc

SEQ ID NO: 205025 - DNA, 16 bp, Homo sapiens
ggccctggggtctctg

SEQ ID NO: 205026 - DNA, 19 bp, Homo sapiens
ggccctggggtctctgagc

SEQ ID NO: 205027 - DNA, 15 bp, Homo sapiens
ggccctggtggagag

SEQ ID NO: 205028 - DNA, 22 bp, Homo sapiens
ggccctggttcccccaggaccc

SEQ ID NO: 205029 - DNA, 15 bp, Homo sapiens
ggccctgtcagagcc

SEQ ID NO: 205030 - DNA, 21 bp, Homo sapiens
ggccctgtcagagccgccact

SEQ ID NO: 205031 - DNA, 13 bp, Homo sapiens
ggccctgtgccct

SEQ ID NO: 205032 - DNA, 12 bp, Homo sapiens
ggccctgtggga

SEQ ID NO: 205033 - DNA, 18 bp, Homo sapiens
ggcccttcagtccctgag

SEQ ID NO: 205034 - DNA, 17 bp, Homo sapiens
ggcccttcctctccact

SEQ ID NO: 205035 - DNA, 12 bp, Homo sapiens
ggcccttgccca

SEQ ID NO: 205036 - DNA, 15 bp, Homo sapiens
ggcccttgcccaact

SEQ ID NO: 205037 - DNA, 14 bp, Homo sapiens
ggcccttgggacag

SEQ ID NO: 205038 - DNA, 17 bp, Homo sapiens
ggcccttgggacagcca

SEQ ID NO: 205039 - DNA, 15 bp, Homo sapiens
ggcccttggggcctg

SEQ ID NO: 205040 - DNA, 18 bp, Homo sapiens
ggcccttggggcctggct

SEQ ID NO: 205041 - DNA, 19 bp, Homo sapiens
ggcccttggggcctggctt

SEQ ID NO: 205042 - DNA, 20 bp, Homo sapiens
ggcccttgtcctgccagctg

SEQ ID NO: 205043 - DNA, 21 bp, Homo sapiens
ggcccttgtcctgccagctgc

SEQ ID NO: 205044 - DNA, 23 bp, Homo sapiens
ggcccttgtcctgccagctgcct

SEQ ID NO: 205045 - DNA, 18 bp, Homo sapiens
ggcccttttctggctcct

SEQ ID NO: 205046 - DNA, 20 bp, Homo sapiens
ggcccttttctggctcctgt

SEQ ID NO: 205047 - DNA, 21 bp, Homo sapiens
ggccgaatcccctccctgtca

SEQ ID NO: 205048 - DNA, 13 bp, Homo sapiens
ggccgaggcaggg

SEQ ID NO: 205049 - DNA, 17 bp, Homo sapiens
ggccgaggcaggggctg

SEQ ID NO: 205050 - DNA, 23 bp, Homo sapiens
ggccgaggcaggggctgggcaga

SEQ ID NO: 205051 - DNA, 14 bp, Homo sapiens
ggccgagggaaatg

SEQ ID NO: 205052 - DNA, 21 bp, Homo sapiens
ggccgagggcttccctagatg

SEQ ID NO: 205053 - DNA, 17 bp, Homo sapiens
ggccgaggggccagggt

SEQ ID NO: 205054 - DNA, 16 bp, Homo sapiens
ggccgcagggcgctcc

SEQ ID NO: 205055 - DNA, 17 bp, Homo sapiens
ggccgcagggcgctccg

SEQ ID NO: 205056 - DNA, 18 bp, Homo sapiens
ggccgcagggcgctccgg

SEQ ID NO: 205057 - DNA, 21 bp, Homo sapiens
ggccgcatgtctgcatggcag

SEQ ID NO: 205058 - DNA, 15 bp, Homo sapiens
ggccgcccacctgca

SEQ ID NO: 205059 - DNA, 16 bp, Homo sapiens
ggccgcccacctgcat

SEQ ID NO: 205060 - DNA, 21 bp, Homo sapiens
ggccgcccacctgcatcagcc

SEQ ID NO: 205061 - DNA, 17 bp, Homo sapiens
ggccgccccgccccaga

SEQ ID NO: 205062 - DNA, 21 bp, Homo sapiens
ggccgccccgccccagagctc

SEQ ID NO: 205063 - DNA, 17 bp, Homo sapiens
ggccgcccgggcccaga

SEQ ID NO: 205064 - DNA, 19 bp, Homo sapiens
ggccgcctcctccagactc

SEQ ID NO: 205065 - DNA, 15 bp, Homo sapiens
ggccgcctgtccttg

SEQ ID NO: 205066 - DNA, 20 bp, Homo sapiens
ggccgctagaggcctgagga

SEQ ID NO: 205067 - DNA, 23 bp, Homo sapiens
ggccgctgggagaaaagccagat

SEQ ID NO: 205068 - DNA, 14 bp, Homo sapiens
ggccggcagcctgg

SEQ ID NO: 205069 - DNA, 13 bp, Homo sapiens
ggccggccagcct

SEQ ID NO: 205070 - DNA, 16 bp, Homo sapiens
ggccggccccaggctc

SEQ ID NO: 205071 - DNA, 17 bp, Homo sapiens
ggccggccccaggctcc

SEQ ID NO: 205072 - DNA, 12 bp, Homo sapiens
ggccggctggcc

SEQ ID NO: 205073 - DNA, 19 bp, Homo sapiens
ggccgggggtgggggcctg

SEQ ID NO: 205074 - DNA, 18 bp, Homo sapiens
ggccgggttggaggcctc

SEQ ID NO: 205075 - DNA, 23 bp, Homo sapiens
ggccggtccaccccgtcccggcc

SEQ ID NO: 205076 - DNA, 22 bp, Homo sapiens
ggccgtcctcccgggccctccc

SEQ ID NO: 205077 - DNA, 18 bp, Homo sapiens
ggccgtctcctccctcag

SEQ ID NO: 205078 - DNA, 22 bp, Homo sapiens
ggccgtgcccgcccacctctgc

SEQ ID NO: 205079 - DNA, 16 bp, Homo sapiens
ggccgtggctgcccac

SEQ ID NO: 205080 - DNA, 16 bp, Homo sapiens
ggccgttccccttggc

SEQ ID NO: 205081 - DNA, 19 bp, Homo sapiens
ggcctaagagttgagctct

SEQ ID NO: 205082 - DNA, 14 bp, Homo sapiens
ggcctaaggctgct

SEQ ID NO: 205083 - DNA, 18 bp, Homo sapiens
ggcctagcccaccctgct

SEQ ID NO: 205084 - DNA, 19 bp, Homo sapiens
ggcctagtcagatggatgt

SEQ ID NO: 205085 - DNA, 21 bp, Homo sapiens
ggcctagtggcttcagcccct

SEQ ID NO: 205086 - DNA, 22 bp, Homo sapiens
ggcctagtggcttcagcccctg

SEQ ID NO: 205087 - DNA, 23 bp, Homo sapiens
ggcctagtggcttcagcccctgg

SEQ ID NO: 205088 - DNA, 16 bp, Homo sapiens
ggcctcaaccctccct

SEQ ID NO: 205089 - DNA, 17 bp, Homo sapiens
ggcctcaaccctccctc

SEQ ID NO: 205090 - DNA, 18 bp, Homo sapiens
ggcctcaagccatcttcc

SEQ ID NO: 205091 - DNA, 14 bp, Homo sapiens
ggcctcaagttcaa

SEQ ID NO: 205092 - DNA, 14 bp, Homo sapiens
ggcctcacccagaa

SEQ ID NO: 205093 - DNA, 12 bp, Homo sapiens
ggcctcaccctg

SEQ ID NO: 205094 - DNA, 15 bp, Homo sapiens
ggcctcacctggctt

SEQ ID NO: 205095 - DNA, 22 bp, Homo sapiens
ggcctcacctggcttcccagga

SEQ ID NO: 205096 - DNA, 23 bp, Homo sapiens
ggcctcacctggcttcccaggac

SEQ ID NO: 205097 - DNA, 18 bp, Homo sapiens
ggcctcactccaggaagg

SEQ ID NO: 205098 - DNA, 10 bp, Homo sapiens
ggcctcagaa

SEQ ID NO: 205099 - DNA, 12 bp, Homo sapiens
ggcctcagacca

SEQ ID NO: 205100 - DNA, 23 bp, Homo sapiens
ggcctcagaccaactctctcctg

SEQ ID NO: 205101 - DNA, 13 bp, Homo sapiens
ggcctcaggaggc

SEQ ID NO: 205102 - DNA, 17 bp, Homo sapiens
ggcctcaggtttgcctg

SEQ ID NO: 205103 - DNA, 18 bp, Homo sapiens
ggcctcagtgtcctcatc

SEQ ID NO: 205104 - DNA, 15 bp, Homo sapiens
ggcctcatccctcgg

SEQ ID NO: 205105 - DNA, 12 bp, Homo sapiens
ggcctccactcc

SEQ ID NO: 205106 - DNA, 14 bp, Homo sapiens
ggcctccactcccc

SEQ ID NO: 205107 - DNA, 16 bp, Homo sapiens
ggcctccactccccca

SEQ ID NO: 205108 - DNA, 22 bp, Homo sapiens
ggcctccactcccccacctgac

SEQ ID NO: 205109 - DNA, 18 bp, Homo sapiens
ggcctccagcctctcccg

SEQ ID NO: 205110 - DNA, 13 bp, Homo sapiens
ggcctccaggctg

SEQ ID NO: 205111 - DNA, 18 bp, Homo sapiens
ggcctcccaataaagctg

SEQ ID NO: 205112 - DNA, 19 bp, Homo sapiens
ggcctcccaataaagctgg

SEQ ID NO: 205113 - DNA, 12 bp, Homo sapiens
ggcctcccagcc

SEQ ID NO: 205114 - DNA, 16 bp, Homo sapiens
ggcctcccccagccag

SEQ ID NO: 205115 - DNA, 23 bp, Homo sapiens
ggcctccccgggggtccccggac

SEQ ID NO: 205116 - DNA, 15 bp, Homo sapiens
ggcctccctctctct

SEQ ID NO: 205117 - DNA, 23 bp, Homo sapiens
ggcctccctctctcttctgctcc

SEQ ID NO: 205118 - DNA, 14 bp, Homo sapiens
ggcctccggcctcc

SEQ ID NO: 205119 - DNA, 16 bp, Homo sapiens
ggcctccggcctcccc

SEQ ID NO: 205120 - DNA, 15 bp, Homo sapiens
ggcctccgtgaccca

SEQ ID NO: 205121 - DNA, 15 bp, Homo sapiens
ggcctcctctaacag

SEQ ID NO: 205122 - DNA, 19 bp, Homo sapiens
ggcctccttgtccaggtct

SEQ ID NO: 205123 - DNA, 13 bp, Homo sapiens
ggcctcggcagaa

SEQ ID NO: 205124 - DNA, 16 bp, Homo sapiens
ggcctcgggacctcag

SEQ ID NO: 205125 - DNA, 20 bp, Homo sapiens
ggcctctgcctccaggaggg

SEQ ID NO: 205126 - DNA, 12 bp, Homo sapiens
ggcctctgtgcc

SEQ ID NO: 205127 - DNA, 16 bp, Homo sapiens
ggcctcttcctccctc

SEQ ID NO: 205128 - DNA, 13 bp, Homo sapiens
ggcctcttgagca

SEQ ID NO: 205129 - DNA, 15 bp, Homo sapiens
ggcctcttgctggtg

SEQ ID NO: 205130 - DNA, 16 bp, Homo sapiens
ggcctcttgctggtgc

SEQ ID NO: 205131 - DNA, 17 bp, Homo sapiens
ggcctcttgctggtgca

SEQ ID NO: 205132 - DNA, 18 bp, Homo sapiens
ggcctcttgctggtgcac

SEQ ID NO: 205133 - DNA, 17 bp, Homo sapiens
ggcctgaaatgtttcca

SEQ ID NO: 205134 - DNA, 16 bp, Homo sapiens
ggcctgacctggcaca

SEQ ID NO: 205135 - DNA, 16 bp, Homo sapiens
ggcctgagctggggcc

SEQ ID NO: 205136 - DNA, 18 bp, Homo sapiens
ggcctgaggatgagctgg

SEQ ID NO: 205137 - DNA, 15 bp, Homo sapiens
ggcctgagggaagcc

SEQ ID NO: 205138 - DNA, 21 bp, Homo sapiens
ggcctgagggaagcccacccg

SEQ ID NO: 205139 - DNA, 14 bp, Homo sapiens
ggcctgatgctccc

SEQ ID NO: 205140 - DNA, 23 bp, Homo sapiens
ggcctgatgctccctcccctgcc

SEQ ID NO: 205141 - DNA, 14 bp, Homo sapiens
ctagcaactgttgg

SEQ ID NO: 205142 - DNA, 17 bp, Homo sapiens
ctagcaagaagattcta

SEQ ID NO: 205143 - DNA, 22 bp, Homo sapiens
ctagcaagaagattctaaaaca

SEQ ID NO: 205144 - DNA, 17 bp, Homo sapiens
ctagcacatcatggcag

SEQ ID NO: 205145 - DNA, 21 bp, Homo sapiens
ctagcacatcatggcagtggg

SEQ ID NO: 205146 - DNA, 15 bp, Homo sapiens
ctagcactcacatgc

SEQ ID NO: 205147 - DNA, 15 bp, Homo sapiens
ctagcattttcttga

SEQ ID NO: 205148 - DNA, 18 bp, Homo sapiens
ctagcattttcttgaacc

SEQ ID NO: 205149 - DNA, 22 bp, Homo sapiens
aaaagatggatttgacacactc

SEQ ID NO: 205150 - DNA, 18 bp, Homo sapiens
aaaagattaaaattagtg

SEQ ID NO: 205151 - DNA, 17 bp, Homo sapiens
aaaagcaacatcagctt

SEQ ID NO: 205152 - DNA, 16 bp, Homo sapiens
aaaagcaactccatca

SEQ ID NO: 205153 - DNA, 14 bp, Homo sapiens
aaaagcacaaaccc

SEQ ID NO: 205154 - DNA, 13 bp, Homo sapiens
aaaagcacaagca

SEQ ID NO: 205155 - DNA, 23 bp, Homo sapiens
aaaagcagacgcagcagctggga

SEQ ID NO: 205156 - DNA, 23 bp, Homo sapiens
aaaagcaggcttgtgctttatac

SEQ ID NO: 205157 - DNA, 19 bp, Homo sapiens
aaaagcatactctatgtga

SEQ ID NO: 205158 - DNA, 17 bp, Homo sapiens
aaaagccactagactct

SEQ ID NO: 205159 - DNA, 21 bp, Homo sapiens
aaaagcctcaactagtcattt

SEQ ID NO: 205160 - DNA, 19 bp, Homo sapiens
aaaagcctgcaatttcata

SEQ ID NO: 205161 - DNA, 14 bp, Homo sapiens
aaaagctcatattt

SEQ ID NO: 205162 - DNA, 18 bp, Homo sapiens
aaaagctcatattttgta

SEQ ID NO: 205163 - DNA, 19 bp, Homo sapiens
aaaagctttaaaaaataaa

SEQ ID NO: 205164 - DNA, 21 bp, Homo sapiens
aaaagctttaaaaaataaagc

SEQ ID NO: 205165 - DNA, 13 bp, Homo sapiens
aaaaggaagacta

SEQ ID NO: 205166 - DNA, 16 bp, Homo sapiens
aaaaggacacctttta

SEQ ID NO: 205167 - DNA, 14 bp, Homo sapiens
aaaaggactcttga

SEQ ID NO: 205168 - DNA, 17 bp, Homo sapiens
aaaagggaaaaaagcaa

SEQ ID NO: 205169 - DNA, 15 bp, Homo sapiens
aaaagggaacaggaa

SEQ ID NO: 205170 - DNA, 20 bp, Homo sapiens
aaaagggaagttgtgccttt

SEQ ID NO: 205171 - DNA, 11 bp, Homo sapiens
aaaaggggcat

SEQ ID NO: 205172 - DNA, 23 bp, Homo sapiens
aaaagggggctattccctggaga

SEQ ID NO: 205173 - DNA, 18 bp, Homo sapiens
aaaaggtattttgaatac

SEQ ID NO: 205174 - DNA, 21 bp, Homo sapiens
aaaaggtattttgaataccat

SEQ ID NO: 205175 - DNA, 18 bp, Homo sapiens
aaaaggtgattaaatatt

SEQ ID NO: 205176 - DNA, 13 bp, Homo sapiens
aaaagtacatagt

SEQ ID NO: 205177 - DNA, 13 bp, Homo sapiens
aaaagtacattta

SEQ ID NO: 205178 - DNA, 23 bp, Homo sapiens
aaaagtcttcaagggctgcttca

SEQ ID NO: 205179 - DNA, 14 bp, Homo sapiens
aaaagtgacacagc

SEQ ID NO: 205180 - DNA, 22 bp, Homo sapiens
aaaagtgagatgggaagggctt

SEQ ID NO: 205181 - DNA, 23 bp, Homo sapiens
aaaagtgatcaataaaatgtgat

SEQ ID NO: 205182 - DNA, 21 bp, Homo sapiens
aaaagtgatgtgatttatgca

SEQ ID NO: 205183 - DNA, 19 bp, Homo sapiens
aaaagtggcaagaccaaaa

SEQ ID NO: 205184 - DNA, 21 bp, Homo sapiens
aaaagtggctaattcaattta

SEQ ID NO: 205185 - DNA, 14 bp, Homo sapiens
aaaagtgtcctata

SEQ ID NO: 205186 - DNA, 13 bp, Homo sapiens
aaaagtgtttatt

SEQ ID NO: 205187 - DNA, 18 bp, Homo sapiens
aaaagttaaaaaaaataa

SEQ ID NO: 205188 - DNA, 14 bp, Homo sapiens
aaaagttaacatta

SEQ ID NO: 205189 - DNA, 12 bp, Homo sapiens
aaaagttaagct

SEQ ID NO: 205190 - DNA, 16 bp, Homo sapiens
aaaagttgcacattag

SEQ ID NO: 205191 - DNA, 20 bp, Homo sapiens
aaaagtttcacgtcttggtg

SEQ ID NO: 205192 - DNA, 13 bp, Homo sapiens
aaaataaaactaa

SEQ ID NO: 205193 - DNA, 13 bp, Homo sapiens
aaaataaaataag

SEQ ID NO: 205194 - DNA, 18 bp, Homo sapiens
aaaataaacgaaacattt

SEQ ID NO: 205195 - DNA, 12 bp, Homo sapiens
aaaataaatata

SEQ ID NO: 205196 - DNA, 14 bp, Homo sapiens
aaaataaatatact

SEQ ID NO: 205197 - DNA, 15 bp, Homo sapiens
aaaataaatatacta

SEQ ID NO: 205198 - DNA, 14 bp, Homo sapiens
aaaataacacacat

SEQ ID NO: 205199 - DNA, 17 bp, Homo sapiens
aaaataacatctgaaaa

SEQ ID NO: 205200 - DNA, 21 bp, Homo sapiens
aaaataacatctgaaaagaaa

SEQ ID NO: 205201 - DNA, 16 bp, Homo sapiens
aaaataacttcaagca

SEQ ID NO: 205202 - DNA, 14 bp, Homo sapiens
aaaataagtaaagt

SEQ ID NO: 205203 - DNA, 20 bp, Homo sapiens
aaaataagtaacatataaat

SEQ ID NO: 205204 - DNA, 12 bp, Homo sapiens
aaaataataaat

SEQ ID NO: 205205 - DNA, 15 bp, Homo sapiens
aaaataataatagta

SEQ ID NO: 205206 - DNA, 22 bp, Homo sapiens
aaaataataatttttatattta

SEQ ID NO: 205207 - DNA, 15 bp, Homo sapiens
aaaataatataaatg

SEQ ID NO: 205208 - DNA, 18 bp, Homo sapiens
aaaataatctggtgttct

SEQ ID NO: 205209 - DNA, 14 bp, Homo sapiens
aaaataattttatg

SEQ ID NO: 205210 - DNA, 18 bp, Homo sapiens
aaaataattttatgaact

SEQ ID NO: 205211 - DNA, 14 bp, Homo sapiens
aaaatacaataaac

SEQ ID NO: 205212 - DNA, 15 bp, Homo sapiens
aaaatacaataaact

SEQ ID NO: 205213 - DNA, 15 bp, Homo sapiens
aaaatacagtattct

SEQ ID NO: 205214 - DNA, 13 bp, Homo sapiens
aaaataccaagga

SEQ ID NO: 205215 - DNA, 15 bp, Homo sapiens
aaaatactctagcct

SEQ ID NO: 205216 - DNA, 13 bp, Homo sapiens
aaaatagcttgta

SEQ ID NO: 205217 - DNA, 18 bp, Homo sapiens
aaaatagtaagcctccct

SEQ ID NO: 205218 - DNA, 17 bp, Homo sapiens
aaaatagttctatttct

SEQ ID NO: 205219 - DNA, 22 bp, Homo sapiens
aaaatataaattaagactttaa

SEQ ID NO: 205220 - DNA, 11 bp, Homo sapiens
aaaatatatgt

SEQ ID NO: 205221 - DNA, 17 bp, Homo sapiens
aaaatatattaaaaata

SEQ ID NO: 205222 - DNA, 22 bp, Homo sapiens
aaaatatattaaaaatataaac

SEQ ID NO: 205223 - DNA, 17 bp, Homo sapiens
aaaatatcactttgtat

SEQ ID NO: 205224 - DNA, 20 bp, Homo sapiens
aaaatatcactttgtattct

SEQ ID NO: 205225 - DNA, 18 bp, Homo sapiens
aaaatatccctttttcac

SEQ ID NO: 205226 - DNA, 21 bp, Homo sapiens
aaaatattatctttgtaatta

SEQ ID NO: 205227 - DNA, 14 bp, Homo sapiens
aaaatattctccat

SEQ ID NO: 205228 - DNA, 17 bp, Homo sapiens
aaaatatttctaagctt

SEQ ID NO: 205229 - DNA, 21 bp, Homo sapiens
aaaatatttctaagcttattt

SEQ ID NO: 205230 - DNA, 23 bp, Homo sapiens
aaaatatttctaagcttatttct

SEQ ID NO: 205231 - DNA, 20 bp, Homo sapiens
aaaatattttgttgccttca

SEQ ID NO: 205232 - DNA, 15 bp, Homo sapiens
aaaatcaacttgtgt

SEQ ID NO: 205233 - DNA, 16 bp, Homo sapiens
aaaatcaacttgtgta

SEQ ID NO: 205234 - DNA, 16 bp, Homo sapiens
aaaatcaacttttgaa

SEQ ID NO: 205235 - DNA, 17 bp, Homo sapiens
aaaatcatgcttataag

SEQ ID NO: 205236 - DNA, 12 bp, Homo sapiens
aaaatcattgat

SEQ ID NO: 205237 - DNA, 16 bp, Homo sapiens
aaaatccatttaatca

SEQ ID NO: 205238 - DNA, 22 bp, Homo sapiens
aaaatctaaaacaaaatctgaa

SEQ ID NO: 205239 - DNA, 23 bp, Homo sapiens
aaaatctaatattaaaaatatgg

SEQ ID NO: 205240 - DNA, 22 bp, Homo sapiens
aaaatctagatcaattaattct

SEQ ID NO: 205241 - DNA, 12 bp, Homo sapiens
aaaatctagttt

SEQ ID NO: 205242 - DNA, 14 bp, Homo sapiens
aaaatctagttttt

SEQ ID NO: 205243 - DNA, 16 bp, Homo sapiens
aaaatctattttgtct

SEQ ID NO: 205244 - DNA, 16 bp, Homo sapiens
aaaatctctctctgtt

SEQ ID NO: 205245 - DNA, 22 bp, Homo sapiens
aaaatctgccctcagatgaaaa

SEQ ID NO: 205246 - DNA, 21 bp, Homo sapiens
aaaatctggggaggacaaagg

SEQ ID NO: 205247 - DNA, 13 bp, Homo sapiens
aaaatctgtggca

SEQ ID NO: 205248 - DNA, 19 bp, Homo sapiens
aaaatctgtttgatccctg

SEQ ID NO: 205249 - DNA, 21 bp, Homo sapiens
aaaatcttcactgaatatcat

SEQ ID NO: 205250 - DNA, 12 bp, Homo sapiens
aaaatcttcagc

SEQ ID NO: 205251 - DNA, 19 bp, Homo sapiens
aaaatcttcagctggtgga

SEQ ID NO: 205252 - DNA, 11 bp, Homo sapiens
aaaatcttgtc

SEQ ID NO: 205253 - DNA, 12 bp, Homo sapiens
aaaatcttgtca

SEQ ID NO: 205254 - DNA, 22 bp, Homo sapiens
aaaatctttcagaatacaattc

SEQ ID NO: 205255 - DNA, 12 bp, Homo sapiens
aaaatgaagatt

SEQ ID NO: 205256 - DNA, 18 bp, Homo sapiens
aaaatgaaggaattacat

SEQ ID NO: 205257 - DNA, 17 bp, Homo sapiens
aaaatgagaatctgtgc
